United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 91

SEQ ID NO: 4117299 - RNA, 69 nt, Human
guuccauuaugcuuaggaaaauaugaaaaacgagcuaaguguuucagcaauuuuuuaagcuaauugaau

SEQ ID NO: 4117300 - RNA, 65 nt, Human
guuccauuugcuaagcccugggccuaggcugcaccuacccagagcugggcuuggcaaacugugac

SEQ ID NO: 4117301 - RNA, 76 nt, Human
guucccaaauuaccuuguuuguguuuugugggauaacauucaucacacagaauaauucacauggcucuuuggguac

SEQ ID NO: 4117302 - RNA, 66 nt, Human
guucccacaucuguucuuaguucugaguugccaggaaucugcagugggaggauaggaugugagggc

SEQ ID NO: 4117303 - RNA, 56 nt, Human
guucccaccccugagcuccgaugcucaucacaucgggaguuuuucuggaugggggc

SEQ ID NO: 4117304 - RNA, 82 nt, Human
guucccacuuuauagauauaaaacugaagcuuagggaaaucaaacaagcagcccaaguuuacagauguaguagggguggaac

SEQ ID NO: 4117305 - RNA, 68 nt, Human
guucccagaugugggccgcggccuuuccucuuucuggaggaaugacaggccucccgcagaggaggagc

SEQ ID NO: 4117306 - RNA, 129 nt, Human
guucccaucugguagucaggccuuucacgaguagcccaggaaggaagcagggguuucacaaccauuacugagaauucacuugucuuccauuuuacucuccuccuguaagggugaugugcuggauccaac

SEQ ID NO: 4117307 - RNA, 62 nt, Human
guuccccaggacugugauagcucuucggcuauaccuucagcagcuauuucagauuugagagc

SEQ ID NO: 4117308 - RNA, 62 nt, Human
guucccccuuaaaguuuauccaguguugaaaaaauacacaauccuugaacuuuagguggagc

SEQ ID NO: 4117309 - RNA, 90 nt, Human
guuccccuuccuguguccauguguucucauuguucaauucccaccuaugagugagaacuaaucaugcauggaguuuauagcacuuugaau

SEQ ID NO: 4117310 - RNA, 90 nt, Human
guucccucucucagucccugggaagaccggcagugggguaggacgccaaucuccccagcugcucuuccaggcuccccugccagaggaggc

SEQ ID NO: 4117311 - RNA, 77 nt, Human
guucccugaaagcuuguaagaaaaauauuuuaaaaucuauuuucaaugaaaaauauuguuuuuggcucucagggaau

SEQ ID NO: 4117312 - RNA, 91 nt, Human
guucccuggcacacaugaccugagcuuucuaccagguccugucuccaaggggagaaggaaccuguguugagauaugggccagcuaggugac

SEQ ID NO: 4117313 - RNA, 70 nt, Human
guucccugggucuccggcagccucgggccucucggaagccgcuugccagaagaccggggagucagggagc

SEQ ID NO: 4117314 - RNA, 65 nt, Human
guucccuucucaugggguccagcauguccuaucauuguggagcugggcucugaguggaagggggc

SEQ ID NO: 4117315 - RNA, 117 nt, Human
guucccuugcuugauaccccacuccaauuuuaucucaggagguuccucugucccaggauguuggguagaagaagauuccugaguuuaguuugaugguuagcaccaacaaccaggaac

SEQ ID NO: 4117316 - RNA, 80 nt, Human
guuccgacuauccaccaggcuccauguucaguguuggaaaugcaagacugaaaaagacaucuugguaagguaguaggagc

SEQ ID NO: 4117317 - RNA, 62 nt, Human
guuccgugcagaggacaagcaaucacagcuccaucuguuaagcuucuguaucuagcaggaac

SEQ ID NO: 4117318 - RNA, 80 nt, Human
guuccuagaguugccccucuuguacuagacaguuuugcuaaaccacagacugcggauagauaggcggggguguggggaac

SEQ ID NO: 4117319 - RNA, 55 nt, Human
guuccuaucugcuauccaaggcauaucaaggugucuagaaagccaaauuaggaau

SEQ ID NO: 4117320 - RNA, 78 nt, Human
guuccucacuauagguuuugccuacucuuagauucaaacaagaaaucugaauguaagacuuuaagaaccuaaaggagc

SEQ ID NO: 4117321 - RNA, 79 nt, Human
guuccucaguugaaauaguuacuguauucucauuaucuacaacaguagcaacaauggaaguaacuucaggcucaggaac

SEQ ID NO: 4117322 - RNA, 88 nt, Human
guuccucaguuugcagcugcugagcugcucccgcugcagcgacaggcucugcgugcugcggcgcaggcacuccaggcucugcaggaac

SEQ ID NO: 4117323 - RNA, 68 nt, Human
guuccucgaagaagccuccuaugagugccuggaugaggucaggcuucuugggcuucauucugagcagc

SEQ ID NO: 4117324 - RNA, 62 nt, Human
guuccugaugcauuacaaaagugauuauugaugauaaugauuauugaugagagcaccaggac

SEQ ID NO: 4117325 - RNA, 57 nt, Human
guuccuggggggauagauuucaccugauagcccaggcacaucccuauacuuaggagc

SEQ ID NO: 4117326 - RNA, 68 nt, Human
uauggucaaagauaugaagcccucaaguccagauaaacaugaaggccauggcuaaugucuuugaaaua

SEQ ID NO: 4117327 - RNA, 63 nt, Human
uauguaacauacguauguaugugcauguguacauuugcacauguauauuucuguaugugcaua

SEQ ID NO: 4117328 - RNA, 55 nt, Human
uauguaaggagccacagugggggcaacuucugucuuuucaaugguucuuuaugug

SEQ ID NO: 4117329 - RNA, 60 nt, Human
uauguaagugagaucauggaguauuuguuuuuccgugccugacuuauuucacuuagcaua

SEQ ID NO: 4117330 - RNA, 55 nt, Human
uauguacaccaaggauugaaaagguucacaucuuuccaaucaaaagugcugcaug

SEQ ID NO: 4117331 - RNA, 68 nt, Human
uauguacauuuugagguuaaaacaaccaugcaguuauggugguuuuguuuauucugaaccuguaugua

SEQ ID NO: 4117332 - RNA, 63 nt, Human
uauguaccauguuuugugcuuaauuucaaagcuaauguaacuacuaggcacagagcauacaua

SEQ ID NO: 4117333 - RNA, 56 nt, Human
uauguacuguuucugugguggucuuagaugauacagccaagaacaagacagacaug

SEQ ID NO: 4117334 - RNA, 79 nt, Human
uauguacuucuguguuuuuuucuccuuuaaauaugauauaguguaugaaugggaaaaggaaacgaaguuaagaaacaug

SEQ ID NO: 4117335 - RNA, 101 nt, Human
uauguaugcaagcuuacaggugccacaugugugcugaggacuguggguaacucauguagcagccacauauguauacugcaaugugacauguuugaugcaua

SEQ ID NO: 4117336 - RNA, 56 nt, Human
uaugucagagugcuugggagggcggaaugucucccuccccaccagacucuaacaua

SEQ ID NO: 4117337 - RNA, 57 nt, Human
uauguccugcuacucucucaugcugcauuuuugcucuugggaaauguccaggacaua

SEQ ID NO: 4117338 - RNA, 81 nt, Human
uaugugacagcuggccgggaaggacuggugccugcauauggagagugcacuugugacaguuccuggcauagaauaagcaua

SEQ ID NO: 4117339 - RNA, 56 nt, Human
uaugugcuaagugucugguauaugccccauguaucuaccagagcucucaguaugug

SEQ ID NO: 4117340 - RNA, 62 nt, Human
uaugugcuguagcuuacuguuauuccauuuuguacaguuaaucaaauggcauauggcgcaua

SEQ ID NO: 4117341 - RNA, 89 nt, Human
uauguggaacugcagauacuguuggcagcagaccagaauuuauaguuaauucuguuuggccuugcacgucaucuagucaguuguauaug

SEQ ID NO: 4117342 - RNA, 67 nt, Human
uauguggccuuauuauguacaaaaugaauaagccaucauuuccaguacuaucauaaggagcuacgug

SEQ ID NO: 4117343 - RNA, 61 nt, Human
uauguggcucauuguuugcuuacggagacugaugucauaggguaagcucuauggguacaua

SEQ ID NO: 4117344 - RNA, 75 nt, Human
uaugugguguacaugugucuguauaucuuuggagaggcuuacaugauuauggagaaauauguacaggcuuacaua

SEQ ID NO: 4117345 - RNA, 82 nt, Human
uauguguaagaauuauauuuugcaauuguguugguauaaaaacuaauauguuaaugugauauaaaguauuuucuuugacgua

SEQ ID NO: 4117346 - RNA, 71 nt, Human
uauguguauauguguguguguguauuauauagauaauguugaugaaauaaauacccacacauacacacaug

SEQ ID NO: 4117347 - RNA, 60 nt, Human
uaugugugcauuagcauucuagggagucauuuaauugacccuagaggagaguuuaccaua

SEQ ID NO: 4117348 - RNA, 58 nt, Human
uaugugugccccuuuuacucuuugcuuuacguaaucuagaauuuuagggguauaucua

SEQ ID NO: 4117349 - RNA, 88 nt, Human
uaugugugugugcugagcaggagaauaugggcuacugucuuuuaaaacagagucauaguuuaacuuuuguuauacacacacacacaua

SEQ ID NO: 4117350 - RNA, 55 nt, Human
uauguguguguguguguguuugugcauauauacagauauacacccauaucacaua

SEQ ID NO: 4117351 - RNA, 80 nt, Human
uauguguuuaacaugcaaugucugaaaauccagggaauauuuugucuuggauuuccagcuucauugucuaaaaacacaua

SEQ ID NO: 4117352 - RNA, 61 nt, Human
uauguuaagugggauaaucaaauauuuuuauuucugugucugguuuauuucacucagcaua

SEQ ID NO: 4117353 - RNA, 61 nt, Human
uauguuaccaucuuuuaucuacaucuuuaauaaggugggacacauuaaaguuggugacaua

SEQ ID NO: 4117354 - RNA, 56 nt, Human
uauguuagagucugguggggagggagacauuccgcccucccaagcacucugacaua

SEQ ID NO: 4117355 - RNA, 76 nt, Human
uauguucacaagaugucuguggcuucagguggggauuaaacaaaaauaacugccuuagucacaggccuggaacaug

SEQ ID NO: 4117356 - RNA, 68 nt, Human
uauguucuaaccuugucuuucccuucagccauucuaccaauauggggcaacuuaggaguuagagcaug

SEQ ID NO: 4117357 - RNA, 69 nt, Human
uauguugccuuuugacuguuuaugaauggauagcugcuccagaacauaaaucucuuaagacucaacaug

SEQ ID NO: 4117358 - RNA, 87 nt, Human
uauguuggaagugucuaucaguuugagugcugugucaaagaacucacacuggcuuuucaacagcucucaaaugaucacucuuuuaua

SEQ ID NO: 4117359 - RNA, 129 nt, Human
uauguuuuguaagauuuuauuucauucaacauucaaccaacauuuaugaaucaccucuaugggacaggugcugugugaaauuuuggugguguauagaugaauaaaaauggugccuugucuucaauaaua

SEQ ID NO: 4117360 - RNA, 69 nt, Human
uauuaacauuuuccaaagcaucugagugugcaugugugugcaugcacauguggcuuuauguauauaaua

SEQ ID NO: 4117361 - RNA, 97 nt, Human
uauuaaccacaguuagaauuuaagauagcacgucuagauauauuugggcuuauaaaguauauuguaggugcuauuugaacuucauauauguuuaaua

SEQ ID NO: 4117362 - RNA, 84 nt, Human
uauuaaggucacacguggagauucugggcaauuacagauagugccuucuccucccacagaaaucuccaugucagacauguagua

SEQ ID NO: 4117363 - RNA, 87 nt, Human
uauuaaguuggugcaaaaguuauugcgguuuuugccaguuccaaaaccaauggccaaaacugcaguuaccuuugcaccaaccuaaua

SEQ ID NO: 4117364 - RNA, 88 nt, Human
uauuaauuucugaauacucaguuuauauuuuuagauuguuuugugaauugggaucucugaguauaaagugguuuucagcacauuggug

SEQ ID NO: 4117365 - RNA, 63 nt, Human
uauuacccaggguaggaauuccuguuaaucuuaccuaaguaguuauuucuuuauuggguaaua

SEQ ID NO: 4117366 - RNA, 96 nt, Human
uauuaccggguaccaccaguacagugaaaagaauauuagaauaggcauaaaaauggauucuaauucuucauucaucacuaugugauuuuaguaaua

SEQ ID NO: 4117367 - RNA, 102 nt, Human
uauuacuuuuugguuuaguuuucaaggaacucugucugugggaggaauucuaaguaucauuuacagauggcaguuucuugagcugguuuaaucacgucaaug

SEQ ID NO: 4117368 - RNA, 80 nt, Human
uauuagagacuuaucagcauguggaaaaagggugcuuuucagccguucagaaaacucuucacacaugcugcccucugaua

SEQ ID NO: 4117369 - RNA, 83 nt, Human
uauuagaggggacaguuuuuaauccuuucauggggauaaugaaaauaucuuugacauggauugaaaaccaguguuuguugaug

SEQ ID NO: 4117370 - RNA, 68 nt, Human
uauuagaugggagguucauguacuaggcagacacuccaaaaugucuacuacaaaccuccacacuggug

SEQ ID NO: 4117371 - RNA, 71 nt, Human
uauuagcauagugucugguaacauaguaaagauucaguuauuuuauuauuguuaugaggcuuaugauuaug

SEQ ID NO: 4117372 - RNA, 84 nt, Human
uauuaggugggugcaaaaguaauugugguucuugccauugcucuuaauggcaaaacccacaauuacucuugugccaaccuaaua

SEQ ID NO: 4117373 - RNA, 82 nt, Human
uauuagguuggugcaaaagaaaucaguuuuugccauuacuuucuauggcaaaaacuguaauuacuuuugcaccaaccuaaua

SEQ ID NO: 4117374 - RNA, 84 nt, Human
uauuagguuggugcaaaagucacugcuguuuuugccauugaaaguaauggcuuaaaucacagugacuuuugcaccaacccgaua

SEQ ID NO: 4117375 - RNA, 64 nt, Human
uauuagguuggugcaaaauuaauugugguuuuugccauuaaaaguaauuugcaccaaccuaaua

SEQ ID NO: 4117376 - RNA, 85 nt, Human
uauuagguuggugcaacaguaauuugcgguuuuugccguugaaaguaauggcaaaaacugcaauuacuguugcaccaaccuaaua

SEQ ID NO: 4117377 - RNA, 83 nt, Human
uauuagguuggugccaaaguaauugcuguuuugccauuaaaaauaauugcaaaaacugcaauuacuuuggcaccaaccuaaua

SEQ ID NO: 4117378 - RNA, 84 nt, Human
uauuagguuguugcaaaaguaauugcgguuuuugcuauugaagcuaguggcaaaaaccgcaauuucuuuugcaccaaccuaaua

SEQ ID NO: 4117379 - RNA, 78 nt, Human
uauuagucucuagccuuuuggcaucugugauuguguaaucacuuguccugagaugucacaagguuuauaggauuaaua

SEQ ID NO: 4117380 - RNA, 55 nt, Human
uauuauauguuguugaguguaguugucaaagcaacuagcacgauuccaaguaaua

SEQ ID NO: 4117381 - RNA, 56 nt, Human
uauuaucucuaaauuuaggagaggauaaauguucccuccugggcuaagauauagug

SEQ ID NO: 4117382 - RNA, 82 nt, Human
uauuaugagcagugucccaaucuacuuuucccuccaaauggaaggaauauucucugauugggacuagaugauugcuauagua

SEQ ID NO: 4117383 - RNA, 63 nt, Human
uauuauggaauuuauaaaguguaauuucuaauaggauauugcuagccuaugaguucaguagua

SEQ ID NO: 4117384 - RNA, 63 nt, Human
uauuauggggggaacaucacucagcucacuacaacuucugagacaaaguucccaccucugaug

SEQ ID NO: 4117385 - RNA, 79 nt, Human
uauuauguuaauaguggcagagcaugaguguuaaagaucuauagacucaaauaucagcucugucacuuacuaaccaaug

SEQ ID NO: 4117386 - RNA, 99 nt, Human
uauuauuuuaagaggagagcaacgaggugauacuagaagaauguuuuucugaccauaagugucacuuuuugcauuacgucauucuuucaugaaguagua

SEQ ID NO: 4117387 - RNA, 73 nt, Human
uauucacccacccaccugccgggcucaugcagacccacccaggugcagagucccagcaggugguggcugcaua

SEQ ID NO: 4117388 - RNA, 95 nt, Human
uauucacuguaguccaagagauguaacgaagaacaagacuaauaagauucuuacuuuuucaaaauuacauccucauugggagacacagaugaaug

SEQ ID NO: 4117389 - RNA, 83 nt, Human
uauucagauucuauaucauauuaauaagaauugaaccuugaaaguaacaucuguuauucuauuaaugugauugugugugaaug

SEQ ID NO: 4117390 - RNA, 88 nt, Human
uauucaguuuggaccaaauuaaaaguuggcugcaauuuauucccuugcacuguagcuaaaaucaccuuugguccuuuguaacugagug

SEQ ID NO: 4117391 - RNA, 81 nt, Human
uauucauacuaaauuugucaaugacacuugcuuuagugcacuuaaguucaaggugacguugaaaauuuggagaaguggaua

SEQ ID NO: 4117392 - RNA, 59 nt, Human
uauucaucuuugucuuaggcugaauucucuaaaaccagacccugaggaaaagaugauug

SEQ ID NO: 4117393 - RNA, 67 nt, Human
uauucauguguuggaaaggaacugggauaauuaaaugcuuuccuacauuccuuuccuucauuggaug

SEQ ID NO: 4117394 - RNA, 57 nt, Human
uauuccaccagagaugugaauuguggaaucgaggcaauuuauguuugggguggaaug

SEQ ID NO: 4117395 - RNA, 130 nt, Human
uauucccucuccuagccacacaugccauccucugucggaagugacagaugauauuuuggucuugggauuuccucuuuggagucugucugucacuucugcagucugugaugaaugcauucuuaagagcuua

SEQ ID NO: 4117396 - RNA, 78 nt, Human
uagagugcguauuggcuuauuuccuuagaugauguucucaggaguggaaugaauaacaucugaaaaggcuucacucua

SEQ ID NO: 4117397 - RNA, 74 nt, Human
uagaguuacugucacuccaacugagucgucaaaacccauuuuuaagucuuaugacuuuuaggagcagugcucug

SEQ ID NO: 4117398 - RNA, 74 nt, Human
uagaguuugaggugccuauggaugucaacuuggagagauuauauagauaguuggauuuauaagccuuaagccua

SEQ ID NO: 4117399 - RNA, 87 nt, Human
uagaguuuucaaugcacuuucuuauccaugaucucacugaugcuuaagacaacucagugaaacaggcaggggaaguauauaucucug

SEQ ID NO: 4117400 - RNA, 72 nt, Human
uagauaaacuaagcuuuucaaaaacauguuucugacugugugacaucuuguggagaggcuuuggaagaucug

SEQ ID NO: 4117401 - RNA, 80 nt, Human
uagauaauuuuuuccuacauuuguacaauaagauuauucucauuuauagucuucauguugcuguagggagagaucauuua

SEQ ID NO: 4117402 - RNA, 83 nt, Human
uagauacccagacugguugauugcugaaaguauuuuaugacuaccaaguugggaaauuguaguaaaaccuaucuguggauuug

SEQ ID NO: 4117403 - RNA, 90 nt, Human
uagauagaaugugacauuuuuggucaacuccaaagaaguggcaggauuuucuuuggaauuugcuggaaauauugugguuguuuucuacug

SEQ ID NO: 4117404 - RNA, 68 nt, Human
uagauagaggccaggacacuuaaguaagaaggucuaccuuuccuguuuuaaagucaugguugcaucua

SEQ ID NO: 4117405 - RNA, 56 nt, Human
uagauaggaaauaaggauuugguggggaaugucugccaguauuauuucucuaugua

SEQ ID NO: 4117406 - RNA, 85 nt, Human
uagauauagacaugugguauaaucaggggacuagaucgugcauagaaaugcauguacaaacccuugauugucuauaggucuucua

SEQ ID NO: 4117407 - RNA, 66 nt, Human
uagauauuuaaauaaagagcaguguaguuguucuucagguaggugucugcucuuauuuaacaucug

SEQ ID NO: 4117408 - RNA, 61 nt, Human
uagaucaggaguuggcaggcuauagccccaaggccaaauucugccugccagccugaaucug

SEQ ID NO: 4117409 - RNA, 123 nt, Human
uagaucaggcuagagaugguuaccaugaggcaugcaauuuuugguucucuaucuugguugaagucacuauguagauauuaaaaauggcagugcuuagaguguggcuuugaaucuuaugauuua

SEQ ID NO: 4117410 - RNA, 67 nt, Human
uagaugaggaagccgaagcuuguagagaccaagugggugcuacaggucuucugccuucacucaccug

SEQ ID NO: 4117411 - RNA, 69 nt, Human
uagaugcugauggaugagcugaagugaaaguagcugcuuuaggaucagccuacacuccaacagcaugug

SEQ ID NO: 4117412 - RNA, 120 nt, Human
uagauuccauuuuacuaauuauuucuuaugucaaauuugugcccacauucaaaaggugaugaaggccaaaaccucuaucgcauuuuuuuaugucaacaguaacagauaaaaugugaucua

SEQ ID NO: 4117413 - RNA, 80 nt, Human
uagauucucauaaggagcucacaaccuagaucccucacaugugcaggucacgauaggguucgcacuucugugagaaucua

SEQ ID NO: 4117414 - RNA, 66 nt, Human
uagauucugaggccuugcucaagauuauucugacauaauaacucuucaguagguccucagaaucug

SEQ ID NO: 4117415 - RNA, 59 nt, Human
uagauucuggagagacagcagugaauuagacauaaaaauguguguucuuccagaauuua

SEQ ID NO: 4117416 - RNA, 58 nt, Human
uagauuuccucuuccucauuccuauagacaacauaugugaagaggaaaugggaauuua

SEQ ID NO: 4117417 - RNA, 127 nt, Human
uagauuugaauuggugaaugaauaaauugggucuuggagaaaggaaagggcuugaaugaguucuuucagaauaggccuuuucuuuucucaaaaguaccagcaauagcuucccauuuuuucagaacug

SEQ ID NO: 4117418 - RNA, 87 nt, Human
uagauuugaggggcuguugccgaaccaauguaaagcuuucagagggaaguaugcaggucucugcaaggccuaucaagcagcauucua

SEQ ID NO: 4117419 - RNA, 74 nt, Human
uagauuuuuuggaagcaaauuccagaaccacagaguugacuggucgauaugucucuugaguuuguuuuaaucua

SEQ ID NO: 4117420 - RNA, 83 nt, Human
uagcaaaagcuugcugacacccauucaaugugacugguuuugcaaggauuggaaaacaugcacauuggauucagcugcugcua

SEQ ID NO: 4117421 - RNA, 82 nt, Human
uagcaaagcucucccacuguaugaaggaaagacuagcaaagugaaauaaguuagccuuguaagcagagggucagcuuuucua

SEQ ID NO: 4117422 - RNA, 83 nt, Human
uagcaacuagugcuggcguuuucuuaauguguuuucucuuguaauucugacagcucuaugaaugcuccaguaacuuucagcua

SEQ ID NO: 4117423 - RNA, 58 nt, Human
uagcaacugcucuauucuaggacuggagagcucucccgggcccuggucagaguugcua

SEQ ID NO: 4117424 - RNA, 82 nt, Human
uagcaagcucaaacuaauauggggcuaaacaugaucaauauuuguugaaugaaugguccauauagaagguuaugggaggcug

SEQ ID NO: 4117425 - RNA, 56 nt, Human
uagcaaggcuuccaaugaacagcagaugcaggagcuggaguaggaagugauuguug

SEQ ID NO: 4117426 - RNA, 76 nt, Human
uagcaagucacagcaguuuaggguugacauagcagaguucaaaugucugacuuuucucacuguuguguacuuguug

SEQ ID NO: 4117427 - RNA, 70 nt, Human
uagcaaguggcaccacauuucuaggcauauaaagaaauaauaacaccuagaauuuguaaacaauuugcua

SEQ ID NO: 4117428 - RNA, 60 nt, Human
uagcaauguguugacuuggucaucuauuguaguaaaauuugaccaagugucagguuguua

SEQ ID NO: 4117429 - RNA, 63 nt, Human
uagcacacaguacuauaugcuacagaugaaguacaaugcugucaaauagggguacuuguguua

SEQ ID NO: 4117430 - RNA, 56 nt, Human
uagcacacuaaagauauuaacagucgguaccucuagacugguguaucauugugcug

SEQ ID NO: 4117431 - RNA, 57 nt, Human
uagcacagauuugucaacauagaccuguuacauugucuaucccuaaaucugcugcug

SEQ ID NO: 4117432 - RNA, 69 nt, Human
uagcacagcaauguacccaucugugaguuuuaguagcuuugaaugagugcauugcagacacuguggcua

SEQ ID NO: 4117433 - RNA, 96 nt, Human
uagcacauuuugcuuaaucuagauuuugcgucaacaaauaacuuucaguaacugaggcaaucuugaagcggauuagagcaaauuccuccugugcua

SEQ ID NO: 4117434 - RNA, 71 nt, Human
uagcagaacugcaguuaacaagucuucauggucccagagagaaauugauauuugcugacugcauugugcug

SEQ ID NO: 4117435 - RNA, 68 nt, Human
uagcagagagauucuaaaccaggucugacuuuccaauuucaacaucuguguuugaaucucaaauguua

SEQ ID NO: 4117436 - RNA, 58 nt, Human
uagcagaguaauacuuuggagccagauaucuggauuucauuucuguguuaguuugcua

SEQ ID NO: 4117437 - RNA, 61 nt, Human
uagcagagugugaaggcagggcuuaagucacuagaccagagcucauaucacggcucugcug

SEQ ID NO: 4117438 - RNA, 66 nt, Human
uagcagcaauucaggugugaugcugucauuuuuuaucauggcccugaacucccagaauuguuguug

SEQ ID NO: 4117439 - RNA, 62 nt, Human
uagcaggaggcaguuccucgcuucagucuacauguagcaucuaaggagacuacuucuugcug

SEQ ID NO: 4117440 - RNA, 55 nt, Human
uagcaggcuugugaauggagccuguaaauaucaggcuuuuagacccaagccucug

SEQ ID NO: 4117441 - RNA, 57 nt, Human
uagcagggaagccuccagaaccuuagacaugaaggcacacacuugaggcccuugaua

SEQ ID NO: 4117442 - RNA, 69 nt, Human
uagcaggguuuugaagaggguugcuggggguggcugacucugccaaaauguuuccuuuuucucuugcug

SEQ ID NO: 4117443 - RNA, 82 nt, Human
uagcaguagcuaguuuguaggcuuuugugagaauuacauaauauccauauaauguucuuagcaaaguacuugcuacaugcua

SEQ ID NO: 4117444 - RNA, 101 nt, Human
uagcaguagcugugagaagaugggguccagcaugcccuguaggaaguucccaagccucagggcaggacaguguaggcccuaguucuggcugugugcugcug

SEQ ID NO: 4117445 - RNA, 61 nt, Human
uagcauaaggcuuaaagaauauauauuuucacauggaaaaaaaugugcuugggccaugcua

SEQ ID NO: 4117446 - RNA, 83 nt, Human
uagcauagcucauucugggugcucuguacuaauaaucaaaccacacuaaauugaauuugaagagcaucaugaugcuaagucug

SEQ ID NO: 4117447 - RNA, 65 nt, Human
uagcaugcagugaugcacugcaucaucuuuuguuugugguugcaacaacgugucgcuguacgcug

SEQ ID NO: 4117448 - RNA, 65 nt, Human
uagcaugucuauagccugauuuguuggccucuucugcaaggucaacacuggcuacaguuaugcug

SEQ ID NO: 4117449 - RNA, 76 nt, Human
uagcauuuguggguuguugcugaguacuguugaauauaacauguagcagaaacgacuaaaugguuacaaaugauua

SEQ ID NO: 4117450 - RNA, 57 nt, Human
uagccaaaguagcuguuauagcuauaugcuaugguaaaacacugcagcuuuugguug

SEQ ID NO: 4117451 - RNA, 56 nt, Human
uagccacagagcauuagauuucagaguacacuugaguucuuucuguucugucacua

SEQ ID NO: 4117452 - RNA, 109 nt, Human
uagccacgggaugggggcaugggaagggaggggucucuagcgaggagacugucucuugucuauccugagagccucuucuccccuucuacccaccaugaauccugggcua

SEQ ID NO: 4117453 - RNA, 78 nt, Human
uagccacuuguguccuggagcccccaguucaaaucuuuccauuggacuggaggcuugugggaggcugggagguggcug

SEQ ID NO: 4117454 - RNA, 64 nt, Human
uagccagaagacuaccuucagggucaaacaauaacuuuccccugggucuucagucugcugguua

SEQ ID NO: 4117455 - RNA, 73 nt, Human
uagccaucuuaacaggucucugagggucaauauccuuugacuaucccucuagcuuuguuggucaugauggcua

SEQ ID NO: 4117456 - RNA, 60 nt, Human
uagcccagccacugauuugcaaccagugggcaccugcugcaaguucagaagguugggcug

SEQ ID NO: 4117457 - RNA, 71 nt, Human
uagcccuguagauuuaggagaguuuucagccccuauaggccucacuuuucuucauuuauaaaaugaggcua

SEQ ID NO: 4117458 - RNA, 87 nt, Human
uagcccugucuaauuaagccuggaauguguguaaaaucacuagcauagaguuuugcaaaguacauuaucaggcucugguuugagcua

SEQ ID NO: 4117459 - RNA, 100 nt, Human
uagcccuuccugaauugauccucagagcugaggccagggacagguaagacuacaaggugcuuguguggucccagcuuuggggagcaagcagaagggacug

SEQ ID NO: 4117460 - RNA, 112 nt, Human
uagccggcauguuggcacgugccuauagccccagcuucucagaaagcugaggugggaggaucacuugagccugggagguugaggcugcagugagcugugaucaugccgccug

SEQ ID NO: 4117461 - RNA, 57 nt, Human
uagccucucuccuccacaaccuagagagucucagauuguacugagugggagaggcug

SEQ ID NO: 4117462 - RNA, 60 nt, Human
uagccugggcaugggacgggagggcucauuaaccauccucccuuccuccaucccggccug

SEQ ID NO: 4117463 - RNA, 61 nt, Human
uagccuuucuccaaggccacccaaggagcccagugaaagcuccagcccuggagccaggcua

SEQ ID NO: 4117464 - RNA, 84 nt, Human
uagccuuucuucccaugaucacccgugcacagaugaggaggcugagcuggucugagcauggccgguccauggugggcuaggcug

SEQ ID NO: 4117465 - RNA, 130 nt, Human
uagcgaaaggugacgaggcuguuuucggagagccaggggucccagcggcccgcuuuccugcuagaggagggggcggcgcguagccggagacuucagcgcggcggcuccaaagaucucccuucacuuuuca

SEQ ID NO: 4117466 - RNA, 85 nt, Human
uagcuaugugacauuggaagauuacuuaguuuucucuuuuguaagaugaaaauaguaauaucuaccuuagaguguuauagaguua

SEQ ID NO: 4117467 - RNA, 60 nt, Human
uagcuauguuaaguauaccuguuaagugccaggguacuguacuaauugcuuuacauguua

SEQ ID NO: 4117468 - RNA, 71 nt, Human
uagcuauuuggaaaauuccaauaaaauauuuugacugguaagauaucgcaguggccuuuuugaaauagcua

SEQ ID NO: 4117469 - RNA, 87 nt, Human
uagcucaacugugcacaaguuucuucauuguucauuauucuccauggauagaguagacauuguggaacaugaucucauuacaugcug

SEQ ID NO: 4117470 - RNA, 85 nt, Human
uagcuccaggugaguuugucucuuagcuccuuaagagaggcuuagaucucuuuagggaagcauggaggagaugguauuugagcug

SEQ ID NO: 4117471 - RNA, 56 nt, Human
uagcuccuccccauccagguuccccuaguguugggcagcaaaggaggucaggacua

SEQ ID NO: 4117472 - RNA, 77 nt, Human
uagcucuggauuucaguucaccugggaacccgcuggaagccgaguggacuccaggaggaacgaagugccuugggcua

SEQ ID NO: 4117473 - RNA, 74 nt, Human
uagcugaauauaggcacaacagaaauuucccauuaagcacgggguuuuuguuuguuuguuuguccuuucaguua

SEQ ID NO: 4117474 - RNA, 112 nt, Human
uagcugagcaugguggugcaugccuguagucccagcuacuugggagguugaggcaugagaaucgcuugaacccaggaagcggagauugcagagagcugagaucaugccacua

SEQ ID NO: 4117475 - RNA, 76 nt, Human
uagcugcacugguuucuuuccacucuccacccucauuuccuuggaagguuuuagauauagaagaaacagauagcua

SEQ ID NO: 4117476 - RNA, 69 nt, Human
uagcugccuaugugauaagagagccagggaacaguuaaacgguuaaauauauuuguccuguggcagcug

SEQ ID NO: 4117477 - RNA, 58 nt, Human
uagcuggcuuauauaaaagggcuguggauaaaggcccgggaaguaugggagccaguua

SEQ ID NO: 4117478 - RNA, 93 nt, Human
uagcugggaaaggaugaaacaucuauuuucugugagguaucaaccacaagggaagauacaccuuuuuagaagauuuuauuuugaugccagcua

SEQ ID NO: 4117479 - RNA, 74 nt, Human
uagcugggacagacaacuauguugagaugcacaacgucaaagagaguacugagcauguugugauguuaccacug

SEQ ID NO: 4117480 - RNA, 91 nt, Human
uagcugggguggaguguggguucccaagggggcagggggcacugagagugggaggccucaggccuagggagccacaccaggccacaugcug

SEQ ID NO: 4117481 - RNA, 65 nt, Human
uagcugguucuccaggagcuaggaucagcucagccuggcaccuaguuagcaggaggaaucaguua

SEQ ID NO: 4117482 - RNA, 87 nt, Human
uagcugguuuuacaggugugagccaccaugcccaauuaauuuuuguauuuuuaguagagaugggguuucaccauguuggccagacua

SEQ ID NO: 4117483 - RNA, 60 nt, Human
uagcugucagcugcaggcaggccaccccaucccauagaccuucucacaguaugacagcua

SEQ ID NO: 4117484 - RNA, 67 nt, Human
uagcugugccaucugauauaagagccaccagucaccuguggcucuugaaauguggcuggcgcaacug

SEQ ID NO: 4117485 - RNA, 126 nt, Human
uagcuguggauuacauguguuucaaauguauagcuaggaauugaaaaguggucugagcuucaaaaagucuuacuauauuuuaauacuuccauaugaauuugacuuaauuauguaaggaaauaguua

SEQ ID NO: 4117486 - RNA, 126 nt, Human
uagcuguggauuacauguguuucaaauguauagcuaggaauugaaaaguggucugagcuucaaaaagucuugcuauauuuuaauacuuccauaugaauuugacuuaauuauguaaggaaauaguua

SEQ ID NO: 4117487 - RNA, 64 nt, Human
uagcuucuaauacuuaccaauugcauuuuaauaucacuuguuucugguagucuaggggaggcug

SEQ ID NO: 4117488 - RNA, 73 nt, Human
uagcuugcugagagcgugucaacaagaagagugacaaauaaucuugcuuuuguucacugucucugagcaccug

SEQ ID NO: 4117489 - RNA, 78 nt, Human
uagcuuuaaugauaccuauuagauauguaaucuugagcaaguuuuuuaacuugucagugucugagguuuuauaaguua

SEQ ID NO: 4117490 - RNA, 69 nt, Human
uagcuuuaauugugacaugagggccacagugccuccccacucuggccuauuucugucagauccaaguua

SEQ ID NO: 4117491 - RNA, 130 nt, Human
uagcuuuaguucucucuccugguagcugggccaacagggugcgggagaugugcaccagcucagcuucugagguguuauuuguacacuuggaugguccagugcaucaacauugaaggagacaggauuccug

SEQ ID NO: 4117492 - RNA, 55 nt, Human
uagcuuugaccaacgacugguccucacuaaugggagaccaggaguaucagagcug

SEQ ID NO: 4117493 - RNA, 77 nt, Human
uagcuuuguuuuuguugucuuuuucuguagggaucccauuaauuaugucuaugagaagaaaacaagauuaaaagcug

SEQ ID NO: 4117494 - RNA, 97 nt, Human
uagcuuuuuuacauccccucuucauccuccugcagagaaguacgaaguacuuuuuuggugcuccuaggaaggugguagaaauggaguagacagguug

SEQ ID NO: 4117495 - RNA, 59 nt, Human
uaggaaaauaucucuuauugggaacacaaguaaaaaauguguaaagggauaucguccua

SEQ ID NO: 4117496 - RNA, 57 nt, Human
uaggaaaugaaugcaggcucccaugggguaucccccagccugauucuggguuuccua

SEQ ID NO: 4117497 - RNA, 61 nt, Human
uaggaacacacauguguagcugucuuucguaucuaccugaagucacacaaugguguuuuug

SEQ ID NO: 4117498 - RNA, 64 nt, Human
uaggaaggccauuuuuagguagaauauacaaagaaaguaauugagccuaaagaggaccuaacua

SEQ ID NO: 4117499 - RNA, 63 nt, Human
uaggaaggccugucacuacuugauguuugaauuuagccuacgauguagucacaggcauuucua

SEQ ID NO: 4117500 - RNA, 55 nt, Human
uaggaaugcuuucaaaaaugugcagugguaaaacugccagauugaagguuucuua

SEQ ID NO: 4117501 - RNA, 63 nt, Human
uaggacagagcugguuacaaugcugugugguuuugagcagcuuacuuaaccucucugaaccug

SEQ ID NO: 4117502 - RNA, 55 nt, Human
uaggacagcaugagaguagcaaaaggaguccuugcugaaacucuuaguaguugua

SEQ ID NO: 4117503 - RNA, 73 nt, Human
uaggacaggugaggggcugugggcacacaaacauuucacuuacuuaaugguggccauggccacaucugugcug

SEQ ID NO: 4117504 - RNA, 124 nt, Human
uaggaccuccaugguuccagagucuaaggucuuccauguuuucucugacaccuaugcugauccaucccauuguaggaugugccaggaaagaaaggauuuuuagcaccuggcaaccuggguccua

SEQ ID NO: 4117505 - RNA, 68 nt, Human
uaggacuuugagaauuguuauuaggugaguuugacaauagcacaggguaauaaugucucagacaccua

SEQ ID NO: 4117506 - RNA, 91 nt, Human
uaggagaagacuauggacuuguugaugagauaaacaugcucaaaauuugacaugggcauccaguucugaucaacaauaauacuuucucuua

SEQ ID NO: 4117507 - RNA, 79 nt, Human
uaggagaauaucacaaggugcauggaguaauuucucaaauuuugaggccuuaguaacccugcacuggauuaaucuccua

SEQ ID NO: 4117508 - RNA, 93 nt, Human
uaggagacgacaguuccauguguguuacugcccuugaauaccuuccaguggaacaaaauguggagguggaaggcagugauauuguugauccug

SEQ ID NO: 4117509 - RNA, 72 nt, Human
uaggagcaccugggacacagcuuguucucgauuuccccucugaacacugacaccugcccucagguccuccua

SEQ ID NO: 4117510 - RNA, 73 nt, Human
uaggagcaucaggagagugucuggaggaagcuaacauccccauguucuuuaucagcaucuccuauuguuuuug

SEQ ID NO: 4117511 - RNA, 63 nt, Human
uaggaggauguaaaauagacaaaauggaacagccacuuuggaaaacaguuuggcauccacuua

SEQ ID NO: 4117512 - RNA, 65 nt, Human
uaggaggauuuugacuuauucagggaggaagggaaggcuucucugaagaaucgaugauucuguug

SEQ ID NO: 4117513 - RNA, 116 nt, Human
uaggaggcauggagagcauauaggauccuaagaugggcugugauccuguuccauuuguaucugugccuaacacaguccugcucacuuauuuccuuauuuucuaaccaacccuccua

SEQ ID NO: 4117514 - RNA, 69 nt, Human
uaggagggcccugaaaauggcagagaccucaauucuccccucccucccugccccuuuaugggcucccua

SEQ ID NO: 4117515 - RNA, 87 nt, Human
uaggaguaguucuugaucuuuuuaucaaguuauccauuguuaggaauugcaugggucacuauuugcagagacgugaaauacucgcua

SEQ ID NO: 4117516 - RNA, 87 nt, Human
uaggaguuuccucuauagggaaugggacccacugguggugagcgcuccacccagcuggugggucuuucucugaaaccagagcucuua

SEQ ID NO: 4117517 - RNA, 60 nt, Human
uaggaugacaacaguugugagaacauuccaauauaugcaguucuaacagcuuucauucua

SEQ ID NO: 4117518 - RNA, 67 nt, Human
uaggauggcuguggcaccuuugcuucuccagugccuggagucaccaucuguggcagccugaguccua

SEQ ID NO: 4117519 - RNA, 78 nt, Human
uaggauggugcaaaaguaaucaugguuuuagccauggaaaguaagggcaaaaacugcaguuacuuuugcaccaaccua

SEQ ID NO: 4117520 - RNA, 124 nt, Human
uaggauguuuaaguucauguuggguuucuggaggaagucucucuacaagaaaaaauauuuggaguguuuucuguaggggauaucuuugaagauuaaccuucauucaucacuucaauuuguucug

SEQ ID NO: 4117521 - RNA, 80 nt, Human
uaggauucuguggauuguuagagcucugggcaguuuugcugccuguaaucuuggcucaggcucuggccauccaaggcuug

SEQ ID NO: 4117522 - RNA, 116 nt, Human
uaggcaacucgcaaaaacuugguuuccaaugguuuaaagaguaugacuuugacuuuaagcuugguucaaagucaugaugaaccaccguaaacuguuucuccuucugcgagugcuug

SEQ ID NO: 4117523 - RNA, 59 nt, Human
uaggcaaggcauuuggcucuuggugguuacauuaagucagcuuuaccugucaugaccug

SEQ ID NO: 4117524 - RNA, 69 nt, Human
uaggcaaguugcccaaucucucugagccuuguucuuccaucauuaguaaaaaagagaggguuuugccua

SEQ ID NO: 4117525 - RNA, 64 nt, Human
uaggcacugccacacccaauguuuuugugugacagcaaagaucacacuguggggcagugacuua

SEQ ID NO: 4117526 - RNA, 88 nt, Human
uaggcagaagggccaccuccuucaucagaaggaaggacgauuaugcagaugcagguauauuugcugagaaggagggagauccugccua

SEQ ID NO: 4117527 - RNA, 66 nt, Human
uaggcagcucuccaguugcuuucuuuuucccuacgugcaggggacucuucagcugugagagccuua

SEQ ID NO: 4117528 - RNA, 55 nt, Human
uaggcaggugugcacugcccacuggcgcagggcuguggguaccugcaccugucug

SEQ ID NO: 4117529 - RNA, 74 nt, Human
uaggcauaccauguaguugugagugacagaaagcuuugauaggcuucaguauucaccgcaugcucuuuugccua

SEQ ID NO: 4117530 - RNA, 77 nt, Human
uaggcaugugauuucagguuuuucauacugagaacauugagauuucaguuggaagacacccugaaaucuuaugagua

SEQ ID NO: 4117531 - RNA, 66 nt, Human
uaggcauuaguaacccacacaacaguagauuagucaguaaugauaggugcuaccgugggaugcuua

SEQ ID NO: 4117532 - RNA, 81 nt, Human
uaggccaaagaaguuuccugggaggacuugugggcuucauguccacauaugaagccaucuccuccccuucauaauggcuua

SEQ ID NO: 4117533 - RNA, 85 nt, Human
uaggccaaagcuugggauauauaugacccaucugcauggugcuguacaugugcacauauacucauauuccccauugcugggccua

SEQ ID NO: 4117534 - RNA, 84 nt, Human
uaucagggacaaaauguacuuccuuaucaaacagagaccuaaccaaggacacucauaaggcaagcugucaguuuguccuuuaua

SEQ ID NO: 4117535 - RNA, 95 nt, Human
uaucaguuuggaugaauuuuucuaagcuuuuguauaaaucucaagaaggaaggcaggacauuggaaaaguuuccuauagaccaucccaacuggua

SEQ ID NO: 4117536 - RNA, 88 nt, Human
uaucaucugaguauuugaaacgauuccuaccacauccuaauucuagcaaggagaaaggggaaaaaguguuaggaguauacuugugaug

SEQ ID NO: 4117537 - RNA, 122 nt, Human
uaucaucugcauuagcuguguugucuaaaauuucuacaguacacaugcauuauuuucacaaucagaaagaaauaauauggacucuagaugauuuuuguggggcagugggagagguagaggua

SEQ ID NO: 4117538 - RNA, 59 nt, Human
uaucauguagaugaugguaaaagcaucaagcauaugcuguugcuuuaucagacaugaua

SEQ ID NO: 4117539 - RNA, 67 nt, Human
uaucauucauacaaguuuguuucauuucauggugguauugagaugaaaguagaaugucugaaugaug

SEQ ID NO: 4117540 - RNA, 57 nt, Human
uaucauuguaugggugagacaggauuguucauuaauucaccauuacauacaaagaug

SEQ ID NO: 4117541 - RNA, 56 nt, Human
uauccaaagagauucauguucuugguccauauauuuggaaugaucucuuugaggug

SEQ ID NO: 4117542 - RNA, 60 nt, Human
uauccagugaggaugauaauuaagguggcuuuaccuaaggcaguuauuuucaucuugaua

SEQ ID NO: 4117543 - RNA, 61 nt, Human
uauccauuauguuggcuagucuacaucccugcaggugaaggaugcuuuucagugauggaug

SEQ ID NO: 4117544 - RNA, 58 nt, Human
uaucccgucauaaugaugcuauuaggaauuucuucaugguggcucaccugauuggaua

SEQ ID NO: 4117545 - RNA, 75 nt, Human
uauccuacacaagaaagaaggagguacaagccaaagaucuuucucuuuauaaaucucucuuuauucuuggggaua

SEQ ID NO: 4117546 - RNA, 76 nt, Human
uauccuagugggguuucagucaccagcaaagaaaauccuaauuaguacauuuguauaugagaaauuccacaggaug

SEQ ID NO: 4117547 - RNA, 73 nt, Human
uauccuauaugaauaugaaguagagaaugcucuauagagcugcagauucucuacuucauauucauauaggaua

SEQ ID NO: 4117548 - RNA, 69 nt, Human
uauccucagaguuuaagaugucagaccugggauccagccccaacucugucaauuaugggcugugggaug

SEQ ID NO: 4117549 - RNA, 85 nt, Human
uauccucuguccuaagacagcagguaauuaguuaacauaaggccuuaaagauguaaguaaauuucuguugucuggauacuugaua

SEQ ID NO: 4117550 - RNA, 104 nt, Human
uauccucuucgaggcuuuucuagucuaagaaaucuuuacuuuucauuaggagaguugagguuagcacuuacuuggcuagaguggcagggucuggagugagggua

SEQ ID NO: 4117551 - RNA, 62 nt, Human
uauccuucuuaaagucgcauuuggccuuucacuaggaagggugcaacuaagaagaggugaua

SEQ ID NO: 4117552 - RNA, 66 nt, Human
uauccuucuucuucaauggcacagugcuacucuauguggggcacuguacugugaauaaggaggaua

SEQ ID NO: 4117553 - RNA, 75 nt, Human
uaucgauuuuauguuguuuugagaagcuaaagauguaaggaaauuuagcauaucugcaagauaaugaagaugaua

SEQ ID NO: 4117554 - RNA, 83 nt, Human
uaucgcauaauuaaacaggcaagauuuacuccuuugggcaucuaccagaacauauuuaaauguugucuuugaauugugcugua

SEQ ID NO: 4117555 - RNA, 65 nt, Human
uaucuaacacaaucguaaaugaauagucucugacucagagcagucauuuacagacugugugggug

SEQ ID NO: 4117556 - RNA, 55 nt, Human
uaucuacaggugucagguaagauguuaaauacaugaaccuggaagucaguagaua

SEQ ID NO: 4117557 - RNA, 93 nt, Human
uaucuaccaggguauacuuuguaagaucuucugauuccuauaagauauuuugcugauaauagaaaucuuaucaagaaaugcccuuuggagaua

SEQ ID NO: 4117558 - RNA, 77 nt, Human
uaucuaggaagauauagauggugguauaaauaaggacaaaucauuguuauauaucuguauuuauaucaagauagaua

SEQ ID NO: 4117559 - RNA, 66 nt, Human
uaucuauggcuucaccucagcaugaaggcaaaugaguuuccuuuagcuugagugaguuuggagaua

SEQ ID NO: 4117560 - RNA, 57 nt, Human
uaucucaucauguuuagauccucagucuugauucugagcauuuaugcuaaugggaua

SEQ ID NO: 4117561 - RNA, 74 nt, Human
uaucucaugcuguuugugccucaaauccucuucugagucaaacaugaagacaaacuggguagaaauuguagaua

SEQ ID NO: 4117562 - RNA, 60 nt, Human
uaucucugugggauguaggccucugcgcccggagguggcucccugugucccacguagaug

SEQ ID NO: 4117563 - RNA, 58 nt, Human
uaucugcuuuccuacuuaucuuggugaauaaaauaaagccaggaaagaaaggcaggug

SEQ ID NO: 4117564 - RNA, 68 nt, Human
uaucugucuugccuugcauauuuucuugaaaagaaacaaauagacaaaaauguaggucagggcauaua

SEQ ID NO: 4117565 - RNA, 102 nt, Human
uaucuuaauuuggcuucaccaugcuugauuuguaauguguucugagacccaagagaagcucugacauugcaauuagguaccuaugaacguuauauuaggaua

SEQ ID NO: 4117566 - RNA, 63 nt, Human
uaucuuauuuggggaggucucuguagaauuuucuacugaugacaccuuugccagaucaagaug

SEQ ID NO: 4117567 - RNA, 116 nt, Human
uaucuucaaaaccuaaaauauagggccuugaucauaacaggcgcucaauaaauguauguagaaugaaugagugccuuuuguaugcaggccauguauaguauuagguucuggggaua

SEQ ID NO: 4117568 - RNA, 70 nt, Human
uaucuucagcaguucacacuuaacaagugcucugugcauaguaggugcuuagugaaugcuauugaagaua

SEQ ID NO: 4117569 - RNA, 94 nt, Human
uaucuugaucucaguguguaguaaauuguagguuuuugauaaguuagauaauccugagucaauucuucucuaucuacugugauuaaaugagaua

SEQ ID NO: 4117570 - RNA, 70 nt, Human
uaucuuggcuauucuaauaggugugggcugaaguuagagaccagauagggaugagagugcuaccgagaug

SEQ ID NO: 4117571 - RNA, 58 nt, Human
uaucuugucucucggucuggacuaaauguuaucuuucagagacaugagacacaggaug

SEQ ID NO: 4117572 - RNA, 73 nt, Human
uaucuuugaaugugaccuuauuuagaaauagucuucacaaauuuaauaagguuaagaugaggucauuaagaua

SEQ ID NO: 4117573 - RNA, 60 nt, Human
uaucuuuggacggucccaacugacaauguuaaauuuguaagacacccgacuccagagaug

SEQ ID NO: 4117574 - RNA, 61 nt, Human
uaucuuuuagaguacugagugaagcaauggccugcauuccuucagcaguccucuagagaua

SEQ ID NO: 4117575 - RNA, 78 nt, Human
uaucuuuucccuauaguuccaggcauguuauugaauugaguaacaguuugccugaaauguauuaaccugggauggaua

SEQ ID NO: 4117576 - RNA, 66 nt, Human
uaugaaagcaguuuuucaaaauuacaugaucuacugguuccuaaauuugaaggacuuuaguucaua

SEQ ID NO: 4117577 - RNA, 71 nt, Human
uaugaaagggcuuuggauaaaaaucccauuugaauaugucgcuguuauugauaucuaaugcucuguccaug

SEQ ID NO: 4117578 - RNA, 84 nt, Human
uaugaaauaugcagagaaaguguagacaggcucccagcugguuuugcuauucuacauucucucuucuuuagcauacuuuucaug

SEQ ID NO: 4117579 - RNA, 81 nt, Human
uaugaagacucugaccauucccuugauuuuuugaaucacuguaaaaccauucacaaagaagaaaauggcagaguuuuugua

SEQ ID NO: 4117580 - RNA, 95 nt, Human
uaugaaggguuauuguugaauuauuuugaauaaaaaaguaguuucacuugaagcuagauaacuuuuauauuuaacguguuauauaaacccucgua

SEQ ID NO: 4117581 - RNA, 70 nt, Human
uaugaagucauugcugugggcauuugcugccugaccagagcacaaguccuccgacagcacguucuuggug

SEQ ID NO: 4117582 - RNA, 81 nt, Human
uaugaauacuuuuuggagaaugucucuguugcuggucucaggcccagggcaguuuuacuucucucuuaggauugguucgua

SEQ ID NO: 4117583 - RNA, 62 nt, Human
uaugaauaugcuuauacauaauguacaggucaucuuguaugcuuguguauaauauaauuaug

SEQ ID NO: 4117584 - RNA, 77 nt, Human
uaugaccaccuuauaugauggguacuauuaacauccccauuuugcaaauggagcaccugugugguagggaggucaug

SEQ ID NO: 4117585 - RNA, 88 nt, Human
uaugacuucuaagauacagggaaugggacauaaaucccagagcccaccaagguagggaguccacaugccuguaucccaaagaauuaua

SEQ ID NO: 4117586 - RNA, 70 nt, Human
uaugaguuaguacaagaaagaugaacugaggucggcucacauccguuugcauuucuugaacuauaucaua

SEQ ID NO: 4117587 - RNA, 84 nt, Human
uaugauaaagaugcccacauugcagguaaugauaauuccaaguguucgcaauucaucaccugccuacuggacauuuucagcaua

SEQ ID NO: 4117588 - RNA, 79 nt, Human
uaugauauuuuuuucuacuuuucuguaggugcauugcgaaaagaaaaugcugccuuucugaaugguggagaaguacaua

SEQ ID NO: 4117589 - RNA, 60 nt, Human
uaugauggacuaaaagggaaaccagaagccuauuucuuaagcccaacuggauccaucaua

SEQ ID NO: 4117590 - RNA, 71 nt, Human
uaugaugucgcagcugaaaaucucaaugaacaaaaaagccauuaaagaaacccagcaugugacugauuaua

SEQ ID NO: 4117591 - RNA, 64 nt, Human
uaugauuguucucugggccuugcaagugcucagagcuaacuuugccuccuagagcacguucaua

SEQ ID NO: 4117592 - RNA, 60 nt, Human
uaugauuucuaaguuuuaccacaaauauuucucaguauaguggaaacuuagagcauugug

SEQ ID NO: 4117593 - RNA, 76 nt, Human
uaugcaaauugucuuuaaucaggucauguuagacaaacuuaaaaagaugugacucuacuuaagauuaagcugcgua

SEQ ID NO: 4117594 - RNA, 129 nt, Human
uaugcaagauuuucuaaauccccugguguaugguucuaggcuuugucuuuuguucuccauauccuuacuugucauauaaaugcaaagcuuggcgcuuacuuacccaggcuaccugaaauugcugauaua

SEQ ID NO: 4117595 - RNA, 59 nt, Human
uaugcacuggagauccuggggagacugaagaggccauucccacagucucacaaugcaua

SEQ ID NO: 4117596 - RNA, 74 nt, Human
uaugcauauauuuucccaucuuaaaguuuauugauaaaaaaugucuucucaaggauucggggaaguacugcgua

SEQ ID NO: 4117597 - RNA, 62 nt, Human
uaugcauuaugccugugccugagggacccguaaugagggaaauuguguaggucuaaugcaua

SEQ ID NO: 4117598 - RNA, 72 nt, Human
uaugccagagcugugggagcacaugacagauaacacacugucccuguuuguccccaucccucagcaggcaug

SEQ ID NO: 4117599 - RNA, 129 nt, Human
uaugccuggcuaauuuuuguauuuuuaguagagaugggguuucaccacguuggccaggcuaaucuugaacuccugaccacaggcgauccacccgccucagccucccaaagugcggggauuacaggcaug

SEQ ID NO: 4117600 - RNA, 64 nt, Human
uaugcuggacaggcuggggacugcaaacuauaauguggauuaaggugaaggcuugucaaggaug

SEQ ID NO: 4117601 - RNA, 67 nt, Human
uaugcuucacuguuugguucacagcaguuauuuccuguuaacagccagauuuggugauuuaagcaua

SEQ ID NO: 4117602 - RNA, 84 nt, Human
uaugcuugacauucaacuuugaugauuaugucagugacuuucagguuucuaucuaaugauucaucaaguuguauuucaacugug

SEQ ID NO: 4117603 - RNA, 91 nt, Human
guuccugucggaagggcgggccugcucauccuggcgagaauuugcuuuucugcuuuauaggggauugcaggccaggcccacugacaggagc

SEQ ID NO: 4117604 - RNA, 66 nt, Human
guuccuguucuuguugacugggggaaggaaugagaccccuugucccucagagggcaagcgcagagc

SEQ ID NO: 4117605 - RNA, 55 nt, Human
guuccuguugauuucccaggaggcccuuucuucuucugcugaagucacugggagc

SEQ ID NO: 4117606 - RNA, 68 nt, Human
guuccuuagaguugauaugguaacuuuuaaugagaauuggauucuuuuaccauauagacugaaggaau

SEQ ID NO: 4117607 - RNA, 61 nt, Human
guuccuuagcugucccuggaaauagauuuaaucucaucuacuuucacaugagcaaagggau

SEQ ID NO: 4117608 - RNA, 83 nt, Human
guuccuucugagggcccuaccucccugcugggccagccuuaugcccagcauccucagggagcggggcugucaccauagggagc

SEQ ID NO: 4117609 - RNA, 65 nt, Human
guuccuuguaauuuguuaaggaagcccuaggaaacuaacacaucuaacaacaagaugcgaggaac

SEQ ID NO: 4117610 - RNA, 78 nt, Human
guuccuuucaucagauuuacugcagagcagauucaucaacaugaaguucaauucccaguagacuaaugaaaagagggc

SEQ ID NO: 4117611 - RNA, 59 nt, Human
guuccuuuccuauuuggauaagggagcaaguugguuauccaguaaaauggcagagggac

SEQ ID NO: 4117612 - RNA, 129 nt, Human
guuccuuuuuuuuugcugaaacauaguggauucuucuacucugcaguggaaagacucagacuucacagaugaggaccuguguuuuccuugaaugaggaaccaacuaguuuagccagcaacugaagguau

SEQ ID NO: 4117613 - RNA, 88 nt, Human
guucgcgucucugacugcugucccaucccugcucccagagaagugccuggcauguagcagggcugcagugugucuuuguggauggaac

SEQ ID NO: 4117614 - RNA, 88 nt, Human
guucgggcccaucuccccucccuggaccagugcugcagagggcugcauccuguccaucuggcuccugggagggguggaaccacugaac

SEQ ID NO: 4117615 - RNA, 89 nt, Human
guucgugguccuagcucuguucuccucuaccuucagaucauauucauauuaugauuuugucagugagaacagaguugcgauccaugggu

SEQ ID NO: 4117616 - RNA, 97 nt, Human
guucguggugcuugcaagccggaaugcaacagcugggaauauguauauuauuacugcaauguuaaccccugcugugcgguaugggaauaccaaaagc

SEQ ID NO: 4117617 - RNA, 129 nt, Human
guucuaaaguugcaucauuuuuggguuauggcauuaccuuccuccuguuuugguuuguaucuuuggggauaagggucaggguggaauggaaugcuggccaauccuuaaugagaagcccaacucuagagc

SEQ ID NO: 4117618 - RNA, 117 nt, Human
guucuaacccaaauagacauaaagaauaacacuuauagauaauaauaggauguacaauagaauugugaacaucuguuuacuccugauauauuuuugagggcuguaaggaaagagaac

SEQ ID NO: 4117619 - RNA, 81 nt, Human
guucuaagaucagcaguuauauugaaauaaaaaugauuacucuuuuauuauagcaaguguaacugauugguugccaaagac

SEQ ID NO: 4117620 - RNA, 63 nt, Human
guucuaaguguugacaaagucuagcugugaucauacuucugaugauugggagacauuugggau

SEQ ID NO: 4117621 - RNA, 71 nt, Human
guucuacucuugauagcauuuaccuuuuuggggagucucccaggcuccaaaggauaaaagcagaguagaau

SEQ ID NO: 4117622 - RNA, 102 nt, Human
guucuacuguugaaggaaggcaaagguauccucugauuaaaauugagcuauugggcucuguaaugaugaacucagagggaaccagcccauucaguguaagac

SEQ ID NO: 4117623 - RNA, 97 nt, Human
guucuacuuuucuacauaagcucugggaguaguuccaccuggauuccaaugggccucuuucccugggggaaacuuagaaaaggaaaguuaaugggac

SEQ ID NO: 4117624 - RNA, 76 nt, Human
guucuauggucuuuaguugaaacaugugguagugacugcgauacugcuauaagaggacagaugaagauuacagagc

SEQ ID NO: 4117625 - RNA, 69 nt, Human
guucuauuguaauaagcgggugaagaguggggcuuauuuguuuuagcagcugguguuaccauagcagac

SEQ ID NO: 4117626 - RNA, 67 nt, Human
guucucacucuucauguauagaaaguuaacaauuuuucucagagcacggggagugaaugguuagaac

SEQ ID NO: 4117627 - RNA, 69 nt, Human
guucucauugcacaggaagcuggucauuuagacugcagucuucauuugugugccugaugcaauaagaac

SEQ ID NO: 4117628 - RNA, 88 nt, Human
guucuccaaugcugcacugcaaaguaauauggucccagugauguauccuaauaacugaacagccuaauucuuuugcagauuggagggc

SEQ ID NO: 4117629 - RNA, 62 nt, Human
guucuccauuuaacuuccuuaugcagcuaccagcucaucgcauuaaggaaaagaugcaggau

SEQ ID NO: 4117630 - RNA, 66 nt, Human
guucuccucccuuggcccagccucucuguaaggaagucagacucugugcucagagggagggagagc

SEQ ID NO: 4117631 - RNA, 84 nt, Human
guucuccucugccucgcuuacuuccuaccacucucuccucacccagaagaguguaugaacuuaagagagagcucuucucagaac

SEQ ID NO: 4117632 - RNA, 128 nt, Human
guucuccucuuuguguggguaccugugagcaugguggcugaagugggcaggagggaggccguucugugucucuuccuccuuauuucaugugaugcugcuccagaggccuggcuugaaaagagcaggac

SEQ ID NO: 4117633 - RNA, 84 nt, Human
guucucguggaggccuggaucuuggguaaggccuggguucuuguagaggucuggguuuugggcaagguccagauuccugggaac

SEQ ID NO: 4117634 - RNA, 58 nt, Human
guucucuaaaagaaacuuucaagacuuauauauaucuugaaaguguuuuaaagaggau

SEQ ID NO: 4117635 - RNA, 67 nt, Human
guucucuaucuaacacucucugccaugacucuccaacuuuggcaggcaccaggaucaguuagagaac

SEQ ID NO: 4117636 - RNA, 58 nt, Human
guucucucugcuuccaagauggugcccuuccugccccaucuucacauagcagaaggac

SEQ ID NO: 4117637 - RNA, 57 nt, Human
guucucugccacuuaccagcuacagagcccugacugccugcggagugugcagaguac

SEQ ID NO: 4117638 - RNA, 71 nt, Human
guucucuuucaaguuaccuuuaaacagcuuccuauuuuugaagcuugauuuuaaggcuuguuagauugaac

SEQ ID NO: 4117639 - RNA, 80 nt, Human
guucugccacuggacaucucuucccaacuccacauucugugacaucaaguuguguagccugaaguuggccaugguaggac

SEQ ID NO: 4117640 - RNA, 76 nt, Human
guucugccaggcaggugcagauuccucuugacuuuuguuaugaaaaccaucgucaccuugccuggcuuaccagagc

SEQ ID NO: 4117641 - RNA, 107 nt, Human
guucugcccaggcuuaacuuccuguaaauggaacuauguaguauauaggcacaaaaggguaaauacugccaaauuccauuuauaggaaguucgaacacuggcagaac

SEQ ID NO: 4117642 - RNA, 80 nt, Human
guucugcucccugccugcuguagcggcuucacuuuugugaugugaugagcuagcaaauagcauguaggaagguacugaac

SEQ ID NO: 4117643 - RNA, 63 nt, Human
guucuggaaagcaagaaagagugcuauuaauucauugcacuaauuuugaggacuuuccagagc

SEQ ID NO: 4117644 - RNA, 77 nt, Human
guucuggagcauuucuuccccaugggguaagucagaauuuucuaggcaaaccacaggggaggaaugaugcccgggac

SEQ ID NO: 4117645 - RNA, 56 nt, Human
guucuggcaccuuugcccccuggucaaugaguaccaggguggcucugggucagaac

SEQ ID NO: 4117646 - RNA, 107 nt, Human
guucuguaacaaauacccacuauguucucggcacuauggaugccuacuaugugcuugguaccauguuaguuacugggaauguuguaaugaauauauuugaagugaac

SEQ ID NO: 4117647 - RNA, 126 nt, Human
guucuguaaugauuaggguuuuaucuggacugucuggguggaugggcuaagcuggaggggcauuuuggaauacuccuccaguggcccaguccuucaacagcccuggcccauauuucuuugcagagc

SEQ ID NO: 4117648 - RNA, 59 nt, Human
guucuguacuccaagcucuuccacaaccacauguguaggcugcuuacugguaucagagc

SEQ ID NO: 4117649 - RNA, 67 nt, Human
guucuguagucauagagcaauucauacugagucaaaaugcucagcuucuguuccacaugaucagaac

SEQ ID NO: 4117650 - RNA, 63 nt, Human
guucuguaucuugauuguggugcuaguuacaugacuguacacauucgucaagacucacagaac

SEQ ID NO: 4117651 - RNA, 59 nt, Human
guucugucauuuucuuccaauauaagguuucacuaugauuggcaugagaauggcuuagc

SEQ ID NO: 4117652 - RNA, 64 nt, Human
guucugugugaauagugaggucuauugguuguaaguucgguguacacuuccuucacacgguuac

SEQ ID NO: 4117653 - RNA, 86 nt, Human
guucuguguguuucaaucucacauccucaguagugcaagcccuguucuauuuaugguguuugugagugagguuaacacuuguaugc

SEQ ID NO: 4117654 - RNA, 103 nt, Human
guucuguguguuuguuuugggucucuugauauauuacauagaguuccgauuauuaaacuccauuuauccaaggagauguuuccaaagcuaaaacucaaugaac

SEQ ID NO: 4117655 - RNA, 57 nt, Human
guucuuaauaucucucuuccuuucuugguggcaaagaggcugcaggguauugagaau

SEQ ID NO: 4117656 - RNA, 83 nt, Human
guucuuaauggcuuauauauuuucacuugccuuggccacauucucuggcauugguacaugauguauguaaugucuguaagaau

SEQ ID NO: 4117657 - RNA, 62 nt, Human
guucuuaggguauuauguguguggguauaaucauaccuuuucaucugaaacuuuuagagaac

SEQ ID NO: 4117658 - RNA, 56 nt, Human
guucuucagauuccauuucagugccuuuccaacacugaggaguaguucuggaggac

SEQ ID NO: 4117659 - RNA, 65 nt, Human
guucuucagcccauaucuuccaguggccccacugcccuucccacuggccugccugggcugagagc

SEQ ID NO: 4117660 - RNA, 57 nt, Human
guucuucaucuuaaccaucuguugcaggcugacagauggguugauauaugacagaau

SEQ ID NO: 4117661 - RNA, 78 nt, Human
guucuucucugacaugccuaagacuuuucucuguuauugacaaauaucaaggugguaggcuauaucaguaagaggaac

SEQ ID NO: 4117662 - RNA, 77 nt, Human
guucuugagcccccaaauuuuaaucauugucucuuugguugcuacuauggcaacuuacaauguuagagucucaauac

SEQ ID NO: 4117663 - RNA, 62 nt, Human
guucuugaguaucugcacagugcccagcagagugccuggcauacaguaggugcucaaugaau

SEQ ID NO: 4117664 - RNA, 68 nt, Human
guucuugguggcuucugaggauggcgaagggcucaccuucugucaucccgaaccaucacugaugggac

SEQ ID NO: 4117665 - RNA, 71 nt, Human
guugaaacauucuacaguuaaccauuagcaugcuaguuguccuaauggaaauuuuugaagaguuuuucaau

SEQ ID NO: 4117666 - RNA, 67 nt, Human
guugaaagcauagaauuagaguuaggcugcuuggguuugaaaccuaguuauaugacuaacuuuuagc

SEQ ID NO: 4117667 - RNA, 87 nt, Human
guugaacaugauucugaaagcaauggcacaugaugguaccuuuagauuucugaauaugauuugucauuguuuaaaaaguguuucaac

SEQ ID NO: 4117668 - RNA, 93 nt, Human
guugaacugacagucuugccaaguuucuuacaugacaguacugauuaagaaagaauggaauucagaaacuugggauaagauacccaguuggac

SEQ ID NO: 4117669 - RNA, 77 nt, Human
guugaaggaacugggcucauaaugucauagaaggcaauuauuuucacauuuuguucaaggcuaguucccaaaucaau

SEQ ID NO: 4117670 - RNA, 60 nt, Human
guugaaggcucuaggauccauccuuauuucacaaugagaaccaagaccaagggccucaau

SEQ ID NO: 4117671 - RNA, 129 nt, Human
uaugcuuuauuuuaucuuaauuuuuacguagcuuguugagggucaaauuggaagguggauauccuagucacagaauauguggcuguaccaguuuucuauuuuagccuggauagucuaauugagauuaua

SEQ ID NO: 4117672 - RNA, 101 nt, Human
uaugcuuuccuuugggagcaugaauuuucccaaagcccaccggcauccucuccuaauuccuugcuggucaaaaugaauuuuugcucccaaaggaaagcgua

SEQ ID NO: 4117673 - RNA, 97 nt, Human
uauggaaauguguagaaguaaaauguuuccuuuauuacuuaaaaacauuuagacuauaaggugauagauuacaauauuguacucugauuaguccaug

SEQ ID NO: 4117674 - RNA, 55 nt, Human
uauggaugacuccagaugacuguagccccaacuaacaucugccuguuaucacaua

SEQ ID NO: 4117675 - RNA, 58 nt, Human
uauggcaguuuauauucuagugcuguuccacggagcagggccaacaguaaacaccaug

SEQ ID NO: 4117676 - RNA, 59 nt, Human
uauggcuuuuaacugucguaugcaaggaauucccuuaucugacaguaggcagagccaug

SEQ ID NO: 4117677 - RNA, 62 nt, Human
uauggguaggccugccgccugucucgcucuaucugcuaccugggaguggcuuccugcucaua

SEQ ID NO: 4117678 - RNA, 56 nt, Human
uauggugauggcacagaccagcaauucuggacacuucuggagucaucuuuaccaua

SEQ ID NO: 4117679 - RNA, 106 nt, Human
uauggugguuaagaacuuaggcuuuguaguuaggcuauaggaauuucaauuuugacuucacaagucauuagcugcauaaccuuagguaaguuacuuaacuacuaua

SEQ ID NO: 4117680 - RNA, 81 nt, Human
uaugguuguaacuuggauacuuguguuagguuacuuggccuuuaauauaaaguaauuucucauggauucaguuauaccaua

SEQ ID NO: 4117681 - RNA, 63 nt, Human
uaugguuuguuauaguugugagugcuucuaauguacucacaucaacauuauagcaugacugua

SEQ ID NO: 4117682 - RNA, 61 nt, Human
uauguaauggagauucaauccucauggaaauuugguaggagauauggucuccgagugcaua

SEQ ID NO: 4117683 - RNA, 59 nt, Human
uauguacauguuaaagggcaaaagcacauccaacguuuggcugccuugagauguauaua

SEQ ID NO: 4117684 - RNA, 77 nt, Human
uauguagcaauagcaucauacugggccccacaggagcagccugacaguaugauuuggcuauuauuccuggcugcaug

SEQ ID NO: 4117685 - RNA, 129 nt, Human
uauguagugacuguaaagcuaaccaucagauuucaaguguagauuauggagugucuuauuauguggaaauaggcuucugugagcucauacaaguaugugugaugguuagguucacuaugaaauaccuua

SEQ ID NO: 4117686 - RNA, 72 nt, Human
uauguaguuagaagauucaaacagauuucucuagaaaaagcaguaggguuauggaaacuucuagcuuacgua

SEQ ID NO: 4117687 - RNA, 57 nt, Human
uaugucugucacugagggcuuuaugaagacauccagccucagccgguggcagaagug

SEQ ID NO: 4117688 - RNA, 74 nt, Human
uaugugaauguuaaaaucagacauuguucccuuuucuuuacaacaacaagucuuugguuuuggcuauauacaug

SEQ ID NO: 4117689 - RNA, 74 nt, Human
uaugugacaaaaguaaacugcaugacuucugaugcuaugucauaagaaccccguaguucuacuucagucucaug

SEQ ID NO: 4117690 - RNA, 57 nt, Human
uaugugauuaguccuuacaugcagccaaucauuuugcucguaagugauuaucucaua

SEQ ID NO: 4117691 - RNA, 57 nt, Human
uaugugcacauuagagagauggccccucacuucacaggccauaaaaucugguauaua

SEQ ID NO: 4117692 - RNA, 112 nt, Human
uauguggcuccgugggcuaggagaagaaucugaaggcaccucuggucagucacugcccaucugaaagacccagagaacugugccuugagggccuuagaucaucagucacaug

SEQ ID NO: 4117693 - RNA, 61 nt, Human
uaugugguguaggucucagaggaguguacgaugagcuccuagaagcaccacucaucacgug

SEQ ID NO: 4117694 - RNA, 66 nt, Human
uauguguaagcuguuuaucuuuuuccucuuauuauacuuuggccaagguggaaaaagcuuaccaug

SEQ ID NO: 4117695 - RNA, 78 nt, Human
uauguguaagugagauuuggaaaauuugauaugccagcaaggacaaagaaguguugaauuugcaaguuuaugcacaua

SEQ ID NO: 4117696 - RNA, 65 nt, Human
uauguguagcucauauuaguguuacugaggacaugcccacugacagaaaaauguagcuccaugua

SEQ ID NO: 4117697 - RNA, 83 nt, Human
uaugugucauuuuucugugcauaagcaagaauaugcauagccaugcauacacccacaccuguguacacgagagguuauauaua

SEQ ID NO: 4117698 - RNA, 62 nt, Human
uauguguuguauaugugcagagguguuauuugucuucuucuguuccauauuuccagcacaug

SEQ ID NO: 4117699 - RNA, 85 nt, Human
uauguugaugaucauguugacuucagugccaugaauaauaaaauauuucucucuuagccugaaguuucaugccucuaucagcaua

SEQ ID NO: 4117700 - RNA, 98 nt, Human
uauguuggauguggaagugggauagagauaacauuguggcuuuuggaaaguucaaacucuauuucuguuggcuuaauuucauuaucauuucuuucaug

SEQ ID NO: 4117701 - RNA, 58 nt, Human
uauguugugaucauuaucuugaugacaaacauuucgucccaagauuuguucacacaug

SEQ ID NO: 4117702 - RNA, 105 nt, Human
uauguuguugccagauauuuuaggaaggccuugaaugccagucugagugucaacaguuuugguauuucaagcagggccacuauuccauaugcucaaagcaacaua

SEQ ID NO: 4117703 - RNA, 80 nt, Human
uauguuuguuuuauacuggcuaguguuuuuuaauggaaaaauaguguuuugauugacauuagacuaauguagcauuuaug

SEQ ID NO: 4117704 - RNA, 84 nt, Human
uauguuuucaugcuuugcauucaucuucuuuuaaaucauuaagagguagggaagaaggcaugaaauuacuaucauaaauacaug

SEQ ID NO: 4117705 - RNA, 57 nt, Human
uauguuuuccucuggcacuuauggagcuuauaaaccagugacagaggaaggugcaua

SEQ ID NO: 4117706 - RNA, 98 nt, Human
uauuaaaaggcauauaaaguacuugaugcuacagaguaucuagaaauaugcguugugcuuauucauuugugacaauagguauuuuggcauuuuuaaua

SEQ ID NO: 4117707 - RNA, 83 nt, Human
uauuaaacauuuuauucucaucucccuacuuagauucuaagcuucuauuuugaauggucagauguggaguacugaguuuagua

SEQ ID NO: 4117708 - RNA, 62 nt, Human
uauuaaaccauccagagacucuuccaggccauagaucugaaacugucauggguaguuuagua

SEQ ID NO: 4117709 - RNA, 104 nt, Human
uauuaaauuauuuaguuugcaugccuguuugaaauuggaccucucagcagcacuuugaaauaguuuuaauuagguuaacauuuuguacauuaaauaaguagaua

SEQ ID NO: 4117710 - RNA, 55 nt, Human
uauuaacacguauaaaguguuuagcagagugcuugacacaugugcguguucagua

SEQ ID NO: 4117711 - RNA, 114 nt, Human
ucaaugcacacaggacuuggugaccuauaauccuugacagagggcagaugugauguaauauccauauucacuuugucuuuuuccucaaggauauuaccaaaucauuguguauga

SEQ ID NO: 4117712 - RNA, 57 nt, Human
ucaaugcauaaugguuugugacaaauuuuagcauuuugcucuuaccauuauguguga

SEQ ID NO: 4117713 - RNA, 62 nt, Human
ucaaugcauaggagguggcagaguguuuccagaccaagaccugucaccugauuaugauuuga

SEQ ID NO: 4117714 - RNA, 62 nt, Human
ucaaugucaauaucuugguuguacuauauuguacuauaguuuuucaagauguugccacuugg

SEQ ID NO: 4117715 - RNA, 68 nt, Human
ucaaugucauugacuuuccagaagcaaccuauaccucggguuugcucuugauacaucaagaacuuuga

SEQ ID NO: 4117716 - RNA, 57 nt, Human
ucaaugugcuuuagguuuguuuacaaccuguugugaaucuaucuaaagguauuauga

SEQ ID NO: 4117717 - RNA, 128 nt, Human
ucaauucacucugguggauugaacacaaguauucagcacaucuuuguacagcugcucgugauaagguagcuuaguccuaguguacuaaauaucuguugaauuuuaauccuuaugaacagagaaauugg

SEQ ID NO: 4117718 - RNA, 74 nt, Human
ucaauuggcccaauagagaaauagugaaauucagcagacacuguuauuuucugacucuauugagguaucauuga

SEQ ID NO: 4117719 - RNA, 57 nt, Human
ucaauugugaacaagccccuuauucaaaauuugagcaggaguugagugcacaguugg

SEQ ID NO: 4117720 - RNA, 77 nt, Human
ucaauuguucucucuucauccauuucaguguaucacuauuuguggcagaugaauaaacuaugaggaggaauaguuga

SEQ ID NO: 4117721 - RNA, 74 nt, Human
ucaauuugaucccauuuccuguuuugucaagggggaaagccgccuugcaggauuuuagagaugacaugaaauga

SEQ ID NO: 4117722 - RNA, 67 nt, Human
ucaauuuggugaugaaaauuugauuugugguuuccucucacagggcucuucaucacacaguaauuga

SEQ ID NO: 4117723 - RNA, 72 nt, Human
ucaauuuguuuaucauuauuauuagcaaccuuugcacuuauuuuggucuagcaaugaugaugagcuauuaga

SEQ ID NO: 4117724 - RNA, 107 nt, Human
ucaauuuuuguuuggaguuccguuagauauuccuguauccuuucauaaaugacuaauaggaaagauacaagacuaauaggaaacacaacuuuaugcaacuucauuga

SEQ ID NO: 4117725 - RNA, 70 nt, Human
ucacaaaaacaggcacuuuacaaugugugacauagacuaugauagacaauaaaagugaccagguuuguga

SEQ ID NO: 4117726 - RNA, 79 nt, Human
ucacaaaaugauuuauuacuuacauuagcaaacaagguuucucuaagcccugacacuugguggaaguauugcuuugugg

SEQ ID NO: 4117727 - RNA, 57 nt, Human
ucacaaaggagaaugucagcauaauagcugcuguuugauugaugaauccuguuguga

SEQ ID NO: 4117728 - RNA, 56 nt, Human
ucacaaagugaagugugucauggguaaaaaguccagacaucauaaugacuuuguga

SEQ ID NO: 4117729 - RNA, 64 nt, Human
ucacaaaucgaagccuuauaauugacuucaaaauuuuuguuaagccauaugaggcaguuuguga

SEQ ID NO: 4117730 - RNA, 126 nt, Human
ucacaaguacuuagccgauucuuaguugagauacguuaaagaugcagcuuuagagaagauuuccaggccucuggcccuauucuagacugcuucuuucucacugaguguucaaugcauugacuguga

SEQ ID NO: 4117731 - RNA, 70 nt, Human
ucacaaugaacaagaaagacuuugagcuguccuuccacacggcucuggaguucccuugaucugacgguga

SEQ ID NO: 4117732 - RNA, 86 nt, Human
ucacaaugccagugcuugugucugagcagaaacuuguuuccagucucuguugcugcuuaauagugcacugguuuccuuuaauguga

SEQ ID NO: 4117733 - RNA, 67 nt, Human
ucacaauggcagcagcuuuagcuguggcuguuacaauuuaaagccagaagugauugcuccguugaga

SEQ ID NO: 4117734 - RNA, 57 nt, Human
ucacaaugucugguaggccacuuuggguucuagagguagcauauuccagacuuguga

SEQ ID NO: 4117735 - RNA, 114 nt, Human
ucacacagggaaccugcuagaaaugcaguuuccuggucccugcugcacugcagacaucuuuaaugaccuaggagggaccuaggaauauugcguuuucagcaggcccccugguga

SEQ ID NO: 4117736 - RNA, 74 nt, Human
ucacacauuuuuggguugaugucugauauuuugcaucacaaaugucaauuggcuacaaauaauguaauuuguga

SEQ ID NO: 4117737 - RNA, 82 nt, Human
ucacaccccucucccccgacacccaacauaacaccuauaguccaugcuguucaaggcuguggugcugaaggagggggugugg

SEQ ID NO: 4117738 - RNA, 67 nt, Human
ucacagaaggcaucacagaagacaugauuaacaagaucuugaguuagaaagguggguuuucuuguga

SEQ ID NO: 4117739 - RNA, 56 nt, Human
ucacagaagggaaagaugccaaaaguccgcaucuuuguggcaucauugaucuguga

SEQ ID NO: 4117740 - RNA, 72 nt, Human
ucacagaccagaggcauguucaaagcaauuucagagaugaaaauggcauggaguuuuugggagguccuguga

SEQ ID NO: 4117741 - RNA, 64 nt, Human
ucacagcauuuuuagaaagauuaaaugguuuaauuguuaugccuuccuuuuagggauguuguga

SEQ ID NO: 4117742 - RNA, 76 nt, Human
ucacagggcagucaguuuuaccaaucucagugaaguggcacaucacugauaggugaacuaaaauugauucuuguga

SEQ ID NO: 4117743 - RNA, 55 nt, Human
ucacaguaucacacaaggauuaaccuuacccuggauuuccauuguucuacuguga

SEQ ID NO: 4117744 - RNA, 119 nt, Human
ucacaguggucucuuuuuaggaaaugcauauuagcaugccaagcuuuuagaauuccaagaaacacauuuuaggagauauaaaucuagaauguuuuuugaaagggcgaaauucauuguga

SEQ ID NO: 4117745 - RNA, 86 nt, Human
ucacagugugacaugauggcgucauguaacaaggcuaagaaucgguugcaugacaauugccgucaaguuucguggaggugcuguga

SEQ ID NO: 4117746 - RNA, 60 nt, Human
ucacaguguggcaacucacagaagaagaaaauucauguagggugcucuggcacauucuga

SEQ ID NO: 4117747 - RNA, 80 nt, Human
ucacaucacugaaaggagggcucacaaaaguggucugcaggcagugcuuacuccaagcccgcuuuuuacacugaaaauga

SEQ ID NO: 4117748 - RNA, 74 nt, Human
ucacaucuuucuuugcacacucaggguaauaaucuaaaugcugaguauucucugaagucaauggaaaucuguga

SEQ ID NO: 4117749 - RNA, 57 nt, Human
ucacaugaggcauccccgggcagccccucaccuggcuccaggggccagcucguguga

SEQ ID NO: 4117750 - RNA, 76 nt, Human
ucacaugcuugauaaaaugaugaaaucacugaccagcaggauccgucaguggagucagcauuuuaucacaauguga

SEQ ID NO: 4117751 - RNA, 81 nt, Human
ucacauggacagugcccuaugaacagcucucuguugaccaacaaaaagaugcuucguuuauagauggcauuuucaaggugg

SEQ ID NO: 4117752 - RNA, 76 nt, Human
ucacauggacuucacagagggccacuugaauguuuucacaaugugaaaagauaaacaacagccuucuccaggguga

SEQ ID NO: 4117753 - RNA, 61 nt, Human
ucacauggcuaaagcaagucuagauucaauggauagagaaauaagcuuugccuugauguga

SEQ ID NO: 4117754 - RNA, 121 nt, Human
ucacauggucaagccugacaucacuggagcaaaggggcacagcaagaagggaaaugaaauauuugguccaccagucauagacucuaucaugcuguguuuucagucuugggagaugaugaga

SEQ ID NO: 4117755 - RNA, 65 nt, Human
ucacauucacaggaggaaccuggccuggacgucauaaccaccagacucaggcuccuguagguuga

SEQ ID NO: 4117756 - RNA, 77 nt, Human
ucacauucuggcuggagugcaggugagugaucagcaaugagcugugaccacacacgugcacuccagccuggguguga

SEQ ID NO: 4117757 - RNA, 73 nt, Human
ucacauuuaggaaguggauaaaauagcuuuauuuucaucagagugaaacuucagcaucauuuuuaagauguga

SEQ ID NO: 4117758 - RNA, 85 nt, Human
ucaccaacuuauauuacaacucugaacuacagagguuuugcagugucaagaaccugagugauauugaguguaaugaagucuguga

SEQ ID NO: 4117759 - RNA, 58 nt, Human
ucaccacucccuuuucuacuucuacccaaaauuggguaaguugauaagagagucuaga

SEQ ID NO: 4117760 - RNA, 90 nt, Human
ucaccaggccuagagggacgccugcucuccauacacuuucuaggcuggcuggagggaggggagggacaggggccucuuauggcucuguga

SEQ ID NO: 4117761 - RNA, 56 nt, Human
ucaccauccucaccuagaaaugaccaacucuguggucacccuaggaggucugguga

SEQ ID NO: 4117762 - RNA, 100 nt, Human
ucaccaugagagcaaugaauggggaggcaugguggagucugagcaggggugagccaugcucagccccuuggguucuacuugcugcccgaccagcugguga

SEQ ID NO: 4117763 - RNA, 125 nt, Human
ucaccaugcuggccaggcugguugcaagcuccugaccucgugaucugcccaccuuggccucccaaagugcugugauuacaggcaugagccacuguguccggccuggugcagaauguuaauagugg

SEQ ID NO: 4117764 - RNA, 86 nt, Human
uauaaauuuauuguauuaaaaguuuaaauauuggugugugggcauccuacaugauauaugggaaaugcuuggaucaguaauuuaua

SEQ ID NO: 4117765 - RNA, 123 nt, Human
uauaacgaggugaccaguugucccacuuugccugggacugcagauccccagagcaugaaacuuaccauuuugaaaucaggaaaguuccaggcaguugaagauggguuggucaccuucgcugua

SEQ ID NO: 4117766 - RNA, 128 nt, Human
uauaacucuaguuuuggccauuguaugggauuuuauguuauuauuuacuacaugaucaaaugaaaaugugaaagugucauagaaacccaugucuggaacugagcacgcaccccuucuuaagaguuaua

SEQ ID NO: 4117767 - RNA, 76 nt, Human
uauaagcuuuugguaacaagucauuuuaaauuauguguguaaagcacauaguggaaugcuuguuccuuaguaggua

SEQ ID NO: 4117768 - RNA, 77 nt, Human
uauaaggaaccacaaguuucagcacccagagaagaugucaaauuuuucuggccuuucaugaaauuugauucauugug

SEQ ID NO: 4117769 - RNA, 122 nt, Human
uauaaguaacuauauugaucucaguagugcuuugguauagaacuauuuuguggaaauaagcuguccugacuugguaagcuguccaaagcauuacuaagaggugcauugcucuguaacuuaua

SEQ ID NO: 4117770 - RNA, 64 nt, Human
uauaagugacagauuauccaaauuaaugguggcuuaaacacaguaggauuucuugucucuuaua

SEQ ID NO: 4117771 - RNA, 78 nt, Human
uauaauauguucguaagguguuuguauguucuauaguguuagauguaaaaacuccuuucgaaaagaaagcauguuuua

SEQ ID NO: 4117772 - RNA, 68 nt, Human
uauaaucugucauuuuguaucuacauggguagcucccuauaucuacagauaacugaaugcagacugua

SEQ ID NO: 4117773 - RNA, 82 nt, Human
uauaauuuucuuuuauuauuuucuacuuggcuccuaguuuugcuugccaaguuuggauuaugaaaaaguggccaauguugua

SEQ ID NO: 4117774 - RNA, 60 nt, Human
uauacagaaccgccugaagucugcaucaugacuugaugguuacccagggguuuaugugug

SEQ ID NO: 4117775 - RNA, 55 nt, Human
uauacagucuuuugcuauauucacuaggugaugguaguuuaugaaauacugugua

SEQ ID NO: 4117776 - RNA, 71 nt, Human
uauacauguaauugauuuuguguuagccagucaugucauguuugacuaacacugaaaaugaugcaugugua

SEQ ID NO: 4117777 - RNA, 60 nt, Human
uauaccaguauuagacugagaaauggagucucuccugagaaccaucuaaguacugguaua

SEQ ID NO: 4117778 - RNA, 130 nt, Human
uauacuccuugaaggauauccuaagucuuauucauaucuggaucuccagcacuuaucacaacgccuagcacagagugaguaccugguaaaugcugagggagauuaaugagaccaccaaauuccuuugaua

SEQ ID NO: 4117779 - RNA, 68 nt, Human
uauacugucccucugcacuccaccccgcauacaccauuauuugucuugaagugaccuggggcagugua

SEQ ID NO: 4117780 - RNA, 88 nt, Human
uauacuugugugucauuuggacuuugguauuaccauaagggaauauauacuuaugauaacaugaaacuccaaaugguacagaaguaua

SEQ ID NO: 4117781 - RNA, 61 nt, Human
uauacuuuccugcaacuuugauuuugaccuuggaaugaauaugggcagcaggacuagugug

SEQ ID NO: 4117782 - RNA, 63 nt, Human
uauagaaacaaacugacauugcuucuaggauaucuaggagggcagauuugguuuguuuuaaua

SEQ ID NO: 4117783 - RNA, 70 nt, Human
uauagauguaggcugaagaugaaguggagcuaaaaaccauuaguuauauauuaaaguuagccauacugua

SEQ ID NO: 4117784 - RNA, 81 nt, Human
uauagcagcauuauucauuagagucaaaaaguggaaacaaauguccaucagcugaugaauggaugaauaaaaugugguaua

SEQ ID NO: 4117785 - RNA, 71 nt, Human
uauagcuaaaauaacucagcacauuccuguuuacaaggaauuauuugaguaacuggggaauuugagcuaug

SEQ ID NO: 4117786 - RNA, 65 nt, Human
uauaggaacagcuagcacagaacugcucaggaaggaugcaaugucuucagugcauguuaccuaua

SEQ ID NO: 4117787 - RNA, 87 nt, Human
uauaggauuuggcugcuugauuagguugacacugauacauuuaguuguggcaagugaaccaagucaagccauuagccaaauccugug

SEQ ID NO: 4117788 - RNA, 67 nt, Human
uauaggcuccuugauuauaaaaaaugcacccaucugguguggcauguugauaauggagaaggcuaug

SEQ ID NO: 4117789 - RNA, 76 nt, Human
uauaggcuuuuguugcagaacacguuucgggaaccaccauuuccgauuucagagguuuugguaggaaaagcuaaua

SEQ ID NO: 4117790 - RNA, 76 nt, Human
uauagggauagaucauggaguaaaauggaagucacuggaaugcuuucaguagaggagcuacaugaucugacuuaug

SEQ ID NO: 4117791 - RNA, 95 nt, Human
uauagggucaucuuuaaaacauauuaacugcacuacacuauuaaaugucuguagaugaaauguguguuauuaugaaugaagaauaugggucuaug

SEQ ID NO: 4117792 - RNA, 124 nt, Human
uauaguaguagguucagaaacucaggcuaaggaaagcauccagaaaacauugucugccucugcaacaguuuguggauagcuuguaauuguaguucugaucuugucaaucugucuuauaacucua

SEQ ID NO: 4117793 - RNA, 55 nt, Human
uauagucuucaguggucuaucuccgguagugaaggggagagcagggaagacagua

SEQ ID NO: 4117794 - RNA, 66 nt, Human
uauaguuacuguuuucuagcaggugagcucuuucacaagaugguaaagcuagagaagguuacuaug

SEQ ID NO: 4117795 - RNA, 61 nt, Human
uauauaaaagguacaggguauuagauuauguauggaugcaugauaauguauuuuuuauaug

SEQ ID NO: 4117796 - RNA, 87 nt, Human
uauauaagaggaauaacaugucagaaucaacuugaguuuaucccaggaauacaacacugguucgacaugugaaaaucacucaguaua

SEQ ID NO: 4117797 - RNA, 83 nt, Human
uauauacacguauuagaggguuauuaggacagaagcggagcuggaacaagcuccuuuaccugaagaccuucaaagaauauaua

SEQ ID NO: 4117798 - RNA, 59 nt, Human
uauauaggcaguccagccccucauuuacuuauauuaggggcugacgaaggccaugugug

SEQ ID NO: 4117799 - RNA, 56 nt, Human
uauauauuacaaaagaggaaggauuucacaugaauguccuacucuuuuaauaugug

SEQ ID NO: 4117800 - RNA, 64 nt, Human
uauauauugcuagugguacuguaaauugauuccauuuuacagaagaguaacuuggcaauauaug

SEQ ID NO: 4117801 - RNA, 105 nt, Human
uauaucaaacuguuugagagcaauugaauagaugcauuauacuaugagagaaaaaagauuaguaaagcaugauuuaaucaagugcaaucuuauagaguagauaug

SEQ ID NO: 4117802 - RNA, 65 nt, Human
uauaucaccaaaaacaguucuggguggaauuaaacaccacauuucauguaacuuggugccauaug

SEQ ID NO: 4117803 - RNA, 76 nt, Human
uauaucuaggcugaauguaaaaucccuuauguuguaucaauggggguaaaaacuauuuuuauuugccuaugauaua

SEQ ID NO: 4117804 - RNA, 62 nt, Human
uauaugaauuuggcuggaaaggucgaugcuuggucaacagaccuugccacaggauucaugua

SEQ ID NO: 4117805 - RNA, 76 nt, Human
uauaugaccaauguggcauuuuuugauaucuuagucaguaauuugaaggucuagaaaugccauacgugccuaugua

SEQ ID NO: 4117806 - RNA, 87 nt, Human
uauaugaggauguccauugcagcauucauuuggagaauaaaauauugaaaaaccacugaaaguccagcaugguacauccuuacuaug

SEQ ID NO: 4117807 - RNA, 74 nt, Human
uauauggcacagcuauuuuauuuauucauguauuuaucaauuaauuugggaauggaaauagcaugugucauuua

SEQ ID NO: 4117808 - RNA, 130 nt, Human
uauauguaugugcuucuaggaagagcggguaaaugagaugacacacccugcccacuagcaaucugcuacuuuggcaccuagguuugggagggugaacagaaucauuuguuugucucagcaacugcauaua

SEQ ID NO: 4117809 - RNA, 71 nt, Human
uauaugugggauuauuugugcugucaucugcuaauuucacagaugucuucucaacuguagaccuucauaua

SEQ ID NO: 4117810 - RNA, 71 nt, Human
uauauguguguguauacauacauacacacguauguuauauaugugugcauguguguguacacauacaugua

SEQ ID NO: 4117811 - RNA, 58 nt, Human
uauauuaaccauaggguucuaguagcuguuccaguaguuuuuccugugguuugauaug

SEQ ID NO: 4117812 - RNA, 72 nt, Human
uauauuaagauccauugccauaucuuaacaaauggcuuagcauaagcugggcauuugauagggcauaauaua

SEQ ID NO: 4117813 - RNA, 127 nt, Human
uauauuagaaucacuggggagcuuuaaaaaaauccauaucuggacucuaccccagagauuuugguuuaauugguccaggauggggucuaugcacuguuuuaaaagcuccccagguggaucuaaugug

SEQ ID NO: 4117814 - RNA, 69 nt, Human
uauauucugugccauucuuuguagcaugaugaacucucauucugcccugccccaguggcacuggaugug

SEQ ID NO: 4117815 - RNA, 63 nt, Human
uauauuugugagacugacugaaguugauacauauaauguacuucauucauuuucacgaaugua

SEQ ID NO: 4117816 - RNA, 79 nt, Human
uauauuuuggaggcuugcuagagauacuggacauuuuacacacauuaucuuauuuaacacagcaaaacuuuaaagugua

SEQ ID NO: 4117817 - RNA, 72 nt, Human
uaucaaaacuuuuuaugaacguuguagacuaaaaauaguuauuuacucuuauaauguugaaggguugggaua

SEQ ID NO: 4117818 - RNA, 68 nt, Human
uaucaaagugauuuguaaacagggaaaugcaaauauuauacagaagagcccugugaauugguuugaua

SEQ ID NO: 4117819 - RNA, 73 nt, Human
uaucaaauuaguaaguuacucuugggcuauuuuaacauuuaaaaagcaaugcaguggcuuaaggaaaaugaua

SEQ ID NO: 4117820 - RNA, 126 nt, Human
uaucaacaacagcaaauaucauucauuauuguuuggaggacagaacuauuuuuauauucuuuaauuaaaaauggcuuugacauuuucaaauucagagggaaguugauaauuuagugcuguaugaua

SEQ ID NO: 4117821 - RNA, 72 nt, Human
uaucacagacagaggugacccugagcuggauggauagauaauccagccuuccuuuucacucucucuguaaua

SEQ ID NO: 4117822 - RNA, 127 nt, Human
uaucagaaccuccauggcuacucagccaggacugagaaugggagcaaacccaggccagaaagcuauggacuccuacuguucuuaucucaguuuuagcaguuuagcaguuauaaaggugucucugaua

SEQ ID NO: 4117823 - RNA, 58 nt, Human
uaucagcaccgcggacagcauccaggcagggaccggggagcuguccugggugcuagug

SEQ ID NO: 4117824 - RNA, 81 nt, Human
uaucaggucaucuguauguccucagcuuguuugccaccggcccacacccauagucagcuggagaucaugcugauacugaua

SEQ ID NO: 4117825 - RNA, 104 nt, Human
uaucauugaggcacauuggagccuccagguuuuacaaggucuauauagucuaaauagggaaauuguagaacugguuauuguuuuauauuaugucugaaaugaug

SEQ ID NO: 4117826 - RNA, 63 nt, Human
uaucauuguuacugcuggagcaggucggaggguaucuguaugccagaggcagucacaguggug

SEQ ID NO: 4117827 - RNA, 63 nt, Human
uaucauuucacacuuguuaggauggcuuuuauaaaaagacaagagauaacaaguguguggaua

SEQ ID NO: 4117828 - RNA, 80 nt, Human
uauccaaagauuucugcuuuuggaggcagauagccuacuuucguguccuccaaacaaagccaguauaagaacuuaggaua

SEQ ID NO: 4117829 - RNA, 61 nt, Human
uaucccagcaucuaugugcuguugauaguaacaguccacugccacauagaugcugaagaua

SEQ ID NO: 4117830 - RNA, 89 nt, Human
uauccccacaguuuaugaagcugaccuugucuugcugaugguauacucuggcucaggcagggcauggaugguggaauccuuuggggaug

SEQ ID NO: 4117831 - RNA, 91 nt, Human
guuuacccugaggacucuugcugggccagaagacauuuaggaugcucugacuuagcucuuaaggagucugguugggaagaguuauuuaagc

SEQ ID NO: 4117832 - RNA, 88 nt, Human
guuuacccuggagaagagaagacuuaagggugauuuaaugcuguuauugaagcauaagaggguucuuuucuagagccuccugguaagc

SEQ ID NO: 4117833 - RNA, 115 nt, Human
guuuacugcuaaaauuccuaaaacagagcugaguaucccacugaagucccaaaauaugacugccugauguggacuuaaagggaaacuugaguugugagaaaucuuauuuaugaac

SEQ ID NO: 4117834 - RNA, 127 nt, Human
guuuacugcuguuucugggcugagagcaagacagaagccagaggcaguggguacucuugucggcaagggcugcccugcaucugugccuuccaguaagcuugagacgaguuuggagacggcuguagau

SEQ ID NO: 4117835 - RNA, 88 nt, Human
guuuacugucaguuuagucauccugaagcaugaaugucaaaaggcuacuccuguuugcucacaauuuuuaguuugaccuucagugaac

SEQ ID NO: 4117836 - RNA, 103 nt, Human
guuuacuuccauuuugugcagagguuauaaaaugagcgauaaaugauuuugaauccuugucauugguaauuauuuuugacaugcacaguagauuugggaaaac

SEQ ID NO: 4117837 - RNA, 80 nt, Human
guuuacuuuguaaaaccagcaacuccuguagcuuaugcauaguuagugcccuauaugaauuugcugaggaccaagugaau

SEQ ID NO: 4117838 - RNA, 111 nt, Human
guuuagacuaucauuucuugcauaucaacccaagcauacugugagaguuuuaaacaagaaucuuaauaaagcuauuauaguuauguuuuaaagaaguggauuuguuuaaau

SEQ ID NO: 4117839 - RNA, 120 nt, Human
guuuagcaaaaaccugaauguuuuauagagaagucuucauuuugaagaggcagaaaccaacuggauuuagcuuaaauggagaaagaggagauuuauuuuuaggacauagggaugucuaac

SEQ ID NO: 4117840 - RNA, 108 nt, Human
guuuagcugaagcugagacagauuuagguagaagacuuauauugcucuccucugagaucccauugaaaguccuaucuaagggagauauucugcucuuacagcuuugac

SEQ ID NO: 4117841 - RNA, 63 nt, Human
guuuaggcuuuaaguggccuacagcuccuuccuggagcaugcuaccacucaagcucuuuaaac

SEQ ID NO: 4117842 - RNA, 81 nt, Human
guuuaggucaggccuggcuggguugaagcggggacccuugagggacuuugcugugucagcuucagcuucccggucuuuaac

SEQ ID NO: 4117843 - RNA, 69 nt, Human
guuuaggugugugaaguuguggucauuuuagcaggguaaucagaggccaaaucuugcacacucuuguac

SEQ ID NO: 4117844 - RNA, 70 nt, Human
guuuaguaaguguucuagggauuguaaccaucugaugaagagccaguuacaacuguggagaaauauuaac

SEQ ID NO: 4117845 - RNA, 88 nt, Human
guuuaguauaugaugaauaugguauuucacacuugaucuuagccaaaagccugagaaguaaugaauacgguauuugaaaugacagggc

SEQ ID NO: 4117846 - RNA, 74 nt, Human
guuuaguggaaugggaaguguaaugggcuggaagggaacccaccucuacaacauuaugcuuucuguccuuaggc

SEQ ID NO: 4117847 - RNA, 64 nt, Human
guuuaguucugggcuccaaacucaaggaguggcauuaagcgacuggugcgaggccagagcagac

SEQ ID NO: 4117848 - RNA, 55 nt, Human
guuuauagauggcagagcuaggagugaaacccaggcagucugugauaguguagau

SEQ ID NO: 4117849 - RNA, 64 nt, Human
guuuauaguuugaaagugaugugaaggaaacagaaucaaucacagacacauuaaacaugugaac

SEQ ID NO: 4117850 - RNA, 65 nt, Human
guuuauauacaaucaucauuauauucccagugacugggcaauuuguagauggugauugaaugaau

SEQ ID NO: 4117851 - RNA, 73 nt, Human
guuuauauaugcuauugccuguaucuucagaagucuccaacuucugaggauagaggcaauaggacauauaaac

SEQ ID NO: 4117852 - RNA, 111 nt, Human
guuuaucacuaaaauucuauggcuuugggauugauuuauugucaaguaugaugacuguuauacuucaacauaucagucagaaucacagaaaaauagauaauaaagaugaac

SEQ ID NO: 4117853 - RNA, 64 nt, Human
ucacucagcacugaggaucugcgugauauuuaacaaauuaccagcaucacagcauguuggauga

SEQ ID NO: 4117854 - RNA, 74 nt, Human
ucacuccuuugauuaaaaguggcacaguuauuugugacccuuacugugcauuuaguuuuaauaaaggagccuga

SEQ ID NO: 4117855 - RNA, 88 nt, Human
ucacucucugggcagauguaauuacucaagucaauggccuacugacaaauaagcauugaaauugucaaaauuaaauucccagagggga

SEQ ID NO: 4117856 - RNA, 56 nt, Human
ucacucugacuuggccuccaacacacuuccccucauguuggaaggagccagagugg

SEQ ID NO: 4117857 - RNA, 84 nt, Human
ucacucuuuucagaacaaccaugguuagauccagaaauccaggacugugggccauuggguucuguaucaauuuucaaaagguga

SEQ ID NO: 4117858 - RNA, 71 nt, Human
ucacugaaaguuugagugauuugacacaguucuugagugugucagauuuaggcucaaacgcagucaguuga

SEQ ID NO: 4117859 - RNA, 74 nt, Human
ucacugaauguguccacaggugugagagaagggcuggaugcugugccucucucacaguugcagggcaguagugg

SEQ ID NO: 4117860 - RNA, 117 nt, Human
ucacugacucugacaacaucccuuuuucuauagauagaaauauauaaguacaggggcaugccacuuaauacaucauucaucuaaggaagagguauguauuugucagcugguaagugg

SEQ ID NO: 4117861 - RNA, 67 nt, Human
ucacugagguacuggccuccauucaacaauauuugauauucaagaauguauguuaguaucuuagaga

SEQ ID NO: 4117862 - RNA, 58 nt, Human
ucacugcagccucgacuucccuggcuuccgucagccucgacuucccuggcuugcguga

SEQ ID NO: 4117863 - RNA, 66 nt, Human
ucacugccaaucugaagagcuucuuuuugaagacggaaguagcauggggagucuuagauaugcuga

SEQ ID NO: 4117864 - RNA, 59 nt, Human
ucacugggcccugaggugggacaucaaauaauuagaaauuccuuuuuauggcuuagugg

SEQ ID NO: 4117865 - RNA, 98 nt, Human
ucacuguccaguuacuuuuuccaacaugccagacauuaguuuguaggaucccuacgcuagagugcaggcauaguugucaaaguguaggaaucaguuga

SEQ ID NO: 4117866 - RNA, 58 nt, Human
ucacuguguaagaagaugggcuuagugacuuacucaaguacauauauuuagauaguga

SEQ ID NO: 4117867 - RNA, 80 nt, Human
ucacuuauaaaaaugagggcgguagcuagauaaguuaguaucacauauuguuuuguuaccgaauuccuuuuuucaaguga

SEQ ID NO: 4117868 - RNA, 66 nt, Human
ucacuuccccaucauguagagcagcucaggucuucucuagcucuuccaccucaugauggguaguga

SEQ ID NO: 4117869 - RNA, 126 nt, Human
ucacuucuuuucuucucucucccuucucucaguguucucaaauuuauacagaguucagaguuaauucacccuggauucaacaguagauaugaaauacugagaaggaggauaaugugaaaagauugg

SEQ ID NO: 4117870 - RNA, 71 nt, Human
ucacuucuuuugugauuauucaguuacuucaggccaucuggauguauacgugcaggucacaggggauauga

SEQ ID NO: 4117871 - RNA, 76 nt, Human
ucacuugaacucagaagguggagguugcagugagccgagaucgugccauugcacucccgccugggugacagaguga

SEQ ID NO: 4117872 - RNA, 70 nt, Human
ucacuugagauguuugcaccugguaagaauguuucaaaccuugaauucuacuuuguguaauuaucuguga

SEQ ID NO: 4117873 - RNA, 64 nt, Human
ucacuugggcucucucugauauuagcuuaccaucagugagcauagauacauugagccacauuga

SEQ ID NO: 4117874 - RNA, 66 nt, Human
ucacuuuaagagaucaccaaucacacuugcacauucaaguaucugugaaggugcuccugaaaauga

SEQ ID NO: 4117875 - RNA, 67 nt, Human
ucacuuuaagcgggaggcagagguugcagugagccaauaucaugccacugcacuccagcuuggguga

SEQ ID NO: 4117876 - RNA, 57 nt, Human
ucacuuuaguuucuuuauacuuuucucaugggaaguacacuaugguaacuggaguga

SEQ ID NO: 4117877 - RNA, 124 nt, Human
ucacuuugcacacuucugagugguuuugaugucucagggucucaggugucucagguucccaucccagcacugcccaggcacccaucuugugcucauagauccaaacuugcaagaaguuugcuga

SEQ ID NO: 4117878 - RNA, 57 nt, Human
ucacuuuuugauaucauucugccacuauugggacaggaccaacugauauagagguga

SEQ ID NO: 4117879 - RNA, 130 nt, Human
ucagaaaaaaagccaguggcuggaucacauaaauaaauuuggaaagagaugaagcucaacagguaggugaggaccacgcuauuucaggcuauauuucuuguuuauugugccucauugguuuuguuuuaaa

SEQ ID NO: 4117880 - RNA, 68 nt, Human
ucagaaaggaguuagaggucucauuuuagagaagguuaauauacuaaagacauuuaauugcuuucugg

SEQ ID NO: 4117881 - RNA, 80 nt, Human
ucagaaauccuggaguaggccuuagccaucuguguuuuaacaauuccuccagaugauacugaugccugcuugaguuuuga

SEQ ID NO: 4117882 - RNA, 72 nt, Human
ucagaaaugguuugcuagucugaucuaugauccuacuguuagaaaaggcauuuugucaaccauaauuuuuga

SEQ ID NO: 4117883 - RNA, 57 nt, Human
ucagaacagugccuggcacuaaguaaccauucaacauaugcuaguuauuguuucuga

SEQ ID NO: 4117884 - RNA, 57 nt, Human
ucagaacauuacauuuugagcugcugauguagaagugcucaaaaacuaguguuuuga

SEQ ID NO: 4117885 - RNA, 64 nt, Human
ucagaacuuggacuccagacuccuguuuuuugguuugugucaggcaucuggagggaagcuuuga

SEQ ID NO: 4117886 - RNA, 57 nt, Human
ucagaagacuacuaggacacauaauccucuucaaauguuuccuaagugguuugcuga

SEQ ID NO: 4117887 - RNA, 86 nt, Human
ucagaagaucuuguucccauuccuuguucuuuaaauguuucaaaaaucacagaacugaaggaagcagaagcgagguuucaugcuga

SEQ ID NO: 4117888 - RNA, 63 nt, Human
ucagaagggaaacacaagugaccuuaaugaaaugaagccguggucaugcuuucuccuuccuga

SEQ ID NO: 4117889 - RNA, 62 nt, Human
ucagaaggucacacuuggaucauagaaaagccagagagguguuauuaugaccuguguucugg

SEQ ID NO: 4117890 - RNA, 106 nt, Human
ucagaaguaagauuacuaggauauaagaagagugagaugagcuuaagacuguggauagauuucgcugcaucucaaucaguaucugaauucaagaauguacuuuuga

SEQ ID NO: 4117891 - RNA, 69 nt, Human
ucagaaguagggaaauguuuuacuuagagauuuaaaauacuuaauuucauuacauuucuaugcuucugg

SEQ ID NO: 4117892 - RNA, 60 nt, Human
ucagaagugcuggcuggacauggagcacugcuacggugaccagcgcagccaccacuagga

SEQ ID NO: 4117893 - RNA, 66 nt, Human
ucagaaguuagacuucaacuaauucagcaaggccccaucauguauuagaaaaagucugaguucuga

SEQ ID NO: 4117894 - RNA, 102 nt, Human
uaucccuuuaaaucccgcgagggguguggcuggggagccccgacucccggguuccggcccgcggagcuccagcccgccccgccgcgcaaggguuaaccgaua

SEQ ID NO: 4117895 - RNA, 62 nt, Human
uauccuuguacuucgggcauugccauaagaaccuugcagcauaggccacuagugccaggaug

SEQ ID NO: 4117896 - RNA, 62 nt, Human
uaucuacaguuaauaugucaucuguagucuauuauuuacaguuaauauguuaccuguaggua

SEQ ID NO: 4117897 - RNA, 129 nt, Human
uaucuagagagucacaagauggaauggcuucuagagcccuuccccucuuuauuggacagauggagaaacugaggcccagagaggggaagggcuugcccaaggccauacagaaauuuuauggcagagaug

SEQ ID NO: 4117898 - RNA, 60 nt, Human
uaucuagauauuuggauaaaugcaguuauaaauucuugcuuuaucauuuccgucuggaua

SEQ ID NO: 4117899 - RNA, 56 nt, Human
uaucuagcaguguuauaauuggauacaugagagugauucauaugauccugcuuaua

SEQ ID NO: 4117900 - RNA, 69 nt, Human
uaucuaguauggcuucugcuuucuugacuguacccagacuuauacaccagugaaagcauagcuuagaug

SEQ ID NO: 4117901 - RNA, 85 nt, Human
uaucuccaugauggcuuguuuagcauaggucacugggagccucccagaccuggaaaacaggcuugcccaugguuuaugccaggua

SEQ ID NO: 4117902 - RNA, 73 nt, Human
uaucugaaccucaguguccucaucuguaaaaugaggagaacaccuccuacaucugaggaugacuguaaagaug

SEQ ID NO: 4117903 - RNA, 58 nt, Human
uaucugaagggcuaaggguuuuagaauuuguauuccauagaauucuuacccuuugaug

SEQ ID NO: 4117904 - RNA, 79 nt, Human
uaucugcucaaagagaugaugagauaaggauaacuucaaaguaauggaagaacuaacuagucucaucucugaggagaua

SEQ ID NO: 4117905 - RNA, 75 nt, Human
uaucuggaacaaaugacacauugaugugaguacauagcagaaaguguuguucaaugccuaguauguucacagaug

SEQ ID NO: 4117906 - RNA, 58 nt, Human
uaucugggaaaggagaccugaggugagcguggagugaucaccuuuccuuucucagaug

SEQ ID NO: 4117907 - RNA, 109 nt, Human
uaucuguaaaaugggaaggguauauuagaugugaauuaggcugauguaagaaagcaaaagauguuacacagaaccugguguacaguggguaugacuauuguugaagaug

SEQ ID NO: 4117908 - RNA, 66 nt, Human
uaucuuaaaggagguuuuguuuccauaauucacuucaguuguggaagcaaaauauccuuuaaugua

SEQ ID NO: 4117909 - RNA, 72 nt, Human
uaucuucauuagaaaaguaaaaaugcuggagaacccuggguuugauaggcauggagcuucguggugaaggua

SEQ ID NO: 4117910 - RNA, 67 nt, Human
uaucuuccagaaauaucaccuggacucuagacaaguguguggguaggaaguguuucugggacagaug

SEQ ID NO: 4117911 - RNA, 86 nt, Human
uaucuuucugcaagaucugcuccagugugguauucuauuuaauaauguaaaaugcuauuucauggaggagagaguacggaaaggua

SEQ ID NO: 4117912 - RNA, 61 nt, Human
uaucuuugccuuggguuuuguucucuccacagacugagauccagugcccguggaaaagaug

SEQ ID NO: 4117913 - RNA, 102 nt, Human
uaucuuuuccuccuaagaacacuaugauuauaauaaaaccgucauauaucuguggacacuccuaauauuugcaggcuuuugucaugguggggggaaaagaug

SEQ ID NO: 4117914 - RNA, 63 nt, Human
uaugaaaacaauguuuuauuuccuauugagagaauaggccaggcaugaagcauuguuuuugua

SEQ ID NO: 4117915 - RNA, 67 nt, Human
uaugaaacacuggaagggacaucaagugacaaucucauugagucccugucuccauugugaccacaua

SEQ ID NO: 4117916 - RNA, 88 nt, Human
uaugaaagguaagauuggguacgauuauuuuaugguauuuuagaauucaaguuuuguuuaauccuuguacccaugcuguauuuucaua

SEQ ID NO: 4117917 - RNA, 76 nt, Human
uaugaacauaaauuauuuacagugugcucgaagagcucagaagggcuuuguaagguaaauaauuuauaaacucaua

SEQ ID NO: 4117918 - RNA, 80 nt, Human
uaugaacuacuauucuuuuccaaacugucaacuucuguuugaaaucauugugggggauaguuuggaaauaugguggcaua

SEQ ID NO: 4117919 - RNA, 78 nt, Human
uaugaagucccugaaacacagcuuuacuuguuaaaacacuacccccaaagaggugcacugucuaauuaggucuucaug

SEQ ID NO: 4117920 - RNA, 65 nt, Human
uaugaauucuguucauugaugacuucacuuaagaaagguuugugcuuaguggacaguauuacaua

SEQ ID NO: 4117921 - RNA, 95 nt, Human
uaugaauuuguauuuaaaucaauguuagucaugaauuuucaauacauuggaaauuucuaguguugcuaauauuaugguuuaagaaaauugucaua

SEQ ID NO: 4117922 - RNA, 78 nt, Human
uaugagaucauauucuguucuugaucuguauauuaugaaauauuuaucucacaauucaagaagagagaugaaaguaug

SEQ ID NO: 4117923 - RNA, 130 nt, Human
uaugaguucuauuuuaccuguucugguucaagggcuauaugaguuucccacuucuggaaaagauaacauuuucuagaaguguaaaacucauauagcccuugauucaugcuuuucuguggaauccaauuug

SEQ ID NO: 4117924 - RNA, 77 nt, Human
uaugauauuccuggguagccuguccaagauggcaacucucaaagccuacaucuuugaaugcauugaggcaugucaua

SEQ ID NO: 4117925 - RNA, 73 nt, Human
uaugaugagaaaaagagcugaaagauuacugauguaauuuauaacagguuaguauuuuuaguucaucauuaua

SEQ ID NO: 4117926 - RNA, 67 nt, Human
uaugauuaggcauauggcacaugauagaaaaucaguaguuuuuuaucuagauuguuaugcuuucaua

SEQ ID NO: 4117927 - RNA, 98 nt, Human
guuuggaguuuagaccccaagaaguuagcuguggccucauguuugguguuugagucacgaauguggggaagccauggcugaugugucagcucacaaac

SEQ ID NO: 4117928 - RNA, 68 nt, Human
guuuggcccagggucagcggcgcucccugcaggccgguggggauggccugagagaauucugggccagc

SEQ ID NO: 4117929 - RNA, 65 nt, Human
guuuggcugguuucaagaaggcaucucugaggaaaugacauuugaauugagaccgguuaacaaac

SEQ ID NO: 4117930 - RNA, 117 nt, Human
guuuggguuuuuuuaaauggacagucuacauuuucauuuguucugcugaggccaguaauggcuaugcuaaacagugagaagguggacaggaauuuaaaacugaucacaaauccaaac

SEQ ID NO: 4117931 - RNA, 78 nt, Human
guuuggucuccauggagcccacagggaggcugcuguuaccuggcggccuucucccugggcaucacaggagagucgaac

SEQ ID NO: 4117932 - RNA, 55 nt, Human
guuuggugagcagcuuggguaucacagcacugucccaagacucuuuuuaccaagc

SEQ ID NO: 4117933 - RNA, 69 nt, Human
guuuggugucccauuuaucuagaugucagaugcaucauggcuuuaacucucuagaaaauggcuacaaac

SEQ ID NO: 4117934 - RNA, 56 nt, Human
guuugguuuaugaguggggacagcuaauagauuuaguauuuacucauaggccugac

SEQ ID NO: 4117935 - RNA, 83 nt, Human
guuuguaaaggggagcgugaauuaguugguacacaguugaucgucugugcaguagggucaugcucacacgucccuccacacac

SEQ ID NO: 4117936 - RNA, 59 nt, Human
guuuguaaccagaacagagagucagauguaacaagcugacucugggcugcguugcaaac

SEQ ID NO: 4117937 - RNA, 85 nt, Human
guuuguaaucuagggaaagaagcagauacauaaaccacuaggugaaauacuaguguauuugucuggcuucuccagaaaaacacac

SEQ ID NO: 4117938 - RNA, 78 nt, Human
guuuguacuuggauuuaguaaaauugagggaauuuuggggcucuucccaauuucuuccucauuugccuguuugcagac

SEQ ID NO: 4117939 - RNA, 130 nt, Human
guuuguagcucucuggaccgggaaaaugccugucauuaagguggcccauucauaguaugaccuaugucugcuucaaaaugagcugggccauccagugaucuuggcauucugagcuuagaaauacaaagac

SEQ ID NO: 4117940 - RNA, 90 nt, Human
guuuguaggccuuucuggauuaaguaaaauagaggaagguguaguccuuccaccucuugcauugguuaguuucgggaaagaacuacagau

SEQ ID NO: 4117941 - RNA, 72 nt, Human
guuuguauugacugugaaucuaaguuacuaagaaaaauuagugauauuagcaaaugguuauacuaugcaaau

SEQ ID NO: 4117942 - RNA, 72 nt, Human
guuugucaauuaugaguaaaaccacuauuuacagauaaauaucuguaaagguuucaauucauuuggguaaau

SEQ ID NO: 4117943 - RNA, 64 nt, Human
guuugucauccuuggcuugcccucuucagcacuuccguguaaggucaaccacaagcugacaaac

SEQ ID NO: 4117944 - RNA, 61 nt, Human
guuuguccacucccguaucccagcaccaagaagagugccugggacaugguaggggcacaac

SEQ ID NO: 4117945 - RNA, 72 nt, Human
guuugucuguugauuguggauuuuuauauauacauuauauaauuauguauaaguacacagucggaauugaac

SEQ ID NO: 4117946 - RNA, 57 nt, Human
guuugugugaguguacauaugugugugugugcgugugugugugacucauacuagaac

SEQ ID NO: 4117947 - RNA, 59 nt, Human
guuuguuaaucucuugguuuuauuucaaaaaugaaacuauauuuagagagggaacaaau

SEQ ID NO: 4117948 - RNA, 59 nt, Human
guuuguucauggcugaugcuugcucgcagccucgcccuaagcaugcagccagagccaac

SEQ ID NO: 4117949 - RNA, 128 nt, Human
guuuguucuaaaagugauaagaucuauaauaguuuugaaucaacuuugccuucagugcuuuccaaggagagagauuacugaaaaaguaugauucacuguaaugauccauugucaugaguggaauuaac

SEQ ID NO: 4117950 - RNA, 74 nt, Human
guuuguuuccaaagucuuuucuuaaucuuugugugcucaguacaaguucaauuacagagaagaggaacacaaac

SEQ ID NO: 4117951 - RNA, 129 nt, Human
guuuguuucucuggugcugcccugacuugcucuguuuacaguuuuuaguacccucaguguguguaccucucuaacuucagggcuuucuuuguaaaagaagggucagaacuugucacagagucacaaaac

SEQ ID NO: 4117952 - RNA, 75 nt, Human
guuuuaaaaauaguugcuuuguguacacaagaaucaacaccaguugauucuuaacuccaaggcauaaaaugaagc

SEQ ID NO: 4117953 - RNA, 130 nt, Human
guuuuaaaacauuaguuugaaaauucuggauauuacuuaucuauccccucuccaggccucaaaccaggauuaugaagauuaguaucauuuccaggguuuuccucuuuaauuauauugaauguaacaaagc

SEQ ID NO: 4117954 - RNA, 81 nt, Human
guuuuaaaaugaugagccagcauauauauaguugaauacauguaaaaaugagaguucagcauaggcugcucuucaaugaac

SEQ ID NO: 4117955 - RNA, 77 nt, Human
guuuuaaaauuuuguuuuaguggaggcuguguucaguucuagugcaguuuaugcagcuggaauagaauuuauagaac

SEQ ID NO: 4117956 - RNA, 74 nt, Human
uauguacaaguuuuugugugaacauguuauuguuucacuauguauguaucauuucacacauaaacuuggguaua

SEQ ID NO: 4117957 - RNA, 58 nt, Human
uauguauacauuuaacuagauagaaauggaaccaucgucuauaagugauguaggcaua

SEQ ID NO: 4117958 - RNA, 56 nt, Human
uauguauauagcagaaguacauaugcuacauaguaugagguacuaguauauacgua

SEQ ID NO: 4117959 - RNA, 59 nt, Human
uauguauaucuggauauauguguagaauauauucaccugcacauauguggauauacaug

SEQ ID NO: 4117960 - RNA, 70 nt, Human
uauguauugcuucauaauuguugccaaagcuucuccuaggaguuuggugcaaggcaaugaagaauaaaua

SEQ ID NO: 4117961 - RNA, 123 nt, Human
uaugucaaaauguggaaauaucacuaauuuccuuggguuuccacuggcagcguagcucccaaaauuuaagacaaauucuaccugcagcgggaauccauuaguauccaauccacguuuuauaua

SEQ ID NO: 4117962 - RNA, 58 nt, Human
uaugucucauggaagggcauuaucugcucugggauguccugcagaaacaugagaaaug

SEQ ID NO: 4117963 - RNA, 81 nt, Human
uaugucuggauucuaauucuguauuuggucauuggauauagcaucugugacauaaaaacagcaaucagaaguacaggcaua

SEQ ID NO: 4117964 - RNA, 77 nt, Human
uaugugaauucucagaaggcaagggcuggggguaauacugcuuuuaaugaaaaucugcuuuuaugaguuuucagaug

SEQ ID NO: 4117965 - RNA, 67 nt, Human
uaugugauguuggcaauuaacauauacaguuuuuaccagcugucaccacauuugucaauaucauaug

SEQ ID NO: 4117966 - RNA, 62 nt, Human
uaugugcauuauuaccaguggacacauccaucaucaugaagccauggguauuaaugcauaug

SEQ ID NO: 4117967 - RNA, 81 nt, Human
uaugugccucaaguauuuccucugucaaauguaguaguuaggccuaagcuguauucugggcagggaaggagaaggcauaua

SEQ ID NO: 4117968 - RNA, 65 nt, Human
uauguggaaauuuaucaagauauacaguugagugcacucauguaugugugauaaacuuccaugua

SEQ ID NO: 4117969 - RNA, 102 nt, Human
uauguggauaacagaugcacauucucaucagcaaccagucacaucacuucuuccaaugucugucuguuggugcugggucauggugcauuucuuaucaguaua

SEQ ID NO: 4117970 - RNA, 80 nt, Human
uaugugugugcauguauguaaaugugagcguguacauauguacauccauacauacagauaugcauucagaaauauacaua

SEQ ID NO: 4117971 - RNA, 68 nt, Human
uauguuauuugaaccaaauuuguuuggaagaaaugauucugugggcaaaaugguuuaaaaguggcaua

SEQ ID NO: 4117972 - RNA, 72 nt, Human
uauguuauuugggaaaguuguacaguucagaugugaacauuucaauguauuuaagcuuuaccuaaaaaugua

SEQ ID NO: 4117973 - RNA, 60 nt, Human
uauguugagugaaagaagcuagaugcaaaagagcacauaguguaagcuuucauuuauaug

SEQ ID NO: 4117974 - RNA, 79 nt, Human
uauguuuguguuuauauguguauccaucugucuauuuagaauuuuuuaaauaugcaggggugcacuuggaucacacaug

SEQ ID NO: 4117975 - RNA, 59 nt, Human
uauguuuuagcccagugaccacacaugggggcagauaggugugguccaguucagauaua

SEQ ID NO: 4117976 - RNA, 82 nt, Human
uauuaaaacacagacugcugggccccaucccucgagcaucugauucagugugggguugggguuagucuuuugcauuuuaaua

SEQ ID NO: 4117977 - RNA, 129 nt, Human
uauuaaagguaguugagaaggugcugacgucaccagcucucaggaggaugacugccuuggaaaaacagcuuuuaaaggcaguaauuccugaguuuaguagaugcaguuuugccucuuggcugggaauga

SEQ ID NO: 4117978 - RNA, 56 nt, Human
uauuaaguaucuugaugacaaacagcgauauguuauuugucagauuuugcuugaug

SEQ ID NO: 4117979 - RNA, 122 nt, Human
uauuaauagcauuguugaacaacuaaauaaaagucuuacauaauaguuuggauaguccuuuaugcuaacugcuauuaugugaguuuugcuuuucuggcucuuuugauaucauguuacgagug

SEQ ID NO: 4117980 - RNA, 59 nt, Human
uauuacagcucuuacuccgaaauuuuaaaaaugagguuucacaauuuagagcagugaug

SEQ ID NO: 4117981 - RNA, 87 nt, Human
uauuaccguucugacagauauguuggguucuuguuuguagucucuacaacaauaggaccuuuauguucuacaaagaaauugguaaua

SEQ ID NO: 4117982 - RNA, 77 nt, Human
uauuacucaggccagaguccaacuccagaaauucugacuccguuggucuggagugggacuuugcaucuuuaguuuua

SEQ ID NO: 4117983 - RNA, 123 nt, Human
uauuaggaacaagcaguguugggcaguggguggaucucagggauggaugcaaacuugccucugcaguggugagcccauguucucuuccaauccacuaagcucagccaacagauguucuuagua

SEQ ID NO: 4117984 - RNA, 84 nt, Human
uauuaggcuguugcaaaaauaauugccguuuuugccauugaaagugauggcaagaaccacaauuacuuuugcaccaaccuggua

SEQ ID NO: 4117985 - RNA, 57 nt, Human
uauuagguaaguauuugugguguuuuuuuccauacaaaacaagucacuuacuuagua

SEQ ID NO: 4117986 - RNA, 59 nt, Human
uauuagguaugaacuggcaaccauguguugguacaggcucaaguucauauggacugaua

SEQ ID NO: 4117987 - RNA, 62 nt, Human
uauuagguuagugcaaaaguuuuaauggcaacaaccacaguuacuuuugcaccaauuuaaua

SEQ ID NO: 4117988 - RNA, 65 nt, Human
uauuagguucaugaaauuuucaggaauuaaaguuaguccugaggaaaguucaugaaugucuaaug

SEQ ID NO: 4117989 - RNA, 75 nt, Human
uauuagguugguacaagaguauuugcgguuuucaccacaauuaaaaaccacaauuacuuuugcaccaauguaaua

SEQ ID NO: 4117990 - RNA, 94 nt, Human
uauuagguuggugcaaaaguaauugagguuuuugcuauuacuuuuaauuuuugcuauuacuuuuaaccugaauuacuuuugcaccaacuuaaua

SEQ ID NO: 4117991 - RNA, 86 nt, Human
uauuagguuggugcaaaaguaauugcgguuuucccauuaaaaguaaagaaagguaaaauugcaauuacuuuugcaucaaccuaaua

SEQ ID NO: 4117992 - RNA, 71 nt, Human
uauuagguuggugcaaaaguauugcgguuuugccauuuaaaaacugcaauuacuuuugcaccaagcuagua

SEQ ID NO: 4117993 - RNA, 84 nt, Human
uauuagguuggugcaaaagucauugcagcuuuugccauugaaaauaauggcaaaagcugcaaugacuuuugcaccaaccuaaua

SEQ ID NO: 4117994 - RNA, 129 nt, Human
uauuaguuauucuucagauauuuuaauuauauagcuuucauaauggcucuaaaaugacauacaaguuuaggaucaaugagaaagucuaugguaguucuguuuccuaaaauuaaugauugauaacucaug

SEQ ID NO: 4117995 - RNA, 78 nt, Human
uauuauauuuuggaauuaugcuuaaaguuucacugcugaaauuacuuugaaggaaauggcgucuuccaaaauaaagua

SEQ ID NO: 4117996 - RNA, 81 nt, Human
uauuaugccaugagucauuucucuaguccauucugagacacugauaaaaaagauuugugauagaaauacuuugguauaaug

SEQ ID NO: 4117997 - RNA, 100 nt, Human
uauuauguugcauugguugauugucacucccuauaugguaacuucccccaaaaaaaugaagaugcaggugugguuggugucaggacagccuguuaugaug

SEQ ID NO: 4117998 - RNA, 69 nt, Human
ucacucaaauuaggaugacuugaggacgguuuaauaaagagacuauuuacaaagacaugcuaggggugg

SEQ ID NO: 4117999 - RNA, 87 nt, Human
ucacucaacaaaagcugugcuaggcuaggggauggaguagcaaacaaaauugaaauucuaaagcuuguggagcuuauguucuagugg

SEQ ID NO: 4118000 - RNA, 59 nt, Human
ucacucaauaucccaguggggcccaaauacuuauauagccuuauuugagaggggaguga

SEQ ID NO: 4118001 - RNA, 83 nt, Human
ucacucagaugguagguggcaggacugaaauuaauacuccuuucugcuguguucaaaucacucugccuccauauuacuaguga

SEQ ID NO: 4118002 - RNA, 69 nt, Human
ucacucagguuucuucuuaggaauauguuucuaccuuaagaaauucuauaaagaagaggcuuguuuuga

SEQ ID NO: 4118003 - RNA, 114 nt, Human
ucacuccauuagauugugaguucccauggacuuugucuaucuaguuccaggcaugguccucaugcucuggaauaguccuaggcacauauugggugcucaauguuuguggaguga

SEQ ID NO: 4118004 - RNA, 108 nt, Human
ucacucgaacccaggaggcggagguugcaguaagccgagauugcgcuauugaacuccagccugggcgacagagcaagacuccgucuccaaaaaacggaagagaagaga

SEQ ID NO: 4118005 - RNA, 58 nt, Human
ucacucguuaaaaaaaugcagaugcuaaaugucacgcguuuacauuuugaaacaguga

SEQ ID NO: 4118006 - RNA, 77 nt, Human
ucacucucaagcaaaguaugugcugggagcuuaaagagaaaaaauaagcuuaagccaaauacuuugguuuccaguga

SEQ ID NO: 4118007 - RNA, 76 nt, Human
ucacucuguggcccagguuggagugcagugguguaaucucagcccacugcaacuucugccuccuggguucaaguga

SEQ ID NO: 4118008 - RNA, 76 nt, Human
ucacucuguugccuaggcuggagugcagugacccgaucuuggcucacugcaaccucugccucacggguucaagugg

SEQ ID NO: 4118009 - RNA, 77 nt, Human
ucacucuuguugcccaggcugaagugcaauggcacgaucucggcucacugcaaccuccgucucccggguucaaguga

SEQ ID NO: 4118010 - RNA, 129 nt, Human
ucacugauaagaagcuaucuuuaagaucucagguuggucugcuucagaaacauguggcucugacagauagauagacagucaugcccugccaagcaggcuaaaucuuagagugcagguauccacaaguga

SEQ ID NO: 4118011 - RNA, 56 nt, Human
ucacugcagaaaacagcaggugcucauccacucauuugcagugauucuugcaguga

SEQ ID NO: 4118012 - RNA, 55 nt, Human
ucacugcagagaccucuagucauaauauucgaugcacuagagcagcucucagaga

SEQ ID NO: 4118013 - RNA, 59 nt, Human
ucacugcaucuccccaucuguuucccuccauguaucugaaccagaggaaagagcaguga

SEQ ID NO: 4118014 - RNA, 86 nt, Human
ucacuggaaauuuuaugagguaugcugaacucuguuucugaaaaguacaaacauuagacaccauaugcuccugaaaugcuccagga

SEQ ID NO: 4118015 - RNA, 63 nt, Human
ucacuguaauagguuugaagauaggggaagaaaagauccuugcucucaagaacuuacagauga

SEQ ID NO: 4118016 - RNA, 79 nt, Human
ucacuguagagucuguuuccacaaaccacucccggcccuggcuuagguuggguucuccaggaaacagacucugagauga

SEQ ID NO: 4118017 - RNA, 59 nt, Human
ucacugucccuguccucuuaucuguagaaagaggugagugugacagagggggcagguga

SEQ ID NO: 4118018 - RNA, 75 nt, Human
ucagaauagaggugucacuuugggaaguaaguaacccagagaucuagcuucucaugaaaucucuagcuauguuga

SEQ ID NO: 4118019 - RNA, 61 nt, Human
ucagaauuuagcauuuuaacaagaucuccugcagaucuguuguuuguuugcuaaagcuuga

SEQ ID NO: 4118020 - RNA, 58 nt, Human
ucagacaggcuggacagcuugcuuacagaagcagagccaggauccggaucugacuuga

SEQ ID NO: 4118021 - RNA, 61 nt, Human
ucagacaugggauaugaagcucugagaacuucugacucauuuguuuggauccccuguuaga

SEQ ID NO: 4118022 - RNA, 58 nt, Human
ucagacccaggugccaagcuguacgggcaugcugccagcagccaggacuuugggcugg

SEQ ID NO: 4118023 - RNA, 127 nt, Human
ucagacgugaggcuuccuuccuggguucuuucuggcugcgcuaguccagaagaccagcaaacccgagauggucugagguggacgauggagccugaauggagagccuggggcgugagccagggucugg

SEQ ID NO: 4118024 - RNA, 65 nt, Human
ucagacuguccacauggagaaccugguuuggauggcucugccagucgugccucuccuggguuuga

SEQ ID NO: 4118025 - RNA, 56 nt, Human
ucagacuuucuccuugcuuaguucuuacaucuaggcaacauaacacgaaagucuga

SEQ ID NO: 4118026 - RNA, 67 nt, Human
ucagagaaaggcugaaaugccagaauggccauuguagugcauucuagcugaguaucagccccucugg

SEQ ID NO: 4118027 - RNA, 59 nt, Human
ucagagaaugaaaaugaaacuugcucacuguagcuucauugaaccacuuuauucuuuga

SEQ ID NO: 4118028 - RNA, 105 nt, Human
ucagagacagagacuaggauucauugcaguugaguuguguuaaaguaaaacuuauagaacaaacuuuuagaauuccugcugccaauguccaaagacugucccuga

SEQ ID NO: 4118029 - RNA, 60 nt, Human
ucagagaguuagugucuuagcuuguucugauagaucuagagcugccacccuagcuucuga

SEQ ID NO: 4118030 - RNA, 61 nt, Human
ucagagcuaaggggagagcaaaagggccgggguccacuguguaauccuucccuuguucuga

SEQ ID NO: 4118031 - RNA, 82 nt, Human
ucagaggaagugcuggagcaggacgugggaaugggaaaccagaagguuucgagccaggguacccgccuaguguuuccucugg

SEQ ID NO: 4118032 - RNA, 73 nt, Human
ucagaggaucaucuaguuugacucaggcagagcuuugaauagccaugggacauuuaucagaugaccauuuuga

SEQ ID NO: 4118033 - RNA, 68 nt, Human
ucagaggaucuuugugaaucucaacuuggacauggugucuaguuugcccuguuauaggguaccucugg

SEQ ID NO: 4118034 - RNA, 57 nt, Human
ucagaggcuucuggccagucuguuuggggacaauugccugagauaugaggccuuugg

SEQ ID NO: 4118035 - RNA, 107 nt, Human
ucagaggucacauagucuagcaggagagauaaugugaagauaaugcaagaguuugaggaaaaucuucugcuauuuuucuuuauguaacccuagucuaccacuucuga

SEQ ID NO: 4118036 - RNA, 60 nt, Human
ucagagguggccccugcccucacccucucagagcugguuacuggcaggggacgccuguga

SEQ ID NO: 4118037 - RNA, 62 nt, Human
ucagagguuacccaugggacagauggcauuuaaacuaggccuugaagcaaggguggcucuga

SEQ ID NO: 4118038 - RNA, 56 nt, Human
ucagagguuccggccauaaccacagaggaauuggagguugguaaaugacgcucuga

SEQ ID NO: 4118039 - RNA, 79 nt, Human
ucagaguaauuugagaaagauggaaucuuacaggcuguacugucuguucaugaaauaucuuuuugaaguugaacucuga

SEQ ID NO: 4118040 - RNA, 73 nt, Human
ucagaguaggcggggcagggggaaucagagcaguggcuccaaagucacccuucccagcuguccgccacucugg

SEQ ID NO: 4118041 - RNA, 71 nt, Human
ucagaguuuucuauuuuuauuccuguguguaaucaaugggaacacacugugacggaaauaaagaauuauga

SEQ ID NO: 4118042 - RNA, 57 nt, Human
ucagauaccauugaauuuguuguauggucuuuggcagcacucaguaugggcgucuga

SEQ ID NO: 4118043 - RNA, 57 nt, Human
ucagauccacacagcgucucaggccccaacuccggguuucugggagagugaaucuga

SEQ ID NO: 4118044 - RNA, 59 nt, Human
ucagaucuuagugacauccaggauggauaauuuucaucuuuguuuugaugcagaucuga

SEQ ID NO: 4118045 - RNA, 69 nt, Human
ucagaugagaggagcugugaguguggccuggaaaagaugucuccggcaaaccccagccccucuaucuga

SEQ ID NO: 4118046 - RNA, 85 nt, Human
ucagauguagauuagauaggaaucgagugggacugacucaaaggcacuauuuauuagcucacaugcccuaccuaaucuuagcuga

SEQ ID NO: 4118047 - RNA, 68 nt, Human
ucagaugucaacaggccuuuaaacaugcucuuuaccacugagcaauaaauacccugguugaguccuga

SEQ ID NO: 4118048 - RNA, 58 nt, Human
ucagauguuucuuuaacgcaugguugcaaaacgugcuguuaguaaggaacaugacuga

SEQ ID NO: 4118049 - RNA, 85 nt, Human
ucagauuaucccgauuacaguagcuuuauuuggaguaacuuucccucuuacuugccaaaggcuguguagcuaauaggauuauuga

SEQ ID NO: 4118050 - RNA, 93 nt, Human
ucagauuccucugcuuccugaugugagaaaugucaguggcuaaaagcaacauacagacaguuuuucagauauuuagugaaaagagucaucugg

SEQ ID NO: 4118051 - RNA, 66 nt, Human
ucagauuuccuccugugguugcuuuguuccuuuccaauauggcagccaguguuggaggaaagaugg

SEQ ID NO: 4118052 - RNA, 63 nt, Human
ucagauuugcugcccugguucugugauuucaucaaccuggauggguagggacagugguucuga

SEQ ID NO: 4118053 - RNA, 69 nt, Human
ucagauuuggacaucacugggcauuugugagacuaaaccucugacaguggaugugauguccagguaaga

SEQ ID NO: 4118054 - RNA, 64 nt, Human
ucagauuuguccuacuaggcacuacaggguaaucacuccuuaucugcuuggagggaccuuuugg

SEQ ID NO: 4118055 - RNA, 72 nt, Human
ucagcaagcacaugaaaaugugaagcuggaugcacugagaggcaucaacaguuucauucauuugcaugcuga

SEQ ID NO: 4118056 - RNA, 87 nt, Human
ucagcaaguuccuaagcuguggcccuggaucccuucacuccauacucuucagggaggugucaaagguggucaagcuugggaggcuga

SEQ ID NO: 4118057 - RNA, 61 nt, Human
ucagcaauaaugucuacaaaucuucuagguacauagcagauugugcaacaauguugcuaga

SEQ ID NO: 4118058 - RNA, 60 nt, Human
ucagcacaggucuugcaaaacauuucacuuauaguucaguaucuugggcucugugcuuga

SEQ ID NO: 4118059 - RNA, 61 nt, Human
ucagcacagugaccagacccacuagcauguggacauagggcagugggguggcugugaauga

SEQ ID NO: 4118060 - RNA, 80 nt, Human
ucagcaccugauaugaugagguauaaaggauaaugguggcuguaacauuaugacccuuacugcaucauacaaagcacuga

SEQ ID NO: 4118061 - RNA, 70 nt, Human
ucagcacucuuaguuugucucagcaacuggauagcucugugcagguacuugacaacuugggcucugcuga

SEQ ID NO: 4118062 - RNA, 56 nt, Human
ucagcacugauguuucagaagaaauuaaguuaaaguuuuuugccuaucaguggugg

SEQ ID NO: 4118063 - RNA, 65 nt, Human
ucagcagacccugaagacuugcuuuuaaacaaagaaaauccugggcacuucugcagggcugcugg

SEQ ID NO: 4118064 - RNA, 56 nt, Human
ucagcaggcccauccuccaggccaauggcccacacuaugggggcuggguaagcuga

SEQ ID NO: 4118065 - RNA, 62 nt, Human
ucagcaggucuggguuaaguccugauaauuugcauuacuaacaaguucccagauggugcuga

SEQ ID NO: 4118066 - RNA, 71 nt, Human
ucagcagucacauguugucccaaguguuaggaauuugggacaaaugccaugugaccuaccagugaugcuga

SEQ ID NO: 4118067 - RNA, 123 nt, Human
ucagcauccguauccuguuugauugcaaacuugcuaaagguagguauuguuugucuuggacuucgcugccaguccuuagaacagugccugggacacaguguguucucaaauauuuguugcugg

SEQ ID NO: 4118068 - RNA, 74 nt, Human
ucagcaugacauuacaguagcaugacuuuuagauuucugccuaaaagacauauaacuguaggaaucauuacuga

SEQ ID NO: 4118069 - RNA, 57 nt, Human
ucagcauuccugaagacaagcauaaaaagaaguaugcaguuaucaagaggaugcuga

SEQ ID NO: 4118070 - RNA, 55 nt, Human
ucagccaggccaccuucagcuuuauccaccagucuuugaauuuggccugagcugg

SEQ ID NO: 4118071 - RNA, 123 nt, Human
ucagccaggguuuuuaaggaucuuaauagaguggaacuaagguagaaacuauuaagagcaauuaauagugauauaucuauaguccuguuucuaaacaaguuuuuuuaaaaaccucaacucuga

SEQ ID NO: 4118072 - RNA, 72 nt, Human
ucagccaugugcuaggguuuacuccaggagcauauuaacucccaggauuuuaggcucucaguagcuggguga

SEQ ID NO: 4118073 - RNA, 64 nt, Human
ucagccccuuaucucuggcugccuaugaaagaaagcuuccaaagcagcuuggaugagaggcuga

SEQ ID NO: 4118074 - RNA, 56 nt, Human
ucaugugaaagauugagaaaguaaauccuuugugcaauucuuagucucaugcauga

SEQ ID NO: 4118075 - RNA, 62 nt, Human
ucauguguccucuggcagguuuagaaguauguacuuugaaaccucaaccaaagguuaccuga

SEQ ID NO: 4118076 - RNA, 67 nt, Human
ucauuaaagcagccucauuugugguaagaaaccaucauucccgaaauagguugcuuucaagaaauga

SEQ ID NO: 4118077 - RNA, 106 nt, Human
ucauuaacuuaaaagacgaacacagguggcagaguauggugauuauaugcugucccucauaagcucacauucaaaucugccuucuaucuuuugucuguguuaauga

SEQ ID NO: 4118078 - RNA, 69 nt, Human
ucauuaaucucugggaaguguuucauuggcaacaugauugugacaacaucuuguccuuagauuaaauga

SEQ ID NO: 4118079 - RNA, 67 nt, Human
ucauuagaaaugcagauucucaugccccaccccagaccugcuucaucagaaucugcauuuucagagg

SEQ ID NO: 4118080 - RNA, 89 nt, Human
ucauuagcccuauuuuacagauguggaaagugagccuuagagaaguaaguaauugccauaagucacacaucugagaaauaaugaaguga

SEQ ID NO: 4118081 - RNA, 81 nt, Human
ucauuaguagccaaugauauauauuuguaucauguauacauauuuguguaaugauacauauguaucguuaguagccgauga

SEQ ID NO: 4118082 - RNA, 61 nt, Human
ucauucaagauuucaauagauuuuuagaaaaauggaaaucauaugcaggaguugugaauga

SEQ ID NO: 4118083 - RNA, 63 nt, Human
ucauucacuuuuuaugucuaaguauaguccuaagacuuacuuugguuaaugaaaugugaguga

SEQ ID NO: 4118084 - RNA, 66 nt, Human
ucauucagauugguuaccacuuuaaaucuuuucugauagagagauagaaggguaaaccaugcguga

SEQ ID NO: 4118085 - RNA, 56 nt, Human
ucauuccuccagcgggaguccagucaggguccugaaguuugcugguucaggaaaga

SEQ ID NO: 4118086 - RNA, 85 nt, Human
ucauuccugaccuacaguggcccucagcaguugccaagauuuguccccaaagcucagggcugguggucagguggguuagggauga

SEQ ID NO: 4118087 - RNA, 71 nt, Human
ucauucugagcuaauaugcuuaugagcaugacuuauuaaggagcaccaguauaggcauguugauggaauga

SEQ ID NO: 4118088 - RNA, 88 nt, Human
ucauucuucauggcaguccugaaauugugauuucuuggcguccccuucagcaaguuggcucauuuuauagacagcgauugcaggauga

SEQ ID NO: 4118089 - RNA, 67 nt, Human
ucauucuuugacuguuguaguaaugaguuagcuuugcuccaacugccagaaucauucaaggaaguga

SEQ ID NO: 4118090 - RNA, 57 nt, Human
ucauugaaagugccuccucggacuggccaaaagcaguuagguaaugcucuucgguga

SEQ ID NO: 4118091 - RNA, 55 nt, Human
ucauugagcgguucuuaacccaucucugcacuggugggaccucugcccucaaugg

SEQ ID NO: 4118092 - RNA, 66 nt, Human
ucauugccauggcauuugcagacuguccuggugcuggugggagugucuuuaugcuaugagcaguga

SEQ ID NO: 4118093 - RNA, 85 nt, Human
ucauuggcucaacaaauauuuacugagugccuguuauccuccaaggucuuuaagaggcauuagagacauagcagugagccaaaga

SEQ ID NO: 4118094 - RNA, 101 nt, Human
ucauuguaaaauuauuucagcuuuucuguauguuugaaauuuucauuaaaaaaugaugaaaaaagacgagcauauaaagggagagaaguaaacuacuuuga

SEQ ID NO: 4118095 - RNA, 56 nt, Human
ucauuguaggugaugcugugaacccuccccaagggagguaccaaaagccugcauga

SEQ ID NO: 4118096 - RNA, 96 nt, Human
ucauuuaacugagaaaguugugcaugcagauuugcugagauaaucugggugaauuagcucagcaaaucugcauucacaacuuccugacauaaauga

SEQ ID NO: 4118097 - RNA, 73 nt, Human
ucauuuaacuucuuugagcuccaguuuucucauguacaaaaugggaaaaauccuaucucacagaguuguguga

SEQ ID NO: 4118098 - RNA, 92 nt, Human
ucauuuaauugucacauccaucuuaugagauaggugcuauuauuauucucacuaaagagggcugaucauuggauugaugugagccuagauga

SEQ ID NO: 4118099 - RNA, 60 nt, Human
ucauuuagauauuaaggugucacuguccaauaaggcaguaugaaccuggguucuggauga

SEQ ID NO: 4118100 - RNA, 78 nt, Human
ucauuuagucagugcuucccauuagaacugugauguucugaggauauuaauagguuauuuggggagcauuggggguga

SEQ ID NO: 4118101 - RNA, 69 nt, Human
ucauuuaucgcugccuuuuaaaagcuaaagagggaacuuuacagcauaugaagggugagauauaaguga

SEQ ID NO: 4118102 - RNA, 57 nt, Human
ucauuucacuucucuagggagagauuuuuauauccaucuuuugaagagaugagauga

SEQ ID NO: 4118103 - RNA, 84 nt, Human
ucauuucauaaaucacauucgucugcuccuuccagcaauuucccuuuucccuggaagggggauguuauuguguuuuaucugugg

SEQ ID NO: 4118104 - RNA, 73 nt, Human
ucauuucauagauucucagagagggauuccugauaauauuucugcucacaugaugugagaauguaagaaaugg

SEQ ID NO: 4118105 - RNA, 57 nt, Human
ucauuuccucaaauucaagguuuuagauaguuucucuccauggcuaugaggaaauga

SEQ ID NO: 4118106 - RNA, 64 nt, Human
ucauuuccugucuuuugugaaggauuccguaauauuagaaucacucagcacagauggggccuga

SEQ ID NO: 4118107 - RNA, 61 nt, Human
ucauuucuccuaagugaaauauacuguuuguuuuccugugugugcauggagggggcaguga

SEQ ID NO: 4118108 - RNA, 56 nt, Human
ucauuucugagccuuccaugauuuuugagccugauuugcugguaucucaggaauga

SEQ ID NO: 4118109 - RNA, 76 nt, Human
ucauuugaacccaggaggcacagguugcagugagcccagaucaugccacugcacuccagccugggugacagaguga

SEQ ID NO: 4118110 - RNA, 88 nt, Human
ucauuugaagcuagucaagcuuagauaacgauaaugauaauuaaaucucaugcuucaguaucuaaguaugauaaugcuucaggcauga

SEQ ID NO: 4118111 - RNA, 86 nt, Human
ucauuuggauuuaauggaugaggggcagcucucuggauuuuuuccuauguccuguuccucuaucacguuagauaaguaucaaguga

SEQ ID NO: 4118112 - RNA, 71 nt, Human
ucauuugguauuaauuuucagaaccugucguucuaaaaccuuaauacaguuugaagauuaugccagaguga

SEQ ID NO: 4118113 - RNA, 94 nt, Human
ucauuugugcagggacaacugugcaccugaucuugguaaucuccuuacccugacuaauuucagugucacaggaugcuaugcauaccacccauga

SEQ ID NO: 4118114 - RNA, 68 nt, Human
guuuuuuaugaucuuuauaaccuaucuucuuccuaaguagaggagagguauaugaaggcaaugaaaac

SEQ ID NO: 4118115 - RNA, 77 nt, Human
guuuuuucauaugcagauuaacaaauauggcugucuggauuuaguuauauuuuuaaggcucugacaucuggaaaaau

SEQ ID NO: 4118116 - RNA, 129 nt, Human
guuuuuucuuuguuuuacccauuuggauaacugagccagaggcauuacugaaaaggugaguuuccucccauuguucuagaaugccaacuuugucauaauucaagugucuacagguaauuaucaguuuuc

SEQ ID NO: 4118117 - RNA, 94 nt, Human
guuuuuugccccgugagacagauaguuuuaucauuacuuccaagggaaaacugagguauaagguauguaaacuauuuguccauggucagaaaac

SEQ ID NO: 4118118 - RNA, 62 nt, Human
guuuuuugcucuuuaauacauuuucaaguagguauuuguaaauaugucugagggcaaagaau

SEQ ID NO: 4118119 - RNA, 91 nt, Human
guuuuuuuuaagguguauaguuagccauuuuauucagcaggucuuaguugagugccugccaugagcuaaugacacacugauuaauagggau

SEQ ID NO: 4118120 - RNA, 82 nt, Human
uaaaaaacgcaauuucugggauuucauuccagaucuacucaaugagacucugcaggugggccccuagaaucugcauuuuuua

SEQ ID NO: 4118121 - RNA, 56 nt, Human
uaaaaaucgugggaaacuagaacauguauauacauuucaagugacuaugguuuuug

SEQ ID NO: 4118122 - RNA, 107 nt, Human
uaaaaaugucuauguaguauagaaacccagaaagauaguguaacuacuuuuauaucauacauuauuuuuaaaaguucacacagaucuuacuuuguaauacauuuuug

SEQ ID NO: 4118123 - RNA, 57 nt, Human
uaaaacuuaacuauccagauuauuauuucuuugguguuucuggauggcuaagauuua

SEQ ID NO: 4118124 - RNA, 57 nt, Human
uaaaaggaggaagaggagaaggagauaaggaagaacuucucuguaaaucuucuuuua

SEQ ID NO: 4118125 - RNA, 72 nt, Human
uaaaaggaguuguucugugcaccagaaugauauuucuuaaagaaacucucauuuuagugcacugaccuuuua

SEQ ID NO: 4118126 - RNA, 129 nt, Human
uaaaaggcauuucaacauggugaagccaguagcugagaggccaauugaacuuuuaaaacagugaacagcaugcaucugggccuuaucuuccaaguucuuguuuuauuacguugcuauaccuucaaagug

SEQ ID NO: 4118127 - RNA, 80 nt, Human
uaaaagggugauucuagguuacuguaauuaagcuccucaaagccuucauuuauaaagauccuuccagaguuaccauuuua

SEQ ID NO: 4118128 - RNA, 120 nt, Human
uaaaaguuuaucuuucucauggcauuuuuuacaaucguaguugaaaugaaucucuuccuagcauggguucagacuaaagcuaugcaguuaaguagaauaaauaucauuagaacacuuuug

SEQ ID NO: 4118129 - RNA, 57 nt, Human
uaaaauagccagugccccucugaguuuuaaaccuucagaggggcacuggcuauuuua

SEQ ID NO: 4118130 - RNA, 115 nt, Human
uaaaauauagaacuacauuugaagaaggaaaaaauggcuuaauaggcaauaaguacaauacuuuuuuucugaagcaguuuuacuaccuaaauccugaguguuggauuauauuuua

SEQ ID NO: 4118131 - RNA, 80 nt, Human
uaaaaugaggggacagagauucuaaacuugauucugcugcaaaucagcuaugucauuuggggcucugacaucucauuuua

SEQ ID NO: 4118132 - RNA, 102 nt, Human
uaaaauuuuauauacuggauauuaauauaaugcuauauaauaaaacauuuuucccaguuguuugcccuuuagcuuuguguaugaugucuguguauuuuuuua

SEQ ID NO: 4118133 - RNA, 92 nt, Human
uaaacacucauguacaaguuuuugugugaacauguuuucauuucucuucccuagaaguggaauuacugggucauauggaaauucuauguuua

SEQ ID NO: 4118134 - RNA, 70 nt, Human
uaaacagccuucaguccccagcaagcuguuuagggaagaggccuggcagcagcaagguuggagcuguuua

SEQ ID NO: 4118135 - RNA, 80 nt, Human
uaaacauggcuguuucaguuaucuuuggcugcuuaacaaaccaccccaaaaugcagugccugaaagcaacagccauuuua

SEQ ID NO: 4118136 - RNA, 79 nt, Human
uaaaccaagcauuucuagccagucacauucaacugaaauugauacaguguagugaugauuuagagugcuucuuaguuua

SEQ ID NO: 4118137 - RNA, 67 nt, Human
uaaaccagguaaagaagcucucugguuccucaugcugccucuuccugcuggcuuuauucugcguuug

SEQ ID NO: 4118138 - RNA, 61 nt, Human
uaaaccuguaguugauguaauugggagaaacaauagcucuugaaaacacagcuaagguuua

SEQ ID NO: 4118139 - RNA, 98 nt, Human
uaaaccuucuuuuauuggucuuuuccccuuuguuuaugugagauuacaucaucuaaucugagguaggaagagcugccaucugaagaacugcagguuug

SEQ ID NO: 4118140 - RNA, 87 nt, Human
uaaacuagaguuucagaugcagugcuuaaaucauuugcauguuuucugcaugauaauugaauuuauguaugcacuuccuuucguuua

SEQ ID NO: 4118141 - RNA, 88 nt, Human
uaaacucagugguuuucaagucaucuguuaugggaguuuuugguaaaaggugcccuguucccacugcagugaugguagcccuguuuua

SEQ ID NO: 4118142 - RNA, 66 nt, Human
uaaacugaacacagggccaaacuugagcuuagcagccaggcagccagguuuccacuguguuguuug

SEQ ID NO: 4118143 - RNA, 85 nt, Human
uaaacuucaaaguuuggauucucacuuuaaagcaagggacaaaccccuuuguaacuggacaagauauucaucacucugagguuug

SEQ ID NO: 4118144 - RNA, 88 nt, Human
uaaagaaggcaaguuggucgcaauuagucacauguuuuuauaauuaccauguagaaauuaguaagaucaacuauggcacacuacuuua

SEQ ID NO: 4118145 - RNA, 89 nt, Human
uaaagaagguuaugauggcccuuuccuggugagaugccaacuggggagaaauggggggcaaaaucagaaaguucaucauguuuguuuua

SEQ ID NO: 4118146 - RNA, 75 nt, Human
uaaagaaucuucuguguugcucuuuguccacuacauguguggggcuuacagggaaggagcauagaaaaaguuuua

SEQ ID NO: 4118147 - RNA, 73 nt, Human
ucagucucauuaacacuuuauguugguuuuuaugacuuucugcaucuggacagcuuuguguuaaugggaagga

SEQ ID NO: 4118148 - RNA, 84 nt, Human
ucagucucuuucauuuguccagaucaaugcccacaugcccaauuuaggucaaggcaucaggcagaggaaaggacuggagacuga

SEQ ID NO: 4118149 - RNA, 58 nt, Human
ucagugaggucagugggcuugccagaggucauagguaaagagcagcugcacccauuga

SEQ ID NO: 4118150 - RNA, 101 nt, Human
ucagugaguuuucuauuuguguccaggaggugaggggaccaaaugccucagaggcuggcauuugagacccauaaccucuccgguggcagaugggacacuga

SEQ ID NO: 4118151 - RNA, 64 nt, Human
ucagugauaggugguuguuggcaaaauuaagucugaaauacugccaaaguuuaccuaacacugg

SEQ ID NO: 4118152 - RNA, 130 nt, Human
ucagugauuuuuuugguuuugauuuuuguauuuaccuggcaacaaggguuauuauuugcacguuuauagcuagugugcuaaauggcacuuugacagccugccaggaaggucagucagaauuucccacuga

SEQ ID NO: 4118153 - RNA, 66 nt, Human
ucagugcuuccuggaggaagcccuaugcuuugaugcuucuuccaggaagcaacccaugauuucuga

SEQ ID NO: 4118154 - RNA, 63 nt, Human
ucaguggcaguucguggccaugcaggcaauucugcuggccugguuguugcugccguuuccuga

SEQ ID NO: 4118155 - RNA, 71 nt, Human
ucagugggcagauuaauuucucaauacgugcuaaucuacaauugagaugcuuaaaucuucaccugcacuga

SEQ ID NO: 4118156 - RNA, 99 nt, Human
ucaguggggggcuuuuguugcagguggugaugacagaagacaggugcaggcagugaccaugaucaccacuugacagcccugagagugaccuccaacuga

SEQ ID NO: 4118157 - RNA, 77 nt, Human
ucaguggucucgcugcagugcaagcccagauggauugguccuuacugauuugcagugcagcacuaccagcuuucuga

SEQ ID NO: 4118158 - RNA, 59 nt, Human
ucagugguuggaugauggucgcccacaguaguacgggugaucuuuacucagccuacuga

SEQ ID NO: 4118159 - RNA, 86 nt, Human
ucaguguucagaacacuagucuagaccagaccagaccaaugugguauucguugugggcuggcaaguagacugugugagaauaaaga

SEQ ID NO: 4118160 - RNA, 129 nt, Human
ucaguuaugaggacuuuuucucugcccuucaucaacaugcagccugugaacagugucugggaaaguaguggucauugguugcguaauuugauuuuaggcuuauggagaaaaggacccaagugacucuga

SEQ ID NO: 4118161 - RNA, 66 nt, Human
ucaguuccagagguagcaaugacuuggagaauaaauuuggcagugguuccuguucuucugggcuga

SEQ ID NO: 4118162 - RNA, 70 nt, Human
ucaguucucaucauuccuucaaagcccgggaccuucuguuguaucgggcucgaaugcugagaguaacugg

SEQ ID NO: 4118163 - RNA, 60 nt, Human
ucaguucugaaguucugccucccuugaugugucauacucggagacacucuuaagaacuga

SEQ ID NO: 4118164 - RNA, 85 nt, Human
ucaguugaaagaugcuucaguguuuaauuuaggauucacuuaaaaauaauuuaucuuaauaugggcagucugaauauaaagcuga

SEQ ID NO: 4118165 - RNA, 70 nt, Human
ucaguuuaagaugacuaacaauucaguaaguaugagaauacagguagaauuaaaguugaaauugaacuga

SEQ ID NO: 4118166 - RNA, 55 nt, Human
ucaguuuaauacccagaugccuucccuguguccagugucugcucuggguauuuga

SEQ ID NO: 4118167 - RNA, 100 nt, Human
ucaguuucauaucuaucccugauaguuacaauggcggaggucugcguuauaagcccaucccugacccaaaacugucagaaauagauugugaauauauuga

SEQ ID NO: 4118168 - RNA, 64 nt, Human
ucaguuucauuaccugacccaugaggauaauaagugucuccuucaaggguuguagugaagauga

SEQ ID NO: 4118169 - RNA, 62 nt, Human
ucaguuuccugguuuugacauugcacuauccuacgaaaaauguuacuuuuauaggaaacuga

SEQ ID NO: 4118170 - RNA, 67 nt, Human
ucaguuucuaccuacuaugugugagucacaugaauagacccacauucauugccaggguggaagcuga

SEQ ID NO: 4118171 - RNA, 64 nt, Human
ucaguuucugccaggauguguuaaaauuacuucuaaaauuuucacauucuuuucagagacaugg

SEQ ID NO: 4118172 - RNA, 60 nt, Human
ucaguuugggaauuguagcugucuugcuguagaucaggccuguuauaauucccagcuugg

SEQ ID NO: 4118173 - RNA, 65 nt, Human
ucaguuuuuguuguuuuuuaaauggcugaauagcauacccuuuacaggaacagcaaauuuucuga

SEQ ID NO: 4118174 - RNA, 80 nt, Human
ucauaaacaucacuguggcuuucuuuuugcucucuguuucacagcaguuauugucaaggaagauagcuauuaugacauga

SEQ ID NO: 4118175 - RNA, 60 nt, Human
ucauaaagcuugccugcaguguagcucuggacaacagaaaacuccugguaacuuuuguga

SEQ ID NO: 4118176 - RNA, 56 nt, Human
ucauuuugucuucugauccagguacauccacuggauuaguuucaaggcagcaauga

SEQ ID NO: 4118177 - RNA, 77 nt, Human
ucauuuugugcuagacacuauggcuaaaaccaaauaaagacaagguucuucccuucaugguguuuacauacugguga

SEQ ID NO: 4118178 - RNA, 66 nt, Human
uccaaacccagcaaagggagccauccugccugacugaagccagaguggggcccacugcugggugga

SEQ ID NO: 4118179 - RNA, 59 nt, Human
uccaaagagcuuaggagagaaauggcauaaaccuuaaauucucuacucagcuuuuagga

SEQ ID NO: 4118180 - RNA, 67 nt, Human
uccaaaguauuaaaucuuagcaacugaugaaguaaaaagcuauuuuugcuaagguuuaacuauugga

SEQ ID NO: 4118181 - RNA, 56 nt, Human
uccaaagucucagauuucuccagacuuccuggaugagaaacucuggugacugugga

SEQ ID NO: 4118182 - RNA, 76 nt, Human
uccaaaguucacaguuuuagaaaauagauagucuucauuaucuguguuuaguuuuuaauuaauuguuuguuuugga

SEQ ID NO: 4118183 - RNA, 66 nt, Human
uccaaauauagaugaguuguaaugucuggcauuuuugacagucagccuuuacaauuaaaucuugga

SEQ ID NO: 4118184 - RNA, 77 nt, Human
uccaaaucauugauuaauuguugcuagcugagaauacaaccugaacaaagacaguaacaaauauucauuggauugga

SEQ ID NO: 4118185 - RNA, 90 nt, Human
uccaacagaucuugaccuaugguaugugugacugaacagucccuuuugcuucuuauuuguacauucuauaucuguuacaucuguuuugga

SEQ ID NO: 4118186 - RNA, 64 nt, Human
uccaacagcugcaacucugucuccuuaacacaagcggaugacaaaaugaaugcagcuaguuuga

SEQ ID NO: 4118187 - RNA, 61 nt, Human
uccaacugggccuugccauggcagccuccaacaggacuagcuucuggcgggcccacgugga

SEQ ID NO: 4118188 - RNA, 82 nt, Human
uccaacuucugucacugagcucaggauucccaggcaagcccacggagugccccacagggucagagccguaacaggacuugga

SEQ ID NO: 4118189 - RNA, 71 nt, Human
uccaagagacaguuacccccaaaagaauucagcagacuuaguaucuauuuggggaugacuuuaucaauggg

SEQ ID NO: 4118190 - RNA, 59 nt, Human
uccaagaucaagguguuggcaggguugguuucuucugagacugcucuccuugacuugga

SEQ ID NO: 4118191 - RNA, 96 nt, Human
uccaagaucucaccagucaguaguaagcggaggaggcccaaggacacaggguguguucugggguuggugcuuacaccagcguggcaggagcuuggg

SEQ ID NO: 4118192 - RNA, 71 nt, Human
uccaagcccaugaaauggccucaaugaacaaauguuuagaaaacagaaagucauuggugggaucacuugga

SEQ ID NO: 4118193 - RNA, 66 nt, Human
uccaagcuaucuuccugcagccuucaucagugauaccacaucugggugaaggaggaagcugaugga

SEQ ID NO: 4118194 - RNA, 85 nt, Human
uccaagcuucuggaaugauaaauggaagcagcaucacugugcuacuaguuucauuuuucagaucuaguuguaaaaagcuauugga

SEQ ID NO: 4118195 - RNA, 90 nt, Human
uccaagggcaaggcaacauaugauuuuguauauaaaguucacauuuugcauuuaaaugguguguuuacuuuuuuagccuugucaacugga

SEQ ID NO: 4118196 - RNA, 55 nt, Human
uccaagggcucuaagucacaagauggucuugaaucauuugaacugggcuuuugga

SEQ ID NO: 4118197 - RNA, 86 nt, Human
uccaagucuuugcuauugugaauagugcugcaauaaacauacgugugcaugugucuuuauaguagcaugauuuauagucgcuuggg

SEQ ID NO: 4118198 - RNA, 119 nt, Human
uccaagugauguuaagaggauuacaguaaugaggccaugcuugguaugcugugagcuccuaaaagucuugagucauauaaagacagaggccuuauaauuacaucuuuauauucacugga

SEQ ID NO: 4118199 - RNA, 57 nt, Human
uccaaguuucccaggauccuugccuuuuucauagaaaggacaggaggggaauuagga

SEQ ID NO: 4118200 - RNA, 105 nt, Human
uccaauaucauacuuuaugggcaagaagcuggaagcauuccccuugaaaaccagcacaagacaaggacgcccucucucagcacuccuauucaacacaguauugga

SEQ ID NO: 4118201 - RNA, 83 nt, Human
uccaauugacccagauuuuuggccugguccuugucaaggcaucucauaggguuuggaagggccgggccgugggauuuacugga

SEQ ID NO: 4118202 - RNA, 76 nt, Human
uccacaaagccccccagaguucucaggucagcugagucuccaaaagccuggagaccagcagagaagggggccagga

SEQ ID NO: 4118203 - RNA, 79 nt, Human
uccacaauaaaguguaggcuucaaagagggaugacauguauuuuccaucccuuaguuguggacccugcacuggccugga

SEQ ID NO: 4118204 - RNA, 130 nt, Human
uccacaauaauaacaugaaauauauaagggaaaucuuaugcauguacucuggcuggcuagguugccaguaaucuguuuccauuagagucauaccauaagcuuuccuuuuuguuuccucuuuuauuuugga

SEQ ID NO: 4118205 - RNA, 55 nt, Human
uccacacaccccuuaccuccaggguccguaucuccugcugggugaggucguugga

SEQ ID NO: 4118206 - RNA, 102 nt, Human
uccacacagguguccagggcuugucuggagucuggugguuauggugucacugcccggaagcacgacccccaagccuccagccgcagccccagcaggugugga

SEQ ID NO: 4118207 - RNA, 93 nt, Human
uccacaccuggcaaagcccuggcucagcucaccagagagaagagaccucacagccuggguggggcugagguaggggcagugcccagaggagga

SEQ ID NO: 4118208 - RNA, 55 nt, Human
uccacacuccucuggcccaaggugcugucaugaacuugggcuuguagauggugga

SEQ ID NO: 4118209 - RNA, 83 nt, Human
uccacacuuagaagcagaaaucuccucucacgcuaggaacuccugauguguacagcaggauuucucaaccuucacacugugga

SEQ ID NO: 4118210 - RNA, 73 nt, Human
uccacagccugauuuauggagcagugccgucuccuggaugauauggagacacugugaaugaaagagcugugga

SEQ ID NO: 4118211 - RNA, 93 nt, Human
uccacaggagcagcuaaagucaaucacaugcacacugaauggaaaaagaauauuaaguugugacacgugauaaggcagagggcuuaugcugga

SEQ ID NO: 4118212 - RNA, 65 nt, Human
uccacaucucucgccaaccaauuuacugcauccuugugaagaagguuagaggagagaugugugga

SEQ ID NO: 4118213 - RNA, 65 nt, Human
uccaccacacgaguucuuuucuugauaucugcaaagaaaccaagaggcuggcauugaugguagga

SEQ ID NO: 4118214 - RNA, 80 nt, Human
uccaccacuuuaaacauuuugggagaaaguuguuacuuuggcuugauggcagcucauuuggaaauggaguacuguuugga

SEQ ID NO: 4118215 - RNA, 80 nt, Human
uccacccgaggcagguccagucaccagagagagaagcagccaccuccuuucucacggcagcuggcaaagcaccgggugga

SEQ ID NO: 4118216 - RNA, 55 nt, Human
uccacugacaggugaauggauaaacaaaaugugguauauauauaccuacagugga

SEQ ID NO: 4118217 - RNA, 71 nt, Human
uccacugagcaauguuugaaacuuugaucacuaaaucuauauccuuguguuuauggucuuucuucagugga

SEQ ID NO: 4118218 - RNA, 106 nt, Human
uccacugagggugaaguguccacuggacuucucuucaaagacaggcuuucucugugucuuccagagagucuauaaaacauuuaaacaccaggaagaaucgguagga

SEQ ID NO: 4118219 - RNA, 61 nt, Human
uccacuggaguccagacccaagaggccaucugcagaaagagaagcccuggcucuaggugga

SEQ ID NO: 4118220 - RNA, 75 nt, Human
uccacugggagacgcagcuggggaucccucccaggacuuuuucacuugagggcccccaguucugaucccaaagga

SEQ ID NO: 4118221 - RNA, 65 nt, Human
uaagaucucuguuucuguggaguauuguuggaggaggcagauaacacaaagaaaugggcauuuua

SEQ ID NO: 4118222 - RNA, 64 nt, Human
uaagaucuucaucuucuuacagccaucaaucuuaggaugguuucaagaauugaagaggauuuua

SEQ ID NO: 4118223 - RNA, 77 nt, Human
uaagauggagacugucucuaguugcuggcauucaucaaagguguuaguugcaagcaauggacggugacuuugacuua

SEQ ID NO: 4118224 - RNA, 84 nt, Human
uaagauuauuuagaauuuaguguaaagcuacuggaauguaaauugcuuuccuuuggcuuagcacuagguauagaucugaacuua

SEQ ID NO: 4118225 - RNA, 58 nt, Human
uaagcaagggucucuguaucagauauuuaccaacagugagauuagagacccuuguuua

SEQ ID NO: 4118226 - RNA, 98 nt, Human
uaagcaaugaaggcaaagcuccaagugugguguuuggcacauagcugguacacaaugaaugccauccaucaguauuugugguuuguuuuaaauguuua

SEQ ID NO: 4118227 - RNA, 72 nt, Human
uaagcauuagguggacaaaugaaugacugaacgagugccaagucucuuuuguuacuuugccacccuuacuua

SEQ ID NO: 4118228 - RNA, 78 nt, Human
uaagccacacagucugugguacuuuguuauggcagcccaagcugaguaagacaaauacuauuucaagaaagugacuua

SEQ ID NO: 4118229 - RNA, 56 nt, Human
uaagccacuaggacuaaacaaagcuguaaauuggcuuugaauagaaauagugcuua

SEQ ID NO: 4118230 - RNA, 76 nt, Human
uaagcuaguaaaauauuucagaggaucuggcuuaugaaaacuuuaagcauuuccaagaguauaguuuauuggcuua

SEQ ID NO: 4118231 - RNA, 82 nt, Human
uaagcuauuaaguagacuuggccaaagacaaauuugaaaucaguuuacauuuaccuaguuaagucaauauuugguggacuua

SEQ ID NO: 4118232 - RNA, 100 nt, Human
uaagcuauuugaagucuuucacuuccucagaugcucucuggcauguauuucagauggcugaacaugcaacaaaguaccugcaagugaguuucguaguuua

SEQ ID NO: 4118233 - RNA, 73 nt, Human
uaagcuuuccaugauuggucaucauagaaaauagaaucuugauuugcuaugguuccagauggugguuugcuua

SEQ ID NO: 4118234 - RNA, 62 nt, Human
uaaggaagauuuuuuccaaauauuagagguuucugaaaguggagggaaugaaucuucucuua

SEQ ID NO: 4118235 - RNA, 68 nt, Human
uaaggagaccuuuaaagcaagcugcaguggugucauaucauuguacaguuauuuuaaaauaauccaua

SEQ ID NO: 4118236 - RNA, 55 nt, Human
uaaggagagaauuuagagguuuuagacuggcaucugcuucuaaauucuguuuuua

SEQ ID NO: 4118237 - RNA, 65 nt, Human
uaaggagcguccucaaauuacacucacaguuucaaaguucaagaauuguggcugagcacuccuua

SEQ ID NO: 4118238 - RNA, 57 nt, Human
uaaggcaaagaaccauaguaaugucccugacacuagacuagaugguuuugugucuug

SEQ ID NO: 4118239 - RNA, 118 nt, Human
uaaggcaguucuuuaaaccaaccaaacccuucagcaggaguuugaugcuuuuaucauucaaaagugaucuaauauaugugccuugauuggguuugguuuagccuugagaauaaccuua

SEQ ID NO: 4118240 - RNA, 66 nt, Human
ucagaggcaggaagaugggcaguagcuauguuuuccugaauuacuguucauuuguccuguaucugg

SEQ ID NO: 4118241 - RNA, 55 nt, Human
ucagagguucuucucaguggccacugacaagucugcaggcugugaagagcucuga

SEQ ID NO: 4118242 - RNA, 64 nt, Human
ucagaguacgcaugcucugauuuucucuuuggagucuucccaaaucagaguacgcaugcgcuga

SEQ ID NO: 4118243 - RNA, 75 nt, Human
ucagaguauguacgggccccaggacacccggauguucauucuagcccuguccuuggccugugcuuuauucucuga

SEQ ID NO: 4118244 - RNA, 55 nt, Human
ucagagugaggcgucaacaugagcugaugcacaggaccagauggccuuaaucuga

SEQ ID NO: 4118245 - RNA, 65 nt, Human
ucagaguggguccacagaggugacagugggaguccugcuauuuuccuugguggacccagucuuga

SEQ ID NO: 4118246 - RNA, 102 nt, Human
ucagaguguccugagaaccacccggagagcggggauuaacguggaagcagcggagcuucugagggaaccuuguucuuguggcugcccacaggacagcuuuga

SEQ ID NO: 4118247 - RNA, 87 nt, Human
ucagauaaaccacaugguuuuaagcaaaaguaucucucaugcaauauaugggaaagcuuuguacuugaaaacuugugguuuaucuga

SEQ ID NO: 4118248 - RNA, 118 nt, Human
ucagauauuaccaagauccccaucauucucagacacauuuuacauuaacuguacugacaaacuugaacagaaugcguagugcauguuggagaauguugugcauguuggagacauauga

SEQ ID NO: 4118249 - RNA, 77 nt, Human
ucagauauuuggaaguaguucuguguuuguauuccuuuuucaggugcaaagucgcaaaauucuucucuccauucuga

SEQ ID NO: 4118250 - RNA, 61 nt, Human
ucagaucaggccacucuucagcucagcaucgguguguggccuuaaagagaggcugagcugg

SEQ ID NO: 4118251 - RNA, 120 nt, Human
ucagauccaggaguucugucaaagucugaaauauugguaauacuuuggauccaaagaucaagaguucauaaauuauuaauauuguucaaugaaacuuuacaaaacucgaggaugaccuga

SEQ ID NO: 4118252 - RNA, 64 nt, Human
ucagaugcuaaauuauuugcacauuagaggcaaaacgugccuucuauguagaugauuuauuuga

SEQ ID NO: 4118253 - RNA, 117 nt, Human
ucagauggcccugcgccucugucagcaaacccgcccuggccuucagggcucagguucuuagaugcagcuucagcccugggacccagggaugcugaaguagagaguucugucaacuga

SEQ ID NO: 4118254 - RNA, 71 nt, Human
ucagauggugacugagggggaaggacuucagacugggugugagggaggcccuuugagcagaugacauuuga

SEQ ID NO: 4118255 - RNA, 59 nt, Human
ucagaugguuaccuuugaaaggagagagcuuuccaagcucuccugggcugaccguccga

SEQ ID NO: 4118256 - RNA, 67 nt, Human
ucagaugucuccaagggcugggcaaguuacaugaaucaguaagagauggccaaacuggagcauuuga

SEQ ID NO: 4118257 - RNA, 58 nt, Human
ucagauuaagugcucaacaguguuagcuguugcugauauuauuagucucuugguaaga

SEQ ID NO: 4118258 - RNA, 83 nt, Human
ucagauucccaggagugucgggucacuaggucuccaggccaucuggaggaagcuuggcaucucacugacucuugggaauagga

SEQ ID NO: 4118259 - RNA, 89 nt, Human
ucagauuccuuuguucauucacccaggaaacaucucagagcagaggucugggcucggaugugguccaggaguuggagagucaaagcuga

SEQ ID NO: 4118260 - RNA, 99 nt, Human
ucagcaacauccacccuggccuuguguuuaagcaagaaauccacugcagauaaaugauuucuccccacugcaaaaugcagggcugugcgguucaucuga

SEQ ID NO: 4118261 - RNA, 79 nt, Human
ucagcaacauuaaaccaauaauuguuaccauuuggagagguuuggaggcagaugcaucuugguuuaaacugauagcuga

SEQ ID NO: 4118262 - RNA, 56 nt, Human
ucagcacacuaagauguaugcccagaacuuccuugggcuucucuuuagugagcuga

SEQ ID NO: 4118263 - RNA, 128 nt, Human
ucagcaccaccugggagagucuuuggaaacaccugagcaacacuccacauugcuaggagucccuggguguuguucuggguuaucugguuuuguuguuguuuuguuuuguguuuaagcucuuccauuga

SEQ ID NO: 4118264 - RNA, 98 nt, Human
ucagcaccuccugcugucagcuacuuagaaugugaggccacacugugcuuggaacccacccugggaagcuaggcagcaggggucaguccaauugcuga

SEQ ID NO: 4118265 - RNA, 61 nt, Human
ucagcaccuuccuuaacuccaggacaaaguggggguugggggaagaauggggagguguuga

SEQ ID NO: 4118266 - RNA, 81 nt, Human
ucagcacgaaguccucgcggcacucgggccggauguccuugcgcagcuuggccagcagccgcgacgcccacuucugcuuga

SEQ ID NO: 4118267 - RNA, 66 nt, Human
ucagcacucacuuuuggguuuccaguagauuuuguugagucuacauuggaagcuaggguguguuga

SEQ ID NO: 4118268 - RNA, 56 nt, Human
ucagcacuuacuaguggccuuucggcaguucccgagaagaucaccagcaaggcuga

SEQ ID NO: 4118269 - RNA, 110 nt, Human
ucagcagauuugaauggucaaagcacaucucaccugccucaugcuuuuagaaauccugacgaugaaauaaaacagcagggcagagaaguuuaaaucuucaaacuugcuga

SEQ ID NO: 4118270 - RNA, 58 nt, Human
ucagcagccgcagcugacucagcagugucauuugccauccaucacugaggcugcuuga

SEQ ID NO: 4118271 - RNA, 89 nt, Human
ucagcaucaguccagauuuaccuaacuccaaguucuaggcuaucgaucuuacaucuuaaagcucaggagugagggaguuucugauguga

SEQ ID NO: 4118272 - RNA, 56 nt, Human
ucagcauggagacaaagugggcaugguaugccugcacgcacuugcucuccagcgga

SEQ ID NO: 4118273 - RNA, 65 nt, Human
ucagccaaggaggaggauaguaagaaguacagauaaugaucucuggccuuccuuuuccaagcuga

SEQ ID NO: 4118274 - RNA, 56 nt, Human
ucagccaggcacaauggcagcugaacacugauuugguaucaacguguuugugcuga

SEQ ID NO: 4118275 - RNA, 92 nt, Human
ucagcccacaugaaaagaagacaguguucuucuucaaagcucugauggacgacuuuagagacuguuucaggaacacucugucuuuuugcuga

SEQ ID NO: 4118276 - RNA, 80 nt, Human
ucagcuacagggauaacccccaagaaggucuuuaauagcauauauaugcuugagaguuuggagguguuccuggaagguga

SEQ ID NO: 4118277 - RNA, 79 nt, Human
ucagcuacuuaaaaagaugucauacacauuaagagggacagaacuugcuuuagaugcuguauguuauuucuguaaauga

SEQ ID NO: 4118278 - RNA, 58 nt, Human
ucagcuccacagcuccucugccuuuguccgagggcaaaaggaacggaugugaagcuga

SEQ ID NO: 4118279 - RNA, 68 nt, Human
ucagcuccacuugaguggggccuggaagauauacagaacucugacagccauauuaaggauggggcuga

SEQ ID NO: 4118280 - RNA, 61 nt, Human
ucagcucucugggcucgaaccuaguuggccguaacaugguugaaugcaccaagagaguugg

SEQ ID NO: 4118281 - RNA, 59 nt, Human
ucagcucuguguacaguuagcauuaggcuguuccaauaugacugauugacauggacuga

SEQ ID NO: 4118282 - RNA, 56 nt, Human
ucagcucuguuuugaguggaacugaacacucagugauggcuaaaaacagcaguuga

SEQ ID NO: 4118283 - RNA, 62 nt, Human
ucagcucuuccccccagccaggaaggacucuagccacaaaacuugcuggguggaagagauga

SEQ ID NO: 4118284 - RNA, 63 nt, Human
ucagcugcaagaagaggucccugacaauauuagggucagaugcuuccuuagcuugcagacaga

SEQ ID NO: 4118285 - RNA, 59 nt, Human
ucagcugcucaaauuuaugucaaggaaagccaaauucuauuaauauuuuguguagcuga

SEQ ID NO: 4118286 - RNA, 56 nt, Human
ucagcugcugugguauguacauaggcuugccugugaugcauaguugcugcaguuga

SEQ ID NO: 4118287 - RNA, 82 nt, Human
ucagcugcuucccgcugcucuacccaugcaucugucuugcuggacguugcaggagagccggcccgaugcauccucgugcuga

SEQ ID NO: 4118288 - RNA, 72 nt, Human
ucagcuggaguuguggguuuacuaaauguguuacuagacaaaaaucauuagugaaucuuaacuccugccuga

SEQ ID NO: 4118289 - RNA, 117 nt, Human
ucagcuucuuugguacaacuuuuucagggcugacaagccuauuguagggcagugucacuguaggucaguaguuauuaguugccacugaaaacaguuucuuuaacuacuuaagacuga

SEQ ID NO: 4118290 - RNA, 111 nt, Human
ucagcuugaucgggcgggccccagaagccagguguuuaggccagcgguugaggccaaaaccgcugccuucaucccacgccuaggcucgcugaucuuucccuuuccagcugg

SEQ ID NO: 4118291 - RNA, 55 nt, Human
ucagcuugcguucugggauuuacucuugucuucuugggaaauguuugcgagcuga

SEQ ID NO: 4118292 - RNA, 77 nt, Human
ucagcuuugcucguuacacuaacuacuguugacuucaauuaucuuacucaauuuuaagugauaaagaguagagaugg

SEQ ID NO: 4118293 - RNA, 58 nt, Human
ucaggaaagaagaugcucaguggacugcuacccaccccacaucccuauucauuucuga

SEQ ID NO: 4118294 - RNA, 60 nt, Human
ucaggaacagcagggaggaaagugcuucacuucaucaucucacucucugacuuuuguuga

SEQ ID NO: 4118295 - RNA, 76 nt, Human
ucaggaagucaccaguggaauuaaaaauaagugcauuuuugugugacauauuuucaguuuuacuugcgcuuuguga

SEQ ID NO: 4118296 - RNA, 58 nt, Human
ucauggaccaacauucacuggcauacuugugaccuaugccuugaaauguggucacaga

SEQ ID NO: 4118297 - RNA, 56 nt, Human
ucauggaucuggugaacauuuacaggaaucuguaaaugaaacagcuaaauccuuga

SEQ ID NO: 4118298 - RNA, 58 nt, Human
ucauggcauuguuaaggguuuuaaaugagauaauacaaguucuuagcauaaugccuga

SEQ ID NO: 4118299 - RNA, 77 nt, Human
ucauggcgcuccacaccagggccuagccagggcgacagaguugugauucaugccaucuggggccugccgugcuguga

SEQ ID NO: 4118300 - RNA, 96 nt, Human
ucaugggaaguuugguuuccagaggacagacggaaagugccaccugauuugcagugguauuacaacugacuucuagggggagccaccugcuuguga

SEQ ID NO: 4118301 - RNA, 123 nt, Human
ucaugggucaaauguugucaaguuuuucauucauuauacaguagagaagaggcuaggaucauguccacccugggucacuauaguagcuugggugaaaaguaacuuggccauugaaucccgagg

SEQ ID NO: 4118302 - RNA, 106 nt, Human
ucauggguuggagcaguguuuagcagugaagugaagugaagagaugaaaggagaaaauucaugaaacuuuuauucacuuauacauguuaaaguuccuaggccauga

SEQ ID NO: 4118303 - RNA, 59 nt, Human
uaaggcuuuauuuuuacaaugccuucucugggguuuuuuguucaaucuguaaggccuug

SEQ ID NO: 4118304 - RNA, 64 nt, Human
uaagggagcauuuacaucgacggagagaaggcauaauucgucaguggagacucaugcuuccuua

SEQ ID NO: 4118305 - RNA, 67 nt, Human
uaagggaguaucuuuuacaccaggaaauuaauaguacaguaaauuucacugauaaagacuccacuug

SEQ ID NO: 4118306 - RNA, 71 nt, Human
uaagggauguggaggaaggcauuccaggcacagaaaauugcccuuccugucugaauuccacaucguucuug

SEQ ID NO: 4118307 - RNA, 55 nt, Human
uaagggcuuuccagcuauucuuguucacaagggaauguagaggggaagaccuuua

SEQ ID NO: 4118308 - RNA, 80 nt, Human
uaagggucugagagguuaagaauccuuccaaaugcuuaucuuauugcaccacuuuggaacuuaacccugauagguccuua

SEQ ID NO: 4118309 - RNA, 71 nt, Human
uaagguagggauagcuuugagggcuccuuaggagggagugaaaccccugagggucaaggagcccuaguuug

SEQ ID NO: 4118310 - RNA, 120 nt, Human
uaaggugccccgggcggggacccugccccugagguccucucggaaccccuuugaagaaguuucagggcuggaggaagaagaggccggggagcuggggucccuccccaauggaacaucuug

SEQ ID NO: 4118311 - RNA, 64 nt, Human
uaagguuauaaagucuaccguauuaaagaggggaagauuuccuucuguggaauuucagaucuug

SEQ ID NO: 4118312 - RNA, 57 nt, Human
uaagguuucuucagauacuagucucugaucccacaggagauucuagaagaugccuug

SEQ ID NO: 4118313 - RNA, 55 nt, Human
uaaguaaaacauucaagaagucagcauccucugcuuuaguugagugcuuuauuua

SEQ ID NO: 4118314 - RNA, 83 nt, Human
uaaguaguucuaagauucacauugguucuugauagcugugcuacacaaguagagucucaaagucagugucauggauuuauuua

SEQ ID NO: 4118315 - RNA, 63 nt, Human
uaagugaaauggugcaucaaauggcacuaguagccauuuggaacuucuuuccauuuugacuua

SEQ ID NO: 4118316 - RNA, 60 nt, Human
uaagugauuuguaaagcucuguacuuuuugaguucuagugcaaaguuuuauucucauuug

SEQ ID NO: 4118317 - RNA, 71 nt, Human
uaaguggcagaagucacuggguagcuuuggguacauuauugcccauuucuugccuucugcuucuccauuug

SEQ ID NO: 4118318 - RNA, 61 nt, Human
uaagugucuguaauagucacuaugugaaauguaagcugcucucacaauuaugagacacuua

SEQ ID NO: 4118319 - RNA, 103 nt, Human
uaaguguuuauugaaugaaugguucuacuucaaagauuugugggacugaguucucacaguaucagguggaguggagaauuaaguuauuaaauuaacccacuua

SEQ ID NO: 4118320 - RNA, 86 nt, Human
uaaguucuacgguacauaugcacaacaugcagguuuguuacauauguauacaugugccauguuggugugcugcaccuauuaacuug

SEQ ID NO: 4118321 - RNA, 113 nt, Human
uaaguugcucucaugaaagguaaacagauccuuucccaaggagcucuugguagucugccuccuggagaaacucagagaucuguuuaucuaugugcuuuuuagagagcaaguua

SEQ ID NO: 4118322 - RNA, 67 nt, Human
uaaguugguauacaauacacaaugcucuggaagacucugauggaacacagugauugauagcgacuua

SEQ ID NO: 4118323 - RNA, 56 nt, Human
uaaguuucuacuugucgggucuucagagcacugccugguagguacugugaggcuua

SEQ ID NO: 4118324 - RNA, 62 nt, Human
uaaguuugugucucuguuacuugcaaaacguaacacccagcaaaauacagagacuagauuug

SEQ ID NO: 4118325 - RNA, 117 nt, Human
uaaguuuugauuuuaaagaaauuccuugcacuacagccuuuucuuaaaaugcaagauucucacuuugaagguuuuguguuggaagaaaugcuacugguuuuuaaaaagcaaagcuua

SEQ ID NO: 4118326 - RNA, 130 nt, Human
uaauaauaugcaguaaaaaucaaaauauggcacaugaucuuauguagaagaucucagcaccaaaaugaaaaugaguuguggucaauuuuaucuaaaucagagcuauucuauuuauaugagcaauauuuaa

SEQ ID NO: 4118327 - RNA, 74 nt, Human
uaauaaucuauccaugucaugcugaagcucaacccuccgggggagaguuauuucaguaacauaauaguaguuua

SEQ ID NO: 4118328 - RNA, 110 nt, Human
uaauacauccuggcauauuugcaucaauggaaugcucuacaguuauuuuuaaacaaugauagagacuauagagcacuuacuugggaugaaaagaugccugcaauauauug

SEQ ID NO: 4118329 - RNA, 57 nt, Human
uaauaccuacuggucauugcaauguguaaauugugcugaccaucaugugggauguua

SEQ ID NO: 4118330 - RNA, 79 nt, Human
uaauaccugguguguuuagcuucugggcuguagugagcaucacacagagcuucccagccugagcauugccuaaauauua

SEQ ID NO: 4118331 - RNA, 90 nt, Human
uaauacuaugauugucagaagcuaaauuugauauuugcugacuauaaaaaugucaucaaguggaguuuauuuuuaugauuaucuuuauug

SEQ ID NO: 4118332 - RNA, 79 nt, Human
uaauaggaauauagcaauagaaacauauaaagucccugaacucauggggcuuauauucuacuguuagagacagauauua

SEQ ID NO: 4118333 - RNA, 91 nt, Human
uaauauaguauuuacuucucaggguuauagugaggauuuaaaugaguuaauauacgucuaaagcccuuagaauaguacaugacacauagug

SEQ ID NO: 4118334 - RNA, 80 nt, Human
uaauauauuccuacaucagcacuaugauuaaaguaucuaaaaugguaacuauagucagucuggugguuuuggucuuauua

SEQ ID NO: 4118335 - RNA, 71 nt, Human
uaauauauuguuagagcaggagcagucauguucauauaacaugauucucugcuacucuaaaugauagauua

SEQ ID NO: 4118336 - RNA, 64 nt, Human
uaauaucgaauuucauccugugguaaaauaaaauuaggcuaccacaggguaaaguuagauauua

SEQ ID NO: 4118337 - RNA, 62 nt, Human
uaauauggaucuuuccaauguuugccugauuuacacaggauaacauuucaggauccaaauug

SEQ ID NO: 4118338 - RNA, 87 nt, Human
uaauauuccauuguauggguauaccacauuuuguuuaucugaucaucaguugauggccauuuggguguguccauauuuugacuauua

SEQ ID NO: 4118339 - RNA, 67 nt, Human
uaauauugugucaacaacagccuuggaugucccucagauuauuccuggacauuguuuacacauguug

SEQ ID NO: 4118340 - RNA, 77 nt, Human
uaauauuguuggaaagacuaaauguguucuaaaguaugagguacuuuauaaaguauaguggucaugaaauaauauua

SEQ ID NO: 4118341 - RNA, 95 nt, Human
uaauauuugcucucugugcucacaagggcaguugaaauauugaacauccuuccaccaucuguucucuuguccuuggauuacagacgguaaaguua

SEQ ID NO: 4118342 - RNA, 85 nt, Human
uaaucacagugcauuacauguaauaaaauagugguaucauuuaacuuuuguucauuguuuaugcauguguaugcauaugugauua

SEQ ID NO: 4118343 - RNA, 66 nt, Human
uaaucauaguggguacaggggcagagaacauuaauuucucuacuucuauguaacuacuucauuuua

SEQ ID NO: 4118344 - RNA, 72 nt, Human
uaauccccaggauuuggaagggagaugggauuuugagcucucuuuaucuuuagaccuuugcaaaggggguua

SEQ ID NO: 4118345 - RNA, 84 nt, Human
uaauccuuuauauugcagaauguuuaauuguuuuuaaaugggaagugaggaaauauuuuguuuuaguuguauuauaaaguauua

SEQ ID NO: 4118346 - RNA, 92 nt, Human
uaaucugugaacuacaugcaucagaggacucugggaaccugcauuuucacaagcauuucacaggauucugauguagugaagcucacacuuug

SEQ ID NO: 4118347 - RNA, 73 nt, Human
uaaucuuccuaggcuccagaacugugaaaaaugaauuucuauuguuuauaaauuaggcgccucagguauuuug

SEQ ID NO: 4118348 - RNA, 99 nt, Human
uaaucuuucugaagcucaauuuccuuuucuuaaaaaugaguauaacauuuacuucauaggguuguaaggauuaggugaauuaaguauucaaagagauua

SEQ ID NO: 4118349 - RNA, 63 nt, Human
uaaugcaacagcugcuagugaucaugugauugauacauuuuuaaaggcagauguugaguauua

SEQ ID NO: 4118350 - RNA, 56 nt, Human
uaaugcaggugcccuuggguuucagagagaaaugcccccacuggggcuccacauua

SEQ ID NO: 4118351 - RNA, 63 nt, Human
uaaugccuacuacaaagacuugucagugaagauuaacugagaauaguuuuauaggugggauua

SEQ ID NO: 4118352 - RNA, 65 nt, Human
uaaugcugaucuguaauaagauuuuauguauuuuacuucugaaaauuccuugcagauagguauug

SEQ ID NO: 4118353 - RNA, 109 nt, Human
uaaugcuuuugucacuguuugcugcugaauuccagggaaguauauguuucuucucaucccaauucagaagcaaucacagugaguuauuucauuuauugcaaaaauauua

SEQ ID NO: 4118354 - RNA, 79 nt, Human
uaaugguguauuauagagaaauuccucaaaucaaguauugcucuugaagagagaagucucucugguucuaugacuauua

SEQ ID NO: 4118355 - RNA, 96 nt, Human
uaaugucuggcuuaauagaacacugcaggaaucuuguauauauuucugauuaaauaagcuguguauugcacauccuguagccucugcagaauauua

SEQ ID NO: 4118356 - RNA, 112 nt, Human
uaauguuccucagccaagaaggcugugaugagccucauggagaaaauauacauguuagaugagcuucauucaggcuugaguuacggugcuguuggccuugaguucaacauua

SEQ ID NO: 4118357 - RNA, 59 nt, Human
uaauguugaggguauggagggccaccccaguggaucuuuccaggugaccgucagaauua

SEQ ID NO: 4118358 - RNA, 93 nt, Human
uaauuaaaguucauuugagauaauuaaaucaaaaccucuagucuggguuggagggugauaaaguuaucuggcgaaauauaugaacuucuguua

SEQ ID NO: 4118359 - RNA, 103 nt, Human
uaauuagccgaaagaucuugaaggaggaaucaagaaaauggauccaaucaccuugaauaauaugcuucguucuccaagaucacaaauuuauuuugguuauuug

SEQ ID NO: 4118360 - RNA, 109 nt, Human
uaauucaccuaucuacaucuguguauuucuuggacuuuguuuuucauggccauuauuauagacuaaugcuguccaauaggaacauaaugugagucacaaaggugaauua

SEQ ID NO: 4118361 - RNA, 64 nt, Human
uaauucaguuacucuagacacuucauguaaguggaaucaugcagucuuuucugugacuggcuua

SEQ ID NO: 4118362 - RNA, 57 nt, Human
uaauugcugguuauuaucaugucauuauuaacuaguaauaauaguagccggcauuua

SEQ ID NO: 4118363 - RNA, 124 nt, Human
uaauugguaggcugaggcaggaggaucacuugaaccuggaagguggagguugcagugagcugagaucaugccacugcacuccagccugggcaacagagugagauuccaucucaaaaaauaauua

SEQ ID NO: 4118364 - RNA, 73 nt, Human
uaauuguggcuucuuucuuuccauguguacacucaaaggagaacaucuguuugagaaaaagaagccaucauua

SEQ ID NO: 4118365 - RNA, 55 nt, Human
uaauuguucagcagguaacaucuuuucucaagguguuacuaaagaugaacauuua

SEQ ID NO: 4118366 - RNA, 109 nt, Human
uaauuuguucccaauaguagugugugugugugugugugugugugugugugugugugugugugugcaugcacgggcacauaugcuagcguauauaccugucuacaaguua

SEQ ID NO: 4118367 - RNA, 76 nt, Human
ucauucacguuuuuuguugguuucagauggguugaaacaguuuaacaaaucuggaauuaagagaaagugaagauga

SEQ ID NO: 4118368 - RNA, 64 nt, Human
ucauucagaauugcuuggucucugucuccugaagacuguggcuaggauuauuccugaugaauga

SEQ ID NO: 4118369 - RNA, 63 nt, Human
ucauucagagagaauguuccaggugagaagagccaagcaccaaacauggggcccuuugaauga

SEQ ID NO: 4118370 - RNA, 66 nt, Human
ucauucauaacggcaaaugucaccugucggaguuagacggugcacagccugugcugcugugugggg

SEQ ID NO: 4118371 - RNA, 73 nt, Human
ucauucauccauucacugaacaaggcuaaacaagcaguguuuggcacuguucuaggugcaagaagcugacuga

SEQ ID NO: 4118372 - RNA, 73 nt, Human
ucauucaugcugcuacacacaacagggagucauggaaggaagaaggucuggaguguaaagagcauagaaguga

SEQ ID NO: 4118373 - RNA, 61 nt, Human
ucauucauugcuuacccuguguaaggcuagcaagcuguuguuagaacaggguaaaugaaga

SEQ ID NO: 4118374 - RNA, 58 nt, Human
ucauuccugcccgucuuucaagccagguucucccuacucuuguugauucuaggaauga

SEQ ID NO: 4118375 - RNA, 56 nt, Human
ucauucucacacucgucaaugucugcaaaaggaagggcaugagaggugucagaaga

SEQ ID NO: 4118376 - RNA, 64 nt, Human
ucauucuccuuauuuuuauuauguacucuucaagcaaaugugguacauugaagaaugggaauga

SEQ ID NO: 4118377 - RNA, 71 nt, Human
ucauugaauauggggccauacaggauauuuaacuuucuuuuguccauuuguaacaggcuuuaauucacuga

SEQ ID NO: 4118378 - RNA, 61 nt, Human
ucauugaaugagaugcaauagacaaguuauuuauuguagucuguccugucuuguucaguga

SEQ ID NO: 4118379 - RNA, 55 nt, Human
ucauugcagugauguuguauguagcaccuggcaugcaguaugcucagaguaauga

SEQ ID NO: 4118380 - RNA, 56 nt, Human
ucauugccaaccagcaucuuucccuaaucggaauuuauggcucuguuuggcaguga

SEQ ID NO: 4118381 - RNA, 129 nt, Human
ucauugccuccugcuauuaaugagucaucuguugcuucagucagugcugcccagggcuuuauuugccaucucuguguuugagcuuugaaaugagguuaucgauuuaugaucaguguaacuccuggcuga

SEQ ID NO: 4118382 - RNA, 129 nt, Human
ucauugcuguggauuuuugucuuggacuugacauucaugaauguuccaugugaguaaagcacucaaguuuaccugugaccaccuggagcaguaugauuugguguccaguuagcugauccagcuuaaggg

SEQ ID NO: 4118383 - RNA, 75 nt, Human
ucauugggauauacaauggcugaaucauccagugggaaaaauuucuucccuggcuuaaagccaguuguccaguga

SEQ ID NO: 4118384 - RNA, 62 nt, Human
ucauugguuccuugaacccugcacuguggcaaaguggcccacaggcuggaggaggaccaaga

SEQ ID NO: 4118385 - RNA, 86 nt, Human
ucauuguaugcauuauuuguccauucuacuguugauagauauuagguuguuuccaauuuuuaaguggaugacuaaugcugcuauga

SEQ ID NO: 4118386 - RNA, 124 nt, Human
ucauugugucucuucagccuccucuggucugugacaguuucucagaauuuccuuguuuuugaugaccuugauaauuuugaggaagcuguuuucaacagcaagagggaucaaggaagcaaaauga

SEQ ID NO: 4118387 - RNA, 60 nt, Human
ucauuguuuaccaauauugaaugucaguuaguuuggauuuauuagguuggugaaaaauga

SEQ ID NO: 4118388 - RNA, 80 nt, Human
ucauuuaaacacagaugcuuggaccaggcaaugauguagucagcacugaugacuggaaucccaggcucugugggggaugg

SEQ ID NO: 4118389 - RNA, 87 nt, Human
ucauuuaauuuucacgacaauccuacaaagcagggcuauggcuguggcauccauagccuaaaugugaggaacugaggauuugaauga

SEQ ID NO: 4118390 - RNA, 84 nt, Human
ucauuuacauuacucaucggccacugcagacaucagauuuugugacuacugauuugaaagaaaccagugagugaguguacauga

SEQ ID NO: 4118391 - RNA, 65 nt, Human
ucauuuauaaggaugcaauuaaagcauugccaaguuaaaaaugucauguugcucuuugucaauga

SEQ ID NO: 4118392 - RNA, 61 nt, Human
ucauuuccaugucgguauuuuauaaauauucggucuguacuccuccaggcaugaggaauga

SEQ ID NO: 4118393 - RNA, 110 nt, Human
ucauuucuaaauucccugccuaugacucacagauguuucaaggggccuucagaaugccuguggacuuuaguaggugagagccaugggcagaggaaagauguaguagauga

SEQ ID NO: 4118394 - RNA, 69 nt, Human
ucccaaagugcuaggauuacaggugugagccacugcaccuggucugauucuccacuuucuauauaggga

SEQ ID NO: 4118395 - RNA, 73 nt, Human
ucccaaagugcugggauuacaagcgugagccaccacgccuggcccaaugcuuguauuuuuaguagagagggga

SEQ ID NO: 4118396 - RNA, 71 nt, Human
ucccaaauuccucugaucauaagaaucaccugggcugcucaucuuguaauucugagucagaaaguuugggg

SEQ ID NO: 4118397 - RNA, 63 nt, Human
ucccaaccccuucuccuggcuguuccagccucuagcuugagauuccaggggauggggagggga

SEQ ID NO: 4118398 - RNA, 60 nt, Human
ucccaagacuauguucugugugacagccuccaucuguguggcauaaggccaauuuuggga

SEQ ID NO: 4118399 - RNA, 64 nt, Human
ucccaagccauaauggcucaaccuagugguuuggaagaauccaagccagucauuaugagcggga

SEQ ID NO: 4118400 - RNA, 78 nt, Human
ucccaaggucuggcaugaguaacgugagugaggagagagcucugaauucacaauugcauuaugacauagggauuggga

SEQ ID NO: 4118401 - RNA, 62 nt, Human
ucccaagguucagcugaggagggccacauuugagaacaggugugccacuucacugagcagga

SEQ ID NO: 4118402 - RNA, 74 nt, Human
ucccaaugagaugaacaggguaccucaguuggaaauacagaaaucacccaccugcuguguuggucucgauggga

SEQ ID NO: 4118403 - RNA, 71 nt, Human
ucccacacagccaggcccagcacgcagggagaggcgcccucccuggaccagcucuccuugucuguguggga

SEQ ID NO: 4118404 - RNA, 115 nt, Human
ucccacacuaacugguguucuggggugcacagcacaugaauugaugccaagugcucucagauguacuaggaggaggugcuuggcuccauuuuuggugcccucagaggcuguggga

SEQ ID NO: 4118405 - RNA, 58 nt, Human
ucccacaggcccagggcggaaacuguucccacagcagcaaggcccuccggccugggga

SEQ ID NO: 4118406 - RNA, 56 nt, Human
ucccaccacugccuucucugggacccaaccuccagacaucaggaugguggcuggga

SEQ ID NO: 4118407 - RNA, 130 nt, Human
ucccaccaugccuccuguccaacacugaagauaacaauucaacaugagauuuggguggugauaugguuuggcuguguccccacccaaaucucaucuugaauucccacguguugugggaacaaccugguga

SEQ ID NO: 4118408 - RNA, 55 nt, Human
ucccacuucagagaagaauuagacuguucccaaugucuucacaucugugagggga

SEQ ID NO: 4118409 - RNA, 98 nt, Human
ucccagacuccucccagaaccugagaugugagcacuuggcccugagccuguuccagagaacuucaggacuaggggcuucaagguuaaaggggcugggg

SEQ ID NO: 4118410 - RNA, 94 nt, Human
ucccagagccuuguacuuugugaguacaucuuaauuugacuaauugaauuuaucacucuuuuggucaguugguguuuugcaaacacauuuggga

SEQ ID NO: 4118411 - RNA, 63 nt, Human
ucccagaggaaauggcagcugauuugaguuugaaaagacagcuggcagucauccuagugagga

SEQ ID NO: 4118412 - RNA, 77 nt, Human
ucccagagggauugcuauauuuagggaaagucuuucuuaacuagugaaagacuggaaggugaggcuguuuacuggga

SEQ ID NO: 4118413 - RNA, 105 nt, Human
ucccagaugaacuucucaucuucucagacuagagaaauggggagagaauuggggugcggucacuugacccuucucuagccugugggaguugcaaaguuccuggga

SEQ ID NO: 4118414 - RNA, 65 nt, Human
ucccagauggagugauugauugauauuuaccacacggagugauagagcaguagaucaccauggga

SEQ ID NO: 4118415 - RNA, 73 nt, Human
ucccagccucagaggucuacugggccaaggucaagguucugaucaggaaagaguggaacucugaaaauuggga

SEQ ID NO: 4118416 - RNA, 56 nt, Human
ucccagccuccugacaguuuugcaaucuaggcaaugucuuucucaaggaccuggga

SEQ ID NO: 4118417 - RNA, 69 nt, Human
ucccagcuucuccugucagagggugucagccaacaucuuggagaauggcagagaagcaagcucuuggga

SEQ ID NO: 4118418 - RNA, 90 nt, Human
ucccaggaccuagucuaguucucucagccuccccguugguggcuguuuucaacuuggagggagcuggguggaaucuuuacuugucuggga

SEQ ID NO: 4118419 - RNA, 55 nt, Human
ucccaggagcaccuuuugagcccaacucacauggcuaucucagggaguucaggga

SEQ ID NO: 4118420 - RNA, 80 nt, Human
ucccaggccucuguuccccauguuuuccuuccuagacaugaaaauaugaauggaaaaacaaggagaacagggcuaaagga

SEQ ID NO: 4118421 - RNA, 91 nt, Human
ucccagggcuccaugcagcggcguuugguuuaaaguggagagaggauacgcuuagguuaaaggcagcugcaaggagaccuguguccuggga

SEQ ID NO: 4118422 - RNA, 77 nt, Human
ucccaggggcgcgagagagggcgacguagagcagcaccgcccagcggcagagcggcgagccccuccgcggcucgggg

SEQ ID NO: 4118423 - RNA, 118 nt, Human
ucccagggggagaguguaucuguugguuggcuggauucucaucagagccagagcucugcccucccucuggcuguguaugagaguuuuuguuuccuuuguaaacucccuuuccugagga

SEQ ID NO: 4118424 - RNA, 77 nt, Human
ucccagucagaaaaaucuauuauuuuuauucgagggaaaucauauuuuccaugcuuaacagugacagauauguggga

SEQ ID NO: 4118425 - RNA, 76 nt, Human
ucccagucguugggccgucuucacuggugcuuccugaacaaucucuacgcugcacuugaggacgacucagcuggga

SEQ ID NO: 4118426 - RNA, 61 nt, Human
ucccagugcaggcucgcuugugaggccuggggaaaggcacggaggaagggccguacuugga

SEQ ID NO: 4118427 - RNA, 103 nt, Human
ucccaguggcagcaacagugccuguggcugcagugguguacagagaaggggucccacucuguguacaagccugaguacagaggccacucugccaguuguggga

SEQ ID NO: 4118428 - RNA, 85 nt, Human
ucccaucagauguucagcauagcagcuucaggacuaucaucuaagggaaggcggaagaagcugguuauguuggugucugauuuga

SEQ ID NO: 4118429 - RNA, 88 nt, Human
ucccauccugcccuuacuccagcccagcuccucucagaacuuaggaguggagcaguggcuggguugggggaagagcaagcccuuggga

SEQ ID NO: 4118430 - RNA, 79 nt, Human
ucccaucuguuuaggugaguugauuccauuuuucacuuuggaaaugugaguggcaucaacuuuaucuguagcagaggga

SEQ ID NO: 4118431 - RNA, 72 nt, Human
ucccaugagugugccauccucaggcccuggggucuccuaggcaagaccagggccucugugggcucucucgga

SEQ ID NO: 4118432 - RNA, 129 nt, Human
ucccaugcugaugcccauguaaacuuaaagugguuuaauaucuauuggcuuuuguguauaguuaguauugcaaaagaauauagauauugucauaauuauguggugucauaacauuggcaaagugguagg

SEQ ID NO: 4118433 - RNA, 87 nt, Human
ucccaugcugugacccucuagagggaagcacuuucuguugucugaaagaaaccaaagcgcuucccuuuggagcguuacgguuugaga

SEQ ID NO: 4118434 - RNA, 109 nt, Human
ucccaugugauggacaaacacucagaacccagcagcaguguucuagaaucuuugugagggacaaacauucagaaucuuguagcaguguucuagaauccuauuuauggga

SEQ ID NO: 4118435 - RNA, 98 nt, Human
ucccaugugccuuuaaggaaucauucuugaucucagccauaaaauuggaaagcugcauaacugacaagaugaucccugaaggcagcugaaacaugggg

SEQ ID NO: 4118436 - RNA, 78 nt, Human
ucccauuagccaaagcaagucacaugaucaaguccaaauguaaaaggcuggggggcaugugacugcuuuuguguggga

SEQ ID NO: 4118437 - RNA, 96 nt, Human
ucccauucgcgcuaccaccgcggccgcagccccaggagucgccgcggagccagcgucgcccuccagcuguugcgcgucggaagccggaagcaggga

SEQ ID NO: 4118438 - RNA, 73 nt, Human
ucccauuucaauggaaagcuuuuaccgaaucugaaaugcaaugagauuccaucugguaaaauucauugaggga

SEQ ID NO: 4118439 - RNA, 58 nt, Human
uagaggaacugccuuucuucuguuuagaagagacagagaagggagagcauuuccucug

SEQ ID NO: 4118440 - RNA, 71 nt, Human
uagaggaauguucagcuuucuuacuuaaggaugaaacccaacauuuuuaaucuggccugaauauuuuucua

SEQ ID NO: 4118441 - RNA, 64 nt, Human
uagaggagcuguguuauccauucccaggcacagcaugggaauguggcaaggcauagaguuucua

SEQ ID NO: 4118442 - RNA, 93 nt, Human
uagaggcaaaaucuuugauggagagauagauauucugagacucuauggucuuauaugcauauauccuguuucucaucauacuuuugccuacua

SEQ ID NO: 4118443 - RNA, 63 nt, Human
uagaggcagugggaaauaagugagaaaggugucauuucgcucuucuucugccuauugugucua

SEQ ID NO: 4118444 - RNA, 111 nt, Human
uagaggcuuuucuuaauguauucaccugguguguucaguuauuucugaagauauagaaauguuugaugaaaugaaugaagauacagaauguagauucaguaucaagcucua

SEQ ID NO: 4118445 - RNA, 69 nt, Human
uagagggaauaucagagcaacaucagggccuaggucauauagagcccugugguucugguaaggauuuug

SEQ ID NO: 4118446 - RNA, 55 nt, Human
uagagggggcaguaaccucaaaguguuaccaaccuuugggauaacuguucuccua

SEQ ID NO: 4118447 - RNA, 74 nt, Human
uagagguuauuucuguaugcauaaaaggaaaaaaaaguuuguuuuauguccuuuguaugugauauggaucuuua

SEQ ID NO: 4118448 - RNA, 55 nt, Human
uagagguuggccuuagaaagauucaaaauagaaaaauuuuaagcuauuaccucug

SEQ ID NO: 4118449 - RNA, 85 nt, Human
uagaguaacuggagcagagagguggcugcauaugaaaagcuuuuccuuguccuugcagacaucucucuucaaaccagucacucug

SEQ ID NO: 4118450 - RNA, 62 nt, Human
uagagucaauggccauugggucaugcuagcuaagaaagcacauguucuugaagccaacucug

SEQ ID NO: 4118451 - RNA, 65 nt, Human
uagaguccuccaucccuaucuguguucgucaacagcaggugaccuucacaaaugaugaggaccug

SEQ ID NO: 4118452 - RNA, 56 nt, Human
uagaguccuucauucugugcagaugcacuuggcaucuagagugggaccggagucua

SEQ ID NO: 4118453 - RNA, 57 nt, Human
uagagucucaaugaauagccugcugaaauuccaauggcuuuaucaaaugagacccug

SEQ ID NO: 4118454 - RNA, 64 nt, Human
uagagugagcaaaguucuauguucucaacaaugauugccaacaugucuuacuuugcuuucuuug

SEQ ID NO: 4118455 - RNA, 62 nt, Human
uagagugcugucaaagacuuguguuacucauuccuaagcauaugucaugcaccagcacuuua

SEQ ID NO: 4118456 - RNA, 94 nt, Human
uagaguuauuaccccuggaggucauaaguguauagauguguauucacaugaguuuccaucacuagguuaugcugccuugaggguaagaagucug

SEQ ID NO: 4118457 - RNA, 64 nt, Human
ucccaaagugcugggauuacaggccugagucaacaugccuggccuccuacaguacuuuuuaaga

SEQ ID NO: 4118458 - RNA, 57 nt, Human
ucccaacaggagucagaccuaggaggagaaagguccuaggcucacucaccuugugga

SEQ ID NO: 4118459 - RNA, 57 nt, Human
ucccaacuugaaccugggagucaaaaagauagcucagucaccaggugggaggugggg

SEQ ID NO: 4118460 - RNA, 59 nt, Human
ucccaagauuauugagggagggaguuccuaugcauuucucuuugagcaagauccugggg

SEQ ID NO: 4118461 - RNA, 82 nt, Human
ucccaagccagggagccagagauggaggaggagguggaagaguccgggcugccucuguagcuuuggacccuaggcagaggga

SEQ ID NO: 4118462 - RNA, 87 nt, Human
ucccaagccuaacauagaaccuggcacauaguaagccaacacuugucaagggcuuacuaugugccaggcucuguguuaggcuuggga

SEQ ID NO: 4118463 - RNA, 63 nt, Human
ucccaagcuuggggugggcaauguaggcaagucgaucgagcuuguggcugacacccuuuggga

SEQ ID NO: 4118464 - RNA, 63 nt, Human
ucccaagcuuggggugggcaguguaggcaaguugaucgagcuugcagcugacacccuuuggga

SEQ ID NO: 4118465 - RNA, 74 nt, Human
ucccaaugagaugaaccagguaccucaguuggaaaugcagaaaucacccacuuccuguguuggucuugcuggga

SEQ ID NO: 4118466 - RNA, 70 nt, Human
ucccacacaugucucuccaugcucuucucuguuuuacagaguggauggagaugaccauggugaccuugga

SEQ ID NO: 4118467 - RNA, 55 nt, Human
ucccacaggaggaguuggaaaugaaucucaaauuucaccaaggccccugcugggg

SEQ ID NO: 4118468 - RNA, 111 nt, Human
ucccaccaaagcuuggcauggcaguggcaaaugccugugagagugguggccuaggcagggugccugggucuuguuccccacacugcccaccaccagucauggcgaguggga

SEQ ID NO: 4118469 - RNA, 61 nt, Human
ucccacccuaguugguuguagaaggagaacgugccagaaccuccaccaggaaggguaggga

SEQ ID NO: 4118470 - RNA, 84 nt, Human
ucccaccgggcagacguuaugugagcagccucaccugaggguagagaauauucuuuaauggggcccuuauucugcucucuggga

SEQ ID NO: 4118471 - RNA, 67 nt, Human
ucccacuagaucuuggggggaucaccaugguggacuugcucacacaugagagcccccaagagcagga

SEQ ID NO: 4118472 - RNA, 64 nt, Human
ucccacuauuauccuauguggguucacagaugaaaacucaaggcccaaaagguaaugaguggga

SEQ ID NO: 4118473 - RNA, 81 nt, Human
ucccacucacuaggucaucccuguccucccucaguuggggcaaaucucgcuggccuggaggggagccagagaaggugugga

SEQ ID NO: 4118474 - RNA, 68 nt, Human
ucccacucucuucacucuaccuuuugacuccacaguggaaaccagaaguaguccaguggaaaguagga

SEQ ID NO: 4118475 - RNA, 71 nt, Human
ucccacugaacuuuuucuccaauucacauacuagccggacuuggauuuucuggaaagauuucaguugagga

SEQ ID NO: 4118476 - RNA, 68 nt, Human
ucccacuggcuucugaguuaacaguagauuuuggggaaacaagaguauaggcaggaugccaguuggga

SEQ ID NO: 4118477 - RNA, 56 nt, Human
ucccacugucaggcccaagaagcucagagugguggcugaaggagccugggguggga

SEQ ID NO: 4118478 - RNA, 83 nt, Human
ucccagacuacccaacccugucggacccacugcugcuguuuauauaaagagcccagggaguugauuagcauuugggucuggga

SEQ ID NO: 4118479 - RNA, 64 nt, Human
ucccagagggaagaggaagcgcugagaugaguccucacucacggaugcuuuuuucccacugggg

SEQ ID NO: 4118480 - RNA, 58 nt, Human
ucccagccauuccuuuagguguuuccuuaguugaagagccugaugaauguggcuggga

SEQ ID NO: 4118481 - RNA, 106 nt, Human
ucccagccccguccacugucauuccuccuuguucaucaagagcuuugccucugguagcagaaagcagguggccacgaggaggagcugugggacuugggugcaggga

SEQ ID NO: 4118482 - RNA, 76 nt, Human
ucccagccuuagcccucccuacagccuauuucuguccacacauaggaaggcaggaggcaggccugaaauccugggg

SEQ ID NO: 4118483 - RNA, 62 nt, Human
ucccagccuuccagucugguuuucaucguuucagaauaaacgucaaggcuuagaaggugggg

SEQ ID NO: 4118484 - RNA, 61 nt, Human
ucccagccuuccuuguggugaaucaccugagaaugcaggaugugacucagggaguuugggg

SEQ ID NO: 4118485 - RNA, 59 nt, Human
ucccaggcaggugacagggggacagauucacacuccaauccucaccuuuuugccugggg

SEQ ID NO: 4118486 - RNA, 113 nt, Human
ucccagggaaugcuuacuggacucugcugaaggugccacuucccucagacuauggugggagcggguaugaggaugaggguggcaugcacagaguugaguuaacagguguggga

SEQ ID NO: 4118487 - RNA, 59 nt, Human
ucccagggacaccaagcuguuucugauugcaacuguaacagccuguguaccagcuggga

SEQ ID NO: 4118488 - RNA, 64 nt, Human
ucccagggacugggcuaggcuuugcauggaagauaaauuacaauagagcuccuggucucaggga

SEQ ID NO: 4118489 - RNA, 88 nt, Human
ucccagggcaggcauccauccccucagagaucaucuuuaaccugccaggaauggccuggguuccaugaucuccagggcugcccugaga

SEQ ID NO: 4118490 - RNA, 61 nt, Human
ucccaggguccucuucuggaauccaacuagaguuccuaagggaggaggauccccagaggga

SEQ ID NO: 4118491 - RNA, 69 nt, Human
ucccaggugggggcagggcgguccugcgucacggcugacacugcaggcuugcccggccuccuucucgga

SEQ ID NO: 4118492 - RNA, 62 nt, Human
ucccaguagccuucucaagacaaaguugccuuuguguaacuacaacugggaggcuuugguga

SEQ ID NO: 4118493 - RNA, 59 nt, Human
ucccagucuagagccggauuggcgaguuagacgcuuguagauccaagguuggauugggg

SEQ ID NO: 4118494 - RNA, 67 nt, Human
ucccagugaugaaccuaggacuguaggcucuaacuuggaagucagcuacaaguucauucacuaggga

SEQ ID NO: 4118495 - RNA, 58 nt, Human
ucccauaccuagggcuuuucccaccacucaagcucaggggaaguccauggguuuggga

SEQ ID NO: 4118496 - RNA, 78 nt, Human
ucccauaugucauccaugauugcccagaggugucucauaaagagaauuucucucugaauccugaaguacuauauggga

SEQ ID NO: 4118497 - RNA, 66 nt, Human
ucccaucucagcuuucugcuuccacugcagacuucccugucuaucacuagcagagagugaauggga

SEQ ID NO: 4118498 - RNA, 64 nt, Human
ucccaucucuggcccuguuuucuaucuguggaaagcagaugcaugaguugggcuaggucaggga

SEQ ID NO: 4118499 - RNA, 58 nt, Human
ucccaugccugcuguuuauguccucccuccccauuugaucuaaacaguuggcaugggg

SEQ ID NO: 4118500 - RNA, 129 nt, Human
ucccauggcagaagggacuuuguagauguggaugagucgccgaccuuugguggagaugguucuggauuaucugggggcgcacagucaccacaaagguucugagaaggagauggcaggaaggucagagga

SEQ ID NO: 4118501 - RNA, 104 nt, Human
ucccauuagcaaaagcaaacuguguaugcagagagcauuucuggaaggacagcagagaaacuuuuaacaagcaugcuucagcgguguguuggggcuggaugggg

SEQ ID NO: 4118502 - RNA, 81 nt, Human
ucccauucacuuucacucccuucucucuuuccaagcucauauaugauuggguuggcuugggacuggagaauaggguuggga

SEQ ID NO: 4118503 - RNA, 73 nt, Human
ucccauuccagugcucugucaacaugucaaagggcuauuaagcaagugacuaguugccggggcuggggaggga

SEQ ID NO: 4118504 - RNA, 59 nt, Human
uccccaaagauucccucuggcuucuugccuguaaaugaagccuggguauccuuugagga

SEQ ID NO: 4118505 - RNA, 130 nt, Human
uccccaacucuguugggguguagaugcaggccgcccuuccuccauuccuuccugccagagacucaaugugaauagugucugggccuuggaguggggagaaucugcuggcccuucacaccuucgcuguggg

SEQ ID NO: 4118506 - RNA, 82 nt, Human
uccccacaugggaaaacaaugaaauauuuuuauggaccacacaauggaauuauauuaugcucguuuacugauuaugugggga

SEQ ID NO: 4118507 - RNA, 65 nt, Human
uccccacucagaagaaacaagagaguuugcuguugccuuuccugaaaucucuucugcagcaggga

SEQ ID NO: 4118508 - RNA, 80 nt, Human
uccccacuggagagcugcagaggugcaaugaaccagcaaggggaguucugcuggguuugccuuucaccaugccaggggga

SEQ ID NO: 4118509 - RNA, 63 nt, Human
uccccacuucccaggccccugcccuggggauuccaaagcagcggauugggauagugccuggga

SEQ ID NO: 4118510 - RNA, 71 nt, Human
uccccagaagcauuuggcaugaaacucuuguucuucaaagaauaucuuucaggccuaguguuuaaugggga

SEQ ID NO: 4118511 - RNA, 64 nt, Human
uccccagccucgcagcccuccagaagccagcccucagcugggagcagcuuugcgagggagggga

SEQ ID NO: 4118512 - RNA, 71 nt, Human
uccccagcgcccaagcccaggcugccgguccggucugggugccaccgagguccuggacuuggcccugggga

SEQ ID NO: 4118513 - RNA, 71 nt, Human
uccccagggccaaguccaggaccucgguggcacccagaccggaccggcagccugggcuugggcgcugggga

SEQ ID NO: 4118514 - RNA, 55 nt, Human
uccccagggggugggugaugacagauggacucaugacucucccaaguuugaggga

SEQ ID NO: 4118515 - RNA, 123 nt, Human
uccccagugccuucguccaacuccaggcacugaccccuccagggccccucucacuggagcagggcagcuccccuagagcaaaggggccucuuggccagucaggcccucguuacccacugggga

SEQ ID NO: 4118516 - RNA, 57 nt, Human
uagcgcauccuaaugucuucaggucuuacuuacuacagugaaguuaguggugugcua

SEQ ID NO: 4118517 - RNA, 75 nt, Human
uagcgcggcacuuaccucucucuaauggugggauaaagacccugccaguuuggggccgggauaagguuguuguua

SEQ ID NO: 4118518 - RNA, 78 nt, Human
uagcgggccuuaggcccaguucuuucuagacacguagacuucaucaagcugagaaaaaucaggcccuauagcucgcua

SEQ ID NO: 4118519 - RNA, 105 nt, Human
uagcuaacauuuguaggauacuuuauagauuauggcaaugaauaccccagcucucuuucauuugccuugugauuuguaaguacucugacuacaugcacugugcua

SEQ ID NO: 4118520 - RNA, 73 nt, Human
uagcuagcaaggcguggcacucaaauguggacuugagucugaagaauuugaaagccaccgcuccugugugcua

SEQ ID NO: 4118521 - RNA, 73 nt, Human
uagcuauccagggagucucugcuuuauacaagguucugugcaauguacaaagccagaacucccaacucagcug

SEQ ID NO: 4118522 - RNA, 58 nt, Human
ucauuugccugucucuauuucagcaaaaguuaaggcugaaaauuaagcagaugaauga

SEQ ID NO: 4118523 - RNA, 102 nt, Human
ucauuugggguccaucuuauuuccuggggcacagcugggucucuuuucccaguugccaaacugaaggagucucagcugggccugaggaagggcaguagauga

SEQ ID NO: 4118524 - RNA, 60 nt, Human
ucauuugguccucccaacaagccugugagguacacauaguaaaauggagggaccagguga

SEQ ID NO: 4118525 - RNA, 59 nt, Human
ucauuugugcauuguuuuugccagccaaggcaguggcuugaagagacagcagcaaaaga

SEQ ID NO: 4118526 - RNA, 82 nt, Human
ucauuuuaucuucuguguagaaagaauauguuucauaaagucccuuuagagguaaugaaguuuuuacacaaagcugagauga

SEQ ID NO: 4118527 - RNA, 119 nt, Human
ucauuuucagcuucacaaagaggaugcagccccaccucccagcgggagucaguucugcucugagacgugaggcucagaaucagaugaagacuccugcugcugcaucuugaagauaauga

SEQ ID NO: 4118528 - RNA, 78 nt, Human
ucauuuucauggagucaucuuaaucuaggcaacuccauaaguugccuagauauguugguacucugugagcacagaugg

SEQ ID NO: 4118529 - RNA, 81 nt, Human
ucauuuucgccuuuagccugaaauaguuuaugaggcuauuacggucucugaguucauaccaggcuacccagaaaaaauuga

SEQ ID NO: 4118530 - RNA, 64 nt, Human
ucauuuucuguucucuguguuagaacuagacaauguuauguucuaauaggagaaaagacaguga

SEQ ID NO: 4118531 - RNA, 67 nt, Human
ucauuuugguccaucucuugagcccacaugaauacugucauggauggaggaggaaggaccaggcugg

SEQ ID NO: 4118532 - RNA, 59 nt, Human
ucauuuugugccuuaugaccgcugggccaccccuagaauccugguugaguacagaguga

SEQ ID NO: 4118533 - RNA, 93 nt, Human
ucauuuuguuagucuccugggcuugguuguugagaacccaagaauauauaucuguucccaugccuccaagcuucagugaauuaaugaaaauga

SEQ ID NO: 4118534 - RNA, 72 nt, Human
ucauuuuuagaggggaaaguggcugguuuggacuuauuaacaauauuugcaauguguccucuuuauggauga

SEQ ID NO: 4118535 - RNA, 61 nt, Human
ucauuuuucacacagggucaccagaauaccaucaauuuuuugguaucacugucaaaaguga

SEQ ID NO: 4118536 - RNA, 60 nt, Human
uccaaacaucuaucagcauuuuuuacuggaucacuggaagaugccuuuggcauuuuugga

SEQ ID NO: 4118537 - RNA, 64 nt, Human
uccaaaccaggacaauuuugaaaguaaaagaaguugcuuuuaauaauuuaacuggaaccaggga

SEQ ID NO: 4118538 - RNA, 75 nt, Human
uccaaaccaguaggcugggaaggaaggccuggaaguugcguuucuaacaaaccuccagcauuacuggcccaugga

SEQ ID NO: 4118539 - RNA, 68 nt, Human
uccaaacuaguaucuuccgugccaugcaauaagggcuacauugcaaggcugcagagggugcuacugga

SEQ ID NO: 4118540 - RNA, 81 nt, Human
uccaaacucuuuguuguggccuacaauggcuugucucugugcccgucaccaaguuuguaugccaacagcaaagugugagga

SEQ ID NO: 4118541 - RNA, 91 nt, Human
uccaaagguaugaaggaaagaaggguggcugacuguuuuguggauuauaguagggguuuuuagauuacucagccaccauucaucaccagga

SEQ ID NO: 4118542 - RNA, 77 nt, Human
uccaaauagaauucauguuacuguuagcacaaauaaugugccuaaauaccuuuguaacuggguucccuaaguuuggg

SEQ ID NO: 4118543 - RNA, 101 nt, Human
uccaaaucuaugaagucaaagaaacucaguucuuuccacaaugcaauaaaaaguuguacaagaggagaaaauggaguuuuaaacucauguaaaccuuugga

SEQ ID NO: 4118544 - RNA, 61 nt, Human
uccaaauuccucaguuagugccugaggccuggaggcugaaggcaguaacugggggcaagga

SEQ ID NO: 4118545 - RNA, 124 nt, Human
uccaacacugaaagauuacaauuugacaugagauuuggguggggacacagauaguaacugauauggucuggcucuguguccccacccaaaccucaucuggaauuguaauccccacauguuagga

SEQ ID NO: 4118546 - RNA, 72 nt, Human
uccaacccugaagaauauuuccugcacuugggauuggugcaaaauuccaguagaauuuuauucaacagugga

SEQ ID NO: 4118547 - RNA, 107 nt, Human
uccaaccuugagcugcgcggguuccaagagccaggcccguacuugcuguugaugucauuggcuuggggaguugggguuuggugcccagcgcggucguugggggaggg

SEQ ID NO: 4118548 - RNA, 55 nt, Human
uccaagaaucagucucuuuugggggaaaauaauccaacagaggcagauacuugga

SEQ ID NO: 4118549 - RNA, 83 nt, Human
uccaagaaucaucuccagccacagaaugaucccugggguuucacucuuggagagccuuggugaucugggcuggaagagaugga

SEQ ID NO: 4118550 - RNA, 67 nt, Human
uccaagacuuugaacaguguaucaguaaucucggaagaaauucaguauuuauauacaguucauugga

SEQ ID NO: 4118551 - RNA, 55 nt, Human
uccaagaggagacacugggaugagccccgacggguggccauguguuccuuuuggg

SEQ ID NO: 4118552 - RNA, 97 nt, Human
uccaagaucuguuuagauauuagagguagauggucagccaaugauggaaacgaauauucugcuaccuucucuuuuaagucucacaucucacuaugga

SEQ ID NO: 4118553 - RNA, 62 nt, Human
uccaagaugguuggugugguggugcacugugaagcaguuccaugaacagcuaacauuuuggg

SEQ ID NO: 4118554 - RNA, 63 nt, Human
uccaagcuugaacugaaauugucacacucucuaguguuggcgcaacucauucaugguguuggg

SEQ ID NO: 4118555 - RNA, 72 nt, Human
uccaaggccccaucccaucccuuuuuucgaguuuggacacugugggguggagaugguggcccuuuaguugga

SEQ ID NO: 4118556 - RNA, 55 nt, Human
uccaaggguucaugugcauucauccauuaacgggucuugcacggucacccguggg

SEQ ID NO: 4118557 - RNA, 57 nt, Human
uccaaguauaaauuagauacugugggucaucuuggcaaaucugagguuguauuugga

SEQ ID NO: 4118558 - RNA, 55 nt, Human
uccaagucuuccuucccaaaccuuugucauuuagggauugagaagcugaguuggg

SEQ ID NO: 4118559 - RNA, 129 nt, Human
uccaagugccaagaugauuaguucaguccacaaaauuucuugggagcucagagaauaaaaagaucacugugguuugggaagccuagagaaagguuugguggaagagcagguacucagcuaggccuugga

SEQ ID NO: 4118560 - RNA, 79 nt, Human
uccaagugugacauuuaucaaaaccuugacuuuuaauguaaacuuuauuauaugaguugggguuugaguugacacugga

SEQ ID NO: 4118561 - RNA, 63 nt, Human
uccaaguuguccuaaccuuugguggaguaaagaaacuaucuacaaaacuuaggugacuuagga

SEQ ID NO: 4118562 - RNA, 63 nt, Human
uccaaguuucuucugcacaacaguauaaauauaacuaaggugggguggagaaggagauuugga

SEQ ID NO: 4118563 - RNA, 107 nt, Human
uccaaguuugaaggagccagggacaugaaccccugcuucaccucuuaagauggauguuaggucaggagcaaggagcagugggauaaagguuucccuggaagcuugga

SEQ ID NO: 4118564 - RNA, 110 nt, Human
uccaauuauacauaugcuuaaauugcauuagcuaauggugaagauucagacuuuucuaaguuuugauuugucuauuauuuaauuugaauuauugauaugaugacauugga

SEQ ID NO: 4118565 - RNA, 116 nt, Human
uccaauuuuuucuuaaagaaguuacacuuaaguuuggggagaauuucauuucauauuagccgcuguaggaguugaaaaaaauggcuacuggaacuuagugggaagaaaaggaagga

SEQ ID NO: 4118566 - RNA, 59 nt, Human
uccacacccagccuggcacacauccugugugugucucugucucccagguugugguggga

SEQ ID NO: 4118567 - RNA, 82 nt, Human
uccacacucagacagucaucagagcuugucuauucacccaaggggugugauccugcaguucugaggcugcuguauaaaugga

SEQ ID NO: 4118568 - RNA, 68 nt, Human
uccacagagguguggagaaauaugugauuugggcugaguaucucauuaauucuuacaacacccuggga

SEQ ID NO: 4118569 - RNA, 97 nt, Human
uccacagcuugaaguuaccuccaaucuuuacaagaaauucuuuuagagcuuccuuugccugacuuuagagaugggaggucauagcuucucaccugga

SEQ ID NO: 4118570 - RNA, 98 nt, Human
uccacagguuuuuggauaauccuuuaucaaguugcugaaacuuuaucaaaauccuuucaagaacagcaggcaagaagugagguccaauaagccuugga

SEQ ID NO: 4118571 - RNA, 73 nt, Human
uccacauauucugguguguuuuugccaucaacugaaaaagcagaauuggucaaaagcuacuaugaaugcugga

SEQ ID NO: 4118572 - RNA, 64 nt, Human
uccacaucacaggucccucagauaugaccagagaccuccucaagucugagacuuguagugugga

SEQ ID NO: 4118573 - RNA, 68 nt, Human
uccacauccauugcuugacuuuuuaaagagacucucugucuugauuuaaguuccugggguggguggga

SEQ ID NO: 4118574 - RNA, 70 nt, Human
uccacaucucagggaccuucuuugugcucguuuuaaacuuaucacacagacagcucucugaagacaugga

SEQ ID NO: 4118575 - RNA, 66 nt, Human
uccacaugaacaugcuggaaaagccagcuuuccaaggaacauggcuuuugauggcuguucauggga

SEQ ID NO: 4118576 - RNA, 60 nt, Human
uccacccuccucccagcucuuggacaggggcauuccuggcacccuuggguuggaggugga

SEQ ID NO: 4118577 - RNA, 93 nt, Human
uccaccucugaagcccauguucuucccauuaccccacgauccuggccaagaaucagggcagaugugcaugaugggaagggcggcguggaugga

SEQ ID NO: 4118578 - RNA, 78 nt, Human
uccaccucuuccaccuuguagucuugggaaugcuaaaagcaauaaggccaggcaucugcagccgcguggggacgugga

SEQ ID NO: 4118579 - RNA, 92 nt, Human
uccaccuggguagcagcacuggccuggcagggagggcauggccagucucacuccuuuagacccugccaggccucugggcagaacucagugga

SEQ ID NO: 4118580 - RNA, 69 nt, Human
uccaccuuuuuuguuaauggcccuaagccugaaauaucagcugcuguucagaagcagaaaauagguggg

SEQ ID NO: 4118581 - RNA, 77 nt, Human
uccacgagcgagcaucuguuaacaaagaagacagcccugcuguugaugguguugaugagaagagcuccuuuugugga

SEQ ID NO: 4118582 - RNA, 77 nt, Human
uccacguggccucuccuugaggcuuggacuucucacaauauggcagcuggauuucaagagggagugcaccaagugga

SEQ ID NO: 4118583 - RNA, 68 nt, Human
uccacguggggcaggcggguguccagaucggcaaugccugcugggaacuguacugccuugaacaugga

SEQ ID NO: 4118584 - RNA, 59 nt, Human
uccacuacguggucugaaugugucugaagaaaaacagagcacagauaacauggagugga

SEQ ID NO: 4118585 - RNA, 100 nt, Human
uccacugaacaagcccauauauuuuuccucuuuguucuccuuuagcuauuuccaugccuaacucaaaggagacacaaggagaaagugagcucagccugga

SEQ ID NO: 4118586 - RNA, 85 nt, Human
uccacugagaggcgacccagggccacagcccgcaguagaucuguugcuacagccaaaggggcuuggcccugggccaaacaggaga

SEQ ID NO: 4118587 - RNA, 58 nt, Human
uccacuguccccugcuuccuugcccuucagaaaggucuuggaaacaggggccagagga

SEQ ID NO: 4118588 - RNA, 90 nt, Human
uccacuguugaaagcuguacaauguuaccuauuuauuugcagacauccuuuggaaacaaauagguagauuugcaacaaauaaagagugga

SEQ ID NO: 4118589 - RNA, 63 nt, Human
uccccuaagcagaugcugucugcacaaacuuauuuuggaagacagugcaucugcugacaugga

SEQ ID NO: 4118590 - RNA, 56 nt, Human
uccccuccaacuccaacuaugguucugaggaccagaaugggagcuguggagggaga

SEQ ID NO: 4118591 - RNA, 58 nt, Human
uccccucuggagcuucuguaagaagaguccauuguuuccacagaagcauagaaaagga

SEQ ID NO: 4118592 - RNA, 76 nt, Human
uccccugguguuggagucuagccaaccuuggagugugcauaggccuccagcuagggcuggcuuacuuagcagggga

SEQ ID NO: 4118593 - RNA, 81 nt, Human
uccccugucugccucggugucccuugcucagggcucuugauggggccugggagcacaucgggguccuugcaagacccggga

SEQ ID NO: 4118594 - RNA, 58 nt, Human
uccccuguuccuccuccaacccaggcugggaccccugauggcaggaggcagcagugga

SEQ ID NO: 4118595 - RNA, 62 nt, Human
uccccuuggguguuuaauagauauaucagaucuaauaugucuaauaaugcaucucaaaugga

SEQ ID NO: 4118596 - RNA, 56 nt, Human
uccccuugugugugauuccauuccauugguauggaauauuugacacauagggugga

SEQ ID NO: 4118597 - RNA, 80 nt, Human
ucccgagccaaaauugagaaaauucgagcaaguuuauuuaacaauaaugacuugauugguuugucaaguuuggaugguga

SEQ ID NO: 4118598 - RNA, 72 nt, Human
ucccgaguagcuagaacuacaggcaugugccaccacgcuuggcuaauuuuuguauuucuaguagagacgggg

SEQ ID NO: 4118599 - RNA, 123 nt, Human
ucccggcacacggugcuguguuucuccacucuugggcucugcagugacuugaggggucaagucuaugaucccacgggaggcugggcuaaugaggggaccagagaccucagugcugugcaggga

SEQ ID NO: 4118600 - RNA, 65 nt, Human
ucccgguccaucacagggcuguugggcacagacacacuugcccacucagcccuguggagcaggga

SEQ ID NO: 4118601 - RNA, 88 nt, Human
ucccgugguucuuuguggcauuuguauucaagaguuccauauaugugaaagcuucugagaauaguaaaugcccauaccaacguaagga

SEQ ID NO: 4118602 - RNA, 55 nt, Human
ucccgugucuuuuuccagcccugagcgaaggcugugggguuggcuggcacaggga

SEQ ID NO: 4118603 - RNA, 65 nt, Human
ucccuaagaggccacucucuccagcugaggugauaaagaccugggaaaaggaguggccaugggga

SEQ ID NO: 4118604 - RNA, 92 nt, Human
ucccuaccuggcggcaucaaagagagaggacuguuaugaccuccugcggguccugacagggaaagguccucuuuugggggcaacugugggga

SEQ ID NO: 4118605 - RNA, 59 nt, Human
ucccuagacugagagcaugucagggcuagaaggaaccuuacagagccucauuuuagaga

SEQ ID NO: 4118606 - RNA, 112 nt, Human
ucccuagcaggccuagggggggucuggggcaggggucucccuuggggaguggcgucugccagcugcugugcagggaggcucuccugcucauacccucuucugggcacaggga

SEQ ID NO: 4118607 - RNA, 73 nt, Human
ucccuagcuggugggaucagccucagcaccuuagcaaguauaagugugucugccaccccaucaagcucaggga

SEQ ID NO: 4118608 - RNA, 104 nt, Human
ucccuaguaucaucacucagucguguacuuagcaccuugaacagacccuggcacacauuagguucucaguaaguguugaaugaaucagugagugaauacaggga

SEQ ID NO: 4118609 - RNA, 77 nt, Human
ucccuaucaguuccuguuugcucagcucccaaagaggacuuaggugcccucugaggaagcagcaggaagugaaggga

SEQ ID NO: 4118610 - RNA, 64 nt, Human
ucccuauccucauacauaucucagucuuguugcaacagagaaaagcauauggugaaacaaggga

SEQ ID NO: 4118611 - RNA, 60 nt, Human
ucccucagauuggcaauuagaucuuaacaauggugaucuuaaagagcgcaauuugagggg

SEQ ID NO: 4118612 - RNA, 57 nt, Human
ucccucagcuugucuccaugcacgcagugaagcccguggggauguaugggugaggga

SEQ ID NO: 4118613 - RNA, 61 nt, Human
ucccucauagaagcacucagcucccucggggacucccagggaagcuuguuacugagaagga

SEQ ID NO: 4118614 - RNA, 55 nt, Human
ucccucauccugacagcuggcccugcauuauagccagcccuugagauggaaggga

SEQ ID NO: 4118615 - RNA, 70 nt, Human
ucccucaugaauggucuccgcuggcguauuucugaugugcaaagaaugccagugucugcuaucugagaga

SEQ ID NO: 4118616 - RNA, 55 nt, Human
ucccuccccacuucugagcuuugcagcaauaucaaaggcugaaggaggggaggga

SEQ ID NO: 4118617 - RNA, 81 nt, Human
ucccucccuacucauuuuucuuaagcuguaaagcagaauagcuuguucuguauuuaguuugaggacaauuugggcauggga

SEQ ID NO: 4118618 - RNA, 120 nt, Human
ucccucccugcgccagguuucuacucucaugugacccaaagcagggucauugggccaggcugaaucuaggcugggguucugagacugcugggugggagaguugaucccaggagggaggga

SEQ ID NO: 4118619 - RNA, 74 nt, Human
ucccuccuuaauaagaggucuguaucuuaaacaacaggcaaaguauuagagagccauaucucuuaaaggaggga

SEQ ID NO: 4118620 - RNA, 92 nt, Human
ucccucugccuuuggaaaauucuuucauggcuaauaagauaacacuucuauucccauuuuauugcuguguuagggacagucuagagguugga

SEQ ID NO: 4118621 - RNA, 84 nt, Human
ucccucugguggcuuuuucucccucuagugcugggagcucuccaugcagaugguggauggagaaagagaacaaaaaguggggga

SEQ ID NO: 4118622 - RNA, 74 nt, Human
ucccucuugacaagugacccuggaguuaguccuguguccuggaguuggaggcagcauucaggggugaugaggga

SEQ ID NO: 4118623 - RNA, 110 nt, Human
ucccugaugacuccuuagaggaagugguaacccaggcuucccaaucagaaggcacagggaagacugaccugguugagggagguguggaccguggggaguaacuucaggga

SEQ ID NO: 4118624 - RNA, 59 nt, Human
ucccugauggagcccugcugcaugcuggccugacccacaugcuccacgcucugcaggga

SEQ ID NO: 4118625 - RNA, 76 nt, Human
ucccugcacagcuggccagggagagcuugagcccauaacuccaauucaaucacucucccugccaucucugcagggg

SEQ ID NO: 4118626 - RNA, 55 nt, Human
ucccugcaggugggguggccagguguccucagaccggguggcucucccucaggga

SEQ ID NO: 4118627 - RNA, 56 nt, Human
ucccugcccugccuucaugguuaucucugcuaugucagguuggaaagcagaaagga

SEQ ID NO: 4118628 - RNA, 78 nt, Human
ucccugcuuuuauuuguagcuucccaaagcuuuugcugguaauaaaaggauuguaaaguugacaaauauaagcaggga

SEQ ID NO: 4118629 - RNA, 56 nt, Human
ucccuggacaacagacuucacugauacgagauaguggaaggaaagggucccgggga

SEQ ID NO: 4118630 - RNA, 66 nt, Human
ucccuggcacaagaaggcuguccagugaugaagacuucagaugaaauggcaugcuggugcagggga

SEQ ID NO: 4118631 - RNA, 73 nt, Human
ucccuggcugugugcccccggcaccgcggagcgcccaggugaacccucgacugggggcagccgcaccagugga

SEQ ID NO: 4118632 - RNA, 85 nt, Human
ucccugggaugaaagacccaggccuggggcuuaagguggaaaaacaacucauuccucgaggcccggagucgggcgucccgggaga

SEQ ID NO: 4118633 - RNA, 74 nt, Human
ucccugguucuuucugagggcaaaggucucuguuuucuugcuggaaacucucuuuucuucaguaggguuagggg

SEQ ID NO: 4118634 - RNA, 68 nt, Human
ucccuguguguauauaaacgguggcgauauauacagccuauucuaaacuguuuaugaugauagagggg

SEQ ID NO: 4118635 - RNA, 71 nt, Human
ucccuguuagcucacagagcuuuccccaugugacuucagacaugguugacccaugugaguuagugcaguga

SEQ ID NO: 4118636 - RNA, 59 nt, Human
ucccuuaagcaccugaguagucaauauuuacauuuuagacaacugaugugcuuguggga

SEQ ID NO: 4118637 - RNA, 79 nt, Human
ucccuucuuuccccugcugcccuccaguucccacagucaucuuggacuccaggacccugugaggguaaaggcuaaggga

SEQ ID NO: 4118638 - RNA, 89 nt, Human
ucccuugauaaaaccuuuggagcaugcauuuucuugacuaguguuucugaacuaauccucaguuauggauguuuuaaggguucaaggga

SEQ ID NO: 4118639 - RNA, 69 nt, Human
ucccuugggcacaucaguaaguggcaccggccaguucucgcugugggcuagauuuggugacccaggggg

SEQ ID NO: 4118640 - RNA, 69 nt, Human
ucccuugugcauuaucuuuaauguucucaauaaccuucccaguuguuaugaucaugauauugcagggga

SEQ ID NO: 4118641 - RNA, 109 nt, Human
ucccuuucccacccugccucccagaggcucugcagagauucugggcugaggaagcucccucucucagccuuggcccucgcccugccaggagagcagggauggaaggggg

SEQ ID NO: 4118642 - RNA, 69 nt, Human
ucccuuucuccuuguucccuucaauuguuaaaaaacuugggucaaacaacaugaaaggagaggagagga

SEQ ID NO: 4118643 - RNA, 68 nt, Human
ucccuuugcaauuuggcuuccauuuucucaauucuaaugaaaggggagagaaauccgaaugcagugga

SEQ ID NO: 4118644 - RNA, 73 nt, Human
ucccuuuggauccaagcuuaugauuuuaucauuuuuaguguauuacgaauaugggcuuaugauuucacaggga

SEQ ID NO: 4118645 - RNA, 93 nt, Human
ucccuuuggcccccaacucucugcccugcagggagcaguaagaccugaaacucaauuguccucuguagagcagcuccugggaggacggaggga

SEQ ID NO: 4118646 - RNA, 79 nt, Human
ucccuuugucacacuucaccccugcucccagugaaguauauggcuaagcugagagaaaagugagguucuggggaaggga

SEQ ID NO: 4118647 - RNA, 80 nt, Human
ucccuuuucuaucuuagcagguuaucuuuuguaaucacugauuacugugauuacugucuacuugggauagaaggcaggga

SEQ ID NO: 4118648 - RNA, 96 nt, Human
ucccuuuucucagcgggugaacgagugagcaguacuuacuccugcuuuuguagaagcaaggguggcugcuuaacucugagcugcuggagagaggga

SEQ ID NO: 4118649 - RNA, 67 nt, Human
ucccuuuuuuagucccuuuuaucauguaagguaacacaguuacagguuccaggaauuaggacagggg

SEQ ID NO: 4118650 - RNA, 70 nt, Human
uccgaagguucccagacuccacacugaggcaccccagagugccgagcuggagucaugggaagcugccgga

SEQ ID NO: 4118651 - RNA, 61 nt, Human
uccgaguaauaugcuuuuugaccugcuaaacuuugcagcugagacucucauguuauuugga

SEQ ID NO: 4118652 - RNA, 64 nt, Human
uccgauguauaaacugccggguuccuacaguguacugagccugcagugagugcagaaggucgga

SEQ ID NO: 4118653 - RNA, 75 nt, Human
uccgcaauuaaaaugcuagagucagugcuaaauuauuuaaaccucaauaauugcuugaugacuaguaauugugga

SEQ ID NO: 4118654 - RNA, 73 nt, Human
uccgcgaacuggggccacagcuuuuaaccucggggcucuucuggcccuggaguagcacugggucgcaguugga

SEQ ID NO: 4118655 - RNA, 84 nt, Human
uccccucugugcuuuucugcaggguccuaugugaaauagccacaucucaugaacugcuuuuguagaaacgggcaccgaggaggg

SEQ ID NO: 4118656 - RNA, 124 nt, Human
uccccugcacuguccucgccaugcaccugggagagcagagaacccucuuuguaaggcaaaccagccucaagaggaggagacuuugaaggcuccggcuguaucuucaggacuuugcagcaaggga

SEQ ID NO: 4118657 - RNA, 75 nt, Human
uccccuggaagagaacuacaucaaaggcaauauaaccagauuuauauaaggcuuuuaaagguucaccaaguggga

SEQ ID NO: 4118658 - RNA, 96 nt, Human
uccccuggggaggaugcaaaauuacauugagaaccacugcuuagagcaauuuugagcagugguucucaaugcaauuuugagaaccacucaguggga

SEQ ID NO: 4118659 - RNA, 58 nt, Human
uccccuguauuuccuguucauagauugccaggucuagagcuugauuggauucagggga

SEQ ID NO: 4118660 - RNA, 81 nt, Human
uccccugucugccucgguguccccugcucagggcucuugauggggccugggagcacaucgggguccuugcaagacccggga

SEQ ID NO: 4118661 - RNA, 76 nt, Human
uccccuuaguucuggccaaggcugccagauuagcacggugagugugagugugggguuguggccagcauggggagga

SEQ ID NO: 4118662 - RNA, 56 nt, Human
uccccuuccugagcuaccugcccacugaggucagcgcuggguggcaagcaaggggg

SEQ ID NO: 4118663 - RNA, 103 nt, Human
uccccuuggacuccucacccuguggccagaagguuuaaaagaggggccuuaaagcacggccccccugcuuggucauagagugguacugagacuccaagaggga

SEQ ID NO: 4118664 - RNA, 96 nt, Human
guucuggaacuagaagcugcugccccugaugccuagaacagagcucucauuaagcugcagggcagcuagggagcuuuugguaucuguguuccagac

SEQ ID NO: 4118665 - RNA, 63 nt, Human
guucuggaaugccuguucuaauucuccaaggagaauuagaaaauaaaaggcagagucuagagc

SEQ ID NO: 4118666 - RNA, 72 nt, Human
guucuggacaaagacugugguuuauucuuugaucuucugagauuagugccaccacugucuuuggcccugagc

SEQ ID NO: 4118667 - RNA, 63 nt, Human
guucuggagcucagacaucugaaauggguuaucaaggcucauuucuuguggagacuucaggac

SEQ ID NO: 4118668 - RNA, 79 nt, Human
guucuggaggcugggaguccaggauacagaugccagcagguuuggugucugguaagaaccuggacucuguuuccaagac

SEQ ID NO: 4118669 - RNA, 56 nt, Human
guucuggccccuggcaguccuggagaaagagaccuucugucugauggugccagaac

SEQ ID NO: 4118670 - RNA, 62 nt, Human
guucugggcgccgugggaaacagccggagccaaaggcccggcgccuucacggggcuuagggc

SEQ ID NO: 4118671 - RNA, 64 nt, Human
guucugggcucugggaauuagggaugagccagccauguuccucuuucuucccagaacucagagc

SEQ ID NO: 4118672 - RNA, 56 nt, Human
guucugggugaugagguuggcuuuggacuuuaauugcuucccuuguuaaccagaau

SEQ ID NO: 4118673 - RNA, 55 nt, Human
guucuggguucagugacaucuguuaucaccugggagcuuguuauuaauucagaac

SEQ ID NO: 4118674 - RNA, 59 nt, Human
guucuggucacuagcagacucauuucauucaccccuuggaaucugcccaggacuuggac

SEQ ID NO: 4118675 - RNA, 55 nt, Human
guucuguagcagaaagcacaugguaaaaugugcauuccuuugucuguuaaagagc

SEQ ID NO: 4118676 - RNA, 86 nt, Human
guucuguaucauacagcugacgccagaguggaauuauagcaugaauaucaauuucuuuggcucaguuucuuucugugguuguuuac

SEQ ID NO: 4118677 - RNA, 95 nt, Human
guucugugaggaaccuucuugugcagaacuguagacauugauaaagauuggcacaucauaaccugacaaguuuugcugcaggaagaacaugggac

SEQ ID NO: 4118678 - RNA, 63 nt, Human
guucugugagucuugacgaauguguacagucauguaacuagcaccacaaucaagauacagaac

SEQ ID NO: 4118679 - RNA, 88 nt, Human
guucugugguggcaucuuccaaaugucugucuuuagcccaggucccuucccugaggucauggcugauauuuccaguugccagcugaac

SEQ ID NO: 4118680 - RNA, 105 nt, Human
guucuguuuugccuuugugaagaacagugaacaugcucugcacuuuucuaaaguagaaaaaugagcugaugucagggauucuuucaagaaggcaaauuucagagc

SEQ ID NO: 4118681 - RNA, 58 nt, Human
guucuuaagcuugagguuugcagaggagcaguaauaguagcuucaggcucaagagaac

SEQ ID NO: 4118682 - RNA, 99 nt, Human
guucuuauuguuguugucauuagcuguuuaagcguaugcauaugacuuaucacaucuaagaugcuugaauaguuuuggauagcauauauucauaagaac

SEQ ID NO: 4118683 - RNA, 83 nt, Human
guucuucagcguggcguuaguauucuuucugauuuuuucuaaucccuagacagguguugauacuaaucguggccuaggagggc

SEQ ID NO: 4118684 - RNA, 85 nt, Human
guucuuccaggcccuacagaggagaccaaggcucagcuggcagcuagcuguggggccaaauucuccucucugccuaggggagagc

SEQ ID NO: 4118685 - RNA, 62 nt, Human
guucuuccuaagcauccuuaacaggugaucaccucgccuauugagaacccucaggaggcagc

SEQ ID NO: 4118686 - RNA, 66 nt, Human
guucuuccuuggguaacuggguaaauggugguguuucccugagaccaggagacccagggaaggagc

SEQ ID NO: 4118687 - RNA, 66 nt, Human
guucuucuugcucuuuuagguccuuuauacccugucauaaagagaauacaagcaggcaggaagagc

SEQ ID NO: 4118688 - RNA, 126 nt, Human
guucuugacagacugagaaugauacugagaauguuuucugauugauuuggugagcugucuguuuauagcaucauuagagauuauuuuccauggcuaggaauuauucuugaccucacaguaaaggac

SEQ ID NO: 4118689 - RNA, 60 nt, Human
guucuuuaggggcccaauuuccugcuccuucaaccagaaagagagggccucucuaagagc

SEQ ID NO: 4118690 - RNA, 69 nt, Human
guucuuucccgagucauugauucaacagaacagcccacugugguuauuggaaugcacugggagagacac

SEQ ID NO: 4118691 - RNA, 63 nt, Human
guucuuucuauucugaugucauagaauacuguaggugugugauuacugaauagaaaauagagc

SEQ ID NO: 4118692 - RNA, 63 nt, Human
guucuuucucugggcagguaggaauucauuugcccugccugccagcccccauagagacagaac

SEQ ID NO: 4118693 - RNA, 79 nt, Human
guucuuugggccaaagauguccuuguuaaccuaugggaagaucuuuccucuacuaacaagagacucuguuccagaaaac

SEQ ID NO: 4118694 - RNA, 85 nt, Human
guucuuuucaugaugaaacuguuauguaucuugauugggugguggugauccuaugacucuaugcauguuucacaauucaaagaac

SEQ ID NO: 4118695 - RNA, 61 nt, Human
guucuuuucuacauuauacuucuugaagcuucuguuuuauucaguuuguguagaggugaau

SEQ ID NO: 4118696 - RNA, 76 nt, Human
guugaaagaauaggcaagugcauuagaagagcauuugugaacgaguaugcauucugcaauuugccucuucugugac

SEQ ID NO: 4118697 - RNA, 69 nt, Human
guugaaagccaagagcacuucuugaagagcugcccaaguagccucucugggaauuuuuuggacaucagc

SEQ ID NO: 4118698 - RNA, 66 nt, Human
guugaaauaacagagagcuacugaacugguaggauuucuuuacauucagagcuuucuuaucauaac

SEQ ID NO: 4118699 - RNA, 129 nt, Human
guugaaaugucaugaucucccagcugugagcaauguuugagauaguccagguuaaucccugccuuuuagaaaggaagaaaggaaagccuggccacuagcuccacaucaccccuaaagguaauaacaaac

SEQ ID NO: 4118700 - RNA, 104 nt, Human
guugaacacuugacauguggauagugugacugaggaguugaauuuuuuauucuauuuaauuuuaauuaguauacauuuuaaaaccacaucugacgagugccagc

SEQ ID NO: 4118701 - RNA, 72 nt, Human
guugaaccauaggaaauugccaauauaugaccacuuuuggauuauuaaaacaguaauuucauacgguccaac

SEQ ID NO: 4118702 - RNA, 72 nt, Human
guugaaccauaugauauugcuauuuuuguaggucaagaucugucaauuaguggcaauuucauacaguuuaac

SEQ ID NO: 4118703 - RNA, 64 nt, Human
guugaacccaggagacagguugcagugagccaagaucgugccacugcacuccagccugggcaac

SEQ ID NO: 4118704 - RNA, 124 nt, Human
guugaaguagauuuuucaauuagaaaguaaauggaacgcauuguaaaugacugcagcuucucuuguuguguuuuuacugugauccagaaaugacuauauugauuuuugaaguuuuuacguuaac

SEQ ID NO: 4118705 - RNA, 59 nt, Human
guugaagucugagggucaugggucucaccuguugguggggcugggcucuuagcuccagc

SEQ ID NO: 4118706 - RNA, 78 nt, Human
guugaauauagaaacauccugcuuuccauuugcagcucauaguacugcauuguguggagaugcaggaguugaugcaac

SEQ ID NO: 4118707 - RNA, 62 nt, Human
guggucauuaagauuuuuuucuacugggauuuuccaagcagacugaauccugauaauaccac

SEQ ID NO: 4118708 - RNA, 56 nt, Human
gugguccagguacccguugugggcaucauggccacaggaggaggugcccgggccau

SEQ ID NO: 4118709 - RNA, 65 nt, Human
gugguccccagagcuguguacagccaaaaguaauuucaaacuaguucacauuucuaggauaccau

SEQ ID NO: 4118710 - RNA, 89 nt, Human
gugguccuggugcuggucauugucggccucugucucuggcugcccucggccuccaaggaaccugacaaccauguguacaccagggcugc

SEQ ID NO: 4118711 - RNA, 94 nt, Human
guggucuuauuccugaauucuuaaugaaaucuacuuuuuucaggagugggaauauuagugagauauuauuaaaguuuuuaggguuaaguaucac

SEQ ID NO: 4118712 - RNA, 80 nt, Human
guggugaaucgcaugcucugcccuguuccgcugccccugagcagugucugaaccaccggggcauuuuaacgucuucccac

SEQ ID NO: 4118713 - RNA, 62 nt, Human
guggugacaaucuguuugaucugagcacaauuacuuuauuuggauggagccauugccaccau

SEQ ID NO: 4118714 - RNA, 71 nt, Human
guggugagguaacugccuaaaacuguaggugagugcauuagaguuuuaucauugccuuaacaaaucaccac

SEQ ID NO: 4118715 - RNA, 90 nt, Human
guggugccguugccuggagacccaggggcagggagaaagugagauuuccugggcuuucucucucccucugggaccagaaaacagcuccac

SEQ ID NO: 4118716 - RNA, 68 nt, Human
guggugcugauugauacaacucaauccaaugcauauuuauugggcaucuacugugugauaggcaucau

SEQ ID NO: 4118717 - RNA, 76 nt, Human
gugguggaccuuuuaaaggcuguaugaccaagauauaauuuugguucagguugucuuuauugauauguucacucac

SEQ ID NO: 4118718 - RNA, 104 nt, Human
gugguggcauaugccuguaaucucagcuacucagaaggcugaggcacgagaaucgcuugagcuugagagguagagguugcagugagcugagauugugccacuac

SEQ ID NO: 4118719 - RNA, 104 nt, Human
gugguggcgcuugccuguaaucccagcuacucgggaggcugaggcaggagaacugcuugaaccugggaggcggagguugcagugagccgagaucgugccauugc

SEQ ID NO: 4118720 - RNA, 71 nt, Human
guggugggaauucauagcaacaaagacccaacugucaacacuagaugguuaugggcuauggaucuuauuac

SEQ ID NO: 4118721 - RNA, 77 nt, Human
gugguggggggcuuccugaggcuaaagugcaguggugcaaucacagcucauugcagcuucagguguucacccacuac

SEQ ID NO: 4118722 - RNA, 79 nt, Human
gugguggugcaugccuauagucucagcuacugggagggucacuugagcccaggaguucgaggcuguagugcacuaugau

SEQ ID NO: 4118723 - RNA, 78 nt, Human
gugguggugucuggaguccuaggagucuagaagugccuuucagugggucuugaaggacauccaguccacacucuccac

SEQ ID NO: 4118724 - RNA, 97 nt, Human
gugguggugugagccuguagucucagcuacuugggaagcuuaggcaggaggaucucuugagcccaggaggucgagacugcagugaacacgccacugc

SEQ ID NO: 4118725 - RNA, 60 nt, Human
guggugguguuuggggcgggagagugcuaauauuauuccaaaaucccaaacugccaaaac

SEQ ID NO: 4118726 - RNA, 57 nt, Human
guggugucuccauacauugugaccuagucacugcuagcacacaggagccacacucac

SEQ ID NO: 4118727 - RNA, 67 nt, Human
gugguuaaacaauaacuggcacacagaaagcacucaguguuagcuguuccuguuuguugcuaaccac

SEQ ID NO: 4118728 - RNA, 73 nt, Human
gugguuaaacguuugguaguuugaaaucagccauggugggaauauuuacaccauggaaauuggcaaaugcuac

SEQ ID NO: 4118729 - RNA, 64 nt, Human
gugguuagcgccccauucuucugcuguaguuauuucaccccgggagggugugggccuuagccau

SEQ ID NO: 4118730 - RNA, 86 nt, Human
gugguucaaucagaauaaaguauuccccaaguauucuggaucccuaaggaccagugcuuccaggaauacgguacugaugauuccau

SEQ ID NO: 4118731 - RNA, 64 nt, Human
gugguuccugaggacaucagcaucaccugggaacuuauaggaaaugcaaauccucagggccuau

SEQ ID NO: 4118732 - RNA, 79 nt, Human
gugguucuggaaagaaggcuaaggucccacagggcagcaacuuccuggaaggccuuugccuuuagaguucuagcuuugc

SEQ ID NO: 4118733 - RNA, 82 nt, Human
gugguucuguccaggcccugggaugggagcagucccauacucacuggccagugucccucccagggccaucuggcagagcugc

SEQ ID NO: 4118734 - RNA, 119 nt, Human
gugguugacaauggcaccauuguuccuggaguccccucagugggggccacagggcucacacacccugguccaguggaugcugagggggugccaggauucuggaugcaagauacagccac

SEQ ID NO: 4118735 - RNA, 86 nt, Human
gugguuggugaauguccaggaagucuuaacucaagccaccccaaggcugugauucagaacauuuucgugguccgucucaucuccac

SEQ ID NO: 4118736 - RNA, 57 nt, Human
gugguugugggacugaaguuaccauuuucuugcuggcucucagcucccagcagccac

SEQ ID NO: 4118737 - RNA, 64 nt, Human
gugguuuaaaacaguuguuuucagaagagguuauuaugaauuaacugucuuuaacuggaaccac

SEQ ID NO: 4118738 - RNA, 69 nt, Human
gucccagaaacauauugcuggucccagauuuaauugaaagggauagcaaauuuuaauuucuaaugggac

SEQ ID NO: 4118739 - RNA, 99 nt, Human
gucccagcuacucgggaggcugagguggaaggauccuuugaaccugggaugugaagguugcagagagccaugaucauaccacugcacuccagcuugggc

SEQ ID NO: 4118740 - RNA, 67 nt, Human
gucccagcuacuugagaggcugaggcgggaggaucacuugagcccaggaggucaaguagcuaugggc

SEQ ID NO: 4118741 - RNA, 66 nt, Human
gucccaggaauccguccucuagaucauuucuucagcuuuugacaucugaggaaaaguucuugucac

SEQ ID NO: 4118742 - RNA, 59 nt, Human
gucccaggcuuauguggagcuuaauuaauguucauugagugccauuugcuucuggugac

SEQ ID NO: 4118743 - RNA, 58 nt, Human
gucccagggagguucagggcuugccacuggaagugguaaccugugcaggcccuggggc

SEQ ID NO: 4118744 - RNA, 59 nt, Human
gucccagggaugcagacaugagggcauuggucugucuuccaugaugccauuuccugggc

SEQ ID NO: 4118745 - RNA, 90 nt, Human
gucccaguugcaggagguguucugaagagaggcuggaauucugcauauguggaugagauuuccguucucucuucagucuucaguauggac

SEQ ID NO: 4118746 - RNA, 88 nt, Human
gucccauggggacacugagagaacgggcugcucccuaaggaaacucgaguuuugggucagucugauccuaccagacaucacaugagac

SEQ ID NO: 4118747 - RNA, 88 nt, Human
gucccccuauugaauauugccaggagaaagacccuguccuggccugggacagcuguacacuccugguuaaucaguucugaugggaggc

SEQ ID NO: 4118748 - RNA, 113 nt, Human
guccccuagaccuggaguauugucucucagucaagagugacaggaauauuuaucuguccuauuaaagaggauguuugucaucauugugagagagauucuaguagcugggguac

SEQ ID NO: 4118749 - RNA, 76 nt, Human
guccccugaguacuuuacuucuuacaguuuauguugcuacaucucagaaaagguaggggaaagaguacaggguggc

SEQ ID NO: 4118750 - RNA, 58 nt, Human
guccccugcugguguugcugcuugguuggcuuuacagcaguagugcgucgcagaggac

SEQ ID NO: 4118751 - RNA, 74 nt, Human
gucccgggagcccggggaauacuccguccagggguccuugacccucugguucagggcucccuggcucccaaggc

SEQ ID NO: 4118752 - RNA, 72 nt, Human
gucccuagccaacaccuuauuuucuggcuguauaagacagcgacccaaaaagcaaaggguugggaggaggac

SEQ ID NO: 4118753 - RNA, 78 nt, Human
gucccuagcccuggcagagccagguagugccugcgggcuaaggaaauuauuaaccuggcugugcccagaggaagggau

SEQ ID NO: 4118754 - RNA, 69 nt, Human
gucccuagcuuugcuggcaagcaugucagggaaauggugggacuggcagccagcacgcaguugauggau

SEQ ID NO: 4118755 - RNA, 61 nt, Human
gucccucauaacuggcaggugucaccugguuggccgcagaagggccugccagccgagggac

SEQ ID NO: 4118756 - RNA, 87 nt, Human
gucccucccuucaugaaguuuauggucaggugggcuaucccccagcuaccagcccuccccacaaagcuucacacuggaggcagggac

SEQ ID NO: 4118757 - RNA, 78 nt, Human
gucccugaaccacuagugaugagaagaugaggggaggcugacuccucaggcuuguacuuagugagaaauucagaggac

SEQ ID NO: 4118758 - RNA, 130 nt, Human
gucccugcagcaggaagaagcauuuccuggcccuggucuccucucagggguccccggccgaguauccuguuucugcucugccagggcauccuguggugguccccggggcugcuggagccuggcagggggc

SEQ ID NO: 4118759 - RNA, 61 nt, Human
gucccugcagugccugccacugagccugauuaccacagccugcagaggugcugcuagcuac

SEQ ID NO: 4118760 - RNA, 74 nt, Human
gucccugcgucuuaugcauauucauaacacacugaacccuggugguugugagcgauggauggagcuucagggau

SEQ ID NO: 4118761 - RNA, 88 nt, Human
gucccuggcccggagggacccacucuagaggugguaaguaauucagucuuucugcuagcucaguccugggccucuccccaacaggggc

SEQ ID NO: 4118762 - RNA, 72 nt, Human
gucccuggggguuuaggacucagaaaaaagaccuaguucagucaucccaguccaaacaaacuucccgagggc

SEQ ID NO: 4118763 - RNA, 55 nt, Human
gucccugggucuaaggcaguaauucucaacuggagcaauuuuguccucaggggac

SEQ ID NO: 4118764 - RNA, 82 nt, Human
gucccugugcucacaugugcaaguggguuguguguuucugaugugcaaagggacuugcacauggggaaguagagguagugac

SEQ ID NO: 4118765 - RNA, 55 nt, Human
gucccuucugcaaucugaccucaaucuuuugugcugcaguuuguccagaggggac

SEQ ID NO: 4118766 - RNA, 55 nt, Human
guccgagccaggcuccggagccgcgcugccgcccaaucccuggcgccucucgggc

SEQ ID NO: 4118767 - RNA, 69 nt, Human
guccgauggcacaucuuaggugcuuuguucaccuggcuaugcuuaaugagcagagaaucuacaucggau

SEQ ID NO: 4118768 - RNA, 129 nt, Human
guccgcaaacucuuuaguuucuggcugaaaauugauguguaaguuguucauggggugugauuggccuuuuggucaauaacauuuggcaucuuguaacacucaucuggcaaaggacugaagacaaaagac

SEQ ID NO: 4118769 - RNA, 100 nt, Human
guccgcccccugcagccucacugaacacaccugcagcacguguguccgcaucaugauguccacagggguguucaggagguugugucagguucugcuggac

SEQ ID NO: 4118770 - RNA, 67 nt, Human
guugccuuggccugcuuugagaaucuaccucuuuauaaugagaggcaaggacagcgucaggugcaac

SEQ ID NO: 4118771 - RNA, 85 nt, Human
guugcgaggggcugucuuguauguuguaggacacuuagcagcaucccuggcguccauccauugaauauaauaguuccccuccagc

SEQ ID NO: 4118772 - RNA, 72 nt, Human
guugcgcccauucugcucaugagcucccggguuuccaagcgggaccugucugagccagggugggcagccaac

SEQ ID NO: 4118773 - RNA, 69 nt, Human
guugcggaaaugcagggcuagggugaggaugguugaaacagcuguaccuguagcacuggguaccacggc

SEQ ID NO: 4118774 - RNA, 116 nt, Human
guugcgggaaauaggcgaagacggggcgcgcaagggagcugagccuggguggaccgcgucagggcgcggggagcucgaggcgcagcggcugcagcuccggccucagagcccgcggc

SEQ ID NO: 4118775 - RNA, 94 nt, Human
guugcuaguuuuauaauugcagucucuaguuucugaaugaaaaaggaugccccacauuauacagaacauuaagaacuguuuuuaaagcugaaac

SEQ ID NO: 4118776 - RNA, 72 nt, Human
guugcucagcuccaggaggcaccuuuggaccauguuccaugcacguggcccacgccuuuggagcugugcaau

SEQ ID NO: 4118777 - RNA, 62 nt, Human
guugcucucagcuuuuaaaaacaagaaguauuuguugcuuuuugaaagaaaguuggcgcaau

SEQ ID NO: 4118778 - RNA, 72 nt, Human
guugcugcaaaaguaauuggggcuuuugccauugaaagugaugacaaaaaccgcaauuacuuuugcaccaac

SEQ ID NO: 4118779 - RNA, 62 nt, Human
guugcugcaaaggaguguagguaacacaaaccaccaccugcaaacuuccuuucuagcucaac

SEQ ID NO: 4118780 - RNA, 56 nt, Human
guugcuguuuaguugccuacauaucgcaggugguaaaagagguauaaaaugguagc

SEQ ID NO: 4118781 - RNA, 70 nt, Human
guugcuuagaacugacguuagggaagaagcccucccgguuaucaaauaccuucucuugucaguuugcaau

SEQ ID NO: 4118782 - RNA, 60 nt, Human
guugcuuccaggcuuccuaccuuugacauauuuaguucagguuuaggaauuuggaaaggc

SEQ ID NO: 4118783 - RNA, 91 nt, Human
guugcuugcauugcaaaccaaggagcaaggcucaacaaggucacuuccaauucuaccuuacccgaguguuucuuguuugaucuguggcagc

SEQ ID NO: 4118784 - RNA, 72 nt, Human
guuggaaaagggauggagggaccaaugcugaauaguaaaggaaccagcugucccagccuuucuuucuccagc

SEQ ID NO: 4118785 - RNA, 61 nt, Human
guuggacaaugaacgcuuuuuaacugugugugguucacaguacugcuguucuuguccuagc

SEQ ID NO: 4118786 - RNA, 57 nt, Human
guuggagagggugguagcugauaugaaauaaucuauuauugcaccuuccucacuaac

SEQ ID NO: 4118787 - RNA, 55 nt, Human
guuggaggaugcaaugagggaguaggccgucugccucccaaccagcaguuccagc

SEQ ID NO: 4118788 - RNA, 113 nt, Human
guuggagggagauugccucuaggcgcaaugugaggcuugguuuugagcauauacaaaguacggaaacaaaaccggggccuuuccacaauggcagguagcucagcaccuuuggc

SEQ ID NO: 4118789 - RNA, 62 nt, Human
guuggagggcagaacagagaggggagggagcccagaaccucuggaucugcccugacgccaac

SEQ ID NO: 4118790 - RNA, 94 nt, Human
guuggagucucacucugucaccuaggcuggagugcagugacacgaucuugacucacugcaaccuccaccucccagguucaagugauucuccugc

SEQ ID NO: 4118791 - RNA, 60 nt, Human
guuggauuuugguugaauuguucugauagaauucagaauagaauucucauagaauuucac

SEQ ID NO: 4118792 - RNA, 55 nt, Human
guuggccauuaauuggaggacacagauaauugaucuccuagauuucuggucauac

SEQ ID NO: 4118793 - RNA, 58 nt, Human
guuggcccagaaaugaacuugcuguggauuugauccucccagucauaguuggggcagc

SEQ ID NO: 4118794 - RNA, 99 nt, Human
guuggcccggauggucucgaucucuugaccuugugaucccccugccuuggccucccaaagugcugggauuacaggugugagccaccgugcccggccugc

SEQ ID NO: 4118795 - RNA, 79 nt, Human
guuggcggcacgguagguucauuagucaauaaagcauugccacgcguuuuauugaauuguaacccuauuuugcccugau

SEQ ID NO: 4118796 - RNA, 58 nt, Human
guuggcugcucagugauaugagaauaugcccccaugcauguuucaagggcaucccaac

SEQ ID NO: 4118797 - RNA, 72 nt, Human
guugggagggucauaguuuuucuuacugaugauuuaaaguguuucuguauuaaaggcagugaucuuuuuagc

SEQ ID NO: 4118798 - RNA, 67 nt, Human
guugggcagaggcugugcagaggacacaggagcugcccuucaucauucucugcagccugggcucggc

SEQ ID NO: 4118799 - RNA, 63 nt, Human
guuggggauuugaaucccaugugugccaccaaauagccauacagcuuuagcaaauuaccuaac

SEQ ID NO: 4118800 - RNA, 77 nt, Human
guuggggcagugcuaaggauucugccuucugggagcucauuuccugagcagaauucccucuugguaccuggccuggc

SEQ ID NO: 4118801 - RNA, 62 nt, Human
guugggucagcuuucagguaguaggauaccaguacuuucuacagccaugucgcugauuuaac

SEQ ID NO: 4118802 - RNA, 118 nt, Human
guugguaauuuuaaaaugucuuucaccuucuagaguuaauauuuauguaaauaaaaacugagaaaugagugaaauucugguaaaggaaguugguuguaacauuuuaacuuauauccac

SEQ ID NO: 4118803 - RNA, 84 nt, Human
guuggucaggccagggcacugcucuuuaguuuuugaaacuuuccuuccuuuucaugucuugagguuuggugcuugguugauagc

SEQ ID NO: 4118804 - RNA, 81 nt, Human
guuggugaacuuggugucaugccaggagugaggacuccagcccagcucacuccuggaaaagaacgcagggggcucaaagac

SEQ ID NO: 4118805 - RNA, 73 nt, Human
guuggugacauguggcccagaugagugugcuaauggaaucauuuguacccuuucuaugaggccaagcacuagc

SEQ ID NO: 4118806 - RNA, 57 nt, Human
guuggugaccgaggucuugcccaaaaauauuuagggcauuucagaaagguuaccaac

SEQ ID NO: 4118807 - RNA, 66 nt, Human
guugguggcagggucguagcgcuccacagcauucaggucauugugguagucacggcccgccacagc

SEQ ID NO: 4118808 - RNA, 76 nt, Human
guugguucuuauccuuucuaucuaugaaugucucucuguaugucucucguggguagaguggagggauaagagauac

SEQ ID NO: 4118809 - RNA, 102 nt, Human
guugguuggaauuaguucuugcacaccaagacugcacagagccagcuagcagagugugcagggccucugagccaguucugggugugcuccuuguccaccagc

SEQ ID NO: 4118810 - RNA, 73 nt, Human
guugguuuauuuuucucuucuuuuuccucagagcugcaaggaaccagggaaagggaaggagguuagaacccac

SEQ ID NO: 4118811 - RNA, 65 nt, Human
guuguacauaugaggauaaguuuuagugcagaaagucucauugcauugcauuccauguguucaau

SEQ ID NO: 4118812 - RNA, 62 nt, Human
guuguacugucuuugagcuggaggaggagaauacauccucccucagaaugaagaaaggcaac

SEQ ID NO: 4118813 - RNA, 61 nt, Human
guuguaguggaauauacccaugcuccauucacaugguucaugucugcuuucaugcuacaac

SEQ ID NO: 4118814 - RNA, 92 nt, Human
guuguaguguuuaugugcucucauaccuuucauaugcaucuucauuuaauucaaaggucaaaugccagugguguggaucaaagcuuuauaau

SEQ ID NO: 4118815 - RNA, 57 nt, Human
guugucaaauaguagaaagauggcugugucuuggccaggcuccugcugugugacaau

SEQ ID NO: 4118816 - RNA, 80 nt, Human
guugucaauuaugugacacaucuuccagggggaagccagccaaauaaaacccaagcugaagauaucacauggagacacac

SEQ ID NO: 4118817 - RNA, 76 nt, Human
guugucauuuugcugcauauuuagaccuugauacucuacuugcuccucagguucuuuuguacucaguauugacaac

SEQ ID NO: 4118818 - RNA, 60 nt, Human
guugucuggaaaggggcuuuuaucucccgucagggaacaggcucuucauuuccagaggau

SEQ ID NO: 4118819 - RNA, 63 nt, Human
guugucugggagauugaaugaguuaaguuuguaaagagcuuagaacagugucugccagagaau

SEQ ID NO: 4118820 - RNA, 123 nt, Human
guugugacucuacuuguauaaauaauuaauuuuuuaugucuugccaguuccuggaaccagcuugauauucuuuguguagaagcuagccuggagccagcagacaugaauaggcagaagcagaau

SEQ ID NO: 4118821 - RNA, 109 nt, Human
guugugacuucuaccccaucuugcacugaaucucaaggggaggguucaaugacggacaaaucuucaggcucuugugcagaaucagagagaaaggggaaguggagacgac

SEQ ID NO: 4118822 - RNA, 125 nt, Human
guugugcaggaucugauauaauccuacauucauaaguuuuugugcuggguuuggggagagagggugucuccccagacccagcacaaaaacuuaugaaucuaggauuauaucagauccugcacaac

SEQ ID NO: 4118823 - RNA, 62 nt, Human
guuguggaguggucugagcugccaggaguuuaaacccggauucuccaggccauucccagagc

SEQ ID NO: 4118824 - RNA, 80 nt, Human
guugugguugccaaagcaguuuacugucaauaacucuuccaaauaauugaaguguuacugaucguagauucagaaacagc

SEQ ID NO: 4118825 - RNA, 69 nt, Human
guugugguuugugugcuaggucugaaucagucguccuucagaccagggggagcacagagagucuauagc

SEQ ID NO: 4118826 - RNA, 55 nt, Human
guuguguucauguucagagauucuagcuaaucagugucucuggcauagacucaau

SEQ ID NO: 4118827 - RNA, 55 nt, Human
guuguguuggcuugaagcucauaggagacuuaagacgggcucucgagcaaccaac

SEQ ID NO: 4118828 - RNA, 60 nt, Human
guuguuaucuauugcugcguuacaaaccaaaccacuccaaauguagcaguuuaaaacaac

SEQ ID NO: 4118829 - RNA, 91 nt, Human
guuguucuguuucuaguuuaggauccaaucuaagaucccacguuuaguuuuuauaucucuagucuccuuuaaccugaaacaguuucucagc

SEQ ID NO: 4118830 - RNA, 64 nt, Human
guuguugauucauauguaacaucccugguuuaggagagcugggauagugggguagaaucauaac

SEQ ID NO: 4118831 - RNA, 80 nt, Human
guuguuggccgugauggcauuugaccgcuuuguggcuauuugcaagccacuucgcuacacugucauuaugaacccucagc

SEQ ID NO: 4118832 - RNA, 57 nt, Human
guuguugggcuuggggaucugccuuuuuaguaagcagcccagauaaagcucaggaac

SEQ ID NO: 4118833 - RNA, 60 nt, Human
guuguuucuguaagagacagcucuauaaauaaugagcuguuuguuucuaugagagauagc

SEQ ID NO: 4118834 - RNA, 85 nt, Human
guuguuuguucaagcucaacugaaagcuuuuaaauaacccaauuaguaaucaaaagcugaaugcaggcuugauuauucagacaau

SEQ ID NO: 4118835 - RNA, 56 nt, Human
guuguuuugggaggguguuacaauagauguagaauugaaacauuugaucaaagcac

SEQ ID NO: 4118836 - RNA, 74 nt, Human
guuuaaaccacucaugaggaaguaguuggcaauuuuuuuugaaacuuuuaaaccucaugaguauucuuuuaaac

SEQ ID NO: 4118837 - RNA, 80 nt, Human
guuuaaacccacugcucuucacugagauaauccuagaugaauaucccagggguauccauggagaagagggugaaugugac

SEQ ID NO: 4118838 - RNA, 79 nt, Human
guuuaaaucauuugugcauaguaacagaauugagugucaaaaucaagucuguuggauucuacgcccaaagcucuuaggc

SEQ ID NO: 4118839 - RNA, 75 nt, Human
guuuaaauuguaucaaagucuguuacuccugccuuaucaaggcauaaacaaccagcuuugauacgcauuauaggc

SEQ ID NO: 4118840 - RNA, 72 nt, Human
guugaauaucagaucuggcuacucuagccaacuuucaugucuggcagcaauuagcuagagcugagucucagc

SEQ ID NO: 4118841 - RNA, 74 nt, Human
guugaauggcucuguuuuaugaguaccacacugacaaaggcauaaauggcaccaaaagcagacguauuuucgac

SEQ ID NO: 4118842 - RNA, 80 nt, Human
guugaaugugauuaaagguggaaggcagguuuguaucacuggcugcagagcucaacuagucuauuuucaaucuauucaac

SEQ ID NO: 4118843 - RNA, 57 nt, Human
guugaauuaccccaugccuggagcacuuacuaagcuccaggcaugguguaauuuugc

SEQ ID NO: 4118844 - RNA, 71 nt, Human
guugaauucaguuaagcaacuggcuguuuugcgacuaaugauuuguaaguagcaguuuggcugaauuuaac

SEQ ID NO: 4118845 - RNA, 101 nt, Human
guugaauuguuaugagugugugugugugcuacuggcaucuagugggaaagaccagggaugcugcuaaguggucuacaaugcacaagauagcccuccgcaac

SEQ ID NO: 4118846 - RNA, 64 nt, Human
guugacacaggcaggcucuggguaugugcaucgagagauauuucccagagucuguuuuuuugac

SEQ ID NO: 4118847 - RNA, 66 nt, Human
guugacagugacccugaaagcauggagcgagagcugcucaccaaacucccagggugacuguucaac

SEQ ID NO: 4118848 - RNA, 61 nt, Human
guugaccaugacauuucuaguuucuacaaccacaccaucugaaauguaguguuaugucaac

SEQ ID NO: 4118849 - RNA, 63 nt, Human
guugagaguuaagcgggcuaaugaauggggagcacuuguguuuucucccuccuuggccucagc

SEQ ID NO: 4118850 - RNA, 82 nt, Human
guugagauugagaacugugccaaaaauuuuguucaacuuguacgaaauacuuugcacaguuuuaaauggcuuuaaucccaau

SEQ ID NO: 4118851 - RNA, 69 nt, Human
guugagcaccuuuguucauugccuucagucugaaacuuagcugaaaggaucugacaaauaaugcucaac

SEQ ID NO: 4118852 - RNA, 73 nt, Human
guugagcucuccuagcccugcugccugaauuagcugcaacugugaggcugagaaggagugggugaggcuaaac

SEQ ID NO: 4118853 - RNA, 55 nt, Human
guugaggagguucagggugguuacuauguucuugguucacucccaucuccucugc

SEQ ID NO: 4118854 - RNA, 66 nt, Human
guugaggcugaucccaggcacugucgcaacccagcugggugugugcaugcuuggggcagcacugac

SEQ ID NO: 4118855 - RNA, 66 nt, Human
guugagucagcaguaguaaaucaugaaauaugauaugaacaccauggaagugcucuucugaccaac

SEQ ID NO: 4118856 - RNA, 74 nt, Human
guugagugcucugcaggccugugaagggugccaccugagggagccgccugcaagcggcccugcagccacaaagc

SEQ ID NO: 4118857 - RNA, 63 nt, Human
guugagugcuuugaauguucugggcacugggcuggaugcuaggaauacacagagcaauaagac

SEQ ID NO: 4118858 - RNA, 59 nt, Human
guugaguguuccagaaacuggcccugugugcaccagggcuggaggcuggcacguugggc

SEQ ID NO: 4118859 - RNA, 67 nt, Human
guugauaagcagcauugagaucugcccuccuaagaaugggccauuaggucuucaaagcuuuuacgau

SEQ ID NO: 4118860 - RNA, 77 nt, Human
guugauaauacugaaggcccuggaguuucuggacaauagugucauugucugggagggacagggcuacaauuaucuac

SEQ ID NO: 4118861 - RNA, 90 nt, Human
guugauaggcaguauaguauaguguagugacugagaacaugaaugucaguguccaccugaauuccagucucugcucuauuucuuauuagc

SEQ ID NO: 4118862 - RNA, 70 nt, Human
guugauaucaauggaucuggaauucaggaaaagugucugagauauccaggagauucauuaggucaucagc

SEQ ID NO: 4118863 - RNA, 61 nt, Human
guugaucauucuuccagagugaacuuuaagaaacucauucucacaggcuggaaugaugaau

SEQ ID NO: 4118864 - RNA, 99 nt, Human
guugaucucagucuucugauggguggagucuuaaaaaucaaauggauggaguaaucaaguccugggugaggcuuuauuuuaggugagaaugagauuuac

SEQ ID NO: 4118865 - RNA, 66 nt, Human
guugauguugacgcuaagacuuagaacccuaauguuuuuggucuucauccgucacagcauaucaau

SEQ ID NO: 4118866 - RNA, 130 nt, Human
guugauguuggcucuuggcagggaccuugccuggugcugugguaggaucauagccucucuguguggcugcuugacuuugucacagcaugguggcaggucccaagagggaaccaagaggccagguggcaac

SEQ ID NO: 4118867 - RNA, 55 nt, Human
guugauuccggggccauuucaacgugcagaggcuugggaugggucugggaccagc

SEQ ID NO: 4118868 - RNA, 79 nt, Human
guugauugaaaucuacuagugauauaaucaaagaugaaucauugaacauaaaucacuggucaguaguuuccccaccagc

SEQ ID NO: 4118869 - RNA, 58 nt, Human
guugauuugaagagcagaaagucuuuuucauuacuacguuuugcucuucuaugucaau

SEQ ID NO: 4118870 - RNA, 102 nt, Human
guugauuugggguggagaguucuguagauaucuauuaggucugcuuggugcagagcugaguucaauucuuggauauccuuguuaacuuucugucucguugac

SEQ ID NO: 4118871 - RNA, 58 nt, Human
guugcaaaugggaagaugguuaacagcugaaaggagguucaucuuucaaauuugugac

SEQ ID NO: 4118872 - RNA, 79 nt, Human
guugcaaugcagggccucuggaacacugagggcuguccugugccacccccagccaccaguggccccugugcauggagac

SEQ ID NO: 4118873 - RNA, 102 nt, Human
guugcacaaguugugcacugcacaucucuagcaggcaugauuuauguggaauacuauguaaauggcaaccccuagagcugucaaauguacaguuugugcagc

SEQ ID NO: 4118874 - RNA, 83 nt, Human
guugcagagugaagcaguauggaaaagaaauuccacucauuuuuuggaaagucaguuucucaugcaugcucuuacuuuucaac

SEQ ID NO: 4118875 - RNA, 84 nt, Human
guugcaguuauucagaaggcccgcccugagcaagggcuccaaaccaggauuuccuucaggguugaggccgacucuaguggcagc

SEQ ID NO: 4118876 - RNA, 91 nt, Human
guugcauauuucugcauguuaauuaggaagaggaugucagcauucaauaauguuauuguuuugcuuccuagaaggucugcaaaaaggcagc

SEQ ID NO: 4118877 - RNA, 76 nt, Human
guugcaugacugauaagaaagauuccuauuuggacacugccauuucuuaggugucuuucuguccuuguucugccac

SEQ ID NO: 4118878 - RNA, 127 nt, Human
guugcauuuagggaaagcaacagcacagcaguuaagagaaagguguccaauccugguuggaucauuuacuagucauccggcuugguaugccuuaaccucucugugccucaguuuccucuucuguaau

SEQ ID NO: 4118879 - RNA, 75 nt, Human
guugccaaaacugugacugagcauucacauggguuuucaaggcagguucaguguuugcuuaaguuauaugguaac

SEQ ID NO: 4118880 - RNA, 60 nt, Human
guugccaaugucuuuagcaaauggugagauauauuccaagaaacugaagauaauggcaac

SEQ ID NO: 4118881 - RNA, 63 nt, Human
guugccagacuuucuuaccagugucauuuaagucaacgaauacaugguaaaaguuuuggcaau

SEQ ID NO: 4118882 - RNA, 65 nt, Human
guugccauugagguaaaauguucaugguuagacagugaacucugaauuaauugcucucaaucaac

SEQ ID NO: 4118883 - RNA, 73 nt, Human
guugccccaguacacacugaccugaacuuagcaucccggagaaugaaagggacaguuggggcaguggggcagc

SEQ ID NO: 4118884 - RNA, 99 nt, Human
guugcccuccaaucccuucccuugaaguagccagagggagguguccacuccugauucaagcccuuccuuagcuccucauggccugggguggaguccagc

SEQ ID NO: 4118885 - RNA, 102 nt, Human
guugcccugaugaugauuaauccagagccuucgauaagaagagucucagauucaaagauucccuguaagguucugagauuuggacauccucaaauucgcagc

SEQ ID NO: 4118886 - RNA, 79 nt, Human
guugccgcugcaaguacucgcagcuguuggcgcuggcuggccgcagccgggacagcaggugggcuuugcggauggugau

SEQ ID NO: 4118887 - RNA, 77 nt, Human
guugccuccauuuuuuaaccuguaaaaugggagaaguauuaccuguuuugcccaccuuauagguuuugaugcacaac

SEQ ID NO: 4118888 - RNA, 105 nt, Human
guugccucuggccuuucccuguccagcauugagccuguaauccuugggcccugaccagagggcccagcccuugcuggucucaguuguuggacuggccaagguggc

SEQ ID NO: 4118889 - RNA, 73 nt, Human
guugccugagucaggacaagguggucuccagagaaacuucaacuuuugggguaccacaaucuggaaugguagc

SEQ ID NO: 4118890 - RNA, 88 nt, Human
guugccugguacagaaucuguuauugaauaggugcuaccaauuaauguugguagcacugacuuucaugacaggacuguaaccaguaac

SEQ ID NO: 4118891 - RNA, 63 nt, Human
guugccuuuaucuugggccaaguuucuauccuggaagaggaaaguaagagaugaaguuguaau

SEQ ID NO: 4118892 - RNA, 61 nt, Human
guugcggaucuucauggccucaggagacuuguuucuccaugggcucuucuggacugcacac

SEQ ID NO: 4118893 - RNA, 56 nt, Human
guugcgguggcuggcuggcacuguccccaggggcagugccagcuccacacagcagc

SEQ ID NO: 4118894 - RNA, 65 nt, Human
guugcuaugggaggagauaucacaggggcuggcucagcuccagguaucuggcuuccacaucugac

SEQ ID NO: 4118895 - RNA, 77 nt, Human
guugcuccguuuugugggacacggaugaguuuucuuagguuagaaccucucaccuuccccaacgcauggaauaaaac

SEQ ID NO: 4118896 - RNA, 65 nt, Human
guugcucgcgcuguuccagcagcuggcgccgcguguggugcagcagcuggguccggcggagcagc

SEQ ID NO: 4118897 - RNA, 59 nt, Human
guugcugaaggcaugccagagaaggacccaaauacuauccaggcagcuugacuagcaac

SEQ ID NO: 4118898 - RNA, 76 nt, Human
guugcugccccugggugagcaguggggccacaguuagguccccucugcaaauagccaggcuuuccaaggcaggaac

SEQ ID NO: 4118899 - RNA, 60 nt, Human
guugcugcccguaccugugcacuuggccacaguccaaagugacuccauugcgggcacagc

SEQ ID NO: 4118900 - RNA, 82 nt, Human
guugcugcucuacucucuaguuguugaugaaugacugaaccucggucgucaguuuucucauuuaugagauguggauaauaac

SEQ ID NO: 4118901 - RNA, 70 nt, Human
guugcuugggcuggagugcaauggugcgaucucagcucaccgcaaccucugccucccagguucaagcgau

SEQ ID NO: 4118902 - RNA, 69 nt, Human
guugcuuugcucucuucucuccugcagaauuuuguguagcucccccaagaggaaugguuugcaaagcac

SEQ ID NO: 4118903 - RNA, 66 nt, Human
guugcuuuucuccaucacauggagagaucuuggcucuguggggauagcaaugguggggaggacagc

SEQ ID NO: 4118904 - RNA, 59 nt, Human
guugcuuuugucugucccagcuugugcaucccaugggucagggcuggggucagagugac

SEQ ID NO: 4118905 - RNA, 65 nt, Human
guuggaaaugaaaugaaguuggccuggcuuuugaagccugugccauuuucauuacacacucugac

SEQ ID NO: 4118906 - RNA, 108 nt, Human
guuggaagccaaguacuuuacauuccuucguuuagagauuucaugcuuuucgaaagucguggcgguucugaucgcuaaacaaaguagaaaugaagugugcucaccagc

SEQ ID NO: 4118907 - RNA, 80 nt, Human
guuggaaggcacaguuaaagggucaugugaccaaggagggaaaugccuuugucacaugacuuuuugguggccugauuagc

SEQ ID NO: 4118908 - RNA, 59 nt, Human
guuggaaguagcaagugaaagccaggaaaaauuaucugugcuuucugcaugguuccuac

SEQ ID NO: 4118909 - RNA, 59 nt, Human
gugucaccucuucugcgucccugggaggcaaagcacccugggcucagagcagguagcac

SEQ ID NO: 4118910 - RNA, 81 nt, Human
gugucagaaaccccugggccaggggccucuucugauagucagcauacauuucaagggguccuugcuugggggcucuugcau

SEQ ID NO: 4118911 - RNA, 76 nt, Human
gugucagggaacccugggcggguguuggccgagucacgugaagcaaggcagcuccugcccaggaaggcucuggggc

SEQ ID NO: 4118912 - RNA, 56 nt, Human
gugucagguugguuuucagagaacagaaaugacaguucuaugaaaucaacuugaac

SEQ ID NO: 4118913 - RNA, 55 nt, Human
gugucauaaauccacgugcaugaaggcaccaagccagcaccagauugagugacac

SEQ ID NO: 4118914 - RNA, 105 nt, Human
gugucaucaugguccuccuucugcccccgugagauuggaguuugaugaggccagguaacaaauaaaugccuguguaaauucuagcuacgguggguccauagacac

SEQ ID NO: 4118915 - RNA, 59 nt, Human
gugucaugacccugccauaugaucuuugccgcccaacagaaggaagcagggucaggcau

SEQ ID NO: 4118916 - RNA, 58 nt, Human
gugucaugcacacucaguguugcaaauuaauggucuggugaucuggguggcauggcau

SEQ ID NO: 4118917 - RNA, 72 nt, Human
guguccaaacuccuccacugauccugacuuuggagcagcccugaccaaggcccucagugggaggcgggacac

SEQ ID NO: 4118918 - RNA, 66 nt, Human
guguccaaguggaaguauaagaaugauagcugccccauauuaucagauauagcauucacuggaugc

SEQ ID NO: 4118919 - RNA, 55 nt, Human
guguccauguuguucagggugaguccaugugucucuccuugaaucuucaugacac

SEQ ID NO: 4118920 - RNA, 122 nt, Human
gugucccccaucgauggggcuggucacucaguuuuuggccucugcugcaucccuaacacuauaucaaguguggcggggaaauugagaggccccuccucaagcccuggucaugauggagguac

SEQ ID NO: 4118921 - RNA, 105 nt, Human
gugucccuguccccgcccaggaaagggcugccauuucuggcccaagacugcuccccuuggaaaggccugccuggaaggccagcccuuggcggcaucuggggacac

SEQ ID NO: 4118922 - RNA, 90 nt, Human
guguccuauucugcuacugaaugaugaucuagcaagggggaaaaauugcuucugaaaugcaggucuucauaagacaaaggaagaggaugc

SEQ ID NO: 4118923 - RNA, 60 nt, Human
guguccucuguuuccaucugacuuccacuccagguggggguucuuaugugcacagggcau

SEQ ID NO: 4118924 - RNA, 69 nt, Human
guguccuuauauggcagacagcagagagagagaaagaaggcucucuacugccuccucuuaugaggacac

SEQ ID NO: 4118925 - RNA, 83 nt, Human
guguccuuggagaagugacagagccucuaaacuuccugcugcagucaguuacaguguucuauuacucugcuggucaaggagau

SEQ ID NO: 4118926 - RNA, 74 nt, Human
guguccuuguaaagcucaugucuacucugcagcucagaauguggcuguguuggaaauagggucuuugcagacau

SEQ ID NO: 4118927 - RNA, 56 nt, Human
guguccuuuugaggguccacaggggacuuucucauguccuuggguuugaaggacau

SEQ ID NO: 4118928 - RNA, 74 nt, Human
gugucgcuucagggggcuagugugcuggaggcuacaggaagcaaagggcauggcugguguccugagggagacac

SEQ ID NO: 4118929 - RNA, 72 nt, Human
gugucuaagcucuuucugaauauuugaccucaccauugugacauuguagguuaagcggaggugucuggacac

SEQ ID NO: 4118930 - RNA, 75 nt, Human
gugucuagaagugggccacugaggguggucauuuuguuuuggaacagggauucucagccuuggcaccacugacau

SEQ ID NO: 4118931 - RNA, 129 nt, Human
gugucuaguguauuuuauuuuaccugucucuuuuuuuguaugggcagaaauuagaucuuuagagauuauuaaagcuacaucaaggagaggcaacauaauauaguggugaagaacacugacgcuagaucc

SEQ ID NO: 4118932 - RNA, 59 nt, Human
gugucuauaaugaaaugcacuugugauucuacacacacaggaugauuugauaugggcau

SEQ ID NO: 4118933 - RNA, 79 nt, Human
gugucucccagagguggggacaggugaugcaaggucuggcacagauugguaaucagaaguccaauaccaugggagaugc

SEQ ID NO: 4118934 - RNA, 71 nt, Human
gugucuccuggcauuugguugaguagaauucuaucucccuuauuagcuaagugucucugcugaggagucau

SEQ ID NO: 4118935 - RNA, 88 nt, Human
gugucuccuuggugccuuggcuaugcuuguguucaguuuugaagcaacaaaauguggagauaaugcuagcuuuauaguaaggguacac

SEQ ID NO: 4118936 - RNA, 130 nt, Human
gugucucuguguuugcagguguccagugugaggugcagcugguggagucugggggaggcuugguacagccugggggaucccugagacucuccugugcagccucuggauucaccuucaguaacagugacau

SEQ ID NO: 4118937 - RNA, 84 nt, Human
gugucugagucuaugacagcagcagagauacugguuucuuuuugggagggaagcauauccauguugcagccaaggagcaggcac

SEQ ID NO: 4118938 - RNA, 65 nt, Human
gugucugcucagcuugcuagaacuuuuuaccucccuauccucuagcugcuggggagggcagacac

SEQ ID NO: 4118939 - RNA, 88 nt, Human
gugucuggacagggguaccuggguuaccugucugucccagaagagagggcuggggggagcuacaggucccuuggagucaucaggauac

SEQ ID NO: 4118940 - RNA, 84 nt, Human
gugucuggagacauuuuuggcuguuauagcuaaggagaugcuaaugucuccugguggauagaagccaagguugccacuaaacau

SEQ ID NO: 4118941 - RNA, 66 nt, Human
gugucugucuuuugucuuugaaaugcugcuacugaaguggcacuuucaaaagagaagucaugacac

SEQ ID NO: 4118942 - RNA, 70 nt, Human
gugucugugcaacgguuagaugaagaugcuuugcgaggugagauauggacaucugaaguugcagagagac

SEQ ID NO: 4118943 - RNA, 128 nt, Human
gugucuguguuucucugcucuucucuguauuuaagggugucugccucuuucuuucugggucucugacuugugaauuaaaagguaguaguuagaagugcagugucugaguagggcaugguggugugcac

SEQ ID NO: 4118944 - RNA, 61 nt, Human
gugucuguuuacuuauugguaaagaguuuguuacuuaaagcucuuuauauaguaaagauau

SEQ ID NO: 4118945 - RNA, 85 nt, Human
gugucuucuacucaagauagggaaaguacaacuccccugguuauuaucaggaccaauugauuuugccugaucugagagaaaacau

SEQ ID NO: 4118946 - RNA, 71 nt, Human
gugucuuuccucuucuggcaggcagggacaugaacaaauccgugacucagcacugacccaggagaugacgc

SEQ ID NO: 4118947 - RNA, 61 nt, Human
gugugaaagagaauaaaaccaguggagguaaaccccagcucucucaguucugcuuucaugc

SEQ ID NO: 4118948 - RNA, 57 nt, Human
gugugaaaugguucucuuuguuguuaauaacaaaucauaggagucccauauucccac

SEQ ID NO: 4118949 - RNA, 89 nt, Human
gugugaacagaucugagguuuauugaucuaaaucaacgugggcugaggaacagcacaguaacugaugugaucaaacgagcuucucauac

SEQ ID NO: 4118950 - RNA, 80 nt, Human
gugugaagacagcacaggaccaaggaagcuguagucuucagggaguacacaguucaugguggcuggugguggaugcacac

SEQ ID NO: 4118951 - RNA, 87 nt, Human
gugugaagauccugggagugucagacuugcuucugcgcaucaucaaauccauaccauaagcaaaauagugacaccuccuacuugcau

SEQ ID NO: 4118952 - RNA, 61 nt, Human
gugugaagguaauggaaucuccugauucucaaagggucagaggacugagaguugcccaugc

SEQ ID NO: 4118953 - RNA, 98 nt, Human
gugugacagucaugacagaggagcuggaaugauucuguuuuucagaucuguucuuuuucucucugcauuugaacguugauaacccugacaaaucacac

SEQ ID NO: 4118954 - RNA, 80 nt, Human
gugugacccauucaaggaacugccaggugcuccaucugaaccaacaugucugagcugggggccuggcaugagggucaugc

SEQ ID NO: 4118955 - RNA, 72 nt, Human
gugugacccuuguccucaaggucaggauagaguuccagcugucauaucccauuggccaggacauaguugcau

SEQ ID NO: 4118956 - RNA, 60 nt, Human
gugugaguauaugcauguuuuagacuguauguauuuguguguauguacauguacucacac

SEQ ID NO: 4118957 - RNA, 79 nt, Human
gugugauucucaaggcaugaaaggagugaguguugaguuauaauuacgauuuauuucuuccuuuaauguggaauuguac

SEQ ID NO: 4118958 - RNA, 89 nt, Human
gugugcaauucuuuucucuccagguggggugaugucggucagcaacuucugagguuuucccaguucuggcgaggaugagccugguagac

SEQ ID NO: 4118959 - RNA, 80 nt, Human
gugugcagggccuuguugaugugcuccacaauccagccgaacaacugggcauagaugugcuucgccagggcguugcgcgc

SEQ ID NO: 4118960 - RNA, 55 nt, Human
gugugcaggggguccccaugccacccaacccugggcugagugggccccugcagac

SEQ ID NO: 4118961 - RNA, 76 nt, Human
gugugcauaugugugugugcauaugugcauguguguuuuuguaggcauguauaugugcacauguguguggcuauac

SEQ ID NO: 4118962 - RNA, 74 nt, Human
gugugcaucuuuucugcuugauuuucuguuuauggugacaccuaaguaagcuuuuaagugacuaaguugcacac

SEQ ID NO: 4118963 - RNA, 104 nt, Human
gugugcaugagugccugcauguguguacauuugugcacaugugcauggguguggaugucuaugcguuuguguauaaauuuauguguguggguaugugugcacau

SEQ ID NO: 4118964 - RNA, 62 nt, Human
gugugcauguauauacuuuuaugcguacauauauguauacauguagguauauacauguacau

SEQ ID NO: 4118965 - RNA, 90 nt, Human
gugugcaugugugcacaugugugugugugugugugugugugugugugugugcgggugcauaugcaugcaugcuugugagaggcaguacac

SEQ ID NO: 4118966 - RNA, 73 nt, Human
gugugccaucaaaguaucucaauaugguagaauuuuuucuccuuuguggaaauacuuguggugccauguacau

SEQ ID NO: 4118967 - RNA, 94 nt, Human
gugugcccagacagcugagccaggggaugguggggagacuugagcggcuuugucuguccaggcaccccaagugggcccaggcugcuggggacau

SEQ ID NO: 4118968 - RNA, 89 nt, Human
gugugcccuaaacugugacaccuuauuuggaaauauaauuauagcagauguaauuaguuaagauggggucuuacugcaguagggugggc

SEQ ID NO: 4118969 - RNA, 68 nt, Human
gugugccucugaguguuuuccccgggucgcuggauaugcagccaggauaggaaucacugcagcuacau

SEQ ID NO: 4118970 - RNA, 58 nt, Human
gugugccuguaucaugguaaccacuccauaaauguggcuuuuauuauggaagguacac

SEQ ID NO: 4118971 - RNA, 67 nt, Human
gugugcuagcugcuucacacagguaacuaauuuaacccuaacauucugugaaauagcuaugcuacau

SEQ ID NO: 4118972 - RNA, 72 nt, Human
gugugcuauuaaugaggcugcauuuuaaagcagguguuguuaagugcaaucagagcagcuuuauuaagccac

SEQ ID NO: 4118973 - RNA, 57 nt, Human
gugugcugagugacugucaucauaccacggcauaagugacaacagaacugggcaagc

SEQ ID NO: 4118974 - RNA, 56 nt, Human
gugugcuucagauucauuauuguuuaguucuuccuaagggaugaaaugaugcacac

SEQ ID NO: 4118975 - RNA, 58 nt, Human
gugugcuuccagggugucauccgccagggcaguggccucugagcuccuggaagcgugc

SEQ ID NO: 4118976 - RNA, 69 nt, Human
guguggaacaaugagguuugcagggagcagguuaacaaaauaauccauucugccaugcuucaucuacau

SEQ ID NO: 4118977 - RNA, 73 nt, Human
guuuaacaacuugcguucagagauguccuguaaggcauaggugugcacucuugaaugcugguuguucacaaac

SEQ ID NO: 4118978 - RNA, 74 nt, Human
guuuaacaauguaaucuacucugcucaaguugauugucuucauuuugcauggaggaguagagauugcauguagc

SEQ ID NO: 4118979 - RNA, 61 nt, Human
guuuaagaauaaaugguuguugcuaaucuaacauacuuagcacaccaggcaugucuugagc

SEQ ID NO: 4118980 - RNA, 60 nt, Human
guuuaagauuuguacccuguugacuucuuaaaggacuugcgacaguguauagauuagagc

SEQ ID NO: 4118981 - RNA, 101 nt, Human
guuuaagcaacauggaaugguugcauguggcguuucugcugacaggccaaauuaaggccccagccaacagccagcaucaaccaagauaccugugcaugagc

SEQ ID NO: 4118982 - RNA, 119 nt, Human
guuuaagccacucagucugugguauuuuuguuauaggagcccgaacuaagacaccacuauucugaucguagucucuugauguugccauaauaaaauaccauagucuaggaggcuuuuac

SEQ ID NO: 4118983 - RNA, 80 nt, Human
guuuaaggacaggugcugcguggcggagcugguauccaaacucaggacccgcuccaaagacuggcuccugauccuuagac

SEQ ID NO: 4118984 - RNA, 62 nt, Human
guuuaagguggaagaugugcuuuuuguauauaaaaaagcacaucucaaacuucaucucaaac

SEQ ID NO: 4118985 - RNA, 80 nt, Human
guuuacagaaaaguguuaacaucuuggacucgugaagcaauguuuucacacauucuagguauguugaccuaauaugaaac

SEQ ID NO: 4118986 - RNA, 68 nt, Human
guuuacaguggcuucauuggauuugguugaaaacacaaugguggcaauagcaguguagucucugugac

SEQ ID NO: 4118987 - RNA, 59 nt, Human
guuuacauuaaguauuagcauccuuagagaaaccaggaccagcugacuuaauuguaaac

SEQ ID NO: 4118988 - RNA, 125 nt, Human
guuuaccccaagagcccaccaagagcucccccagcucagagaauagggcuugaggggacccugagcccccucccuguccucggaggugucaucuuugggagcuccagggaggggucuggggaaac

SEQ ID NO: 4118989 - RNA, 78 nt, Human
guuuacccuuugucaccaguggcuuugguauuuccaugucuggcauugcauaaacuucucuggugugaaaggauaaau

SEQ ID NO: 4118990 - RNA, 74 nt, Human
guuuacugcacaguaagguaucccagugaauacccaguggucuucuaaauggggauccuuucugugucacaaau

SEQ ID NO: 4118991 - RNA, 57 nt, Human
guuuacuguuaaccaacgaauggggaaggagaaccacauuacaugguuuuagugaac

SEQ ID NO: 4118992 - RNA, 57 nt, Human
guuuacuuagaugcucaugcagagagguuaucaucaaagaugggcacuagaguagac

SEQ ID NO: 4118993 - RNA, 87 nt, Human
guuuagaagccagagagaaauggauuugagucccaaaccccuuauuuacuaaucaugggaacuuaaucauucucucugcuuucaaau

SEQ ID NO: 4118994 - RNA, 59 nt, Human
guuuagaaugaaacuuuugagcacagguuauuggacucaggcaaaccuucguucuaagc

SEQ ID NO: 4118995 - RNA, 66 nt, Human
guuuagagggcauaguuaaauaggaggaaaguacuuucaccagaauugcaaacuguguccuacaac

SEQ ID NO: 4118996 - RNA, 99 nt, Human
guuuagaucgcauugucaugaaucuucuugcugccuguuuuauuauaggucuuauuauggacuuuaauucucaggugcacauacaaugcuuucuaugac

SEQ ID NO: 4118997 - RNA, 65 nt, Human
guuuagaugggaggcauuucaggaaacaaauguguggggagaagcugccuuuuauaccuuuaaac

SEQ ID NO: 4118998 - RNA, 79 nt, Human
guuuagcucaauuguacauaaaccauuuggcccccaguaucaacuggaugcuuuguuuauguguaguuuuaugcugggc

SEQ ID NO: 4118999 - RNA, 67 nt, Human
guuuaggaaacauauuaauccagugaaaauaacaacuauuguuauuggauuaauauguucccuagac

SEQ ID NO: 4119000 - RNA, 114 nt, Human
guuuaggauuuuugauagugaagucauauaaauuuguggccacugauucuaagucucacuggagucaaaugaguaaauauauaagacugaucaccgaaguuuaauuaucugagc

SEQ ID NO: 4119001 - RNA, 57 nt, Human
guuuaguggaguagaaaccaaagaagccucuuuucugcuucucauaccccgcuaagc

SEQ ID NO: 4119002 - RNA, 92 nt, Human
guuuauaacgaggauacaaugucaugauuuuccauuagaaauauuuucaugauuuagggggauaaugacuuucugauucuauguccauaagc

SEQ ID NO: 4119003 - RNA, 57 nt, Human
guuuauacacaagacuauaugugugugcauguguguauacagugucuguauauaaau

SEQ ID NO: 4119004 - RNA, 79 nt, Human
guuuauauccugaauaaauuagcugucacucaacaacaaaguuuagugauaugucugguuugguucagugauuuugggc

SEQ ID NO: 4119005 - RNA, 81 nt, Human
guuuauaugcaaauacuaugacauuuuguaucagggacuugagucuguggauuuuaguguucaugggagugagaugugggc

SEQ ID NO: 4119006 - RNA, 82 nt, Human
guuuaucuagaacuuaaagucagucaacagcuauuuacugagcaucuacaauguuguuuggcuaaguaggugcuggaagaau

SEQ ID NO: 4119007 - RNA, 96 nt, Human
guuuaucucuugacuucuggauggaugcuucuuucuaguuuuugaauauuauaaagaaagcugcuaugaacauucuauuucaagucuuauauaaac

SEQ ID NO: 4119008 - RNA, 82 nt, Human
guuuaucugcagaucugcaggugagggcccuggaagcaugaacuguggccaggggaguuccccuccacugcacucagaauac

SEQ ID NO: 4119009 - RNA, 60 nt, Human
guuuaugguguuaauuuauauugugguguaacaaacuaccacacauauagcagcauaaac

SEQ ID NO: 4119010 - RNA, 66 nt, Human
guuuauugaacaccuggugugugccugggccuuuauaagagcugaggauacaucagugaacaagac

SEQ ID NO: 4119011 - RNA, 64 nt, Human
guuuauugagcauuuaaccauaugccaggcacugugcuuggcacugggacagaugcucucagac

SEQ ID NO: 4119012 - RNA, 92 nt, Human
guuuauuuucuuaagccucugcauuaucucucacacgucuugcuuaaaaaauagguuagugagaagauaaguauugcaaaagacaaagaaac

SEQ ID NO: 4119013 - RNA, 79 nt, Human
guuucacagaauaccagguucuuccaggugagaucacucuccaagaggcaguuucaucaggagaaaagauucgucaaac

SEQ ID NO: 4119014 - RNA, 63 nt, Human
guuucacagcaaaguucccuguuuuauuaaaauccaccaggggauguuuucaacuugugaaau

SEQ ID NO: 4119015 - RNA, 56 nt, Human
guuucacaugaaacuuggggaaccgauuucauucccccaguaucacccuguggcgc

SEQ ID NO: 4119016 - RNA, 104 nt, Human
guuucaccaauuagacggcuacuaauuucuucacuuauuuuacugagaauaaaugucugagaucagugucauaaggagaaauuacagcaaguuuuugguuugac

SEQ ID NO: 4119017 - RNA, 68 nt, Human
guuucacccacauuccacuggccaaagcaauuuccaugaccaagcucagagucagaggauggggaaau

SEQ ID NO: 4119018 - RNA, 58 nt, Human
guuucaccuccaaagaauugcucccaguguaggagcagcccugaaaucgaggugacac

SEQ ID NO: 4119019 - RNA, 80 nt, Human
guuucacuccagugcaaugcagaugacaccaagccaacacgcagaggcauggccggaguguugucacugugaguuggggc

SEQ ID NO: 4119020 - RNA, 57 nt, Human
guuucacugaauuaauuuccuucuuaaguucuaucucaagaaggauucaaguggaau

SEQ ID NO: 4119021 - RNA, 93 nt, Human
guuucagaaagucuggaaaugcccccaucucagucgugcuaagggcuugugcacuuagcccaaugcugaauggacaggguggcugccuggaac

SEQ ID NO: 4119022 - RNA, 79 nt, Human
guuucagacacucuguaaggcacuaagcauaugucagugaaaagaauuacuacaucuuugcucuuauagagcuuggaau

SEQ ID NO: 4119023 - RNA, 84 nt, Human
guuucagagaagaaagaaaaagcuaccuuuguguucauagcuaaacauuaguuucuuauauuggagucucucuuuuucugauac

SEQ ID NO: 4119024 - RNA, 81 nt, Human
guuucagcaaaacgggauugacugcgcuuuauuguuuguauuugcaguuuuaauugaagccagucaauguuaaguuauaau

SEQ ID NO: 4119025 - RNA, 79 nt, Human
guuucagcccagguggaguguguggggauuggggguuagaagcaguccccauggaaaacccaccuagggaacaggaagc

SEQ ID NO: 4119026 - RNA, 79 nt, Human
guuucaggcuacucuuuugagucuucagauccucuuaaaauugaagaguauuuuaagauugcaaggugagguguguaac

SEQ ID NO: 4119027 - RNA, 61 nt, Human
guuucagugaaguucaagcuugccaucuauuuucaguagaagcaggaagaaugucagagac

SEQ ID NO: 4119028 - RNA, 57 nt, Human
guuucaguucauguauuccgagugaauuucugguucacucguauuuucaacugaaac

SEQ ID NO: 4119029 - RNA, 111 nt, Human
guuucaguuuaggacugaccagcuuuuuucuguaggcuuacgcggcuucugugucuccaaacuacucuuagagcuguuugucuagagagugacuggcaggauuacugagau

SEQ ID NO: 4119030 - RNA, 58 nt, Human
guuucauuaaguauaaaauguggugauuuuucacaccuacacuaggacuagauggaac

SEQ ID NO: 4119031 - RNA, 72 nt, Human
guuucauuuauugguuaggccagcagaagacgguaaacguugguuuggugguguugacagauggugugaaac

SEQ ID NO: 4119032 - RNA, 69 nt, Human
guuuccacaacaguccagcucaucaguggcaccguuggagcugugucuaccccacggguuggaggaaac

SEQ ID NO: 4119033 - RNA, 63 nt, Human
guuuccagaaaacgcuuuauuuaggugcucuuugcauuuugaauccguucguucuuugggagc

SEQ ID NO: 4119034 - RNA, 55 nt, Human
guuuccagccaauccccucaggggucuagagaugccugggcugugguuuggagac

SEQ ID NO: 4119035 - RNA, 64 nt, Human
guuuccagcuugggcccggggauuggagauguccccacugagaguagggcacaagugaggaaau

SEQ ID NO: 4119036 - RNA, 55 nt, Human
guuuccaggcuaugauauagagaggggaaaaccucucugucugagccuggcagac

SEQ ID NO: 4119037 - RNA, 61 nt, Human
guuuccaugggagaagacaguguaaguuuacauuagagcuguguuucuacccaggggaggc

SEQ ID NO: 4119038 - RNA, 69 nt, Human
guuuccauggugcagaaauccaggcauggcccgacugggucuucugcugggggugucucaccaggcugc

SEQ ID NO: 4119039 - RNA, 92 nt, Human
guuuccauuuuggaaucauuguaaauaaugcugccaugaacauuuguguauguguuuguggguggacauauguuuucaaugcucuuggauac

SEQ ID NO: 4119040 - RNA, 62 nt, Human
guuucccagucugcagaguucuuuccuacuaugaagaagaggugauucugcaggcuggaaau

SEQ ID NO: 4119041 - RNA, 95 nt, Human
guuucccucacagugccccuucuuauagaagcaaccauuguuccuuauacaagcaaccguugcuucuguaaguagccauuguuccuccuggagac

SEQ ID NO: 4119042 - RNA, 70 nt, Human
guuucccuccacagaauguaagauccacaaaagacagaucuuguggucuuguucggucugugccuagaac

SEQ ID NO: 4119043 - RNA, 57 nt, Human
guuuccuauggcugcugcaggaaaugacacaaauuauccccuuauagucguggaagc

SEQ ID NO: 4119044 - RNA, 93 nt, Human
guuuccuccuggacuuucucagcuuuucccaccccagcgccagugggagggagguggccugacaagugggaagaggcuggggccagaggaaac

SEQ ID NO: 4119045 - RNA, 56 nt, Human
guuuccucuccggggccuccaggguucccgacuccugccggaccugguggggagac

SEQ ID NO: 4119046 - RNA, 93 nt, Human
guuuccucuuagaauuguuccuuuucuuaugcaucauuaccuggcauuccccguagucacaguacaggauaaagaaucgaaucgaagggaaau

SEQ ID NO: 4119047 - RNA, 93 nt, Human
guuggagaaguggaaaugcccuuucacucagcacaaacagcaacauucccaugagcugaggagaugggcuuuuuagggaguaguucauccaac

SEQ ID NO: 4119048 - RNA, 59 nt, Human
guuggagggugugucugugugagggcggguuccccugcugucgccagagccccaccuac

SEQ ID NO: 4119049 - RNA, 79 nt, Human
guuggagugauaauguguuucaagaggcuuaauucuggaugaaacaucuggaggcuaagucauuugcuaccacucuaac

SEQ ID NO: 4119050 - RNA, 67 nt, Human
guuggaguuaagagagaugacgcugacucugaauucagaggaggcucuaaacuuuccuuggcucaac

SEQ ID NO: 4119051 - RNA, 74 nt, Human
guuggauguuuauuauggcaguuuucuaggugagaguugauucugacuugggccagggucauagaaauauagau

SEQ ID NO: 4119052 - RNA, 79 nt, Human
guuggcaccuucuugcuuuaucuguucaggggaggaaaguuuuauccucccauuguggaaggcagaagagcaagcuagc

SEQ ID NO: 4119053 - RNA, 65 nt, Human
guuggcagaauucaguuccuugugauuguaggacugcagugccuacuuucuugcugucugucaau

SEQ ID NO: 4119054 - RNA, 59 nt, Human
guuggcagcccugacccaaugggccacuggcucagaggcaagcaaggagcugacccgac

SEQ ID NO: 4119055 - RNA, 70 nt, Human
guuggcauacaaagacugcauaacacaugaauuuccccaauguguucacaguguugugccuuuuguugac

SEQ ID NO: 4119056 - RNA, 85 nt, Human
guuggccaggccugaugucgugauccacccgccuuggccucccaaagugcugggauuaccggcaugagccacgcgccuggccaau

SEQ ID NO: 4119057 - RNA, 100 nt, Human
guuggccaggcuggucuugaacuccugaccucgugaucugccugccucggccuccccaaagugcuaggauuacaggcgggagccaccaugccuggccaac

SEQ ID NO: 4119058 - RNA, 111 nt, Human
guuggccaugcuggggccuucuagggucacagugcacagcaggcguggggccuucaucucuguggcauguugcacuuguaccuggagagucggccugggcaugaggccaac

SEQ ID NO: 4119059 - RNA, 105 nt, Human
guuggccuucaguccuggcgugggguguggccagggggccaugucccccaugggcccagcaggagggcagcgcucugccacaccgcauguguggauccggcccac

SEQ ID NO: 4119060 - RNA, 70 nt, Human
guuggcugcagagcauaaaucugaauagguucuccaaaguaagcuuuuucugcaugcauuugcucccaau

SEQ ID NO: 4119061 - RNA, 59 nt, Human
guuggcuggaugacuguguuaacuggcccuuaccaguuaaguggucaguuuuagacaac

SEQ ID NO: 4119062 - RNA, 55 nt, Human
guuggcuuccacuccccaaauggaacaauaguuccuccugagugagagugccagc

SEQ ID NO: 4119063 - RNA, 84 nt, Human
guugggaaauaugggggggcgugcagaggagcugggaagccauggugcugggucacugauuccccauuuuauauaaucucccac

SEQ ID NO: 4119064 - RNA, 56 nt, Human
guugggagaaguugaacugugauccggucacagcaaaggcuucggcugaucccaac

SEQ ID NO: 4119065 - RNA, 82 nt, Human
guugggauccugucacauuuauacuccauuugcagccauacucuuggggaugcauguugaaauaacugugcaaugucaaaac

SEQ ID NO: 4119066 - RNA, 87 nt, Human
guugggcaacuugaguuuaacugucucuucuuccaguggccaaguccaaauucugaaagcacaguucugaccaugucccuguccaac

SEQ ID NO: 4119067 - RNA, 57 nt, Human
guugggcgugguuuucugugucugcgcuuacuauucgucggcucaggcuauccuaac

SEQ ID NO: 4119068 - RNA, 75 nt, Human
guuggggaaaggcuugacuagaagggagagucacaagugaguuuucuggguuggugucacugccugcacccugac

SEQ ID NO: 4119069 - RNA, 130 nt, Human
guugggggagggauggggccuggcucaaggcggagaaggggguugcagucuagggucugcgggacgccugggagugugcggccggggcccucucucugcaaaugggucucccaagcccuugccccccagc

SEQ ID NO: 4119070 - RNA, 83 nt, Human
guuggggguguccccagucccggcggugggugugugagagacuagaccuccugcuguggccgggcccuggggucagccucggc

SEQ ID NO: 4119071 - RNA, 58 nt, Human
guugggguugccacaacagugagaagaagucggauggcgccucauguguggucccagc

SEQ ID NO: 4119072 - RNA, 67 nt, Human
guuggguccuucagggcugcauacaggagauauggaagccugucuuuugcaaguagcuggaccgaac

SEQ ID NO: 4119073 - RNA, 61 nt, Human
guugggugagggacaaaaguuucuucaacaaauuaccagaguacugcagcucucacugaau

SEQ ID NO: 4119074 - RNA, 88 nt, Human
guugggugucuggcagcaggucacacgcagauucaacuauuagcuauugagcuauguucuuugcugggcucugugccagacauuuaac

SEQ ID NO: 4119075 - RNA, 121 nt, Human
guugggugugggagggauccaggcccccaagcucuaaggccuugaaaggauguccuguuaaggcagcuacuuucaaugucuugggagucagguuauguggggcccccuccccuaccucaac

SEQ ID NO: 4119076 - RNA, 65 nt, Human
guuggguuucuccuguaggcugugagauggcaaggaguccuugcugccuccuacaaaagcccagc

SEQ ID NO: 4119077 - RNA, 68 nt, Human
guuggguuucugccagagauuuaaaucagguuuauaaagaguuaccugccuaaggcaagaaacuggac

SEQ ID NO: 4119078 - RNA, 90 nt, Human
guuggucaggcuggucucaaacuccuugugaucugguugccuuggccucccaaagugcugggauuacaggcuugagccaccgugcccagc

SEQ ID NO: 4119079 - RNA, 67 nt, Human
guuggucuuuucaagguuaaauaaacuagaggucuugcuucuugcuaugaagcuuugaaaagcuuac

SEQ ID NO: 4119080 - RNA, 72 nt, Human
guugguggauuuuuaagugaguugacugucgaaaagauuuaguacacaagacacauuuaaaaggccucugac

SEQ ID NO: 4119081 - RNA, 100 nt, Human
guugguguacaaauaucugaguucugcuuucaguucuucuggguguauauaaguaccuagcaguggaauugcagaaucauaugguaaugcugcauuuaac

SEQ ID NO: 4119082 - RNA, 71 nt, Human
guugguuagauuuccucacuuugcaagaauucccaaguaugcacagugauuacaaagaaaucagagccaau

SEQ ID NO: 4119083 - RNA, 79 nt, Human
guugguuuuaugauugcaguugcuuucuauauugaauuaucaaauucaaacagaggaacaauuguuuuguauaauugac

SEQ ID NO: 4119084 - RNA, 100 nt, Human
guuguaucaaucaguaaaggcuagguuaugcugugauaacaaagaauuccaaaaucucaguggcuuaaaaugacagguguuuauuucuuuuuguuacaac

SEQ ID NO: 4119085 - RNA, 87 nt, Human
guuguaugauuaaacaaguuauuauuuacugagugcuuagaauaguuccuggcacauaguuagugcuauauguguuuaguaaauaac

SEQ ID NO: 4119086 - RNA, 88 nt, Human
guuguauuaugaggcacugaauacuugaggguauaguacauagccuauuuuacucuuuugcuuauucuaaguguaucaaggauacaac

SEQ ID NO: 4119087 - RNA, 129 nt, Human
guuguauuucuuugggccauuuucuugugugauaacaguuuauguaaauguccagcaguccuuaauugcuguuuauuuuuauaaguguuaagccauauuuacaaaagucagugacacaagguuuucugc

SEQ ID NO: 4119088 - RNA, 63 nt, Human
guugucaagugauuagccauaauguuucuugcacuucaggcuugcauuauaaaucacgacaau

SEQ ID NO: 4119089 - RNA, 96 nt, Human
guuguccaaugaaaaugguuauggaguaaugagacuuugcaucuaguauaauuuguuuaauagucuuauggccaucucugauuuuuauccagaaau

SEQ ID NO: 4119090 - RNA, 60 nt, Human
guuguccugugccaccuuccugaguggcuaccacccaggaaguugaugcagaggaccugc

SEQ ID NO: 4119091 - RNA, 57 nt, Human
guuguccuuaaaaacucugcucccugaaugcucagggagacugaucugagugauaac

SEQ ID NO: 4119092 - RNA, 107 nt, Human
guugucugggagggugcaaggugugugaacaauguucuauauuuugaucagggugcugguuauacggguguagacacauguucaucuaacugcacccuuaggauuac

SEQ ID NO: 4119093 - RNA, 64 nt, Human
guugugaauagugccgcaauaaacauaugugugcaugugucuuuauagcagcaugauuuauaau

SEQ ID NO: 4119094 - RNA, 57 nt, Human
guugugagccacugggcaggauggcagccccacaccccaaccugccugagccauagc

SEQ ID NO: 4119095 - RNA, 55 nt, Human
guugugauuguagcuaaacuagguggcaacacucguugaauagcaauagcacaac

SEQ ID NO: 4119096 - RNA, 72 nt, Human
guugugcuagucacuuaacagguauuauuuuguuuauuccuuauaacaaccuuucaaaguggcuaucacugc

SEQ ID NO: 4119097 - RNA, 127 nt, Human
guugugugacauaagaagaucuuggauuaauuagcacuauuuuucacuauccuucuauuaguauuccacugaggaaaugaagaaaaguguuguauuaaauuguaaggauuuaggaacauuaggcaac

SEQ ID NO: 4119098 - RNA, 62 nt, Human
guugugugaggguuaauugcggucugaauauaaugcacuuggcccagugucuagcgcacagc

SEQ ID NO: 4119099 - RNA, 57 nt, Human
guugugugugagccuucaccacaagaacccugguucugugggaaggacacgcagagc

SEQ ID NO: 4119100 - RNA, 80 nt, Human
guuguguguggacaagaugccaauugaucugacucaaaagccauugaaguuccaucagugcauccugccacaaagaaaac

SEQ ID NO: 4119101 - RNA, 57 nt, Human
guuguguucuuguugugaagcucauuggacuuugacuucauaaacucagaaggcagc

SEQ ID NO: 4119102 - RNA, 64 nt, Human
guuguuaaggccuugguaaauuggcauuugagucacucagcagaggcccugccaggagcccaac

SEQ ID NO: 4119103 - RNA, 88 nt, Human
guuguuacagaguuggagcugagagccaggcuggcuuccaagucugugcucauaaacacggugccauccuggauucagaccaaacgac

SEQ ID NO: 4119104 - RNA, 96 nt, Human
guuguuacuggacagguaaagcuucaaaucacuugcugucauuucacagcacaugaaaaauguuugcaguuuucuuuucaaccuccagccugacac

SEQ ID NO: 4119105 - RNA, 120 nt, Human
guuguuaugaacugaauguaugugucuccuaaaacucauauauugaagccuugaccccuaaggugacaguguuggggguaaauuuuuugggaaguaauuagguuuagauuagaucacaac

SEQ ID NO: 4119106 - RNA, 76 nt, Human
guuguuauuaauuugcaggcuggugauggaauuucauucuuuugacuucuagauugccuguaaguaaauauuugac

SEQ ID NO: 4119107 - RNA, 59 nt, Human
guuguucuaagcaggggucaaguguacaaggcauagcuuugucaucugcauaggacaac

SEQ ID NO: 4119108 - RNA, 59 nt, Human
guuguucuguaggcacacaguuucaagccugggauggcuuggaguguuacagaugcauc

SEQ ID NO: 4119109 - RNA, 91 nt, Human
guuguugcaucaucaaagacagcagcccuuuggcugaacugugagcccauuucccgucaccauaugccgcgggcugcuguugagcaauaac

SEQ ID NO: 4119110 - RNA, 78 nt, Human
guuguuguuauuuugagauggagucuugcucugucguccaggcuggagugcgguggcaccaucucagcucacugcaac

SEQ ID NO: 4119111 - RNA, 76 nt, Human
guuguuguuuuugagauggagucuugcucuguugcccaggcuggagggcaguggcaccaucucagcucacuacagc

SEQ ID NO: 4119112 - RNA, 79 nt, Human
guuguuuauaaauuacccagucugugguauucuguuguagcagcccaaacagacuaagacgugggugaauuuaaauagc

SEQ ID NO: 4119113 - RNA, 130 nt, Human
guuguuucaaaugcuguucuuuuagguagaacucuaugaaauugcuguguucauuggucaaaaauggccaaauaccagucauuucauaugguucaaccuacuaucuaugaggacuauugcaauaaacagc

SEQ ID NO: 4119114 - RNA, 59 nt, Human
guguggcaaaacccugccuacuaaaaauacaaaaauuagccaggcaugguggugcgcac

SEQ ID NO: 4119115 - RNA, 116 nt, Human
guguggcagccaaguucaacucuacugggcaugccuguuugagaauagucaggggcacccaaggucccucugcuauuucuagauaacaagaacagaagagcagccugaugccauac

SEQ ID NO: 4119116 - RNA, 97 nt, Human
guguggccccccaggcagaugugugcagacagauauuacuuagcuaccacucugcuauuaguguacaucucacacgcaugccuguucuggcucucac

SEQ ID NO: 4119117 - RNA, 59 nt, Human
guguggccgauuaagcuuaucuacaaucccuguucuaagucauagauuaauggccacac

SEQ ID NO: 4119118 - RNA, 55 nt, Human
guguggcuaggauggcuuugcugucacagaagggacaguccacacuacccaacac

SEQ ID NO: 4119119 - RNA, 81 nt, Human
guguggcugggacacaggcagcugggugggugcugccccagcuccauccccaugcccagagccuggugccagcgcccacac

SEQ ID NO: 4119120 - RNA, 73 nt, Human
guguggcuugggugucucagcucuucaaggauuuuguaauuugaaggacugucuaaggccuccaagcugucac

SEQ ID NO: 4119121 - RNA, 63 nt, Human
gugugggcagcccucuccccagcucggugcacaccaggcucugugaaggguguugcucaccgc

SEQ ID NO: 4119122 - RNA, 59 nt, Human
gugugggcagcuggagcuguucagucaagaaggaagcugauucagcccagcucccacac

SEQ ID NO: 4119123 - RNA, 62 nt, Human
guguggggagcugcagccacauucccgcggacaggcugcucagugguggcaguugcccaugc

SEQ ID NO: 4119124 - RNA, 129 nt, Human
guguggucagggagaguguugggaaaugagggugggauacagagagaaggaugauuuaaagguuuagauggucugguuauuuuuaguuuuucuauucccauuucugcaauaguuuuuauuuuuccucau

SEQ ID NO: 4119125 - RNA, 71 nt, Human
guguggucuagcugcuucucacaugggcaacucugugcagucugcguuauugaaaagcagccagauuuuau

SEQ ID NO: 4119126 - RNA, 108 nt, Human
gugugguggcaggcaccuauaaccccagcuacuugggagucugaggcagaagaaucacuugagcccaggagguggagguugcagugagcuaagauucugccacugcac

SEQ ID NO: 4119127 - RNA, 103 nt, Human
gugugguggugguaccuguaaucccagcuacucgggaggcugaggcacgagaaucgcuugaacccacccgggagguggagguugcaguaagccaagaucgcac

SEQ ID NO: 4119128 - RNA, 83 nt, Human
gugugguguggcccugguguugugaaguagccguucucugauuggcaacggccugauucacaacaccagcugccccaccacac

SEQ ID NO: 4119129 - RNA, 105 nt, Human
gugugguuuucuagcaccuugaggaaauuuagugucuuucaaaagguuuauucuacuaauaagcucuuuugguugagggacuuugcaagguagagaaaaugucau

SEQ ID NO: 4119130 - RNA, 59 nt, Human
gugugguuuuuagauuucuacagucuuucucuuaagauuuaggaauauagaaaccaugu

SEQ ID NO: 4119131 - RNA, 124 nt, Human
guguguaggggcuggacuuggggagugugagcuguaaggauggguguauuuuguccuccaaguguggcaggaaggagggagaugcccauccuggcauuaccauuuucugcagccagauacaugc

SEQ ID NO: 4119132 - RNA, 62 nt, Human
guguguagugaggagugugaccaaaauuuaaauuuuauuuugauuaaauuuaagcuacaugc

SEQ ID NO: 4119133 - RNA, 74 nt, Human
guguguaugucuauaguuuuuaaauagaccaggaauuauacuaaaauuauuuaauaaaacuauggcaugugcau

SEQ ID NO: 4119134 - RNA, 57 nt, Human
guguguauuuguauuaugaaccuacauacguguguguacauauacacaaauacagau

SEQ ID NO: 4119135 - RNA, 61 nt, Human
gugugucuguuauuugucgcugcauccccaccacgcggcacaguaccugucacagaggcac

SEQ ID NO: 4119136 - RNA, 63 nt, Human
gugugugacagcugcuuaugaaccaacggcacaccugcugcuggcugcagugcugucaaaugc

SEQ ID NO: 4119137 - RNA, 63 nt, Human
gugugugacugauuguucugagcaccagauccuucugaguggcagggaguucguucacaacac

SEQ ID NO: 4119138 - RNA, 57 nt, Human
gugugugcaugcguguaugcacauguguauguuaugugcauauauaagugcauacac

SEQ ID NO: 4119139 - RNA, 61 nt, Human
gugugugcgugugccuaucaauaaaggcugucaaaguccuugcaggaagcagauggcacac

SEQ ID NO: 4119140 - RNA, 69 nt, Human
guguguggaugugagaaggaucaggcucaaauuuuaugagccaagccaugauuuucuauauuuuuaugc

SEQ ID NO: 4119141 - RNA, 62 nt, Human
guguguguauguagaacuauguauauagaacaauauguauguauagaacuauauauauauau

SEQ ID NO: 4119142 - RNA, 98 nt, Human
gugugugugcgcgcgcgcagggguggcuuugggggguggcugcugucucugcucugguacagucugcuugucuccauggugccuguugccacacacgc

SEQ ID NO: 4119143 - RNA, 72 nt, Human
guguguguggcuaggccucaggccugccuggcuggccuccagcugcaggagagcuggucuggccccagccac

SEQ ID NO: 4119144 - RNA, 83 nt, Human
gugugugugucugguguuuauguuuguguaggggacucaucuuugaccaaauucucugcauuguaaagagccagaacagucac

SEQ ID NO: 4119145 - RNA, 91 nt, Human
gugugugugugagguucugguuuaagaaagugcuggugcacucaaaaggugcugguucaggagacauucuuaaaguagaaugaccaugcac

SEQ ID NO: 4119146 - RNA, 72 nt, Human
gugugugugugcauauguguggcucuccucugugaagucacuugguuccucacaguaugcuaauauauucac

SEQ ID NO: 4119147 - RNA, 80 nt, Human
guguguguguguagcuuuaauaagcugcugaauuauugcugaauuaugcuuauucagaguuuguuuuacaaggucauuac

SEQ ID NO: 4119148 - RNA, 112 nt, Human
gugugugugugucuccccagaaugcccccugcgugucuuagcauggaacauguugcauaacaccagccccagagcuaaacacacaggcugggacugguggaagcaccaccac

SEQ ID NO: 4119149 - RNA, 83 nt, Human
gugugugugugugugagugugugcaugcauucgugcaugcgugggugugcauguaccaugcauauacacccaucuauacacac

SEQ ID NO: 4119150 - RNA, 106 nt, Human
guguguguguguguguguauguaagcaauggcuucugaagcacacuuuacaaaaguaugugcuuuaaagaagccagcugaagguuuuauguucacugcaugcucau

SEQ ID NO: 4119151 - RNA, 62 nt, Human
guguguguguguguguguauguguguguguguguguguguguguauacacacauauauguac

SEQ ID NO: 4119152 - RNA, 84 nt, Human
gugugugugugugugugugugcgugugcgcgcgcgcgugugugugcaugugugugugcacgugcgcgcgagcauaugugcgcau

SEQ ID NO: 4119153 - RNA, 65 nt, Human
guguguguguguguguguguguauuggggcaaggagaagacgggagcacacauagaaaugcauau

SEQ ID NO: 4119154 - RNA, 84 nt, Human
gugugugugugugugugugugucccuacaacagcuucacuuacaaaguaguugaaaaagaggggcugcuucaucacaagcagac

SEQ ID NO: 4119155 - RNA, 83 nt, Human
guguguguguguguguguguguguaugcauaugagugcaacuuucccaaaguugcauauacccgcauuuacauaaacauauac

SEQ ID NO: 4119156 - RNA, 68 nt, Human
gugugugugugugugugugugugugugugugaugguacacauguauggcacuuacauuuucacugagc

SEQ ID NO: 4119157 - RNA, 76 nt, Human
guguguguguguguguguguguguguguguguguguguuugcaugcacacauguuuacaagcaucuaaaaacacau

SEQ ID NO: 4119158 - RNA, 63 nt, Human
guguguguuuguguguguaucuaaugucucuucucacugaagguacacauuauagaaauagac

SEQ ID NO: 4119159 - RNA, 93 nt, Human
guguguuauuccuacuugcagaugagaaacugaagcuccgcuagguuaaguaagcuguuccaggccucauugcuaguugggauccaaacucac

SEQ ID NO: 4119160 - RNA, 67 nt, Human
guguguucaacaauccccucucccagaugugcugcucugugcagccagcugcucgggggaaacagac

SEQ ID NO: 4119161 - RNA, 78 nt, Human
guguguucagcccuacuguuauauauagcagcaguauucuuuucaauugcugaauaauauuccacuguaugaauauac

SEQ ID NO: 4119162 - RNA, 66 nt, Human
guguguuccaaacauggcacccagaucucaaaagcuucuucaacgcucccaugguuugggauacac

SEQ ID NO: 4119163 - RNA, 55 nt, Human
guguguuccacauguguuuggccauuaucuuauugucacacauaagugaacgcac

SEQ ID NO: 4119164 - RNA, 91 nt, Human
guguguuccaugggugaagggauuuuguuugcuucgaucucuccuguauucugagcagcuagauaaagcccuuccagcacauuuuacucac

SEQ ID NO: 4119165 - RNA, 61 nt, Human
guguguuuaaugcacauuguuuccugguuaaaccaguuuucaguguugauauuuaauacau

SEQ ID NO: 4119166 - RNA, 56 nt, Human
guguguuuuuauccuuugaaucacuguaauaguuauguugaagaauaaaaacacau

SEQ ID NO: 4119167 - RNA, 62 nt, Human
guguuaauauauccccuuggcagacaugaagaacaccagcuccaagggaaugugggcaaugc

SEQ ID NO: 4119168 - RNA, 68 nt, Human
guguuaauuuauucauuauuauuugcugaaugcccauaaugcaccaagcacaaagaugaguaaaacac

SEQ ID NO: 4119169 - RNA, 75 nt, Human
guguuacggacaggaagcugagcugcacugcagaacuagaaggcucucauugugggcaucuuccugcuauaccac

SEQ ID NO: 4119170 - RNA, 110 nt, Human
guguuagccauccaucauaugcucagcugugauaugccugccugagugccugucccacucacggggcagucagcauggcaagcaguuggugugguucggggaaggagcac

SEQ ID NO: 4119171 - RNA, 127 nt, Human
guguuaggggcgccagggaaacugcauggguggguucugggagcauagaguaggauggcccgcccacaauccaucugucucugucccagacccaccucucuugugucccagaauuuaucucuaacau

SEQ ID NO: 4119172 - RNA, 89 nt, Human
guguuaucagguuuaucucauagaaagaauguguaaaauuuuucauguacaaacauaaucuuuuagcaaugaguuaaaaaauuuggcau

SEQ ID NO: 4119173 - RNA, 110 nt, Human
guguuaugaggcacauccagacguuaagaaagguguugccuuggagaccugguacaaaugccggguccucgggaugacgcugcacacuugacaacauggagcccaagcac

SEQ ID NO: 4119174 - RNA, 71 nt, Human
guguucacgugaauugcacccuagcuggaaguuaacagacuaaacaauagcagcagcaauuaaguggauau

SEQ ID NO: 4119175 - RNA, 69 nt, Human
guguucacuuucuccuucucuauuugcuguauggaguagaaacagccagggucagggagagaggaacau

SEQ ID NO: 4119176 - RNA, 67 nt, Human
guguucagguagacuuccgggucucugaaauccacaccaacagaggggaaagaccaugcuugaggac

SEQ ID NO: 4119177 - RNA, 67 nt, Human
guguucaguccugccagaggcucaggccaaaucugauugauaccugggcucugucagaauuggguau

SEQ ID NO: 4119178 - RNA, 75 nt, Human
guguucauuuaauccguauuuauugaucacucgucuuacacaguguacuuaggaauacagagauaaauagaacac

SEQ ID NO: 4119179 - RNA, 58 nt, Human
guuauggcacuugauauuugauuugccccaauggcacauacuccaucaaggccaaaac

SEQ ID NO: 4119180 - RNA, 59 nt, Human
guuauguguguguauacauacaaacacacaugacuuuuguauguacacacacacaaagc

SEQ ID NO: 4119181 - RNA, 128 nt, Human
guuauuaaauauuucuugucuaagcuaagucgacaaaguuucuucuaacaucuggaauuuuuaauaucugagacuguuuuggggaacuucauuguauucuucugccgacaaguaaaaaaaagaauaau

SEQ ID NO: 4119182 - RNA, 65 nt, Human
guuauuacauuucugagcagggagcuguucauuagaaugaacacugaaucagaaauuguuggaac

SEQ ID NO: 4119183 - RNA, 91 nt, Human
guuauugaggauauaaaaagacuauuuggaagaaaucugaaacuaaacagagggcuuauuagucuagaugucuugauauguacccuaaaac

SEQ ID NO: 4119184 - RNA, 63 nt, Human
guuauugcugggccacaaaaaacuccugugcucauaagcacaagcaucagguucagcaauaac

SEQ ID NO: 4119185 - RNA, 74 nt, Human
guuauuuauugcauuuucaauuuguacaucagcuguuggcugugucagucacaaauuuggugagaguaaauaac

SEQ ID NO: 4119186 - RNA, 100 nt, Human
guuauuuccagagaugggcauucacuggcucgcauuauauuuugggaccauuguaauuguuccaaacgggagccaaaugagcaaaacuuugcgaaauaau

SEQ ID NO: 4119187 - RNA, 72 nt, Human
guuauuuguggcauccauguugguaguaacugauuauuugggguuuuaucacaaggauaagccacauauaac

SEQ ID NO: 4119188 - RNA, 95 nt, Human
guuauuuucuuagagaggguacaaaaaauuaucauaguuccugaugacuucugucucacagcucugucaauuuuauauuuguuuuucaagauagc

SEQ ID NO: 4119189 - RNA, 69 nt, Human
guuauuuuggagaaaugggacuuaaucuauaauaguuacuauguauuuggucuacauuuuccaaauaau

SEQ ID NO: 4119190 - RNA, 61 nt, Human
guucaaacugcuugaggccauuuagagccaaagcugcuaguggcugcagggcuguuugaau

SEQ ID NO: 4119191 - RNA, 60 nt, Human
guucaaacuggcagacuucuacuucuuacugagggaagaggagagagccaaguuuuaaac

SEQ ID NO: 4119192 - RNA, 55 nt, Human
guucaaaucucaggacuucagaggccacugaguuccacuaucuggggugcugagc

SEQ ID NO: 4119193 - RNA, 129 nt, Human
guucaacuuucaacucuuaacaugugcugcuugauuugaauuugaaacuuggcacuguguguccuccugugccugguuauuauucuuggaaugcaaaaagguacauguuuuuguaauucucugaggaac

SEQ ID NO: 4119194 - RNA, 85 nt, Human
guucaagacaaaagagcauuugccuuuagauaagaauauauuuauguuuaucaucuagcaccaaacuagcuuuuuuccaguggac

SEQ ID NO: 4119195 - RNA, 126 nt, Human
guucaagaugcauaaaacuuaaugggaaaacuuuuaaagccugaauuucaguacagaaaaaccuuuggaauguucucuacuugagauuuuaaugcugcuuagaaauuucuuuaggacaucuagaac

SEQ ID NO: 4119196 - RNA, 115 nt, Human
guucaagcucauuccauucaucauuaguuuuaaaauagagguuagagaauuuuguuauuuuaauucuaacuaaagucuuuguuuugagaaucugaagaacaggaaauucuugaau

SEQ ID NO: 4119197 - RNA, 68 nt, Human
guucaaggucacugucuaguuugcagaaagcgguucugccucguaugcaaauuaggccgggacucagc

SEQ ID NO: 4119198 - RNA, 65 nt, Human
guucaagucuaguuuugaugcaucaugcccuuugaaugccacaugcaucaugaaaacuagagagc

SEQ ID NO: 4119199 - RNA, 56 nt, Human
guucaaguucauaucucuuaacuguauuacauaguguuaagguuaugaucuuggau

SEQ ID NO: 4119200 - RNA, 76 nt, Human
guucaauacaggucaagugugacuauuuuuucauauuaccuuuauggugugagagagugcauuugcauauuugaac

SEQ ID NO: 4119201 - RNA, 60 nt, Human
guucaauggaucgcugaaguccagggaauguucccaaagggcagcugugguuaauugaac

SEQ ID NO: 4119202 - RNA, 69 nt, Human
guucaauuaccugucaucagaucauuuguuuuaucagacagaaaucauugugaugacagggguuuguuu

SEQ ID NO: 4119203 - RNA, 55 nt, Human
guucaauuucaugcaucucugcacuugaacuuccagccaggagcaggaguugaac

SEQ ID NO: 4119204 - RNA, 59 nt, Human
guucacaggacagccuuccacccgcuucaccagccguggagaaucgcuggccuuugaac

SEQ ID NO: 4119205 - RNA, 61 nt, Human
guucacaucacuucacugaaccacccaagcaaggauccugcugguuuagugacaugagaac

SEQ ID NO: 4119206 - RNA, 64 nt, Human
guucaccaguacccuuuuugcggauguggccguggagccaugagggggguaaucacuggguuac

SEQ ID NO: 4119207 - RNA, 64 nt, Human
guucaccaucucucuaugcacugaggacucacuacggggcuccagggaguggagagaaggaaac

SEQ ID NO: 4119208 - RNA, 85 nt, Human
guucacguggauauagugcuuuauuguuccugaaacacuguugcauaauuuucacugggguaguagagcacuuaagcaugagaac

SEQ ID NO: 4119209 - RNA, 70 nt, Human
guuugcuuucuguauguaccaaauuagucauuuuuuuaaagugugacauagucccauccgguaagcaagc

SEQ ID NO: 4119210 - RNA, 57 nt, Human
guuuggacaagguccucugaaaugcauuaaaaugcuaaucacagcaucugucugaac

SEQ ID NO: 4119211 - RNA, 130 nt, Human
guuuggauggaguaacaugcaagugugagggaaggagugacucaggcaaggcuuuucauagagaaagagucucugccagcuuguccucucucccaucucugcuccuuaccuccccugcucucuccacccc

SEQ ID NO: 4119212 - RNA, 66 nt, Human
guuuggcccuagaggcacuaauacuacugguaacuaccauuuguggacagcuucuaggugccagac

SEQ ID NO: 4119213 - RNA, 63 nt, Human
guuuggcuggcugucaguaggcuguggggcuuuuuccagagcaaauagagaagccagcugggc

SEQ ID NO: 4119214 - RNA, 63 nt, Human
guuugggauguggccaugguucucuccacacaucuggagaugggagcuguggagcucuugggc

SEQ ID NO: 4119215 - RNA, 104 nt, Human
guuugggcuuuucuauuccuuuaauacaacuguugucacuggguugggaggaccucgugugaaagcuggcaguugccuauucugauuugugggaaaacuuaaac

SEQ ID NO: 4119216 - RNA, 78 nt, Human
guuuggggaagaaucaucugaacuuugaggacugcagaguagacccuuaaaguggcagaauuagacgagcucccagac

SEQ ID NO: 4119217 - RNA, 66 nt, Human
guuugguccugcuccccugccuccucugcuacccagagcugcagagccuggagcccugggccguac

SEQ ID NO: 4119218 - RNA, 63 nt, Human
guuugguucagguaguuuuggaguggcagugaguuaguccacuucaucagccagaaaucaagc

SEQ ID NO: 4119219 - RNA, 63 nt, Human
guuugguuugccugaguacccucacuccuccugcguuuaauuggucugggguguagacuaagc

SEQ ID NO: 4119220 - RNA, 64 nt, Human
guuuguacagaguuuaaacacugucacagaggguccuuaguguuaauuuuaaacucuggcuaau

SEQ ID NO: 4119221 - RNA, 70 nt, Human
guuuguagcuuaucaaggcuguuuggggugcaagaaauagaaaaccauucaaacucgcuuaagcacaaac

SEQ ID NO: 4119222 - RNA, 80 nt, Human
guuuguagcuuuaugcugugucaggaauuugauacccccuaucuggggauguuauaugacaugguugaaccugaacagac

SEQ ID NO: 4119223 - RNA, 85 nt, Human
guuuguauaugcugauaaagaagugccauucauuagucgguagcuuguccauuugcuaauguaaagcauuuguucaguugcaaau

SEQ ID NO: 4119224 - RNA, 78 nt, Human
guuuguauguguuaucccauuugagccuucaaacaguccucuuacugcucauuuuucagaugaggaaugcauacuaau

SEQ ID NO: 4119225 - RNA, 83 nt, Human
guuugucucuggcacaaugguguuugccugacucacacucccuuugggagcuccucaugcaaauacuguuccagaagaucugc

SEQ ID NO: 4119226 - RNA, 59 nt, Human
guuugucugcuuuucuuugucugguaugauacuuuccaggcuguggaugcuuaacaaau

SEQ ID NO: 4119227 - RNA, 88 nt, Human
guuugugauuacuggguguauuaguuugcuauaaacuagacuauuuuagauugcuauagcaaaguacuaccaacucgguggcuuaaac

SEQ ID NO: 4119228 - RNA, 91 nt, Human
guuuguggcagaguuggacagcauuccaucugcagguuaguaggaaagccuguaccagccuuuguggaauguccuagucugccacacugac

SEQ ID NO: 4119229 - RNA, 62 nt, Human
guuuguggccuucagauugacuccuggggguuucucccuccuuuacucauaggaccacaagc

SEQ ID NO: 4119230 - RNA, 96 nt, Human
guuugugggaggaggacuggcaaaaauaugagaguaggaguuugggcucuugagcuugggccuggccuucaaauuuccacucuuucacucacuagc

SEQ ID NO: 4119231 - RNA, 67 nt, Human
guuuguuauuccaaaucaugguugcauuuguggacaagcugccuccugagauuugggcauguuagau

SEQ ID NO: 4119232 - RNA, 78 nt, Human
guuuguuuguuuugagauggagucuugcucugcagcccaggcuagagugucguggcuccaucucagcucaccgcaagc

SEQ ID NO: 4119233 - RNA, 74 nt, Human
guuuguuuuaaacaauugguuucagcauguuuguccauugaaaaugggaaugcugagcccauguauagauaaac

SEQ ID NO: 4119234 - RNA, 60 nt, Human
guuuguuuuuaaaguaauaauguauuagucucuagugcauucaauacaguaagaauagau

SEQ ID NO: 4119235 - RNA, 81 nt, Human
guuuuaaaaaauggaucuuugccaggucuggaaauucaguuuccuugaguucuucugagacagcaaagauucuucagagac

SEQ ID NO: 4119236 - RNA, 80 nt, Human
guuuuaaauaaaugaaaucaagguggauuuugggaauauauccugaaguuaacaucuugauguccuucuuguuguaagau

SEQ ID NO: 4119237 - RNA, 129 nt, Human
guuuuaaguugaagcacuccauuucuuuucugggagcagaugaugguauagcuggcgaaggaccugacaguuuccuuccaaacucauguucguucccaaggaacuuuggagauucucagccuaaaccac

SEQ ID NO: 4119238 - RNA, 83 nt, Human
guuuuaaugaugccuccaauauuaugaaagugugacauuugaugaaugucucauauaguuuugauaucugggcacaugucaac

SEQ ID NO: 4119239 - RNA, 61 nt, Human
guuuuacagcacuaggauauacauuucccaucuuuuguggguuuguaaccagugccaggac

SEQ ID NO: 4119240 - RNA, 73 nt, Human
guuuuacuuguuaucccuuacucuugauuugaauugacaggugcagggaagaggagguggccugagccaggac

SEQ ID NO: 4119241 - RNA, 66 nt, Human
guuuuacuuguuuaggaaagaugcuagagaacuacuguaguaucuauuaguaacaagagaugaagc

SEQ ID NO: 4119242 - RNA, 78 nt, Human
guuuuagagcuucaacgaauagcauaacauuucaauagguacugcuauuguaugcugaucaaaagcuucaucugagac

SEQ ID NO: 4119243 - RNA, 58 nt, Human
guuuuagaugcuuaaaauugagguuuuauaccucaacuuuaguguagcuauuuagaau

SEQ ID NO: 4119244 - RNA, 62 nt, Human
guuuuauaguucgggaccuguuccucuagcccaccaagcuucaguuccccuaacugugaaau

SEQ ID NO: 4119245 - RNA, 61 nt, Human
guuuuaucaucauuauaccauguugcuagguggagaguaacugagauaauguauguaaagc

SEQ ID NO: 4119246 - RNA, 80 nt, Human
guuuuaucuauauccuucagguaauuuuggaguugggcauauaagcugcuagaauaccuaccuggaggaggagaugaaau

SEQ ID NO: 4119247 - RNA, 72 nt, Human
guuuuaugaaggccucugguacaugccaggaaacucacaggagauggugcugccucagaugccuuagaagac

SEQ ID NO: 4119248 - RNA, 129 nt, Human
guuuuauuuaacauuucuuauaaauaauuuguguuuuacugagaaauuuccagacuugcagcagacuguauuuugguguaaggaaaugucaaguagcuaauaauacacuguagagauguauuuuggggc

SEQ ID NO: 4119249 - RNA, 56 nt, Human
guuuuauuuuaaaucccaaacgguaauuuucuacagugggaggacugagauaaaac

SEQ ID NO: 4119250 - RNA, 73 nt, Human
guuuucacucuguccucucaagcaauaaacuaaaauaugucuuuuuauugcaauuggcagagugcuaugaaau

SEQ ID NO: 4119251 - RNA, 67 nt, Human
guuuucagguucaauaaauuaucauccaucagucagguggcacucucccauuuaaugaacugaaagc

SEQ ID NO: 4119252 - RNA, 57 nt, Human
guuuucaugucuauugggcauaaaccuaaaaguggcauugcugggucauauggaaac

SEQ ID NO: 4119253 - RNA, 109 nt, Human
uaaagauaauaaagguauaguuaacaaugaucguacacacauuguagauuccauuacaguauuaaauugagcaauaguguuugcagcaaacuaugggcuuuauucuuua

SEQ ID NO: 4119254 - RNA, 73 nt, Human
uaaagauauuuaucaagguaggagaauaggacaugucuuguguaaugguuuguuagcuugauuuauaacuuua

SEQ ID NO: 4119255 - RNA, 130 nt, Human
uaaagauugauucaaggcaguguggcacagugauuacagauaagaagucagauggagcagguuugaaggucagcucugcuguucuuauguguccuguagccuaagaagcugucugguauacgauacauua

SEQ ID NO: 4119256 - RNA, 57 nt, Human
uaaagcaaggcaaauuguuggugucuugacaccaaauauaucuuuugaccuguuuua

SEQ ID NO: 4119257 - RNA, 58 nt, Human
uaaagcagccagggucuaagccagaagcaaucaaaggcugauucuggucuacgcuuua

SEQ ID NO: 4119258 - RNA, 98 nt, Human
uaaagcccauagcagagugaacuuuaccauuuuaagaacuuuucauaugcguuaagaauucacugguagagucaauucuaguuuuugauggaguuuua

SEQ ID NO: 4119259 - RNA, 64 nt, Human
uaaagggaagcugcaaggaagugugccagccuaguuauggguucauuaaugcagguuccaguua

SEQ ID NO: 4119260 - RNA, 68 nt, Human
uaaagggaggaggauuuauuguacugugugauuucacuccacuguauauuaguugucccuucuuuuua

SEQ ID NO: 4119261 - RNA, 81 nt, Human
uaaagguaacaugaugcuauauucaaaacuuuuguuuuacccagaguaaagcaaguguaagaaugcagaaucaugucuuua

SEQ ID NO: 4119262 - RNA, 60 nt, Human
uaaagguuaguagcagggaaacuguuuccacggucuugaaaucucugcuucugaauuuug

SEQ ID NO: 4119263 - RNA, 62 nt, Human
uaaagguugaaaacugacugccugauggcuggaucuggcucucagauuuguuuuaaucuuua

SEQ ID NO: 4119264 - RNA, 83 nt, Human
uaaagucauagaaucauagcacauuugaacuagaaagcuuuaguuagucaguuuuuagauguguaaaugguacuauguuuuua

SEQ ID NO: 4119265 - RNA, 62 nt, Human
uaaagugcgacccaguccccagaccuacccuagcgaacccuggggucacugcaucuauuuua

SEQ ID NO: 4119266 - RNA, 57 nt, Human
uaaagugcuggauuugaguaaaagacagagaaucaugucuguaauccuagcacuuug

SEQ ID NO: 4119267 - RNA, 74 nt, Human
uaaagugugcgauuuaguggcccuugguacacacacaauggugugcaaccaucaccacugacuccagaacuuua

SEQ ID NO: 4119268 - RNA, 60 nt, Human
uaaaguguuagagucuagcuucccuucucuugaagcaaggcuaguuugugacuuucuuug

SEQ ID NO: 4119269 - RNA, 76 nt, Human
uaaaguuagcagacuaugucauagucaagagacuuugcuuuaugaacuagcugauuuaguuugcucacaagcuuug

SEQ ID NO: 4119270 - RNA, 66 nt, Human
uaaaguugcuguccuagcuggcuuguacccaguuacuguaaccuagccagagaggacaguauuuug

SEQ ID NO: 4119271 - RNA, 126 nt, Human
uaaaguuuauuguuuuuggaaauaguuuuuuggcaaauauuuuguuuuguaaguuuuacauuucuaaaguugaauaaaauuaaauguuuagcaggugcuuguuguaauagaagcuauaauauuuua

SEQ ID NO: 4119272 - RNA, 95 nt, Human
uaaauaagcaaagaagaaauuaaugugccauuacugaugcugugcuuaauuucaaaucauagucuggucaucugauucuuuuaugccaauauuua

SEQ ID NO: 4119273 - RNA, 55 nt, Human
guuuguugauaugccccuuugugcuccguauucacaaaggggcaccucaacaagc

SEQ ID NO: 4119274 - RNA, 55 nt, Human
guuuguugugguagcuuuugcacuacaacagugaaguugaguaguuacaacagac

SEQ ID NO: 4119275 - RNA, 59 nt, Human
guuuguuuguagggaagccguggggauaauugcuaugaguguggucucuacagccagac

SEQ ID NO: 4119276 - RNA, 102 nt, Human
guuuguuuguuuguuuuuuguuguuuugagauggagucuugcucuguuauucaggguacagugcagugcgccaucucagcucaucaacagcacacaggaagc

SEQ ID NO: 4119277 - RNA, 55 nt, Human
guuuguuuuaagauaggauggagccuuauagcucuccccacauuucuaaacagac

SEQ ID NO: 4119278 - RNA, 90 nt, Human
guuuguuuuuugcugaucuaucuaggacuuauucacgcagcuauacuuaagcagcaggucagcuggugacugaguucagcugggacagau

SEQ ID NO: 4119279 - RNA, 112 nt, Human
guuuuaauauuaucucauugccugcaagguccaguauaacuuaagagagaggaaauuaaucuuugagguuaaguuuacuuaccauuugaugucaguguugugcuauaagaac

SEQ ID NO: 4119280 - RNA, 87 nt, Human
guuuuagaaaugcaugugggaaauacaagcuaaaaugcuauuggcauuuuuuucugauuuuccccagucauauguauuuauuagaau

SEQ ID NO: 4119281 - RNA, 68 nt, Human
guuuuagacuuguauguaaagccaggaaagaucuuccuauuguaagggcuuacauauagucauaaaac

SEQ ID NO: 4119282 - RNA, 67 nt, Human
guuuuagaguagagccauuucuguuuuagagcugcagaggcaaaaucaaauggcuuuccuuuaggau

SEQ ID NO: 4119283 - RNA, 130 nt, Human
guuuuaguaaauaauacuuaucguuuaucaagugcuuacuaagggcuaggcacagggcugaguguuucauggauauuuuaaucuccaguccuugcuaugacccugagugaaguguguuauuaucuccaau

SEQ ID NO: 4119284 - RNA, 96 nt, Human
guuuuauaaggaagagaugacccagcagguguagggcucauggcaagugcugucagaauggugggcuccugccuguccccucaugucccuguaagc

SEQ ID NO: 4119285 - RNA, 66 nt, Human
guuuuaucagaaugcagccaugugcaucuguuuaaguguugucuauggcugccuucugaguacaac

SEQ ID NO: 4119286 - RNA, 70 nt, Human
guuuuaucauugaaugcucugcagguuguccuugaauagaagguguaaguugcauuauucaugaaaagac

SEQ ID NO: 4119287 - RNA, 79 nt, Human
guuuuaugaggagucaaggcugugacauggagcccuuccaaggcgucuuucacacguccuugcuacuccucuaauaagc

SEQ ID NO: 4119288 - RNA, 65 nt, Human
guuuuauuuccaugagagaccgagaagcuucgagagcuggacauuuuuucagggaaagauaaaau

SEQ ID NO: 4119289 - RNA, 67 nt, Human
guuuucaaaaaucauucuuguagaaauugauuucucauuggcugauuucuacaggaugaaugaaaac

SEQ ID NO: 4119290 - RNA, 93 nt, Human
guuuucaauauaauugaugugauuguuaguuuauauaauguaguuuuuaauaauggcuguauuuaacaacuggcucacaaaauucuugaaaau

SEQ ID NO: 4119291 - RNA, 57 nt, Human
guuuucaauuauaagauggcuuuacuaauauuuugaggcuaucacugaaaugaaaac

SEQ ID NO: 4119292 - RNA, 66 nt, Human
guuuucacuggggcuggucacaugucugcauagcacaucucaaauuccaggcuccagaaggaaagc

SEQ ID NO: 4119293 - RNA, 81 nt, Human
guuuucagacaaaggcugccuaaaagcuggggcccacauuguggcucuguggcauucaugggcaguauuguuuuugaaggc

SEQ ID NO: 4119294 - RNA, 76 nt, Human
guuuucagcacaguaucuuuugaguaagcaugcaagguuuuacuguauuggaugcuuuuaagaauaugugaaaagc

SEQ ID NO: 4119295 - RNA, 73 nt, Human
guuuucaucuuuucauggucugcguugacacgacaaauaguggcucucaggcagaauuaucaaaagauguaac

SEQ ID NO: 4119296 - RNA, 123 nt, Human
guuuuccaaagaauguuuucuauuguucuguuauuuguuuucugagaaguaucaaguuuguuuauuuguaauacauauccacaggagauaaaaagcaagcaugaguacugaauuuuugaaaac

SEQ ID NO: 4119297 - RNA, 62 nt, Human
guuuuccagguaccuugguauucaaaaaagccuuagaauagcagauuuugguuuuggaggac

SEQ ID NO: 4119298 - RNA, 59 nt, Human
guuuuccaggugcauagaaaacaggcuuuuucauguaggucugcugagcccugggaagc

SEQ ID NO: 4119299 - RNA, 72 nt, Human
guuuuccugacacuggagucuaucuguaacauaaacugugggauacagguagagucucuaguuuauagaaac

SEQ ID NO: 4119300 - RNA, 91 nt, Human
guuuuccuguucugugaccucagguuuguaauggacacaaagaguuguguuggcguuuagugccuggggcagugccaccaacauggagagc

SEQ ID NO: 4119301 - RNA, 75 nt, Human
guuuuccuuuauggccucuagcugagaccaauggcccugaaguaauuggcuucuaaagagggcaaaaaggauaau

SEQ ID NO: 4119302 - RNA, 78 nt, Human
guuuucuaacacugugaaaaggcuucuugauuggaaaaaaguuaugaaucagugauguaacaaacagaguuagaagac

SEQ ID NO: 4119303 - RNA, 63 nt, Human
guuuucucugagaagaguucaaguaaagauaacuuucuuugucucauucuuguccagugaaac

SEQ ID NO: 4119304 - RNA, 65 nt, Human
guuuucugugguggguaguucagagguguauagggcagguuugagaaugucaaucacaagagaac

SEQ ID NO: 4119305 - RNA, 60 nt, Human
guuuucuguuauucaguauuugacauaugcucagguguggagggcagaauaacagacuac

SEQ ID NO: 4119306 - RNA, 76 nt, Human
guuuucuuuuguaaggaauauucuuggugaaguaaagacacuuaauagucaccaacggcuccuucucaaugagagc

SEQ ID NO: 4119307 - RNA, 74 nt, Human
guuuugaaacuuuuccugcucuuguccuugaggacaaaaacugggaggaaagagguggagaggugauauaaaac

SEQ ID NO: 4119308 - RNA, 69 nt, Human
guuuugaaguauguauacauuguggaauggcuaauuugagccaauuaacauaugcaugaccucacauac

SEQ ID NO: 4119309 - RNA, 94 nt, Human
guuuugagauccucaaauacaggauucuguaaucugugaaauuuaaaaauugauuuuuuuaagauugcaggauuauaucaaggggauucaaggc

SEQ ID NO: 4119310 - RNA, 65 nt, Human
guuuugaugcuuuuuuguuccuaaauaaaugagauagaguugaagagaagcaaaaguaucaaagc

SEQ ID NO: 4119311 - RNA, 67 nt, Human
guuuugauggaguguguuaaauauaaaaguaauccaaugcaauacuauuuagcacauuguacaaaac

SEQ ID NO: 4119312 - RNA, 84 nt, Human
guuuugcccugaaagggguuuuauuuguuacaugcaagcuaaauuguuguaacaaagacacuccaaaauauagggucuuaagac

SEQ ID NO: 4119313 - RNA, 73 nt, Human
guuuuggaucucaggcagucaugacuccagaucccaaagcccucuggagucugauacugaguuccucaugaac

SEQ ID NO: 4119314 - RNA, 68 nt, Human
guuuuggcucagugaagagauaacuugauccaaguuuugaacaagauggaauuaucacgagcaggagc

SEQ ID NO: 4119315 - RNA, 59 nt, Human
guuuugggcugagaugugggccgagccucaguggggcucccagcagcauagcucagaau

SEQ ID NO: 4119316 - RNA, 84 nt, Human
guuuuggggcugaguuuugaggucccucaacaugucauagcugaguugaagaggaugagagggcccagagcacaccaaaagagc

SEQ ID NO: 4119317 - RNA, 66 nt, Human
guuuuggggucuggccaucaguggggagggcuuuccccccaccaccaaggcucaguuuucuaaagc

SEQ ID NO: 4119318 - RNA, 84 nt, Human
guuuugguauguaauuggcauagcauacaauucacccauuuaaaggaggugagucaaugucauucaguauguucauaucaccac

SEQ ID NO: 4119319 - RNA, 64 nt, Human
guuuugguuggugcaaacauuuagccuccaugacacauguuuccaaaagcacccuggccagaac

SEQ ID NO: 4119320 - RNA, 81 nt, Human
guuuuguacagguagguuauuucagggauaauaauaguuaaaauuuauaaagugcuuaugauaaccaagcacuguacuaac

SEQ ID NO: 4119321 - RNA, 69 nt, Human
guuuuguagcugucagaaauagcuggaccauucaaguguaugugaaaccagcucuguaagcugugaaau

SEQ ID NO: 4119322 - RNA, 64 nt, Human
guuuuguggguuuuacccugaauaggccagggcaauggccaguggagacugaaacccauuccac

SEQ ID NO: 4119323 - RNA, 57 nt, Human
guuuuguucacugccguauggccaguaccuaggacgcugccuggcaguguacaaggc

SEQ ID NO: 4119324 - RNA, 58 nt, Human
guuuuguugcugcagagcucaaaaugaaaaccaaggccaggagcuucaguugcaaaac

SEQ ID NO: 4119325 - RNA, 67 nt, Human
guuuuguuuguguguguguguguguguguguguaugagcagcuguuuacauugacuacaaauaaagc

SEQ ID NO: 4119326 - RNA, 73 nt, Human
guuuuuaaaagagaagaaaauaagagagugaaaaugacaucuuagauuuucuuguauucacucauuugggaac

SEQ ID NO: 4119327 - RNA, 91 nt, Human
gugaggacagacauugucucagggcagcagcaggggagagccagaacuaaaugacagcaguucccucuccugccgcucucagacuucucau

SEQ ID NO: 4119328 - RNA, 64 nt, Human
gugaggacuaguggguuugugcacagccuggagucugcacaauagcuucccaguacuuucucac

SEQ ID NO: 4119329 - RNA, 67 nt, Human
gugaggagagaacauuccuccauauugucuaaccuuuuuugauuuuaggagauaguuuuuaccuggc

SEQ ID NO: 4119330 - RNA, 97 nt, Human
gugaggagaggcugaguggcaguucuaauugaccauuucuacccauguuccucuuagaaacauacaauaagagcugucacagcuuccugccaaucac

SEQ ID NO: 4119331 - RNA, 60 nt, Human
gugaggagggcuggucccaggcccugccaccuggggacccuggugucccaacccucccau

SEQ ID NO: 4119332 - RNA, 61 nt, Human
gugaggcagcaugggcccagagucccagcggccuggguucgaagcccagugcugcacccac

SEQ ID NO: 4119333 - RNA, 81 nt, Human
gugaggcaggggcagaagcgggugccagaagggacugggccgcccuccccagggucccugcuuccaugcuuccugccucau

SEQ ID NO: 4119334 - RNA, 70 nt, Human
gugaggcauccaggaaacaucuccgccuaaggacaaacaccugcuggagaagcuccugggacugguucac

SEQ ID NO: 4119335 - RNA, 74 nt, Human
gugaggccuggacugacauguucuuacauccagagauucaggaaugaucuggagaauaaauguccaagucuuau

SEQ ID NO: 4119336 - RNA, 68 nt, Human
gugaggcuggcgggugggugaaagacgugggguggagcuccugaucugguacaggccugcagccucac

SEQ ID NO: 4119337 - RNA, 77 nt, Human
gugagggacuggucucuucuuccaagauggcaccuuguugcugaaucuuccagaagggacaaauguuguguccucac

SEQ ID NO: 4119338 - RNA, 129 nt, Human
uaaauaauugauacgagaagauaauaguacuugacauaaagcagaggaguccugaccaccagagaauucugugucugccauuuucugccugcguguuuaggaauuagguguuuuguggacauaaguuua

SEQ ID NO: 4119339 - RNA, 83 nt, Human
uaaauagcuuauuuuuaacaugaggcaagucucaaucuuugaagguuucaaaguauaauugcuuuuuuggaaaaggcuauuug

SEQ ID NO: 4119340 - RNA, 75 nt, Human
uaaauauccuugagauuuucagcuugacugggagaagaauuuuuuccaccagcugaaaaucaguaagcccauuua

SEQ ID NO: 4119341 - RNA, 72 nt, Human
uaaauauguauguauauaguauguguguauauauguuguauauauguguacgugcaguauauauauuuuuua

SEQ ID NO: 4119342 - RNA, 80 nt, Human
uaaauauucagauucugaggaccuacugaagaguuauuaugucagaauaaucuugagcaaggccucagaaucuauguuua

SEQ ID NO: 4119343 - RNA, 88 nt, Human
uaaaucaacacuaacaggaaauggcugaauaaauucuaauagaucaaaacaguggaauuuaaugcagucauuuuaaaauguggguuua

SEQ ID NO: 4119344 - RNA, 76 nt, Human
uaaaucaggcaguucuacuuggaugucugcaagauuugggauuuugccagauagaugaaguggagcaggagguuua

SEQ ID NO: 4119345 - RNA, 93 nt, Human
uaaaucccccuuucuuguucucuugggaggaaagagagaaggaaaaaaagucuuuccucaauuuuuuccaagacaauuuuugggggugguuug

SEQ ID NO: 4119346 - RNA, 61 nt, Human
uaaauccuuuggcaaugugguugucuauucuuuguuuucaaagacauugaagaaggacuua

SEQ ID NO: 4119347 - RNA, 56 nt, Human
uaaaucugauguuaaauguaagguucucauugguugaaccuuuuuacucagguuua

SEQ ID NO: 4119348 - RNA, 103 nt, Human
uaaaugcacuuuaucaucuguuccccucuacucugugagcuagguucuauuauugugcccauuuuauagaagaggaaacugagguugaauaaugugcuauuua

SEQ ID NO: 4119349 - RNA, 56 nt, Human
uaaaugcaguuaguacuugccacuacacccuuuuggcaaguguuauugugcauuua

SEQ ID NO: 4119350 - RNA, 71 nt, Human
uaaaugcaucucaguggauagagauuuaaaaaugauugaaagaucauucugaucauucaagaugucaauug

SEQ ID NO: 4119351 - RNA, 70 nt, Human
uaaaugccuguagaacacuuagaucaguaccuaacaugauuagccuugguaagucuuucauaggcaauug

SEQ ID NO: 4119352 - RNA, 79 nt, Human
uaaauggagaagaacauguuuuuaucugugcuaggaucauguuauuucuuuguuuuagaaacauguucuguucuguuug

SEQ ID NO: 4119353 - RNA, 67 nt, Human
uaaauggauggaauaaugaccacagaaacacucugacagugcugaggaauaauuguuccugcauuua

SEQ ID NO: 4119354 - RNA, 80 nt, Human
uaaaugugggaaaauacauaaagguuguaccaguuaaacacuagggcugcuacucuuguauguguauuuccaaauauuua

SEQ ID NO: 4119355 - RNA, 76 nt, Human
uaaauguguaaaacugaauacauacugagggcaacaagcuguaggaguguauuucaguuaaaaagccauacguuua

SEQ ID NO: 4119356 - RNA, 95 nt, Human
uaaauguuauuagguuggugcaaauguaauugugguuuuugccauugaaaguaauggcccaaacugcaauuacuuguguaccaccccaauauuua

SEQ ID NO: 4119357 - RNA, 76 nt, Human
uaaauuaugcuuugguagagaguuguggaacuuagugccauaaaaugcauaacuuuuuuaccaagagcaaaauuua

SEQ ID NO: 4119358 - RNA, 117 nt, Human
uaaauucaaauugauuagcccauuuaccaaucuuccaguguagacaucugccuuguauccccagugauuaauacacggccugccuggaggguaagcaauaaauauuuguugaauuua

SEQ ID NO: 4119359 - RNA, 85 nt, Human
uaaauucucugcuucuccuuggagggcucaguuguucuuuggcauuccagaaaucaaugaagucugcuaagguauugggaguuua

SEQ ID NO: 4119360 - RNA, 71 nt, Human
uaaauucugauuauuaaacugaggcuuuaauugauguuaaugccuuaugucaaauguaaaguuagaauuug

SEQ ID NO: 4119361 - RNA, 66 nt, Human
uaaauugcugggucccacccccagaguuacugauucagcaggucugaggugggacccaggaauuug

SEQ ID NO: 4119362 - RNA, 117 nt, Human
uaaauuugcauuucagauaaacaaugaauaaugauuuaguauaagugugugccaugcaaaauucaggacauacuuagaguaaacaaguauuuguuguucaucugaaauuuaaacuug

SEQ ID NO: 4119363 - RNA, 75 nt, Human
uaaauuuuuacucuuaguuauuuucacuacauggguaaacauguuuucagugacagcugggaaggugaaaauuua

SEQ ID NO: 4119364 - RNA, 60 nt, Human
uaacaaagguugccaaacuaaguagcuuuuuuguuguugcuugguucuggccuauuguua

SEQ ID NO: 4119365 - RNA, 58 nt, Human
uaacaacaugcaauuuaaccuugaguguuauaauaucaagguggauuaacuguuguua

SEQ ID NO: 4119366 - RNA, 63 nt, Human
uaacaaggagauggugggucauagacuucuccugagucuuaauucaucugccaucucauguug

SEQ ID NO: 4119367 - RNA, 63 nt, Human
uaacaaguucugacagcauuguuaacugauuaaaaauaccuaauaaggcugcuggauuuguua

SEQ ID NO: 4119368 - RNA, 81 nt, Human
uaacaaugauacuccuugcagcucucugaagguugcagcugcaggcugagccuggcggaagcagcguggaauaucaaguug

SEQ ID NO: 4119369 - RNA, 62 nt, Human
uaacaaugguuuugcugauaaugugcuuucuguggaguuauuuuugaucaaaacuauuguua

SEQ ID NO: 4119370 - RNA, 66 nt, Human
uaacaauucucucuucauguaggaaaaaagugagugugauaaacuauuccucaggagaggauguua

SEQ ID NO: 4119371 - RNA, 70 nt, Human
uaacacuaaccauguucccaacagcuuagggcugucagcuuagggcugucaggaacaugccuugguuuua

SEQ ID NO: 4119372 - RNA, 130 nt, Human
uaacacugagcuaagccugaugagagaugaauaaaauuuuauuuuagauagaccaauauagucauuuuaaaacuaaugacagguugaaguaucaaagguggauuuuaucagauaucuucacuacagauua

SEQ ID NO: 4119373 - RNA, 63 nt, Human
uaacagcuggcguuauaggaaucagacagacuugccuuugaaucccugcugcaccacuuguua

SEQ ID NO: 4119374 - RNA, 84 nt, Human
uaacaucuugcuuuagugugguguauuuguuauaguugauaaaccauuacuguuacaauauuaucaacugaggucuuuauguua

SEQ ID NO: 4119375 - RNA, 86 nt, Human
uaacaugauccuacaugaauguuucaauauuguaauccuguaaguuacuuuuacauugacaguucugaaauucauguugaguguua

SEQ ID NO: 4119376 - RNA, 59 nt, Human
uaaccaggaaaaagauaugcaugugcuguaagucccuaggugcaagcuuuuucuuguua

SEQ ID NO: 4119377 - RNA, 78 nt, Human
uaacccagaauaauugcaugaccuuuagcgcccugcauuuauguaggugggggcaaggggcagcaaguuuugguguua

SEQ ID NO: 4119378 - RNA, 89 nt, Human
uaacccagggaccaaguccauacauugagaauaacagagaggaaagauaaaagaaaccuguguucucauugaugugaguuacugaguua

SEQ ID NO: 4119379 - RNA, 86 nt, Human
uaaccuaauugauguauauaggacugaucacauuuucagauuuuacuugagucacugagauuauuuuuguuguuguuuuuggguua

SEQ ID NO: 4119380 - RNA, 70 nt, Human
uaaccucugagcuccagcuucuaacucaagcccugucugggcauggaccaaaggcucgggcccagaguug

SEQ ID NO: 4119381 - RNA, 81 nt, Human
uaaccuguuccugccuucccugcccacugcauaaaggaagauggcaguucauugcagccaggaagcccaggacacaaguua

SEQ ID NO: 4119382 - RNA, 86 nt, Human
uaaccuguuucucauucucagcuauuccaauugucgauaauucucacaguaacaaauggccugaggacaaagaugaaaucugguug

SEQ ID NO: 4119383 - RNA, 116 nt, Human
uaaccuuuguuuuauuucuaggacccaaacaguuccugugguacuucucuuucuuccuucucacuagugacaguuguaguaucucauaggaccguuuuuccaaaagacaaauguua

SEQ ID NO: 4119384 - RNA, 83 nt, Human
uaacgucaccaaaugcuccacugacuuuggaacuugcaagagcagugucccugccgaggcaguuggugucauggggugaguug

SEQ ID NO: 4119385 - RNA, 122 nt, Human
uaacuaauuuaagccucauaacagcauuaugagaaaauuacuauaauugucaucauuuuauagaccaagaaaugaaagggcagaagguugaaguaauuugcucaaggucacacaguuaguua

SEQ ID NO: 4119386 - RNA, 63 nt, Human
uaacuauuguucuggugacuuuagucuacaaauugaggccaaaguuugaagcaacaguaguug

SEQ ID NO: 4119387 - RNA, 61 nt, Human
uaacucuagcaagaaucccagggcuaagauuccuugacucugauugccuuagcuuggguua

SEQ ID NO: 4119388 - RNA, 80 nt, Human
uaacugagugccagagaauuugagacuugcccaaggucauaauaaauuugugggagagcuggaauucacuuauucaguug

SEQ ID NO: 4119389 - RNA, 80 nt, Human
uaacugaugcacagugaccccuggugacucacuuugaaaaaaaaucagcauguuagucauggaucauggugcacauguua

SEQ ID NO: 4119390 - RNA, 95 nt, Human
uaacugauuggugcguccuuugaauugaggucuuugagcuauauccacauuuccuuagggaaaauuccuucagauugguacguucuaauuaguua

SEQ ID NO: 4119391 - RNA, 75 nt, Human
uaacugccgacugaucugccuguauguagcuugccccauccaaucuauucucuacaguagacagcaaggucuuua

SEQ ID NO: 4119392 - RNA, 78 nt, Human
uaacugggaagggacgccagugccucucuaugagguccagacagccuggccaggcaugccauugugucccccagcuug

SEQ ID NO: 4119393 - RNA, 62 nt, Human
uaacugugugaacgugaucauuugugugcaaaccaacaaaccagacagguuuacauauguua

SEQ ID NO: 4119394 - RNA, 73 nt, Human
uaacuuaccugaauguuucccuuuccugauuacaugccagguaauacugaaagggaaauguccagaaagguug

SEQ ID NO: 4119395 - RNA, 82 nt, Human
uaacuuacuggcucagugcaucauuccaggcucugauuaucaaagcuguggaucuugauuguguccucagugauaacaguua

SEQ ID NO: 4119396 - RNA, 99 nt, Human
uaacuuagcagacuguaccaagacaguggcauucaugaugaaucuuuauuucuaggauaucaacauuaauauuuucuggucaaaagaucuguuguauua

SEQ ID NO: 4119397 - RNA, 67 nt, Human
uaacuuagccuaagauauuuucauuaaagguuucccuuuuaaggaaaaaauguacuuagccugguua

SEQ ID NO: 4119398 - RNA, 58 nt, Human
uaacuucaagucuguggaucaguaguuaacaauaaaauuccuucagacuuuggaguug

SEQ ID NO: 4119399 - RNA, 102 nt, Human
uaaauuauaugagagaugauuaaaccucagagucuuuuucauuuugcaaacagguguuuaugaagcaguuacuggguguuaaucauuauuccacaugaauua

SEQ ID NO: 4119400 - RNA, 59 nt, Human
guucacugcuuucuuaguacucucuaaugcuacagucugugauacaggagagcaggaac

SEQ ID NO: 4119401 - RNA, 72 nt, Human
guucacuuagcuguuggcuguacguccuuaaaaaugacagaaaggugaccacagcuacaagggcaaggaagc

SEQ ID NO: 4119402 - RNA, 80 nt, Human
guucagaacagcuucuugggagcugggugucguggcacaugccuguagucccagcugcucaggaggcugaucgcuugagc

SEQ ID NO: 4119403 - RNA, 96 nt, Human
guucagaaucugaaucggcucauaucucucuuauacgucaacuuccacuuuucugcaaguugguguaugagacagaagccuacucagaaucugaau

SEQ ID NO: 4119404 - RNA, 77 nt, Human
guucagauuucuauuagaaagcaucuucuauaauauaucaacuuguuuaggggaaauuuuucucaaugggauugaau

SEQ ID NO: 4119405 - RNA, 65 nt, Human
guucagcaguugggacuugagcuugugucugccgacucccuagcccccagucuaaacuguuggac

SEQ ID NO: 4119406 - RNA, 86 nt, Human
guucagcuccuuuccucuuauauaacauccccacuggcaacuucagauaccaguggggaugucauauaagaggaaaggagcugagc

SEQ ID NO: 4119407 - RNA, 83 nt, Human
guucagcuuaagacuuuuugcauuuuugauuguugaaacauuguauuagucaugaaauguaugagucuggguucuuugugagc

SEQ ID NO: 4119408 - RNA, 67 nt, Human
guucaggacaauugagaguuuguugacauucuuucaagauuuguuauaaacuauuaauuuccuaggc

SEQ ID NO: 4119409 - RNA, 86 nt, Human
guucaggagccagguggcuugguaguggcaggaagcacagaugcaucuugcagaagaagcugccaagcccugacucuccugccagc

SEQ ID NO: 4119410 - RNA, 84 nt, Human
guucaggugaggccugggccgcaggagagggccaagugaauggacagcccuccagccauggacccaggugcagcucaccuggcc

SEQ ID NO: 4119411 - RNA, 103 nt, Human
guucaguaacauuuauacauucccagcauuaaugccugucagggcugaaauuccacuuaccaaaccauaggcuaaaugugggaagaaaauguuucuaaagaac

SEQ ID NO: 4119412 - RNA, 70 nt, Human
guucaguagaggugacuaugucaauuguuuaaaagguagguagauacauguguuggcucagaugcugaac

SEQ ID NO: 4119413 - RNA, 126 nt, Human
guucagucuuaaugaaguucuuaguucccagagugcgcuguauuaaaaguccagauugcuaaucacuuuaccaaaguacaggaguaucuuuaccugagggaaguaauaacgagcuugaaccugaac

SEQ ID NO: 4119414 - RNA, 58 nt, Human
guucaguguuuacaugauuguuaugcuauuuagagcuaggucauguaguucacuaggc

SEQ ID NO: 4119415 - RNA, 67 nt, Human
guucaguucagcuucaagcuaugaggaacauuguuagugauugucauagaagagguugcaguugaau

SEQ ID NO: 4119416 - RNA, 96 nt, Human
guucaguugcuuagcuugauauuuaaguaacuuggaacuauugugucuauagaucaauauggcuuguuacuauguuuauagagcuugcgauuuaac

SEQ ID NO: 4119417 - RNA, 68 nt, Human
guucaguugggcucauuacagccugcugggcccagaaaguuccagggguuggauuuggccuagagagc

SEQ ID NO: 4119418 - RNA, 56 nt, Human
guucaguuugcuacaagcaacaucuucagaaguggcagaauaguggcaggaugagc

SEQ ID NO: 4119419 - RNA, 68 nt, Human
guucaugccuguauuucugaucuauaccuauuuaccugguacgaucugauauuaugucagauaugagc

SEQ ID NO: 4119420 - RNA, 56 nt, Human
guucaugcuacccuuuccuaauuuguggaggcuaaacagaaggaauguggcggaac

SEQ ID NO: 4119421 - RNA, 66 nt, Human
guucaugguuucagccacauaaaaggcuccagacccauuuaugugucucaguugugauugaugaau

SEQ ID NO: 4119422 - RNA, 58 nt, Human
guucaugugucuaagugucagaagaaggauuugaaucuaggcacucugacugcagagc

SEQ ID NO: 4119423 - RNA, 57 nt, Human
guucauucugaaaagcagcuugcugacaggggugugugcuagcugcaauagaggaac

SEQ ID NO: 4119424 - RNA, 109 nt, Human
guucauugucuuuucaauucuaucacuuucccacuuaauguauuuauuucuuucacacauaauaagccuuaguaugaggaaaggagacuggcaggagagacaacugagc

SEQ ID NO: 4119425 - RNA, 62 nt, Human
guuccaagcagacaguaggccuagaaaugacuuccauuucuccccauacuuucuuuugaugc

SEQ ID NO: 4119426 - RNA, 81 nt, Human
guuccaauggggacugggacaccauggaccuacucccagaccgagaccugcacuguucaugcuuguuccuccaccuggaau

SEQ ID NO: 4119427 - RNA, 72 nt, Human
guuccacaggccagcguccagaacaagcucaucccccagaugugucuugcuggaccuggcugggugcagaac

SEQ ID NO: 4119428 - RNA, 62 nt, Human
guuccacccugccgugggcugcuuguggcacugcugccaccucgcagacaggcaggggaggc

SEQ ID NO: 4119429 - RNA, 56 nt, Human
guuccagagacagaaaauggaucuagaucucuccagauuuccuuuugucucuuaac

SEQ ID NO: 4119430 - RNA, 71 nt, Human
guuccagcuuauagguagauuuaaaauuugucugguuggcaauugguugaguuuaucuaaagaccugggau

SEQ ID NO: 4119431 - RNA, 55 nt, Human
guuccaggcaguggcaacagcuggugcaagcucugagguggccgcggccuggcac

SEQ ID NO: 4119432 - RNA, 107 nt, Human
guuccaggggguggcacaggagccaaaaacgagaccugaggcugaagcccaacagaagaugaaacuugggagcagccucagcuucgggaauccucacuuccuggcac

SEQ ID NO: 4119433 - RNA, 56 nt, Human
guuccaguggaauaacuuggggucacgauuuggccaguggugagauucccugggac

SEQ ID NO: 4119434 - RNA, 55 nt, Human
guucccaauuagugcuauuuacagacauguaacaccauggcugcugauuggggau

SEQ ID NO: 4119435 - RNA, 66 nt, Human
guucccaguugcugccaguuuuccuaucagugggcaccaccaggaaaaauaaggcagcagggcagc

SEQ ID NO: 4119436 - RNA, 67 nt, Human
guuccccugcuucuccugcgcaggcccagggaagacccccuuccugccugagcguggaggagggagc

SEQ ID NO: 4119437 - RNA, 74 nt, Human
guuccccuggcucugcucuugacuuaccaggcaauggaccuuccuguucaaguugcagggcugggcugaggaau

SEQ ID NO: 4119438 - RNA, 67 nt, Human
guuccccuucacacuuuauuuauuucaugcucccaaggcgggaagacaauggaggugccuagggaac

SEQ ID NO: 4119439 - RNA, 63 nt, Human
guuccccuuguguuguugcccauguguugcuaccaugguaauccugcucaguacgagaggaac

SEQ ID NO: 4119440 - RNA, 77 nt, Human
guuccuaauaucuaaugcagcagcaucuagauccugcaacuuggaccuggcaugaagcaugccuuagcacuaggcac

SEQ ID NO: 4119441 - RNA, 73 nt, Human
guuccuaguggauaauaaaacagaugcugaggguaaauguccuccagcauucaaguaauucacuuggauaugc

SEQ ID NO: 4119442 - RNA, 72 nt, Human
guuccucuggguuuuguuuguacaguguaauuugagggugauuaaaguuaaaaagaugaaucuaagagggac

SEQ ID NO: 4119443 - RNA, 79 nt, Human
guuccugcugggcaaaaccaggcguuuccuauuauucuugaauacagcaugaaggauggcuggcugcccugccaggaac

SEQ ID NO: 4119444 - RNA, 99 nt, Human
guuccugugcuggggcaggggguuauaggguuugaauuuccugcuagagcuaaggaggaagggcccaggcuuuauuaucucucuuuccagauguggggc

SEQ ID NO: 4119445 - RNA, 75 nt, Human
guuccuucaagaugccaucuuuauuucugaaucccccaugcccugugugaugacauucagagaugaaggaggaac

SEQ ID NO: 4119446 - RNA, 77 nt, Human
guucgaaagguaaaguaucugcccaaguucagcuaucaaauuaguuguaucuuuuacuggaauuuuaucuuuaaagc

SEQ ID NO: 4119447 - RNA, 90 nt, Human
guucgaggacucugugggugguagccaugggcaaaugcagagcugcugcuguugcuuugcagugccuauaggacuuagagggccuggagc

SEQ ID NO: 4119448 - RNA, 68 nt, Human
guucggcugcugcgggcuugacagcucccgccacuggggcuggagggggaggcugcggacugcuggac

SEQ ID NO: 4119449 - RNA, 80 nt, Human
guucgucauucuuuuguggcaaugguuaagagcuccuagaggcacgcggaugcuuauuuacugauccacagaugacggau

SEQ ID NO: 4119450 - RNA, 90 nt, Human
guucuaaagcuuuaaaauuuccccaccauguauauaaaggauugaagugucacaguacugaguuggggaguuuggaagacacuuugggau

SEQ ID NO: 4119451 - RNA, 106 nt, Human
guucuaagugcuauuuagaguuauaaugcuuuuccugugguguaugcagcauucccagcugcuggugcuaagaugagguagguaagacuuaugguggacuuuaugc

SEQ ID NO: 4119452 - RNA, 74 nt, Human
guucuacaggcucagggagcccucucuccuucagaccuccacugucuguaaauagauucucucugacuuggaac

SEQ ID NO: 4119453 - RNA, 67 nt, Human
guucuacccaaggagcuguuggaauuuuaaaucauuuuaggaaauugacaccugcuugauuaguaac

SEQ ID NO: 4119454 - RNA, 105 nt, Human
guucuaguauggccagcucaguuuuaucugugacaucuggcagggucaguuuucuaguccugaguuuccagauaagaccuuuuccugagcuucucaaacuuuaac

SEQ ID NO: 4119455 - RNA, 77 nt, Human
guucuauaacauauauaguaaugucauagcagaucuccacagggaugcugaagaguucaugauuaugaguguugagc

SEQ ID NO: 4119456 - RNA, 64 nt, Human
guucuaugcaaggguaaccccagacauaugcagcuccgucauaacugacuccuuugucuggaac

SEQ ID NO: 4119457 - RNA, 76 nt, Human
guucucaaaggcccauugucccguugauuuuaucaguuauucuuuguuaauaaggugguaauguggucuuaagagc

SEQ ID NO: 4119458 - RNA, 75 nt, Human
guucucaaauaggaucuguguaaucuggccugguaaggccaugcuggguaauuugcacugaucaauuugauaagc

SEQ ID NO: 4119459 - RNA, 71 nt, Human
guucucagcgugggaggcagagagauccuguuaugauauaagguggaucauguugccucacuguuuagaac

SEQ ID NO: 4119460 - RNA, 70 nt, Human
guucucaggcauaguuggcuuuuuugaugaaaacaaaagcuugauuaaauuagcaaacugugaaaagggc

SEQ ID NO: 4119461 - RNA, 94 nt, Human
guucucagggucacuuaaaaaugaaugugaguuaccuggauugaacagaauucuauuuaguguauucuaauauguggugauaaaacuugggaac

SEQ ID NO: 4119462 - RNA, 66 nt, Human
guucucauucuccuugccugguggaaguccauucauccuuuaagacccagccagguggaauggaac

SEQ ID NO: 4119463 - RNA, 85 nt, Human
guucucccaugaacugucuugcuguaguuuaaugcaccgaggugccuguaacauccagcaacauagucagcaucaguggggggac

SEQ ID NO: 4119464 - RNA, 78 nt, Human
guucucccuuggggucugcgccacugucugcgaagaaccuacuucaagacagaaaggagggugucaggcaggggaaac

SEQ ID NO: 4119465 - RNA, 106 nt, Human
guucuccuggaaagcacagguucucucagaggccaggguccuggaaccgucuucccggggcugcccggcacucucugcaggugcuccugucaacaccaggucaggc

SEQ ID NO: 4119466 - RNA, 64 nt, Human
guucucuccuuguagcuccccaaggcaaaaaauacccuuucuggagucacacaggaagaaggac

SEQ ID NO: 4119467 - RNA, 64 nt, Human
guucugaaugugccuguacucuguucgugcuucucuuugcagcugugcaaguucauucgcaaac

SEQ ID NO: 4119468 - RNA, 84 nt, Human
guucugaccuugguugagcuuccuaaucagcuaccucuugaaccaaaggagaaauaagaauaggaagucacaucaagggagagc

SEQ ID NO: 4119469 - RNA, 65 nt, Human
gugagggauugggacggacaaucuuuuauucaugaggcagauguacaacugucacaauaccucgc

SEQ ID NO: 4119470 - RNA, 87 nt, Human
gugagggcacuuccuucucagggcuccauuuccugguuugugaaauuaaggucuucagauauggagcagagaugggagcccaaaaac

SEQ ID NO: 4119471 - RNA, 57 nt, Human
gugagggcagaacccccaggccagcagcuuggacucuucacccugggggacccucac

SEQ ID NO: 4119472 - RNA, 125 nt, Human
gugagggcucaugcccugacucauagagagcaucuucuugcucuguccucacaggguggaaggagcaagguagcucucuggggcuucuuuaauaagggcacuaauuugauuuaugagggccucac

SEQ ID NO: 4119473 - RNA, 61 nt, Human
uacaauguuccuagcaggaaaggucaauuauuauucacaguuuucauguaaggacauugua

SEQ ID NO: 4119474 - RNA, 104 nt, Human
uacaauuggaauguuaauuuuuaaagagguacaagaaaguccaguggguuuuucaaggagaaucaucuguguuuucugugagccugagauuuacaucugcggua

SEQ ID NO: 4119475 - RNA, 75 nt, Human
uacaauuuauagauuuugcccuuuaagguuuuauugcuuaaucacaaugaaaguaggguaaaaucacauguugug

SEQ ID NO: 4119476 - RNA, 88 nt, Human
uacacaagugcugaggaaggggcccauuuggugcagagccuggcuuuggggucucccugaauuuggggccucccuggcacggggugug

SEQ ID NO: 4119477 - RNA, 79 nt, Human
uacacacgcuuuacauuuuuuuccuaagugauaauucaaaaucccagugggaauguagaauguaaaccaugugugugua

SEQ ID NO: 4119478 - RNA, 62 nt, Human
uacacacggaaaggcauaugcuguguacaguuuggugaauuuucagaguaaaugccugugua

SEQ ID NO: 4119479 - RNA, 66 nt, Human
uacacacuagaugguaggugcggggcucucccaccccaccuguucauuacccaucccaggucugug

SEQ ID NO: 4119480 - RNA, 81 nt, Human
uacacaggccugggguugagcggguguaguuucggucaggaagccauucuagucuguucuccucacuccucaggccuggug

SEQ ID NO: 4119481 - RNA, 57 nt, Human
uacacauaggaggguaauaaaaagcaaccgaggcuuauuuaacacucacugugugug

SEQ ID NO: 4119482 - RNA, 70 nt, Human
uacacaugcgguuugcacgauauuuccaugggacagcacuguucuaaagagaggcgugagaccuugugua

SEQ ID NO: 4119483 - RNA, 55 nt, Human
uacacaugugcacgcguguccugcguguguuguauggcaugugugcaggugugug

SEQ ID NO: 4119484 - RNA, 68 nt, Human
uacacauguuuggcaaguauguccaggcucaaaaccuugaaaccaagcaugcugcaaaaccauaugua

SEQ ID NO: 4119485 - RNA, 99 nt, Human
uacacucgccuaugaaugacuaugacccuuucaucccugaagacagugcaaaagagggcugauucagggcaaagggcagaguuugaggguagaagugua

SEQ ID NO: 4119486 - RNA, 64 nt, Human
gugcuuuaccuuauuggucucgguucugaguuuucuaaaccuggagacauugaggagagagcau

SEQ ID NO: 4119487 - RNA, 89 nt, Human
gugcuuuacucuuuuaagcauucaaugcuuagcacugugcuuugcaucugccaugugcugguuaguguuugaaugaaugaaaaaagggc

SEQ ID NO: 4119488 - RNA, 60 nt, Human
gugcuuuacuuugccugguuguuccuggacuggaagaccccagagcgagguaagacucac

SEQ ID NO: 4119489 - RNA, 78 nt, Human
gugcuuuaguauuagcgaaguguuuucacauauagaauuucaucuguaguaaagcagguuuugcugucucuauuucac

SEQ ID NO: 4119490 - RNA, 58 nt, Human
gugcuuuauauguggguauccaaaguaucuuccuauggcauagcuaugaauaaaguac

SEQ ID NO: 4119491 - RNA, 79 nt, Human
gugcuuuccguggaggcagugcaguggugccugaggaucucacaggcagcagggccacuggcugaccacuggauggcau

SEQ ID NO: 4119492 - RNA, 57 nt, Human
gugcuuugaaauguuagauccuaggcuucauugaccugaucuuacagagcagaguac

SEQ ID NO: 4119493 - RNA, 104 nt, Human
gugcuuugagauagcacauuuuggcugccuagugucugagcagaaccacuuuuccuccuggguugccucaagcucuggcgcuuaagugguuaaguuggaagcac

SEQ ID NO: 4119494 - RNA, 89 nt, Human
guggaaaaugagccaugaaccaaccaaugugaguaauguuuaguguuguuguuuugaaguugggugguugguugaugguuguuuauuac

SEQ ID NO: 4119495 - RNA, 80 nt, Human
guggaaaaugugcauggagucauagucauuuagaacugaagcuacccuagagaacuucuaaucuguucacauuguuucgc

SEQ ID NO: 4119496 - RNA, 57 nt, Human
guggaaagccagcucuggaagggaugguagaggucauuuaggccagaaguuuuccac

SEQ ID NO: 4119497 - RNA, 66 nt, Human
guggaaagugcucuagacuuucucauaauuauuaacugagaaaaaauaccacugggcauuuuguau

SEQ ID NO: 4119498 - RNA, 63 nt, Human
guggaaaugugugugguagaauauuugagacaagaacauguauucaagccacauacauugcac

SEQ ID NO: 4119499 - RNA, 64 nt, Human
guggaacugguucccugggcugaccggagccgggagaacaaccuggccucagggagagagacgc

SEQ ID NO: 4119500 - RNA, 76 nt, Human
guggaagagcgcucuccaagguggcccgcuuccuguugguguugccggagccgugccuggagaccugcuccucuac

SEQ ID NO: 4119501 - RNA, 70 nt, Human
guggaagaguccaggugggcuggaggcauggccugugugucuugccuccagucccugggcugagauuggc

SEQ ID NO: 4119502 - RNA, 55 nt, Human
guggaagcucucaacuuccaaccucaaaacagagagggacagggggagcuuuuau

SEQ ID NO: 4119503 - RNA, 76 nt, Human
guggaagcuuucaauuuguggcacugaaugaugaucuacacagggcauccuucaaaggcuacaauuaaggauccac

SEQ ID NO: 4119504 - RNA, 69 nt, Human
guggaaggaaaugauaguugcuguauuucuaaauagguugacuauuaacauugcugcauucuccuuccc

SEQ ID NO: 4119505 - RNA, 91 nt, Human
guggaaggaaggacuggccuuggagacaggacaggcagaaugggcuggacaaugcccauuagaugacuccacgucaguuuuccccuucuac

SEQ ID NO: 4119506 - RNA, 70 nt, Human
guggaagggaaaccgcacuggccuuggccugucuugggaccugaacuuggccugcuguucacccugccac

SEQ ID NO: 4119507 - RNA, 80 nt, Human
guggaauggaaaagugcagcugaaaacauccugggggaagcauucuuuccuagggcagccaagguacuuuucaucuucac

SEQ ID NO: 4119508 - RNA, 82 nt, Human
guggaauggaacagucagcaugccugaauucaugguuaacaaacugaucagauacauuaaaaugaugauuguuuuaugccac

SEQ ID NO: 4119509 - RNA, 55 nt, Human
guggaauggggcagagauguugugagcaggcaugacauuauaauucauauuccac

SEQ ID NO: 4119510 - RNA, 56 nt, Human
guggaauguaauaaaagcaugguuuauaaaaacuugcuuauauuauuacauugcau

SEQ ID NO: 4119511 - RNA, 94 nt, Human
guggacacugcgucugauguccaggguaagucucugccuuccaggcccagccuagagcaguggguaccauggcacaucugacagcauugcacac

SEQ ID NO: 4119512 - RNA, 77 nt, Human
guggacagagggcuaacugggaagcagggcaagggcuucucucccuuuccaccugccccgauuacucccaucuccac

SEQ ID NO: 4119513 - RNA, 57 nt, Human
guggacagugaacccagaggggugaguggaauccauccagccuggggguuuaaccac

SEQ ID NO: 4119514 - RNA, 59 nt, Human
guggacucauuucuccugccugcaaggaacugcuguccacaggucagggagauaggcac

SEQ ID NO: 4119515 - RNA, 73 nt, Human
guggagaaacagacuugguagccuuggagucaggacugaggacugacucugccaucccaggugcuguggcuac

SEQ ID NO: 4119516 - RNA, 62 nt, Human
guggagagaaaaaagacaguucuucggugucauaaagacauucuaucuuuuugcucugccau

SEQ ID NO: 4119517 - RNA, 73 nt, Human
guggagagaaaguaaacauuauucugggaacauguucaaauuaugugacuuucagugauuuaucuuuuuccac

SEQ ID NO: 4119518 - RNA, 92 nt, Human
guggagagaugggcuucacccugucugcaagugucaauucucuaugaggcuuuauggcacuauggaugagacugauuucccauuuuucuuac

SEQ ID NO: 4119519 - RNA, 71 nt, Human
guggagauaaagacagggccuggcaggggcaggauagaugcuaaugccuugccacugcucuuaaugucggc

SEQ ID NO: 4119520 - RNA, 67 nt, Human
guggagaugagaggaggggucagagaucuggaucuguggucuggaauuggaaucucuucaucucugc

SEQ ID NO: 4119521 - RNA, 94 nt, Human
guggagauuguuaacccaucacuuuacagcuaagguuguuacauuuucugagacugcuuugguuuguaaauguaacauuuugucauauuucuac

SEQ ID NO: 4119522 - RNA, 61 nt, Human
guggagccaggaucuccgcacaucccuaugcugugauagcuacaggggaucguggcuucac

SEQ ID NO: 4119523 - RNA, 68 nt, Human
guggaggaccuggcauauucauuggcacaugcuugcugcguaauaaaugccaguucuauuauauucac

SEQ ID NO: 4119524 - RNA, 56 nt, Human
guggaggaggacuuagacccauguaaggcagggauuuaaaauuuagaccucuccac

SEQ ID NO: 4119525 - RNA, 60 nt, Human
guggaggccaagucacugaccugggggcaaagacaucugaguucucaucuuggcuucuau

SEQ ID NO: 4119526 - RNA, 84 nt, Human
guggaggcccagagacgggagggauuaguucugccuggggagcccagaaaagcaucugguucuuucauuucuguauuccuuuac

SEQ ID NO: 4119527 - RNA, 67 nt, Human
guggaggccucuguguuuagccugaccauauuuggggcucaguuccaucagcaaaugccugucuccc

SEQ ID NO: 4119528 - RNA, 71 nt, Human
guggaggcuuucaaagaccuuggcaugggggcccaccuucuugcuuuacaauuuuugaaaccaaacuccau

SEQ ID NO: 4119529 - RNA, 127 nt, Human
guggagggagagaaagggaaucuggccugugcuuaacugacgugagagccagacuuugaacuccaguggcuucauuuaccacucaugucaucuugggccaacugagaucacuuuucuaagccucugc

SEQ ID NO: 4119530 - RNA, 65 nt, Human
guggagggccuggccuguguuguguaagagccaauggaguagagaaccagagccaggcucucagc

SEQ ID NO: 4119531 - RNA, 83 nt, Human
guggaggggcagagaugacucagaaagguagcccagcagacccuugcuuccaugaaauguguuaugcuucuagccucuuccac

SEQ ID NO: 4119532 - RNA, 73 nt, Human
guggaggggcugcccugggaguuggagcugcuggaaccagcuaguaacuggcuuccagaggggcccuugucac

SEQ ID NO: 4119533 - RNA, 72 nt, Human
guggaggguugaagucugguccucauccagcucuguccauucugagaugcugccuccucuucagccgcccac

SEQ ID NO: 4119534 - RNA, 86 nt, Human
guggagguuucuuuuugagucagagucucgcucugucgcccaggcuggagugcaguggcgugaucucugcucacugcaagcaccac

SEQ ID NO: 4119535 - RNA, 80 nt, Human
guggagucagcaguucuguacuuuagaguaauaugagaaucaccuggaacacuuacgaaacacagauugcugagcuccac

SEQ ID NO: 4119536 - RNA, 70 nt, Human
guggaguuaaugguccucaucuucugcugcuauugcccuuagaccaccaggaagugugggccaacgucac

SEQ ID NO: 4119537 - RNA, 70 nt, Human
guggauaaaccagauugggaguuucagauggcaacccauggagcauacuaacccacucugguauugcuau

SEQ ID NO: 4119538 - RNA, 63 nt, Human
guggauaauaccuuuuugauguuguuuugaagaguuaaugaaauaauuuagaagguauuccau

SEQ ID NO: 4119539 - RNA, 76 nt, Human
guggauaauucuaagacaugcccugcaugauaccuuaaugggauaucaccagagggauagucucugaguuauuuac

SEQ ID NO: 4119540 - RNA, 115 nt, Human
guggauaugggacugucaacugugaaggguuucacucagaugcuaaagauggaauuacacgguaacucgaguuuuaggucuggcucugcauacaguuacaugguuuuaggucugc

SEQ ID NO: 4119541 - RNA, 62 nt, Human
guggauauuugacgaaacaacaugcauggacaucuauguaagaacaacugucaaaugucuau

SEQ ID NO: 4119542 - RNA, 122 nt, Human
guggaugauguuuuuagccccuggggugggaugucacagacggcuguuuuuauguuguaggggagccagucaacaaaguagcugcuguucuuauuuugaauguugaacauuuguucauccac

SEQ ID NO: 4119543 - RNA, 87 nt, Human
guggaugcaccucuacaggagccccaggcugacaauaaccuuccugaucugguuucaacccuggaugcuuuuaccuggugcauccau

SEQ ID NO: 4119544 - RNA, 61 nt, Human
guggaugugagggcucaggcugacugaucuuuccucaucaaacaaaugcuuuuagauccau

SEQ ID NO: 4119545 - RNA, 87 nt, Human
guggauucauguacaaaaggcaaaugccucacauauguuaagcuugagguaaggguuauugccuauuguacugaugagagaguccau

SEQ ID NO: 4119546 - RNA, 67 nt, Human
guggauuucaggcuccccucagcccuguaaccuggcaucaggaucugagggcuggucugaagucugc

SEQ ID NO: 4119547 - RNA, 71 nt, Human
guggcaaagcagaggguauggccagguuugguuucuaccccaacccauuugccaucccuguugugucccgc

SEQ ID NO: 4119548 - RNA, 111 nt, Human
uacgugccaggaucgcaaacccuuucucucagcaggaaagcaugcaagucaaaugccaucauaaucacuuuguguuucccugcagagggaaaggagggcuccuugcaugug

SEQ ID NO: 4119549 - RNA, 88 nt, Human
uacuaaauauaauaaagaugauuucuauauaaacuuaaauucaguauaaagaauuuauauaaagagaucuuuggguuguccaguggug

SEQ ID NO: 4119550 - RNA, 76 nt, Human
uacuaaauaucagaacacauguuuugcagccuaaacuuuaaaugguggcuugugugugugugugugugugugugug

SEQ ID NO: 4119551 - RNA, 81 nt, Human
uacuagcuauucuaaagcugaccugauugcuuuucaguguuuugacccugcagagaccuaggucagguuuaguagcuugug

SEQ ID NO: 4119552 - RNA, 55 nt, Human
uacuaguaagggugguuuggcuccccaggcuguccugccaucacccuaacuagug

SEQ ID NO: 4119553 - RNA, 79 nt, Human
uacuagucuuuuaacauguuucaauuguuugauuuucuuuuaaagaacuucaaaaauaagugagagguaaaggacugua

SEQ ID NO: 4119554 - RNA, 130 nt, Human
uacuauccaggacucuccuggauagauacuauccaggacucuccuggauagauacuauccaggacucuccuggauagauacuauccaggacucuccuggauagauacuauccaggacucuccuggauaga

SEQ ID NO: 4119555 - RNA, 97 nt, Human
uacuaugguaaccaagcaaugugcugggagacagaagccuuuaauugcuuuaacaacuuccuggggcuccagcuaccaggcuuggauuugcuaagua

SEQ ID NO: 4119556 - RNA, 104 nt, Human
uacuauuuucccugugaucucaguuucuucuucccaucccucaaaugcuuuuuguguguguguggugggggaagagaguaaaauugaaauucguggaaaaugua

SEQ ID NO: 4119557 - RNA, 55 nt, Human
uacucaaucuagguggcuuaccuacuuccuguuuguaaggcaucaaguuugggua

SEQ ID NO: 4119558 - RNA, 55 nt, Human
uacucagaaugcuuuugagauucauccguguugagucuggugguauuuuguagug

SEQ ID NO: 4119559 - RNA, 84 nt, Human
uacucccuuaccacugcucccugccugugaacugaucauuccacacccucuagucuaggacuuuaugcagauggcaagggggug

SEQ ID NO: 4119560 - RNA, 65 nt, Human
uacucucacccacucucccaccgcccagcccuacgccaggcgagggagcagugcggugggcggua

SEQ ID NO: 4119561 - RNA, 101 nt, Human
uacucucuccuugucuaaaacuuuaauuggaauuuuuguaagggaacuaaaaucuguguuuaccugaaguaacaaugaauauuuuugauaaggauaaagua

SEQ ID NO: 4119562 - RNA, 74 nt, Human
uacugaaaaacaugugucuggcuagauuguaguagacuguacuguagcaaaagaaggcaaggcacaauucagua

SEQ ID NO: 4119563 - RNA, 101 nt, Human
uacugaaacaauucaacaggcaauggaugcccugaauuugauagaaacucaugaaaggcaaacucagagucaacuguugccuguuaauucuccaaacagua

SEQ ID NO: 4119564 - RNA, 57 nt, Human
uacugagauaucaucagauaauuguacaugagaaugacaagcuggugaaauccagua

SEQ ID NO: 4119565 - RNA, 57 nt, Human
uacugauaagaguuguaggagugcgaucucuaauuccucagcauguuuugucaugua

SEQ ID NO: 4119566 - RNA, 69 nt, Human
uacugcagugauucuuuuuaugccuugauagaccuuguuuuauagggaggaacugagucaggagcagug

SEQ ID NO: 4119567 - RNA, 71 nt, Human
uacugccagcugggccccagugcagggggugagugccccuaacucucugugauggaggccagcuggaagua

SEQ ID NO: 4119568 - RNA, 61 nt, Human
uacugccugggggagacagcugguuugccaccugcaaugucugugaccucuuaggcaagug

SEQ ID NO: 4119569 - RNA, 78 nt, Human
uacugcuauagauucaggagaucuuaggaauucuuaggagaauccuaagaaaucuuaggauuucuucuguggcuugua

SEQ ID NO: 4119570 - RNA, 72 nt, Human
uacugcuccuggccagcacagggcccuugggugaauuagaaguuauccucgggcaccuggcuagugacagug

SEQ ID NO: 4119571 - RNA, 83 nt, Human
uacugcucuaaacaauuucugauauacuguagaauccuguuacaggaaguagugaaguuagaauuaaguguucaggugcggug

SEQ ID NO: 4119572 - RNA, 63 nt, Human
uacugcucuagguccauugcgggaaauaauucuuuauguugcccaggguuucuaagagcagua

SEQ ID NO: 4119573 - RNA, 61 nt, Human
uacugcugggcuccugguggcugcugucugcucugcagcagaaagcccuuuccccacagua

SEQ ID NO: 4119574 - RNA, 101 nt, Human
uacugcuuaaaaagggaaacacucaauuuaguaauucgguugccuagaugaaaucgaguggcuauugauccgugauguuucuagauuuuuaagacuaugua

SEQ ID NO: 4119575 - RNA, 66 nt, Human
uacuggaauggaaguggcaggauguggaguccagacauagucuaccacucaugcuacuuacuagua

SEQ ID NO: 4119576 - RNA, 61 nt, Human
uacuggagacucacacaugguaucuugaucagcccagcauagccagugaauguuuccagug

SEQ ID NO: 4119577 - RNA, 95 nt, Human
uacugggaguuggaguuugcuucucuguaguugggcagcugcucuuggucuagugaccaccagccuggacagcuacggagaacccgccuuaggua

SEQ ID NO: 4119578 - RNA, 130 nt, Human
uacugguaggaacucucauauuaaaagggaacccaaaccagggcggcuugaggaggcagcuucccagaaaggauggcuuuuugagcugccuuguggggagacccugcuguguguccccaguucaccagca

SEQ ID NO: 4119579 - RNA, 60 nt, Human
uacuggucuuaccuaauuuuuaucaugccaccagguggcagcauguuauguaaggaagua

SEQ ID NO: 4119580 - RNA, 66 nt, Human
uacuguaaugagauuagcuuccccauauaaacuauuuugguauccugagcuauagcuuauacagua

SEQ ID NO: 4119581 - RNA, 85 nt, Human
uacugucacgcugcaguugacucccuguuugcagucagaccaguaugucagcguauacagaaagucaaaagcuagcuagauagug

SEQ ID NO: 4119582 - RNA, 104 nt, Human
uacuuaaauauauuugaucugguucaauaagucagaauguuuggaaauaaaagacugaauaauauuccaauuaauugaguauugaccagaaaauuuaaaaggua

SEQ ID NO: 4119583 - RNA, 96 nt, Human
uacuuacccucucuugcuucagauuccucuucuguaaaauggagcuggugcugggguuguggggaggauuugaugagacagugagagggugcagua

SEQ ID NO: 4119584 - RNA, 130 nt, Human
uacuuacuaggcuuggguauuaaguuuauauuagauuuauuaaauuauuugggaaacuuuucacuuacauauuuuggaacaguuugaauaauuuagauaggauuauaugauccuuaauaguuuaguuaga

SEQ ID NO: 4119585 - RNA, 67 nt, Human
uacuucaguaaccuugugacaacacgacccuuuauuuuguguguuugagucuuauaggauugaggug

SEQ ID NO: 4119586 - RNA, 73 nt, Human
uacuucaguuacaugaagguauucuggcauagcaauaaaacaaccggaaaguccuuugaguguguuugaagua

SEQ ID NO: 4119587 - RNA, 82 nt, Human
uacuucauacauuuuagguugcccuugcaauauuuagguuucauggggaucaaaagcuggguucuaaaauuaaagagaagua

SEQ ID NO: 4119588 - RNA, 68 nt, Human
uacuucauugagcuuuucugaaaugaauuuaucuaauuuaaacuguaggucaggaaguugaugaggug

SEQ ID NO: 4119589 - RNA, 70 nt, Human
uacuucucugcgaucacgugauaaguuagucacaugauuggcauuuuagacaugauggugcagagaggua

SEQ ID NO: 4119590 - RNA, 112 nt, Human
uacuucucuggaaagcuugcuacacauuggccaaaaguuuuuccaauuccaauuccaauuuguaucuauugaaagauuuugggcucauggaagagcauuagcuggggaagua

SEQ ID NO: 4119591 - RNA, 84 nt, Human
uacuucuguggguguuuguguugaugaggauuugagccauuuuauguacaggucuucauucaacaaauauucauuuuccaggug

SEQ ID NO: 4119592 - RNA, 78 nt, Human
uacuucuuacagacugugaguaugcauaguguugucauuacugaaauucauacucgacaguggggcuucaaagaagua

SEQ ID NO: 4119593 - RNA, 80 nt, Human
uacuucuucuggugcuauucuuuucauucugcugucugaguuuuccagcacugucuucugagagggcauuauaggaagug

SEQ ID NO: 4119594 - RNA, 75 nt, Human
uacuugccuucuucucuacaccagcagccccacugaaagcccagcagggguggcccccuggggagguggcaggug

SEQ ID NO: 4119595 - RNA, 69 nt, Human
uacuuguaagcuauuccugaagaagguugccucagcaggggaaaacuuucugaaaagcuugaucaagua

SEQ ID NO: 4119596 - RNA, 73 nt, Human
uacuuguuuaauuuugugcuuucuggacuucaauccauuuacaauacuuuagaaaguacuaaauuuaacugug

SEQ ID NO: 4119597 - RNA, 57 nt, Human
uacuuguuuuguguuccuaaacuuugaagcucauguuugggaaguuuaaaauaagua

SEQ ID NO: 4119598 - RNA, 76 nt, Human
uacuuuaaaugggaaaaauugcagccuguuaugaauggcaccgaacagugcugauuauuuuaccuuugacaaagug

SEQ ID NO: 4119599 - RNA, 79 nt, Human
uacuuugaauacaguaucuucuggcaagcauaggggacugcagucgacaaugcugcugaauauaccugaguacauagua

SEQ ID NO: 4119600 - RNA, 57 nt, Human
uacuuugcaugcuugugugaucagccaaaucuuaucgcaugucuaaugugcagggua

SEQ ID NO: 4119601 - RNA, 74 nt, Human
uacuuugugacuucucuguagugcugagaugccagaaaauauaauaguuuccagccaagggagguuacuaggua

SEQ ID NO: 4119602 - RNA, 57 nt, Human
uacuuuguuugauccaugggaaguaauauugguaauaucucaggguucagcaaagua

SEQ ID NO: 4119603 - RNA, 81 nt, Human
uacuuuguuuuugucuuuugcauuuguuggaagcugauugaaaaagccuuccacuuaguggaagggcaugcuacauuugug

SEQ ID NO: 4119604 - RNA, 72 nt, Human
uacuuuucccaucagcaacugugccugacacacaguagauacuguguguacuacuuguugaaugaauuugua

SEQ ID NO: 4119605 - RNA, 71 nt, Human
uagaaaaccaugaagguccuuuuuguucugugggcuccucauagaacagggcacugucaugauguauucug

SEQ ID NO: 4119606 - RNA, 61 nt, Human
uagaaaagaauuuuauuugauagcuugccuugccuaagcaaauaccaggaguucuuuucug

SEQ ID NO: 4119607 - RNA, 97 nt, Human
uagaaaaggaaaugaaggcuuacaaugauuagcuaacuugcccaaagguuauauagcuaauuauguagcagaacaaggccuuacauaucugacucug

SEQ ID NO: 4119608 - RNA, 61 nt, Human
uagaaaagggauucaggauuggaauucaaaucuguccaagucuuaauacagcucuuuucua

SEQ ID NO: 4119609 - RNA, 74 nt, Human
uagaaaaguuuguugcuuacaaagaagacggcauagaaagcugaaaguucuacuuguugcaacuuacuguugug

SEQ ID NO: 4119610 - RNA, 93 nt, Human
uagaaaaucaaauaguguucuuugccagugauuuaauuuaauaauaauaauuuuuagaaaugaaauaagucacugggaggagcucauuuucua

SEQ ID NO: 4119611 - RNA, 89 nt, Human
uagaaaaucaaguggcccccacauaagcugaccucacucaauagaagaauuuugguuauguaugggggccuuaugaccugauuauucua

SEQ ID NO: 4119612 - RNA, 60 nt, Human
uagaaaccagacuuggcccauuucccccuagacaggccacucuggucugguaauauucug

SEQ ID NO: 4119613 - RNA, 70 nt, Human
guuucgucaucuccaaaaugcagucaaucaucccagguggugcugaggacuaaaggagaugacaugaaau

SEQ ID NO: 4119614 - RNA, 77 nt, Human
guuucgugaucuuguaauugggcaaugauauaaacaaucauggugaaacagugccccaguuacaugggguuaaaaau

SEQ ID NO: 4119615 - RNA, 124 nt, Human
guuucuaaagcaagauauuuucaaacuacuuaucuugguguuuuaguaauucuagugucuuaauaucgauugcuuauacacaagaugaaagagguuauuuucagggugucauuguuuuaguggc

SEQ ID NO: 4119616 - RNA, 77 nt, Human
guuucuagcacgugacagacacucuguccagccugggauugaguggugggcagggucucuguuaucaggcagcuuac

SEQ ID NO: 4119617 - RNA, 88 nt, Human
guuucuagcuaauuucuaacaaguucccgaggaccacaguugaagaaccuuugcccuaugguauuguggagcaagaaauggaagaaac

SEQ ID NO: 4119618 - RNA, 125 nt, Human
guuucuaggucacacucucaguauuucuauuucaguaguaggucuggaauggaguagggguggagaaaaaggauuugcauuuuuaacaaguucccagaugcugcugaugcugcuggccuaggaac

SEQ ID NO: 4119619 - RNA, 76 nt, Human
guggccccauuuuucuggagccuggaguaguugugggggagcagggagcaggaaggcugcagaagaauagggucau

SEQ ID NO: 4119620 - RNA, 92 nt, Human
guggccgcugggcagagcuggagcaggucaccuugggguaaacgguauuacugccccaggacaggaguuggcuucgcugugcccacguccau

SEQ ID NO: 4119621 - RNA, 81 nt, Human
guggccggcuugcuggagccuucugcaggagcaccugucccauuggccccaguguggcugcguagggcucucaggcaccac

SEQ ID NO: 4119622 - RNA, 61 nt, Human
guggccucccugccuggaguuggguuccuaugccuuccagugacuaaggaggaaauuccau

SEQ ID NO: 4119623 - RNA, 87 nt, Human
guggccucuugcuuugcuggcacuccuggcuggcuggcuggcuggcuaugcugacaguguaagucaagggauuauuagauuggccac

SEQ ID NO: 4119624 - RNA, 91 nt, Human
guggccugaaggccuuuggcagccucugcuauugacaguaaguucuguagauuuugugaacugguugugaaagguuuuucugaggaguuac

SEQ ID NO: 4119625 - RNA, 55 nt, Human
guggccugccgcaccccaauauggcagaaacauuuucaggccccggcagguccau

SEQ ID NO: 4119626 - RNA, 67 nt, Human
guggccuuuaucuuagguauccacaggagaaaccaccucaggugguacauacacuaauauaaaccac

SEQ ID NO: 4119627 - RNA, 80 nt, Human
guggcgagggugcaggugggggucggugcaucuguucuggccgcgcgcaggugugaccucccuccuugaccuuggcacgc

SEQ ID NO: 4119628 - RNA, 99 nt, Human
guggcgcacgucaugcacauuuguuuacauauugucuguggcuacuuucaugcuacagugacagaauuaaacagucaugacagaaacuaugugucccgc

SEQ ID NO: 4119629 - RNA, 85 nt, Human
guggcgucagcuuucccauccagagagccucuccagugggcacauuagacaggaaacauuaggauggagaagaagccuggcacac

SEQ ID NO: 4119630 - RNA, 59 nt, Human
guggcuaaaguaauccuucauaaggagauaauuuuuucuuguaggugauuuuuuuccac

SEQ ID NO: 4119631 - RNA, 68 nt, Human
guggcuacaugguguauugauuauugcugucuuuuuggacagaacugggaaaugcacauaugcaucac

SEQ ID NO: 4119632 - RNA, 55 nt, Human
guggcuaucagcaauggcuucuggaaggaggacagcacaggaguugaaugggcau

SEQ ID NO: 4119633 - RNA, 68 nt, Human
guggcuaugaucccaguuuuggaauguucuaauuauggcuuugaauguuccugguauaucaugaccac

SEQ ID NO: 4119634 - RNA, 84 nt, Human
guggcucagagagcccggccacagccacugggguggggcucacugcucagcccuaggcugaggccagggugcuuugugucccac

SEQ ID NO: 4119635 - RNA, 75 nt, Human
guggcucagccuccauugggccuuugugucugggccagacccuccaggcaagcccccagugaggcucuugggccc

SEQ ID NO: 4119636 - RNA, 58 nt, Human
guggcucauccauuugacuuuuucuuucauaggaagaacaggacacugggauggcuac

SEQ ID NO: 4119637 - RNA, 126 nt, Human
guggcuccccaauagucucgaccuguucuugcuuaggaacucugacaaggcucauuucuuugguucucaggccaacuggccuuggacagagcgcuccuggcuugagcuccacuagugggauuccac

SEQ ID NO: 4119638 - RNA, 67 nt, Human
guggcucugaggcaucauggagaacaguugaaaaucacauugucagcucgaaaugcaucaaagcuau

SEQ ID NO: 4119639 - RNA, 64 nt, Human
guggcugaacugggacacacuagguaguuggacucacgccccauaccuugaacccgccagccau

SEQ ID NO: 4119640 - RNA, 75 nt, Human
guggcugcacaugugcagagaucuuguaacguaacuauggcuuuucucugcaccaugugugaaauaagcugccgc

SEQ ID NO: 4119641 - RNA, 80 nt, Human
guggcugcagcuggagaggaucccaaagccacgcucacuggggcuggcuuucucacagaccaccuccaugcagaucccac

SEQ ID NO: 4119642 - RNA, 77 nt, Human
guggcuggaacugcagguguggguggcugccaggcccagcucugugccugcacuucucacagcugcuguguguccac

SEQ ID NO: 4119643 - RNA, 65 nt, Human
guggcuggaacuggggauguuuacaaugcuguucacugugguuuaauuuccauuuccuuggucac

SEQ ID NO: 4119644 - RNA, 65 nt, Human
guggcuggaggaaggaacugaggaggaccuucagggcuuucugagucuauauucccacuagccac

SEQ ID NO: 4119645 - RNA, 98 nt, Human
guggcuggguccugaauuucuggcuugcuggcuuggucccagcuacagcugaggagaucuauguccaguaguaccccggggaagagggcucagcuuac

SEQ ID NO: 4119646 - RNA, 78 nt, Human
guggcuguaaucuuggcuacuuaggaggauuccuugaguccaggaguccaaggcugcaguuagcuaugauuacgccac

SEQ ID NO: 4119647 - RNA, 104 nt, Human
guggcuguugaagcugaagauaauagacacacaggcccaaagccuaguacauccugggcuccagcuaaugguuucuaucauucucccuuaagcuuuuaaguuau

SEQ ID NO: 4119648 - RNA, 70 nt, Human
guggcuuagaagcaggcuguguccccaggguccagcuuccucugggggagauuagagcuucuuaggccac

SEQ ID NO: 4119649 - RNA, 58 nt, Human
guggcuuccaugugcaucugacugggaccagaccuccagcaaaaccaugaaaggucac

SEQ ID NO: 4119650 - RNA, 66 nt, Human
guggcuucgcuuugccaugaguuuaccgcagaaaccggcucugaaaucaggcacagcgacugcagc

SEQ ID NO: 4119651 - RNA, 63 nt, Human
guggcuucggcauugcuacacccauugugcauuuuuaugugggaaguggggauuugaagucau

SEQ ID NO: 4119652 - RNA, 76 nt, Human
guggcuugcucagugaggccagggcugcacuuugagaggggauggcaaacuccucuccuggcugcacuguggccac

SEQ ID NO: 4119653 - RNA, 130 nt, Human
guggcuuuuugcauaguagacaauuuugaggcaucugcagaguuccacaaagcccuauacacauaacaucaaagcguugggaagauuucccguagcugugccucauguaaucucaauugcuuuuugccau

SEQ ID NO: 4119654 - RNA, 70 nt, Human
gugggaacaacucugagaaacuugcaguugagggugucauaagaacuccuuuuaacugguuucuucccau

SEQ ID NO: 4119655 - RNA, 61 nt, Human
gugggaagaacuuccggcauggggaaacuaauaugaaaucuauugcugggguagaauccac

SEQ ID NO: 4119656 - RNA, 67 nt, Human
gugggaagaauugaggauguuuaccuuggagaagcagaggcucaggguguacaugcucagcuucagc

SEQ ID NO: 4119657 - RNA, 75 nt, Human
gugggaagggauggcugguuggucauccugggagggagaccccuuuccuuagugacuucuagcuacuugcucuac

SEQ ID NO: 4119658 - RNA, 105 nt, Human
gugggaaucaaggcuaaaugaucaguguauguguguucaauggcagaaaaauuauugaauagaguaacguggacaaagaauacuccuuuugccuugaaaaccuau

SEQ ID NO: 4119659 - RNA, 77 nt, Human
gugggaaucguuuccuaccagugguuccagaucucaaaaaugcaauugguuguggaauuauuuaggaccauucccac

SEQ ID NO: 4119660 - RNA, 91 nt, Human
gugggaaugagccacacuaagcacagggagcagcaugggcaaaggcccagaaggcugggcacacucugcuccagcuuugguucauucccac

SEQ ID NO: 4119661 - RNA, 66 nt, Human
gugggacaaaggggauagcacuaugguuuaugaggauaaauaagcuggagcuucccccguccacac

SEQ ID NO: 4119662 - RNA, 67 nt, Human
gugggacacagugguuaacaccugugaucucagugcuuugagaggcaggagguugacuugagcccac

SEQ ID NO: 4119663 - RNA, 79 nt, Human
gugggaccgccuccugucgcacguuuccgccuggucccgcgcuuuaggagcuaggaaaugugacagaggcggugccuac

SEQ ID NO: 4119664 - RNA, 80 nt, Human
gugggacuagggaggcuacuucuuguaggcagugcugccuuucagcugcaguuuacccagagcagugacucccagcccau

SEQ ID NO: 4119665 - RNA, 62 nt, Human
gugggagacagaagagggcugggcuccacacucaggcaccuuagcccucucugucuguguac

SEQ ID NO: 4119666 - RNA, 74 nt, Human
gugggagagaccccgcuuagggaaagucgagggaaguuccucauuacuacuccuggugccuggagcucuccagc

SEQ ID NO: 4119667 - RNA, 61 nt, Human
gugggagccauuuccaguaugcucccaaugucuauggcaaauguggguaauuggcucccac

SEQ ID NO: 4119668 - RNA, 103 nt, Human
gugggagccuggaggcaguguguuucugagauauggccuccccauagguuaugcccagggauuuccauuaucuuuaagcagcacacacuccagagcaucuuac

SEQ ID NO: 4119669 - RNA, 70 nt, Human
gugggagguacggcuccuugagggcugccuguguaacaguccagccacaaaggcuugccucggaugccac

SEQ ID NO: 4119670 - RNA, 61 nt, Human
gugggagguagcaggguccagaggguggaagcacacauccaggcucugcuacuauuaccac

SEQ ID NO: 4119671 - RNA, 60 nt, Human
gugggaguggagcucagcaugucaaaagaagaauugaucgagugaugaugccacuccaac

SEQ ID NO: 4119672 - RNA, 57 nt, Human
gugggauaucuaauugaugauaugugcauuacaaugcaucagauuuagaaguucuau

SEQ ID NO: 4119673 - RNA, 66 nt, Human
gugggcacacaagcuuccugacuggugcucuuacaacccaguuugguggccucgggaagcucccac

SEQ ID NO: 4119674 - RNA, 87 nt, Human
gugggcacacacugaaggguugcccgcagggucuccagaugagggggagccugcaggaugggcagcaccuucuccuggcuuccccac

SEQ ID NO: 4119675 - RNA, 76 nt, Human
gugggcacucugccuagcgccaucugccucucccaccccaggcaggugucagguggcugcugcgcccuguguccgc

SEQ ID NO: 4119676 - RNA, 71 nt, Human
guuuuacaaggcucguaacauuucucugcagcucucugcacuuguggcagaaaguuugugccuugugacac

SEQ ID NO: 4119677 - RNA, 67 nt, Human
guuuuacucaauguauuuccagcuccuggccaguaccuggcacagagcuuguuuacauuuguaaagc

SEQ ID NO: 4119678 - RNA, 68 nt, Human
guuuuagaggucuguuucacaucacugcuuuaauuucuuguuugucaauguguauagauuucuggugc

SEQ ID NO: 4119679 - RNA, 89 nt, Human
guuuuagcaguggaugcaggaguugaugaacagacaagcaaguucugcuucuguccuguuuccuccugacagcuccauucuuuugaagc

SEQ ID NO: 4119680 - RNA, 55 nt, Human
guuuuagccguuugcguggaaugccaaacuguggacacugugcagaugcuagugc

SEQ ID NO: 4119681 - RNA, 81 nt, Human
guuuuaggaaagucauggaugaacacuacuucagcaugagucugaaaguugugugugugugugugugaugucuguaagagc

SEQ ID NO: 4119682 - RNA, 76 nt, Human
guuuuaguuauugcauuaucauuucaggugugcaucacaaauuuaacauuuuaaugagauggcaaugacuuaaaau

SEQ ID NO: 4119683 - RNA, 55 nt, Human
guuuuauacucauuuuguuuucuugcaauaagaaagcuuaacuggguaauaaagc

SEQ ID NO: 4119684 - RNA, 123 nt, Human
guuuuauauggaauuaaguuccaaauugcuuaaacacagauauuguacuugauccucacaccggccacagaggggauuaucaucuucuguuuuaaagauguggaaacuguaaaccagugagac

SEQ ID NO: 4119685 - RNA, 74 nt, Human
guuuuauccuuucauugauuuaacaaacaaguacugaacacauacaaagugcuaaucaauguuaaggcugugac

SEQ ID NO: 4119686 - RNA, 63 nt, Human
guuuuauuggaacacagccaugaccacuuguuuacauauugucuauggcugguuucauucaac

SEQ ID NO: 4119687 - RNA, 125 nt, Human
guuuuauuuauagauauucaaauagacaagacaaugcauuacuaagaagagagaaaaagcaagaagguaaacaauuucuucuuggaauucuaucugucucuggguaugugauccacuagcaagac

SEQ ID NO: 4119688 - RNA, 65 nt, Human
guuuuauuuucaggccguacuuuguauacauuguaaggcaauaguucgguccugaaggccaaaac

SEQ ID NO: 4119689 - RNA, 81 nt, Human
guuuucaaaaacucaguguguuucuuaguaucugguuagaccucuuagaauuaagaggcaucuagagauauuuuugaaggc

SEQ ID NO: 4119690 - RNA, 63 nt, Human
guuuucaagguagaagcagcuuauacuccaggccccuggcauuagacagagcuccuugagggc

SEQ ID NO: 4119691 - RNA, 84 nt, Human
guuuucagcaugaauguuacuagguguaauaauuaacccuagcggggugaguuacugccuaguaacuugacaaucauugaggau

SEQ ID NO: 4119692 - RNA, 62 nt, Human
guuuucauccucuaguacugaagugcccucaaggugguaggcacuguauagcaggagaaaac

SEQ ID NO: 4119693 - RNA, 86 nt, Human
uaauggcauaggagauaauuuucauuuuuguaaaaugucucaucgauaggcugcaaaauaaugaacgauuuuuuucuguggcauua

SEQ ID NO: 4119694 - RNA, 73 nt, Human
uaauguauaacaaauacucaucccaggaacuggcuccaaguagucauucaauaaaggguaucuguugucauua

SEQ ID NO: 4119695 - RNA, 72 nt, Human
uagcuauauuguuugggccauuguuuuugccuauagauaguaauccucuugcaaggcuuaaacauuaaucua

SEQ ID NO: 4119696 - RNA, 84 nt, Human
uagcuaugcagcuauguuugacagaaagugacaaugagagcauuucuugaaaucauuuuucucuuacacguagauauauaucug

SEQ ID NO: 4119697 - RNA, 75 nt, Human
uagcucaaaaaaaguaugaagauuauaauuuuuccaaaaacuuucugggaauuacuaucuugauacucagggcua

SEQ ID NO: 4119698 - RNA, 98 nt, Human
uagcucaucaccugacaggcagggucuugagaggcagccagguuuaaggacuuggaggucacuggaagaugcuguggucugaagcaggagaggagcua

SEQ ID NO: 4119699 - RNA, 58 nt, Human
uagcucaucuaggcuaccacaguuaagucugaagcagggcuguggcgugggugaacua

SEQ ID NO: 4119700 - RNA, 86 nt, Human
uagcuccuugauccuaggauggaagggagagcuuauauagaagcuuuuacuuggaagguuuuguauccuaaggucagacauagcua

SEQ ID NO: 4119701 - RNA, 69 nt, Human
uagcucugacauuugcaauuacaagucugucuuucuuucuuagaaauaguuacauuauugucagagcug

SEQ ID NO: 4119702 - RNA, 58 nt, Human
uagcucugccaaauggaggcugcucugagaagguggcagcucuuuuuugcagcagcug

SEQ ID NO: 4119703 - RNA, 56 nt, Human
uagcucuggucuugcuuccucaaacgugcuguucacagugaugcaagagugagcua

SEQ ID NO: 4119704 - RNA, 64 nt, Human
uagcucuuagacaccaugacuuugauguacaaaucagcucuuucuuggccucuagcuagagcug

SEQ ID NO: 4119705 - RNA, 56 nt, Human
uagcucuucaaucacugucuccauucuuuguacuuggggaucaggaaaggaggcua

SEQ ID NO: 4119706 - RNA, 61 nt, Human
uagcucuucauuucaucugauugguacugcccacuuaacacucagaacaguagaggagcua

SEQ ID NO: 4119707 - RNA, 81 nt, Human
uagcugcuauuuauuuuucaucuacagauggcuucauaaaagccauucuccuuauucugaaaaaaguccaagugguaguua

SEQ ID NO: 4119708 - RNA, 77 nt, Human
uagcuuaaggaagagucuagaacaggcaacucucuuaacugguuguuagccuuaguucagauucagccucaaggcua

SEQ ID NO: 4119709 - RNA, 101 nt, Human
uagcuuaccuggaugguguugcuuguuuuugucuuacagauccccuaugcagcaaguuugaucaggaaagaaaagcuuggcgcccaucucagcaaaagcua

SEQ ID NO: 4119710 - RNA, 65 nt, Human
uagcuuagggacaaagagcugaggccuuuacuauagcagagcuccugcucuuugucccuaagcua

SEQ ID NO: 4119711 - RNA, 96 nt, Human
uagcuucaguggcccuagacacauuuaaccuucuaagggauguucccuuaagaauaucccuuaggagguuaaaugugucuagggccacugaagcua

SEQ ID NO: 4119712 - RNA, 70 nt, Human
uagcuuccacacuucuauucagugaugcuuagaauuaacucaggcuucugucuuuaggaguugguagcug

SEQ ID NO: 4119713 - RNA, 75 nt, Human
uagcuucuaugauccacuccucugugucucauggguggggaagcagcuggggacaugggagggacauggaggcug

SEQ ID NO: 4119714 - RNA, 85 nt, Human
uagcuucuugcuguuugugcucuucaagggauuaucagaguugagccccacaucuggagcagcauucauccagcagucgaggcua

SEQ ID NO: 4119715 - RNA, 75 nt, Human
uagcuugacuuuucucagcugcacuguauuacaccugagucauuugaauugcagcugggaaagaaaaaucaguug

SEQ ID NO: 4119716 - RNA, 58 nt, Human
uagcuuggucaucguggcuguuggacaagaugcuaaagcagccacagccaccaagcua

SEQ ID NO: 4119717 - RNA, 82 nt, Human
uagcuugguugcuuaauaaaguuagauacugagaauugaugaaauuuuaaauccagcuucuaauuuagaguucccagaguua

SEQ ID NO: 4119718 - RNA, 73 nt, Human
uagcuuucuggagcaagugaccuuuacgcugauaucugaaaaucaagaaggaguuauuuauucaaaggagcua

SEQ ID NO: 4119719 - RNA, 56 nt, Human
uagcuuugcccgugcuggauuuaaacacaguggaaaccaaguuaagggcagugcug

SEQ ID NO: 4119720 - RNA, 79 nt, Human
uagcuuuuacuuacucuuuuauaaagcaucuugauguacacuuauucucaaggugcaauggaacugauagugaagggua

SEQ ID NO: 4119721 - RNA, 66 nt, Human
uaggaaaaauacagaauuauaugacacugugugugugugucuguguguguguguguguuucuccug

SEQ ID NO: 4119722 - RNA, 63 nt, Human
uaggaaagcaugagccuuguucuuaaugagcucaaucagaaagaggucauguugcacaaccua

SEQ ID NO: 4119723 - RNA, 94 nt, Human
uaggaaaggguucaugaagcuccagcccuaguacagcuggcguccauccuccgccugucgcugccaacagggcugggagauggccacucuccug

SEQ ID NO: 4119724 - RNA, 84 nt, Human
uaggaaaugcauuagcuacauaugucuuucuguggaugucugugauugucauccucuagacagauguggcuaugagguucacua

SEQ ID NO: 4119725 - RNA, 78 nt, Human
uaggaaauguuuuccccaaaugaucuucccuuguauagucaggaugaacggaagauugggcaaaagacauaaaucuua

SEQ ID NO: 4119726 - RNA, 55 nt, Human
uaggaaccagagcacucugggcacaggaauuuuuggccaguagccugguauucug

SEQ ID NO: 4119727 - RNA, 90 nt, Human
uaggaaccuuugcuccauucaacacuguauuccauuggacaaacacgcaguggccauuaaacauuguuuggaggagugagaggguuccug

SEQ ID NO: 4119728 - RNA, 80 nt, Human
uaggaagauaaaauaacuauggaauacuccuuuauauuuauaagccuaagaggaaccagaaguucauuuugugcuuccua

SEQ ID NO: 4119729 - RNA, 78 nt, Human
uaggaaggauaagggagaagaugcaaugagaggauauauuuuuucuucucuguagcagcuuccuuccugaccucucua

SEQ ID NO: 4119730 - RNA, 70 nt, Human
uaggaagguguuuuuaaggagcaguugcauucuuuccucuucugccuucuccuuccccugcgccacccua

SEQ ID NO: 4119731 - RNA, 66 nt, Human
uaggaauaugcaggguaaguuaggaagaauuuaaauauguugguuacuauuaucuugcuguuucua

SEQ ID NO: 4119732 - RNA, 55 nt, Human
uaggacaauuuauaaugaaugggugauguucauucugucacuuaagaauugccua

SEQ ID NO: 4119733 - RNA, 57 nt, Human
uaggaccaggggcugccaggaauucagcagggggcacuuugggggucccugguucug

SEQ ID NO: 4119734 - RNA, 59 nt, Human
uaggaccccugugguagaugggcuucauaauaucuauuuucauaaaacagaggucucug

SEQ ID NO: 4119735 - RNA, 61 nt, Human
uaggacuggguccccuuuggaggucacacugauugauuagugcucucuggggacaguucua

SEQ ID NO: 4119736 - RNA, 67 nt, Human
uaggagaggugaauggcacacuaaaucuuuuuggcuuccaugugaaauucuuuggcaaccucuuuug

SEQ ID NO: 4119737 - RNA, 57 nt, Human
uaggagcugcagucugacauacgaggacaaauggucacucuucccagacugcaccug

SEQ ID NO: 4119738 - RNA, 118 nt, Human
uaggagcuuacuugccuccccccugggcugagcacauacugacagcagggagccugccuuguucaacucuguauccucagccccugcugcagggccugggacauuuacauguucacua

SEQ ID NO: 4119739 - RNA, 66 nt, Human
uaggaggaauaugaaagggaggaaugaauguuauuagugcauuuacaccuucuucgauucucccug

SEQ ID NO: 4119740 - RNA, 88 nt, Human
uaggaggcugcuucucugcagaucucccaugugcuguccuagacaugucccuguggaagacugccagagucgcagauaacaccuucua

SEQ ID NO: 4119741 - RNA, 75 nt, Human
uaggagugaguuuuggauaaaaauguuuaaguguccuggugaccuuucaguuuuuguuuccaaagccauagacua

SEQ ID NO: 4119742 - RNA, 94 nt, Human
uaggagugauuagaaauaggacagugggauauagauuuaaggcuuuuggcaaaguugaaacuuguucucuugugccuauccccuagaauuccug

SEQ ID NO: 4119743 - RNA, 69 nt, Human
uaggagugcuaucggcuuagcuccugagaugaugccuaaaguugcaagagaauaucgauagcacucuug

SEQ ID NO: 4119744 - RNA, 60 nt, Human
uaggauaacccucacucagaggugguucccuaagaccucuauugcuuguaggucauccug

SEQ ID NO: 4119745 - RNA, 69 nt, Human
uaggauaauagaacucgggcuuuggaaucccucagaccaggguucaaguccaaguucugauacuucuua

SEQ ID NO: 4119746 - RNA, 66 nt, Human
uaggauagaugcugaauggguuaacuugaauuuuauuaugucauugaagacccaggcucuaucuug

SEQ ID NO: 4119747 - RNA, 55 nt, Human
uaggaucugguuacguaagagucuuuuauugaaggcuguauuugauugagaccug

SEQ ID NO: 4119748 - RNA, 56 nt, Human
uaggaugaaagugacugucagguaaagaagcaucuuccagugauuaauucaucuua

SEQ ID NO: 4119749 - RNA, 80 nt, Human
uaggaugccauuuaucacuguucagacuaaaaaaaaucuagaggcaaguuagucuguggcaugaggaaauaggcacucua

SEQ ID NO: 4119750 - RNA, 67 nt, Human
uaggauuauuuguucuauuucuguaagcaaugccacuggaauuuugauaggaauggaauuaauucug

SEQ ID NO: 4119751 - RNA, 76 nt, Human
uaggcaaggccuaaucauacugcuaagugacacauaguauaggugcuauuagauguuugacugggccuuaugucua

SEQ ID NO: 4119752 - RNA, 59 nt, Human
uaggcagaaaggaaggcaaguuuuuauaacuuugucuaaaugaacuuucuaaaugccug

SEQ ID NO: 4119753 - RNA, 63 nt, Human
uaggcagcugguucuuuccauuaaacuuuauuacuuugauguugcugaaagaauuauugucug

SEQ ID NO: 4119754 - RNA, 72 nt, Human
uaggcaucucagagauauagucccugcuuccgugaauggggaaacugaggcagagaguccugcaggagucug

SEQ ID NO: 4119755 - RNA, 58 nt, Human
uaggcaugagcuauuuguagacagaaggaaaaacagugaacuaaauggcuuaggcuua

SEQ ID NO: 4119756 - RNA, 121 nt, Human
uaggcaugcuugaguacugaguaaggagcaguguuuugauucugggagccagaucauccuaaacacauggagguagcugaggaugggaacuuggccuugacucacaaacuuaaugugcuua

SEQ ID NO: 4119757 - RNA, 59 nt, Human
uaggccacaaauaagauccuguggguauugguucucccuuaucauuauaauguggccug

SEQ ID NO: 4119758 - RNA, 62 nt, Human
uaggccagauuguuauccaugguugagcaugacucugcaauagaaacuaacaauuuggcuua

SEQ ID NO: 4119759 - RNA, 69 nt, Human
uaggccucuagguuguagccuuaauugccaugggcauuggcucaugcauggauauauacccuaggccug

SEQ ID NO: 4119760 - RNA, 57 nt, Human
uaggcucacauagcacuaagugucuuugaggcauugcaguugucuauguugagucua

SEQ ID NO: 4119761 - RNA, 58 nt, Human
uaggcuccaguguguggcgaguguucauuuauaggcagcgcucggcauggggagucug

SEQ ID NO: 4119762 - RNA, 120 nt, Human
uaggcugacuggcuuuuuuaggguaggugagaggagaagcacuuuacuuuggggugcccacauccacauuagaauguuuucucaauuucuuucucuuacuuuuuugagauuuuaggccua

SEQ ID NO: 4119763 - RNA, 67 nt, Human
uaggcuggaacuuaggcagaggcagucuagagaaaaaauuccuucuucuuucugaaaucucagucug

SEQ ID NO: 4119764 - RNA, 101 nt, Human
uaggcugggucagggucccccaggagcuggcauguggagagcugacacuuaaccaguucucacucuuugugcaggcucuuggcaaugccccacccacccug

SEQ ID NO: 4119765 - RNA, 77 nt, Human
uaggcuggugcaaaaguaauugcaguuuucgccauugagaguaauggcaaaacugcaauuacuuuugcaccaaccua

SEQ ID NO: 4119766 - RNA, 72 nt, Human
uaaugucuuuaagagcauuggguggaaaagagauguaccaacacacacaauguucugcacauggagucauua

SEQ ID NO: 4119767 - RNA, 104 nt, Human
uaauguucucuccaaacgugguuaauguacaauaagacaaagaggugauuuucagauccuuuuguuguuguuguuauucaaaccuaauguuugggauuucauua

SEQ ID NO: 4119768 - RNA, 79 nt, Human
uaauuacuggagcuagacuuuccagccugcugcuucuucuuacaucaagacagaggucauggagaguucucuggaauug

SEQ ID NO: 4119769 - RNA, 63 nt, Human
uaggguaguaaaggaguuacucauaaagcuuuauuaagugaugucaagacuccuuccucccug

SEQ ID NO: 4119770 - RNA, 84 nt, Human
uagggucuagaugaauucuggcuuggacagaaucugcaucucaugccucucaguucucucccggaacgucauucuggaauccug

SEQ ID NO: 4119771 - RNA, 65 nt, Human
uagggucucccuuuaaucuaacuaaggcucucuaagccccuguuggucccugaagagagaccuug

SEQ ID NO: 4119772 - RNA, 69 nt, Human
uagggugcuaagaugguggccagaguggaaaggacaccuuuuugucacccuggucaccaugguaugcug

SEQ ID NO: 4119773 - RNA, 66 nt, Human
uaggguggccuguaaccagcuugggaugugucuaguacaucugaaagggauugcagaaucacccug

SEQ ID NO: 4119774 - RNA, 69 nt, Human
uaggguuuauugucucucuugcuagauguuacuaaguaaacacagcuggcaucgagcauuugaacucua

SEQ ID NO: 4119775 - RNA, 101 nt, Human
uagguaaaauauauauugagaaugaaccauaguuaguuacacauggguagggaauuaaauucucacauugagugauuaucuguuucguucauaauaaccua

SEQ ID NO: 4119776 - RNA, 78 nt, Human
uagguaacuuggugcaaguaugacagccccaugguaucaccaggaucccagcuuuuuucauuuugcaucaccauccua

SEQ ID NO: 4119777 - RNA, 57 nt, Human
uagguacaaugucuuacagacccaguggaucuuggugugacuaaggcagugugaaua

SEQ ID NO: 4119778 - RNA, 71 nt, Human
uagguaccucauaaauacuacuaugagagauaaauaagauaguuacauauaaaguguuuauguagugccua

SEQ ID NO: 4119779 - RNA, 62 nt, Human
uagguauauuuuuucaguuuuaagcugcaucauggcagugaguuaacuguugaaauagcuug

SEQ ID NO: 4119780 - RNA, 100 nt, Human
uagguaucccaaggguuguuuuguccagaacacagacugacuucuucaacuacgcgggacugcaguggucugugcuucuguacacgacacccaccaccua

SEQ ID NO: 4119781 - RNA, 98 nt, Human
uagguaugcauacaugguuguugugccuguguacacacacacaaggguguguacaugugugcaagggcauguacauugaagugugugcuucagcacua

SEQ ID NO: 4119782 - RNA, 87 nt, Human
uagguauguuuugcguuuauuccaagacagcaggcuuuauuuuccuguaaacauaucagacuuucuugaaugaaugagaauaaccug

SEQ ID NO: 4119783 - RNA, 73 nt, Human
uaggucagaacaagcaguaucguugacauucugaaacaccagccaugucccagacacugcuuacucugaccua

SEQ ID NO: 4119784 - RNA, 86 nt, Human
uaggucagauaaagauggucuacagagagaaaugaagcagacuuuuucuguuucauuuacaucuguagguacucuugccccaccua

SEQ ID NO: 4119785 - RNA, 112 nt, Human
uaggucauagcaaagaaaugaaugguguagcugucagucauaagggaagucuggggaaaacagcccugguugcuggcaacugacuagaugcguuugcuuugugcugacauua

SEQ ID NO: 4119786 - RNA, 62 nt, Human
uaggucugcccuggguggaggcgcugcccuagguggugggucugcacuggguggcgggucug

SEQ ID NO: 4119787 - RNA, 57 nt, Human
uaggucuuagaacacaggaucagaacuaucuguugccugagcaacuucaagggccug

SEQ ID NO: 4119788 - RNA, 61 nt, Human
uaggugcccucugagaugauucacugcacccgugggugggauccucagcucagagcaccug

SEQ ID NO: 4119789 - RNA, 95 nt, Human
uagguguguccagccugagaguccaggcucuuccugaagaagaggucccacuccugcuguuuacggaaaagccuggggcucagcaacagcgccua

SEQ ID NO: 4119790 - RNA, 100 nt, Human
uagguguguugucaauaugcuauguauguaaaugaguuuuagcauucuuacaguuucccugcuucucuuucauuaaaguguuuuugauaacuaguuucua

SEQ ID NO: 4119791 - RNA, 70 nt, Human
uagguucagagaacugaaaauauuuuaguaaauuggcuauaaaaauguauguuuuccagucuugaacuug

SEQ ID NO: 4119792 - RNA, 62 nt, Human
uagguuccucaguuguaaaaaaugugccucucuggugggggauguugauaauggggaggcug

SEQ ID NO: 4119793 - RNA, 67 nt, Human
uagguucuaagccacagccauuuuuccuuauuuauuucuggcaaaauuugguguuguuuggagccua

SEQ ID NO: 4119794 - RNA, 78 nt, Human
uagguuggugcaaaaguaauugugguuuuugucauugaaaguaauugaaaaaacugcaauaacuuuugcaccaagcua

SEQ ID NO: 4119795 - RNA, 73 nt, Human
uagguuggugcaaaaguaauuugguuuuugucauuucagugacaaaaccugcaaucauuuuugcaccaaccua

SEQ ID NO: 4119796 - RNA, 59 nt, Human
uagguuggugcaaaaguuauugcguuuuuugccauuuacuuucaauuugcacuaaccua

SEQ ID NO: 4119797 - RNA, 79 nt, Human
uagguuggugcagaaguaauugcuguuuuugccauuacuuuuaaauggcaaaacccacaauuauaucuguaccaaccua

SEQ ID NO: 4119798 - RNA, 81 nt, Human
uagguuggugcugaaucuguuauuuucuggugguaugauaacaauauucaacuagauuuauacaauuccauaucuugcuua

SEQ ID NO: 4119799 - RNA, 78 nt, Human
uagguuugauguuauuucugaaagaucauuggcauauccuccagcuuguauuuucuuagaagcaacugauaaaaccug

SEQ ID NO: 4119800 - RNA, 59 nt, Human
uaguaacacacugguauuuggaaucucacuguuuugcuguuuugaagcuagguguacug

SEQ ID NO: 4119801 - RNA, 66 nt, Human
uaguaaggcuuaugaucagaagguucaaaguucucuacuagaucaucugaaaaugggucugugcua

SEQ ID NO: 4119802 - RNA, 56 nt, Human
uaguaaguacucaccacuuuacgugauaauaaucaucauuguuaugggugcuacua

SEQ ID NO: 4119803 - RNA, 67 nt, Human
uaguaagucauggagcugggauugagcccagggcaaucaguuccagaguccacaguccugacuacua

SEQ ID NO: 4119804 - RNA, 129 nt, Human
uaguaauauaucacaagucuuugccacuccugcauuuggaaagagacuagagaaagaaacugaaaguuguaguucauagccuuuucugugauucaggacaauaaaguaggcauaauuuggcuauguuua

SEQ ID NO: 4119805 - RNA, 55 nt, Human
uaguagcuagcauauugggcaguguggucauagaccuucagugugcuggcuccug

SEQ ID NO: 4119806 - RNA, 98 nt, Human
uaguagguguacaguuuccacuggcucugguaacagaaugcucacucacauagucugucccugagagcucaggagcugggagcugugcacgcugacug

SEQ ID NO: 4119807 - RNA, 78 nt, Human
uaguaguggaggagaucaagcacuuuagugagaauaagggcaaugucucuuuucucucaaauugcuugccuuaugcua

SEQ ID NO: 4119808 - RNA, 81 nt, Human
uaguaguucucuggauguuucucagucacucugauuggccuaguccuauuuaucugacuucuaaacauuagaguugcucua

SEQ ID NO: 4119809 - RNA, 70 nt, Human
uaguauauacguauauuccaaaggguauuuaguaaggaaaagacuugauccuaugugguauauguuacua

SEQ ID NO: 4119810 - RNA, 57 nt, Human
uaguaugucuuacucuaauacacacauucauauaucuguguguauguggauacacua

SEQ ID NO: 4119811 - RNA, 63 nt, Human
uaguauuauuugaaugauggcacaauuuuuaaagaagaauugugcauuuuuaaaucacggcua

SEQ ID NO: 4119812 - RNA, 62 nt, Human
uagucaaaccucagaauaccccugugcuaugcuuaugggugaucuuuuucugagauuuacua

SEQ ID NO: 4119813 - RNA, 85 nt, Human
uagucaauuuagaguucaauuaguuggauaaauaacauuuguaaugguuaucugucugacaggguaugaacuaaauaacugacua

SEQ ID NO: 4119814 - RNA, 68 nt, Human
uagucauuaaacaguaauuguaaaauguagugagauuaucagcccaugcaaacaacuguuuaaugcug

SEQ ID NO: 4119815 - RNA, 76 nt, Human
uagucauucagguguagguuguucaguuuccauguaguucugugguuuugagugagugucuuacuccugaguucua

SEQ ID NO: 4119816 - RNA, 60 nt, Human
uaguccacagacucuacagcaucauggccccaagucuauugcauggaauucuggggacua

SEQ ID NO: 4119817 - RNA, 71 nt, Human
uaguccugaccagcuggauguuucauuacacauuggaaucuguauuucagcuggcaucucaggagaaucua

SEQ ID NO: 4119818 - RNA, 72 nt, Human
uaguccugccccagguggauggcucgcauagcuccacaggcuuugugaacuugucuggcugggccagaccug

SEQ ID NO: 4119819 - RNA, 58 nt, Human
uaguccugggagaugggacccugaaguuccugccucaguucugccauccccagcacug

SEQ ID NO: 4119820 - RNA, 78 nt, Human
uacagggacaaaacucagugcagaagagcccucuugagcacucuccuuaacucuucuacacugaguuuuuucccugua

SEQ ID NO: 4119821 - RNA, 59 nt, Human
uacagggacaagauguuuagaaauguguacuugguuuuccucagacucugucccaugua

SEQ ID NO: 4119822 - RNA, 57 nt, Human
uacagggaccaauaauaacuauagaacagugcuguauaaauguugggcauccuugua

SEQ ID NO: 4119823 - RNA, 88 nt, Human
uacagggacuauuuaggggccaggccuucugggagccucuuuggaccaagugugucaggaggccugaguagcucuagaaagccaugug

SEQ ID NO: 4119824 - RNA, 103 nt, Human
uacagggguugagggaccaggccuggccggggcugauggacaguggggacuuuccuucucuccaugauggcuuugcaggggcuccaugguccuucucucugug

SEQ ID NO: 4119825 - RNA, 60 nt, Human
uacagguggucuuugcuccuuuuggccgggaguuggaccaaagggcagcuggcuucugug

SEQ ID NO: 4119826 - RNA, 83 nt, Human
uacaguaaaaguuacuuaugcagauucuagaagugggcuacuuggguuugaaucugaguuccaccauuuaggaucugucugua

SEQ ID NO: 4119827 - RNA, 59 nt, Human
uacaguagaaugcggugccaguggaaaaauccuacucagcauaucuaaauucuaaugug

SEQ ID NO: 4119828 - RNA, 61 nt, Human
uacaguagacaggaccacaggcaugaguguuagacugggcugggguuaaacugucacugug

SEQ ID NO: 4119829 - RNA, 59 nt, Human
uacagucaagcauaagaagucauacuaaaugaugauaucuaaaggaaugcuugauugug

SEQ ID NO: 4119830 - RNA, 69 nt, Human
uacagugaccuagaauaaauacaauggcaguaucuuuuuuguucuaagguuauuuuuaguuucacugug

SEQ ID NO: 4119831 - RNA, 61 nt, Human
uacagugaguggcagagccagagauucaaaccuaggucuuugugccccuaucacucaugua

SEQ ID NO: 4119832 - RNA, 56 nt, Human
uacagugcuagaaccugcuguaaugaaagaaguggcagcagaguaaugcauucgua

SEQ ID NO: 4119833 - RNA, 60 nt, Human
uacagugugcugugauguaguauacaauaauagaguguaauauagcauuguaugacugug

SEQ ID NO: 4119834 - RNA, 67 nt, Human
uacaguuguuuuuugguuguguuucugguuggauaauccagaucagacuuugugacuaggagcugua

SEQ ID NO: 4119835 - RNA, 61 nt, Human
uacaguuucucauuaugcucuccagucuaguccauguguugagcagagugagguagcugug

SEQ ID NO: 4119836 - RNA, 123 nt, Human
uacauaauaaaaacaagaggcugguuaauguucuuuguuauguguacaucugguugagcagaauauugcuuagcuuuuuaccaucaaaguuacacuuuugacucagcacaugcuuugaaugua

SEQ ID NO: 4119837 - RNA, 68 nt, Human
uacauauggaauuuggagauuaggcauugagucauuuaacucucugugcccauuuaagucuuugugua

SEQ ID NO: 4119838 - RNA, 77 nt, Human
uacaucugucuccucaucgccuguucacucacugagacacccguaagugccacuacagagaggaggagagagcugug

SEQ ID NO: 4119839 - RNA, 67 nt, Human
uacaugaagacaucuggaauccugaguaguuggcaagauugaaucaggaguacuggugucuacagua

SEQ ID NO: 4119840 - RNA, 116 nt, Human
uacaugauaaagaaacuguagagggaagagaaauuugaaauugaagauauuuacccaucuuccaaugguuucuagauuuuuccuacuuucuuucugaccugaaauuuuuucauuua

SEQ ID NO: 4119841 - RNA, 69 nt, Human
uacaugaucagcuaauuagaauuaggaucagauugagugguucuuuuucaggacugguugacucgugug

SEQ ID NO: 4119842 - RNA, 88 nt, Human
uacaugcagacaaagauuaagguauuguuagcucaaagaaggaguuuacuugagagcuaugaauuauuuuaauaacuuugcuguagua

SEQ ID NO: 4119843 - RNA, 120 nt, Human
uacauggugauaccauagcguguuuaacuguucauguauugaaaagcauuuuaauugcuuccaguuuugguuuuguuuccuaauaaugauuguuuccaagcugcuaugaagaaucaugua

SEQ ID NO: 4119844 - RNA, 67 nt, Human
ugaucuguuauacaacaaguaacagggccuugucagugcauuguuuucuuguauauagccucgguca

SEQ ID NO: 4119845 - RNA, 64 nt, Human
ugaucuuuucccuuuuagucuuuuuggaacacuucuuuggcgcccuaacaggggaaaaugauca

SEQ ID NO: 4119846 - RNA, 57 nt, Human
ugaucuuuuuggucauuuggguuaguuugcacuucucccaggagaagaaaagaugca

SEQ ID NO: 4119847 - RNA, 112 nt, Human
ugaugaaacugccacaccaagagguuaguaaaugaguucaaagucaaggaaacugugagugacagagccagacuuugaacucagcagccucauuccaucgucagugcuauua

SEQ ID NO: 4119848 - RNA, 76 nt, Human
ugaugaaguaauaaacucuuuuuaucucccuaauucccuucccucauagggcaagguaaagauuuauugaguguca

SEQ ID NO: 4119849 - RNA, 65 nt, Human
ugaugaauguuugauauguuggcuuccuccagaauauauggaaguuucuauuauuacauucguua

SEQ ID NO: 4119850 - RNA, 60 nt, Human
ugaugacuuaaggacaaacucaccuuucaaccaaagaaucgaguuucccuggagacauca

SEQ ID NO: 4119851 - RNA, 69 nt, Human
ugaugaggcauaugcuacacauuugugggaagaaugccacaagguagugugucacauugcaucucauua

SEQ ID NO: 4119852 - RNA, 69 nt, Human
ugaugaguuuggagucugagcuuuaaagcccacauucagaaagagaagccaggcuccugaggcugguca

SEQ ID NO: 4119853 - RNA, 78 nt, Human
ugaugauuacacugaguuaggccccugcugauggcagcacuccugcugcagcggcauggucuuuggggauaauauuca

SEQ ID NO: 4119854 - RNA, 61 nt, Human
ugaugcccugagccaccaaugccauuucccagcaggacuaguaggcauggcuggggcagca

SEQ ID NO: 4119855 - RNA, 72 nt, Human
ugaugccugauauuagaaagguaucucugcauacuuacuggguugcugagagugcucuuugaugucacauca

SEQ ID NO: 4119856 - RNA, 60 nt, Human
ugaugcgaacuuucugauggugcaaaggaacauccuucaccaugcacagcuguucuauua

SEQ ID NO: 4119857 - RNA, 55 nt, Human
ugaugcuucacgcugaauaugcuacaaaugauguagcaucaggugguuuggcaca

SEQ ID NO: 4119858 - RNA, 81 nt, Human
ugaugcuuuauucauucgauuuaaccuaguuccagucuuccagauucuuucuagugagucugaaugaguugcccaggguca

SEQ ID NO: 4119859 - RNA, 69 nt, Human
ugauggaaauguuccugaucccugauuucauggacaagcugaaaucaguguguaaauauuuugccauca

SEQ ID NO: 4119860 - RNA, 69 nt, Human
ugauggcacacaggagagugcuggagguuagugucaguuuaucuuaucucuguacuuccuguugccuca

SEQ ID NO: 4119861 - RNA, 65 nt, Human
ugauggccuacuuuccaggcaggaaugauauuaaaaauauuuagcaaccugugacagaggcauca

SEQ ID NO: 4119862 - RNA, 83 nt, Human
ugaugggagguaaaaugagucuccauuauaugccaccuuuauuaggcaaaguaauuuuuaguucauucuaucuuguccuguca

SEQ ID NO: 4119863 - RNA, 58 nt, Human
ugaugguuuaugauagaugggaaauaguuaacuuuuuccuauuaauguuaaccaguca

SEQ ID NO: 4119864 - RNA, 87 nt, Human
ugaugguuugggggaaaauacugguuuuggagaugcugauuguuuccaaucuaagcaguuuuguucaguguuuuccccaaauuguca

SEQ ID NO: 4119865 - RNA, 65 nt, Human
ugauguaagcacuuucaacucuggaucucccauucacaugucugguuggaggugcagugcaugca

SEQ ID NO: 4119866 - RNA, 59 nt, Human
ugauguaucugagcugcuuagguuuaugaaaggucaccuggauauuuucaguugcauca

SEQ ID NO: 4119867 - RNA, 91 nt, Human
ugaugucgguauuuacuuuguguuuauauguguaaguguauguucauauauacuuucaugucuauacauauuuauguacuucuaugcauca

SEQ ID NO: 4119868 - RNA, 67 nt, Human
ugaugugacucaggaauuccacagcuguuggucagccuggcaguucugggcauaucuagucacaucg

SEQ ID NO: 4119869 - RNA, 64 nt, Human
ugauguguaguuggcuaucauuuguuuuuaaaaguaaggaggaauacaauccagcagcacuuca

SEQ ID NO: 4119870 - RNA, 87 nt, Human
ugauguguugucagaucaaugauauguauguugucaaaaacauguauguucaagcaaugauuauggccuuuauacccuagcacauua

SEQ ID NO: 4119871 - RNA, 101 nt, Human
ugauguucauggauauuucgaugaagagugagauauuccucauuacaauuauucccaugcgauguuuauuucauucuuuaucaggagcuguuuugucauca

SEQ ID NO: 4119872 - RNA, 70 nt, Human
ugauguugcuuaauacaauggauagcagcuuuuuaaaacaggcaaagcucuuuuccaaguauugacguca

SEQ ID NO: 4119873 - RNA, 98 nt, Human
ugauuaaagcuuuuuagaaaccaaauguuacacauaggcauaaauggagcaaaauauuuuaaugcguguuuggcagguucagaaacacuuuauaguca

SEQ ID NO: 4119874 - RNA, 74 nt, Human
ugauuaacaaugugggauuuacaaagaaaaauaauaguaauaaucuacugaacuuggugaaugccacaugauca

SEQ ID NO: 4119875 - RNA, 77 nt, Human
ugauuacuuaagacaauaaucuuugaguagaguugagcuauagcuuaagacaggcucaaagauuaaugugguuuuca

SEQ ID NO: 4119876 - RNA, 59 nt, Human
ugagcaguggggccugcauucugccacccccauuugaaaaccaugcccuagcuagcuca

SEQ ID NO: 4119877 - RNA, 66 nt, Human
ugagcaucacaugagcuaagacauguaaagugcauaagagcagugucuggcucauggugggucuca

SEQ ID NO: 4119878 - RNA, 125 nt, Human
ugagcaucuagagaggggaguguuuucaggaagggauagacgguaauauaguagggcgcauagacuugccauauugcaaagugucugccaagaguccuccugaauaauucuucauuuaggucuca

SEQ ID NO: 4119879 - RNA, 130 nt, Human
ugagcaucugccucacuauggauuaugcuguauuugcuuucugacaaaagguaauguuagaaaauaucuaacauuguuuuucacagauuaugaacaaaccugcugcuaaaucauagacaaauugugcuca

SEQ ID NO: 4119880 - RNA, 90 nt, Human
ugagccacugcgcccggccugcucucuguucuuaagcuuguaaauaacaaaaccaggagaugugggcugaacgguuuaguguagugauca

SEQ ID NO: 4119881 - RNA, 61 nt, Human
ugagccagccuucuucugaggucaguggaaagagcucagaaugggagggguugacugcuca

SEQ ID NO: 4119882 - RNA, 56 nt, Human
ugagcccauguagcacuuccauugaugucuuuggagcggccuugcacaugggcuca

SEQ ID NO: 4119883 - RNA, 58 nt, Human
ugagccccaggaaauugaggagaggcagagauagcugcugcuccucccuaagggcuca

SEQ ID NO: 4119884 - RNA, 61 nt, Human
ugagcuagaagcaguaauagaaauaggagcauguauggaacucuccuuuauuguuugcuca

SEQ ID NO: 4119885 - RNA, 61 nt, Human
ugagcucaagccauccuucugccucagccuugugaggagcuagaacuauggcuaugugcca

SEQ ID NO: 4119886 - RNA, 61 nt, Human
ugagcuccugauucucagagauagagacuaaucaugucuuuguuugcugcuuuaggguuua

SEQ ID NO: 4119887 - RNA, 56 nt, Human
ugagcuccuggugagaggggauaccagugaagacuaucccagcacccaggagugca

SEQ ID NO: 4119888 - RNA, 58 nt, Human
ugagcugagaucgcgccauugcacuccagccugggugacagggcgagacucagucuca

SEQ ID NO: 4119889 - RNA, 58 nt, Human
ugagcugagaucgugccauugcacuucagccugggugacaaagcgagacuccagcuca

SEQ ID NO: 4119890 - RNA, 99 nt, Human
ugagcugagucuucacagacauugcagacugaacccauuaaaacuggguugcugugucuuaguuugcaggguguucagagugacaaggcacaugucuca

SEQ ID NO: 4119891 - RNA, 67 nt, Human
ugagcuucaggaccauuucaggcaaugguuaauuaacuauaggugucccuuuguguucugaaacucg

SEQ ID NO: 4119892 - RNA, 82 nt, Human
ugagcuuccaguggaauauauaggggauuugagucaacauuugaucuccuucuaaagucccuuccuauauugcagaggcuua

SEQ ID NO: 4119893 - RNA, 94 nt, Human
ugagcuugaggaauccacaauuuuaugauuuaggagccugcuuugcauaacacugguuucacuuuccugggaguugaagugauuuucaggcuua

SEQ ID NO: 4119894 - RNA, 67 nt, Human
ugagcuugcugaaagucccaaaucucaugaaguaaaaucuuucaugauugauucucugcagguauca

SEQ ID NO: 4119895 - RNA, 89 nt, Human
ugagcuuggcaaagccauugcuuguucuggcggccaguauucauuugugggccuguccuauacaggcggcugcugugcccugagguuca

SEQ ID NO: 4119896 - RNA, 76 nt, Human
ugagcuuuccuaucauccuccagugguuuauucauuuauuuauuuauuaaacuguuggcacagaaaggaaaguuca

SEQ ID NO: 4119897 - RNA, 117 nt, Human
ugaggaaacugaggcucagagaggguaaauugccuaaggucagacagcuauaaacagauggaacuggaguuugaaccaggaacaauuagcucuuuauuccaaaccucauuuucuuua

SEQ ID NO: 4119898 - RNA, 85 nt, Human
ugaggaaauuuuacuuuggauacaguacuuugcagugcagauaaaaacauuuaagcagguaaauuaucaaagguagagaauauca

SEQ ID NO: 4119899 - RNA, 63 nt, Human
ugaggaagagaacagucaccaugcacagagcauuucugugugccaggcacuguauucaccuca

SEQ ID NO: 4119900 - RNA, 88 nt, Human
ugaggaagggccucuacuuccuucagagccuuuaacaaagagccccagacaaccuaaaggcucuaacaaggagagagacuggucuuua

SEQ ID NO: 4119901 - RNA, 64 nt, Human
ugaggaaguuguuucucuucuaaaaccuggucaguagagacuggaggagaugacugcuucuuua

SEQ ID NO: 4119902 - RNA, 73 nt, Human
ugaggaauaauugucguagcugguauuuauugaacaauuacuacaugcuagguacagaucuaaauucuccuca

SEQ ID NO: 4119903 - RNA, 71 nt, Human
ugaggacaccucuucuguuugcuuuacucaucacagauucaugaauaaagacaaacaggggagccaccuca

SEQ ID NO: 4119904 - RNA, 64 nt, Human
ugaggagaccagggcuuacagcaguagcuaacuuaguagcuuugugaccauggccuaggccuca

SEQ ID NO: 4119905 - RNA, 65 nt, Human
ugaggaggcagccuaucccuuagcagagcucaagcacugugcuaggugauccacugcucucuuca

SEQ ID NO: 4119906 - RNA, 66 nt, Human
ugaggaggggccacagagcagaaggcuguaaguacuuggucuccaguguucugucgucuuucuuca

SEQ ID NO: 4119907 - RNA, 66 nt, Human
ugaggauauuuguuuuucuuucuuaaagcuacaguucagagcuugggaaugcuaacagaugacuca

SEQ ID NO: 4119908 - RNA, 69 nt, Human
ugaggaucauuuuagucuagucuccucagaaagcuuagcuccugagagaaguagcuugauuugagcuca

SEQ ID NO: 4119909 - RNA, 101 nt, Human
ugaggcacaauccauucauuuauucuuugucuuugcaauugaguuaacaaugugguaauuaacacugauuguagagacacuuagauaagauguguuacuca

SEQ ID NO: 4119910 - RNA, 68 nt, Human
ugaggcacauguguguauacguauuuauaagcauaacaauuuauagauacauuguuauauuugucuua

SEQ ID NO: 4119911 - RNA, 76 nt, Human
ugaggcaccacugcacugcauccugggcaaaagggucucacucuguugcugaggacgcagugcaguggugccauca

SEQ ID NO: 4119912 - RNA, 101 nt, Human
ugaggcaggagaaucacuugaaccugggaggcggagguugcagugagcugagaucaugccacugcgcuccagccugggggacagagugagacucugucuca

SEQ ID NO: 4119913 - RNA, 100 nt, Human
ugaggcaggagaauugcuugaacccaagagguggagguugcagugagccuagauugcugccacugcacuccagccugggugacagcagaacucugucuca

SEQ ID NO: 4119914 - RNA, 101 nt, Human
ugaggcaggagaauugcuugaacccacgggguggagguugcagugagccgagaucaugccacuguacuccagccugggagacagaacaagacuccgucuca

SEQ ID NO: 4119915 - RNA, 101 nt, Human
ugaggcaggagaauugcuugaacccgggaggcggagguugcagugagccgagaucgugccauugcacuccagccuaggcgacagagcgagacucugucuca

SEQ ID NO: 4119916 - RNA, 101 nt, Human
ugaggcaggagaauugcuugaaccugggaggcagaggucgcagugagccaaaaucgugccauugcacuccugccugggcaagaaagcaagacucugucuca

SEQ ID NO: 4119917 - RNA, 100 nt, Human
ugaggcaggagaauugcuugaacucggaggcagagguugcagugagccgagaucacaccacugcacuccagccugcgcaacagagcgagacucugucuca

SEQ ID NO: 4119918 - RNA, 75 nt, Human
ugagcccagaagaguauguguuugcugcgcugaaccuguacacagacaucaucaacaucuuccuguacauccuca

SEQ ID NO: 4119919 - RNA, 55 nt, Human
ugagcccagucugucugacaugcaaccuugcccuucacaggucagccuggccuca

SEQ ID NO: 4119920 - RNA, 100 nt, Human
ugagcccuagaugcacaaaaauacaugugugugugugugugauaugucauuuuuuaucucacugcaaauauuauguauauaaauguuuucuuuuuacuca

SEQ ID NO: 4119921 - RNA, 78 nt, Human
ugagccugaguuaauucccagcuccagcguggagagggcucuguucacaggcuuggaggugggggacacggaggcuca

SEQ ID NO: 4119922 - RNA, 79 nt, Human
ugagccugugagccccaacuccauccaaggccugccugcaaucuggugccaccugauggcaguuguucccuccagcuua

SEQ ID NO: 4119923 - RNA, 89 nt, Human
ugagcgagaguguaggaccagaggggugggccugguuuaugucuguggcuaugggccaguuauuucaccucugugccuuccuuuccuca

SEQ ID NO: 4119924 - RNA, 68 nt, Human
ugagcuagguuuuccagucgcauggagcacuuucucacauauuccacgcuacugauuuaucucgcuua

SEQ ID NO: 4119925 - RNA, 82 nt, Human
ugagcucaaggcugugugccccagaugaguagcuugagugcacugaaucugcuuccuaauggggaacaagccacuugacuua

SEQ ID NO: 4119926 - RNA, 90 nt, Human
ugagcucagagccuuuccugcucuggcauucaugcaauagagaaugcuggaagcugagaucugccaugacaggggcaggcugcuggcuca

SEQ ID NO: 4119927 - RNA, 86 nt, Human
ugagcuccaagaagccaggcacugugccucgcucccugcugcaaacucagcaccgggcacggugucuggugcagacuagaugcuca

SEQ ID NO: 4119928 - RNA, 87 nt, Human
ugagguauuuacaaaauaaaucuguuguaauguuuuuuaguacaguuaauugaggaauggcgcaaauagaugacaguauuuacuuca

SEQ ID NO: 4119929 - RNA, 55 nt, Human
ugaggugauguggaaaaugaucccucucugagagagcaugcacuacuucaucuua

SEQ ID NO: 4119930 - RNA, 100 nt, Human
ugagguggagaaucgcuugaacccuggagguggagguugcagggaaccaagauugcaccacugcacuccacccugggugacagagcgagacucugucuca

SEQ ID NO: 4119931 - RNA, 86 nt, Human
ugagguggauaggaaaugcugucuuauuguaguuuuaauuugcauuucuuugauuacuaguaagauuggguauuuuucauaucuca

SEQ ID NO: 4119932 - RNA, 61 nt, Human
ugaggugugucugauguuguccacaguucccucccacaucugacagcacagaaauauuuca

SEQ ID NO: 4119933 - RNA, 67 nt, Human
ugaguaagagaaugucuggugcucaagaaauauaaaugcuuaaccuugaaacacagauuucuuacca

SEQ ID NO: 4119934 - RNA, 90 nt, Human
ugaguacauguacugggaucuguguucuaggaagacaccauaucucuugggcuuugguagacacagauugauuaggugccauguaucuca

SEQ ID NO: 4119935 - RNA, 118 nt, Human
ugaguaccauaacauggcuucacaaucuacacuggcacuguguuuagaugggauuggagccaaauaauucuauuugaauugucacaggcuaaagagaaaaagaauagagauggacuua

SEQ ID NO: 4119936 - RNA, 88 nt, Human
ugaguacguugacauuucaagauugaauacaguauuuccaaaaccaacugggauacaaauucaugucugaauuaaacaaaugugauua

SEQ ID NO: 4119937 - RNA, 130 nt, Human
ugaguacucaaaaaaaaaaaaaaagaugucuugaaacagcagaguggagaugagcaccuccuuugaugguaccagccugggugcugaucuucacuuggcugccugagacccugagcuuuucugagauuca

SEQ ID NO: 4119938 - RNA, 79 nt, Human
ugaguacucacaagaucugguuguguggcacuucccuuccccccucucuuugcccugcaccugccaugugagauacuua

SEQ ID NO: 4119939 - RNA, 68 nt, Human
ugaguacugggaccaaaaguugggcucuacuuccugaacucaaagagcuugcuuuucccaguacugca

SEQ ID NO: 4119940 - RNA, 61 nt, Human
ugaguagaguuuggcaauguaauauagcucaagucuauaacaucucccugacuuuugcuca

SEQ ID NO: 4119941 - RNA, 71 nt, Human
ugaguaggagaagcaaaagaauggccaaguuucaugauuucuguucugauacuuguuucuauguuugcuca

SEQ ID NO: 4119942 - RNA, 79 nt, Human
ugaguaguaacacuucccgaccauauggcugucucuaaaccuucauccuuagcaggugugugugggagugugauacaca

SEQ ID NO: 4119943 - RNA, 55 nt, Human
ugagucaccuugguauuggcaggggcugcuuuguucugcauugagggcugucuca

SEQ ID NO: 4119944 - RNA, 118 nt, Human
ugagucaguagaauaagauugcauaggcggauuuguggcuccaggaaguggcuugaacucaggcagucagguuucagagccugcaaucccaauuggcguucuauucgucuacuacuca

SEQ ID NO: 4119945 - RNA, 68 nt, Human
ugaguccuuggugcaauguauacugaugaaagaaaauuaaucagcuaauacauucuauuaagcauuua

SEQ ID NO: 4119946 - RNA, 92 nt, Human
ugagucuauuuucacccaaaggagcuugcuauuauucauguucacuggcugcugagugauucauacgcugcuuuuugggggagauguauuca

SEQ ID NO: 4119947 - RNA, 76 nt, Human
ugagucucuuaauugugugugcaugcacuguguguucauguguuuguguguauguaugcaugcuacaguuuucuca

SEQ ID NO: 4119948 - RNA, 60 nt, Human
ugagucugaagaauuagagaaggcuucuauuuaaauccuuugcaaaguuauuuagacuca

SEQ ID NO: 4119949 - RNA, 67 nt, Human
ugagucuucagcauagcauauggcuaagagauccaguucagagccagauugccugcuuuggaacuua

SEQ ID NO: 4119950 - RNA, 87 nt, Human
ugagucuucugcucuggucauaaguuuacaaucaaagugucagacaggcugcauuaucaucuggaagcuugacugggguaaaguuca

SEQ ID NO: 4119951 - RNA, 81 nt, Human
ugagugacugucuucucaguuucucuaggaugugacauaauuaguuccauucuagaagaacgagaaauauaaguuaauuca

SEQ ID NO: 4119952 - RNA, 61 nt, Human
ugagugccaucuuugccccuauuuuagggauaaggauucugaaauguggagaugguaagua

SEQ ID NO: 4119953 - RNA, 73 nt, Human
ugagugccauuucuggguaguaugguuaguuuuauaagaaacuuucaaaauauuuucagcaauggcuauauca

SEQ ID NO: 4119954 - RNA, 77 nt, Human
ugagugccucugcagguccgaguucaucuaccuggggaacagcgucuucaucgacugggacgugcagauguacuaca

SEQ ID NO: 4119955 - RNA, 81 nt, Human
ugagugcuuacuaugcuuuaacccucuuauauuuguaauccaucauaauaugcagcaugaugaaguaaguacuugcauuca

SEQ ID NO: 4119956 - RNA, 62 nt, Human
ugagugggggugcaggcagggcauuguggggugcccuggaagcugcugcaugcuccuguuua

SEQ ID NO: 4119957 - RNA, 55 nt, Human
ugaguggguauuuuguuuccagcuauacagaaguugcauaauagcuacccacuca

SEQ ID NO: 4119958 - RNA, 88 nt, Human
ugaguguagaugcuguagaaguggcaacacucagaaaaaacaguugaggacuauuucugcuuuugcuaucuuaaaagcgauacacuua

SEQ ID NO: 4119959 - RNA, 62 nt, Human
ugaguuacuugagaacuaagccagggaccacaucuccuccaaauuauucuuaaaguagcuua

SEQ ID NO: 4119960 - RNA, 70 nt, Human
ugaguuaggaaugcagaugcauaauaaauugguugggauuuauuaauacaugcaccugcauuucugcuua

SEQ ID NO: 4119961 - RNA, 87 nt, Human
ugaguuaguucuucccauuugugguagugaauuuaguaauuaguucuuuuaccaaggcaaauggucuaauaauggaggaauaaauca

SEQ ID NO: 4119962 - RNA, 67 nt, Human
ugaguuauguuugcuuggaacuugugagcuguaacugcuucacauuuucuuaggaaacuuaaauuua

SEQ ID NO: 4119963 - RNA, 93 nt, Human
ugaguucaggacaguguuucugaguuccagcucccuuggaaguaauucaucuggguuugagcucauucagaaccaugcuguacugucgccuca

SEQ ID NO: 4119964 - RNA, 67 nt, Human
ugaguucauuguguguggucuucuuugcugcaacaaguaaaaagcccagcuucauaagaugccuuca

SEQ ID NO: 4119965 - RNA, 58 nt, Human
ugaguugaaagacugacuucugcugagggaauuuuaagcagaggaagcugguaacuca

SEQ ID NO: 4119966 - RNA, 55 nt, Human
ugaguugagaggagccugaagauagaucuggauggucaggcuccgcauuaacuua

SEQ ID NO: 4119967 - RNA, 59 nt, Human
ugaguugcuaucuagauccagaguugacacuuuuaaccacugugcuguauuguaacuca

SEQ ID NO: 4119968 - RNA, 68 nt, Human
ugaguuguagucuuuuaugugcaucucaggccauuguugguaacuggucacaugugagauuaaacuug

SEQ ID NO: 4119969 - RNA, 63 nt, Human
ugaguuucgggcucuagauggaauugagaagguccaacuugcucagagggcccuggaggcuca

SEQ ID NO: 4119970 - RNA, 125 nt, Human
ugaguuucuugaaaauaaaucugcauggcuuccuaaauugcugaccaaguauauuccagauggaagucauuuaucagcaauuuacugagcaaugcuucagccagaaguauuuccacauaaauuca

SEQ ID NO: 4119971 - RNA, 81 nt, Human
ugaguuugacaggaucaugaaccacuggaauuccaguccacccuggggaaacauguuguucagaccugugauauaugcuca

SEQ ID NO: 4119972 - RNA, 65 nt, Human
ugaguuuuugccuucugcaucuuccauuagaccaugaaacacuugaagacaguggcuaggacuua

SEQ ID NO: 4119973 - RNA, 91 nt, Human
ugauaacuaugauuucuugaaaggugugcauccaucucuuuacuguaaagaauagaagagaaauagugccacuguuuaaagaaugguuuca

SEQ ID NO: 4119974 - RNA, 74 nt, Human
ugauaagccaugccuaaauaauaaguguugucaaaguagucagcacuaaauauuugagagguguaggcugaaca

SEQ ID NO: 4119975 - RNA, 93 nt, Human
ugauaagguggaacaggugaaugacaaccacaauggugcugggguuaauuuccuuuaaccaguaggaugucacuuuccuuuuuacuguuuuca

SEQ ID NO: 4119976 - RNA, 77 nt, Human
ugauaaguauguauuguaugaaugagguuugggguuucugcucuccuaaugccuuucuguacuauaugaacuuuuca

SEQ ID NO: 4119977 - RNA, 69 nt, Human
ugauaauaucuaagauguauugagcacuugcuuucugccuggcaauguucuaagcacuuagauucauca

SEQ ID NO: 4119978 - RNA, 73 nt, Human
ugauaauauuuacuuuuuggcagcauugaaguaaugaaauguuuuucaaaggcauugccaauaaguagaauca

SEQ ID NO: 4119979 - RNA, 85 nt, Human
ugauaaugauugacucaauaugccagaggggaaaguagaaaucucagcauucccuuccucauguuguuuaucuuugacauuauca

SEQ ID NO: 4119980 - RNA, 75 nt, Human
ugauaauugcugggaggauguguguucuguggacugccauagcacaugggaaugcauuuugcccaggcaagguca

SEQ ID NO: 4119981 - RNA, 67 nt, Human
ugauacacaugacucuggcuacccagagauccauaacucucugggucaugcaaaguuauguuauuca

SEQ ID NO: 4119982 - RNA, 72 nt, Human
ugauacagcuugugaaaugucaccacuaggguucaaacccaagugcuguccaguuucacaggugaucuauua

SEQ ID NO: 4119983 - RNA, 85 nt, Human
ugauacaguaucuaggaguaucuaaaauauaaauacuuugauaaaguauuuauauuuugggagcuccugacuugauaaaguuuca

SEQ ID NO: 4119984 - RNA, 75 nt, Human
ugauaccuuccaagugcuugccgcuuuguacauuccaaaacacuuucaugcaaagcaacccuuggaaugguuuua

SEQ ID NO: 4119985 - RNA, 69 nt, Human
ugauagaaaggaaauuaauuggauuaccaaaggacaguaggugaccccaauuacuuuugcuuuuaauua

SEQ ID NO: 4119986 - RNA, 81 nt, Human
ugauagauaacuggagagagcaugagucaaauggagcaacaaggagcacgcuggcucagaugcucuuccagugcaauauca

SEQ ID NO: 4119987 - RNA, 87 nt, Human
ugauagaucgaucaggaagccugcacugagcuggcacaacuuuauauuuuaugucagguccagaggcuccuuauuacuuugcuauua

SEQ ID NO: 4119988 - RNA, 67 nt, Human
ugauagcagagaaaagguugugaauaacccucccugggagagccacuaacuuguucuaccuguuuca

SEQ ID NO: 4119989 - RNA, 71 nt, Human
ugauagcucuuuugcaaagugacuauuauaugauguguucauuauguucaugcuuaugcagaaugcaauua

SEQ ID NO: 4119990 - RNA, 67 nt, Human
ugauagcuguacacauuuugcggguacaugugauauuuuuauacauguauacaauguguaaugauca

SEQ ID NO: 4119991 - RNA, 66 nt, Human
ugcuauagauguuaagcuucuagaaggcagggaaccuaccugaucuuagcagcuagccuguaugca

SEQ ID NO: 4119992 - RNA, 65 nt, Human
ugcuauauaauugcuagaauucaucacugaguaucugaauuacaguguguagcaauaugcuggca

SEQ ID NO: 4119993 - RNA, 56 nt, Human
ugcuaucagauuaagcauuuuccuugugaaaaauggaaaguguuaaguaaguagca

SEQ ID NO: 4119994 - RNA, 68 nt, Human
ugcuaucagcacagggccuggcacauaagagacgcucaguaaaugccuuucugugaaugaugauggca

SEQ ID NO: 4119995 - RNA, 70 nt, Human
ugcuaucuuuaccccaaaauguaaccccuuaaugcaucaaagggguuacauuuugggguaaggauaagua

SEQ ID NO: 4119996 - RNA, 60 nt, Human
ugcuaugcuugacucuggaauaaaauguugcauucuugcaggugcaugagucaguaagca

SEQ ID NO: 4119997 - RNA, 57 nt, Human
ugcuauuaccugcuggacagucagcaguggggcaccaucacuguggcaggugaagca

SEQ ID NO: 4119998 - RNA, 80 nt, Human
ugcuauuugaaaagagucuagagaaaaugauagcaggaacuuauucuaugaccuuuauuaucucuauaucuaccaaggca

SEQ ID NO: 4119999 - RNA, 75 nt, Human
ugcuauuuuggucuacagcacuugggaacagggaaaguccggguaccugcucugugcugagaacaaaaguggaca

SEQ ID NO: 4120000 - RNA, 69 nt, Human
ugcuauuuuuuaucucauaggucaaguuacaggaaguaaagcacuugaaacccugagaugauaauagca

SEQ ID NO: 4120001 - RNA, 63 nt, Human
ugcucagauaacaguacaaggugacacgcagcaccuguuuguucuugcaacaguuauuaggca

SEQ ID NO: 4120002 - RNA, 82 nt, Human
ugcucagauaccaggccaacaaccauuugacaucacucaauuuccguaucugucaagucuaguugcuggcuuuucucuagca

SEQ ID NO: 4120003 - RNA, 81 nt, Human
ugcucagcacucuucagucucccagaguucccacaggcacccaaacaaaagccccuagagucuggagcugcaggcugggca

SEQ ID NO: 4120004 - RNA, 83 nt, Human
ugcucagccugguguguucccguuuccuucacuggguccuggaguuugucccacugaaugaggagccccagagugucugagca

SEQ ID NO: 4120005 - RNA, 66 nt, Human
ugcucagcugcagcaggcaccauuuacuuuguagucuuugugaaaggcgcccccuagagcucugca

SEQ ID NO: 4120006 - RNA, 59 nt, Human
ugcucagcugcucuguauucuuguagcagcuauuauuacauacugaagcagcugaagua

SEQ ID NO: 4120007 - RNA, 65 nt, Human
ugcucagguuucaguuccugaucaucuccucuguuuggauuugucagugaguuggguccugagua

SEQ ID NO: 4120008 - RNA, 129 nt, Human
ugcucauuaagggaugccagggccagcucuggugguuccuggggaggcugcguccuucccugcuucugcaugucaugaggcagcaggaagguuuccccugcaccugucuguccuggcucccucugggua

SEQ ID NO: 4120009 - RNA, 67 nt, Human
ugcucccaucuucuuucugcaaaguccccaaaacaagauguuugguguacaaaacaagaugggggua

SEQ ID NO: 4120010 - RNA, 58 nt, Human
ugcuccuggaugagguacuccacgauguugguguggcccgucacucuggccgggagca

SEQ ID NO: 4120011 - RNA, 107 nt, Human
ugcuccuucaccaguuaugcaaauuuucaacuuauuuaaugugaucugaagaggugagucuuccaucucuggguugcaguuagauagggcaugaugguguacaagua

SEQ ID NO: 4120012 - RNA, 78 nt, Human
ugcuccuucagagaagcaaaggcagauuguuuggaucaagagaauugcccaaggcuucauugacuguucagaggagca

SEQ ID NO: 4120013 - RNA, 73 nt, Human
ugcuccuuguauaugcuaauggugccauuccugcaguuuuuaaggcaggaaucgcauaguauauauuucauca

SEQ ID NO: 4120014 - RNA, 78 nt, Human
ugcucgcugccaggcuucagggaacgcagucuguagacaucuccaacugucaccuuucugugguuugucucagcggca

SEQ ID NO: 4120015 - RNA, 108 nt, Human
ugcucuaauuuguuuacccaaaugugacaacgagaugaacaguuuugcaaaagcuugacaagugcugauuuaucucccuuugauauuacuuuaugaacauaacaggua

SEQ ID NO: 4120016 - RNA, 57 nt, Human
ugcucuauuaauuuuaacgaugccauaaagugggugaucagaaaauguaauggagca

SEQ ID NO: 4120017 - RNA, 74 nt, Human
ugcucuauugccuaggcuggagugcagugacacgaucucggcucaccgcaaccucugccucccggguucaagca

SEQ ID NO: 4120018 - RNA, 60 nt, Human
ugcucucagagaggagugcgugugauuuccaccuuauugcauuauccucucugaagacca

SEQ ID NO: 4120019 - RNA, 82 nt, Human
ugcucuccagauacuaaaugcucuauaaauaugacauguccagacacuggauguuccccauacaauagaugcucuggaggua

SEQ ID NO: 4120020 - RNA, 80 nt, Human
ucuauucugagcugcaacacuaacaucugggcuucuuuuguuugcauuuucaaauguaguuuggggcuagauuuauuaga

SEQ ID NO: 4120021 - RNA, 76 nt, Human
ucuauugaauuuagaagggauaugacuguuuuugaaaacuuaaggcuaucaguccucucuggguuucuuauuuaga

SEQ ID NO: 4120022 - RNA, 60 nt, Human
ucuauugugaacaguaaaaaucauuuaguuggcacauugccaguuucugcucacaguuga

SEQ ID NO: 4120023 - RNA, 65 nt, Human
ucuauuuaaaaugucucugacugcagucugcccucuagaaugugucagaaguacuuuuggaaaga

SEQ ID NO: 4120024 - RNA, 75 nt, Human
ucuauuucuguaguagguuguaguucuugucaaaguccuacugacaaaguccuacuaccuauugugcagaagaga

SEQ ID NO: 4120025 - RNA, 64 nt, Human
ucuauuugguguuuucaggaauauacgugaaaagacaugccauguuuugguaaauaccaucaga

SEQ ID NO: 4120026 - RNA, 56 nt, Human
ucuauuuucuugccaaaacugcugcacaauugguuguagaggggucagagaaggga

SEQ ID NO: 4120027 - RNA, 58 nt, Human
ucuauuuuguuuccagcucuacuuucagguccauccauagagcuuggcacagaguaga

SEQ ID NO: 4120028 - RNA, 65 nt, Human
ucucaaaaacagugaccccaguuacauaugaaucccaaauucagaugcuggagucacuuuugaga

SEQ ID NO: 4120029 - RNA, 72 nt, Human
ucucaaaaccauuagucaaucagcaagaaacagaacccgugcuuuugcugugcaggcuggugacaaaugaga

SEQ ID NO: 4120030 - RNA, 71 nt, Human
ucucaaagggaguacagcccuggagacaugagagaaggcgucauucagacugcuggugcuucccucagaga

SEQ ID NO: 4120031 - RNA, 75 nt, Human
ucucaacccgcagggccuggggccgggccucggccucuuuuccccguggcagccgcaggcccuguguggcaggga

SEQ ID NO: 4120032 - RNA, 85 nt, Human
ucucaaucuacuuguuauguaaauguuaauauaaaacugacagaaauaugcaucugcagaacuuuaugagcaaagagaacugaga

SEQ ID NO: 4120033 - RNA, 74 nt, Human
ucucacaaccggaccauccugccagccucuguucccgccaaggagucugaagccagugguaguccggccagaga

SEQ ID NO: 4120034 - RNA, 58 nt, Human
ucucacacaacauguuacuuugcuuuuauuugcuuuugauuuugacaguuguguggga

SEQ ID NO: 4120035 - RNA, 100 nt, Human
ucucaccaggugaccuugggcucaaucgguauucuugucccugagccuuaguuucucuucugugcucuggggaaauggauauguaccuggucaugugaga

SEQ ID NO: 4120036 - RNA, 76 nt, Human
ucucaccucagugugugcugacucacacccaugccaggagagcagcuugggcagugagcagcaccaugaggcuaga

SEQ ID NO: 4120037 - RNA, 75 nt, Human
ucucacugcuaagugcucaugcacauuuauaguuccagcaggacuaugucuuuccaugggcacccaaguaggaga

SEQ ID NO: 4120038 - RNA, 74 nt, Human
ucucacugguucauccccuuccaggaagaacagaguggccuguaagguuucaggaaggaggugaacaaggaaga

SEQ ID NO: 4120039 - RNA, 94 nt, Human
ucucacuuccacaauuacuuguuagcugacuguguaguaggugaggauugauuacuuauuuaucaccaguuagcugacugugcaguaggugagg

SEQ ID NO: 4120040 - RNA, 73 nt, Human
ucucacuugugccucauaacacuccuggaguuaggauaacucuaguuaggggugucaugaggaguaagugaga

SEQ ID NO: 4120041 - RNA, 57 nt, Human
ucucagagaucuuucugcaugugaugaaaaucaaggcaguacaugaggaauuugaga

SEQ ID NO: 4120042 - RNA, 72 nt, Human
ucucagaguuugaaucuggaguuucugaaaccuaaaguaguuauuaaacuuucccuggucuagacucugaga

SEQ ID NO: 4120043 - RNA, 69 nt, Human
ucucagaucauggaucuauuacuuggaucaaaaaguacugcacagggaaguagauacuaugaucucuga

SEQ ID NO: 4120044 - RNA, 56 nt, Human
ucucagcaagagacuuuuaugucugccuuguggcugcaguuugucuuuugcuuagg

SEQ ID NO: 4120045 - RNA, 74 nt, Human
ucucagcaguauccaaugagugaagaacacuugacugacucuugggucaccucuauuacuuauuguacucugga

SEQ ID NO: 4120046 - RNA, 78 nt, Human
ucucagcgucucuuaggacugacuguucaaaggcuccucagcaaaugagcccuugaacaguccuaagagacccugagg

SEQ ID NO: 4120047 - RNA, 70 nt, Human
ucucagcucagucuugaagcacuggcaauauuuuagaauaugaaccuccagaugcaaaguugggaagaga

SEQ ID NO: 4120048 - RNA, 89 nt, Human
ucucaggaccccagcccuccugaggcugccgugcuuuaucauaaaggcaaggccaagccaucagugugugcgagcaggagguaaugaga

SEQ ID NO: 4120049 - RNA, 67 nt, Human
ucucaggccuuaauuaauuuggcacuauugguuaauuagcuggaggugucauuuaguuaaucagaga

SEQ ID NO: 4120050 - RNA, 72 nt, Human
ucucagguucuuggugagcauuugguccccucugccaggacugcaggauucagaacagcucacaaucucaga

SEQ ID NO: 4120051 - RNA, 61 nt, Human
ucucaguccuuggcaaguucucagucuaaacggaaagacagacauggaccaagcacuguga

SEQ ID NO: 4120052 - RNA, 57 nt, Human
ucucaguuucuuagucugagcaacagaaaggaugaagugcaguguggaagacugaga

SEQ ID NO: 4120053 - RNA, 70 nt, Human
ucucaucaucaacccugggacugggaauuacacuaucaccuccccugguucucaggccuuugggauggga

SEQ ID NO: 4120054 - RNA, 64 nt, Human
ucucaugguuugugauucaaauauauacuauucuuuauguuucaugaacccacaagcugagaga

SEQ ID NO: 4120055 - RNA, 58 nt, Human
ucucaugugaagaaagaauuucugucacuuuggugaugaaucuuugauuuacauggga

SEQ ID NO: 4120056 - RNA, 77 nt, Human
ucucauguugaauuaucguucccacaauucccauguguuguggaagggauccagugggagguaauugaaucaugggg

SEQ ID NO: 4120057 - RNA, 55 nt, Human
ucucauucaaucuugauagcuuaaaguugccauuaagcuaagaggaaaagugaga

SEQ ID NO: 4120058 - RNA, 70 nt, Human
ucucauuguggaaaugaaugcauguggauagcugugguauccauuaaugauuauuucugugccauguaga

SEQ ID NO: 4120059 - RNA, 65 nt, Human
ucuccaaauagugucacauugugaggaacugggguuaggacuucaacacaugaacuuuuggaaga

SEQ ID NO: 4120060 - RNA, 73 nt, Human
ucuccaagaugugcucugcaaucaguucuuuuuuacucuauaaaaaacacacugagaauagagacauugggga

SEQ ID NO: 4120061 - RNA, 79 nt, Human
ucuccaaugccuuuuccaucucaggcagccaagucucugcuucugacuccacugaagagacuggagggggcaucaaaga

SEQ ID NO: 4120062 - RNA, 68 nt, Human
ucuccacguccagugaucuagggagcuggacuuugagugguaaggucuuuggucacugguagugguga

SEQ ID NO: 4120063 - RNA, 62 nt, Human
ucuccagccagcccugucuucuaaacucauucauccaagugucagaaggcuccuguuggaga

SEQ ID NO: 4120064 - RNA, 61 nt, Human
ucuccagcccuuagauaaaccuggccguguacauuggcagccaggaccgggggcugcggga

SEQ ID NO: 4120065 - RNA, 62 nt, Human
ucuccagggcccccgagcguuggcugaggaccagagccagccagugagcggagccugggaga

SEQ ID NO: 4120066 - RNA, 55 nt, Human
ucuccagguagauaugucaggaaucauuugaaauacuuauaugucugcuggggga

SEQ ID NO: 4120067 - RNA, 65 nt, Human
ucuccaugaaggaauagaauggguucuccuugaaaaaggucaacccaucucuccugucaugcaga

SEQ ID NO: 4120068 - RNA, 55 nt, Human
ugcccucccacauuauggcugugaauagaucuucauaguugggugaggaguggca

SEQ ID NO: 4120069 - RNA, 57 nt, Human
ugcccucuguccucaaucuugcuuaccagcaacaacagcaaaugggacaggaaggca

SEQ ID NO: 4120070 - RNA, 69 nt, Human
ugcccugccugagagacaguaauuguguuuucaaccacauuucacagcacuuuucaaccuggcaaggca

SEQ ID NO: 4120071 - RNA, 93 nt, Human
ugcccuuaacuuguguguuuacaacaaugccaacagcaugcugggggacauuauagacucuuccaguuuugccaugguaacacuuguggggca

SEQ ID NO: 4120072 - RNA, 86 nt, Human
ugccggcaaacgcugcucuguuaauugcuguaauaaacagacuuuauuauaucccuuugcaguaaauggauuauguugucagggua

SEQ ID NO: 4120073 - RNA, 69 nt, Human
ugccuaauaauuugauuuauuuguagcauuugcaucuagagaaugcuuuaagucucaguuuguuagcca

SEQ ID NO: 4120074 - RNA, 58 nt, Human
ugccuacaaaauagcgugucuuuucacggggagaggauuuguugaguuuuagugggua

SEQ ID NO: 4120075 - RNA, 57 nt, Human
ugccuaccuggauuggcugaagcacaaaggacaaauuuuagaggacacagggaggca

SEQ ID NO: 4120076 - RNA, 78 nt, Human
ugccuacguuuacauguuuuucucuuacaggccacacagcauguccugugggacuggagaaauauggagaaugcagca

SEQ ID NO: 4120077 - RNA, 59 nt, Human
ugccuagcugugagcacccaggcugugggauuuacagccgggcguccgccgcugacgua

SEQ ID NO: 4120078 - RNA, 56 nt, Human
ugccuaguucggugguuuagagaauauggaguguuucugggcuuucuuauaaggca

SEQ ID NO: 4120079 - RNA, 64 nt, Human
ugccuauucugauuuguccauucaguggauuuucuccuccugaaugacugaagucacaauugca

SEQ ID NO: 4120080 - RNA, 74 nt, Human
ugccucaaauauuucauauauuuagaaccuuuuugggggccuuugaauaguguuuucaguauacuuuuggggua

SEQ ID NO: 4120081 - RNA, 72 nt, Human
ugccucaacauuccugccauaaauuuuuuaugggcgccugaaaauaauggauugguuggaauauggugggca

SEQ ID NO: 4120082 - RNA, 76 nt, Human
ugccucagugugguuucuuauuugcagguugcuuuuaacaauauagaugcuuuccuggauagagaacauggaggca

SEQ ID NO: 4120083 - RNA, 71 nt, Human
ugccucgucugguucuagaagcugucuguucacaaagaccauaacuaagucaguuuuucccagacgaggca

SEQ ID NO: 4120084 - RNA, 60 nt, Human
ugccucucucagcuugcugcaacugucuuucccaauggauaccugccacagagaaaggua

SEQ ID NO: 4120085 - RNA, 88 nt, Human
ugccucucucugaauuguuuaaguuauuuugugucuuuggaauaucaaucagucuuggaggggugacgcaacagauucggagaaggca

SEQ ID NO: 4120086 - RNA, 99 nt, Human
ugccucucuguuuggccagaccugugggccuagucuggccuagucuugacagaggacaagaaagaagaggcuuaugugugugugcaagagagaggggua

SEQ ID NO: 4120087 - RNA, 95 nt, Human
ugccucugcaguuguguuugcugaguuuucuccuaagagaaauguuucuuggcaagaagcuucagcuaaacaaauuaugccauggaagagaggca

SEQ ID NO: 4120088 - RNA, 84 nt, Human
ucuccuucucucgugaggucucuacuuaguccagaaaugccaggaaugggccccaguguggaccuucacacagagaugggcagg

SEQ ID NO: 4120089 - RNA, 73 nt, Human
ucuccuucucuuccccuuaguuuccuuuaagagugauaaaaauggaaaagggggcugagguggaggaaggaga

SEQ ID NO: 4120090 - RNA, 97 nt, Human
ucuccuugacuuauucuaugaagcauauauuuuauauguugucauaacuaugagggcauuuucuaaaaauaugugcaaugggaugaguaaugggaga

SEQ ID NO: 4120091 - RNA, 63 nt, Human
ucuccuugggacaugagaaauauugaccaaauuaugagauacuauuaacagucaccaaggaga

SEQ ID NO: 4120092 - RNA, 77 nt, Human
ucuccuuuuucuccuucuuucugguuaugcaguuccugucccugacuuuggauaagaaaaugagaaaaaucaggagg

SEQ ID NO: 4120093 - RNA, 68 nt, Human
ucucgcauguacacaccaugauuuauuuacccauuccacuguugaugggcacuggggugauuugcaga

SEQ ID NO: 4120094 - RNA, 119 nt, Human
ucucgccacccccagaggccauggggcagaaggccucccagcuccugaagcuuaagcaugcuuucugcagggggcugaggcuguucugaggacucacauuggccucauccguggcgagg

SEQ ID NO: 4120095 - RNA, 76 nt, Human
ucucggggccucaguuuccccaccuguagaaugaggguaacagaggccuaggaauggguaaauugggcacccgaga

SEQ ID NO: 4120096 - RNA, 123 nt, Human
ucucgguuugaugaaccuugauggcucaucugaucauugaacaggcacuggagcuggaaauacuuucagauauuuccacuggcuuucagugaucuugaaagcuagaaagaaaaaagaaagaga

SEQ ID NO: 4120097 - RNA, 55 nt, Human
ucucuaaacuuauaugaacuauagagcuuugcagugguuuguauaguuuugggga

SEQ ID NO: 4120098 - RNA, 55 nt, Human
ucucuaaaugauuguguacucccugauaauuuggggagcugcuaacauuuaugga

SEQ ID NO: 4120099 - RNA, 94 nt, Human
ucucuaacuguuuguauacucaucccagagcaugaauuaaauguuugugacuuccguuugacucuugcuuugguggcugaguguaauuuugaga

SEQ ID NO: 4120100 - RNA, 65 nt, Human
ucucuaaguggguacuggggcuugguggggcgggucccagagccuaaaacgacuccacuggaaga

SEQ ID NO: 4120101 - RNA, 75 nt, Human
ucucuaauguggucugcagaccaguugcaucuccugggaaacucagaaaugcagaaucucagaccccaccugaga

SEQ ID NO: 4120102 - RNA, 61 nt, Human
ucucuaccuuccuucagagcccacauccuuguccauguuuguugaaugaagaaaggagaga

SEQ ID NO: 4120103 - RNA, 81 nt, Human
ucucuacuggcaaggcuuagucagagggugcugggugaccaucagggcccuggugacuggggcuggccugacaguguuuga

SEQ ID NO: 4120104 - RNA, 70 nt, Human
ucucuaguauaaaagcaaccuaugacuuaguguugaaguuaaggauugucuggcuauuuaugcuuagaga

SEQ ID NO: 4120105 - RNA, 63 nt, Human
ucucuaugaguuaugaaguaaaugauuucuuacagaaaucagaucuuacacaauugugagaga

SEQ ID NO: 4120106 - RNA, 82 nt, Human
ucucuauggucugcagcauuucucagcuuuuguuuuaauuaguuugucuuguggaacacaguuuagaaaaugcugcuagaga

SEQ ID NO: 4120107 - RNA, 80 nt, Human
ucucucaaauguucuguaaaaguguggaugugggagcauaaacucagcaaagcagccacacuguuacagaaugaguaaga

SEQ ID NO: 4120108 - RNA, 64 nt, Human
ucucucaaauuuauccauuuugaagcuuacuuguaaaucuauuguauguauggauaaugagagg

SEQ ID NO: 4120109 - RNA, 58 nt, Human
ucucucaagaacagacgccacgccuucauccaaguguuugauuuguucauugaagaga

SEQ ID NO: 4120110 - RNA, 59 nt, Human
ucucucacaugaggggagcauucacgauugcauuuucucaacucuguucaagugagagg

SEQ ID NO: 4120111 - RNA, 82 nt, Human
ucucucacuauggguuuagaccugucuaauuucuauagggaauuauauagaaaauuauagaucuagugccugcccuggagga

SEQ ID NO: 4120112 - RNA, 72 nt, Human
ucucucacuggguauaaaugaguaaccauuagcacuaguugcuauaaggggguauucuauagccaugagggg

SEQ ID NO: 4120113 - RNA, 55 nt, Human
ucucucacuggugccucuguuggccgacgcuacccagaaggcagccagugagaga

SEQ ID NO: 4120114 - RNA, 62 nt, Human
ucucucauacauagacauuuuguucuguccuugguuagaacaaauggggccuuguaugaaga

SEQ ID NO: 4120115 - RNA, 89 nt, Human
ucucuccugauagcaacuuggacaagcccuguguguccagauagagguggugacaugacacagggggcauucuaggaguuggggaggga

SEQ ID NO: 4120116 - RNA, 57 nt, Human
ucucuccuggauuaagcugccucagaccugagugcagcaagugaauuccaagagaga

SEQ ID NO: 4120117 - RNA, 66 nt, Human
ucucucgauacuuagaugagccagggucaccaagaaugcuggcugacacaaagguaucgaaugagg

SEQ ID NO: 4120118 - RNA, 91 nt, Human
ucucucggccuggaggccccuggcggccucugcucccaagcggggagucgcagccaggcuacagcgggcuugauccucagugcugggugga

SEQ ID NO: 4120119 - RNA, 73 nt, Human
ucucucuaacucccuggguuaggaauguacagacagaauauugucuguaaucuuccccagcucagaugagaga

SEQ ID NO: 4120120 - RNA, 55 nt, Human
ucucucuauuucaucucaucugauuucucacuuucagugcucaggaauagagaga

SEQ ID NO: 4120121 - RNA, 64 nt, Human
ucucucuccagucaggaacucugacgagguacacuggugaggagaagguggcaggagaaugagg

SEQ ID NO: 4120122 - RNA, 77 nt, Human
ucucucucuucagagauaccuugcugcuuagagggaaacuugacacuacccaugccugcauaucuuugaaagagagg

SEQ ID NO: 4120123 - RNA, 61 nt, Human
ucucucugcaugacuucaguuaggucuuuucuuccaaagaaaagagaauccuguacagaga

SEQ ID NO: 4120124 - RNA, 112 nt, Human
ucucucugcuuccgggaaguccuauuccacugaccaccuacugugugcacaggcuugugcugaguggugcuguggaggggcagaagggagcuggaaccuggugauggagaga

SEQ ID NO: 4120125 - RNA, 61 nt, Human
ucucugaagccagcuuuggaagacaccguggggucuucucuaugagcuggucuggcaggga

SEQ ID NO: 4120126 - RNA, 61 nt, Human
ucucugagaaguuccuuugugaaaguacaaaagucucacagaauugauggaaaucucagga

SEQ ID NO: 4120127 - RNA, 58 nt, Human
ucucugagcaccuaagauauaucaugaauccugggugauaaucauuuuugcucagaga

SEQ ID NO: 4120128 - RNA, 90 nt, Human
ucucugauagauaauuuggcaucauauugaggagugacaaaaacaagcuuaaaauaguaugggaugcuaagagacaauuuuuaucagagg

SEQ ID NO: 4120129 - RNA, 74 nt, Human
ucucugaucagcaccacucuuauucccucagaaauaucacaaacuuggcagaugaggaaauagaggcucagaga

SEQ ID NO: 4120130 - RNA, 78 nt, Human
ucucugauugcuuuuuggggcuuggggcuugaaaaugccaggcauuucagacuccaaauucauaagaggcagugagga

SEQ ID NO: 4120131 - RNA, 85 nt, Human
ucucugauuugguagcucucagguagagcccaagaauguguuuccaacaaguucccaggucaugcugaaguugcuaauacagaga

SEQ ID NO: 4120132 - RNA, 92 nt, Human
ucucugcaaucaguauuucacauggaagcucucgagacauuuagcagcccacuaggauucuguagaacuucuguugagaaaacuuguugaga

SEQ ID NO: 4120133 - RNA, 58 nt, Human
ucucugccagccaaagucaucaccauaagacacugguugggggccuggcaggcggagg

SEQ ID NO: 4120134 - RNA, 66 nt, Human
ucucugcccucaggguaaugaucacauaugcaaugugagauaacaaaauuaucuucagggcaauga

SEQ ID NO: 4120135 - RNA, 60 nt, Human
ucucuggcugccuggcagcucugggcacauguucaacagcccaugggaggggccaagaga

SEQ ID NO: 4120136 - RNA, 75 nt, Human
ucucugggcuugaagucugagugucagugcaaguggagggguaccacugacuacuuuaggauuagcguucagagg

SEQ ID NO: 4120137 - RNA, 97 nt, Human
ucucugguuuaucuuucacagcauaaugaaauauacuuuuaucauuagagucaaguagaaucuuauuaagacuugcugugcaagguaacuccaggga

SEQ ID NO: 4120138 - RNA, 55 nt, Human
ucucuguaagagaggcuuucauguaguacuauaguaugaagccacauugcagaga

SEQ ID NO: 4120139 - RNA, 63 nt, Human
ucucuguacaguacaugccgugugugugugugugugugugugugugugugugugugagagaga

SEQ ID NO: 4120140 - RNA, 67 nt, Human
ucucuguagguuuuaaggagaguuaaaauggaaauuaacauuacacuuaucuagagccauggagaga

SEQ ID NO: 4120141 - RNA, 90 nt, Human
ucucuguccaugaacagcacaaucugagucccagacaccacuacuuuuggggaucuguuccucaaggucugugugaauuuauggcaguga

SEQ ID NO: 4120142 - RNA, 113 nt, Human
ucucuguuacucuccuuugcacuguccuucagcucuugguaaauguuugggucucacaauaaacauuucuuaaacaucuacuguaggcuggagguaguguuggauuccaggga

SEQ ID NO: 4120143 - RNA, 84 nt, Human
ugaguuaggugcccuaggucagugaugucauauaauauauacaggaacaauagaaaugcuacaacauuaucugggguugacuca

SEQ ID NO: 4120144 - RNA, 93 nt, Human
ugaguuagguuuguaaaugucauggugaaaaaauauuaauaucucaaaacgucuauuuuuaaaauugaucucauggcuuaacaagcccacuua

SEQ ID NO: 4120145 - RNA, 72 nt, Human
ugaguuguaaaagcacuuucuguauucuggauccaaguccucuguuagaaaugugcuugcuuuugcaacuua

SEQ ID NO: 4120146 - RNA, 67 nt, Human
ugaguuguagaguuaggauuggacauuagaaguuauccuuguucagucuccucauuuuacaaauuca

SEQ ID NO: 4120147 - RNA, 60 nt, Human
ugaguugugcuuccuccuuaaacugucauguugugagaguugaugagaggagcaauuuca

SEQ ID NO: 4120148 - RNA, 62 nt, Human
ugaguuguuaaagacauuucugguagaaaguaauacuggguugaaauuucuuugacaacuua

SEQ ID NO: 4120149 - RNA, 57 nt, Human
ugaguuuagugugagacuuaucugauuaaguauaguuucauaagccacuagaucuca

SEQ ID NO: 4120150 - RNA, 77 nt, Human
ugaguuuccugugaaaagagaaggcaguugaauuuugguuaguuguacugccuguagcucuucaucucaggaacuca

SEQ ID NO: 4120151 - RNA, 90 nt, Human
ugaguuugggggugggaagaugagaaguggggcucccuucucuaguagcaaagggugaggagacugagucuccuuucuacugccagguca

SEQ ID NO: 4120152 - RNA, 85 nt, Human
ugaguuuguccacaucugcuucacgugucucauucuccuuggacaaguggcaaugacaauggcagagguagaagagggcacacca

SEQ ID NO: 4120153 - RNA, 75 nt, Human
ugauaaacauuuguacauuggcaugucuccucucagaacucacccccaugaaaggcagccaccguacagauauca

SEQ ID NO: 4120154 - RNA, 60 nt, Human
ugauaaagacugcagaacuguacauuuucauauguguaauauguugcagacuuuuuauua

SEQ ID NO: 4120155 - RNA, 68 nt, Human
ugauaaagcagaaaguaaauguguauccaggaugcacuggauguaacacccacuuuuauagcucauca

SEQ ID NO: 4120156 - RNA, 98 nt, Human
ugauaagaggaaauaaaacucuuguaauuaacuagaaagauauaauguauugaucuguaaauuaaagaauuuuaaauaaugaguguuuucucucuuca

SEQ ID NO: 4120157 - RNA, 63 nt, Human
ugauaaggcaaauguguucuuuuaguucccgucaggaggaaggaucagaacaguuugcauuca

SEQ ID NO: 4120158 - RNA, 72 nt, Human
ugauaauucuccugugugcuuauggagaacaggccuacuuagccuaaacauuggagcauuaggagguuauca

SEQ ID NO: 4120159 - RNA, 82 nt, Human
ugauacagguguacacacaugcaaaaacuuccugagcuguacacuucagaucagcacucauugcauguaugugaucuguuca

SEQ ID NO: 4120160 - RNA, 118 nt, Human
ugauacgguguucucaguuuccauugcucauugaauugauucuucugaauuugcagauaauguuccaugcugacuuucugcacccaucgaggagucaguuagcugggacaauguauca

SEQ ID NO: 4120161 - RNA, 80 nt, Human
ugauacugcuguaggagccacaacaggaaggcugcaaguauccagcuucaugccagcccugugugguaacagcaccauua

SEQ ID NO: 4120162 - RNA, 82 nt, Human
ugauacuggaaaagagguuaaccagguguguuucguccucaauaaagaaacagaaacccagaaaaccucucuucagguacca

SEQ ID NO: 4120163 - RNA, 82 nt, Human
ugauagaaacaaagugagccauucugcucaguggacuuuuggcuuuaagguggcaaagaugguucucaccauguuuucuuca

SEQ ID NO: 4120164 - RNA, 78 nt, Human
ugauagaguaucgcuuuacagccugcuuccucaguagcugaucaccaggcaaaaugucagagcagcuggugcucauca

SEQ ID NO: 4120165 - RNA, 77 nt, Human
ugauagaugaaggugaugagaugguaagauauacauuaugacuaacucuuacaauaccacaucaccucauuauguca

SEQ ID NO: 4120166 - RNA, 56 nt, Human
ugauagguucucaaugaaugcugauguaugaacaauggcauuucauuuaaccauca

SEQ ID NO: 4120167 - RNA, 66 nt, Human
ugauaguuuauucaucaccaucuucuguuacuuggcagagcucagaaacuuuugaugaguguauca

SEQ ID NO: 4120168 - RNA, 88 nt, Human
ugauauagaauccuggugagugaauauguucccugauaucccuagauacaaagacaaaucucaaucuuuaaaacuuugauucuguuca

SEQ ID NO: 4120169 - RNA, 70 nt, Human
ugauaucuuucaaagccaaaaguaauuagaaauagagaaaucuaguuauugcuuuaugggaaaaauguca

SEQ ID NO: 4120170 - RNA, 80 nt, Human
ugauauguaaggaagaagggaaguuacuuaaggaaaucucaccaugaguuauuuaaaacuuuucauuaugggauauauca

SEQ ID NO: 4120171 - RNA, 74 nt, Human
ugauauguacauugauauuaaaaauauaggaugcugacuuuuggauuuuauguacaauguuaauguaaauauca

SEQ ID NO: 4120172 - RNA, 100 nt, Human
ugauauuuagcaacugccuggggucaggcacuggccagucagcacacaggcugcugugagcaguggcauggccgugcugcuaugggcuggcugcauguca

SEQ ID NO: 4120173 - RNA, 101 nt, Human
ugauauuugacuuuugaaccagacuagaugaggcagagcuucagcacauauuuuaccagugucuucagcaaaugccuuucucuuugcaaagcuccauauua

SEQ ID NO: 4120174 - RNA, 65 nt, Human
ugauauuuuuaauguggcagcauuuuaguauauuuuccuauuaaauggccaagguuaaaaauaca

SEQ ID NO: 4120175 - RNA, 81 nt, Human
ugaucacaguguagaccuuuuaaaugaacuguuuaguucacuuuuucaguguuuuguugaggaguuuuacaucuguguuua

SEQ ID NO: 4120176 - RNA, 57 nt, Human
ugaucacuguaugcugcaggauuugaaaagagacugugccacagccugcagugguca

SEQ ID NO: 4120177 - RNA, 129 nt, Human
ugaucagacaguaucuguuacguuuuacucuugggauacaaauuuuaagagacacuuugguaaauuagacagugucuagaaaaacaaaguaucugaaagagaagacagaagaaaugacugacuagauua

SEQ ID NO: 4120178 - RNA, 56 nt, Human
ugaucaguaaagucaguugucacuugguagaguggcagggcuggcugcugcacuca

SEQ ID NO: 4120179 - RNA, 66 nt, Human
ugaucaugcuuaaaguuggagucaugagcucacccaguccaagacuccccacguuaaggaauguca

SEQ ID NO: 4120180 - RNA, 56 nt, Human
ugauccaaugggagaagcuguucaguaaaugcauagaauauuucucauugucauca

SEQ ID NO: 4120181 - RNA, 57 nt, Human
ugauccagcggggcuagaggaaggcuggguugacaguguuuuuaaugggcuggagca

SEQ ID NO: 4120182 - RNA, 86 nt, Human
ugaucucacuccagugauuguuuuaauaacugagauuuccauauaaauauccucugaauaguugaggcauuacuguaaugagauua

SEQ ID NO: 4120183 - RNA, 62 nt, Human
ugaucucucugggagcugacagugaggauuagaugccuuaaggcagccgcucagagagguua

SEQ ID NO: 4120184 - RNA, 61 nt, Human
ugaucugacucaaggcccuggggugcagaaaaaggucacuaagccccugggugaguucuca

SEQ ID NO: 4120185 - RNA, 61 nt, Human
ugaucugggucaugacucagcgugagucugagggucggguugcaguccguggcccaaguca

SEQ ID NO: 4120186 - RNA, 79 nt, Human
ugaucuguggugauauucugauaauaagauuuugaucuaacggaggauacaguucuagucaaaaaucaccuauagauca

SEQ ID NO: 4120187 - RNA, 59 nt, Human
ugaucuucagcacagguucuagacaccgcuguucucaggcccacuguguugaaagauca

SEQ ID NO: 4120188 - RNA, 59 nt, Human
ugaugaagaaauguagagccuaguaaacgaaaguuuauaggaucucacccuucugagca

SEQ ID NO: 4120189 - RNA, 63 nt, Human
ugaugaagucguggcaggcuugcacgauguccgucaucugcaggaagcuggcggcugacauca

SEQ ID NO: 4120190 - RNA, 76 nt, Human
ugaugacuuguauguuauagauuugugauuacauuaaaacuuaaaauuucacaaaucuauaauaugcaggucauca

SEQ ID NO: 4120191 - RNA, 64 nt, Human
ugaugauugugcaggacauaaaggacagaaagcccaagccuauuuaagaccugcaucaucauua

SEQ ID NO: 4120192 - RNA, 83 nt, Human
ugaugcagccucuaucaaucagcuuguuggguuggcucuagcucuuuuaagcagcucuuaacaaagcauggagggaaacauca

SEQ ID NO: 4120193 - RNA, 68 nt, Human
ugaugccacauucaaauauuaugugaguuccugugaaacgagaugauauuugcaaugugcuugcauca

SEQ ID NO: 4120194 - RNA, 59 nt, Human
ugaugcugaugcccccaucacugagaacaagaauucucucccugagguuguuagcauua

SEQ ID NO: 4120195 - RNA, 77 nt, Human
ugaugcugcagccaugaggaugggggaguccaagggucgcgcccuucuccccugacccugaugaggcacuugcauca

SEQ ID NO: 4120196 - RNA, 95 nt, Human
ugauggaaaagcucguguuaguauuggcaaauuuguuuggaagaaaauauauuccagcaaaauuccaaaaugcuaauuuaaguuuuucucaguca

SEQ ID NO: 4120197 - RNA, 65 nt, Human
ugauggaaauuugggaagcuuucuuaaaauucugcuuaccacagagcuuuucuugguuuccuucg

SEQ ID NO: 4120198 - RNA, 77 nt, Human
ugauggaauauggcaguacguugaaaauuuucaccuuggggauuauucacugaaaauagcggauguccuuuuuauca

SEQ ID NO: 4120199 - RNA, 83 nt, Human
ugauggcaggaggauaucagggggucaccucaccagggccaggagggccucugugggccgggccugcugccuuccugaccuca

SEQ ID NO: 4120200 - RNA, 76 nt, Human
ugauggggagaaaaaugacuucugcaaggucauuuggaaagucugugacugagcugcagagugucacuucugguca

SEQ ID NO: 4120201 - RNA, 90 nt, Human
ugauggugaagcaugggcucugaagucagucugcuuguaucccagucuuaccucuagcugagugaucuagggccuaguuauguaaccuca

SEQ ID NO: 4120202 - RNA, 107 nt, Human
ugauggugagucauuuucacagaggccauugcaaaguuugccuccuguagcugauucugcagcacaggagugcugcuauuguuguuucauuuggugucuuaucauca

SEQ ID NO: 4120203 - RNA, 69 nt, Human
ugaugguuaaauugguuauuuauguuguguauaagguuugcaaggcuacuuaaccagcuugauucuuca

SEQ ID NO: 4120204 - RNA, 60 nt, Human
ugaugguuauuacauuccucuugccaguaauugguauaggaugugcauaugaccuaauca

SEQ ID NO: 4120205 - RNA, 74 nt, Human
ugaugguucauucugaagucuucagcacuuguauuggugauagcugaagauacucaguuaugacagaaucauca

SEQ ID NO: 4120206 - RNA, 112 nt, Human
ugaugguuugcuuaauuaggcagcauagcuguuggaaauccuauaguucagugauugucccuuuaacauaucugugagguuuuguugugaaaacuugauuaagaaacuguca

SEQ ID NO: 4120207 - RNA, 66 nt, Human
ugauguagaugacagacucgcuucaaguuaggacuaacacugugguguucuuuguccucuaaagca

SEQ ID NO: 4120208 - RNA, 69 nt, Human
ugaugucacaugcauuaaaaauacuugugagugccucuucuuuacaggcccuguugaugcuguauauua

SEQ ID NO: 4120209 - RNA, 67 nt, Human
ugaugucugcauuauuggaaaguccuucauguugagaugaaaguuucccaaaguaaugugaauauca

SEQ ID NO: 4120210 - RNA, 77 nt, Human
ugaugugcuaauuugggcaacuuaauuuacauucuggcagucaguguagauaaguaaaagcccaguuaaguauuuua

SEQ ID NO: 4120211 - RNA, 104 nt, Human
ugaugugugaaaaaauuagaguucagagaaacaagaaagaauuuccaaaguaaucuuuagaaaucagguuuuuagaaaguucccucugauauuuaagcauauua

SEQ ID NO: 4120212 - RNA, 121 nt, Human
ugauguuaagguaguguucaccagguuucucuacugcuaaguuaguauuuuucccuuuauaauuaauaaguaauuugugcagagauacuuugagacuauguaaauaucuauuuccucauua

SEQ ID NO: 4120213 - RNA, 71 nt, Human
ugauguuaucuggaggccugucuuaucccuaccacagagugggggguaggugggguguuccagaguuuuca

SEQ ID NO: 4120214 - RNA, 58 nt, Human
ugauguuuuccuuuggcuuccuugcugagucaugacuagauuugccugggaaagcuca

SEQ ID NO: 4120215 - RNA, 88 nt, Human
ugauuaaaauaugcauugcuugaggguaggaaccuaccuuaagguucuuuuuauuccccucaagcacuugcugcauggccuaugauca

SEQ ID NO: 4120216 - RNA, 65 nt, Human
ugauuaaaaugcauguauuaucuagaugagcuagcugcaccaaucuggaugguacagcagaguca

SEQ ID NO: 4120217 - RNA, 68 nt, Human
ugccugagaagcgcggcgucggcguggguccugcgcagccugccccgcgagcgcccgcugcaagugcg

SEQ ID NO: 4120218 - RNA, 64 nt, Human
ugccugccucuggcagcccugcccagcccaccucugucucugcagggcaucccggaggcaggca

SEQ ID NO: 4120219 - RNA, 58 nt, Human
ugccugccuugcugcuggacaggacacagaaaucucuuuccagauauuaagacaggca

SEQ ID NO: 4120220 - RNA, 73 nt, Human
ugccugcucucuuucuaauuuugauaccgcaaugauuaauucugugaaaaaaguucuagaaggauauaaggca

SEQ ID NO: 4120221 - RNA, 60 nt, Human
ugccuggaaaguacagugugucacacagaugccuguugaccuggaaggugcuuccuggca

SEQ ID NO: 4120222 - RNA, 74 nt, Human
ugccuggaaggcccaugggaagaggccaggaucuggacucagauaaaccaaguuccacugggcaaucuuaggca

SEQ ID NO: 4120223 - RNA, 63 nt, Human
ugccuggagacgaggcuggaccaucuugaaggaaaagagggugacgucagccugcuuuaagca

SEQ ID NO: 4120224 - RNA, 75 nt, Human
ugccuggagugccugugcccuggccaggccucucuuuggucagggaagagccccagggacagccucgcuccagca

SEQ ID NO: 4120225 - RNA, 70 nt, Human
ugccuggcacacaguaugaucuaaaguaaguaauuguuaucauuucucaguuccuacuguuuacuaggua

SEQ ID NO: 4120226 - RNA, 64 nt, Human
ugccuggcaggagcuguggccguagcuaggggauuacagcuacggccacaacucuggcccugua

SEQ ID NO: 4120227 - RNA, 57 nt, Human
ugccuggcccugacagcccugggcucccucugggagaggauaggggcaggggcagca

SEQ ID NO: 4120228 - RNA, 110 nt, Human
ugccuggcucugaccuccaaaagggaggggcugcccuggugucagggccuagggcguacagauggcuccacaaggcagcuccuccaggucaggcagcuggagcccgggca

SEQ ID NO: 4120229 - RNA, 58 nt, Human
ugccuggcugcugguucugaggauggggaugcuucaguccuggccagggcacuaggca

SEQ ID NO: 4120230 - RNA, 83 nt, Human
ugccuggcuuuugccugcucagguuggcguuuuucugacacacagauuucuguugccaugcucuggggaggucaagcagggua

SEQ ID NO: 4120231 - RNA, 100 nt, Human
ugccugggaggcaggccugaggccaccaucuuguccccagauauccagaucuugggggacuuuggcauggaaaggggccagagccugccuuucacaggca

SEQ ID NO: 4120232 - RNA, 64 nt, Human
ugccugggcuuuucuggaaacugcuggggcaggcccaccagaaguuugaaugagagccugagca

SEQ ID NO: 4120233 - RNA, 65 nt, Human
ugccuggguuugggagaugguaaugguguacaugcaucucuguuagaucugcuuaaacacaggca

SEQ ID NO: 4120234 - RNA, 89 nt, Human
ugccugguguuuagcaaggggagguggagugugguccucccccaggagaggcagcaggcgacuucccuauugaaaacacagcuguggca

SEQ ID NO: 4120235 - RNA, 55 nt, Human
ugccugugcccuuugcugggaggcuaaucagaauccaggaacgagaggcugggca

SEQ ID NO: 4120236 - RNA, 61 nt, Human
ugccugugggugccaccacccuuugagaacugaaaaaugcgugugcccccaccuccaggca

SEQ ID NO: 4120237 - RNA, 56 nt, Human
ugccuguguaguucagccugugaaggcucccuuucaaguaggccagcugcauggua

SEQ ID NO: 4120238 - RNA, 68 nt, Human
ugccuucccuggcaacaaacaaggucuuuccuuccccaggaagggugugugugagggacacaaaggca

SEQ ID NO: 4120239 - RNA, 58 nt, Human
ugccuuccuggagcugaaggcugcugggggaagugccuccacagcuccagggcaggca

SEQ ID NO: 4120240 - RNA, 56 nt, Human
ugccuucuuaaauuaguugaccaggcagguucugguuuggucaagaaaguaaggca

SEQ ID NO: 4120241 - RNA, 71 nt, Human
ugccuugagggaguaagaugagaagacuggggugguuguccaggcuuauuaucuucuccauuacucaggca

SEQ ID NO: 4120242 - RNA, 56 nt, Human
ugccuugcgggcguuucuguuguaaguggagggcagcagggccacgcuccaaggca

SEQ ID NO: 4120243 - RNA, 78 nt, Human
ugccuugguagugauuaauaguacagguucuuagauuuagaccauuuaggcucuuuaucaguuaacucuugccaggua

SEQ ID NO: 4120244 - RNA, 62 nt, Human
ugccuuuauggccauuuucauugcccucuugugguuuugcaguuauuuggcuauagauggua

SEQ ID NO: 4120245 - RNA, 56 nt, Human
ugccuuuggaaggcagagcucugugaacuauguauauuuucuucuuuccaaaagca

SEQ ID NO: 4120246 - RNA, 65 nt, Human
ugccuuuuaccuuguaauucuggugaucuuacauccauaaccucugggauugcuacagaagggca

SEQ ID NO: 4120247 - RNA, 130 nt, Human
ugccuuuuccuaacacuugucuuauuauuucgaaggucuuugccuagggagcacuagcugccuugcacaaguugaggcucuacugugcccuuggacaugagagcuaaggcauuuguugguucagaaagca

SEQ ID NO: 4120248 - RNA, 83 nt, Human
ugcgagcuucaggaaaccgcaucccagugggcacugcaguauugacugaccugcugggacgugugguugccaggagcaaugca

SEQ ID NO: 4120249 - RNA, 71 nt, Human
ugcgauaaagugcaugcaaauuacuguaaaguauuuuacauuaccauagcaacgugcaugauuaaauugca

SEQ ID NO: 4120250 - RNA, 101 nt, Human
ugcggagaauagucucugucccagacuauuuugcacaaaacaauuggcaaacaguuuaacauuuugcuagaauggcugauaggucagaguuguuuuuugca

SEQ ID NO: 4120251 - RNA, 59 nt, Human
ugcggcaggagaagguguuauggggagggugagccucccguaacucacuugugccugca

SEQ ID NO: 4120252 - RNA, 70 nt, Human
ugcggccuacugucaugugaugugaguuccuggagggcaggaguucugaccuacaugcagcaggcacgca

SEQ ID NO: 4120253 - RNA, 79 nt, Human
ugcggccuuuucaucuuccuuggcauaggucugaaggaauuucagagcuaugugggagggugagagcauccaagccaca

SEQ ID NO: 4120254 - RNA, 70 nt, Human
ugcggcuuuaaggcuugucuugcgguuuccuuaacuuaaaccuuaaaccaagcucuugagagaagcuaca

SEQ ID NO: 4120255 - RNA, 81 nt, Human
ugcgggcuggggcugcgguggaggagccaaggguugaugcacugccugaccugcccuccggcuccucgcccccagcccgua

SEQ ID NO: 4120256 - RNA, 61 nt, Human
ugcggggggaggaacaucuugcacucagaaauagccucagugcuuguucucuguccuugca

SEQ ID NO: 4120257 - RNA, 82 nt, Human
ugcggguaccaccugugccaggcccaugaacacuuacaggacagaguaugcaaccaaggauguucgggucacauagccugca

SEQ ID NO: 4120258 - RNA, 72 nt, Human
ugcgucaggcccuguugggggauuacaaacaucaacuacaugcacguaaacaucgacccaacaggggaggca

SEQ ID NO: 4120259 - RNA, 67 nt, Human
ugcgucucuguccucaaagaccuccauggccucucuucauaucaggacaucaggagacacagacgca

SEQ ID NO: 4120260 - RNA, 78 nt, Human
ugcguggcagugaagcaguccuuguugagcuauggcauguucuaauuuagcaagaaagauugcagcacuuggugugua

SEQ ID NO: 4120261 - RNA, 59 nt, Human
ugcguucaccucuggcuucuguguugagagugaacuguagagaggcaaggguggaagua

SEQ ID NO: 4120262 - RNA, 75 nt, Human
ugcguuugagauggcauucacauuuccagagaggaauaaaagaaaccaucuuggaaauguugggggccccaugua

SEQ ID NO: 4120263 - RNA, 74 nt, Human
ugcguuuucuugugguuacauuuuaagaaauuaugugcaauguuuugauuucuuuguacccacaauccaagcca

SEQ ID NO: 4120264 - RNA, 56 nt, Human
ugcuaaagcuuccuguucuuauuuucuuuccauucuaaggaaagguggccuuagca

SEQ ID NO: 4120265 - RNA, 75 nt, Human
ugcuaacaaagucuaaaucauagaaacaaugaauaauuaucaauuuacagaauauugauuugggcuuugguagca

SEQ ID NO: 4120266 - RNA, 83 nt, Human
ugcuaacuuauuugccguuuuuuaaucauguggagguagaaaaaccucagcauggagggagaacaaguaggcagauaggagca

SEQ ID NO: 4120267 - RNA, 73 nt, Human
ugcuaauuugcauggccgacuugcucuaauuuuuagaagggaugggaacuugguagggcaugaugaaagagca

SEQ ID NO: 4120268 - RNA, 62 nt, Human
ugcuacacuuaaaucagucacccaguguuagagucuggguaguuggaaaugcaaguggagca

SEQ ID NO: 4120269 - RNA, 78 nt, Human
ugcuacagggaacucaguaucugucaguaaucagguucucuuacagugaacugaucacauagauauauuccaaguaca

SEQ ID NO: 4120270 - RNA, 74 nt, Human
ugcuacucaacagggccaagcugcagcaucuguccuaaccaugcaagggucugguccugcagugaguuaaagca

SEQ ID NO: 4120271 - RNA, 75 nt, Human
ugcuacuucuaaguauucagauaguugugagucaaacugagucaguaaugcugucuggauaucuuggaauuagua

SEQ ID NO: 4120272 - RNA, 55 nt, Human
ugcuagaagcugaaaccucuugauacugcauguguagagaugacgagcucuagca

SEQ ID NO: 4120273 - RNA, 80 nt, Human
ugcuagauuucuaccuggcuggggaauagccagcccgacagagccgggacugggccaugggccagcgaggcaguuucgca

SEQ ID NO: 4120274 - RNA, 59 nt, Human
ugcuaggacucccuuguuggagucuacauguaggacacacaacagaggggucuggagua

SEQ ID NO: 4120275 - RNA, 57 nt, Human
ugcuagggcacuaggacucaugugcuuucuacuccacagguuucagaugccacugca

SEQ ID NO: 4120276 - RNA, 87 nt, Human
ugcuaggucuuaugucacggcuauuuguguccuuuuguuuauccuaugagagggaaaaacccacugaagccugggaguaagacagca

SEQ ID NO: 4120277 - RNA, 103 nt, Human
ugcuauaagauuaggugcauuguucagcauggaaucuauguaugccauuuuauuuuaaaaagguuauauaauucagugcuuuccagaguugaauuuaauagua

SEQ ID NO: 4120278 - RNA, 70 nt, Human
ugcuauagcacauucuuuaguuacugugggugccacagaaggcugccucagagaaagguauggcugagca

SEQ ID NO: 4120279 - RNA, 87 nt, Human
ugcuaucguagcagcagaugcaaacuuaccuugagagcugaacguccacaggcaccucagggcuggcuuuugcagagcuguuuagua

SEQ ID NO: 4120280 - RNA, 102 nt, Human
ugcuaugugccuaaaaggacaugcaccuuauuuaaaugauguuuuaauaaaaauaaggcauuacugaagguucaugguccuuuuuuuuaaaagguacauaca

SEQ ID NO: 4120281 - RNA, 89 nt, Human
ugcuauguggucuucuccauaggcaguucauaacauagaagcaagcugcuauguuaugaacugccuauggacuugcaaguccacuagca

SEQ ID NO: 4120282 - RNA, 64 nt, Human
ugcuauuauugucaccacuguauagaugguaggaaacugaggcuagagaggugacacaguggua

SEQ ID NO: 4120283 - RNA, 78 nt, Human
ugcuauugugaauagugccgcaaugaacauacgugugcaugugucuuuacagcagcaugauuuauaauccuuugagua

SEQ ID NO: 4120284 - RNA, 108 nt, Human
ugcuauuguuccacugagguuguauucaaaguuuaggugggugacauaaugaaggaugcaauaguuaaagcccuaaauugauagacccagaggaaaugucuaauggca

SEQ ID NO: 4120285 - RNA, 80 nt, Human
ugcuauuguuuugaauauggcugugagacaaagagcugcuuaggucaagcgcuauaaauuacaguuuucauacaauagua

SEQ ID NO: 4120286 - RNA, 61 nt, Human
ugcucaaaacccagccaucaggacuuaugaaugugagcuauuuggacagaggguuuuggca

SEQ ID NO: 4120287 - RNA, 59 nt, Human
ugcucaacagcaauaguaccagaauaaaagaaaaguuauuauguucugggcugugagca

SEQ ID NO: 4120288 - RNA, 55 nt, Human
ugcuguuucuugcaugcccacaaacaugucugcucaaugggcacaaugaacagca

SEQ ID NO: 4120289 - RNA, 122 nt, Human
ugcuguuuuguugcaucaucaugucaaagugcuguuguucaucaucugucauucaacauugaaugccagagcuccugaguaacccccaaagcacucaucaugaaguauacacagaaauagca

SEQ ID NO: 4120290 - RNA, 96 nt, Human
ugcuuaaaaaagaccugcacacugugcucuguaaggguggugguaguggugguggcuuuauccgcuugacccuuacugugcaaaaggccuuuggca

SEQ ID NO: 4120291 - RNA, 88 nt, Human
ugcuuaaagugaagaaggagcuacuaauaagagggugucuauuuagggcuuuuuaauugaacguagucuccaaucagucacccaagca

SEQ ID NO: 4120292 - RNA, 85 nt, Human
uggcaauugcauuuuacuuuuuucaacucaucuuuggaaagauuauuuuucugacgucuugaagaguagaaaaugcaaauuggca

SEQ ID NO: 4120293 - RNA, 82 nt, Human
uggcacaauaaaaacuuuuggaaucauagauauauucacuaucuugauugagugaugauuucaugagugcacgcguguguca

SEQ ID NO: 4120294 - RNA, 76 nt, Human
uggcacacaguucugcaggcuguacaagaagcauggugccagcaucugcuucuggugaggccucaggaagugucca

SEQ ID NO: 4120295 - RNA, 73 nt, Human
uggcacaguucuugaucaaccacuuguucccaacucuugaggaacaggaaacaaguuguuaggauaccuguca

SEQ ID NO: 4120296 - RNA, 59 nt, Human
uggcaccauguuggcaaauguuucgauguagcgcacaauuucaccacaugauggugcca

SEQ ID NO: 4120297 - RNA, 93 nt, Human
uggcacccaagagggcccaggaugcaagaacugaacccaaccuguggguuuggagcugagaugucacugcuggccuuacugggagcagugcca

SEQ ID NO: 4120298 - RNA, 130 nt, Human
uggcaccuaacagauguuccaucuuuguugaauucauacacgaaaaugcaugcauguguauuugcuuguguguguguguguguguguguguguaaaagagagagggagagagacagaaugguuugugugg

SEQ ID NO: 4120299 - RNA, 56 nt, Human
uggcaccugaacuuagaggugugagcgaauaucucacuuugacugggaagguguca

SEQ ID NO: 4120300 - RNA, 96 nt, Human
uggcacugagcacccauccugcucccucugccugagcugagcugccuuucaggaagcucugguuuagaaggggaaagaugucauaugcucaguuca

SEQ ID NO: 4120301 - RNA, 122 nt, Human
uggcacuggagcuggguuuccuggugacuuuacucucugucuuggcauuuggucuguguuuauagucaaagcaacagacaugagguaaugaagcagagaagggaaucacagaauaaugacca

SEQ ID NO: 4120302 - RNA, 88 nt, Human
uggcagaacuggaaucuaacacuguaaacugucuuugucuuugacaaaguugcauaaacaauagugguagaaaaggccaguguuguua

SEQ ID NO: 4120303 - RNA, 66 nt, Human
uggcagaaugaagacuggggccucaggguuucccccaucuuuccaccuuucccacuucauuuucca

SEQ ID NO: 4120304 - RNA, 112 nt, Human
uggcagaccccagccacccuccaacuaguguuuacccagugccuaauacgugcaauuagcauucuucuggggggcaccuauaguuuagugguuccguacacgggcucugcca

SEQ ID NO: 4120305 - RNA, 59 nt, Human
uggcagacuuuagggucuacauguuucaaaauggaaaauguagcucagugaaguuguca

SEQ ID NO: 4120306 - RNA, 64 nt, Human
uggcagagaugaagaguuguuuugauuaugacauaacagcugcuucuaucuuuucaaugagcca

SEQ ID NO: 4120307 - RNA, 77 nt, Human
uggcagagcugggauuuguacugggaagucuggcuccaaacuucguaccauuaaccaguauacucuccugcuuucca

SEQ ID NO: 4120308 - RNA, 57 nt, Human
uggcagagucaggauuccaucccaggcugagcacuccuggaucucugcucugagcca

SEQ ID NO: 4120309 - RNA, 79 nt, Human
uggcagaguuauauagugucagugauaaauaucaugaagaaaaauaaaggucaagagaugcugucuacagaucuggcca

SEQ ID NO: 4120310 - RNA, 122 nt, Human
uggcagcaaaccuugagcuuggggaggucuucagcugccagucucacccuggguccuccagcccuaggaugggccaguggugggaauggggauguggaccagacauccuuagcacagggcca

SEQ ID NO: 4120311 - RNA, 64 nt, Human
uggaaacuugccuguuacauuucuaguauauuauuauuauacuagugagggcuccaggcuucua

SEQ ID NO: 4120312 - RNA, 67 nt, Human
uggaaaggagggccugaaacaacacuugauggagggcccacuggaugcuugauggcucuucuuucua

SEQ ID NO: 4120313 - RNA, 55 nt, Human
uggaaaggcacuaugcaaaauuggacucagcaucacuguagcuagugucuaucca

SEQ ID NO: 4120314 - RNA, 61 nt, Human
uggaaagguguaaagcagaaccaucauuuuauccccggaacugucugaugcaccuuaucca

SEQ ID NO: 4120315 - RNA, 61 nt, Human
uggaaauagggucggaucucucguuguggauuugcgcaauuuauccuaaauccaguuucua

SEQ ID NO: 4120316 - RNA, 59 nt, Human
uggaaauauguagcaauuacaaggagcuggaaaguuuuuuugaaagcccuauguuuuca

SEQ ID NO: 4120317 - RNA, 75 nt, Human
uggaaaucaaaauaaaaugucuccacugggcucauuaccugagaucuuuuuguugaccuuuucuugaguuuucca

SEQ ID NO: 4120318 - RNA, 87 nt, Human
uggaaaugaacacaaaauaccaucuaaugcuuacuuuggggaacgggaagagagccucaaacagagagauguauguggagguuucua

SEQ ID NO: 4120319 - RNA, 72 nt, Human
uggaaauguuugucaggcugccagucuuuauuguguucuuuuaugcacaagaugugccuggcagaaugucua

SEQ ID NO: 4120320 - RNA, 59 nt, Human
uggaaauuacuaacacuuagaggaagaaaaauauuacuuuagggucauugugauuucua

SEQ ID NO: 4120321 - RNA, 59 nt, Human
uggaaauuccuaauuaacauggagagaauauuuucucuuuacuggaauggaacuuucua

SEQ ID NO: 4120322 - RNA, 65 nt, Human
uggaacaaacauggugauggcuacaagugacuugggaaucacaagcguccuaugauuuguucaca

SEQ ID NO: 4120323 - RNA, 66 nt, Human
uggaacaaggguucauuuaaauuguaaggcaguauacaagcagcaauuaaaugauaucuuuuucca

SEQ ID NO: 4120324 - RNA, 58 nt, Human
uggaacaauucuugaagggaaucaucaaggaacuggguuccuuucaauuucuauucca

SEQ ID NO: 4120325 - RNA, 84 nt, Human
uggaacauuaagggggaagaaagaacauggcauacaaaaauauguguaaaugcaacgggcuuuccuuauccucuugaguuuuca

SEQ ID NO: 4120326 - RNA, 90 nt, Human
uggaacuugucaagggaaugaauuuuggauggugaaguuaccacagcagugaaucuguugcuuucauuugaaguccauucacagguccca

SEQ ID NO: 4120327 - RNA, 63 nt, Human
uggaagaacuugugaaaugccagauaaucuuaaaggagggcaucagguauuuuaugcuuacca

SEQ ID NO: 4120328 - RNA, 86 nt, Human
uggaagacaauguaaaguagcuuuuaugauuuacugcaaagaauccugcuuguuuaaaguccuggcugucuuauguugaacuuuca

SEQ ID NO: 4120329 - RNA, 86 nt, Human
uggaagacucuggacaggcagagaugagaaggagcauguaacugaaacuacaaguugucuccuaaugucuguuuccucuucuucca

SEQ ID NO: 4120330 - RNA, 67 nt, Human
uggaagagggagcuggguggcccuuacuuuccuuugcuuaaagguggcccugacuuuccuuuucaca

SEQ ID NO: 4120331 - RNA, 69 nt, Human
uggaagccauagauagagguuccuaauagaaguaccuuugguuaugagucuguuuuuuauggucuuuca

SEQ ID NO: 4120332 - RNA, 82 nt, Human
uggaagcugaggcaaguaauucaaagcuguggcucaaagaaauugacagggccaggcugugggugauuuacuguggcaucca

SEQ ID NO: 4120333 - RNA, 79 nt, Human
uggaaggagagcagcggcauuugguuugguggugggcagauuuucuuuuacgacugcuaaaugccugccuuucucccca

SEQ ID NO: 4120334 - RNA, 62 nt, Human
uggaaggccugugaccauccauccuguccucucuccagaugguugguccauaggccuaacca

SEQ ID NO: 4120335 - RNA, 60 nt, Human
uggaaggcgucucgaaggccuagucuguucuguucacaguagugucuuaagagccuugca

SEQ ID NO: 4120336 - RNA, 58 nt, Human
uggaaggcuuugcuguccuugcuguguguaagaucggagaaggcaaggaaaccuucca

SEQ ID NO: 4120337 - RNA, 68 nt, Human
uggaagggagugacagucagaggcuaguuauuauuguuuuugcuucucuuauugugacucucaguuca

SEQ ID NO: 4120338 - RNA, 78 nt, Human
uggaaggggcuggaaggaagcugucuggaugugugcccuuacacauacaucuuaacgcgcucuuggguuuuucuucca

SEQ ID NO: 4120339 - RNA, 97 nt, Human
uggaaggggcuuaggucucugaaguauuauaugaaaauauuccaccaaccaggaauaauuacauuauacuguuagaggauaagcaaccaacuuacca

SEQ ID NO: 4120340 - RNA, 92 nt, Human
uggaagugacuuuugagcaaaucagauuguaauuacuaacuugguaaucaauugaucauuguucagggagauuaguguaagauguccuucca

SEQ ID NO: 4120341 - RNA, 57 nt, Human
uggaagugauuuugcuucugccuauuucuauuugcuagaagcuagucacuaaaucca

SEQ ID NO: 4120342 - RNA, 89 nt, Human
uggaagugcacaggcagccaaguccugggcauuugaacaggaaggauguuccucaguagcucacaaggacccuaacugcugcauuucca

SEQ ID NO: 4120343 - RNA, 58 nt, Human
uggaaguggcagaggaagugguauaggaaaauuaaaucacuuugacggccaacuucua

SEQ ID NO: 4120344 - RNA, 64 nt, Human
uggaaguuccaccagagcccucuuugcggguucuucaagagggacuuucucugggguuccucca

SEQ ID NO: 4120345 - RNA, 59 nt, Human
uggaaguugguagagugacagagcucagccccuuuuuggcacucugcucugccaaucca

SEQ ID NO: 4120346 - RNA, 57 nt, Human
uggaauaacucaccaaggucaucuaugagaauagccgaccuggagagauuauuacca

SEQ ID NO: 4120347 - RNA, 78 nt, Human
uggaauacacguagauuguuuaaacugguuuaaagcccuuucgcauuuacacugcuugaacaaucucucuguguuuca

SEQ ID NO: 4120348 - RNA, 103 nt, Human
uggaauauguaacuguggcuaauaauuaguauuuaucuuuucacacuucauuuucuaugugcaugaaugcaaguauuguuuguuuagccaacaagugcuucca

SEQ ID NO: 4120349 - RNA, 78 nt, Human
uggaauauuauacagcuguccaaacacauuaacugcagcauaacuucagugauguagguggauucuggcaauaucaua

SEQ ID NO: 4120350 - RNA, 58 nt, Human
uggaaucauaagaugccccuaauucagucuuaguaaagagacuggcuucuuauuucua

SEQ ID NO: 4120351 - RNA, 127 nt, Human
uggaaucauuuggggagcuuucaaaaguucuaaugucuagaucagaccucgagcaggauucugguuuaauugauuuggggcauggccugggcaucaggauucuuaggcacuucuccaggcaauucua

SEQ ID NO: 4120352 - RNA, 80 nt, Human
uggaaucuggagaugggucugucaccaguggagagaugauaagagccauauccuggguggcuuugacccacuagaagcca

SEQ ID NO: 4120353 - RNA, 75 nt, Human
uggaaugcagguagugaucgagggugacaggauuggggccccaaaugccacccucgucacuagcugcgaauaccg

SEQ ID NO: 4120354 - RNA, 58 nt, Human
uggaauguucccaaaaucccuguagauacgaaagucaguaucugaaggaaugauucca

SEQ ID NO: 4120355 - RNA, 88 nt, Human
uggaauguuuaagagaacuugagaguccucaguaaguuuuauuugugagauuuacuagggcuguuuaaguacuugcaagagcuuucca

SEQ ID NO: 4120356 - RNA, 65 nt, Human
uggaauuaccaggucauaugguaaaucuauguuuaacauuauaagaaauugccaaccuguuucca

SEQ ID NO: 4120357 - RNA, 70 nt, Human
uggaauuauauauauuuuuugccaucaucugcuguagacuauggcucccaaagaaucauggguaauuuca

SEQ ID NO: 4120358 - RNA, 83 nt, Human
uggacaagucugcuguucucaugcugauuuucuguuaucccuuuacauucugaaaacaacacugccagcagaagcgcugucca

SEQ ID NO: 4120359 - RNA, 75 nt, Human
uggacaaucacucugcaacauuccugagaauugaauaauauaauaaucuugaaagucagcagaguggauuaucca

SEQ ID NO: 4120360 - RNA, 69 nt, Human
uggacaucuggaggagaugaauggcagauugaacacaagcaucuaauuauacuccucccagaaacucca

SEQ ID NO: 4120361 - RNA, 66 nt, Human
uggacaugaaaguagauuggauuuggaauuggguuucccagguucugccauuuacuuguauaucca

SEQ ID NO: 4120362 - RNA, 57 nt, Human
uggacauguccggccagacaaugggacagaaggaaaugugucagcuggacauguuca

SEQ ID NO: 4120363 - RNA, 70 nt, Human
uggacauuuccccaguggagaaguauuugaaauacugcauuuccuguugcuuuugccacugcugcugcca

SEQ ID NO: 4120364 - RNA, 100 nt, Human
uggaccaggugucuguguguauuuaugcauguauguauguaugcauguaugaauauaugcauguguugguuuaugcaugugcauguaggcugccuaucca

SEQ ID NO: 4120365 - RNA, 88 nt, Human
uggaccaugccgugccucaguuucuccauaugaacacauaggggcaucucucuacuucaggggacuauugaauccaugagcaaauuca

SEQ ID NO: 4120366 - RNA, 77 nt, Human
ucuuaucucuaaaauggggcaaagucacccugccuuacacuugagacaguggcucagccccagucuugagaugcaga

SEQ ID NO: 4120367 - RNA, 81 nt, Human
ucuuauuaguucuguuaccuuugugaguuucaccagcagcuaaugaacuccacagugagguaacuugagaacagaugaaga

SEQ ID NO: 4120368 - RNA, 55 nt, Human
ucuuauucaccucuauuagacucagucagcugagaguuuuuaauuggugaaggga

SEQ ID NO: 4120369 - RNA, 57 nt, Human
ucuuauugggaagaaauugugacaagugaaauugugacaagucucagccaaugcaga

SEQ ID NO: 4120370 - RNA, 64 nt, Human
ucuuauugucuagauugagauggggaauaaaaaagagacccucaugucuauguaugaaguggga

SEQ ID NO: 4120371 - RNA, 100 nt, Human
ucuuauuuugcaucugaaauuugucauugaaaccacaguaugacuuaaaaccacauugugauccgacugauuaauguucuucagaaacuggcagaaaaga

SEQ ID NO: 4120372 - RNA, 69 nt, Human
ucuucaaagcugcaagcuccugaggaaucugcugagguucuuaauuggccauugcaggugcuuugggga

SEQ ID NO: 4120373 - RNA, 58 nt, Human
ucuucaaggaagugaugucuucuguaagucaagagaaggcaagaaacuuucugggaga

SEQ ID NO: 4120374 - RNA, 100 nt, Human
ucuucaaguacuucagugaguccaggccuccucuuuuccugcucauccauugauaucuguguaugggaaagggggcuggacagagggggguaucugagga

SEQ ID NO: 4120375 - RNA, 97 nt, Human
ucuucaaguucuagguagacucuuggggaaaucugcagaaaagaguugugucuauuauucuggagagucaucugcuacaaccuaaggaacaugagga

SEQ ID NO: 4120376 - RNA, 85 nt, Human
ucuucaauagcuuuucuguucuuuccaacaagacaguguauuugcuucugccaaggagagaagguauguaaaaagcugaugauga

SEQ ID NO: 4120377 - RNA, 83 nt, Human
uggagacuccaggaaagugggauguguguuuuguguucuucuggccguccuucaauauacuuccaauuuccuguggguuucca

SEQ ID NO: 4120378 - RNA, 85 nt, Human
uggagagauuuggauuccagaauaccggcaagauguauuuuuuuagagcuuuuguuucacucuauuuuggaacucauuucugcca

SEQ ID NO: 4120379 - RNA, 59 nt, Human
uggagagcacugucucauuuuggaaaauuaucuauuucugaaaugugcacuguuuucca

SEQ ID NO: 4120380 - RNA, 91 nt, Human
uggagagcuguuaguugggcagggcugaagcguagguggcgaggaacaggaggcuccuacugcagauggccuuguucuucggauccuccca

SEQ ID NO: 4120381 - RNA, 55 nt, Human
uggagagguuuaaacaaaaguuggcuacaacguagugaaauuagacuucuuacca

SEQ ID NO: 4120382 - RNA, 64 nt, Human
uggagaguaauuucugaagaccauuuauuacuauuaucauuagguuuugagaaguuauuaucua

SEQ ID NO: 4120383 - RNA, 72 nt, Human
uggagaucucaaaggcuucuuugcuccaugucugucuagaugggaagaacggggaugccuuggauaucucua

SEQ ID NO: 4120384 - RNA, 61 nt, Human
uggagauggaguuacuguugagagucacuguugugagccacucugcugagcuccauuuuca

SEQ ID NO: 4120385 - RNA, 73 nt, Human
uggagcaaggagggcaaacguaagguugaauaacgaagaguuuauagcuuugggaaugcucuccugggaucca

SEQ ID NO: 4120386 - RNA, 67 nt, Human
uggagcaaggaggguggggccuuugaugaaaaccagaugucuucaaacgccuugccccuccccucca

SEQ ID NO: 4120387 - RNA, 71 nt, Human
uggagcagaguucagcggggagcugaagggaugugcaaacacggacaagauuccugcugagguuuuuucca

SEQ ID NO: 4120388 - RNA, 99 nt, Human
uggagcagggaggagcugggaugaggagcauccuuaccugggcaaucuguccagacccaucucagggaucuccuccuccuguaccccccaccaccucca

SEQ ID NO: 4120389 - RNA, 61 nt, Human
uggagccugcucucuugcauuucugccauugccauagguagaauaugccuuagcaagccca

SEQ ID NO: 4120390 - RNA, 55 nt, Human
uggagccuugggugcaagggaucagaaaggcaggucccacuggcccagggcucca

SEQ ID NO: 4120391 - RNA, 73 nt, Human
uggagcgagaaagccaagguuuuggucacagcuguguuuccuaccgccaugugacccuuggccacuugagcca

SEQ ID NO: 4120392 - RNA, 61 nt, Human
uggagcuaucagaguuauagucauuggacuggcaguccagcugcucucauagauggcuuca

SEQ ID NO: 4120393 - RNA, 94 nt, Human
uggaggaggaaguaaagcuggaggcugggguaguggcaagauaugagcauucaggucuacaaagcuucaagucucucauuacuucacuccauca

SEQ ID NO: 4120394 - RNA, 62 nt, Human
uggaggagugugaguucauccagcaggcuugaagccaggccucugggggcucagaccuguca

SEQ ID NO: 4120395 - RNA, 62 nt, Human
uggaggauacguuuuuuguccucauggagccuacuauauagaggggaaaaugcguauuaaca

SEQ ID NO: 4120396 - RNA, 73 nt, Human
uggaggcagagaagggacaggaaagaagguggccaaugacucuguggccuugcugugccuuugucugccucca

SEQ ID NO: 4120397 - RNA, 103 nt, Human
uggaggcagcacgcacuggucucccagcuguccauccacuucccagcggggcuggcugugcguggggacagcuggguggaggguggagggccucgcuccucca

SEQ ID NO: 4120398 - RNA, 71 nt, Human
uggaggcagggcugagggugggcgggcagauuuauugcagccauuccucuccccugcagcgccugcuucua

SEQ ID NO: 4120399 - RNA, 55 nt, Human
uggaggcauuucuuuuuggucgggacagaagacuaucaaucagaaagugccugca

SEQ ID NO: 4120400 - RNA, 67 nt, Human
uggaggccgaauuagagcguuggcuuuaggaaugggaauucagugccuguucugguucuucucucca

SEQ ID NO: 4120401 - RNA, 66 nt, Human
uggaggcuuucagauuaaugcugugguaagagaugacaucacauuuugagaaaugacaagcuucca

SEQ ID NO: 4120402 - RNA, 58 nt, Human
uggagggaacaaaggagucccagagcacaggcagcuuaggcacguccuugauccccca

SEQ ID NO: 4120403 - RNA, 79 nt, Human
uggagggacuuaaagagaugaugaugugaugauagcuaacauucagugguuacauacauuaccucauuuagucccuaca

SEQ ID NO: 4120404 - RNA, 68 nt, Human
uggagggaugacaaggaaagcaaaccaaauguaaucauaaaauugguugggcuucuguucucccuuua

SEQ ID NO: 4120405 - RNA, 69 nt, Human
uggaggggaggagacggagugauuagugucuucugaaaggccugugguuacgccuguuuccaaacucca

SEQ ID NO: 4120406 - RNA, 63 nt, Human
uggaggguagcuacccaacuccagagcagcacacaacgcuuuguccagguggcuaaccuucca

SEQ ID NO: 4120407 - RNA, 122 nt, Human
uggaggguccccacaagacacaucagcuuccugucuagguagaagccaagaaacaccugcucacaaggggcuuucuuaggcucuaaaaugacuugcagaugccaugggaugggggagcccca

SEQ ID NO: 4120408 - RNA, 88 nt, Human
uggagguaaguggcaggagccugcggggaggugggcugugcauugccgaccugguguccugagcgcagccugggcccgcuugccucca

SEQ ID NO: 4120409 - RNA, 83 nt, Human
uggaggucuuuguauauucugccaagguccuggggcuuuauccuaugggcaacaggagccaugagcaggaggcaaugccauca

SEQ ID NO: 4120410 - RNA, 59 nt, Human
uggaggugcuagcccuguagucagaaacugagcugggagcagaaguggcuacaucucca

SEQ ID NO: 4120411 - RNA, 63 nt, Human
uggagguggaguuggaaacugacaucugugauuuuacucucuuacuuuccagcucuagcuuca

SEQ ID NO: 4120412 - RNA, 101 nt, Human
uggaguaaggauaucauugucacauucaaguuuuauauccauggcuugauaaaauuggguuuuagaauaauaacugaugacaauguaggucauauuuuuca

SEQ ID NO: 4120413 - RNA, 66 nt, Human
uggaguagcgcaacugcagagaaguaguuuguaaaaggacaucauguugucaguugcccuucuuca

SEQ ID NO: 4120414 - RNA, 64 nt, Human
uggagucccaggauaugugcuguucagacauuguugaaacaagagacagauucugggaccacca

SEQ ID NO: 4120415 - RNA, 64 nt, Human
uggaguccuucaaucuuaagucagcccagcaauucaguuguauugaccugauggaggccauccg

SEQ ID NO: 4120416 - RNA, 57 nt, Human
uggagucguguuugggaucggagcugccugugguucugaaccauugagcacugccua

SEQ ID NO: 4120417 - RNA, 58 nt, Human
uggagugacucacagcugggacaaagguccacucgcucuugccccugcagucuaccca

SEQ ID NO: 4120418 - RNA, 71 nt, Human
uggaguggcugcugacuuuaauacaugaaaaaaaguguugccaucuguacuugaaaucagcugucacccca

SEQ ID NO: 4120419 - RNA, 72 nt, Human
uggaguguguauaggacacucugagcuguucaguccaauuagagggcaggaguguccuacugauacaaccca

SEQ ID NO: 4120420 - RNA, 89 nt, Human
uggaguuacauagaaugaguuuucagccucucaucaugaaaauucacaaagggugauggugggucugaucucauauauaugaaucucua

SEQ ID NO: 4120421 - RNA, 72 nt, Human
uggaguuagaagcaggccugccaccucgggguucccagcgccauugggaccauccccaggccacugaagcca

SEQ ID NO: 4120422 - RNA, 85 nt, Human
uggaguugagagucauguaagggagggaggugaugcuuggcugugguaccccagcaagucucuuacccucucuggcucuacuuua

SEQ ID NO: 4120423 - RNA, 105 nt, Human
uggaguuucuauuugaguauuuauaccauagaaaggaagcuacuuaggggcaaaaucugagucuuuaauguacuuucuuucacagugacucauauugcuacuuca

SEQ ID NO: 4120424 - RNA, 63 nt, Human
uggaguuugggugagguauaagaaaugggcugaucccugauuccauacuuuauucccccucca

SEQ ID NO: 4120425 - RNA, 84 nt, Human
uggauaaauagguggauuuguggaaguugaacaucauggaaagggugauuccagauuucuacacaagaccacagccauagucca

SEQ ID NO: 4120426 - RNA, 76 nt, Human
uggauaguaaacugugugccuuugacuaaaucgacuaggagucuagggaagggaggaggugagcaguuuacauuua

SEQ ID NO: 4120427 - RNA, 95 nt, Human
uggauauagccugauuucuucauuccuuuaugcacugaucuagaagagcguccuucauguagacagauuuaaaggaauggauuaaugaauaucca

SEQ ID NO: 4120428 - RNA, 59 nt, Human
uggauaugggccauggaaaaaaagugaaucuggaaaauuucauucauggccucuaucca

SEQ ID NO: 4120429 - RNA, 130 nt, Human
uggaucacugcaggcccauggucaggguucaaggagccagauucucucacuuucaacaagaaauugagaaaugaagcuggugauucagggacuccaaaaucuggccaggucguauaaugcaagugagaua

SEQ ID NO: 4120430 - RNA, 81 nt, Human
uggauccagcgugauggggccuccugccacccaggcccugcugccuauccccagguguccagguggccucugcugcuucca

SEQ ID NO: 4120431 - RNA, 119 nt, Human
uggaucugagugucauuaggagccuugcagacaaguguuucuggguaacuucucaguaacaucuuugacauuuguuuaguugcagaccuaaauggccacugauggauacugcaguuuca

SEQ ID NO: 4120432 - RNA, 85 nt, Human
uggaucuuaaaggacaaguaguauuugcaucagaaaauaagcaacaguguauuccagauaaaggcaacagcuugucuaaggucua

SEQ ID NO: 4120433 - RNA, 93 nt, Human
uggaugaaaggcuugcaagggaaaagcaaucuauccuaggguucgcucuguggacuugaaauuacuuuucaaccuuuucuucuuauuuaucca

SEQ ID NO: 4120434 - RNA, 124 nt, Human
uggaugaacuaaugaaguauauaucuuugagcuuacaauucugagagaaauauuugcccaucugucccacuagaugacaaacucuuugagaacaaggacugugucucuuaucucaguuuuucca

SEQ ID NO: 4120435 - RNA, 91 nt, Human
uggaugaagaaagccugcauaaggagauaucaugaaucauuacauggauauuuauugagccuuuccuaugugccagaugcucuauuagaca

SEQ ID NO: 4120436 - RNA, 77 nt, Human
uggaugacacugggacuauguguuucuguacuuuucuuacagaagacauacuaugaauacauguguccuggaaucua

SEQ ID NO: 4120437 - RNA, 75 nt, Human
uggaugaguuacggcaccaagcugggcccucuccgaauuuccaggaggaggcuuuugcaggugccacaaguacca

SEQ ID NO: 4120438 - RNA, 73 nt, Human
uggaugcaaagugaaauggggcagagacaccaaaaccaaauaagcggguuugccccagcucuuuuacuuucca

SEQ ID NO: 4120439 - RNA, 61 nt, Human
uggauguuggcaggucuuguugggacuuuauaauaauaaaaucuuacaaucguuacaucca

SEQ ID NO: 4120440 - RNA, 76 nt, Human
uggauuaucuauucaguauuucaugacuuucuucaucuauaauugaccaagaaagugaugagcuacagauggucca

SEQ ID NO: 4120441 - RNA, 60 nt, Human
uggauucaucucucaguguccagaaagaaucagccuucuggacucuaagcagaggaucua

SEQ ID NO: 4120442 - RNA, 76 nt, Human
uggauuccacacauaagugagaucgugcaguauuuguccuucugugccuagcuuauuuuacuuaguguaaugucca

SEQ ID NO: 4120443 - RNA, 121 nt, Human
uggauugaugauaagaagaagagcagaagcaggaggagcauuaacugagcaucuccugauugccagacacagcucagagcuugaaguuccacuuauauuugcucugauccucacaacgcca

SEQ ID NO: 4120444 - RNA, 67 nt, Human
uggauugcagauagcuauguaccugucaauggccauugcugucaggacacagcuuucugugauacca

SEQ ID NO: 4120445 - RNA, 57 nt, Human
uggauugccacuguguuuuugaaucuguaauucuagauguagcuacaaggcaguuca

SEQ ID NO: 4120446 - RNA, 87 nt, Human
uggauuguugaaaaugguuuggcucugucagcacuugccauggagauacaggccuugucacuuuggccaagccauugcaauauccca

SEQ ID NO: 4120447 - RNA, 90 nt, Human
uggauuuaauacucaaaaggcagagauuagcagaaugauuaaaaagucauccagcuauauuuugccuguaagagacaucuauuggauuca

SEQ ID NO: 4120448 - RNA, 84 nt, Human
uggauuuaauacugaaaguuggauaaaauuugaucuuguuaagaagacaaggaagauauaucaagcuuaauguaauggaguuua

SEQ ID NO: 4120449 - RNA, 63 nt, Human
uggauuuaaugcuuucuuuguauugcugauccuuaagcaugauuagagaaagaauugagucua

SEQ ID NO: 4120450 - RNA, 69 nt, Human
uggauuugugagggucacagugcaccacaccaucccucccugcaccggguggcccugccgcagugucca

SEQ ID NO: 4120451 - RNA, 95 nt, Human
uggauuuuuuccugggaaaacagagaacuacuuuuuauauguguaucuuuuuaugcaauuagcauuguauucuuaguucagggaaaauauaucca

SEQ ID NO: 4120452 - RNA, 64 nt, Human
uggcaaaagaaucacauccuucagcaaguccaugggaacaacuagggcuaggggcugugagcca

SEQ ID NO: 4120453 - RNA, 92 nt, Human
uggcaaaaucucuacaaaucaauuugauuaauaccauacuugguuuaaaagucuaagaaaugugaauauugaauagauauuugauuuugcua

SEQ ID NO: 4120454 - RNA, 118 nt, Human
uggcaaaauuaauuuuuccaucauauuggagugagccacaugucaaacacaaguguacacuucaguuguguacaaauuuugguccaaguuuuacucuuuuggaagaauaagcauguca

SEQ ID NO: 4120455 - RNA, 65 nt, Human
uggcaaagaugaagcauuucgucucuucgagguaauguugaauuggcuucaucuauauguugcca

SEQ ID NO: 4120456 - RNA, 78 nt, Human
uggcaaaguaucugucccagcuccauaugaaagaaagacuugucaucaucugaacccuuugggacacuugcuuugcua

SEQ ID NO: 4120457 - RNA, 57 nt, Human
uggcaagaaacugaggccugcugucaacaguuagcagggaaccaagaccuuuugcca

SEQ ID NO: 4120458 - RNA, 81 nt, Human
uggcaagagaaaccuauugcauuugcaagauuagagcuaauugguuuugcagagugcaauaaaucaguuuugaaaaugcca

SEQ ID NO: 4120459 - RNA, 59 nt, Human
uggcaauuucagaaaauagaauaaagauuagucuuaguuuaguuuugaugaaaaugcca

SEQ ID NO: 4120460 - RNA, 69 nt, Human
uggcacagugauuuuaggauagauggacuuccugcaugguggccaacuccuccaagggugauuguucca

SEQ ID NO: 4120461 - RNA, 85 nt, Human
uggcacaugccuguaaucucagcuacuugggaggcugaagcaagcgaaucgcuugaacccaggagguagagguugcagugaccca

SEQ ID NO: 4120462 - RNA, 59 nt, Human
uggcacaugguaagugcuuaacaaguguuagcacauguuauagcaaauagugugugcca

SEQ ID NO: 4120463 - RNA, 67 nt, Human
uggcaccugcucaucuggacucagcgccugccuccauccaaguugagugucccaaagcagguaguua

SEQ ID NO: 4120464 - RNA, 73 nt, Human
uggcacuaauagagucauuauuauuguucucacagauuagauggcagagccagugaugaagacucuggagcca

SEQ ID NO: 4120465 - RNA, 56 nt, Human
uggcacugucaagaacuuaauaaaucagagauaagugaguuaaaaugucagugcca

SEQ ID NO: 4120466 - RNA, 69 nt, Human
uggcacuguggauuucacaaguuuccugacuucugugagcuguuauguaacguggagauugacauguca

SEQ ID NO: 4120467 - RNA, 55 nt, Human
uggcagaagguaccugaccccaaguguuuuugccaccaggaaacaccuacugcua

SEQ ID NO: 4120468 - RNA, 88 nt, Human
uggcagaauuguacuaguuauucuuuguaugguacaucuaaaacucaggguguuaguauuaaggaguaaaugucaacaucucuagcca

SEQ ID NO: 4120469 - RNA, 58 nt, Human
uggcagagcccagacuccagucagauuugccuggccccagaguggguguucugaacca

SEQ ID NO: 4120470 - RNA, 72 nt, Human
uggcagaggagcccacccaggcaccuugugcacucacagaaaucugggcucugggaaauggucuuccugcca

SEQ ID NO: 4120471 - RNA, 81 nt, Human
uggcagccccuccagggaggguccugaggccggcaguggugaagcagcaggcaccggguugcuccccuccgaggggcucca

SEQ ID NO: 4120472 - RNA, 87 nt, Human
uggcagccuaauagaggugacccaccugccucacccugguuuguucuuauagauguaacgguagguggcauuucaaauggguuucca

SEQ ID NO: 4120473 - RNA, 129 nt, Human
uggcagccuaauauuuuguuaugcuuuauacagguaggaaggagacuaggcugauugaagagauucauuauaauauaguuucagcuccuucauccugucugauggggaaaagugaagaagaaucugcua

SEQ ID NO: 4120474 - RNA, 57 nt, Human
uggcagccucugguugcuucaggaugggaacuagucaccagagagaccaaggcgcca

SEQ ID NO: 4120475 - RNA, 76 nt, Human
uggcagccuuauuuacagaugaugcuauuugaaaucuaguguuuguaaauagaaguuggugaugguaaggcugcua

SEQ ID NO: 4120476 - RNA, 64 nt, Human
uggcagcucaugccuguaaucccagcacuuagggaggaagagcugggaagauagcuugagccca

SEQ ID NO: 4120477 - RNA, 62 nt, Human
uggcagcuccggguaggggcugaauuaggguggccagcccuccuuuacccagcuggcugcca

SEQ ID NO: 4120478 - RNA, 62 nt, Human
uggcagcuggagggcaauggcccccaaccccuggcacggccaucccacccgccagccagcca

SEQ ID NO: 4120479 - RNA, 87 nt, Human
uggcagcuggggcugaagacacccaagggcuugacugcucacuaacuuggcugacaguuaaauuuggcuguuuucucaaagcuguua

SEQ ID NO: 4120480 - RNA, 61 nt, Human
uggcaggaaaguaacagagcacagcggaugguacaauaaagugcuaguuaacuuuuagcca

SEQ ID NO: 4120481 - RNA, 79 nt, Human
uggcaggaagcccugugauggagacuagaggccaagaggucuaaagacacuuuuuacagggggcucuuuguauccucca

SEQ ID NO: 4120482 - RNA, 58 nt, Human
uggcaggaguuaggguaaaaaugaccuaauaggucuuuuccaacucugauuucuauca

SEQ ID NO: 4120483 - RNA, 93 nt, Human
uggcaggaucaguugcccacuggcuguuggucagaggccucuucugguuccuggccuugugacccucuccaaugggcagcucacagccuggca

SEQ ID NO: 4120484 - RNA, 59 nt, Human
uggcaggcaggcagccuucugagcugggguccuuuugagauggcuuagccuggcuccca

SEQ ID NO: 4120485 - RNA, 61 nt, Human
uggcagggagccaccggucaugucccacuuaaaggacacacaaccgagaagcuucuuguca

SEQ ID NO: 4120486 - RNA, 59 nt, Human
uggcaggucaugaguggccaccucacucuccaccuggucacccccaccaucaccuccca

SEQ ID NO: 4120487 - RNA, 60 nt, Human
uggcagguggcucuggcauucugugcaaaucaaacagaauuaaccucauaacccuugcca

SEQ ID NO: 4120488 - RNA, 76 nt, Human
uggcaguaccauuugucacacauaguuuauccuaaauucaccacugagaaugaacuacaugugacaauugaaguca

SEQ ID NO: 4120489 - RNA, 62 nt, Human
uggcagucacaucaguaggaaggaugcagaaaaaugacagagucgucgucuuucuuaugcca

SEQ ID NO: 4120490 - RNA, 60 nt, Human
uggcagucgaucauauucagcaggagagaccaggauguuugcuauuugauggauugcaca

SEQ ID NO: 4120491 - RNA, 66 nt, Human
uggcagugaaagacaauugggccaguugagauucacaacuccagccugaaaauuuucuuuacguca

SEQ ID NO: 4120492 - RNA, 64 nt, Human
uggcaguggcuccuuucauggguccaugaaaucuuaagcagggccaggaagugcagcccugcca

SEQ ID NO: 4120493 - RNA, 106 nt, Human
uggcaguguuagcaugaucccaggguggaguuuucagcccucugacauuaaaaggugaagcagaggacaugaaaacucgcucugugcauccucuguacgcuggcca

SEQ ID NO: 4120494 - RNA, 74 nt, Human
uggcaguuaagagaucauugcugccuuuuucuauaauuggauauuuauaauaaagaagauagaaugagcugcca

SEQ ID NO: 4120495 - RNA, 76 nt, Human
uggcaguuccugcugcucaccuuuuugucauccucuucucuuuucaggggcaaacaggagaguaaagagagggcca

SEQ ID NO: 4120496 - RNA, 88 nt, Human
uggcauaauaaaguauaagcauuggaguauuccaugcacuugucuaucaaacagugguccauacucccaacccuuuugcauugcgcca

SEQ ID NO: 4120497 - RNA, 97 nt, Human
uggcauagaucugaaauuuagagagccaguugucauaguucuaacaugccccuucaucaugugacugcagcuucucuuuccaaauuaucuccugcca

SEQ ID NO: 4120498 - RNA, 109 nt, Human
uggcauauagggccucagaagggugagugacauguuacuggaguucaagugcacugaauaaccuuccagccauucauuaugacaccuacugggaaucuauuaugugcca

SEQ ID NO: 4120499 - RNA, 56 nt, Human
uggcauauguuccaaauaauccucauacagggaagauuuggcaaaggcgaugcaca

SEQ ID NO: 4120500 - RNA, 80 nt, Human
uggcauauugcugagugaccaauaaauauuuucugaauaaauaaugagaguaaacaugcuguguacucagcacugagcca

SEQ ID NO: 4120501 - RNA, 74 nt, Human
uggcaucugaggcaguuuaauuuuugaagcggagacacagaagcuuuagcaaauuagcaccucuaaggauggca

SEQ ID NO: 4120502 - RNA, 73 nt, Human
uggcauggaagaaaggauauauagaugaaagagguuaauaaaaguucugucaucaaauaugcuuucucugcua

SEQ ID NO: 4120503 - RNA, 81 nt, Human
uggcaugggaggcuggaaagagaaccugggggcccugcgggaggaggcugugccccagcuugucugauucagccugugcca

SEQ ID NO: 4120504 - RNA, 57 nt, Human
uggcauguauuuguggugaauuaugaauagaaauaauuuuucaugcauacaugcaca

SEQ ID NO: 4120505 - RNA, 56 nt, Human
uggcauguucucuuagcagcucccuuaacagggugagguagggcagguacgugcca

SEQ ID NO: 4120506 - RNA, 60 nt, Human
uggcauguuguuuauguuucuggagaauaaaaucuuaccagaucaauaaacgcaugucca

SEQ ID NO: 4120507 - RNA, 59 nt, Human
uggcauugcuagugacccagcaggucugacugccuuucugcucuauugcuggcgaucua

SEQ ID NO: 4120508 - RNA, 68 nt, Human
uggcauuguccugccucuccaugcuaacuaccuuuuagcgcauguacugagugccaggcacuaugcua

SEQ ID NO: 4120509 - RNA, 65 nt, Human
ucuucaauuucucaauaggcaugugaucucagaaaaaagguccugugucccagagaaagagaaga

SEQ ID NO: 4120510 - RNA, 60 nt, Human
ucuucacagaugcauauacuucauccuggcuuccacccacagagguugcaucugugcaga

SEQ ID NO: 4120511 - RNA, 56 nt, Human
ucuucacagcuuuguccagaagcccacaugguguugcuggcaugcaugcuguagga

SEQ ID NO: 4120512 - RNA, 56 nt, Human
ucuucaccauaaugcaaagugggauuuagugggauuuugcuuuaagauggagagga

SEQ ID NO: 4120513 - RNA, 61 nt, Human
ucuucacuggaacuauuuuaauaaaaugagcuauaagcuuuuaacauaguccagagaacga

SEQ ID NO: 4120514 - RNA, 76 nt, Human
ucuucacuggccaaacugaagaaugaaggggaaauugauaaaaucaccaccccagaauuuuucaaggccgugauga

SEQ ID NO: 4120515 - RNA, 59 nt, Human
uggcaggcucugaguagcaccuguguccuuuagaucaagcaucugcugccaguuugcca

SEQ ID NO: 4120516 - RNA, 62 nt, Human
uggcagugccagagguacuaguggagggccuaacaucccacauccacuggauuggcaagcca

SEQ ID NO: 4120517 - RNA, 57 nt, Human
uggcagugggcauauuuucuguuacgaccuugcuuuuagcagaaacaguucaggcca

SEQ ID NO: 4120518 - RNA, 65 nt, Human
uggcaguugaguuacugggugaaaaguuuaaugugcaucggauuuuuuaaaaaguagcauugcca

SEQ ID NO: 4120519 - RNA, 73 nt, Human
uggcaucaguguuaacaugaaugguuuccuggacagcaacuacugucaguaaacuguccacauguggcaccca

SEQ ID NO: 4120520 - RNA, 74 nt, Human
uggcaucaguuucuagccucacuguuuagaauguugcaguucugaaucagugucugggcuggagaaagaaucca

SEQ ID NO: 4120521 - RNA, 91 nt, Human
uggcaucaucacugucuuaaacaugcuugcuuagaaucagcuuccucccagaugcugaagcuaacggcuaugucuaaaaccagaugggcca

SEQ ID NO: 4120522 - RNA, 76 nt, Human
uggcaucucauuuggccauuccagucacaugcucaaacccagagccaaugugggagaggauuagacaaggcugcca

SEQ ID NO: 4120523 - RNA, 61 nt, Human
uggcaucuccgacagucuugaugcgacuuaacgcaugguaagaacccaucagagaaggcca

SEQ ID NO: 4120524 - RNA, 75 nt, Human
uggcaugaaccccggaggcggagcuugcagugagccgagaucgcgccacuguacuccagccugggggacagaucg

SEQ ID NO: 4120525 - RNA, 56 nt, Human
uggcaugcaugggacagaaacaucaggcagacgucagacugacuccuuugcugcca

SEQ ID NO: 4120526 - RNA, 81 nt, Human
uggcauggauggccugagcacagcuggcauggaggucaggccaagcuaagcugagagcccaggccacagggaguccugcua

SEQ ID NO: 4120527 - RNA, 61 nt, Human
uggcaugguuuccugcaacguucugccucuggggcagagcagcuuuucggaaccacugcua

SEQ ID NO: 4120528 - RNA, 71 nt, Human
uggcaugucucuacacugacaguaggugcauugcugcagaccggugugcuguuguucagguagaagugcua

SEQ ID NO: 4120529 - RNA, 77 nt, Human
uggcauuauguagcuaaaaauuguguccugucucuaccuauuuuugaagaccauccuuuaguuugcguuuccugcca

SEQ ID NO: 4120530 - RNA, 64 nt, Human
uggcauuucuggccauuugugucugugacagucucucagcccaggaguggugcaggaccugcca

SEQ ID NO: 4120531 - RNA, 59 nt, Human
uggccacagccucugccaguucaauucuugaaggccugcucugugccagggcugggcca

SEQ ID NO: 4120532 - RNA, 90 nt, Human
uggccacuucccuccucugcacggggccucugcugggccgugguggugcccacagcuggccccacaguagaggcaggcagaggguggcca

SEQ ID NO: 4120533 - RNA, 67 nt, Human
uggccagaacgggaagcugaaauucugaaacaagcaaaauuuuucacaauuucccuucaucaggcca

SEQ ID NO: 4120534 - RNA, 58 nt, Human
uggccagaccugacugucagggugcagucacccugggauggauuggcaggaaugguua

SEQ ID NO: 4120535 - RNA, 85 nt, Human
uggccagagcuuaguacaggcccauccgucacggggcugauuugguucagcagguguuggcugggccaucgcucauuucaggcua

SEQ ID NO: 4120536 - RNA, 62 nt, Human
uggccagauucaugcauguaucacccagcaguuagcgaugagcacucaugagcucugggcua

SEQ ID NO: 4120537 - RNA, 95 nt, Human
uggccaggauggucucaaucuccugaccuugugaucugccugccuuggccucccaaagugcugggauuacaggcgucagccaccgcgccuggcca

SEQ ID NO: 4120538 - RNA, 76 nt, Human
uggccagggaagcuggucacgcagguaaucuggcuauuucuccuuacagacccagcugaccacuuuccuugagcca

SEQ ID NO: 4120539 - RNA, 66 nt, Human
uggccagguagcugauuucaauacuugaacccaauugggaaagaauuggucacaugcuacaagcca

SEQ ID NO: 4120540 - RNA, 55 nt, Human
uggccagguguggguucucagaaauguucuuuuugauuccccuucacucuggcca

SEQ ID NO: 4120541 - RNA, 67 nt, Human
uggccaugggugggagugaaggggcucagccuuaggggcgggaagucuuuucuuccacccaaaucca

SEQ ID NO: 4120542 - RNA, 56 nt, Human
uggcccaggcgaggugggcagacaugacucucgcgucagcaucuucccuggugcca

SEQ ID NO: 4120543 - RNA, 57 nt, Human
uggcccauguaugugucaggguuugcuuagggacccccaaacaugaucauggugcca

SEQ ID NO: 4120544 - RNA, 76 nt, Human
uggccccagccaugaagacucagaagcuaagauaccgacgguguuccucugaacuucuuccaauggcuaaaagcua

SEQ ID NO: 4120545 - RNA, 80 nt, Human
uggcccuguucuacuucauuccuucccuaagcaacuagcaugaagaagcuaugauuacaagggcaaugaacaaagggcca

SEQ ID NO: 4120546 - RNA, 65 nt, Human
uggccuauugucugggaaaaggaauguccaaggaugcucacuacauuuuagacaguaaagagcca

SEQ ID NO: 4120547 - RNA, 96 nt, Human
uggccuauuuuuucuuauggggggaguguugacaagauuuuguggcauuacuuacuggcccacaucaucugcauguccccauggaucccaaggcua

SEQ ID NO: 4120548 - RNA, 63 nt, Human
uggccucagaauugccucugugagcagcugguguggcugcacuuuggaaaauuuugaguucca

SEQ ID NO: 4120549 - RNA, 64 nt, Human
uggccucagccucaucacucugacccuuccaggucuccaguggcacaaaugggugcucaggcca

SEQ ID NO: 4120550 - RNA, 122 nt, Human
uggccucugaugacaggaggggagccauccuuuaggagugaggaccgagcagauuuagaaaaaccuucaauuccugcuuggcuuuacuagggggacauccucucucuagcagcuggagguca

SEQ ID NO: 4120551 - RNA, 78 nt, Human
uggccucuggccacuuuaaguuaccaguggaaagagcccaccucuuuucaaguuguugcauuaaaugucucaaggcua

SEQ ID NO: 4120552 - RNA, 61 nt, Human
uggccucuugcuguagaagcaaagugaccuucugucagguuaaccugcagcuggagggcca

SEQ ID NO: 4120553 - RNA, 60 nt, Human
uggccugaguugucugcaggccucaucucugucugagcucguccccaaccaaccaggcca

SEQ ID NO: 4120554 - RNA, 122 nt, Human
uggccugaugcacgccaccagccucccgcugaaaggugacacucugccagcuggguucccuuagucacccugugggcgccugucagccucacucaagaauggagcugguggcugcaucccca

SEQ ID NO: 4120555 - RNA, 59 nt, Human
uggccuggcagagcaaggccugccccacuggguuccugccuuggugucugguaguguca

SEQ ID NO: 4120556 - RNA, 56 nt, Human
uggccuggcucacagugagauucauggggcagccacgaaucugccugagccagcca

SEQ ID NO: 4120557 - RNA, 66 nt, Human
uggccuggcucaugauaaucagauuuauaggaggcucacuuacaaaucagaucaugaguuuauuca

SEQ ID NO: 4120558 - RNA, 56 nt, Human
uggccuggugcucaggcaguaguagauuuugccugcugacuucaguaucaaggcca

SEQ ID NO: 4120559 - RNA, 59 nt, Human
uggccugucuuguugugcuagauauacccauccccgcagccacugcagacagaaagcca

SEQ ID NO: 4120560 - RNA, 101 nt, Human
uggcgguaggcaaccugucuagugaaaguucaaggaggucucacuaaaaacacagugaguucuaccuccuggcuuaucauggacaggcucuguuuauucca

SEQ ID NO: 4120561 - RNA, 60 nt, Human
uggcgucucucauaaguaugugccuuuugcagguccacaaacauaugaaugauagagcca

SEQ ID NO: 4120562 - RNA, 66 nt, Human
uggcuaacauuuuaguuuuagguagaaauguagaauugacaauaucuugaaauuggaugguagcua

SEQ ID NO: 4120563 - RNA, 78 nt, Human
uggcuaagaaucauagagccacugauagagcaauagcacugauuauuaguuaucaaaggcuaugugauuuuuagguca

SEQ ID NO: 4120564 - RNA, 68 nt, Human
uggcuacccagagccucacccugugcacagaggagugugucaaaacuggggcagguucuggucagcca

SEQ ID NO: 4120565 - RNA, 79 nt, Human
uggcuacuggaaguccaagaacaaggugcuggcaggauugauuucucuugaggcucucuccuuggcuuucagaaggcca

SEQ ID NO: 4120566 - RNA, 72 nt, Human
uggcuacuuuccuuugaucuucugcuuccuuugaacaaaguagcagaaggucuugaagggcaaaaguggcca

SEQ ID NO: 4120567 - RNA, 126 nt, Human
uggcuagaaacgugcuaucuuucagugauaaagacgcucuaguuuccuccuggcauggugccugucagaggcuaucauccuagaaggaagcuaggaucacaggguuauuagcaacaucuuuggcca

SEQ ID NO: 4120568 - RNA, 64 nt, Human
uggcuagcccagagccugaguagggaaggcuugauuuuacgucugcuuuaacucugggaagcca

SEQ ID NO: 4120569 - RNA, 95 nt, Human
uggcuauuucuuuaaccuuuggcccaucucuuuuauaauaaaagcaggccaucaaaugaagugcugguucuuaggagagagauggcgucaagcca

SEQ ID NO: 4120570 - RNA, 74 nt, Human
uggcucaaggaaacagauuuuagacucuuggccuccagaauuuugagagaauaaauuucuguuguuuugagcca

SEQ ID NO: 4120571 - RNA, 59 nt, Human
uggcucaagugauccuccugccacaaccuccgaguagcugggacuucaggcaugagcca

SEQ ID NO: 4120572 - RNA, 55 nt, Human
uggcucagccagcccuaggaacagcuugcuuuguuugugcugcuucuuugagcca

SEQ ID NO: 4120573 - RNA, 92 nt, Human
uggcucaggacagguguucuagaucagcugacagcucugcuccacaauucaauucagagaacuggucuaaagauacuuggccuucaaaguca

SEQ ID NO: 4120574 - RNA, 62 nt, Human
uggcucaucuuuuuagacuuaucgaaaccauauagcaggaggauggucuuugaggugaacca

SEQ ID NO: 4120575 - RNA, 64 nt, Human
ugccagucacaguucucaaagagcuauucucuuccucccuuccucauucaggcugugccuggua

SEQ ID NO: 4120576 - RNA, 66 nt, Human
ugccagucagcuggccaggcuggcagccugccagagaaagccagccagccagccaguugcucagca

SEQ ID NO: 4120577 - RNA, 56 nt, Human
ugccagucggcacuuuaucuggccggacauuggucccucaggaggucgaccuggca

SEQ ID NO: 4120578 - RNA, 59 nt, Human
ugccaguggccugugugguggccucuauucucaggcuccaggcaagagaggcucuggca

SEQ ID NO: 4120579 - RNA, 66 nt, Human
ugccaguugggcccaggaaauagccaggagguggggagcaccaggucuuggguuuucugggaggca

SEQ ID NO: 4120580 - RNA, 84 nt, Human
ugccauaagauuguaugccuucaagucuuuuggcaagccuuccuuuugccaggccaaugaaggcagggaaugcaauucuaggca

SEQ ID NO: 4120581 - RNA, 76 nt, Human
ugccauauaaguguguggcuguuaguucccggcuugugcagugccuaaguaugcugacugccuuaccuauauggca

SEQ ID NO: 4120582 - RNA, 69 nt, Human
ugccaucccuucucuggccagcagagggaagcagaugcccagacugugaccuccaggaaggggugugcg

SEQ ID NO: 4120583 - RNA, 64 nt, Human
ugccauccuagcaucagaugagaagcugugaggccagacaccuacaguugcgugaugugaggca

SEQ ID NO: 4120584 - RNA, 75 nt, Human
ugccaucuccaucauccagggccggugguccacuuugagaugucugugcugucugccucaggaugagggugagca

SEQ ID NO: 4120585 - RNA, 88 nt, Human
ugccaugcuagaaggaagcccagcacuucucugaagauggcaccaaaaagguagaacuaggaaggcagguuccuaacucuggcaugca

SEQ ID NO: 4120586 - RNA, 124 nt, Human
ugccauguccagcucagcaaaguggcaaagguuucacuaggguauggcuucucaugaugcaguacccugcacacagaaccucauagccucucuaaacgucuuuacacucuggcugggacuggca

SEQ ID NO: 4120587 - RNA, 67 nt, Human
ugccauguggauggucuccucaucacacacaggcugugacucuugaugacaggccacccaccuugca

SEQ ID NO: 4120588 - RNA, 69 nt, Human
ugccauuacuuggggaggauaaaaggagagggaagaaaacuagcuuccuuaaauaucuacccuguggca

SEQ ID NO: 4120589 - RNA, 69 nt, Human
ugccauuagaguauaucauguugugcuucagcauuuacuuaugcauaacaaauaugcuuuaaauaggca

SEQ ID NO: 4120590 - RNA, 58 nt, Human
ugccauucucuggcuaugggcuucugcacagugcugaucaccagugccaagaguggca

SEQ ID NO: 4120591 - RNA, 59 nt, Human
ugccauucuugucucuucagcagagcugcugugcuacugaaaugauguacaagaaggca

SEQ ID NO: 4120592 - RNA, 65 nt, Human
ugggcucagugggagaaagggcaaaugcugaucagcccuuuucuaagucuuccauuuccuuucca

SEQ ID NO: 4120593 - RNA, 101 nt, Human
ugggcuccccaggcuuuggguguccucugggccuggucucauggaguaguucaggcuggagacucaagacugcagaagacgcuauggcgaggggagaucca

SEQ ID NO: 4120594 - RNA, 59 nt, Human
ugggcucucacacauguucugacggcuacauggagacaccagaacagucugagaggcca

SEQ ID NO: 4120595 - RNA, 60 nt, Human
ugggcucuggggaaacugugaugaacagaacagacaaaaauuccaguuuucuugagcuua

SEQ ID NO: 4120596 - RNA, 114 nt, Human
ugggcugagcuagcaggugccuuugggauuugggucugugaugagagguugugaaggagaaauuccggaaagguuacaaacucaggugccaaaagcaacugcacagcucuucca

SEQ ID NO: 4120597 - RNA, 58 nt, Human
ugggcugcuguuacaggggcugguggggagagccccagcugccugugcugggagccca

SEQ ID NO: 4120598 - RNA, 82 nt, Human
ugggcuggaaacugucagcaggacagagaugcaaaaauagaauaggacagugccaucgagccugcugagguugacaugccca

SEQ ID NO: 4120599 - RNA, 64 nt, Human
ugggcuuauccguccuuacaucaccuccucuuguucaaagacugaaggguaaugugggagccca

SEQ ID NO: 4120600 - RNA, 77 nt, Human
ugggcuugcugagauuucaggccaaggagugccugcauaauagaccacuuaaaacuccuggaauuguagugagcuca

SEQ ID NO: 4120601 - RNA, 58 nt, Human
ugggcuugggauauuggguuaacucguggguaagggucauucauaucucucaagcuua

SEQ ID NO: 4120602 - RNA, 92 nt, Human
uggggaacacucaggaaauugagauaauggcaaacaguaguauauuuuuuguaaucuauuauuaaauuucuagagugucuacuguuacccca

SEQ ID NO: 4120603 - RNA, 56 nt, Human
uggggaagaauaauguauguacucugagaguauuccugcaaaccauucccucccca

SEQ ID NO: 4120604 - RNA, 77 nt, Human
uggggaaggaaucagaugcacugcaguauauacuguaggauucuauuuauauaaaguauuguauuaguccauucuca

SEQ ID NO: 4120605 - RNA, 80 nt, Human
uggggaagggaugguagaauggugauguguggagagccuaguucugagcuguggccauucuuccuacucuuaauucccca

SEQ ID NO: 4120606 - RNA, 71 nt, Human
ugggagguauggucuuugagaggugacugagucaugaggacucuucuuucaagaauggauuaggucucuua

SEQ ID NO: 4120607 - RNA, 106 nt, Human
ugggagguggaauccacuggagaagccgcugcuacccagaaccuucccauacgugccugggcuccaaacugggagcuggcggauuccccaggccuggaaaccccca

SEQ ID NO: 4120608 - RNA, 56 nt, Human
ugggagugauacaguauggaauuuucuauuugguacaauuuagaauguagcuccca

SEQ ID NO: 4120609 - RNA, 75 nt, Human
ugggagugggguuacucuaugaacauccucuuacagccaugauggcuugggcaggcacauagaguuuaauuccua

SEQ ID NO: 4120610 - RNA, 62 nt, Human
ugggaguuauagcaagaaaacacaagaauuaccuagguaagugaguucuugcuagauuuuca

SEQ ID NO: 4120611 - RNA, 66 nt, Human
ugggauauaaucugaaaaguauuugugaaucagucuauggauucaccuuacuuggauuguuuucca

SEQ ID NO: 4120612 - RNA, 102 nt, Human
ugggauccaagacugaauuggcaagcaaguuauccaguucaagggaaauacaguuccaucgugcuuugugauacugagcuuggcauucagacuuugaggcca

SEQ ID NO: 4120613 - RNA, 69 nt, Human
ugggauccggggagggcagaggcucccucagccaggccugggcuccgccugcugcccucccccagccca

SEQ ID NO: 4120614 - RNA, 55 nt, Human
ugggaugaaagguuguagauuaucccugugguaacugcacugauuuaucauccca

SEQ ID NO: 4120615 - RNA, 129 nt, Human
ugggaugacccagaucauguuugagaccuucuacaccccagccauguagguggccauucaggcugugcuuucccuguaagccucuggcuguaccacuggcaccgugauggacucuggcagggucaccca

SEQ ID NO: 4120616 - RNA, 59 nt, Human
ugggauggccuuugaaagccagcugagacaccagcuuagaguugauagauggcguccua

SEQ ID NO: 4120617 - RNA, 78 nt, Human
ugggauggugcaaaaguaauuaugguuuuugcuauuaagacuaauggcaaaaacugcaauuauuuuuguaccaaccua

SEQ ID NO: 4120618 - RNA, 78 nt, Human
ugggauguucuuucuucugagaucagggagaauuggaacauagauauuuggccuuaguccagaagaagcaacaucuua

SEQ ID NO: 4120619 - RNA, 130 nt, Human
ugggauguuuaauagcaagggaaguaacugugcgucuguuuuaaacucaaccaugauuaaauagggagaggaagcaggccgcuucuaaagcuucccuuuaguucuccaaucuuaugcuauuuacucuuca

SEQ ID NO: 4120620 - RNA, 78 nt, Human
ugggauuaucuagauuauucaugagucugcuuaaaaggaaauuuuuuaaggcaggacuggauagcuauggcuuuccca

SEQ ID NO: 4120621 - RNA, 94 nt, Human
ugggauugggagggggcaugacuuuuggagugggagcgcagggcccugaccucccauucugccaaggacauugcccucacuuucaacagucuca

SEQ ID NO: 4120622 - RNA, 89 nt, Human
ugggauuucuucuagggaugucugucauuaugcuuucuuguguagagccauuaggaaaaguaaacacagucauccguggucaaauuuug

SEQ ID NO: 4120623 - RNA, 63 nt, Human
ugggcaaacugucaaccaugucagaacauacggaauacucuggauggcucaaaguguugccca

SEQ ID NO: 4120624 - RNA, 55 nt, Human
ugggcaaaugcuuuuuagucaauccuaggauucuauucuaagaggucguuucuca

SEQ ID NO: 4120625 - RNA, 56 nt, Human
ugggcaacuacugugugucaggcuggauuccagcugcugggauacaguagugaaca

SEQ ID NO: 4120626 - RNA, 61 nt, Human
ugggcaagaaaagagccuucagugguguacauuuccaccguuuggggcuguuucuuaccua

SEQ ID NO: 4120627 - RNA, 65 nt, Human
ugggcacauacagaaagauucuucaaauaaaagcuaacauaaauugaggauuuauuaugugcuca

SEQ ID NO: 4120628 - RNA, 78 nt, Human
ugggcacggagaagcccuggggucagugucgugcacggauggcggcaguguugaacccaggaggcugaacccggccca

SEQ ID NO: 4120629 - RNA, 60 nt, Human
ugggcacugaagcuuugagcagagauccuuuuuuccacuuucuccuggugacaguaccca

SEQ ID NO: 4120630 - RNA, 56 nt, Human
ugggcagacugagcccuguccccucugggaucccuggagagagcuucagucgcuua

SEQ ID NO: 4120631 - RNA, 59 nt, Human
ugggcagagucauacaggagaccaccgacaugguuaacucacacacugugaccugccca

SEQ ID NO: 4120632 - RNA, 64 nt, Human
ugggcagauguccucugaaguggcaugggcugcuugcucacuggccuucccaggacccugccca

SEQ ID NO: 4120633 - RNA, 56 nt, Human
ugggcagggccagggugcuaugggagcauauaagaauggcacagaacccuugccua

SEQ ID NO: 4120634 - RNA, 63 nt, Human
ugggcaggugcuauuuuccauggucauuuuugucacuugacuucauaaauauuuacuugcuua

SEQ ID NO: 4120635 - RNA, 81 nt, Human
ugggcaguggcagagugggggcagagaaauggacaguugggcuguugcuuggauucugggucuuugcccucuggcagccua

SEQ ID NO: 4120636 - RNA, 59 nt, Human
ugggcaguugcuccucagacccuucugggccaccagcacugggcagggagggacuccca

SEQ ID NO: 4120637 - RNA, 73 nt, Human
ugggcaucucuguggcaguucugguucaucucagauguugacuggugaccaggcugcggcuggcuggugccca

SEQ ID NO: 4120638 - RNA, 64 nt, Human
ugggcaugagguuaccuaucucacaggauuguugugaagauuaaaugaagugaccugugcauca

SEQ ID NO: 4120639 - RNA, 84 nt, Human
ugggcaugaugaagggcaagaggcauuugguuuugugacuuuccuucacauaaaugguaaugucuuucuguuuuuaugaugaca

SEQ ID NO: 4120640 - RNA, 92 nt, Human
ugggcauguuucgauauucaauacaaauguacuguagaauagcaaaugccaucugcgugaauuugcauugugggauggaggaacgugaccua

SEQ ID NO: 4120641 - RNA, 93 nt, Human
ugggccacucaguggaaccaggaaguaugacccaacagaccacagagacuuuguucccugccuccguugagucagcuucggacccacgguuca

SEQ ID NO: 4120642 - RNA, 60 nt, Human
ugggccagcauauagagugaaguagauauguaacuccuuugcccuguauucuggaccuca

SEQ ID NO: 4120643 - RNA, 64 nt, Human
ugggccauucugcuugguucuugguaugacugcuuccugucacuaccuccacgguaguggucca

SEQ ID NO: 4120644 - RNA, 66 nt, Human
ugggcccucagcgcugguaucuugcuucaccuggggauggugaugaaaugaugcagagcugacuca

SEQ ID NO: 4120645 - RNA, 79 nt, Human
ugggccgagaugaugcaucuguuuaaggcuggaaggaagagaaauagaggccuugacaaaaaccucauuucaccgccca

SEQ ID NO: 4120646 - RNA, 60 nt, Human
ugggccggacugggguaacagcaugagucuccugaugcccauccauggggucauggccug

SEQ ID NO: 4120647 - RNA, 60 nt, Human
ugggccgggcacuguacugggcauugggaguaaagacugagcuaggcuguguccugccca

SEQ ID NO: 4120648 - RNA, 55 nt, Human
ugggccucccaugucuuagggacgcagaggccagccuggguagaaugggagccua

SEQ ID NO: 4120649 - RNA, 55 nt, Human
ugggccuccugcccuggccuaggaaagugcucuaggcagccauccaggaggcuca

SEQ ID NO: 4120650 - RNA, 55 nt, Human
ugggccucugggcuauucagacucaacaucuuggaaaccugaggcccagggccca

SEQ ID NO: 4120651 - RNA, 60 nt, Human
ugggccugauucaguggaaugacuuuggaugggaauucaaagucugagcagaauuucuca

SEQ ID NO: 4120652 - RNA, 74 nt, Human
ugggccugcagucacugaauacaggccaggauuccaucucuugcauuggcuguagaaucagagacuugggucca

SEQ ID NO: 4120653 - RNA, 82 nt, Human
ugggccuggagccagccuccgccucucucccuucaagagccuugccaaggcuggagagagcgggggucaggcucuggggcua

SEQ ID NO: 4120654 - RNA, 61 nt, Human
ugggccuggggcagcccaaauccuacagaugagggaauuggggaagugugccacaggucua

SEQ ID NO: 4120655 - RNA, 82 nt, Human
ugggcgaggugaggccacccuuggguucggaggccggcgcgggaggcggcgguggcggaggcgggggugguggcgccgccug

SEQ ID NO: 4120656 - RNA, 64 nt, Human
ugggcgggcaggaggcagagagaagcugaggacgugagcugugauugugccuccucgucuccua

SEQ ID NO: 4120657 - RNA, 129 nt, Human
ugggcguccacagccucuguuccugcccacuccaccaagagccccuuaggcuguuccaggauacagaggagcaugcaaggaccaagggagcaucuuggaaggacaggagaagcgguaucaaggagccca

SEQ ID NO: 4120658 - RNA, 62 nt, Human
ugggcguggggccuucugcccgcuggccugcaccaggcggaagauggccccauagaggccca

SEQ ID NO: 4120659 - RNA, 56 nt, Human
ugggcucugaaauucucacuuuuaggaaacugguuucugcagaguuucagggacua

SEQ ID NO: 4120660 - RNA, 58 nt, Human
ugggcucugaagggucccggaugaaacucucugcaggccucugggucucucaggucua

SEQ ID NO: 4120661 - RNA, 58 nt, Human
ugggcugcagagcccggccuuccacugggcuaauggagggaggggugaccgcagccca

SEQ ID NO: 4120662 - RNA, 124 nt, Human
ugggcuggacuuuuagccucuauucugcugaccagccccagcacugcaaacaucuuuuaaacucucuuuggaaacaaggggaggcagaugggagcuggaaguugcaggacaagaauccagccca

SEQ ID NO: 4120663 - RNA, 87 nt, Human
ugggcugucagucucuuucagguuccguuucugacuucaugugauuuuguaaggcagauauauucgugaaauaggcugauggugcua

SEQ ID NO: 4120664 - RNA, 97 nt, Human
ugggcuguggggaagggcugggguggugcaguagagcugucugggguuaggaacucugcagaaguggcugggccaccuccuccuagcucagagccca

SEQ ID NO: 4120665 - RNA, 63 nt, Human
ugggcuuccagggggccacagcgugguccugugcaggacaggcuggcaaugcccugcugccca

SEQ ID NO: 4120666 - RNA, 59 nt, Human
ugggcuuggccaagugggugugaaguguuccauugacucaggccugcagugccaaccca

SEQ ID NO: 4120667 - RNA, 59 nt, Human
ugggcuuuugaacuugguuuguaaaaauaagauggaacacucagccagguacaagucca

SEQ ID NO: 4120668 - RNA, 65 nt, Human
ugaccauaagcugccuuagagggagugguucuuugauuaaggcggcucucuguggcagcagguua

SEQ ID NO: 4120669 - RNA, 111 nt, Human
ugaccaucuggagaaaauugcuguugggugacucuucagacuauccagggcaaaaguagccaggagagcagucaguuaugcauguauauuuuucccaagguaaauagguua

SEQ ID NO: 4120670 - RNA, 58 nt, Human
ugacccagcuaacccuacccuggaugccugagcccuccccaccugguuagcuggguca

SEQ ID NO: 4120671 - RNA, 92 nt, Human
ugcucuccagcccaaaugggaggccucugucccaccagggagcuuuagguuccccgggugcuucucggaggcugacaagggcguggagagca

SEQ ID NO: 4120672 - RNA, 113 nt, Human
ugcucucccuacugacucugaaaauuggacguagcuacuccauuaccagaaaggauuugguuuaguccccucuuggaucucuaguuuccaauuuaaagucuggggcaagggca

SEQ ID NO: 4120673 - RNA, 85 nt, Human
ugcucuccuucccuuccccucacggagacgccucucugagcuggggagucuuguuugggauguggauggaagggaaggcugggca

SEQ ID NO: 4120674 - RNA, 60 nt, Human
ugcucucgguucuauauucaauguggcuuuuggauugccucagaaguucagccuagagua

SEQ ID NO: 4120675 - RNA, 57 nt, Human
ugcucucugguuccagucaggaaccacgcauuggugguuccugaugcaagagagaca

SEQ ID NO: 4120676 - RNA, 72 nt, Human
ugcucucuuaaagaauguuccagcugcuuuacuuaauuguagucagcuugaaauuacauuuguuuaacugca

SEQ ID NO: 4120677 - RNA, 78 nt, Human
ugcucugaaaagagaguugccagucuguacaccaaagaagaaugcaguaugauuaauauucuuaaaauuuuuagagua

SEQ ID NO: 4120678 - RNA, 57 nt, Human
ugcucuguaucuuacaacagggugcucugaguaucagcaugggaagaucgcggagua

SEQ ID NO: 4120679 - RNA, 59 nt, Human
ugcucugugagucucugugcuuuucuacugggcugugggcagcagaggcuugacagaca

SEQ ID NO: 4120680 - RNA, 64 nt, Human
ugcucugugggugaagacaagggagagugucucauaccucuuuggugaauggucauccagagua

SEQ ID NO: 4120681 - RNA, 81 nt, Human
ugcucuguuuccuuucuggugagcauacaggcagguuuacuuguuaauauacuacgcaccaaacaaaggaggaucugagua

SEQ ID NO: 4120682 - RNA, 56 nt, Human
ugcucuucacaguuucagcauccagcucacucugggggcacugaaagggaauagca

SEQ ID NO: 4120683 - RNA, 55 nt, Human
ugcucuucaccauuacaucauguuaacuucuuugcuugggauguuugguagagca

SEQ ID NO: 4120684 - RNA, 68 nt, Human
ugcugaaaaguaaauaggccuaaccacauuuucaagccccugugcgugggucuuuugugcuuauagca

SEQ ID NO: 4120685 - RNA, 62 nt, Human
ugcugaaauauuuaugggucaagugucaugauaauugcaacuaccuuucaaaugauucagca

SEQ ID NO: 4120686 - RNA, 66 nt, Human
ugcugaaguccaagagcuccaaggaucagaagcgugguccuguuuaagaauuuuaggacuucagca

SEQ ID NO: 4120687 - RNA, 62 nt, Human
ugcugaauagaagucuucaaagggagcuuaauugcuuucaccuuuccgugauucuauuugca

SEQ ID NO: 4120688 - RNA, 79 nt, Human
ugcugaauuaguaguaguuagcagccuccuagaggaagugaggucuagcauauuacuagaaaagaauaaauauucagua

SEQ ID NO: 4120689 - RNA, 72 nt, Human
ugcugacuccuggcugugacacaaagcccucuauugcucccccugggucccucaccugccaggauuuacuca

SEQ ID NO: 4120690 - RNA, 110 nt, Human
ugcugacugagguguguugggggguuccagggugacaaguggcaaggagcuggguuugcccuucuccccagcccugguauucugaucaccuccuaugaacuccauuggcg

SEQ ID NO: 4120691 - RNA, 118 nt, Human
ugcugagauauuugaugauguuucaaauaucugaaauuauugaaggugcauuuucuauuagcccgguuaguuauuuuucagauauccaaauuuuggaaagucauuugguauacuugca

SEQ ID NO: 4120692 - RNA, 69 nt, Human
ugcugagccuuagaaacuacuagaauaagagauacaucgagauucucuuaugaaguggauucucucgua

SEQ ID NO: 4120693 - RNA, 68 nt, Human
ugcugagcuuauuagguuauuucaaggaugaaaucagacagcuccugagaagcacuuaauacacagca

SEQ ID NO: 4120694 - RNA, 68 nt, Human
ugcugaggcaguccuaacaggagcagaaaggauaacagcugccucugugcagguguguuugaucagca

SEQ ID NO: 4120695 - RNA, 75 nt, Human
ugcugaguaaaagaagcuuuauauaaaagaguacauacuguaugauuccauuuauaugaaguucuacaauaggca

SEQ ID NO: 4120696 - RNA, 78 nt, Human
ugcugaguacauuguugcgugagauggcauuuuugucauuuuguggacauugaucagccucccaugcaguaguuggca

SEQ ID NO: 4120697 - RNA, 72 nt, Human
ugcugaguucuggaggagaacuccaaucugaauucuacucaguauuagcuaccuauccuucagggccucaca

SEQ ID NO: 4120698 - RNA, 61 nt, Human
ugcugauuuuuaagugcugucuguccuucugcaacagaucagugcugggagaugucagaca

SEQ ID NO: 4120699 - RNA, 91 nt, Human
ugcugcaccguggggcugcugccaccagguggaugcuggugccuaggugauggucaccuguccacacuggagggcacucgaugaugcagca

SEQ ID NO: 4120700 - RNA, 68 nt, Human
ugcugcaggccaggucguugucccaccccaccccaucccaucccaguguccaccuaccuccugcagca

SEQ ID NO: 4120701 - RNA, 62 nt, Human
ugcugccagccaggccauggaggcuauucauucugccucuccuagcgcugaguuggucagca

SEQ ID NO: 4120702 - RNA, 65 nt, Human
ugcugcgugucuccuuggggcagaccauuuaucacaggucuaagccaggacugagagacgcugca

SEQ ID NO: 4120703 - RNA, 70 nt, Human
ugcugcuagccaugucaguuucauuuuaagucauguuucucucauggcaaugggauggcugcugguagca

SEQ ID NO: 4120704 - RNA, 58 nt, Human
ugcugcucaucagauuuuaaaacuagguagaacuaaggauaaaacgugcauggcagca

SEQ ID NO: 4120705 - RNA, 77 nt, Human
ugcugcucucucugguuugcauucuaguacugucccacugaccaggcugcugcaggcacagaugcugagcaugugca

SEQ ID NO: 4120706 - RNA, 120 nt, Human
ugcugcugccaccaaacaugcuguguguuccacauaacacaucuacaacaugguauaauuucaguucuugagugacuguguggaucacaaucuacuagcaacccuugcgggcauguagca

SEQ ID NO: 4120707 - RNA, 63 nt, Human
ugcugcugccuucuucugacucuauuacauugcucagugaugucucugacuaaggcaguggua

SEQ ID NO: 4120708 - RNA, 62 nt, Human
ugcugcugcuguggggccucaaggacagcccacugcuaacuucuagagccagggcagcugca

SEQ ID NO: 4120709 - RNA, 58 nt, Human
ugcugcuguuaucauuuuaccagcaaaccaccugccaugcaaugcauugacagcagca

SEQ ID NO: 4120710 - RNA, 112 nt, Human
ugcugcuuccucaccacugucccacugaggguuaaugccugcauaggacuuaaucugguucuuuucccagcggaguuugauccagugcuuggaccaggagaguaagccagca

SEQ ID NO: 4120711 - RNA, 55 nt, Human
ugcuggagaggaagguggggucaaaccuuuguugcccgcaucuuccucuccagca

SEQ ID NO: 4120712 - RNA, 56 nt, Human
ugcuggagauuagugaaaauaaccaagaaaauauuauuuaaaauagugcuccagca

SEQ ID NO: 4120713 - RNA, 64 nt, Human
ugcuggagcagcuaagccucugagaaguuaaugaaaguguccaggccgcauaguuacucuggca

SEQ ID NO: 4120714 - RNA, 57 nt, Human
ugcuggagucagacaauugaguucaagucucacuugcaagcucugugaccuugagca

SEQ ID NO: 4120715 - RNA, 60 nt, Human
ugcuggagugcaguggcuuaaccauagcucacuguagccuuaaacuccugcacucaagca

SEQ ID NO: 4120716 - RNA, 130 nt, Human
ugcuggaguggcuccuucccuguggugagaugaagggaccaccuccaggaggucugaguguggacacuggggccuggucuucacacacaguccucuuucucuucagcaccauucacaugcagccuccaug

SEQ ID NO: 4120717 - RNA, 75 nt, Human
ugcuggauugugaauggauuauuuuuguaugugucaaauauguagcauucaaacauuaauuuauucauccaugca

SEQ ID NO: 4120718 - RNA, 55 nt, Human
ugcuggcaccauuuucggacaugagggaaaagcccaucugggaaugaugccagca

SEQ ID NO: 4120719 - RNA, 64 nt, Human
ugcuggcaugguguauuuguucaacuccaaaaaguuaaaugcagaguuaccauaugacccagca

SEQ ID NO: 4120720 - RNA, 59 nt, Human
ugcuggccaauggcagaggcggaagcuguuuaugggggcggagcgucgccauggcagca

SEQ ID NO: 4120721 - RNA, 58 nt, Human
ugcugggcuucaacugccugagacacccugagugagaacuacauagcugagcccagua

SEQ ID NO: 4120722 - RNA, 93 nt, Human
ugcugggucaaaugguagcucuguuuaaaguucuuugagaaaucuccaaacugcuuuccacaguggcuagaccaauuuacauucucaccagca

SEQ ID NO: 4120723 - RNA, 56 nt, Human
ugcugggucccuugagagcucaugggauuaccugacuguugagcagggcccagaca

SEQ ID NO: 4120724 - RNA, 66 nt, Human
ugcugguauuugcagccugucaucauauuaguacaaugaugaaauuugcugcuaaguuccucagca

SEQ ID NO: 4120725 - RNA, 56 nt, Human
ugcugguccaugaggccagaucaaaggcugauacugcacuggcuucaggcugagca

SEQ ID NO: 4120726 - RNA, 63 nt, Human
ugcugguuuaaccauguauccuggggaccuagaaggagcucagggaacaucguuaaacuagua

SEQ ID NO: 4120727 - RNA, 75 nt, Human
ugcuguaccuccaggauguuagacguccagaaugcacugcccuuuggauacuauauauaccucaaggaggcugua

SEQ ID NO: 4120728 - RNA, 74 nt, Human
ugcuguacuucucagaacuuuuaauaugcuaauguacauuguacagcucugagagggggaauuaguaugcagca

SEQ ID NO: 4120729 - RNA, 60 nt, Human
ugcuguauuuuaguuagcuggaguugguugcaaccaagauucuugacuagaaugauugua

SEQ ID NO: 4120730 - RNA, 66 nt, Human
ugcugucaguuauacgauugguuuuauuuaacaaauacuuacauagcacuuauuguaugcugagca

SEQ ID NO: 4120731 - RNA, 76 nt, Human
ugcugucgcuuucucuucuuccuccuagcucagcuuccagagcauggggcacagcugagaaagcacaaagauagca

SEQ ID NO: 4120732 - RNA, 71 nt, Human
ugcuguggcaguuuauguauagcagucucauuaaggaacuggggaaaaauaacaucaacuagucacagaca

SEQ ID NO: 4120733 - RNA, 67 nt, Human
ugcuguggcugcccucaugggccugauauccacagagggaugacagcuaugaugggggagccaggca

SEQ ID NO: 4120734 - RNA, 60 nt, Human
ugcugugggauauauguucaaagugcuuuaugaacaguaauuuauugaauacucauagca

SEQ ID NO: 4120735 - RNA, 75 nt, Human
ugcuguggugauguuaggguuccuacuuuugugggcaggauccauuuaaguaaaagcuuuaccaugcgcuaugca

SEQ ID NO: 4120736 - RNA, 58 nt, Human
ugcugugugaggugaaaaaaggacacagaaaccugugcccuucagaacuuacauagua

SEQ ID NO: 4120737 - RNA, 56 nt, Human
ugcuguguguaccauguauguacuccucucuguauccuuuauguguguuugcagca

SEQ ID NO: 4120738 - RNA, 55 nt, Human
ugcuguguucaccaauauguguaccuuggcuuggggccacacuggaggaacagua

SEQ ID NO: 4120739 - RNA, 83 nt, Human
ugcuguuauaaaauccagcugugucacaggugauguaggauguugauuauuuacauuggucacuagcuggaucuuaaacugua

SEQ ID NO: 4120740 - RNA, 87 nt, Human
ugcuguuccaaacuuuuuccuucagggcaguauuuucugaaaucuauuaggcuacuucuagagggacaaucguuuugguaagcagca

SEQ ID NO: 4120741 - RNA, 81 nt, Human
ugcuguuuagagcaggcuugcagagaaggggcugagacuuacuagccccaccucccuucaggccugcagaaaugaacagua

SEQ ID NO: 4120742 - RNA, 76 nt, Human
ugcuguuuuccaugugucuuucaauguguaauugacaaaauacaaauuuauugaagggcauauuggauuuuuagua

SEQ ID NO: 4120743 - RNA, 72 nt, Human
uggggaauucaaaaaugggcacuaaugacuuuugagcagugcuuuccaggaggucaaaggccuguuuccuca

SEQ ID NO: 4120744 - RNA, 74 nt, Human
uggggacuaaguggaccuuagcauugggcacuuggacuacagaaaggcccaggacucagggugucgcgucccca

SEQ ID NO: 4120745 - RNA, 80 nt, Human
ugguaccugaaauagguugccugugagguguucacuuucuauaugaugaauauuauacagucaaccucuuuccgauaucg

SEQ ID NO: 4120746 - RNA, 80 nt, Human
ugguacuaacccaauuauccaacaaauaaauauaaaauuacaguuauaauuauugcuauggugagagggaugugguacca

SEQ ID NO: 4120747 - RNA, 80 nt, Human
ugguacuuaaaucuuaugugcugugagauuuuucuccuccagggaguuuagagauaauuggcacauggagaagauuacca

SEQ ID NO: 4120748 - RNA, 60 nt, Human
ugguacuuauacauuugcuugauacaaagauggauguguacaaguaaauuguagauacca

SEQ ID NO: 4120749 - RNA, 82 nt, Human
ugguacuugaagagaaguuguucgugguggauucgcuuuacuuaugacgaaucauucacggacaacacuuuuuucaguacca

SEQ ID NO: 4120750 - RNA, 114 nt, Human
ugguagaaacugaaguugagagaauauagugacuugcucaacacugcauagaaacaugguagaaacaggauauaagcauacaguccuuguauucuucuccuuuauuuauugcca

SEQ ID NO: 4120751 - RNA, 66 nt, Human
ugguagaguagaaagacaugggccagcagcugggcaacccaguuucccuucuguucuauucuguca

SEQ ID NO: 4120752 - RNA, 59 nt, Human
ugguagcaaagagggugaaggcagguaaaagaccugcaagcaaaucaacucuuugccca

SEQ ID NO: 4120753 - RNA, 88 nt, Human
ugguaguaagauugauuaaauuugguguuucucacuuuuugcccuagagaaaugaaaugaagauaugaucaguucuuaaguuuuacua

SEQ ID NO: 4120754 - RNA, 55 nt, Human
ugguagucuccaugggcaaggcugugacagucagugccacuuaaugaggcugcca

SEQ ID NO: 4120755 - RNA, 71 nt, Human
ugguagugggugaccuugagcgagaacugacaagcugcguccuugcaguccucguaaaggucgaagcgccg

SEQ ID NO: 4120756 - RNA, 56 nt, Human
ugguaguguuaacggggccaguugucacauugacagggccaauguuagcauugaca

SEQ ID NO: 4120757 - RNA, 62 nt, Human
ugguauaugcauggagguaucaaagcucgaggauagagcacacaccaguugaugcauagcca

SEQ ID NO: 4120758 - RNA, 121 nt, Human
ugguauaugucuccgugauuugaguuucaguuauggcuuaacuaaagagguuuugugaaacuguuuucaauuucauucuauuaguuaaguagcuaaguuaauuuucuaagauauaaaauca

SEQ ID NO: 4120759 - RNA, 67 nt, Human
ugguaucacagaaagcuguguccugacagcaauggccauugacagguacauagcuaucugcaaucca

SEQ ID NO: 4120760 - RNA, 77 nt, Human
ugguaucagagccaucuguauuuauguuugcugugugacugucacuuguauacaaucaugcagagacucugauauua

SEQ ID NO: 4120761 - RNA, 76 nt, Human
ugguaucaucaccuuguucucuaagaaaagaagcaugauaucagcuuuguugggggagggaggaugggggauauua

SEQ ID NO: 4120762 - RNA, 69 nt, Human
ugguaugaaagaaggguggaaaauguaggaacacuuuagucucuguuuacuuuccuucucacagggcca

SEQ ID NO: 4120763 - RNA, 63 nt, Human
ugguaugcaauguuacagaauguacugaauucuaauauagacuuucuguagcaucuguaauca

SEQ ID NO: 4120764 - RNA, 114 nt, Human
uggucaacauauaguagauaauuuauuuaauaugguuuuagugaaugcuugacuuaauaugagugaaguauucauaaggacauauguuuuaggugugcacaaauauguuagcua

SEQ ID NO: 4120765 - RNA, 95 nt, Human
uggucagaggcccuggccccuguggcuaaaaucaggauuaugucuguacugauuuacuucccagcuggguuucaggaaaagccucaaaaagacca

SEQ ID NO: 4120766 - RNA, 66 nt, Human
uggucauaaucaagucuugaugagacaaaccuggcaggucaggucagucuugcuaagauugaacca

SEQ ID NO: 4120767 - RNA, 81 nt, Human
uggucauauaucuguucccugguacaaugguucauuuuaugugucaacuuggcugcgucauugugcccagguauuugguca

SEQ ID NO: 4120768 - RNA, 89 nt, Human
uggucaucuaagcggcccugcugagcuugucuggguugcucacauaucugggggucagcaggcugucagcaggggccacugggugaugg

SEQ ID NO: 4120769 - RNA, 55 nt, Human
uggucaucuacauuuacaugaagaauucuguacauguuaaaagugaggauggcca

SEQ ID NO: 4120770 - RNA, 58 nt, Human
ugguccauguccuccaucucuccugcuuaugaacaggagggcugggcucuguggauca

SEQ ID NO: 4120771 - RNA, 88 nt, Human
ugguccuggaggggagccuggacacaaacaucuccucuggccaagaccagaggcagguguccuuuguucuuucuugucuccaggucua

SEQ ID NO: 4120772 - RNA, 66 nt, Human
ugguccuggcugcccauggacccucugaccuugaacccucauagcagcuccagggcaguuauucca

SEQ ID NO: 4120773 - RNA, 69 nt, Human
ugguccuguagcucucuaaguuccagaagaagcccuuuagugcacggggauugagagcuacaaaggcca

SEQ ID NO: 4120774 - RNA, 58 nt, Human
ugguccuuugcugccucagcaguuguuagcugcagcuggcugaguguuccaaggagca

SEQ ID NO: 4120775 - RNA, 69 nt, Human
uggucuaagaaguagauuuacagugaagcuaaugaaacuuuagcuuuauggugccucacuugaaggcca

SEQ ID NO: 4120776 - RNA, 65 nt, Human
uggucuaagagccuaacugcuggccaaauaaauucucaagucugccagcuuuagaucuuugauua

SEQ ID NO: 4120777 - RNA, 63 nt, Human
uggucuaggagguuaccuaugcucuggguuagauagaagagggcauggcaggucacuggggca

SEQ ID NO: 4120778 - RNA, 76 nt, Human
uggucucgaucucuugaccuugugauccacccgcuuuagcuccccaaagugcugggauuacaggcaugagccacca

SEQ ID NO: 4120779 - RNA, 65 nt, Human
uggucugauucuguugaacaccuuccuuaugacuuuaagcaaacuguuggaguagagucuugcca

SEQ ID NO: 4120780 - RNA, 55 nt, Human
uggucugauuucuuucuggaguucacuuccuccauggggugcugaaguuagauca

SEQ ID NO: 4120781 - RNA, 129 nt, Human
uggucugcagugucuaagggggcauggaggcagagccaggcugggauugaaucuuuguagaggaacgugaccuugcaaagagauaauccuaggcugcuguuauccuggugccagcccucccugacucca

SEQ ID NO: 4120782 - RNA, 61 nt, Human
uggucuggggucagcugggccuuugccugcuguuuggugcccagugcaggcccgcagguua

SEQ ID NO: 4120783 - RNA, 57 nt, Human
uggucugugcagggaccccaagaguuuaaaaaggugaauccuuccuugcagggucca

SEQ ID NO: 4120784 - RNA, 78 nt, Human
uggucuuacaugauaugugaaugaaucauaaguuauuccucaaacucuuaacaaguauuuauguaucuguguagauca

SEQ ID NO: 4120785 - RNA, 76 nt, Human
uggucuugaucuccugaccuuguaauccaccugacuugaccucccaaagugcugggauugcaggcgggagacacca

SEQ ID NO: 4120786 - RNA, 82 nt, Human
uggucuugaucucuugaccucgugauccgcccgcuuuggccucccaaagugcugggauuacaggcuuguaauuucuggacua

SEQ ID NO: 4120787 - RNA, 59 nt, Human
uggucuuggagucugaagaccuggguuuguggcccaguaacacaaccacuccgugacca

SEQ ID NO: 4120788 - RNA, 64 nt, Human
uggucuuuucccagaaugaaucuugcaucagcagaggugagauucaguugugagagaagacaca

SEQ ID NO: 4120789 - RNA, 128 nt, Human
uggugaacacaauuuaauucauagcaucuauuuauguggaguuuuaaaugaugauaaaauuagauggucuauaucaaggcauggaaaaugcuagauaaaugacugcugugcuuaauuauuaccuacca

SEQ ID NO: 4120790 - RNA, 101 nt, Human
uggugacuauagaaugguuauggcgaucuguguguuucacucugagcuguaaguagagauguguucgcuagauugcuguuaauuaaucguuuaguuuguca

SEQ ID NO: 4120791 - RNA, 68 nt, Human
uggugagaaguuuugagauucuggaaauauugcuuucaauggcaaaaauuucaauuacuuuugcacca

SEQ ID NO: 4120792 - RNA, 71 nt, Human
uggugagacacuucugaagguuccaagaguucagaagucugggcacuugaaauauuaggggugauuuacca

SEQ ID NO: 4120793 - RNA, 118 nt, Human
uggugagauaguaauuauauucuucaauuuaugugugggcaaacugucagaaagagucuaagugaaauucugucucaguuuaccuauauguaaauuugaaaauauauuuauuucccca

SEQ ID NO: 4120794 - RNA, 89 nt, Human
uggugaggcuauuugcuccuguugauuuuagggcaauuguguagcucuaacagccccugagcagucugcagagagcagccauuucacca

SEQ ID NO: 4120795 - RNA, 64 nt, Human
uggugauaucaugggaagguguacuuccggugaugccuagaggucacguccugugaugucauua

SEQ ID NO: 4120796 - RNA, 67 nt, Human
uggugauguaagguuucuuccuguucccagcucagacagaggagggagacaagguaccacguuaaca

SEQ ID NO: 4120797 - RNA, 61 nt, Human
uggugauguugccauuaacccuugucugaccaaaagucuagaccugaggcaaccaucacua

SEQ ID NO: 4120798 - RNA, 57 nt, Human
uggugcaagucucugaggagggugggcagaggguaccucucguuagaaacugcagua

SEQ ID NO: 4120799 - RNA, 81 nt, Human
uggugcaggaaaaacauaauuuagcaacagauuuaaaagguagucuggaguguuucuaauuacuguuuguuuaguucacca

SEQ ID NO: 4120800 - RNA, 67 nt, Human
uggugcaggugaugugaugugagcaucuuucauugcuaaggacucacuuccacuuuuaucuccacca

SEQ ID NO: 4120801 - RNA, 72 nt, Human
uggugcaugccugguaugaagcaaggaaggagugagcugaggaaucuuccaaggccagacagggcaguacca

SEQ ID NO: 4120802 - RNA, 77 nt, Human
uggugcccaugccuggagcacagcccagucccacccugccccugaggguggcucacauguucuuaaggcagguacca

SEQ ID NO: 4120803 - RNA, 72 nt, Human
uggugcuccugcugccuugucccccaagucaacugagguuguccagggcccaaaaggcagcaguagcaucca

SEQ ID NO: 4120804 - RNA, 79 nt, Human
uggugcuugagauggugaagaagacagcacacgcauuuacacagcauugauguuucugcugcucuucacugcuuuacca

SEQ ID NO: 4120805 - RNA, 59 nt, Human
ugguggaaggcagagcuacaccucuuucucucuuauaggccuguucuuugucuuuccca

SEQ ID NO: 4120806 - RNA, 95 nt, Human
ugguggaagucugagguaucccacagcccuaaugguaggcuggaguuuucugccuugaggagguugugggacuauuuuuagcacguuuuccacua

SEQ ID NO: 4120807 - RNA, 70 nt, Human
uggggagagauugaggaguuuuaagccaggagaguaaugugauggcaaaacuccugaaauuguuucccua

SEQ ID NO: 4120808 - RNA, 70 nt, Human
uggggagcagcagggcugggauuugagcccaggcagccuggcuccagcguccacguccugugcucacuca

SEQ ID NO: 4120809 - RNA, 64 nt, Human
uggggagccacaagugcugaugaaaacagaagugagcuguguuauguccucauguuguucucca

SEQ ID NO: 4120810 - RNA, 83 nt, Human
uggggagcucuccccccacugggccccacccugaggggagccgggggugguggccagcagugggcagggggcagugcccacca

SEQ ID NO: 4120811 - RNA, 72 nt, Human
uggggagguuaguuucaucaaguugucagacgccagcaggcugggagcugguggagaagcagaccucaccca

SEQ ID NO: 4120812 - RNA, 74 nt, Human
uggggagugaugccucggauaacacacccaacaaguuccccaccauggcacugaugucccagguagcgccccca

SEQ ID NO: 4120813 - RNA, 65 nt, Human
uggggaugacucucagguacuccgagacugggggaggccaagucucagaguaccugagggaccca

SEQ ID NO: 4120814 - RNA, 67 nt, Human
uggggaugccaucucugcaaugccugggagguuuccuuuuaugcacacuuagacauggcugggccua

SEQ ID NO: 4120815 - RNA, 58 nt, Human
uggggaugugcuacacuucaaugaaaauggcuuuuuaaaggaagaucuauacacccca

SEQ ID NO: 4120816 - RNA, 90 nt, Human
uggggcaaugcuggaagcggacguugugggguguuugguggcuucucagaacucauuggccauguccaacccccuucucuucaugcccua

SEQ ID NO: 4120817 - RNA, 66 nt, Human
uggggcagagcccggugccugugagggauaggaagcuccaguucaaagcaggcuugggucucccca

SEQ ID NO: 4120818 - RNA, 71 nt, Human
uggggcaggagcccuucuucagcugguggcugcaaugucccucgcugcugcugcuaagcguuucuguucca

SEQ ID NO: 4120819 - RNA, 93 nt, Human
uggggcauggucugccugggaaggggaagguccucuccagcccccaggccucaguggaguagucggcucccuccuuucugcagccaugccuca

SEQ ID NO: 4120820 - RNA, 57 nt, Human
ugcuucggggucaugggccaucauuccuagggcuuugggaggcccuggccucgaaca

SEQ ID NO: 4120821 - RNA, 67 nt, Human
ugcuucuagacacugcaauugacaguccagguaaacaugauuguaaaaguguagauguuuagaagua

SEQ ID NO: 4120822 - RNA, 62 nt, Human
ugcuucuauaccuauaaucagccucagguuccagcagcccccagagaaugagguacgaagca

SEQ ID NO: 4120823 - RNA, 71 nt, Human
ugcuucuccuuccaucaugugcugaaaguaguugcuucuuuagaacuauugcauagaaggaaggaguuuca

SEQ ID NO: 4120824 - RNA, 74 nt, Human
ugcuucugaauuucuguguaucuuaauuugacacuuuaagaaaacaaaauaagucaugccugaaauuuggagua

SEQ ID NO: 4120825 - RNA, 55 nt, Human
ugcuucuuuagccauacucuagugcagcuguuuaagauccuguggcugagaagua

SEQ ID NO: 4120826 - RNA, 78 nt, Human
ugcuugaaucugcuacaucuaccuauauaguauacgcaguauacaaaguagucaaaguagaugaugguggaauuagua

SEQ ID NO: 4120827 - RNA, 72 nt, Human
ugcuugagaauguguugcccuucucuugaguuaaaccaucaaucuuuggaaaagagacauuucucaucagca

SEQ ID NO: 4120828 - RNA, 74 nt, Human
ugcuugagcccaggaguucgaggcugcagugagcuaaaauugugucacugcacuccagcccgggcaaaagagca

SEQ ID NO: 4120829 - RNA, 68 nt, Human
ugcuugaucuucuggucaaauuuuugcaagcaguagagcccuuccagaaaugacagagaagaaaugca

SEQ ID NO: 4120830 - RNA, 68 nt, Human
ugcuugggccccagagaaagucagcagcaucuaaagccaaaacacgggauguuuucuggaguccugca

SEQ ID NO: 4120831 - RNA, 58 nt, Human
ugcuugugagaguuuuuucagauuucucugaaaaaaaucugaaagacguaacagugca

SEQ ID NO: 4120832 - RNA, 77 nt, Human
ugcuuguggauccaguagugacuuuuacauuuuauaucuaaauagaagcuggaggcuuuguuggguacucauaggca

SEQ ID NO: 4120833 - RNA, 79 nt, Human
ugcuuuacgugaggugguacaauauuaacucaaaauagaccacgaugaguuaagaauacacaucauaauuccuagagca

SEQ ID NO: 4120834 - RNA, 129 nt, Human
ugcuuuagaaugaccuggguguucauucaaaauucuaggcuccauccaagaucuucugaauccaaaaggugugcugugagaccuggugauuggaagauacagcaaauccccaggugauuugauugugca

SEQ ID NO: 4120835 - RNA, 84 nt, Human
ugcuuuauaagcaaacuaacagauggcugaaucuggauauaacugcggagaccauuuucagcauuucuguuguuggcuaaagca

SEQ ID NO: 4120836 - RNA, 55 nt, Human
ugcuuuauguuaucagaaggguggugugauaaaacaaggcugguugcauaaggca

SEQ ID NO: 4120837 - RNA, 104 nt, Human
ugcuuuccuuauauacauuuauuuacuauuagguuggugcaaaaguaauugcaaaaacaauaauuacuuuugugccuaccuaauaacagaugcuagggaaaaca

SEQ ID NO: 4120838 - RNA, 62 nt, Human
ugcuuucuccauuuaaaucuuaugucuucagaaaugcucaagaacugcgaauggagaaagua

SEQ ID NO: 4120839 - RNA, 65 nt, Human
ugcuuucuuuccaucaugaagacgauuaggucgugcuaagacccagucauccuggugugagagua

SEQ ID NO: 4120840 - RNA, 56 nt, Human
ugcuuugacugccgaccauaacauguccuaauaugcuaugacaacgcagcaaggca

SEQ ID NO: 4120841 - RNA, 72 nt, Human
ugcuuugcccaagggcccuacccucucagggacauggcaagugcagccaggaaggggagggucugcaaagug

SEQ ID NO: 4120842 - RNA, 74 nt, Human
ugcuuugucaccgaggcuggagugcaguggcacgaucucggcucacugcauccuccaccucucagguucaagca

SEQ ID NO: 4120843 - RNA, 55 nt, Human
ugcuuugugaguguguaaugacagaaaccaaggaucuguacacaaagucaaagua

SEQ ID NO: 4120844 - RNA, 61 nt, Human
ugcuuuuagccacugagcagagguaaagauaauaggaaucugcagaaagcggcuugaagca

SEQ ID NO: 4120845 - RNA, 70 nt, Human
ugcuuuucauaacuguuaagauaauuuuuaaaggaaaaccugagagacugucacauaacagaggaaagca

SEQ ID NO: 4120846 - RNA, 78 nt, Human
ugcuuuuuucuuauuuacuuauuucucagaaauuauagaagcuuuaaaaaugcagaucuuugagaaaugggaaaagca

SEQ ID NO: 4120847 - RNA, 97 nt, Human
uggaaaauagcagucuggguuacuaaaggauucuugauugucauggaugaguaucacaugaacaacagauguccauuguuacuaacugccuuagcca

SEQ ID NO: 4120848 - RNA, 82 nt, Human
uggaaacaaugauaaaaaguucacuauguagcagcgucccuaucucuuggacauuguuccugagaacuuggguuuguuucca

SEQ ID NO: 4120849 - RNA, 58 nt, Human
uggaaaccuacugauacaggaguuaaguacagcuggcucucuguauccauggguucca

SEQ ID NO: 4120850 - RNA, 86 nt, Human
uggaaacucgugggaaaucauuacaguguuuauaugucucccuugucggacggcguuauccugugauauuuuaccaguguuuucca

SEQ ID NO: 4120851 - RNA, 115 nt, Human
uggaaacuuauuuccuagugaaauggaugacuguguccuguaauagaauauuuacuauauuuaguaacagauuuauacagucucauuuguuuuaguuaagaaguuugaguaucca

SEQ ID NO: 4120852 - RNA, 128 nt, Human
uggaaagaaagugggaaccuuggcaguuuagauaauucacuucaucugguggccagcuauguuaacaaucacaucauaugccagcacuuagaugagaugaaaggagccccaggggcacugaagcuaca

SEQ ID NO: 4120853 - RNA, 55 nt, Human
uggaaagacuucauuuuggaaucugaugcaaaaagcucuugaugagguuucucca

SEQ ID NO: 4120854 - RNA, 104 nt, Human
uggaaagaggugaacuggaaauauuugauaaacagcauagugacuaccagcggccacuauucugauuaccagauauugguucaauugguucacacucuguucca

SEQ ID NO: 4120855 - RNA, 64 nt, Human
uggaaauagccuaaaauugccucccuacccaacuuggaggaggggcaaugauagucuggcucua

SEQ ID NO: 4120856 - RNA, 62 nt, Human
uggaaauauuugcucauuaucuccuuaaauuuucaguggagucacaaaugaauauguuucca

SEQ ID NO: 4120857 - RNA, 63 nt, Human
uggaaaucucagguguuugcggggagaaaacauagcuucauuugggccagaucugaguuucua

SEQ ID NO: 4120858 - RNA, 69 nt, Human
uggaaaugagcuggagcugaguggcugcccccuuggaaaagggccugcugucuccaguuuauucuucca

SEQ ID NO: 4120859 - RNA, 113 nt, Human
uggaacagaauaauagagggagcaugucaggaggcuguaggcuuugcuuagacacucaaagauagacaaaaaacaguuugcccugacauucuccuauuuauuuccaaguucua

SEQ ID NO: 4120860 - RNA, 56 nt, Human
uggaacaugcauaugugggucacuggagaaauccugagugaucuuucaugauucca

SEQ ID NO: 4120861 - RNA, 72 nt, Human
uggaaccaacaaugcgauucccaugccccuugugaggggugggaugggagccaucgcauuugcugguagcca

SEQ ID NO: 4120862 - RNA, 76 nt, Human
uggaaccucagugucucaaaacaaguugcuucccaauuuggggaccaggcugugaagugagacuagugacguuuca

SEQ ID NO: 4120863 - RNA, 84 nt, Human
uggaacuaacaucugacuguuugcugaaaggucuggacuuuuggccaugacaggaggcagcugggcagagucagagaaguucca

SEQ ID NO: 4120864 - RNA, 104 nt, Human
uggaacuaucagcucuuaucucagugaucaacuuguccuugauguuaaaggugggccuuugaugauacccaauguugugucccuggauauuaguuucaguucca

SEQ ID NO: 4120865 - RNA, 90 nt, Human
uggaacuggaggagcuguccugugucagccugaaauaaucaaaaggaucaaaaauccuguuuuaggcaacauaggaagacuccaacucua

SEQ ID NO: 4120866 - RNA, 69 nt, Human
uggaacuuuaaucccuugggcuuagauaucaaguuuaggacaggcuaaaagggauaauuagggcuucca

SEQ ID NO: 4120867 - RNA, 56 nt, Human
uggaagacauuuuggaccuugggauacugcacacuucauuuccauuuugucuuuua

SEQ ID NO: 4120868 - RNA, 57 nt, Human
uggaagaggccacgaaggauccucuacuggggcuucagagggagaguggcccuucca

SEQ ID NO: 4120869 - RNA, 71 nt, Human
uggaagauggcuguccuggagacacaaggugguugaccguugaccagcucuucugcucuaguugccuucca

SEQ ID NO: 4120870 - RNA, 84 nt, Human
uggaagcaaguaacuaaaggccaaaguuuucaggcuaaaaaacaacauugagaugagaacuuuggcuuuauuuacuugcaacca

SEQ ID NO: 4120871 - RNA, 80 nt, Human
uggaagcaaguauugugcugcuuacucagauugcuacaguugcuagcugcagcccuggaagccacaguccuacgcuuuca

SEQ ID NO: 4120872 - RNA, 65 nt, Human
ugacccccaguggcugauugccaggauggccuguggaaagcacaugaguuaagcuggggcaguca

SEQ ID NO: 4120873 - RNA, 56 nt, Human
ugaccccugacacaggcuacacagacaugggauuguggccagaaguuaagugguua

SEQ ID NO: 4120874 - RNA, 57 nt, Human
ugaccccuucucaaucaggcaaggcacauggaagcccagcugucuugagaggaggca

SEQ ID NO: 4120875 - RNA, 96 nt, Human
ugacccucggggauccauccacguggcccacccaaguaaugcaccuuuuagaauauuugcugaaauaacugccaccugguggcaucuucuggguca

SEQ ID NO: 4120876 - RNA, 62 nt, Human
ugacccucuuccccaugcgcucauuccucuuguagaugagcuccuggcggaaguagcuguca

SEQ ID NO: 4120877 - RNA, 130 nt, Human
ugacccuggcuuccccuucugaaagagcaguguagugguuguaaggaauaggggcuaagaaaacaguuaggcuucuaaucccagcucuacuacuuauuagcugugcagcuuuggggaaguuauuuagucg

SEQ ID NO: 4120878 - RNA, 55 nt, Human
ugacccugguguccagguccugcccuggugcuggagggcagagcaucaaggguua

SEQ ID NO: 4120879 - RNA, 57 nt, Human
ugacccuuccccucuggguucugagucgccucggaaggagugggaggugagggguua

SEQ ID NO: 4120880 - RNA, 111 nt, Human
ugaccggauggaccgcggccugagagccucucccagcggucucauugucacagugguccugcuacaggggauuagaaguuccaguuuugcucgaggucacccuccagguua

SEQ ID NO: 4120881 - RNA, 117 nt, Human
ugaccuaaauucuuccugcucugcacucggugagucuuccccaugugcagcccucccauggaucucacacauggaagagauacagugagguccuggggagcaugagaaucuagguca

SEQ ID NO: 4120882 - RNA, 77 nt, Human
ugaccuaaccucucugugccucaguuuccuuuucugugaaauggauuuacugauaacaaucucaaaaggucugguca

SEQ ID NO: 4120883 - RNA, 61 nt, Human
ugaccuaggagguugagggugcagugagcugugaucacaucacugcacuccagccugggca

SEQ ID NO: 4120884 - RNA, 129 nt, Human
ugaccuccagaugcccguuuuaccagguuaccaggcauccugaggcccacccucuauuaaggaagucagggcggggguccaggagccugcauuuaacaagacuuucugguaaugcuaaugcugggggua

SEQ ID NO: 4120885 - RNA, 87 nt, Human
ugaccuggcggacaggugggagccacagcguacaccccaggguucccucugugcugugcguagugccuacugcuugcuuccagguua

SEQ ID NO: 4120886 - RNA, 59 nt, Human
ugaccuuggcuccaaucccagcucugcaauuuacucgcaguuugauuuggaccaaguua

SEQ ID NO: 4120887 - RNA, 64 nt, Human
ugaccuuucuggcugggauuguaggauugguacucacaagaucuuacagcagcaaggaaguaca

SEQ ID NO: 4120888 - RNA, 62 nt, Human
ugaccuuucuuugagauuccugggcaguuuaugugacuacuagguugucaucaaagaaguca

SEQ ID NO: 4120889 - RNA, 81 nt, Human
ugacgccuauuaaggcaacugagaggcccguguuggggcugagccucauugcgagccucugguugucuagcgauggugcca

SEQ ID NO: 4120890 - RNA, 55 nt, Human
ugacgucaacugcaaaggccuuguucuccaagaggacuugugcaguucacgcuca

SEQ ID NO: 4120891 - RNA, 96 nt, Human
ugacuaacagccaccccugguguggaugugauuggcaguuccgagagaaauauggggacgucuucacgguacaccugggaccgaggcccgugguca

SEQ ID NO: 4120892 - RNA, 69 nt, Human
ugacuaccauccuuaggcugaagugauugugaaggaaaagacaucuauuggaguauggggcuggaguca

SEQ ID NO: 4120893 - RNA, 73 nt, Human
ugacuaugaggauacaagucucagaaugcuggaauacaccagaaguguucuagagaauaucaauccauaguca

SEQ ID NO: 4120894 - RNA, 130 nt, Human
uguagcaauuuuguaauuauuauuugguuucccauguaagucugucuacagggagaaugauaugcaaauuuggaguaugucaggucucugugaugguaauuucucauggggaauuaacaaauugccugca

SEQ ID NO: 4120895 - RNA, 114 nt, Human
uguaucauuuagcuaagcaugucugaagauauuuucuuuaaccagcaugaacuaugcauuguaugaaaggaaauauaucaugaaauuguauuauguguuaugcuauaauauaca

SEQ ID NO: 4120896 - RNA, 59 nt, Human
uguauccuggccauuuuagaauccuggugaguuggaacauucuagaaugcccagggaca

SEQ ID NO: 4120897 - RNA, 64 nt, Human
uguauccuuuagaugaucucuuggacauugagcuagugucuacgaaaauaucuuaagaauuaca

SEQ ID NO: 4120898 - RNA, 104 nt, Human
uguaucuaagaaguguguugugagcaaaaauaacuuagaguaggcaaaaguguuuuguaaauuauacugcagacucuacaguuauaaguugauaaauugauaca

SEQ ID NO: 4120899 - RNA, 74 nt, Human
uguaucuagguauucauguuucguggccauaaugaaguacaauuuaagccauaggaugggauacuuagguaaca

SEQ ID NO: 4120900 - RNA, 124 nt, Human
uguaucucuaccauuuggcuuccuucuaggcauccgauuuguugcaaugaagaucaauuaugucucuauugucaucuucaucauaaguaaaagauguccagucuacuuuccagagacagguaua

SEQ ID NO: 4120901 - RNA, 57 nt, Human
uguaucucuaucuaucuaucuaucuauaucugcauagaaaagggcaggagggauaca

SEQ ID NO: 4120902 - RNA, 84 nt, Human
uguaugaugucaugguaacaaagaagacuuucagaauuuccuagggacugaaggaaacuuuuguguuuuaccagggcauuuaca

SEQ ID NO: 4120903 - RNA, 61 nt, Human
uguaugccuuuuucuguuguaaccagaucuaauuuuuuuuaauuaagagaaaaagcaugca

SEQ ID NO: 4120904 - RNA, 105 nt, Human
uguaugcguaaagguaggauaucaggccaaguaacggaccugugagagaguaguuuaagggcagggcugggacuuacugguauccuuucaaucacacagcaugca

SEQ ID NO: 4120905 - RNA, 79 nt, Human
uguauguagggaaaucacaaaucauuuuaucugugugcagcaaccaauuauuuaaugauuuggggucuacuggcguaca

SEQ ID NO: 4120906 - RNA, 90 nt, Human
uguauguauguguguauauauauacacauauauguguguguguauauauauacauauauguguguguguauauauacacacacauauaua

SEQ ID NO: 4120907 - RNA, 77 nt, Human
uguauguauugaguagcuguuaugugccaagaucuguucucagugcuuuucauacauuaccuaacuuaaugcucaca

SEQ ID NO: 4120908 - RNA, 84 nt, Human
uguaugugaguguguauuugugcaugugugugugugcaugcauaccugugcgcacacacucaauugcauaagcaccuccaaaua

SEQ ID NO: 4120909 - RNA, 83 nt, Human
uguaugugggcuagcugacuguagugggaacauggacucacugaauuaugggaguucccugcaguaggcagcccuccauugca

SEQ ID NO: 4120910 - RNA, 59 nt, Human
uguauguguguaugcaugcacauguauguauguacauguguauagccuguauagauaca

SEQ ID NO: 4120911 - RNA, 62 nt, Human
uguauguguguguguguauauguguauauaaauauauguguguguauauacacacauguaca

SEQ ID NO: 4120912 - RNA, 76 nt, Human
uguauucuuucugcuguucauucuuuuagcucugaguauuuauaagagacuucaccaugaauauaggaaugguaca

SEQ ID NO: 4120913 - RNA, 74 nt, Human
uguauugauauuuaugguacuauagaauucuuggcacacagcugagagauaaagugcucauaaaaauggauuca

SEQ ID NO: 4120914 - RNA, 68 nt, Human
uguauuuagucauggaauuuccagaaccacuggaguuuagggaagaagcccauggccagugagucaca

SEQ ID NO: 4120915 - RNA, 84 nt, Human
uguauuuagugauuuuuuagcccuguacugugauacuaagaaguagggcuuaaauagggccuaaaaaguauugcuaaaauuaca

SEQ ID NO: 4120916 - RNA, 86 nt, Human
uguauuuccacaagcaaauuacuacaacaaacuugccugcugaguucaggucaucagacaauuguugaguacugggcuggaaguca

SEQ ID NO: 4120917 - RNA, 77 nt, Human
uguauuucuuucuggauaugcuuggccauuucgguuccugauauaauaauggcuucaugucuguggaaagcaaaaca

SEQ ID NO: 4120918 - RNA, 107 nt, Human
uguauuuguuuaauuuccucaucugagucucugacagcauguuuugccugaauucacaaaggaaacacaguucaagacaucaguaugaucucuauuuuauauguaca

SEQ ID NO: 4120919 - RNA, 95 nt, Human
uguauuuuaccuggcaacucuaguuauaugcaaauaccuuggacuaucucuaaagauaaucuggucuuuguaugaguuaacagaugauuuuuaua

SEQ ID NO: 4120920 - RNA, 74 nt, Human
uguauuuucaugcugugggaauucucggaaguuggcugaauugagacuuaggaauauccacagcagguuuuaca

SEQ ID NO: 4120921 - RNA, 79 nt, Human
uguauuuucuucauugacaaggaaaaaucauuaaugaauuuuuuuuccuaagcaguggagcuggcauauuaaagguaca

SEQ ID NO: 4120922 - RNA, 109 nt, Human
uguauuuuguagcaguuggacuagauucaguucuggaaauuguuuuauaaccuuuuggcaguuuugaaaugaaauguaguucaacauuuuuauuuuucugugaaauaca

SEQ ID NO: 4120923 - RNA, 71 nt, Human
ugucaaaauggagaggacauuaaguguuugcuaauauauuugacuuuaguuuccuuggauucaauuuggca

SEQ ID NO: 4120924 - RNA, 58 nt, Human
ugucaaacucaagggcuugaucaaaugauuagugaugacuagacuuuuguguuuggca

SEQ ID NO: 4120925 - RNA, 105 nt, Human
ugucaaagaugacugauauacacaguuuaaacgauuaguacuguaauagauauauucgggaaacgagcuaguauuuaguugaaaauugugugucauuuuuaggca

SEQ ID NO: 4120926 - RNA, 91 nt, Human
ugucaaauguguguuuuauaauugcuucauaagaugaguuucagaacauucacuguuucuuaaagcagcuuguaaaauguagguauuguca

SEQ ID NO: 4120927 - RNA, 74 nt, Human
ugucaacaauguagcugcagaugauaaugcuggcauuuuauucaugaggaauuaucaaugcagguuacuggaca

SEQ ID NO: 4120928 - RNA, 68 nt, Human
ugucaagaacuugggagaaccugauucugucaucuagaauauuugcuaacagucccaaauucuuguca

SEQ ID NO: 4120929 - RNA, 55 nt, Human
ugucaagagugcacacaucugcuuuccuucugaguugugcuuucugcccuugaca

SEQ ID NO: 4120930 - RNA, 63 nt, Human
ugucaaggccuuggaaagauacccagcucucuggagccucgguuuccuccaagguagaagaca

SEQ ID NO: 4120931 - RNA, 72 nt, Human
ugucaauauagguuucaaacaugacucuuggggagaugauuugaaugucuuguuugauaucaaauauuggua

SEQ ID NO: 4120932 - RNA, 78 nt, Human
ugucaauuuccccagauaggaaaagcuaggcauagaaccccaaaguucuauuuuagccauguuccauuuggggugaca

SEQ ID NO: 4120933 - RNA, 67 nt, Human
ugucacaugaucugauaaucauccacuagugagucugugggugaugaguaucagagcaguaaugaca

SEQ ID NO: 4120934 - RNA, 60 nt, Human
ugucaccaaauguuuuccuggagccagacucaugacugguuucuaagguuuuggugcaca

SEQ ID NO: 4120935 - RNA, 113 nt, Human
ugucacucgagcauucuugucucccaaacucugaugguccgcaguggguacugggcucccugggcccugggaggaagacggaggaguuugggugaaagaucagacggugcgca

SEQ ID NO: 4120936 - RNA, 73 nt, Human
ugucacuuaugcccuguugucggacgucaagguuuuuuccaaucuuaaauggacuaacagugcuaagaugaca

SEQ ID NO: 4120937 - RNA, 64 nt, Human
ugucacuuuggggagaguuuugggaaggucuggucaucccuaagggcucuuccugaaagagaua

SEQ ID NO: 4120938 - RNA, 122 nt, Human
ugucagcuauuguaaagguacugagauccuguuuuaugaagggaaugagacauccggucuuuaaaaaaaaugcauauuucuuauuucccauaaggcaguuagaagucugcacaauaaugaua

SEQ ID NO: 4120939 - RNA, 78 nt, Human
ugucagggagaggucuggcccagcaauuugcucacccaaggaagaggagugucagagcaaggccaggccagccacgca

SEQ ID NO: 4120940 - RNA, 105 nt, Human
ugucagguaauuaccagaguggccuucagagaagaaccuauaugcugaugaauucuuaugugaaggucaguguagugguuugggcgacucuuucuaauucuggca

SEQ ID NO: 4120941 - RNA, 92 nt, Human
ugucagguuauccaccucgggcagcucgucaggcugcggcgcccuguucagucuguugcagcugagaucgagcacucugagcuuggcuggca

SEQ ID NO: 4120942 - RNA, 67 nt, Human
ugucagguuauugccaugcaaaagagugguaacuuccagguguugccauagcaaugguaagcugaca

SEQ ID NO: 4120943 - RNA, 59 nt, Human
ugucagguucagugauuuuacuguggaauaguucaucagugagucaaaaaacuuagaua

SEQ ID NO: 4120944 - RNA, 60 nt, Human
ugucagguuuggaggggcagaagcaaaauuuaaaaaauuguuuauaccugcaaccuguca

SEQ ID NO: 4120945 - RNA, 61 nt, Human
ugucagucacugaaucucuguacucaaagaagaagucuuggacauagaucagugauugaca

SEQ ID NO: 4120946 - RNA, 55 nt, Human
ugucauauuugggcuaaaagugagcaguauuguucucauuuuucccagauggaua

SEQ ID NO: 4120947 - RNA, 62 nt, Human
ugucaucccugcuguggccugucuccugucucccaggagcuuaggccagggacagggacaca

SEQ ID NO: 4120948 - RNA, 70 nt, Human
ugucauguuuuucucuuagccuguaugagaacaaaaaguuuucagagucuaaauagaagaauaccagaca

SEQ ID NO: 4120949 - RNA, 65 nt, Human
ugucauucuccaagaacccgcugcugcgacgcaggccaaacagcuggguuuagugggguguggua

SEQ ID NO: 4120950 - RNA, 72 nt, Human
ugucauuuuagugcaucacucaauuuagcauguagaauaauguucucuggugaaugaugcaguauaaugaua

SEQ ID NO: 4120951 - RNA, 75 nt, Human
ugucauuuuuugaagaaguaauuuuaagucuccuaucaugggagauugugucaauuucucuuuaaaauucuguca

SEQ ID NO: 4120952 - RNA, 69 nt, Human
uguccacauccaucauguucacagcuauauccccaaggacuuugagcaaugucuggaacaguguggaca

SEQ ID NO: 4120953 - RNA, 86 nt, Human
uguccagaugacaugggagcaagcacuacaggaaaggugagggaaagguccuggcaggccaggcuaguuccugugcauccagggca

SEQ ID NO: 4120954 - RNA, 77 nt, Human
uguccagcuuuguagaaaauucucuuggauagcccuggccuaagugaugucuaagauaacuuucagcuaguaaaaca

SEQ ID NO: 4120955 - RNA, 55 nt, Human
uguccagggaaggugugaggcugggcaaguuuauuucccccuuccucccugggga

SEQ ID NO: 4120956 - RNA, 58 nt, Human
uguccagggauggggucagggacggguuuggcuguugccuagaugcugcccugggaca

SEQ ID NO: 4120957 - RNA, 65 nt, Human
uguccauaaugggauguaaaugugauaacauaaauguguuguacaauuguuucacaugcaggaca

SEQ ID NO: 4120958 - RNA, 61 nt, Human
uguccaugagcuagcuuuccaaaggcaauugauugcuuuaaaaaaauguuagcuuugcaca

SEQ ID NO: 4120959 - RNA, 77 nt, Human
uguccauguuuuugaugguauggccuuuuuuacuacaaacaccguaauuauaaagaggaaccaagagcacguggaua

SEQ ID NO: 4120960 - RNA, 72 nt, Human
ugucccaaaacuacauuuccugaccccugugucaccuuggugccagggaaacagcccagugugaugaggaca

SEQ ID NO: 4120961 - RNA, 69 nt, Human
ugucccccaggcuggagugcaguggcgcgaucucggcucacugcaagcaagcuccgccuccuggguuca

SEQ ID NO: 4120962 - RNA, 83 nt, Human
ugucccugagaguugaacacauuggggaaaaauugggcacagcccauuacuuuuacaaacuccagugagugagccucaaugca

SEQ ID NO: 4120963 - RNA, 67 nt, Human
ugucccugcuauccucugcggagcccagcugacagcucagggcugcguguggaggauguaauggaca

SEQ ID NO: 4120964 - RNA, 59 nt, Human
ugucccugucuucuuugcaguguugcuucaagcuagugcagacuucgaggagggggaua

SEQ ID NO: 4120965 - RNA, 73 nt, Human
ugucccuguuuuaaagauuaggcaaauugcuucccuucuaacucuuaguaucccagucuguaaaauggggaca

SEQ ID NO: 4120966 - RNA, 120 nt, Human
uguccuaauauaucuuauagugcuugcaaauuugauuuucuuaaaccauacauggaauacaguuguuugucaaggguuaaaaagcauugcaaguucugaaguaaacauguacaaagguca

SEQ ID NO: 4120967 - RNA, 70 nt, Human
uguccuacacugggcucucgcccgcucucaugcagaaauaagggccuggaacuggagaccacagaggaca

SEQ ID NO: 4120968 - RNA, 64 nt, Human
uguccucagggagucccagucaugauuugagcaugaugacagaaggccucccugacacaggaca

SEQ ID NO: 4120969 - RNA, 113 nt, Human
uguccucauacguaaaauagagauguaauugcauaaauuucauagcauuguuauuagguacagacaaugcuaauauacaugaagugcaugucuccuggcauauugugaagaca

SEQ ID NO: 4120970 - RNA, 84 nt, Human
uguccucuuacauugcugauggagggaaugcucaaaauauguuaauucucuggcacuuccgucugccuugugcauuggaggaca

SEQ ID NO: 4120971 - RNA, 72 nt, Human
uguccucuuguggccaaaaguugcugcugcaucuggaaaagcuggcaauuucaaugaggccacagggggaua

SEQ ID NO: 4120972 - RNA, 64 nt, Human
uguccucuuugcaugcauuuucccuuacauuuagaugugaggaaagaaauagcaaggauugaca

SEQ ID NO: 4120973 - RNA, 67 nt, Human
uguccugacaggggucccucugggcuguggugcugugguaaacagcagugggggaacccugcagaca

SEQ ID NO: 4120974 - RNA, 67 nt, Human
uguccugaggaaaauggaguguaauuaagggugagcacccuuaauucuugagcugucuuuccagaua

SEQ ID NO: 4120975 - RNA, 82 nt, Human
uguccugaggccuggcugggcccccaccugccuccggggucuccaagagaagacaguauggggcccagcggugaccaggaca

SEQ ID NO: 4120976 - RNA, 72 nt, Human
uguccugagugcuggugauaaagaccgaaaagauaaacguuaucugguccuugcuacccagcaagcaagaca

SEQ ID NO: 4120977 - RNA, 107 nt, Human
uguccuggagccccugcaccugucuccaaaugguauccgcugugccgccaggacgcgcuucacuggcagcaugggugccuuugugaagauugugaggcgcuaggaua

SEQ ID NO: 4120978 - RNA, 59 nt, Human
uguccuguaggaggcagaacaaggauuagacugccuaucuguacugucauccugggaca

SEQ ID NO: 4120979 - RNA, 61 nt, Human
uguccuuacaaggucccuuucgugggcauuucuagcuuuuaggacgaugguguguggggca

SEQ ID NO: 4120980 - RNA, 78 nt, Human
uguccuuagggauauaaaauauucaaaaguccaaaaaguggaagucuaugugguuuuauuuuguugucucugaugaca

SEQ ID NO: 4120981 - RNA, 71 nt, Human
uguccuucuuauaucuuuauccuggacuacccaucaagugaauauuucagaaaggauaauuggaagguaua

SEQ ID NO: 4120982 - RNA, 58 nt, Human
uguccuuggccuggguagaguggcaccuaguugguggugcccauauuagccagggaca

SEQ ID NO: 4120983 - RNA, 96 nt, Human
uguccuuguugacauuguuguugcucugcugacuuguuuuucuccuggagcggagccugccugcagcacagcacagcggugacucagcacuggaua

SEQ ID NO: 4120984 - RNA, 82 nt, Human
uguccuuguuuaaacaaaauggaauauuuuccccuuaauaaaacucuugggaagaauugcccauuucugucuuucagggaca

SEQ ID NO: 4120985 - RNA, 62 nt, Human
ugucgacucucuggucagaauuugcuccggacucucuuauggcagaaucaggucaggugaca

SEQ ID NO: 4120986 - RNA, 65 nt, Human
ugucgcccaggcuggagugcaguggugcaaucucggcucacugcaaccucugccucccggguuca

SEQ ID NO: 4120987 - RNA, 61 nt, Human
ugucgugggugcaggagagcuuuuggcacacauaccaguuacuagucucacaucccuggca

SEQ ID NO: 4120988 - RNA, 108 nt, Human
ugucgugguuguugaauuuaagucacaaguaaugguuuuauaauaguguaauaauauuuuacagcucaaagcuguuacauuguagucugaagcacaugcaaucaugca

SEQ ID NO: 4120989 - RNA, 59 nt, Human
ugucuaacccaguggcaggaggggugcuuccuagaggaguaucugccaguggggaggca

SEQ ID NO: 4120990 - RNA, 130 nt, Human
ugucuaaggcaaccaucacaaaaugguauuuuggaaagauuauuauuaugaagagaauauauuuuccuccauuaucucuuuguuuuuaucuuuuuaaagguaaucauagccuccugguaucgcacaucca

SEQ ID NO: 4120991 - RNA, 80 nt, Human
ugucuaauuauguuuggaaacacuggcagaaauucauugaaaaaguuucauuucaacagugcuuccagcaggguuagaua

SEQ ID NO: 4120992 - RNA, 70 nt, Human
ugucuaccaaguguauuaugcuuuguuuggaaauguuggaccucgguacuauugcauuugguaaaaggca

SEQ ID NO: 4120993 - RNA, 87 nt, Human
ugucuaccguaccccaugacccuucuguuucaaggugcuacugccaagaagccagauuuggggcauaucauguggacauuguggaca

SEQ ID NO: 4120994 - RNA, 72 nt, Human
ugucuacugaagcaugcuuauaugucuugugucuucugcugcacuugagcauuagguguguuucagaggaua

SEQ ID NO: 4120995 - RNA, 55 nt, Human
ugucuaucaacagguaaauggauaaacaaauugugguguaucuguaugauggaua

SEQ ID NO: 4120996 - RNA, 63 nt, Human
ugucucacagccuuaacaaggagccagcuggccaacaucucagaccuccagagcugugagaca

SEQ ID NO: 4120997 - RNA, 80 nt, Human
ugucucacuguacaugcaucuugucuaugucuuccacuagagaccaugagggcagagaucagaccuauguacguugcaca

SEQ ID NO: 4120998 - RNA, 61 nt, Human
ugucucaggaaaaacuuugucaagacuguugccagucuugacauugcaaucuucagagaua

SEQ ID NO: 4120999 - RNA, 93 nt, Human
ugucuccaaagccuguuccaucaguuuuugguugaagcccuacagaucuccuaauuuggucaaugaagugcugauaacauuguuauguggaca

SEQ ID NO: 4121000 - RNA, 71 nt, Human
ugucucccaggaacgggccucacaucccugcagugcugucagcagccuguggaaggccuguccugaaagca

SEQ ID NO: 4121001 - RNA, 69 nt, Human
ugucucgcaagccccaccugagccugacugaacuuagcagagccaugguaugggcuugugcucuagaua

SEQ ID NO: 4121002 - RNA, 91 nt, Human
ugucucggcacacggugucucagauacgccaucaagggaagaucuccgguucuugcuuuguuguagucucugagcucuugcuuuagagaug

SEQ ID NO: 4121003 - RNA, 74 nt, Human
ugucucucuaagacauuacuggaaucugacuguaauugggugacuguuggcaaagaccuaggaugagggagacg

SEQ ID NO: 4121004 - RNA, 63 nt, Human
ugucucugguuaugucauuaagcaguuuggugaacguuuuguaugaggcauacaucaggcaca

SEQ ID NO: 4121005 - RNA, 71 nt, Human
ugucucuucucucaggaaggacagggcuuccacaaucuggagggucaccccuugcugaggcagaaggaaua

SEQ ID NO: 4121006 - RNA, 56 nt, Human
ugucugaagcacugggcguugccccacucuguccucgucaucugugcucucggaca

SEQ ID NO: 4121007 - RNA, 71 nt, Human
ugucugagcccuggagcccucuguuauuaauaaacaaguacaaaagaucacaaccugcucaggcugagaua

SEQ ID NO: 4121008 - RNA, 68 nt, Human
ugucugaggucauuagcucucuucaggauauuuacaggacugaaugaggugaggaaggccucagcaca

SEQ ID NO: 4121009 - RNA, 72 nt, Human
ugucugaguuugcagaucugcugacuucauauuucagugauaucuugcagcuucaucugcaauucucuggca

SEQ ID NO: 4121010 - RNA, 72 nt, Human
ugucugcaauacucaucauuggagauagcuuacugcugaaguuaaaguacaauauugagauugauaaagaca

SEQ ID NO: 4121011 - RNA, 77 nt, Human
ugucugccaggcccaaaugcaaccuucuugugaaaggagacgggagggaaggcuaggguuuagagagaaggcagaua

SEQ ID NO: 4121012 - RNA, 58 nt, Human
ugucugcugguugggagcuuaaagacacaaaugugguagagcuucaacucagcaaaca

SEQ ID NO: 4121013 - RNA, 68 nt, Human
ugucuggagaaacaucaggcauaggcauacauuagauaaauguuuguguuuuccuuucaucacggacg

SEQ ID NO: 4121014 - RNA, 64 nt, Human
ugucuggcccuuucugucucagcugccaaggggaugaccuuuguggccaggagagggugggaca

SEQ ID NO: 4121015 - RNA, 62 nt, Human
ugucugggauguuggcagccacuucaaaaucagaccucuguggcagcauuuuuuccagaaca

SEQ ID NO: 4121016 - RNA, 62 nt, Human
ugucuggggucacuuaggauagaggcaaaaaucucuguacaagcaaauagaccuucaagaca

SEQ ID NO: 4121017 - RNA, 71 nt, Human
ugucuggguugcuucguugcucacuugcugauuggaaucccaggagacagaaacagagguaguccagcaca

SEQ ID NO: 4121018 - RNA, 73 nt, Human
ugucuguguccagugagagagaacgcauucauacucaauaaguuauaugaagcaaauuuauuacuuacagaca

SEQ ID NO: 4121019 - RNA, 91 nt, Human
ugucuguuaauaacacugacaugaucauucaaguuacugcuguuuuggugaacagaguagcucaagaagauugugucuuagauuaauuuca

SEQ ID NO: 4121020 - RNA, 90 nt, Human
ugucuguuacauaguagauccuaaagaaauauuuauuaaaccaccacuuauuuagccaauguugauugggaaucuucucuaugcuaggca

SEQ ID NO: 4121021 - RNA, 68 nt, Human
ugucuguuccugcagccuccuccagcuacgugcagcucagcugccaccgcgaggcugcagagcgggca

SEQ ID NO: 4121022 - RNA, 78 nt, Human
ugucuguuuugcacuagucucagaggcaaaagcugaacagaacagccuuuuaccuacccaguauuaugaacacagaca

SEQ ID NO: 4121023 - RNA, 55 nt, Human
ugucuuauuccuucuguucagcaggugugugcaugucuuaggcaagaauaagaca

SEQ ID NO: 4121024 - RNA, 57 nt, Human
ugucuucaaauacagucauauugagaguugagcuuucaguauaugaauuugggggua

SEQ ID NO: 4121025 - RNA, 64 nt, Human
ugucuucacaugauaagccauuccuaucagagaaauaaaacauuagggaggcauuuugaagaca

SEQ ID NO: 4121026 - RNA, 112 nt, Human
ugucuuccucugggacagugaacuagcacaauccacaccucaugaaagacuaaggcugauguggguuugugagauggauuggguugguucccaccuuguuucaacugguaca

SEQ ID NO: 4121027 - RNA, 67 nt, Human
ugucuucucacguggguuccugugcuucaguaagaacucagaaagcacaguucaugagacaaagaca

SEQ ID NO: 4121028 - RNA, 80 nt, Human
ugucuucugcuggcauuuaaccuguaaaauaugugaguucuaaaucugugccuugcuuaacaagauggcaguaaagggca

SEQ ID NO: 4121029 - RNA, 61 nt, Human
ugucuugagauguauaaaucaucccuucgaaagaaguccuuugagguaucaauucaaggca

SEQ ID NO: 4121030 - RNA, 57 nt, Human
ugucuugaggcgcaguguagauuacaugggucagaauuuguaaaugugcuuaggaca

SEQ ID NO: 4121031 - RNA, 72 nt, Human
ugucuuuaaaauuaaacacaucggucauaacuuuaaugaagguguaaaaguguuuuuaguuuuaaacaggca

SEQ ID NO: 4121032 - RNA, 57 nt, Human
ugucuuuacuuaauaaauauacgagcaccucucguguuucagguauggguaaaggca

SEQ ID NO: 4121033 - RNA, 62 nt, Human
uguagcacuagauguuucucuucugaggcaauggaaugcuugaggaaaugcucugguguuca

SEQ ID NO: 4121034 - RNA, 75 nt, Human
uguagccacugaaaugguauuuacucuguauuacuuuucaucaguuguauagaauuuacucuuuuguggagcgca

SEQ ID NO: 4121035 - RNA, 86 nt, Human
uguagcuggugacuuuaguucuaaugcauugaaauucuaucuaauaaguguuuuucuugugcuggaucuaaucacagaagguuaca

SEQ ID NO: 4121036 - RNA, 73 nt, Human
uguaggaaauccuuccuccagaaaagauggcucauucaccaucagagagugcacccuggagagaagcuccacg

SEQ ID NO: 4121037 - RNA, 64 nt, Human
uguaggcaucacuuucucuugggcaguuaucacauuggcagacugaagggaagugauuucuaca

SEQ ID NO: 4121038 - RNA, 55 nt, Human
uguagggacugaggcuggagaggccacugcugcacucucagccccauccacugca

SEQ ID NO: 4121039 - RNA, 88 nt, Human
uguaggggagauggucugaugucugauuucacuauuuguuuauuaaaaagcaguugggaguuauagacucuaucucucuaccccuuca

SEQ ID NO: 4121040 - RNA, 129 nt, Human
uguaggggauguaaaucacaugaguucuguuucaggucaccgcaugacugucugcagccuuuuuuccggacuuaguacauucacugugguaggcacucggucuccaugugacugcuaacccuuuccaca

SEQ ID NO: 4121041 - RNA, 70 nt, Human
uguagggguuucugauggaugauaaaguagcuuuuuuuggccuacucugaaaacccagaaacuccuguca

SEQ ID NO: 4121042 - RNA, 72 nt, Human
uguagguccuguugucccauuuuuuauauauuggggaaaauugaguaauagaugaaacaauguggagcuaug

SEQ ID NO: 4121043 - RNA, 91 nt, Human
uguaggugaccauuuggcagggaggaggugaaagugagcacaucauaguccucauacaccuaucucucugugcagauacgugauagagaca

SEQ ID NO: 4121044 - RNA, 78 nt, Human
uguaggugcccagggagaucuuggcuccuggugcugagaggauggugaccaagggcccucgaccucccuggcucugca

SEQ ID NO: 4121045 - RNA, 97 nt, Human
uguaguaauaaagauccacauuuaucuucugcaguucuggcuuugguauucuuacuuugaacuggaauagcacaggaaaaguggauugaggaccgca

SEQ ID NO: 4121046 - RNA, 66 nt, Human
uguagucccagcuacugaggaggcugaggcagaaggauuacuucagcccaggagguugagacuaca

SEQ ID NO: 4121047 - RNA, 66 nt, Human
uguagucuuagcaacuuaaggggcugaggugggaggaucucuugaguccaugaguuagagacuaua

SEQ ID NO: 4121048 - RNA, 86 nt, Human
uguaguuaaaucauguugugcaugcaguaaguguuuuaaaugaaaguaauuuaaaacaacucuguguguuuaacucuggaauuaca

SEQ ID NO: 4121049 - RNA, 73 nt, Human
uguaguucauaccuggugcaagaggguccuuggacauugccaagggaaauccucagcccaggacuugauugca

SEQ ID NO: 4121050 - RNA, 93 nt, Human
uguauaagaaguuaauuugcaagcgacuugacuagcaugagaauuuuugacucuuucagcaaacacgaugcuuguuuauguacuuuuuugaca

SEQ ID NO: 4121051 - RNA, 86 nt, Human
uguauacuaaucuugauaggaaugauucaagacuuggcuuauuauccauccaugacuggguuccccuauucccaaauugguauaca

SEQ ID NO: 4121052 - RNA, 56 nt, Human
uguauacucaugaagccagcccuacauuguggucuuugguuuucugagucuguaca

SEQ ID NO: 4121053 - RNA, 103 nt, Human
uguauaguugguuaccucugaauaaaaauguuuuugugugguaauuugugaacuguuuuagugcauaccuaacauuuuugcuuauacagguauucuuuuuaca

SEQ ID NO: 4121054 - RNA, 60 nt, Human
uguauauauuuauguguguauauacacaggcauauguguguguacacacagauauauaca

SEQ ID NO: 4121055 - RNA, 88 nt, Human
uguauauauuuguacauacauguauauguaugugugauuauauguagauacacaugcaugugcauguauguaugcaaaaaauauguca

SEQ ID NO: 4121056 - RNA, 67 nt, Human
uguauaugcaagaaggcaauaaacucuuucuauauaauaaagacauaguaagagcuucgcauauaca

SEQ ID NO: 4121057 - RNA, 56 nt, Human
uguauauguuuguauguacacauguucauguauacauguguguacuaacauauaua

SEQ ID NO: 4121058 - RNA, 84 nt, Human
uguauauugcauugaaaagaaaacaagaauaguuuacuugguucuguguaaacuaggaaguucaucuuauuaguaugauauaua

SEQ ID NO: 4121059 - RNA, 58 nt, Human
uguaucacacuagccuauaguggauguuuguguuucauccaaugagagugugaaugca

SEQ ID NO: 4121060 - RNA, 107 nt, Human
uguaucauuucuguaauucaagcuguuugaacugaauaacauaguguuaggaucacuguuuaauuguucuaguuuugauagauacaaugcuuuauguaagugaaaua

SEQ ID NO: 4121061 - RNA, 72 nt, Human
uguaucauuuuaauuauuuuuccaguucauucccagggaaacuggcugauggggaauuaauuaaugggucca

SEQ ID NO: 4121062 - RNA, 57 nt, Human
uguauccucacuaauuaggagggaaauuauucuccucacacuauagaugaggauuca

SEQ ID NO: 4121063 - RNA, 67 nt, Human
uguaucuaugugggaaucauaauaguuauggagucuccagacaaugguugguaccuauauagaucua

SEQ ID NO: 4121064 - RNA, 59 nt, Human
uguaugaaccuuuaauauagugcugccaucagacauucuauuaagaagguaaucguaua

SEQ ID NO: 4121065 - RNA, 73 nt, Human
uguaugaugauugauguguucauugauugugguaaucuucacaauguauguguauaucaaaucaaguuauaca

SEQ ID NO: 4121066 - RNA, 76 nt, Human
uguaugcaucuccuggagcacagggagcuuguccuguucucugggggcugcccugugguccagcaggugccugaca

SEQ ID NO: 4121067 - RNA, 60 nt, Human
uguauggcuuggaaauaguuuagcugaacauuaugcuuuaauauuuuacuggccauugca

SEQ ID NO: 4121068 - RNA, 57 nt, Human
uguauguuguaugcuggcaucauguauaauaacuuugugucuguaugcagucauaua

SEQ ID NO: 4121069 - RNA, 68 nt, Human
uguauuaaagccuuuucuguuuaacacaccuagagugguuucuguuuccugcaaagaggucuaauaca

SEQ ID NO: 4121070 - RNA, 84 nt, Human
uguauuagagugaaaaccuaaucaugcaguuguucauccucauuaauauggauaagucauguguucaucuuucauucuaauuua

SEQ ID NO: 4121071 - RNA, 77 nt, Human
uguauuagcuucugguuuuguucuagucugaagugcauuauauuaugcaaaauccagaacaaaauuagaggagugca

SEQ ID NO: 4121072 - RNA, 60 nt, Human
uguauuaguuuccuguugcugcuguaacaagugauugcagaugcagugguuaacaauaca

SEQ ID NO: 4121073 - RNA, 105 nt, Human
uguauuauauauuauuuugaaauacacaaauuuaguaaguuuuaauaucaaaauaaagcacagagcauggugaaguugguguguuuaaaacuaaugucuacuaua

SEQ ID NO: 4121074 - RNA, 87 nt, Human
uguauugagguauaauugacaagcaaaaauuguuuauauucaagauguauaauguuucguuuuguuguaauauaccuauccagugca

SEQ ID NO: 4121075 - RNA, 59 nt, Human
uguauuggcucauuuauuugcaaaguuagaggauugcaaaaugcuaugugcccaaugca

SEQ ID NO: 4121076 - RNA, 95 nt, Human
uguauuguuuauucauacauucauugagcucuuccugugugccagguuucaaccuggguaggugcuggggauucaguggagaauaaaacagugca

SEQ ID NO: 4121077 - RNA, 67 nt, Human
uguauuuaauugcugauaaaauaaaccaagaugguugcuuuacuucaugguuucagugucagcugca

SEQ ID NO: 4121078 - RNA, 55 nt, Human
uguauuucaauuuuagcaccaauuuauuuauugguugcugcuacuuuggaaggca

SEQ ID NO: 4121079 - RNA, 64 nt, Human
uguauuucaucuucuuaagcuguuuguguugauguacacuguuaaaaugguuugaugaaguaua

SEQ ID NO: 4121080 - RNA, 93 nt, Human
uguauuucaucuuuuuuauucaucccuagauacagguuaugaaggcaugugcuuggacauucuaggaagugacuaaguagaagauaaaagaca

SEQ ID NO: 4121081 - RNA, 64 nt, Human
uguauuuccaugagcucugaguucacaguugggaacuugaacuuaaacugggaucugggaugca

SEQ ID NO: 4121082 - RNA, 74 nt, Human
uguauuucuguugcugaguuugcccacuuggggaggguugacaccuccuggggcugugcugaguaggaggugca

SEQ ID NO: 4121083 - RNA, 99 nt, Human
uguauuuguguuucuaaguaucuugcaguuuucucauugaccuguucuuagccagcauuuucuuuagguuuuaagacuguaguaagaaaucgcuauaca

SEQ ID NO: 4121084 - RNA, 64 nt, Human
uguauuuuaguuuccaccacacauguucuuuucuguagggcuuguauguuggaaauuuuaucca

SEQ ID NO: 4121085 - RNA, 99 nt, Human
uguauuuucugaaaauguuuaaaguauuuuaucauuuguuugauucuaucccuggugaugucucauaugauauaaaugcagacuggauuaggaaauaca

SEQ ID NO: 4121086 - RNA, 106 nt, Human
uguauuuuuaguagagaagggguuucuccauguuggccaggcgggucucaaacuccugaccucaggugacccacccgccuuggccucccaaagugcugagauuaca

SEQ ID NO: 4121087 - RNA, 66 nt, Human
uguauuuuucuauuuguaugcugcuccuaaaaggaucuaagacagcuaacagaucgacaaaguaua

SEQ ID NO: 4121088 - RNA, 79 nt, Human
ugucaaaacuuucagggauacagaaaugaauagguuaugguuuauguuuguuucugguuuuauucugggguuuuguaua

SEQ ID NO: 4121089 - RNA, 64 nt, Human
ugucaacaaguucaguuguacgucuuucccccaggacagcugcacacugaacuugguauggaca

SEQ ID NO: 4121090 - RNA, 57 nt, Human
ugucaacauuggcugacaguuguaacaaauguaccacgcuggugggggauguugaua

SEQ ID NO: 4121091 - RNA, 116 nt, Human
ugucaagauaaacgcuauuaagguugggacaaaagcaauugcggguuuugccauuacuuucaauggcaaaaaccacaauuauuuuugcaccaaccuaauaacaucuucaaucgaca

SEQ ID NO: 4121092 - RNA, 76 nt, Human
ugucaaggugcugaacaaagaaauagucauggcauuggagccagagaugaccaugaguagacuuuuucccuggaca

SEQ ID NO: 4121093 - RNA, 55 nt, Human
ugucaauaacauuuacuucuauuuggaacgugaugauaggguggaguuauuggca

SEQ ID NO: 4121094 - RNA, 67 nt, Human
ugucaauuuccagguauuaauacuguauuauaguuaagcaugauauuaauacugggaaggcuagaua

SEQ ID NO: 4121095 - RNA, 84 nt, Human
ugucacaagaaguauuucauuaggaaaaaauguacuaauaauaugccaaaguuuucaugaggaaauacugcccauauugugaca

SEQ ID NO: 4121096 - RNA, 96 nt, Human
ugucacaaggcuacacaugaucgucaugugaaaguugcauauuuaauaaagcaacauucaugccauuauguuguuucauguucauuggccuuugca

SEQ ID NO: 4121097 - RNA, 67 nt, Human
ugucacccagguuggagugcaguggcgugaucucagcucacugcaaguuccaccuaccggguucaca

SEQ ID NO: 4121098 - RNA, 72 nt, Human
ugucacccaguuagaagaauauauugaguauuucugaaugagucucaaaaugguuaauuuuaauaagugaca

SEQ ID NO: 4121099 - RNA, 80 nt, Human
ugucaccccagagccugagugcugccuccccuacaucccguugugcuguggggggaggcaggaccgggcagaugggggca

SEQ ID NO: 4121100 - RNA, 69 nt, Human
ugucaccugcggagugcugggagccauauuguacugaaagcuucaagguucacagcuucuuaggucaua

SEQ ID NO: 4121101 - RNA, 66 nt, Human
ugucacugauuucuuagcucuuuaagacuuaaugaaagaacucugcaggguggcaaguuagugaca

SEQ ID NO: 4121102 - RNA, 60 nt, Human
uggccuggaagagaggucgaggauacaaucacccccuuaugccucuggagccaaggacca

SEQ ID NO: 4121103 - RNA, 89 nt, Human
uggccuggagccuggggccgccauugaucagcaucuucacugaggaagccagcuuggccaguggccagugggcacccaggucggggcca

SEQ ID NO: 4121104 - RNA, 56 nt, Human
uggccuggaucugcagagcagggcuucagaggaggcaguggagcuggaauaggcca

SEQ ID NO: 4121105 - RNA, 114 nt, Human
uggccuggucagcucacugaagagcugaaggagaaagcaggggucauagaggccaucaagauccacccugcuuuugucuuugaauaucagcuccuguguguccugaaagagcca

SEQ ID NO: 4121106 - RNA, 73 nt, Human
uggccuguacuguacacagugguguacuguacacagugguguacuguacacagugguguacuguaaauggcua

SEQ ID NO: 4121107 - RNA, 60 nt, Human
uggccuuauucuacuaaacuagcaggugauugauaccaccgcuggugcuugagugaguca

SEQ ID NO: 4121108 - RNA, 58 nt, Human
uggccuucauguggacaaugugucucuguuccccaaagcacaggcuauaugagagcca

SEQ ID NO: 4121109 - RNA, 86 nt, Human
uggccuugcugaguaaauuaaauguauguucaagugcuauuucuuuauggcaccagggaacaagcauuucaaauaguauuaggcca

SEQ ID NO: 4121110 - RNA, 71 nt, Human
uggccuuugaaagauuuacuuucuuuguaauaccuguuugguguaaagagaagaaacgugagccucugcca

SEQ ID NO: 4121111 - RNA, 68 nt, Human
uggcgacaucucagccaaaagacccggcagacaccaucuuggccaagggaucgagguuggcaucgcca

SEQ ID NO: 4121112 - RNA, 71 nt, Human
uggcgaugcaagugcuguauccaauuagaaguuuuacuucucaauaaacugcucaauugcaucaauagcca

SEQ ID NO: 4121113 - RNA, 65 nt, Human
uggcgcuggagugaugccugugucucugagagccacuugggacauagcaucuccuccaugggcua

SEQ ID NO: 4121114 - RNA, 78 nt, Human
uggcguuugaaagccuuuguacacuuccaaaagguaaaugguccacuuggucagugaaggagucuuugcugagcgcca

SEQ ID NO: 4121115 - RNA, 61 nt, Human
uggcuaagcugaggagaggaugcccucauuuugcaaagagacgcuucucccaucuuggcca

SEQ ID NO: 4121116 - RNA, 129 nt, Human
uggcuaaugaccuguaaccacucccuugcuugcuggagucacuuccauuguauuucagaaacaaauaucuuuucaagaaaauacagaguugcuuaaaagcuauaggggauuccauuacuccauuaacca

SEQ ID NO: 4121117 - RNA, 118 nt, Human
uggcuaauuaaaggguaaaguugaaaguagacaugagcaaugauaauuuaucaguucuauuucugaauauuuccaugaaguuuaguuauauuuuuagaaagcuucuuuuuuuuuucca

SEQ ID NO: 4121118 - RNA, 69 nt, Human
uggcuacagcuuggccacagagaagggaggcagagaaguuagauucuauucuguguguuacuguaacua

SEQ ID NO: 4121119 - RNA, 130 nt, Human
uggcuaggcaagccaggcucugcccauguguugagugaucauucagaauugguauuauaauuuggcaaacaaaaaugcuuugauugauuaaaacaauggaucccauuuagaguuuuuugggugucuggaa

SEQ ID NO: 4121120 - RNA, 68 nt, Human
uggcuauauaugauuuguugcauuuaggucacuuaugaaaauuccaaugucaguucauguauaggcca

SEQ ID NO: 4121121 - RNA, 122 nt, Human
uggcuauguucugucauuagucuucaggguuaucaacugcagguuuauuuucuuaccugauuuucucaguaggccuaaauagaacuugccuuggcuuuguuucuaaugcuagaaaacuucca

SEQ ID NO: 4121122 - RNA, 85 nt, Human
uggcucacaccuccuggggcugcaaggccugucccuggcucuggcagcgagaugacagggcuguugccccggcagggugaggcca

SEQ ID NO: 4121123 - RNA, 84 nt, Human
uggcucacgccuguaaucccagcuacuugggaggcugaggcaggagaaucgcuugaaccaggagguggagauugcagugagcca

SEQ ID NO: 4121124 - RNA, 82 nt, Human
uggcucacugcaaccucugcuucccggguucaagcaguuuccugcuucagacuuccaaguagcugggauuacagacaugcca

SEQ ID NO: 4121125 - RNA, 59 nt, Human
uggcucaggcacagacgcaaacuucuugauaaugucuucaagcgccuggagcccagcca

SEQ ID NO: 4121126 - RNA, 60 nt, Human
uggcucaggccacuucuuuuauggcacaaguuuuuauaauggaacaugguuuugaugcca

SEQ ID NO: 4121127 - RNA, 78 nt, Human
uggcucaguguuggcauucagaaauguuaaauaacaauaauaauaauaauacaucugagugugacgcuuuaauagcca

SEQ ID NO: 4121128 - RNA, 58 nt, Human
uggcucauucuggggaagucagccaccaaguaaaagucugacucuccugagaugacca

SEQ ID NO: 4121129 - RNA, 56 nt, Human
uggcuccagaagggagggcgccagaaaagaugccugggaaacucucuucggggcca

SEQ ID NO: 4121130 - RNA, 81 nt, Human
uggcugaaaaucauguuauguacaaauaugacuugauucaauacaauuuauuguuuggguauaauuugaauuagaaagcca

SEQ ID NO: 4121131 - RNA, 64 nt, Human
uggcugaagcugaauuguugcagacuaaugcuuuucaaacuucuguacacaucagcaucuccca

SEQ ID NO: 4121132 - RNA, 57 nt, Human
uggcugaccauggaggcaacaucugugauguuuuguugcugaucugugaaucagcca

SEQ ID NO: 4121133 - RNA, 62 nt, Human
uggcugagcacuuggaggaagagagugguccacacuuucugagcuuucuugugcucaaguca

SEQ ID NO: 4121134 - RNA, 107 nt, Human
uggcugauuguguuuucauuagaauggagagcuuggaugucuuuuguucauaccucguggcaauuuccuguccagguaucuuggucuaguacaucuuauuucagcua

SEQ ID NO: 4121135 - RNA, 74 nt, Human
uggcugcuggucggggucagggagaugaagcagugccagcuccguggucugcacugauccugaccagugaacca

SEQ ID NO: 4121136 - RNA, 68 nt, Human
uggcugcuuuaagaugacaaagaagguaggugcugcuccugccacuguuccaccaucuugauuagcca

SEQ ID NO: 4121137 - RNA, 101 nt, Human
uggcuggacugcaguguguguacaguuuuaacucugagggguuaaaauauucucauuggcccccaagacuaugacuuuauuacuauuguucauccaugcua

SEQ ID NO: 4121138 - RNA, 63 nt, Human
uggcuggauuauuggcuaguacaacucugaguccuucuaucugcucccaaucaauuccagcca

SEQ ID NO: 4121139 - RNA, 91 nt, Human
uggcuggguaaaaugguauuucuaggucuagaccccugaggaauccccacacugacuuccacaaugguuaagcucguuuacagucccacca

SEQ ID NO: 4121140 - RNA, 85 nt, Human
uggcuggugccuguaauccccgcuacuugggaggccaaggugggagaaucgcuugaaccugggaggcggagguugcagugagcca

SEQ ID NO: 4121141 - RNA, 77 nt, Human
uggcuuaaagaugauuauguagauugggaguuaaaagagaauauucauuucacagugguagugcauuuagugagcca

SEQ ID NO: 4121142 - RNA, 67 nt, Human
uggcuuaagauuuaugcuuuuauggaauauuagucuuguccacugaugauagcaauaaaucaaguca

SEQ ID NO: 4121143 - RNA, 68 nt, Human
uggcuuagaaagcagcauuuaugaucucacaguuucuguggguuagcaauccgaaugcaguuuagcua

SEQ ID NO: 4121144 - RNA, 70 nt, Human
uggcuucaggagcaccuggcuuuccucuaguucagagcccccaggucggaguguauucacugaauagcca

SEQ ID NO: 4121145 - RNA, 60 nt, Human
uggcuucaggguugucuucagcuaccugggacugacgauuagcccuggaacugaccgcca

SEQ ID NO: 4121146 - RNA, 57 nt, Human
uggcuucucuggcuuggaggagaggcucugcuucucacaaauccauccaggaggcua

SEQ ID NO: 4121147 - RNA, 76 nt, Human
uggcuugaauuuuucauguuugaugcauaaggccaguggcauucaaacaggaagaaaucauuucuacaguaagcca

SEQ ID NO: 4121148 - RNA, 57 nt, Human
uggcuugaggauauaacuugacuuacaaagaaauucugagaaguaugucuucagcca

SEQ ID NO: 4121149 - RNA, 81 nt, Human
uggcuugaugcugcuaucuuucugcaccauaauuaguugcauguauaguuaauuauuaugagaaaagcagaacaucuccca

SEQ ID NO: 4121150 - RNA, 68 nt, Human
uggcuugcuacugaggugucaggaaauuguacacucaagucucaccuugacauuuaguagcauuguca

SEQ ID NO: 4121151 - RNA, 68 nt, Human
uggcuugguccuggcccuuccccacgagcccaguggacacagcuggagcagggcggggcccaggcaca

SEQ ID NO: 4121152 - RNA, 86 nt, Human
uggcuugucucccacucuggaccgucagccggccucgcggagacccgaggggcuggcacgauggcugcagcggcggcggcaaccca

SEQ ID NO: 4121153 - RNA, 64 nt, Human
uggcuuuauccaucaucgccaacauuuucucuuuugcagcuuugagggugauggggauagguca

SEQ ID NO: 4121154 - RNA, 68 nt, Human
uggcuuucccgaaauguauuagaccugagcauugaugccacauauuccauuguugggauccaaggcca

SEQ ID NO: 4121155 - RNA, 123 nt, Human
uggcuuuggcugugcuguuccucuuggaggugaguggggucuccagggugagcgaggcauuggccaucuccuggggcuugucgcuggccagaaagcggagcagguugugcagggccuuggcca

SEQ ID NO: 4121156 - RNA, 62 nt, Human
uggcuuuggcuucuccuggcaggaagucaucaggcauccucuccaggugagccgaaauucca

SEQ ID NO: 4121157 - RNA, 82 nt, Human
uggcuuuuccgggaaagagaccgaccagcuaggaucuugcuugcuuggaccugccuggacagcucuuaccuugggggcgcca

SEQ ID NO: 4121158 - RNA, 58 nt, Human
ugggaaagaguuguuguauaacaggaauccuaccuaggccuccuauugcucauuccca

SEQ ID NO: 4121159 - RNA, 61 nt, Human
ugggaaaguaauugucauccuuucgaaaacacgaccuugaaaggguugcuaacuuguccua

SEQ ID NO: 4121160 - RNA, 68 nt, Human
ugggaaauuguaacaagucuguuaccuguauauugugucuuccacaaagcagacugaauacauucuua

SEQ ID NO: 4121161 - RNA, 57 nt, Human
ugggaaccauguagcugagauguauuuguuuagaugaaaagucuacacugguucuua

SEQ ID NO: 4121162 - RNA, 68 nt, Human
ugggaagagggaugcuuaggugagagugggguggaaaaaacuucuugaaaguggugacccucugcuca

SEQ ID NO: 4121163 - RNA, 76 nt, Human
ugggaagcaauuuagaaucagaagcacagggguucaaaucccagcucugggacuuucuaaaugugcucuuuuucca

SEQ ID NO: 4121164 - RNA, 74 nt, Human
ugggaagcagccugaagccaagggcuggcugacuuggaauauaaaagcugggccccuugcaaagugcuuuccca

SEQ ID NO: 4121165 - RNA, 63 nt, Human
ugggaagcuuuaaaugggugucugguuuguuacuuugagucauuuucacccgaagccuucuua

SEQ ID NO: 4121166 - RNA, 63 nt, Human
ugggaaggggaucagaggaggacucaaaaccaacagucuucagagacucugagccccucccca

SEQ ID NO: 4121167 - RNA, 85 nt, Human
ugggaagucgccguccuggggcgcucgcucugucccccucgccucggaccaccaggcagagcagccccaggguuuggacuugcca

SEQ ID NO: 4121168 - RNA, 74 nt, Human
ugggaagucucaugaacucucaagucaggccacaacgugcaagggccauucuugaugagguaugaaccucucca

SEQ ID NO: 4121169 - RNA, 75 nt, Human
ugggaauaaagauaugguuugaauuuugugaauccuuaccuguuucacaagcucagaucccugucucuauuuuca

SEQ ID NO: 4121170 - RNA, 78 nt, Human
ugggaaucuagauuuuuacaauucucuaccaguguuucuaaaagcugcuggccuggguugaaaacagcugaguuccca

SEQ ID NO: 4121171 - RNA, 60 nt, Human
ugucacugugggucccagacuggaguguuucauuucauuuguucaucuauagacaagaca

SEQ ID NO: 4121172 - RNA, 84 nt, Human
ugucagagaucaccaaggcauuuucacagcauugaagaugauuuguuuuucccugguguggauugcuuuuuggagaugaugaca

SEQ ID NO: 4121173 - RNA, 79 nt, Human
ugucagaucuagcuggucuuaaauguguccagccacaacuguguugcuauggacaaaagagacugguggacaacuggca

SEQ ID NO: 4121174 - RNA, 61 nt, Human
ugucagcacaucuguaaucacagcuaagcuccugcuguaugugauuuuggucugcgugaua

SEQ ID NO: 4121175 - RNA, 76 nt, Human
ugucagccacaaugguguacucugaacugggcacaugcuuuaacuaauguucagagacacuuauuggaaauugaca

SEQ ID NO: 4121176 - RNA, 56 nt, Human
ugucaggcaagcgggugcccugcuugauccccccggcuuggccccggagccugaca

SEQ ID NO: 4121177 - RNA, 57 nt, Human
ugucaggccugaggcuggaugucaggccaaagcuggcuccagcccagcagccugaca

SEQ ID NO: 4121178 - RNA, 57 nt, Human
ugucaggcuuuucuucccagguuguuuugcauuuccugggccagauccagccucaca

SEQ ID NO: 4121179 - RNA, 70 nt, Human
ugucaguagugccaagguugagaaacuguaggauauaaagauucucaaguuuugcuuugggauaauugca

SEQ ID NO: 4121180 - RNA, 66 nt, Human
ugucaguauuuucaaccauagccugggaggcaucuacgccuccuaggguuauuagaaaguaacaca

SEQ ID NO: 4121181 - RNA, 57 nt, Human
ugucagugcacagaugguugauacauaaguaucaguuguaauuaucuuuggguggca

SEQ ID NO: 4121182 - RNA, 91 nt, Human
ugucagugcucuccagucaaagaccuaguuuguucaauuaggaacauaucugugguugaacaaguuggguauauugcugcuuguagugagg

SEQ ID NO: 4121183 - RNA, 59 nt, Human
ugucaguucaauuauaguaauucaacuaaaugaguuauucuacagucauugaagugaua

SEQ ID NO: 4121184 - RNA, 62 nt, Human
ugucaguucuauaauguggcaguugcugccuuaaauagcugaacugcaaaucuuagacugca

SEQ ID NO: 4121185 - RNA, 71 nt, Human
ugucauaucacaguaucacauccucuaaggcaaaaaccacuuuugcugaaaacaguggguauugauaggca

SEQ ID NO: 4121186 - RNA, 62 nt, Human
ugucauaucuauuaaaugucuagcacagugguuggcacacauuaggcaauuaguagauaaca

SEQ ID NO: 4121187 - RNA, 61 nt, Human
ugucauaugcugucauagccauacaauuuguaagucccguggcugguguuuagcugugaua

SEQ ID NO: 4121188 - RNA, 76 nt, Human
ugucauauguucguagaucuuugguuggaaacacaaugcaaauaacuauuccaaucagcuccuaugagaauagaca

SEQ ID NO: 4121189 - RNA, 98 nt, Human
ugucaucagagcaucuaagacuguaucaagaucagcagcuguucucacuagaauggugcaucuuucaauauucaggucuucccagggguucuuugaca

SEQ ID NO: 4121190 - RNA, 76 nt, Human
ugucaucagcauuuuggggaugguguuuauuucuucaacgagaauaagauuccagaucccaaaaaugauauugaua

SEQ ID NO: 4121191 - RNA, 62 nt, Human
ugucauccugucuuuguuuuaaauaugcuaaaugcauauuuuguaacuuggaauagguaaca

SEQ ID NO: 4121192 - RNA, 64 nt, Human
ugucaugcuaaacuaugaucauuuucugagagagagacucagaaaauugucucuuuagauggca

SEQ ID NO: 4121193 - RNA, 71 nt, Human
ugucauggcuugucuaugagugcucuggucaucucgccagaccaugagcucaccacaggcagaaccuggca

SEQ ID NO: 4121194 - RNA, 86 nt, Human
ugucaugggcucuuucgggggaguuccggacagcaccacugugcaaaagauuguccuggccuccagaaagucggcuccaaaugaca

SEQ ID NO: 4121195 - RNA, 94 nt, Human
ugucaugggucccucugugcccccugcucuccgcaggcaaagucuacccucucccccggugugccugcaagaguuggggcuacagggccagaca

SEQ ID NO: 4121196 - RNA, 76 nt, Human
ugucauguaaugcugggagcugggcuaggggcuuuacauccguuauucuaacgccucaccccagcacuacgugaua

SEQ ID NO: 4121197 - RNA, 88 nt, Human
ugucauuaauaagcagacaauuaaguaauugaggugauguaugggaaaaaucacugggguuauuggauugaaucaacuauuagcagca

SEQ ID NO: 4121198 - RNA, 104 nt, Human
ugucauucauacuucuaguguagagcuguucugugauugaucuacccuuagcuugggauaaugcuuuauuuauaaaauagcaauuucugcauuuucuguaggca

SEQ ID NO: 4121199 - RNA, 78 nt, Human
ugucauuccggucaucacagugacagccaauguuuucaguuauuuugaguaagugagucacugugcuggaauccgaua

SEQ ID NO: 4121200 - RNA, 67 nt, Human
ugucauuuacaauguacagguugugcccugcacaaucaccaaaggguaccauuugcaucguaggaca

SEQ ID NO: 4121201 - RNA, 84 nt, Human
ugucauuuuagagcacaagagaaagguuaaagcuggaauauauguagguguuaucagcauauuuacuuucuugccugauugaca

SEQ ID NO: 4121202 - RNA, 67 nt, Human
uguccaagaacccaagcgaaugcccacaucugcaagucccugggcaugugucuuggggcucugggua

SEQ ID NO: 4121203 - RNA, 61 nt, Human
uguccagaacacaguuaguaagggaaauauugccaauauuccaucuauuguguuuuugaca

SEQ ID NO: 4121204 - RNA, 56 nt, Human
uguccaggaguaaaaagaccugaauucuacuuuggggcuuugacauuaccuggaca

SEQ ID NO: 4121205 - RNA, 55 nt, Human
uguccauagugccuggcauaccaaagguggucaauaaaugucugugcacuggaua

SEQ ID NO: 4121206 - RNA, 130 nt, Human
uguccauuaaugucauuuuucauuuucauuuuuuaauguaugggguugagaugauacuaugggauugaguauaauugccuuuuauagaaugcgugggacugauauuuucuaaaaauggacaaaaauccag

SEQ ID NO: 4121207 - RNA, 85 nt, Human
ugucccaagguaucuuagggagcucuggcagaaggaauaagaugguauuucuaguaaaggccuuuaggaaauauuuuaggugaua

SEQ ID NO: 4121208 - RNA, 57 nt, Human
ugucccagacacaguaugcgcuuguggucacucacucaccauuccugugcugaggca

SEQ ID NO: 4121209 - RNA, 71 nt, Human
ugucccaucacuagcugaaagcaauucaaccuaacuggcuuucuaauugaccuuaggcugugcuggugaua

SEQ ID NO: 4121210 - RNA, 72 nt, Human
ugucccauucaagaguauagagaccaggaguucacagcaacuccaguccuaucugcccuuggacuuaagaua

SEQ ID NO: 4121211 - RNA, 57 nt, Human
ugucccugcagccccugagccuucauagggaauggagaggcaggagcuacagguaca

SEQ ID NO: 4121212 - RNA, 79 nt, Human
ugucccuuaugaaucuguucccgaaauggcucuggacucuuuucccaggagaauauuuuugggucauagacuuuagaca

SEQ ID NO: 4121213 - RNA, 92 nt, Human
ugucccuuccuuuuuuggcacugcgucuacauggcaucuuacaacucuuugauugcugugaugacaggcagggccaaacuagucaggagaca

SEQ ID NO: 4121214 - RNA, 60 nt, Human
uguccuacauuuucuuucauuuccccacccucauaaugaaauggcuuugaggguaggaca

SEQ ID NO: 4121215 - RNA, 78 nt, Human
uguccuccuucccagccuccccacacaagaggcacacagcugugugugggagcacgggcuguugggggagaggggaca

SEQ ID NO: 4121216 - RNA, 57 nt, Human
uguccuccuucggcaaggaagccugcagcaaaggcgggcuccaggucagagaggacg

SEQ ID NO: 4121217 - RNA, 61 nt, Human
uguccucugcuggucucuggcuagguccccaucuccagccaguggcguaaacuagaggaua

SEQ ID NO: 4121218 - RNA, 63 nt, Human
uguccuguucauggcucuggacacccucacagucccagugcccucaucuaugaaaucgggaua

SEQ ID NO: 4121219 - RNA, 62 nt, Human
uguccuguucuugcuguguccucagugcuuagcauaguuuccggcacacaguagggcuggca

SEQ ID NO: 4121220 - RNA, 81 nt, Human
uguccuuacagcaauuuccaucaucauuaggccuagaaguauaaaguacaguugcuugguguguguggaagaaauaggaua

SEQ ID NO: 4121221 - RNA, 57 nt, Human
uguccuuauaaaugaggcccuggggcauugcuuugucccuucugccaugugaggaua

SEQ ID NO: 4121222 - RNA, 81 nt, Human
uguccuucugagacugaggguaaccuggagcugcugcaggcgcuguugcaaucacggguacccauuugucugagauugaca

SEQ ID NO: 4121223 - RNA, 61 nt, Human
uguccuuuaaguagaagagauauuuuuauaaguaggaauauuacuuugcuuuuauuggaug

SEQ ID NO: 4121224 - RNA, 57 nt, Human
uguccuuugggagggcacagcucuuggcagacaauugguugugaccugccagaggca

SEQ ID NO: 4121225 - RNA, 83 nt, Human
ugucgacuuuguuuccaaccccaccaaagugccauccuucagugaaguacaaggaggggcuugagagguacgaagucacgaca

SEQ ID NO: 4121226 - RNA, 70 nt, Human
ugucggugcaagccagcuugaugaccugucggacaucacagaagaaguuguccagcugguuugggccaca

SEQ ID NO: 4121227 - RNA, 64 nt, Human
ugucgucagcuuugugcugcuucuugucacuuuaaugcaaagagacagcauggagcugauaaca

SEQ ID NO: 4121228 - RNA, 102 nt, Human
ugucuaaaguauguucuggaaauugcaggcaccagcaggagcaggggggaaaaaaggaaagccuagcucaaugcucaaugcugcaaaaguagaaaauggaca

SEQ ID NO: 4121229 - RNA, 90 nt, Human
ugucuacagugcugaguaucuugaugaauuugaaauguucaguuaauuaaaacauuucaaaacagcuagauauuggaugucacugagaua

SEQ ID NO: 4121230 - RNA, 79 nt, Human
ugucuacauaugcuuuuaggcuaugauggcaccacugcgucacugcaacagagguuaucuagaccaaaagccuaagaua

SEQ ID NO: 4121231 - RNA, 98 nt, Human
ugucuaccuuccagucauuuaucuagucucuaguugaggacugagcagcgaacgugcguugucugucuggcagggaccaaggacugcagggcgugaua

SEQ ID NO: 4121232 - RNA, 58 nt, Human
ugucuacuugggcucuacagcagaacggcgaauucugaguucggcccucuaguggaca

SEQ ID NO: 4121233 - RNA, 68 nt, Human
ugucuacuuuaagaucauuuguauuaucccuucauuuggguuuacaacuuggguuuuaacauuaggcg

SEQ ID NO: 4121234 - RNA, 119 nt, Human
ugucuauuacagcacuuagcauaggguggagugggggaaggaguguuauuuagcagaguggaccaagcacagcuugcauuccaguccccacuguguccuaagcugugugauuuuggaca

SEQ ID NO: 4121235 - RNA, 63 nt, Human
ugucucaagaaaggauggggcuggaggcaagcaacugccagagcuucauaauuccuugacuca

SEQ ID NO: 4121236 - RNA, 77 nt, Human
ugucucagagaacacugagagucuuagaaacacauaguguuuauguuuucuucauggagucuuauuguuuagaaaca

SEQ ID NO: 4121237 - RNA, 59 nt, Human
ugucucaggcccaagccaguaagcacaucacguuccccuggccuuggugcuugcagaca

SEQ ID NO: 4121238 - RNA, 73 nt, Human
ugucuccaaauagcuggaugauggugucauauuugcaaugcauagauuaugccaucaugucagauuugggaca

SEQ ID NO: 4121239 - RNA, 61 nt, Human
ugucuccagaucucacagaggcccaccaggaacugaaguucugccacugugauaggaaaca

SEQ ID NO: 4121240 - RNA, 66 nt, Human
ugucuccauucuucuaucccuuuccucggggagcccugugcacugguugacagaagaaggaugaca

SEQ ID NO: 4121241 - RNA, 65 nt, Human
ugucucccauagcauuuuaaauagugccuuacucaugguaucuacgcagauguugcugguuggca

SEQ ID NO: 4121242 - RNA, 58 nt, Human
ugucuuuacuuagaaguucaggguacagggcugacuuuguucacuccugggaaagaca

SEQ ID NO: 4121243 - RNA, 57 nt, Human
ugucuuuagccacuugccucuuucauuuuguugggagagugcacauggcugaagaua

SEQ ID NO: 4121244 - RNA, 66 nt, Human
ugucuuucuauaacacuggcuguaauaauuugaaacuguguggccauuuuguguuuuggagaaaca

SEQ ID NO: 4121245 - RNA, 80 nt, Human
ugucuuucucuguguuucacaugcuggccuugaucauggguggcccacacuaaguugugagaaacagaaugagcuaagca

SEQ ID NO: 4121246 - RNA, 86 nt, Human
ugucuuuggagaauauuuuuagcuuuccucacucugauaguugcuucuguuuuagggguuugcugcaguauugaucccaaagaaca

SEQ ID NO: 4121247 - RNA, 63 nt, Human
ugucuuuuaagaaggguuacugccucacugaaauuagcaggcagucaucuuucauauuugaua

SEQ ID NO: 4121248 - RNA, 116 nt, Human
ugucuuuucuuccagaguaaguggguagcuucuuccuacuuuuuuucucuuuucuucuauaaaugggaggaaaagugugaaguauggagacugcucuuucauuugaaggaaauuca

SEQ ID NO: 4121249 - RNA, 79 nt, Human
ugucuuuuuugaauuauuuguuugcaagcuagagaaauaggcuaccuuuagcaaaauaagguaauuuauuggaaagaua

SEQ ID NO: 4121250 - RNA, 92 nt, Human
ugugaaaaacugugugaucuaggaggaagcagcccuaggcaugaggaagucuuagccuugcuuugcuucuggacagcugcaugauuguugca

SEQ ID NO: 4121251 - RNA, 57 nt, Human
ugugaaaagggcuuuguacaaaccucucaugggguuuuauaaaagcucuuuuguaca

SEQ ID NO: 4121252 - RNA, 74 nt, Human
ugugaaaaguagcucaaguuguuucacucauuauuuuaaucagugaaagugcuuagagugugguauuucucaua

SEQ ID NO: 4121253 - RNA, 82 nt, Human
ugugaaaguacuuaaugccacugaauuguaaacuuaaaaaugguuaaaaagguacauuuuagguauuauauauuuuaucaca

SEQ ID NO: 4121254 - RNA, 62 nt, Human
ugugaaauauuuauauacucaacauggcuuuucuccccuguggaagauuuuaauguuucaca

SEQ ID NO: 4121255 - RNA, 82 nt, Human
ugugaaaucaaugucuucugucucuuccuuccagagaaaaauuauaauaauucuuuuaaucagggcagcaagacauuugaca

SEQ ID NO: 4121256 - RNA, 64 nt, Human
ugugaaaugaguauauuugaauugauguuauucugccaggacaucuuuucagcuacucaacaca

SEQ ID NO: 4121257 - RNA, 59 nt, Human
ugugaaauuucucugagaguuccuuaacauuuaaaggaauuucaguaugaaguuucaca

SEQ ID NO: 4121258 - RNA, 64 nt, Human
ugugaacugugaggcucuugcauauugggagcucucugaaggcagcagugucuccagcaucaca

SEQ ID NO: 4121259 - RNA, 100 nt, Human
ugugaagaauaaauuucuguugcuuucaagccucucagucugugguguuuuguuauagcagcccaauggacugagacagcauaagagguuccucuucuca

SEQ ID NO: 4121260 - RNA, 58 nt, Human
ugugaagauauugugaucaggugaauauuggaaaguacacuuuaaaaauaucuuuaua

SEQ ID NO: 4121261 - RNA, 74 nt, Human
ugugaauaaguaggaugaauaacugaaauggugcuguuuaguaguugccacuauccauucauccuauucucaua

SEQ ID NO: 4121262 - RNA, 60 nt, Human
ugugaauagugccgcaauaaacauacgugugcaugugucuuuauagcagcaugauuuaua

SEQ ID NO: 4121263 - RNA, 130 nt, Human
ugugaauauccacuuaaaaugccaugugaugcuaaucaucucugugggagcagcucaugucucuaguaaauugcauuucacaguaaagugauuucacaguucucauguauuuuuuguguuuagugcaaua

SEQ ID NO: 4121264 - RNA, 95 nt, Human
ugugaauggacauuauguaugggaagaggcauggaaaguagucauuucacuuucuuuguuguacuuuccuacagucagcauguuuuucauucaua

SEQ ID NO: 4121265 - RNA, 96 nt, Human
ugugacaucaugggaggagcaccugguccuugacgcgugggaggcgggcuuuggcccgugucgucaugggaggcgggucugguacgugacgucacg

SEQ ID NO: 4121266 - RNA, 60 nt, Human
ugugacccagacucaucuucuuacucuuaacuaaguaggaaacagaccuuugggcuuaca

SEQ ID NO: 4121267 - RNA, 55 nt, Human
ugugacccccgucacggcugcuaccuaacgguggcugccauuuucaggggucgca

SEQ ID NO: 4121268 - RNA, 70 nt, Human
ugugacuauugcuuuggucuuacauguggcugauaucagcuuguuuugaaaauccaaacacuaguccaca

SEQ ID NO: 4121269 - RNA, 90 nt, Human
ugugacugcuaagaaguauugugggcaaagauuuuaacaaacaaaaauaugaaaaucacaacaagcuauacacauuucuugguagucaca

SEQ ID NO: 4121270 - RNA, 64 nt, Human
ugugagagcagaagacacauagaacucauauuuauaguagaggguuagauuuucuugcuccaca

SEQ ID NO: 4121271 - RNA, 96 nt, Human
ugugagaguggcugagguuaugcugguuguauaguuugggauuagguuucuucagaauccucuagguuguuauaacuguucucuccacucugcaca

SEQ ID NO: 4121272 - RNA, 66 nt, Human
ugugagaugauagauauguuaauuugcuuuaaaguagcaaugauuuuacugucuguguaucucaua

SEQ ID NO: 4121273 - RNA, 66 nt, Human
ugugagcacuauggcuaggcucugagaacacauugaauguuuauugagcacuugcugugugccaua

SEQ ID NO: 4121274 - RNA, 68 nt, Human
ugugagccacaaauaaccacuggucugcuucccaucaugacacuuuggugcuuugugguuacauuaca

SEQ ID NO: 4121275 - RNA, 61 nt, Human
ugugagccaggggauucaucagggacgcuuugguggccaggagcagaaucgccugcuaaca

SEQ ID NO: 4121276 - RNA, 107 nt, Human
ugugaggggugucaguuauagccuugguccuugcuccacuucuguggugaggugcugccaagagcuguggggaaaggaguggggcucagagcugaugcccauuugua

SEQ ID NO: 4121277 - RNA, 102 nt, Human
ugugagggugugacauuuauuuaagggauuuggagaccaaggcuucauacacaugcaaucagaggcuucuggugucaguauucuuugaauuauccccuggca

SEQ ID NO: 4121278 - RNA, 122 nt, Human
ugugaggugagaacaaaaauaggaauaugaaaacuagaggagaugaaaucugaccuagauaucuuuucugguacacauuaugcuucucuaaaauuuugaauucuugauugaaacagccucca

SEQ ID NO: 4121279 - RNA, 94 nt, Human
ugugagguugggagguagagcagacauggcuuggauguggcagggucagaugcuguggccugggcagaugugguggcuuccacgaaccucugca

SEQ ID NO: 4121280 - RNA, 113 nt, Human
ugugaguacacgugcuaacauucacauccugggcagugugucacucugcuguucgucucagccagaaucuaugccagagucacacugugugaguguugacagugcuguucaca

SEQ ID NO: 4121281 - RNA, 82 nt, Human
ugugaguaggcaaccauacaauaguguuuguuuugaggacaauuaugaguagguuuuuuagauacauuguaugucacuugca

SEQ ID NO: 4121282 - RNA, 73 nt, Human
ugugagugaugugggacaggaagaggcacaagggccuggucuuucagccacuuaccugucuaggauccucaca

SEQ ID NO: 4121283 - RNA, 70 nt, Human
ugugaguucuuagaaagucaguuggacccuucuaauugccuggguauuagggauuuugcugaaacccaca

SEQ ID NO: 4121284 - RNA, 62 nt, Human
ugugauaauauuuugaaucauaaguuucucaggagauucugauagauuugagaauuauugca

SEQ ID NO: 4121285 - RNA, 82 nt, Human
ugugauagauagcugaccaugaauuaagcaucuuaauuucugagaguuuaccacuauuuuuggucucacuuaucuuuguaca

SEQ ID NO: 4121286 - RNA, 82 nt, Human
ugugaucagagagauaauaggagccaggucacauaggccuuacaugccauugugaauaacuuggcuuuuacucugagugaca

SEQ ID NO: 4121287 - RNA, 58 nt, Human
ugugaucugcacaauuguguagguagguacuauuauuauucacaauuuacagaugaca

SEQ ID NO: 4121288 - RNA, 61 nt, Human
ugugaugacagugccagucuguucugagcagcucugggcuccuggcuucacugacaucaua

SEQ ID NO: 4121289 - RNA, 63 nt, Human
ugugauggcaacucaauuucuacaagacugaaacagucuucaugaaauugauugcuuaucaca

SEQ ID NO: 4121290 - RNA, 130 nt, Human
ugugaugugcauaagguguuugaaugcaugccagcaagagugcugugggggaagaaagagagagaaaaggaacagcuuuuauucucuccccaaucuugcuucacaguauuguguuuuucaccuucauuca

SEQ ID NO: 4121291 - RNA, 84 nt, Human
ugugauguggggagguugcuaggcagugucacagauuauggcacccagccacugagcugugacaaugcuuaacuccauaaugca

SEQ ID NO: 4121292 - RNA, 77 nt, Human
ugugauucuguagccaucauucucacauucuuguuauuagucagaaaaggaauguaauaguguggcucaguuaaaca

SEQ ID NO: 4121293 - RNA, 114 nt, Human
ugugauugcgauauuucaaggugaguagugagagaauaaagcaaauaauucaccugccagaauuuccaguacuauuuucugcuauagcuucucuugaacuucucuguuuucaua

SEQ ID NO: 4121294 - RNA, 72 nt, Human
ugugauugcuuuguucuucgucuuuuauguucuuccuagaugggcucagaacauacaagaauuaaguacaca

SEQ ID NO: 4121295 - RNA, 114 nt, Human
ugugcaaacacacucuuucagaguuuggaaacucuguaucaucuuuggccacuugaaauaaaagugguuauuuugaucuagaauucugaaaucuaaagguugaugcuuugaaca

SEQ ID NO: 4121296 - RNA, 79 nt, Human
ugugcaaaguacagaacugaaguagugaaaaauaucauuuuccaucauauuucuguucagauuugccugucuuuucaca

SEQ ID NO: 4121297 - RNA, 62 nt, Human
ugugcaaaugauucuaauggguagucaagaucaagaaccacugcuuuagacucauuuguuca

SEQ ID NO: 4121298 - RNA, 94 nt, Human
ugugcacacacgugugagagcuguggcaguggcaggcguguagcugcagcaugcacacaggucuaggacauggagacccacaugugugggcgca

SEQ ID NO: 4121299 - RNA, 76 nt, Human
ugugcacauuauuggauaugauaucucaugguauuuaauuaauuaagcaccuguuuuccuaucuagauugugcaca

SEQ ID NO: 4121300 - RNA, 67 nt, Human
ugugcacguaccucuguuuccucugccccucauuugcagaccuacucuggauccagaggaucugcca

SEQ ID NO: 4121301 - RNA, 124 nt, Human
ugugcagagacgcugggagcccgaagaggucguggcuguggcuuccgcugcagguuagggcuauugacuugcauggaggaacauggcccacggacuguguugcaaacccucagucuguugcaca

SEQ ID NO: 4121302 - RNA, 61 nt, Human
ugugcagcuacuccuugguccuagaaucaaauucucucucucaggccagaguugcuccaca

SEQ ID NO: 4121303 - RNA, 57 nt, Human
ugugcaguucaaacccguguuguucaagggucaaccuuauacuuaaugaacuguaca

SEQ ID NO: 4121304 - RNA, 65 nt, Human
ugugcaguuguggacaugacaacuuaagauuaauaaaaagcugucucaucuuccacaucagcaua

SEQ ID NO: 4121305 - RNA, 67 nt, Human
ugugcauauguuucaucucuaugugucugguguauuagaaggagcagaaagaugaaagcaaaugaca

SEQ ID NO: 4121306 - RNA, 70 nt, Human
ugugcaucuaucuccugguacccuuccuagcaucaauucuguauuuguaggaguccaaucaggagacaca

SEQ ID NO: 4121307 - RNA, 129 nt, Human
ugugcaugccugugucuuaaguuuuuauauauguauauaaauguuguagcauaugaaauauaugccuaccuauguguuuauguaauagcauuaaaauuugcauguauggccugugaacauacuugcaua

SEQ ID NO: 4121308 - RNA, 75 nt, Human
ugggaauggaaauuuauuagcuuuggauugcauuuaguucccaugaagugaccugcuuugaagcuaccauuucua

SEQ ID NO: 4121309 - RNA, 61 nt, Human
ugggaauggugcuugaugcauucaacuaauaccuuauuuguagacaucuguaucauuuuca

SEQ ID NO: 4121310 - RNA, 80 nt, Human
ugggaauguuuaaggaaggcguggcuucccccuagaucauggugcuuacagucuaggccaugguuucucaaauauugaca

SEQ ID NO: 4121311 - RNA, 94 nt, Human
ugggaauuaaaugaaagucauggaaaaucuuggaaccaucaugauuaugaaagaaaauucuugagauaauucuaugucugcaguuugcuuucca

SEQ ID NO: 4121312 - RNA, 76 nt, Human
ugggacaaaauuacccagaaccguacagacgugcgcgaaugaguauguguugguagaucugaggucuauugugcca

SEQ ID NO: 4121313 - RNA, 65 nt, Human
ugggaccugcuccuggaaugaggccgcccaugggaggccacaugcccgugaugccugggugccca

SEQ ID NO: 4121314 - RNA, 58 nt, Human
ugggaccuugaacucuaagcaccguauuuccagugucccuuuuauugucaagguucca

SEQ ID NO: 4121315 - RNA, 65 nt, Human
ugggacucaaggcagcagaagaagacuacugucuaaggaucuguuagcuuuuacccaggguccua

SEQ ID NO: 4121316 - RNA, 81 nt, Human
ugggacuggaagaucgcgcgcguuggaccuguggcuuguugcgcucagagcuggcccaggaagacgugucccggcuacccg

SEQ ID NO: 4121317 - RNA, 64 nt, Human
ugggagaaaauugaugaaguuggcugcuuccaguagaucagauaauccaugaauuugucuccca

SEQ ID NO: 4121318 - RNA, 88 nt, Human
ugggagaagaggcuggaagguguggguuugggagagagcugugagcccaggucuggcuguuaggccugaccuuccaccucuucuccca

SEQ ID NO: 4121319 - RNA, 130 nt, Human
ugggagaagggacuucccgcgccagcggcugcgcguccacucuagggcagcucucgcgcggggcaacacggcaggcagagcggccacuagagggcgcgccagccacacgcaccgcgcggcccagagcccg

SEQ ID NO: 4121320 - RNA, 64 nt, Human
ugggagaagggauaccaacauauucuguucaauaaugccaggaaauaaaaaguaucuucuucca

SEQ ID NO: 4121321 - RNA, 70 nt, Human
ugggagauaugaaauggguaaaccuggcuaccacuuacuuaacccugagcuaguccaggcauaucuccua

SEQ ID NO: 4121322 - RNA, 72 nt, Human
ugggagcugaauaggacugucaucucuuugcugugucacacacuagugauggaagccugcagaauucuccca

SEQ ID NO: 4121323 - RNA, 122 nt, Human
ugggaggaacaaggugaggcugugaaggaccuacugauaucuuagcagggggcacagccuccuucuagcaauggcagagugucugugcacaccaggccucaccuguuggacaggaaccccca

SEQ ID NO: 4121324 - RNA, 57 nt, Human
ugggaggaagugcuaaugggaggaaacaggcagagucccggucccagcuuucuccca

SEQ ID NO: 4121325 - RNA, 56 nt, Human
ugggaggagcccucugggaagggacaugauuuccacuugccagggagcugcucuca

SEQ ID NO: 4121326 - RNA, 55 nt, Human
ugggaggcagaaguugacuggaggugacacagguguucagugaacucuaccccca

SEQ ID NO: 4121327 - RNA, 55 nt, Human
ugggaggcuccuuagcccaugcaaaauaaauuuugcaaggcuuuuguguuuccca

SEQ ID NO: 4121328 - RNA, 106 nt, Human
ugggaggcugaggcaggaggaucacuugagcccaggaguucaagaccagccugggcaacauagugaaacccccuggcucaaaaaaaaaaaaaaaaaaagacucuca

SEQ ID NO: 4121329 - RNA, 55 nt, Human
ugggagggcaggcaggggcccaccccggggccacagcugcagcugcaccauccca

SEQ ID NO: 4121330 - RNA, 55 nt, Human
ugggaguagacauccuggacugaaauucagugcaucacuagggcuguggcucuca

SEQ ID NO: 4121331 - RNA, 75 nt, Human
ugggagugagaaauuuucagcaaguaguuauuugggaugauaguuuuugacagcugcuuguugaaauccaaaccg

SEQ ID NO: 4121332 - RNA, 68 nt, Human
ugggaguggaugggggcuggagaagaggggcuugccaggugaagcuccaggcccucaauccauuucca

SEQ ID NO: 4121333 - RNA, 60 nt, Human
ugggaguguucuuggcuugcuuggagaagguaaagacaagguaauccaaggcugcucuua

SEQ ID NO: 4121334 - RNA, 76 nt, Human
ugggaguuagaaggcggcccccagguuucagaguuucuccuuaagcugagauaaauccagcuccuucuaacuucca

SEQ ID NO: 4121335 - RNA, 56 nt, Human
ugggaguuauuggcuguuuugagagacucaccuucuugaugcaguugguacucuca

SEQ ID NO: 4121336 - RNA, 130 nt, Human
ugggauaagaaaaauuuauauggagaaguagcuuaugcucauucugauacugcuuuauuaacuauauuagcagcauguugggaugugaaaauaggauaacugccauucuauuacaauauuuguuuacaca

SEQ ID NO: 4121337 - RNA, 87 nt, Human
ugggauagagaauggugcugaaauggaccucaggaauagaguuuacuuucugaagcucucauuuggcauaaaccauucuagugcuca

SEQ ID NO: 4121338 - RNA, 59 nt, Human
ugggauauuuugagcuuuccucccuccccuagguggaacuguggcuguaacguauccca

SEQ ID NO: 4121339 - RNA, 78 nt, Human
ugggaucuugaaaagcacuaauuucuaggagcaucuauccugagauuugaaacuugcuucauaaaguucaagaucuca

SEQ ID NO: 4121340 - RNA, 77 nt, Human
ugggauggccacaucugagacuuuaaccuggggccacugggguuccugaauggguuucagagguccaugaacuccca

SEQ ID NO: 4121341 - RNA, 58 nt, Human
ugggaugggaucucgcugugucacccaggcuggaguauaguagcgagaucucagcuca

SEQ ID NO: 4121342 - RNA, 119 nt, Human
ugggauuuagucucaguuguguaauuuaggggcugagugaccucaggccaaacaucucaugucuuuuugccuuaguuuauucauuugccaacuaaauggcuuguuaagacuucuuccca

SEQ ID NO: 4121343 - RNA, 67 nt, Human
ugggcaaguuaauuaaccucuccaucaaggagcaugaucuuugaacuggaaagagaauuaaagccca

SEQ ID NO: 4121344 - RNA, 78 nt, Human
ugggcaaucaggcucggauggaccagcuccaagaacugagaguccuggagcuggaauuucugggccucgaucuuucca

SEQ ID NO: 4121345 - RNA, 74 nt, Human
ugggcacaguugagguaggcggacuccuccaucugcuuagauggggacugcgaggcccugccuguuguguccca

SEQ ID NO: 4121346 - RNA, 61 nt, Human
ugggcaccuagcaacccuucuccaugguguacuuugacuccaucuuguugcuaguugucca

SEQ ID NO: 4121347 - RNA, 105 nt, Human
ugggcacucacacaugacacaugguggcuggacuauaguggggcagugagaguacaaguaagagucuccuaaaguccuuaucaaguguaaucaggaguaaacuca

SEQ ID NO: 4121348 - RNA, 85 nt, Human
ugggcagagaggauggaacccugauuucuccauugcugcuugccacuggggaaaagcguuaggaguucagugcccuuuguguuca

SEQ ID NO: 4121349 - RNA, 58 nt, Human
ugggcagccaucccagccucucugcagccuggggagagaggcugggguguuuugccca

SEQ ID NO: 4121350 - RNA, 80 nt, Human
ugggcaggaagaugaaaaggauuggagauguuuucaagaaugguugaauagauucauucuauuucuccgucuccucccca

SEQ ID NO: 4121351 - RNA, 60 nt, Human
ugggcagggcccauggcucagguagggacagguguccaagccuugcaaggggccucccca

SEQ ID NO: 4121352 - RNA, 60 nt, Human
ugggcagggugugucucauacaguuggcuacaucagcuuuauuuuucaccucuugcauca

SEQ ID NO: 4121353 - RNA, 57 nt, Human
ugggcagguuguuauuugacauaauguuuucuacuaugucuguaacccacuugcccg

SEQ ID NO: 4121354 - RNA, 102 nt, Human
ugggcauaccucaaacaucuuaggaacauaugugcuuauauccaugagcaaacacauucguggauugaguauagauguauauagauuggagaaacaugccca

SEQ ID NO: 4121355 - RNA, 70 nt, Human
ugggcaugccuuaguugaaugguguauaaauuugagggcuauacauugauucaggauauaggcaguucca

SEQ ID NO: 4121356 - RNA, 88 nt, Human
ugggcaugguucgguucuuagagcaaaauggagcauuaaaauagaagacggcucugggaauaaaacuagggacuagaaccucugccua

SEQ ID NO: 4121357 - RNA, 55 nt, Human
ugggccacgugacccuuacccuggcaggacagggcaggggguuacuguuggccca

SEQ ID NO: 4121358 - RNA, 57 nt, Human
ugggccagggcacccaguccagaaggagcaauggcaccugggcagugccagggcuua

SEQ ID NO: 4121359 - RNA, 83 nt, Human
ugggcccuggcuggagggacccacucagaaggaaaccccauucucugcuuucagagcugggucccucccaagcaucuggccca

SEQ ID NO: 4121360 - RNA, 58 nt, Human
ugggccucaagauauaaguaaaacagagugaaaucuguuccacaguccugaggauuca

SEQ ID NO: 4121361 - RNA, 73 nt, Human
ugggccucucaguuaagacugcacuggacuaucaauauucgugcuccagauaacuacuuggcuaagaggacca

SEQ ID NO: 4121362 - RNA, 110 nt, Human
ugggccugccuccacuggcugaagacaguauccagguggugaagagcaugcgugcugccuccccgcccucuuacacucuugaccugggagagucucagcuggcaccccca

SEQ ID NO: 4121363 - RNA, 69 nt, Human
ugggccuggggugacguaccccugcgggggaagggaggcugcugcagggggcugggugcugaaggccca

SEQ ID NO: 4121364 - RNA, 70 nt, Human
ugggccuguguguucaggagccuccaaacccucaguacugagggguguaggcccuauucaauggggccca

SEQ ID NO: 4121365 - RNA, 71 nt, Human
ugggcggacccaggcagugcugaucccucagcuuagauaccugcuggggcucaugccugcuggaacccuca

SEQ ID NO: 4121366 - RNA, 76 nt, Human
ugggcgucaggcucagcagcuacaggauucgggguccgucgucguccuccgggccggcuugcucagcacuagccca

SEQ ID NO: 4121367 - RNA, 88 nt, Human
ugggcguucagagggggguagccagagaagagcagggaucugagcaguuggggccucuggguucuggccugcacccccucucagcccg

SEQ ID NO: 4121368 - RNA, 63 nt, Human
ugggcuagguaaacugaauuggauacugugugaacucauucauacaucaguuuucuuggcuca

SEQ ID NO: 4121369 - RNA, 62 nt, Human
ugggcucaggggucucugcucagaugccacuuccuaggaggggccucgcaggaccgcuccca

SEQ ID NO: 4121370 - RNA, 58 nt, Human
ugggcucauagcccaaguccacuacuuauuagcugagugaacuugggcaaguggcuua

SEQ ID NO: 4121371 - RNA, 76 nt, Human
ugggcucucaggcugaguuuguacucaaaugaagaguagaucuuuauugguaggacucagcugagaaguaaguuca

SEQ ID NO: 4121372 - RNA, 61 nt, Human
ugggcucucuuuaccucauaacccugaucccucauagaguucugagacaauugagagucua

SEQ ID NO: 4121373 - RNA, 62 nt, Human
ugggcugcuggggucacaugguaaggaauuguuuucuuuucccagccuccuugagcaaacca

SEQ ID NO: 4121374 - RNA, 72 nt, Human
ugggcuugaguucgcaggcagaggaggccuucuccuuuggcuggccugccguaggcucugccugcaggccca

SEQ ID NO: 4121375 - RNA, 93 nt, Human
ugggcuugcaggcccuggugccaccagcuccuugugugaugggggagucaccuucccugagugggcugguaguauccugggucaucuugucca

SEQ ID NO: 4121376 - RNA, 62 nt, Human
ugggcuuugaagagauuacugugcucuuggugcaauccagggccaauaaggucuuaaaucca

SEQ ID NO: 4121377 - RNA, 77 nt, Human
ugggcuuuucucugugcacuaacauuccugguccaaauuuccucuuuguauaagggcaccagucacauuaaagucca

SEQ ID NO: 4121378 - RNA, 65 nt, Human
ugagcucuuuugccagucacugcacuguuuugucaaccaaagugcaaagguagccaaggagcuca

SEQ ID NO: 4121379 - RNA, 60 nt, Human
ugagcugacacccaaucauacuuccugagcaccugggauuuguugauuggugucaucuca

SEQ ID NO: 4121380 - RNA, 62 nt, Human
ugagcugcaagaaaauuucaguuccuccuguguucuagcugaagucagguucugcagccuca

SEQ ID NO: 4121381 - RNA, 57 nt, Human
ugagcugcuuagaguccucaggauuagccacaaguccuuuaaccuccaggcaucuca

SEQ ID NO: 4121382 - RNA, 130 nt, Human
ugagcuugagcuagaacuuggugagaggugguggggaucagucucagaggcacccagaacuugcuccucucuggacuggaaugcugauccucucucaccaccuccccacgcccaaggacugucagcauca

SEQ ID NO: 4121383 - RNA, 81 nt, Human
ugagcuugugcaaugugcuucgugccaugccacugguaaguugugaagguggaacugaagccuugacaucugccaagucca

SEQ ID NO: 4121384 - RNA, 73 nt, Human
ugagcuuuaccaucauguuaaauauuucaaucuauuuggguagguggaaauggacuauggaaaugugagcuca

SEQ ID NO: 4121385 - RNA, 60 nt, Human
ugaggaaaagagagaauaagggaggauagauuaaucaccuuccagaaaucucuuucuuca

SEQ ID NO: 4121386 - RNA, 89 nt, Human
ugaggaaaguuuaugcucuugaggcuaaagacauaacagauguaauguaaaaguauucaggauguaaacccaauaugaauauuuccuca

SEQ ID NO: 4121387 - RNA, 61 nt, Human
ugaggaauguuauuaaaggagcuguacaaaacuuacccuuggaauuagcugacauuccuca

SEQ ID NO: 4121388 - RNA, 57 nt, Human
ugaggacacagucaagaguggaggaauuaaguuuugcugcugcuugcuguguuccca

SEQ ID NO: 4121389 - RNA, 82 nt, Human
ugaggacacagugggauaucagggcccagucugugcaucucucauuccagggaggccggggcccugaauccacugucccuua

SEQ ID NO: 4121390 - RNA, 66 nt, Human
ugaggagaaucauuuacagaaugauuuauuacagaaucauuugcuguucaugauucagcaaacuca

SEQ ID NO: 4121391 - RNA, 68 nt, Human
ugaggagcagcucugagcucuguggcuuuugugaccauggggucacagcagcuaaaggugucuccuca

SEQ ID NO: 4121392 - RNA, 58 nt, Human
ugaggaggaaggcuucauuagguugugcugauucaauugcuugacauuuuccuuuuca

SEQ ID NO: 4121393 - RNA, 55 nt, Human
ugaggaggauggcagugaggaugaagauaaugaauccaccagcucuuccucuuca

SEQ ID NO: 4121394 - RNA, 65 nt, Human
ugaggaguuuagauauagggaauagcacagaaagagcagaaaauuccuuauauuugaauacuuua

SEQ ID NO: 4121395 - RNA, 57 nt, Human
ugaggauggggagauggugucucucaauagaugaaugaagccaacugcccauuuuua

SEQ ID NO: 4121396 - RNA, 55 nt, Human
ugaggaugugauuaugcacauugaucaguaaguggucaauguaaucauaucauca

SEQ ID NO: 4121397 - RNA, 55 nt, Human
ugaggauuuucuagugcuccguugguaucugaugggccacuauagaaaucucuca

SEQ ID NO: 4121398 - RNA, 72 nt, Human
ugaggcaaauuacuuuaaccucuuuaagcucuagcuucuugauuuguaaaagaaggauuaauaauugccuca

SEQ ID NO: 4121399 - RNA, 102 nt, Human
ugaggcaagagaaucaccugaacccaggagguggagguuguggugagcccagacagcaccacugcacuccagccugggugacagagcgagacucuugucuca

SEQ ID NO: 4121400 - RNA, 101 nt, Human
ugaggcaagaggaucauuugagccucugaguccgaaguugcagugagccaugauugugccauugcacucuggcuugggcuacagagugaagcccugucuca

SEQ ID NO: 4121401 - RNA, 102 nt, Human
ugaggcacgagaauugcuugaaccuggaaggcagagguugcagugagcugagaucgugccacugcacuucagccugggcgacaagagcaaaauuccaucuca

SEQ ID NO: 4121402 - RNA, 101 nt, Human
ugaggcagaagaaucacuugaacccaggagguggagauugcagugagccaagaucaugccacugcacuccagccugggcaacagagugagacucugucuca

SEQ ID NO: 4121403 - RNA, 77 nt, Human
ugaggcagaggaguagacaaggaugcguugcagggcucagggcccugagagguuggccuguccagccucuugccuua

SEQ ID NO: 4121404 - RNA, 74 nt, Human
ugaggcagcaaugaaaauuuaaguugcagcuauuaguugauugcuguaacuuuuucauuuucaaaccauguaca

SEQ ID NO: 4121405 - RNA, 59 nt, Human
ugaggcagcaauuguauuguaugaccagaaucaaggucauacaaaacgauuguguuuca

SEQ ID NO: 4121406 - RNA, 101 nt, Human
ugaggcaggaaaaucgcuugaacccaggagauggagguuguggugagccaagaucacgccacugcacucuagccugggcaacagagcgagacuccaucuca

SEQ ID NO: 4121407 - RNA, 102 nt, Human
ugaggcaggagaaucacuugaacccgggaggcggagguuguggugagccgagaucacaccacugcacuccagccugggcaacaauagugaaacuccgucuca

SEQ ID NO: 4121408 - RNA, 98 nt, Human
ugaggcaggagaaucacuugaaccgggaggcggagguugcagugagcugagaucaugccacugcacuccagccuaggagagagugagacuccaucuca

SEQ ID NO: 4121409 - RNA, 101 nt, Human
ugaggcaggagaaucauuugaacccaggaggcagaaguugcagugagccaagaucacgccauugcacuccagccugggugacagaaugagacucugucuca

SEQ ID NO: 4121410 - RNA, 101 nt, Human
ugaggcaggagaaucgcuucaacccgcgagguggagguugcagugagccgagauugcccuauugcacuccagcccugcaacaggagugaaacuccaccuca

SEQ ID NO: 4121411 - RNA, 101 nt, Human
ugaggcaggagaaucgcuugaaccaaggaggcagagguugcagugagcugagaucaugccacugcacuucagccugggugacugagugagacucugucuca

SEQ ID NO: 4121412 - RNA, 101 nt, Human
ugaggcaggagaaucgcuugaacccaggaggcagagguugcagugagccgacaucaugccacugcacuccauccugggcaacagagugagacuccaucuca

SEQ ID NO: 4121413 - RNA, 102 nt, Human
ugaggcaggagaaucgcuugaacccgggagguggagguuauggugagccgagaucacgccauugcacuccagccugggcaauaagagcgaaacucugucuca

SEQ ID NO: 4121414 - RNA, 101 nt, Human
ugaggcaggagaaucgcuugaaccugggaggcggagguuguagugagcagagauggugccauuguacuccagccugggugacagagugagacuccaucuca

SEQ ID NO: 4121415 - RNA, 101 nt, Human
ugaggcaggagaauggcgugaacccuggaggcggagcuugcagugagccgagauggcgccacugcacuccagccuaggggacagagcgagacuccgucuca

SEQ ID NO: 4121416 - RNA, 101 nt, Human
ugaggcaggagaauugcuugaacccgggaggcggagguugcagugagcggagaucacgccacuguacuccagccugggggacagagcaagacucugucuca

SEQ ID NO: 4121417 - RNA, 101 nt, Human
ugaggcaggagacuugcuugaacccagaaggugcaggcugcagugagcugagauugugcuacugcacuucacccugggugacagagugagacuccaucuca

SEQ ID NO: 4121418 - RNA, 100 nt, Human
ugaggcaggagauucacuugaaccugggaggcggaaguugcagugagccgagaucgcgccauugcacuccagccuggugacagagugauacuccaucuca

SEQ ID NO: 4121419 - RNA, 102 nt, Human
ugaggcaggggaauugcuugaacccgggagguggagauugcggugagccaaaaucaggccaucgcacuccacucuaggcaacaagagcgaaacuccgucuca

SEQ ID NO: 4121420 - RNA, 68 nt, Human
ugaggcagucauauuuugguaaagaauuuguagacuuugcagaggucucuucaaaauaaucuggcuca

SEQ ID NO: 4121421 - RNA, 102 nt, Human
ugaggcaugagaaucgcuugaacuggggaggcggagguugcagugaguugagaucgugccauugcacuccagccugggcaacaagagcgaaacucagucuca

SEQ ID NO: 4121422 - RNA, 57 nt, Human
ugaggccagggauuccaucauuaguguccugaaacgccuaugacagugccuggccca

SEQ ID NO: 4121423 - RNA, 63 nt, Human
ugaggccauggucuucccagucaucucauugggcaugcccggguuggggauggccaggcuuca

SEQ ID NO: 4121424 - RNA, 65 nt, Human
ugaggcccugcucugaauaaccauccaaucugcagguguuuauugcagccgcagggcgcugcuca

SEQ ID NO: 4121425 - RNA, 56 nt, Human
ugaggccucauaaugagauuuccuuagaaaacucaauuagacauuguuaggccuua

SEQ ID NO: 4121426 - RNA, 104 nt, Human
ugaggcggagucucgcucuguuguugccuaggcuggaguguagugguaccaucucggcucacugcaaccuccgccucccgggcucaagcaauucuccugccuca

SEQ ID NO: 4121427 - RNA, 104 nt, Human
ugaggcggggggaucgcuugagcccaggagguugagggugcagugagcuaugaucgcgucacugcacuccagcacucagggcgacagagcgagacccugucuca

SEQ ID NO: 4121428 - RNA, 100 nt, Human
ugaggcuacagaaggagaacaaaguuuucagcauuuuauagccugugagugaccagucuauuuaauuccagucuguacuuugcucuguucuccugccuca

SEQ ID NO: 4121429 - RNA, 55 nt, Human
ugaggcucagagaagucaugguauggcccucagugcuuucauuuuuugugucuca

SEQ ID NO: 4121430 - RNA, 70 nt, Human
ugaggcuggaggaucacuugagcccaggaguuugaggccaguaugggcuauauagugguaccccaucuca

SEQ ID NO: 4121431 - RNA, 56 nt, Human
ugaggcuggucccugugcuucggcuuccccauacagcagugcagggagcacccuca

SEQ ID NO: 4121432 - RNA, 68 nt, Human
ugaggcuguggugaugauugggucaauggguaaaauccccuuccugugacaaacauuucauagcuuua

SEQ ID NO: 4121433 - RNA, 70 nt, Human
ugaggcuguguguguccagguccuauuaauucauguuaaaaaauuaaggagggcugggcaugauggcuca

SEQ ID NO: 4121434 - RNA, 72 nt, Human
ugaggcuuuauucuggauccagagcugcuaucuggggcccagagcagcaggugcuucuggaucuugcacuca

SEQ ID NO: 4121435 - RNA, 60 nt, Human
ugaggcuuuuggcauuccuuagacucacuuaucaaaggugggccagggccagaagcauca

SEQ ID NO: 4121436 - RNA, 69 nt, Human
ugagggaaggcuuccuggaggaagagguacaggcacugucucauuauuaauucaacagggucuccuuca

SEQ ID NO: 4121437 - RNA, 59 nt, Human
ugagggaauggugugcaagagguuacuugaauccaaauuaauugacucaccauuuccca

SEQ ID NO: 4121438 - RNA, 68 nt, Human
ugagggacaccagggcuggagcucagugcugggcagagcagggcgugcucccuaggccuugguccuca

SEQ ID NO: 4121439 - RNA, 72 nt, Human
ugagggaggucagggugccugcugguggcaagaugauguuauccaguguuacggcuugaacuaugucccuca

SEQ ID NO: 4121440 - RNA, 74 nt, Human
ugagggaguccucuugcaagagcugauucagauauaugauuuucuguggcaagaaucugcagaggaauucuuca

SEQ ID NO: 4121441 - RNA, 57 nt, Human
ugagggcugucauuugacaucuuagcgcagauuaauuugucagauaacuagcuguua

SEQ ID NO: 4121442 - RNA, 56 nt, Human
ugagggcugugagggcccagguauggugggcaccuucccugggucugcagcauuca

SEQ ID NO: 4121443 - RNA, 73 nt, Human
ugaggggcagugggggggccaugcugcagguacaaguuaaucucccuguaucgccucugcccacuuacccuua

SEQ ID NO: 4121444 - RNA, 70 nt, Human
ugagggggcuucggggccgucucugccccuggcuucggcaaggccuggccugggcggcauugaccccuua

SEQ ID NO: 4121445 - RNA, 77 nt, Human
ugaggguagaaucacagauuuaggacuguagcgaucccauuugggguucuggggcucuggauuuuaggacuccuuca

SEQ ID NO: 4121446 - RNA, 79 nt, Human
ugagggucaucucaggugugcuugauucuguugcuccuucagcuauuaaggcacuugagcaugaugccauauuuccuca

SEQ ID NO: 4121447 - RNA, 65 nt, Human
ugagggucucacgagggcccugggcagcugccguaggcauugcuuacaggguuucguuucucuca

SEQ ID NO: 4121448 - RNA, 63 nt, Human
ugaggguucaagacucuugaguaucucaacccacauguccccauucugagucuuggggucuca

SEQ ID NO: 4121449 - RNA, 76 nt, Human
ugagguaacagcauuuaccucaaugcaucuguuagcaaauagcacugacgagcguugaugugaagguuuauuccca

SEQ ID NO: 4121450 - RNA, 90 nt, Human
ugaggucaauucuguagguagaaaaugagcauauugauccuuuguuaguaccuuaugauaagaggguccucucaacuaucacaaaucuca

SEQ ID NO: 4121451 - RNA, 77 nt, Human
ugaggucacaagauauuucaguccuuugaaaaaggugugaaccccagcuaaaggggaggaaguguuuugagagcuca

SEQ ID NO: 4121452 - RNA, 91 nt, Human
ugaggucaguauuagcagacuguauucaaaaugugguuauugaaaagcuaacuucucauuaaugauacaguuuggaagcccuguaaccuua

SEQ ID NO: 4121453 - RNA, 86 nt, Human
ugaggucccacugucaccggcucacugacgaggaagcugagauucagcaagguccagcacucgcccagggcuuguacagggccuca

SEQ ID NO: 4121454 - RNA, 55 nt, Human
ugagguccuccacucagcccuagggcacuccagcgcugagagguugggaaguuca

SEQ ID NO: 4121455 - RNA, 89 nt, Human
ugaggucuccuaaauuaaugaguuaaacaggacaggauauagcaucagaagagaguuccugcuguuuaccuacaaugguugcauccuca

SEQ ID NO: 4121456 - RNA, 62 nt, Human
ugaggugacaauucauucuccaggagagcucguuacuucccaagaggcaaauucucacuuca

SEQ ID NO: 4121457 - RNA, 102 nt, Human
ugaggugagagaaucaccugagcccugaagguugaggcugcagugagcugugaucaugccacugcacuccagccuuggcaacagagugagacucuuaucuca

SEQ ID NO: 4121458 - RNA, 103 nt, Human
ugagguggagucucacucuaucacccaggcuggagugcaguggcacaaucucagcuaacugcagccuccuccaccucuggguucaagugauccucccaccuca

SEQ ID NO: 4121459 - RNA, 101 nt, Human
ugaggugggaggaucacuucacccugggagguggagguugcaaugagccaagauugugccauugcacuuccggcugggugacagagcaagauuccaucuca

SEQ ID NO: 4121460 - RNA, 73 nt, Human
ugagguucaguucuuggccacaauccuggagaggcaauaguaugcaacgagaagugugccagaaucugcuuca

SEQ ID NO: 4121461 - RNA, 75 nt, Human
ugaguacaguaaaggcuuugagaaguccugcagcgaagaaacuuguuuaauguagcauuuucucaagcuuauuca

SEQ ID NO: 4121462 - RNA, 56 nt, Human
ugaguagucagugggcaggaaggggaguuuuuaccuuccucugcaacugaugcuca

SEQ ID NO: 4121463 - RNA, 103 nt, Human
ugaguagugcauauacgggcaaaacugcaccuuuuagaagucauuuuuaagacacaguguccuagaaugcaucuaaaagcagagauagcuuguguaggacuua

SEQ ID NO: 4121464 - RNA, 66 nt, Human
ugaguauaaccaugugccagguguuguguuuaacacugauaauacaaagcuaaauaugguuucuca

SEQ ID NO: 4121465 - RNA, 57 nt, Human
ugaguauauuuucccugggugguaguugauuuccacucagcuuugggagaugacuca

SEQ ID NO: 4121466 - RNA, 129 nt, Human
ugaguaugauaaaaaaugaaacuugauuuagugcuuugaauguaaauaaaaggugacauauuaacugauuuuaucaucuuuauguuugaaaguacaaucucaggagauuugaauuuaauaucacuacca

SEQ ID NO: 4121467 - RNA, 77 nt, Human
ugagucacauuugggguaaguuugucaagcugcuccuaucucuuucugcagcacauuuacucagcccucaugacuca

SEQ ID NO: 4121468 - RNA, 74 nt, Human
ugagucaugcgccaggcacaggcgugggucugaccugucccuuggcaccaggcuugguguguggucagggcuca

SEQ ID NO: 4121469 - RNA, 73 nt, Human
ugagucauuuuguaaagguauacuuagcugaauugagaugccucauucaguggauaucuucacuuuugaguca

SEQ ID NO: 4121470 - RNA, 66 nt, Human
ugaguccaaaguuccacguggguuagaggaggauuuaaaaacauugugaggacauuggaggacuca

SEQ ID NO: 4121471 - RNA, 128 nt, Human
ugagucuccacccaagagcggacagagccagcaugaggcagggccugcaagagaccugggucuggucuguagugacuccacagguacggauugaggaccuacuaagugcugggcauaggcuggagaua

SEQ ID NO: 4121472 - RNA, 61 nt, Human
ugagucugucagucugacuuucuugugaaugagaauggucagguagcucugacaggccuca

SEQ ID NO: 4121473 - RNA, 59 nt, Human
ugagugaauguguaucccuugugaucaguuauuugcauuugcaguuacaccuucauuca

SEQ ID NO: 4121474 - RNA, 57 nt, Human
ugagugaggugcuuagggcacagaauuuaauguugucucggauuguaccuuaccuca

SEQ ID NO: 4121475 - RNA, 96 nt, Human
ugagugauuaacauguuggcuugauucucagccagucucuguccucaugguggcaagauggcugcagcaauuccaaccaauacucuuccaagcuua

SEQ ID NO: 4121476 - RNA, 62 nt, Human
ugagugcaugcucucccacuaaaagagcgaacaguguucaugugugaguagcaugugucuca

SEQ ID NO: 4121477 - RNA, 58 nt, Human
ugaguggagaucgugccacugcacuccagccugggugacagagcaagacuccgucuca

SEQ ID NO: 4121478 - RNA, 71 nt, Human
ugaguggcaaugguugauuaaaauuuagccuuaggaacagaauuaaauuaaggguacagccaaccuacuca

SEQ ID NO: 4121479 - RNA, 72 nt, Human
ugaguggcccuuguucaaauaugucacauacauguauguggccuauguaccaggguuuaauaagccuacuca

SEQ ID NO: 4121480 - RNA, 66 nt, Human
ugagugggccaguggccugucagaagccguggggagcccucuccagacauacugccaccccacaca

SEQ ID NO: 4121481 - RNA, 67 nt, Human
ugagugguguggccucuuagguuuuagcaacauuacuacugccuucaaacagcgccaccccugcuca

SEQ ID NO: 4121482 - RNA, 80 nt, Human
ugaguguacuggagcuggugugugcccaagcacagacuaauuaaugucugugugcugcccaacucgcagauucacacuca

SEQ ID NO: 4121483 - RNA, 58 nt, Human
ugagugucaacucggaauaaggauugugauugacaauucccaucccagucuguacuua

SEQ ID NO: 4121484 - RNA, 57 nt, Human
ugaguguccuuuuaugugacugguuuuguaaagccuuacacugugaauggaccguca

SEQ ID NO: 4121485 - RNA, 91 nt, Human
ugcaaagcuuaaaaguauuucuaguugguucuacuauugaaaauuucucuucucauaggagugggcauagcagggaauacaagcuauugca

SEQ ID NO: 4121486 - RNA, 67 nt, Human
ugcaaaucauucagccuaagcaaguacagaaaaugcaagcugugugcaaggggugaagauaggggca

SEQ ID NO: 4121487 - RNA, 58 nt, Human
ugcaaaugggugaggguuaggauuauuuauucaaugauuucauuuuuuccuauuugua

SEQ ID NO: 4121488 - RNA, 68 nt, Human
ugcaaauguaucucaguacaucccauuggaacauacagacuauuuggauaucacugaauacaugagca

SEQ ID NO: 4121489 - RNA, 89 nt, Human
ugcaaauugccagcucccauucuucaccuguucccauacccaccucccaaucauggucaccagagguaaaaggaggagagcccaagaca

SEQ ID NO: 4121490 - RNA, 108 nt, Human
ugcaacauacagauuuuauuggauugagcuguucaccaaguagcacuauugauuaaauucuaagauaaaugcuuugaugaaaucuugaaaucaauaaaucuauuugca

SEQ ID NO: 4121491 - RNA, 69 nt, Human
ugcaacaucaugcauggcucauuugguaaauauugcuucacugaguuaugccuguucuauauguugaca

SEQ ID NO: 4121492 - RNA, 129 nt, Human
ugcaaccaggaaagcugauuuuuaaaauucgauauuaacuacauuuuacagaagaugaaaccagagcucaaggucauguuuuaguaaagugaagguuguggaauucagaaccagauuuaucugacucca

SEQ ID NO: 4121493 - RNA, 60 nt, Human
ugcaagaucaagguguuggcagaauugauuucauucugcagcaguguuccuuggcuugca

SEQ ID NO: 4121494 - RNA, 66 nt, Human
ugcaagcaguuauauucaaaaugaggcugugcaauuaugcacaucagaugaaaauggcagucugca

SEQ ID NO: 4121495 - RNA, 67 nt, Human
ugcaagccaccuggucuguuacaacuauuuaccuuuguccccucuaagcagccauggaugguaugua

SEQ ID NO: 4121496 - RNA, 56 nt, Human
ugcaaggcacccacucugcuuuuuuugugaugagauggagcaugacuggccuugca

SEQ ID NO: 4121497 - RNA, 59 nt, Human
ugcaaggcugccucugaggacccuggcaaggugagagggaccacagggaaggucuugca

SEQ ID NO: 4121498 - RNA, 55 nt, Human
ugcaaggguagaagugauggcauuaagaaaagagugccagcuuugaauacuugua

SEQ ID NO: 4121499 - RNA, 90 nt, Human
ugcaagguuauuacauuauuauuuauuaugugaaaaauuagaaagaacuugauugcccaauaauaaaaugguaaaaguaaugauggugua

SEQ ID NO: 4121500 - RNA, 61 nt, Human
ugcaagucuggaguaauguuugugauuauguuuaaugcaaauucacaugauugcuucugca

SEQ ID NO: 4121501 - RNA, 60 nt, Human
ugcaagugucaaugcucuguuaaaaauucauuuugcauuuuuaacacaguccugauagca

SEQ ID NO: 4121502 - RNA, 109 nt, Human
ugcaaguuaacaucuugguuuuguguuauugcaagaugaugacagcauguguaugcuacauuacaacaaucugccauggcauuaauagcuuuggugugugauaaaugca

SEQ ID NO: 4121503 - RNA, 64 nt, Human
ugcaaugccaguauaguuaaggucuuaaugucauccacauuaaacaaggguuacugagcaugca

SEQ ID NO: 4121504 - RNA, 74 nt, Human
ugcaauuaguuuuuacacuguuaaugacagguucccauaaaaugccuugcauugaaauauggaaacugauggca

SEQ ID NO: 4121505 - RNA, 63 nt, Human
ugcaauuccucuggagccuauguugucaacagcucacuggccugaagaggacgaacuguugca

SEQ ID NO: 4121506 - RNA, 110 nt, Human
ugcaauuucugaauuugcauucuaugaaagccuauuugcucuaucuucaccuuauuugaaugaaugagugcuagguuugucuagaaacuguaacgauuuuaagaaaugua

SEQ ID NO: 4121507 - RNA, 62 nt, Human
ugcaauuuuaauacauuagaggcuaacagaguuaucuugagcucauaauguuugacuuugca

SEQ ID NO: 4121508 - RNA, 94 nt, Human
ugcacaacuucaggggacaucauccauauuguaauagauugugauggacauauucugagaggcacaauguggaugguaccccuggaguucugca

SEQ ID NO: 4121509 - RNA, 128 nt, Human
ugcacaauuuauacucggauuuuugagacaguuugggaauaguuuauccuguuauuaucuucaggagucuauaguccuccuacaggaaauuguaucaaaauuaaagaagacugaguuaauuuauugua

SEQ ID NO: 4121510 - RNA, 77 nt, Human
ugcacacaccacacccgcaugcacacacuuucucacuauuugauauggcaacaaggaguugcagcugagugugagca

SEQ ID NO: 4121511 - RNA, 59 nt, Human
ugcacacacgcggcacaucuguggagccauuauugcugcuggauagcuguguuugugua

SEQ ID NO: 4121512 - RNA, 107 nt, Human
ugcacacauauauguggguguuuuugugugugugcguguacaugggccuggccugugaugggggugcaugcugcacacaugcguaggcauucaugugugugugugca

SEQ ID NO: 4121513 - RNA, 67 nt, Human
ugcacacugugcucuguaaggguggugguaguggugguggcuuuauccgcuugacccuuacugugca

SEQ ID NO: 4121514 - RNA, 57 nt, Human
ugcacagaugcuaggaggugaaacgcaguuagaaaugugcaguuuuuauaucuggca

SEQ ID NO: 4121515 - RNA, 90 nt, Human
ugcacagaugcuuggcagagcccacguugggggagugaagacuucagguuugagcucuuugggaugggcucugcuggagaaucuccagua

SEQ ID NO: 4121516 - RNA, 72 nt, Human
ugcacagaugugacuucagucuucuuacauauuaauaagguggagggggcuggauuuuacuccuuguuagca

SEQ ID NO: 4121517 - RNA, 64 nt, Human
ugcacagcuggcucuccuuuucugagaauguuuuaucuuaagaggggauaaguggguaugugca

SEQ ID NO: 4121518 - RNA, 77 nt, Human
ugcacagguuagaacaguagaagaaagggugaggccuugcuauaagccaucuuucuucacuguccuucccuaaggca

SEQ ID NO: 4121519 - RNA, 55 nt, Human
ugcacauacaagauucggggucaagugggacaaaaaccucaucuuggugugugca

SEQ ID NO: 4121520 - RNA, 64 nt, Human
ugcacaucuguccugucugcuuuuaauuuggaagcaccaguuuuaauuuagcggcaggacugua

SEQ ID NO: 4121521 - RNA, 57 nt, Human
ugcaccaagucuggcacugaauggcuauuuucccagccucaugccaggccuugggua

SEQ ID NO: 4121522 - RNA, 68 nt, Human
ugcaccauuuccaacuaccccuccauuugggagcacuaauccaagcuggagagcuugaaagugaugca

SEQ ID NO: 4121523 - RNA, 66 nt, Human
ugcaccauuuugucaggcuacuggaacccauuuuucuccaacucaagcagaggcagaauguaugca

SEQ ID NO: 4121524 - RNA, 78 nt, Human
ugcacggggaauaugguugaucuggccaagacguggaaaugugcuuguucaucugcauaccaagugauuccuugugca

SEQ ID NO: 4121525 - RNA, 87 nt, Human
ugcacggguguguguacugcaugggugcaugcugcuugggugugugugggcagcauugccuuugcagugagugcagaccucugugua

SEQ ID NO: 4121526 - RNA, 55 nt, Human
ugcacuagccacauuucaaaugcucaacagccacaugggagugguggcuacugua

SEQ ID NO: 4121527 - RNA, 64 nt, Human
ugcacuauauaguaugguauauauacuauauacaugcuauguauacacuaugcuauauggugua

SEQ ID NO: 4121528 - RNA, 105 nt, Human
ugcacucacacaggguuuaugcugaacuuguuaggggccuccaggacucaggagaccuggacucaaguccaaguucacgucuaacuguugacucugggugaguca

SEQ ID NO: 4121529 - RNA, 99 nt, Human
ugcacucauccauccacuuagucacacacucaacuuuucaucuugggugauggagguugggaugcuugugauuuuggugaggauagagauugagaugca

SEQ ID NO: 4121530 - RNA, 88 nt, Human
ugcacugcagccagcagcauguggaaucucuccaugguuccucccccgguauaccaaggaagagauucucaguuaguuuuccagugca

SEQ ID NO: 4121531 - RNA, 57 nt, Human
ugcacugcaguuccccagugcgcaaucauuccauguguguugacggacugcagggca

SEQ ID NO: 4121532 - RNA, 82 nt, Human
ugcacuggcuuucccuuaaauaguucuccagugauucuuuccagcuggagccacuuuuuauccuuuggugggaagucuugca

SEQ ID NO: 4121533 - RNA, 72 nt, Human
ugcacuguaaaagaaggucuuugcaaacgugguagcuuucaucugcugaguguacuuucuucuuauacugua

SEQ ID NO: 4121534 - RNA, 59 nt, Human
ugcacuguaugguaucuggacauaagcauugucaaaaguagacauagagccagcaggca

SEQ ID NO: 4121535 - RNA, 70 nt, Human
ugcacuuacuuuuaaggggccuugauuuaggagucugguauuaccuaaaugcucuuuaaaagugcuugca

SEQ ID NO: 4121536 - RNA, 126 nt, Human
ugcacuucuguucaggcaucucuagggcuggcuggaccaccccucccugcuccucaacuggcaggaucugcaaggugcuggcgaggguggcggggccagccaucuccagggacaggacgcagugca

SEQ ID NO: 4121537 - RNA, 69 nt, Human
ugcacuuugcaggcauggaaaccuuguuccacacauugccuggugcccuguccagcgcugcaaggugca

SEQ ID NO: 4121538 - RNA, 57 nt, Human
ugcacuuuuauaucacucuggcuauagcauauaugauggcuggcggugagaaaugca

SEQ ID NO: 4121539 - RNA, 55 nt, Human
ugcagaacaaugagagcugagagccacugcuuuaaaacagacacucugcucugca

SEQ ID NO: 4121540 - RNA, 64 nt, Human
ugcagaagacacaagguaacgucuacuuauccccgugcuucgaaaccguguguuucccuuugca

SEQ ID NO: 4121541 - RNA, 62 nt, Human
ugcagaagcacaggugacgggccuaggguugcucaccauggccugagccagugucuucugca

SEQ ID NO: 4121542 - RNA, 62 nt, Human
ugcagaagucagaccaucugaauuacuguuuccacagcaacuacaauucagucggcucugca

SEQ ID NO: 4121543 - RNA, 60 nt, Human
ugcagacaagugcaucuaacccaaaucauauccagggccccagcuguacaauuguuugua

SEQ ID NO: 4121544 - RNA, 65 nt, Human
ugcagaccggaaaauugagauuuacagagguuaagucuuuagucuuaaguaauucauggaaugca

SEQ ID NO: 4121545 - RNA, 63 nt, Human
ugcagagagauccucaggguuuuacaaccaaaaagaaacaguagauuugauggccucucugca

SEQ ID NO: 4121546 - RNA, 63 nt, Human
uguggcucccgcuugcaccuaagaucaccuucuccauugucuaccaggcuagcgugagccaca

SEQ ID NO: 4121547 - RNA, 66 nt, Human
uguggcuccugggcugucggcgcucugccaggcaugacggggugcaccaugcgcucggggcccgca

SEQ ID NO: 4121548 - RNA, 113 nt, Human
uguggcuuuccucuuucuuucucuucauugaauguucuugcaaaucauuaccaaauugaaaagauuuacaagucauuggaugaggaauugaucuagaagauauucaagguaca

SEQ ID NO: 4121549 - RNA, 76 nt, Human
uguggcuuugcaggcuuuagccccauggcugcucucaugggcugggcugguguugagugccuguagcuuuuccaua

SEQ ID NO: 4121550 - RNA, 65 nt, Human
ugugggagccacagugaggugcaugguugcgggguacagcuggcuucucugugguggcuccccca

SEQ ID NO: 4121551 - RNA, 87 nt, Human
ugugggagccuguccugugcauugucagauggcuagcagcaacccuagccucugcucuauaaaugccaguagcaccuccucccaaca

SEQ ID NO: 4121552 - RNA, 65 nt, Human
ugugggcuacacacagcaguaaugggguuauuuccuuccacaaacuggcugaguuuauguucaca

SEQ ID NO: 4121553 - RNA, 55 nt, Human
uguggggccaaagcccagccacaacaggaaggaguggccagcuggagucuccaca

SEQ ID NO: 4121554 - RNA, 129 nt, Human
ugugggugucagucaggcuguaaauggugugggugucagucaggcuguaaauggugugggugucagucagucaggcuguaaauggugugggugucagucaggcuauaaauggugugggugucagucagg

SEQ ID NO: 4121555 - RNA, 84 nt, Human
uguggguugguuaacacucccaggcuuguggauuggagcgaguuuguguuuaauuggcugucuuuccaaagcaaguggcccaca

SEQ ID NO: 4121556 - RNA, 65 nt, Human
ugugguaguuaaagaaaaucgaacuaaaauuauguccuguucaagauuuuaaagagacugccaca

SEQ ID NO: 4121557 - RNA, 68 nt, Human
uguggucaaggcaaucucauggcuucuuguuugggugauugagaagauaaauugagauugggaccaca

SEQ ID NO: 4121558 - RNA, 70 nt, Human
uguggucaucaacugagaaugguccgucucaucuuugaguaugcaauuaccuuuauagcugauuaugaca

SEQ ID NO: 4121559 - RNA, 55 nt, Human
uguggucauugcuugaaagaucaagaaugaaagucccuugaaggccaugaccacg

SEQ ID NO: 4121560 - RNA, 55 nt, Human
ugugguccagguuugcaauguuaaguggaaaagaacgacuaaaucugugaucaca

SEQ ID NO: 4121561 - RNA, 55 nt, Human
uguggugacgaccaggguggacuaggggccugucucccauucugucucugccaca

SEQ ID NO: 4121562 - RNA, 69 nt, Human
uguggugcaaaauuuggccaauaacaguuaaaaaaggaaaauuugauuguuaaacagauauugcccaca

SEQ ID NO: 4121563 - RNA, 64 nt, Human
uguggugucaaugcucccaccuuggcagauuguaagcugccaauaugagaucacugacaacaca

SEQ ID NO: 4121564 - RNA, 84 nt, Human
ugugguuaagaucauaugcuuugggauuagaucauccugggcuugaggauuaaaugagacaacguauauaaaugauuuagcacg

SEQ ID NO: 4121565 - RNA, 64 nt, Human
uguguaaagcuuguuccagaaacagugagaaaaccauuuggauuggagcuuaagguuugacaua

SEQ ID NO: 4121566 - RNA, 86 nt, Human
uguguaaaggagugauugaagauauagcaauaaucauuuccaaagaaauguuaguaacuugaguauuugcagucauuuuagaaaca

SEQ ID NO: 4121567 - RNA, 92 nt, Human
uguguaaggaaagaacuguuaacuuuuuacagaaaugaagccucgucugcaugguuuuuaugccuuggaaagauugauuuuuuauuacuaca

SEQ ID NO: 4121568 - RNA, 60 nt, Human
uguguaaugcugacuuuuccuuaagauaguagguuauuucacagcugucaguguuacaca

SEQ ID NO: 4121569 - RNA, 61 nt, Human
uguguacagcauuagaaacuauugcugcaagguuuaccugugcugcauucuaacgcacaca

SEQ ID NO: 4121570 - RNA, 65 nt, Human
uguguacauauaugcccucuggguggcuguuuacuaugcggcauacaagagaaauauaagauaca

SEQ ID NO: 4121571 - RNA, 58 nt, Human
uguguacuucccccugaccuguuugaagcaggccuccacaagguuugguggaaacaua

SEQ ID NO: 4121572 - RNA, 92 nt, Human
uguguacuuuauuuaucuugaaacuuuuugggaacagcuguauaacaggaaguaguauuucugaggcccaggaagugaguaagggcuacaca

SEQ ID NO: 4121573 - RNA, 94 nt, Human
uguguagaagugauauaggaaacuaacuuaucuuuauauguuguuauguacaguuguuugauuugguugguuuuuuaaauuucuaauuuacaca

SEQ ID NO: 4121574 - RNA, 80 nt, Human
uguguagcagguuucuaguucuaagaauauuauuaaaguagcuauuuagucauagaacaaggcagaaaucugguuaagca

SEQ ID NO: 4121575 - RNA, 95 nt, Human
uguguagggacucuggagccauguauagccuaugaauccuuucaaguuuauucgaacuuauaguguuuuauauuggcucuaauaguuuaaacgca

SEQ ID NO: 4121576 - RNA, 64 nt, Human
uguguauacaugucugugugcacaugugugggugugcauguguaugugcaugcaugugugaaca

SEQ ID NO: 4121577 - RNA, 66 nt, Human
uguguauguguguguguguguguauauauauauauauauaugcacgcauacacacauaaauacaca

SEQ ID NO: 4121578 - RNA, 72 nt, Human
uguguauuuccuaaaaacaaggacacucucugacauaaacaccauagaauccuucaaguuaggaagugaaca

SEQ ID NO: 4121579 - RNA, 76 nt, Human
ugugucaaagaggcagguguuacuggaaacugcacuaaauuaaaaguuuuccuucaaacagcuuuuuuuugacuca

SEQ ID NO: 4121580 - RNA, 66 nt, Human
ugugucagcacaguaucaauuacccagaccauaucugaaggccuaauauaugcaugugcuggcaua

SEQ ID NO: 4121581 - RNA, 66 nt, Human
ugugucccaggccucuggaauuagaaucugcauuguaacaagaucuucaagagaccuguggacaca

SEQ ID NO: 4121582 - RNA, 84 nt, Human
uguguccugugcauaugguuacagcaccgcuuccugugaaggaguugagcuagggguugugcugaaugcagagaacaagauaca

SEQ ID NO: 4121583 - RNA, 67 nt, Human
uguguccuuucccccuacuuaaaaauaaugauagguucuucuggaaccugcuuaaguaagugacaca

SEQ ID NO: 4121584 - RNA, 77 nt, Human
ugugucgccaaggagcugcugcucaguucuagccaggacagcagggugagcuggauccaacuccguuugguggcaua

SEQ ID NO: 4121585 - RNA, 59 nt, Human
ugugucuacugaucugauucagacaaagccuggaugucuauuagaaaagauuagauaca

SEQ ID NO: 4121586 - RNA, 55 nt, Human
ugugucuggauagguaauggaucggcgaauuggucaucucuuaccuacagacacg

SEQ ID NO: 4121587 - RNA, 110 nt, Human
ugugucugucuugcaaauuaagcuguguccuucucgaagguagggaugauacccuucauuucucaucaccuagaauuuaaaacauugcugauauauggcaggcagucaca

SEQ ID NO: 4121588 - RNA, 63 nt, Human
ugugucuguguuuguggccggucugccucugugccugggucagaccccagaccagcagacaca

SEQ ID NO: 4121589 - RNA, 57 nt, Human
ugugucuguuuuuguaccaguaccaugcuguuuugguuacuguagcacugcaguaua

SEQ ID NO: 4121590 - RNA, 80 nt, Human
ugugugaaacaguggccaauucuggagaugaaauauaauuucagcugcuauguuccuagguaugccaauuguuucauuca

SEQ ID NO: 4121591 - RNA, 65 nt, Human
ugugugaagugauuuuaagucuagauuuauuuacagguggaggauagacaaaaugacuucaugca

SEQ ID NO: 4121592 - RNA, 130 nt, Human
ugugugaaugugcagaaaaccaggauguugcuacuugauugacaguugacuauguacauauaaaaacacagaguuauggacuuaaugcagguuaagcaagguguauuugauggcauguauacaucauaca

SEQ ID NO: 4121593 - RNA, 83 nt, Human
ugugugaauuccauaaaacaugaaauuuuauuggaaugugaagugaaaauuauggaaaugaaauuuuauuggaaugugaagca

SEQ ID NO: 4121594 - RNA, 57 nt, Human
ugugugacagcggcugcaggugcccagugcccuggcacagggcagugauuguccaca

SEQ ID NO: 4121595 - RNA, 79 nt, Human
ugugugcaaugagaauauauuaaccagggguagaaaaaggaaaaagggucucugguggguauacacucuauugagguca

SEQ ID NO: 4121596 - RNA, 55 nt, Human
ugugugcacuuaaugcaaucaucuucuuccugaucauugcuuuggcugcaucaca

SEQ ID NO: 4121597 - RNA, 63 nt, Human
ugugugccccucccagcacacagccugagcccuagcacagagcuggccgcagagagggcagca

SEQ ID NO: 4121598 - RNA, 73 nt, Human
ugugugccgagaccccaugaauguagcuuuaaugauugaucagggcuccaggggcugggugacucauagcaca

SEQ ID NO: 4121599 - RNA, 73 nt, Human
ugugugcguauguauucuuuguguguugcauguauguuauacaugugaggugugagugauacauguguauaug

SEQ ID NO: 4121600 - RNA, 81 nt, Human
ugugugcgucuaucuccugguacccuuccuagcaucaauucuguauuuguaggaguccaaucaggagacacaaaccacuca

SEQ ID NO: 4121601 - RNA, 70 nt, Human
ugugugcugaacagagucugggcacugggaaugcuguggugaacagauucccugacauccagagcacaca

SEQ ID NO: 4121602 - RNA, 59 nt, Human
ugugugcuuauagucuaguaguaacaggagcaguuuuuacauugacugugugcaucaca

SEQ ID NO: 4121603 - RNA, 62 nt, Human
uguguggggagagaaugggucuuggccuccucagaggagcaaaccuguucuccccacaugca

SEQ ID NO: 4121604 - RNA, 91 nt, Human
uguguggucagggugaggcuggcucuaucuccaaggcugggcacacgguccaggcuuggccaauuggaguuuuccaucuucuuggcugcca

SEQ ID NO: 4121605 - RNA, 63 nt, Human
ugugugguucggguuaaugagggucugagucaucaaguuagaaacucaccuuuccagccauca

SEQ ID NO: 4121606 - RNA, 65 nt, Human
uguguguauauguguauauaggugucuauacauaauugucuuauuuguaugcauacauacacaca

SEQ ID NO: 4121607 - RNA, 66 nt, Human
uguguguaugugcguguguacauauauauguacacacauauauauguacacacacacacacacaca

SEQ ID NO: 4121608 - RNA, 62 nt, Human
uguguguccucauaagauggaggggaaaagggcucccccacgccuccuuuauaaggacacca

SEQ ID NO: 4121609 - RNA, 69 nt, Human
ugugugucuugaccaggaucggauauaaauucuauuauuggaaguuuccaggacccugguagacacaca

SEQ ID NO: 4121610 - RNA, 65 nt, Human
ugugugugcagcuguuacuagagagauugauuugggacuuggucucagugccgauugcauacaca

SEQ ID NO: 4121611 - RNA, 74 nt, Human
ugugugugcucaagggcaggaaccuggcauuaccaaagggauuagccaccucugguuugccuuuagcacggaua

SEQ ID NO: 4121612 - RNA, 91 nt, Human
ugugugugggauucauccucuaugauauguauggguaguggugcauuaucccauaggguuaucauagggacuaagugaguuauuucacaua

SEQ ID NO: 4121613 - RNA, 130 nt, Human
uguguguguauauauauguguguguguauauauauaugucauuuguauauaugugcauauauguguguguguguauauauguuuaagucauuuguauacauguguauauauguguguguauauauacaca

SEQ ID NO: 4121614 - RNA, 60 nt, Human
uguguguguauguauguguguguguguguaugugugcagacacguguguguaaacacaca

SEQ ID NO: 4121615 - RNA, 78 nt, Human
uguguguguauugaagacaagggcagggguuccagaccucccugcauuugagccccaugcccucucuuagcauacaca

SEQ ID NO: 4121616 - RNA, 55 nt, Human
ugcagagggacagccacagcucagagggcagcugaggugcugguucuucccugca

SEQ ID NO: 4121617 - RNA, 63 nt, Human
ugcagagguguugcugagauaaaagagccuaaugguggguauucauuuccagcagucucugua

SEQ ID NO: 4121618 - RNA, 59 nt, Human
ugcagaugaaugcugagacacucugcuggaaguagauuaaaaacuuagacaucucugca

SEQ ID NO: 4121619 - RNA, 69 nt, Human
ugcagcaauuuuuuaggcauuccauauggcuaucagaacuauuagcaaaacaugcaaaaaauuguugua

SEQ ID NO: 4121620 - RNA, 66 nt, Human
ugcagcacauucccaccuguacuucuguuuaucuaauugaaaacauggagggaauuuagugaagca

SEQ ID NO: 4121621 - RNA, 89 nt, Human
ugcagcauguggaaauccagcgugugcaccuuagauggcaacagucuaaagagaguggguacaugucucaggaauccacacuagcugua

SEQ ID NO: 4121622 - RNA, 128 nt, Human
ugcagccccaagaugagccugcaguauuuuccuuacaugaucugguccuacugugggcagcgcugcugcccagagccugagaggauuaugaaaacauggcaacggaagugaggccaggggacacagca

SEQ ID NO: 4121623 - RNA, 130 nt, Human
ugcagccugcuuuccgacuguaucugugcuuaugaaaaacuggaaaaaggcuuuguaauuguccuucuuacacugagccuuacauaaacagccuuauaacuauucacaggagcacucacugcaccaugua

SEQ ID NO: 4121624 - RNA, 75 nt, Human
ugcagcggacagaggccaccccugcagguggugugugcaggacagugcccugagggguggugucuguacucugca

SEQ ID NO: 4121625 - RNA, 130 nt, Human
ugcagcuaaguuuuuugcugugugaagaaaguuauucuguacucuuugagaagaaugaugcgaaaugcugagauucaacaaggaggauggagaaaguuucuaacuucaucuggacuucaucuggccugca

SEQ ID NO: 4121626 - RNA, 61 nt, Human
ugcagcuagcagcaucacaggaagacuucgcaggccugaggacuuugaacacugcucugca

SEQ ID NO: 4121627 - RNA, 58 nt, Human
ugcagcucagaagggaggaaaugaggaguagaaucuccuucccucucuccugggugua

SEQ ID NO: 4121628 - RNA, 92 nt, Human
ugcagcucugcuugacaaccugucucuucuuauggccguggcugagggguugccccucacggaccuaagaggaagauuuuccgggugcugca

SEQ ID NO: 4121629 - RNA, 93 nt, Human
ugcaggaagaggggauaaagaaaaguuugaaaaauauaacaauauguccauaaauauuucguaugcucucuguguccuguuuucuuuccugcg

SEQ ID NO: 4121630 - RNA, 68 nt, Human
ugcaggaccagguuucauucaagaggcaguaagcaauuuuccugcagcuuuggaaaccuguuuccgua

SEQ ID NO: 4121631 - RNA, 55 nt, Human
ugcaggagcgcguggccaacgcucccaccuuucugccuggcuccugccuccugca

SEQ ID NO: 4121632 - RNA, 70 nt, Human
ugcaggagcuauuugucacaacugguguuuucugaagacuuggcauguggcaaguaaguccuuuccugca

SEQ ID NO: 4121633 - RNA, 78 nt, Human
ugcaggauauuaguuuucuuguuaugacaacaaaccaaaauauugucacaaugacaggaaacauuucaguuuucugca

SEQ ID NO: 4121634 - RNA, 55 nt, Human
ugcaggccaaccugugucuggagauaaugcaagccagugcagggguuagcgugua

SEQ ID NO: 4121635 - RNA, 69 nt, Human
ugcaggccggcccuaggccucacuuuccaacaguuucuucuagcccaggccuggugacuggcuucugca

SEQ ID NO: 4121636 - RNA, 68 nt, Human
ugcaggccucuggaggguagacagugggcccucaucaucccugaacccaccccacagaguccauugca

SEQ ID NO: 4121637 - RNA, 62 nt, Human
ugcaggcuaggccuugcccuggaacauggaggcccugcccggggcuggggccuaguccagca

SEQ ID NO: 4121638 - RNA, 60 nt, Human
ugcaggcugaaguugccuauuuuaauauaugacucuucauuuauucauuuucagccagca

SEQ ID NO: 4121639 - RNA, 55 nt, Human
ugcagggaauccagucuagggugaauguuacacagccuucagaucauucugugca

SEQ ID NO: 4121640 - RNA, 84 nt, Human
ugcagggagaggccagcugagcugcugcacagaccugcugggaucaucacagcugugcgcuucaggccagugccucuuccugua

SEQ ID NO: 4121641 - RNA, 62 nt, Human
ugcagggaggaaguugaagaagcucuuggagugccccagcucuguuacugauuuuccugaca

SEQ ID NO: 4121642 - RNA, 58 nt, Human
ugcagggccuugggauguguccuguacacaaauaacugauaccuccugaaaccuugca

SEQ ID NO: 4121643 - RNA, 76 nt, Human
ugcagggcuguucaggaggguggguugugcuugggcuugcaugccucugaccuccaugcccuccuccaucccugca

SEQ ID NO: 4121644 - RNA, 55 nt, Human
ugcagggucccgaagggaagacgaacacuccucauccucugauccuggauccgca

SEQ ID NO: 4121645 - RNA, 83 nt, Human
ugcaggugcaggguagcgacggcaggacucuaagagugagucucuuuccuccccguuuccccguccuacuuucacucuaagca

SEQ ID NO: 4121646 - RNA, 57 nt, Human
ugcaggugcuacaagaacucacagaucagugggccuaguauuuuuguagccauugca

SEQ ID NO: 4121647 - RNA, 74 nt, Human
ugcaggugguccuuccucugcuguguauuaaugcuguaaagaaugcugacugagaggugggaaacacucaugca

SEQ ID NO: 4121648 - RNA, 64 nt, Human
ugcaggugugguuccucagccacuggucuaguagaagccuguggggagggaagucauuucugua

SEQ ID NO: 4121649 - RNA, 58 nt, Human
ugcagguucugaccagccaacuccucuccuuggaggucugguuugugagagcugagca

SEQ ID NO: 4121650 - RNA, 59 nt, Human
ugcaguaacuuuuagacuuggguauaaacacuuguugguguuuguuggaaguuauugua

SEQ ID NO: 4121651 - RNA, 78 nt, Human
ugcaguagagauauauuuuaaugagaaaugacuuaaguuauguuguaacugguagcugauuaaguauaguucccugca

SEQ ID NO: 4121652 - RNA, 74 nt, Human
ugcagucacagugacaggaugugguucucaucuuggccaagaacaacagcuccauauucugccauugcauugca

SEQ ID NO: 4121653 - RNA, 93 nt, Human
ugcagugaauaugccacaguagauagaaaagggauuugucuucuggucugucuuccacagagacuaagcuuuucaucaacgugcuuuacugca

SEQ ID NO: 4121654 - RNA, 81 nt, Human
ugcagugagaaaugaguuaaaucagcucucacugucaacuggaacagccuuggagcugaguuaauucaucacuuacugaca

SEQ ID NO: 4121655 - RNA, 56 nt, Human
ugcaguggaaucuggagagcaguuuguguacugcuuuuggcuggaguucuacugua

SEQ ID NO: 4121656 - RNA, 58 nt, Human
ugcaguggaggccgugagacagacauggguucuguuuguucuuauggacuucccuuca

SEQ ID NO: 4121657 - RNA, 63 nt, Human
ugcagugucuuguggacuugaggcgugcucuaccaggaaagcccacaggccccaagaccugua

SEQ ID NO: 4121658 - RNA, 82 nt, Human
ugcaguguuacugggccuggguguaauguaaauggaauuauuugccgugaaaauacccaguccaaucucuuagcaaauugca

SEQ ID NO: 4121659 - RNA, 59 nt, Human
ugcaguucuaucacccaccccguaaauaguuuucuguugaugguaggugguggaaugua

SEQ ID NO: 4121660 - RNA, 75 nt, Human
ugcaguuguguuaagaucaguucaaacauguguauguugcugaauauauacacaaauuggcauugauaaccugca

SEQ ID NO: 4121661 - RNA, 69 nt, Human
ugcaguuuuaagggcuggccacauucuggguaguuucuggucagaauauacagagcucaggaaacugca

SEQ ID NO: 4121662 - RNA, 61 nt, Human
ugcaguuuuagacagaaguacuaauggguaauuucuauuuaaugcuuucuaaacacaugca

SEQ ID NO: 4121663 - RNA, 76 nt, Human
ugcauaaaaaaugagaacugugauucuauugcuuugcaauauuugcugauucacaguuuccucauauucuugugca

SEQ ID NO: 4121664 - RNA, 84 nt, Human
ugcauagugagagcagagcuuuuuggacucagaccuaaauucaaauccuaggucuuguauuuacuugcucugugacuuaaugca

SEQ ID NO: 4121665 - RNA, 57 nt, Human
ugcaucacuuagcugcacaacuguggcucucucucuucacuggcagauaaugaugca

SEQ ID NO: 4121666 - RNA, 76 nt, Human
ugcaucagaaucagaaucucugggaguggaucaagcaccuacauuguuaccaagcucuugggguucaccugaugca

SEQ ID NO: 4121667 - RNA, 72 nt, Human
ugcaucaguaagucaguagaacuguggucaguuaauaguguauuuuaaaugacagcaggaacugauuaugua

SEQ ID NO: 4121668 - RNA, 56 nt, Human
ugcauccuagggaaggcacugauuucagaguaaccaguauucucugcuaggaugca

SEQ ID NO: 4121669 - RNA, 67 nt, Human
ugcauccugcuagagacaaugcuguuuauaaugucaauuacagccagucaucucagcagggaaagca

SEQ ID NO: 4121670 - RNA, 56 nt, Human
ugcaucucacacuuguauuuccaaagaauaaacaggcucagcaaaggugaggugca

SEQ ID NO: 4121671 - RNA, 55 nt, Human
ugcaucuugagacagggacuguaucuuuucuuuguagucucugcaacauagugca

SEQ ID NO: 4121672 - RNA, 66 nt, Human
ugcaugaccguguuuuuggugacacaacucccgccugcccuguguccuccagcagcaugguaugua

SEQ ID NO: 4121673 - RNA, 124 nt, Human
ugcaugauuuguagauguaaauuugacuuuauuaucauuaacuguugaauuaucaaguguaugaugcagugcaaucaaguuuaacagcaugguggguaagagcaucuagauuagaaucauugca

SEQ ID NO: 4121674 - RNA, 63 nt, Human
ugcaugcuggccucagaaaaauggguuuacuaaacaccugugacccuugaugguugacgugca

SEQ ID NO: 4121675 - RNA, 60 nt, Human
ugcaugguggaggaggcucuugcauucauuucugcccagccucuuuucuccugcccugca

SEQ ID NO: 4121676 - RNA, 58 nt, Human
ugcaugguggguguaguuuccgccaaaaaugaugacgagagacuccauccaccacaca

SEQ ID NO: 4121677 - RNA, 69 nt, Human
ugcauguggaucagaugaauggacauuuuaguauuucccuugcucuucaguuuguauaauccauaugca

SEQ ID NO: 4121678 - RNA, 70 nt, Human
ugcaugugugacaaggacaguuuuccaaacaauaguccuugaagagaaaauuuacuccuuggaaugugca

SEQ ID NO: 4121679 - RNA, 92 nt, Human
ugcauuaauauaacacccccgaaaucucagugguguaauuaacuaaaguauauuuccugcucauugaauucuggggguugagauucugagca

SEQ ID NO: 4121680 - RNA, 68 nt, Human
ugcauucagaaacccauugggucucuugaacaaaggcauuugagagaauccccagguuaucugaagca

SEQ ID NO: 4121681 - RNA, 60 nt, Human
ugcauucauuugacauccuggugcauggggaagcucaggaagccgguuaaauagauugca

SEQ ID NO: 4121682 - RNA, 59 nt, Human
ugcauucucaacccagaguuucugguucaggggaccuggaaugggguugagagcuugca

SEQ ID NO: 4121683 - RNA, 68 nt, Human
ugcauugaucauaauuaucuugucauaugucacuaaaggcagugacaaggugguaaugaagcuuugca

SEQ ID NO: 4121684 - RNA, 64 nt, Human
ugcauugaucauauccuuccugggcuccacuuuaucauccuucugggcuagguggucaguagca

SEQ ID NO: 4121685 - RNA, 55 nt, Human
ugcauuggguugacauacuaaagacugagucucuaggacuuugucaucuaaugca

SEQ ID NO: 4121686 - RNA, 58 nt, Human
ugcauuguguacuuuacaugccaucauuauagguauguaacaauuucauauacaugca

SEQ ID NO: 4121687 - RNA, 80 nt, Human
ugcauuugcauguuauccauggccaaucaaauacaaacagggcuuuauguuuguggaagccggugggaagcagagaugca

SEQ ID NO: 4121688 - RNA, 66 nt, Human
uguucuucuugccagaugugguggccuagaucgcugaaagcccacauuuuuggcuuagaggccuca

SEQ ID NO: 4121689 - RNA, 72 nt, Human
uguucuuuccagcaucccaguucuggcagcaccgagcggcagggaacacaaaugggagagcugggcugggcg

SEQ ID NO: 4121690 - RNA, 65 nt, Human
uguucuuugcauccgaaacaauuucucuuguuugcauaggguucuuguuucagaugcaagaaaca

SEQ ID NO: 4121691 - RNA, 93 nt, Human
uguucuuuuguucaaagcuguaugaguuauucuagguccuuuguauuuuuauauaaauuuuagaaucagcuugucaguugcaacaaaaaugca

SEQ ID NO: 4121692 - RNA, 78 nt, Human
uguugagcagucugcuagaguguuagguauuugugugacucucuguaaucucuuagcagucuagugaccauuuuaaua

SEQ ID NO: 4121693 - RNA, 72 nt, Human
uguugaggcagcugggauacaagggauacuuuggccauuuaucccuucucuuucccucugucucuaaugaca

SEQ ID NO: 4121694 - RNA, 60 nt, Human
uguugaggugucuacaucuucagugcagucuuuaucugccucugagagaugcuucacaca

SEQ ID NO: 4121695 - RNA, 82 nt, Human
uguugagguuaaguuugcugaaugguaaagaaguauaauuuuugaaauuguuuucugucgucaguuaguaaaucaaucaaca

SEQ ID NO: 4121696 - RNA, 129 nt, Human
uguugauaugaacaaaggaaaccaagucucagagaaaaagcuuuguccaaggccaugcaggucuccauuggccaugcaggucuccauuggcagacuccacacuggauuugguucuguguuucuccggca

SEQ ID NO: 4121697 - RNA, 78 nt, Human
uguugaucugcccaggugagccuaagccaaucuugagagcagcugucucaggccaggcugcccugggagcagaccaca

SEQ ID NO: 4121698 - RNA, 104 nt, Human
uguugaugcacuccaguuagaagacuguuuguagaggaagaucaguugagaaaaaaugagaacuucuucaacauaauggacacuuucuguagacuaaaucaaca

SEQ ID NO: 4121699 - RNA, 83 nt, Human
uguugauuauaacacugccuugucaccauuguguucuuucuaagcacagacacagcuugguccccuggcagugauauacagca

SEQ ID NO: 4121700 - RNA, 63 nt, Human
uguugccagagaaacuugagcacuauguaauuaagcuucugcuuuaaaguauuucucgcaaca

SEQ ID NO: 4121701 - RNA, 77 nt, Human
uguugccaggugccacugagagagcgccugggaucauucaucgaauaauccugcccgucucuccgcacuuuuaaaca

SEQ ID NO: 4121702 - RNA, 81 nt, Human
uguugcccagcucuggcaguuugccaggagcucggccguggggcgcggugucuggcgaagcaugccggggaggaggcagca

SEQ ID NO: 4121703 - RNA, 65 nt, Human
uguugcccaggcuggagugcaguggugugaucucgacucacugcaaccuccaccucccggguuca

SEQ ID NO: 4121704 - RNA, 93 nt, Human
uguugccuugaggccuagagcucugcuuuaucuaaauuuaaaaggagauggaaacuuagagaagaguagaggguucuguagucuugggcagca

SEQ ID NO: 4121705 - RNA, 65 nt, Human
uguugcuaaaagauuaauugcagaaggugggucgauuugauuaaggcaauuaauuuuugguuaca

SEQ ID NO: 4121706 - RNA, 61 nt, Human
uguugcuaggcagcaguauaaucagcagccauauagcuaauuacacacugcuucuagaaug

SEQ ID NO: 4121707 - RNA, 62 nt, Human
uguugcuguguggacauucagugcauugcuucuaagggcugcccuguguuccacagcagaca

SEQ ID NO: 4121708 - RNA, 63 nt, Human
uguugcuuugagacucaccguggucuagaaacuccuuuaggugccaagaugucacagacaaca

SEQ ID NO: 4121709 - RNA, 130 nt, Human
uguuggaauguauauuagauuaaauugauagaugguugugugaaaagaacugcaauauucaaacuugacuguaugcauaaaauuauuuacagaacuauaccacauuaauaccaucuuauuucauuucaga

SEQ ID NO: 4121710 - RNA, 66 nt, Human
uguuggauuagaaaauuugcuucuuuggagagcuauuaucuuuagggagaauuuuuuaagaaugca

SEQ ID NO: 4121711 - RNA, 80 nt, Human
uguuggcauagauuucuuuagguuuauccuguuggagcaucuuucagcuucuugaaucugcagguuuauguaucuuaaca

SEQ ID NO: 4121712 - RNA, 65 nt, Human
uguuggccccauucuccccugccacagauagguucuuuccacagaggggaugauggcagcuagca

SEQ ID NO: 4121713 - RNA, 65 nt, Human
uguuggguaaacagugaaaguaagcauguuauaauaauauauguacaagcuguuuuacugcagca

SEQ ID NO: 4121714 - RNA, 90 nt, Human
uguuggguccgggugcucugugggacucugaggaaaagcucgcaccagguagaugcuguucuguccccauggguaaaggacaccccaaca

SEQ ID NO: 4121715 - RNA, 63 nt, Human
uguuggucaaacaaaacccaucccugagggguagcuucaaagauggguuuuguuugauccaca

SEQ ID NO: 4121716 - RNA, 62 nt, Human
uguuggucacuaguacaucccagcaccuugcagagggccuggcagauaguaagugaucaaua

SEQ ID NO: 4121717 - RNA, 77 nt, Human
uguuggugcccaauuuguaggcugcagggagcacauuuuguaucuauuugccaggagacaaagugggcccaccaaua

SEQ ID NO: 4121718 - RNA, 67 nt, Human
uguuguagcccaugaugguggaaggcagucccaucccauugccuccauuuguguguggccacuaaua

SEQ ID NO: 4121719 - RNA, 62 nt, Human
uguuguagcuugacagcagccauagacaauagccaaugaaugggcuuagcugaguugcaaua

SEQ ID NO: 4121720 - RNA, 79 nt, Human
uguuguauagagucuugcuuuugcugaugauuaagccaacaggugucaggagugcuaaagcaaguuggcuuugugccca

SEQ ID NO: 4121721 - RNA, 127 nt, Human
uguugucugaggucaguuucccugggcaacagauucugagcugguguuuuacgugcagaaaaauugcugagaugugccuucaggaucaacaccuauggaagagugaacaaagaaugaucaggcagca

SEQ ID NO: 4121722 - RNA, 55 nt, Human
uguugucuucuccaggugaaaggaaagguauucacuguccuggucuagaggcaca

SEQ ID NO: 4121723 - RNA, 85 nt, Human
uguugugacugacugaggcagggagaguggauauguagucaauauuuucucuuuccuuuccuuuuacuuccaaagucuucacaca

SEQ ID NO: 4121724 - RNA, 98 nt, Human
uguugugucacuugagcuuggccagcucuggaaagugguagauucuuccugaaggccagcgcuuguggagcuggcaggggucaguguuguguguagcg

SEQ ID NO: 4121725 - RNA, 101 nt, Human
uguugugugaaacuguuauguuggccgcuuuaaugcaauuucaccucauuuacaugaauuuugauguugcuuagggauauucaauacaacagcacccaaca

SEQ ID NO: 4121726 - RNA, 58 nt, Human
uguuguuugccaugcuguuggaaauuaaaaacuucaguccaaggauuggcaagcagca

SEQ ID NO: 4121727 - RNA, 81 nt, Human
uguuguuuuuguuguaagaauaugaauacaaauguuaauagagcacagcauuguguuaaaaauguucuuaccaaguuaaca

SEQ ID NO: 4121728 - RNA, 84 nt, Human
uguuuaaaagcagcauaauucuucugcccuauauaaguuacugacaucuucuguaguccaggaauugugucugaaccuuaaaua

SEQ ID NO: 4121729 - RNA, 62 nt, Human
uguuuaaugcauugaccuugggcuauaagagucuguccagugcucaggguccacauuaaaca

SEQ ID NO: 4121730 - RNA, 58 nt, Human
uguuuacacaauagucucucucagcuccgaggggccauuagaguuaauugggugaaua

SEQ ID NO: 4121731 - RNA, 66 nt, Human
uguuuacauauuuggucucagagccaaaaauacgcacagauaggucccaggccaaacuuguaagca

SEQ ID NO: 4121732 - RNA, 76 nt, Human
uguuuaccuuugaacuagcauuucugggccauggugaaaaauuacacaugagcauuuuggucuaguuuaagagaca

SEQ ID NO: 4121733 - RNA, 84 nt, Human
uguuuagcucaugcugaagagagaacuacucagcucuuggaaaaugcugagcuggguauuccugccucuuggcugagcuaaaua

SEQ ID NO: 4121734 - RNA, 77 nt, Human
uguuuagugauuacuacauagaugaccauguuggguaauaauugaauuuaucggugucuguguuguaaaacugaaua

SEQ ID NO: 4121735 - RNA, 67 nt, Human
uguuuaguuuuucuaaguagcgauauuugggggaauuuaaauuggcauuucuuggagaaacugaaua

SEQ ID NO: 4121736 - RNA, 56 nt, Human
uguuuaugcuuuguguucauuuucauauuuagaaaauagaacaccaggcauauaua

SEQ ID NO: 4121737 - RNA, 88 nt, Human
uguuuauugcuuuaucccuaagcuucuaacaccaagaccagaaaaugguagacauggaaaggaggcuuguggaauaaaugaauaaaua

SEQ ID NO: 4121738 - RNA, 69 nt, Human
uguuucacuguguguguaucugccuaucacauaugugugugcacauagguauacacauauacagagaca

SEQ ID NO: 4121739 - RNA, 64 nt, Human
uguuucagauuuguuuuuguuucuguucuaacucuaagcagacagagcucacaagucuuuggca

SEQ ID NO: 4121740 - RNA, 61 nt, Human
uguuucaggaagcucaaguuuauuucugauacuugcagccaaacugaccuugccugagaca

SEQ ID NO: 4121741 - RNA, 73 nt, Human
uguuucauuuucggugcauaauauccuaugcaaagaacaaaagguauugguauaggcauugaaacuugaagca

SEQ ID NO: 4121742 - RNA, 74 nt, Human
uguuuccaggccagcccucaccuguguucuggccuccaagccgagggcugggcuucugggcuggcuugucaaua

SEQ ID NO: 4121743 - RNA, 70 nt, Human
uguuucccucuugcugacucuuaaaggcuuucugaucacccagaucugaagagucuugcaagaaagaaca

SEQ ID NO: 4121744 - RNA, 56 nt, Human
uguuuccugauuguuuuugaaguucagguagaccugccucaagacaucaugaaaua

SEQ ID NO: 4121745 - RNA, 57 nt, Human
uguuuccuggaccuugacugauauaaaaauuaucaccaggaguugucucaggaaaca

SEQ ID NO: 4121746 - RNA, 81 nt, Human
uguuucucccagaggcaguggucugaugcaaggucccagaauuuauuuucugucuuuaucugaccugucucugucauuuca

SEQ ID NO: 4121747 - RNA, 70 nt, Human
uguuucucuagcuauucauuaaauuccuccauuaucuaaacuacuggaauuuggaauagcuguagaaaua

SEQ ID NO: 4121748 - RNA, 56 nt, Human
uguuucuuaugguggagagauauuuauuuggacccaagucucuaccagaagugacg

SEQ ID NO: 4121749 - RNA, 65 nt, Human
uguuugaaguucuucugugacucucgauuaaccuugauuuaaaguuccagaaaaaugcucaagca

SEQ ID NO: 4121750 - RNA, 78 nt, Human
uguuugagguaauugcuuagagaauccagguaggagagacacuucugccuggauucccuuaguaauguagccaaaaca

SEQ ID NO: 4121751 - RNA, 89 nt, Human
uguuugccauuacauucuuggaaucuuguuuauagggcuacaauggauuagcuagaaacagggccuucaggaugggaaugaacuagaca

SEQ ID NO: 4121752 - RNA, 55 nt, Human
uguuugcuuggucaguaaguaguaaaguugagacuuggacacagacaggcagaca

SEQ ID NO: 4121753 - RNA, 63 nt, Human
uguuuguacauauauaaaaucuguguacaacauaugcagacagaguuuauguguguacaaaua

SEQ ID NO: 4121754 - RNA, 67 nt, Human
uguuuguaucucucucuguggcaaaccaguuugaaaagaaucaggacuccagagcagagguggagcg

SEQ ID NO: 4121755 - RNA, 61 nt, Human
uguuugucucacgcugugacccuggcuuguagcacagugccaggcacaugguggacacgca

SEQ ID NO: 4121756 - RNA, 66 nt, Human
uguuugugugggggaaacaagguacagguuaguaacaucuuguacuuugguuuuugccaacaaaua

SEQ ID NO: 4121757 - RNA, 94 nt, Human
uguuuguucuucagcugagguauuuuauugggcuagcagucaucuggauagguggaaaguuugguuccaauaauuuacuucaguuuuauaaaca

SEQ ID NO: 4121758 - RNA, 76 nt, Human
ugcauuuuagcaagaccaauauguagauauauuaaagguugcacagcccuguccuauguguuggucccuccuugca

SEQ ID NO: 4121759 - RNA, 57 nt, Human
ugcauuuuggucauucuauagcauuuagucuuacuguagaaucacuaauaagaugua

SEQ ID NO: 4121760 - RNA, 107 nt, Human
ugccaaaaaaacauuggauucuagcauacugggucuugagcaacagggauaaaguggcuugaggcagggaucaggaugguguggaggaaauagggaagacaguggca

SEQ ID NO: 4121761 - RNA, 60 nt, Human
ugccaaauaaguggaaucacacaauauagucuuuuguugucugguuucuuuuauuuagca

SEQ ID NO: 4121762 - RNA, 96 nt, Human
ugccaaccucagaugccuggccugugcaggaaaugagcuaguuuuuguaacccccuacuacugugccuggcacacgguggcauucaagacauggca

SEQ ID NO: 4121763 - RNA, 79 nt, Human
ugccaagagccuuugaaaaguguuugcuuucuuuucaucccuuaugauacagagcaagcaucuuuuccaugccuugaca

SEQ ID NO: 4121764 - RNA, 60 nt, Human
ugccaagucacuagcaagugggucucuucaagggcugaggcucuccuugccgacuuggca

SEQ ID NO: 4121765 - RNA, 129 nt, Human
ugccaauaugaauuugucaauauuaauucuggaaugcucauauaaguuuaaaacuaucugucauucuuauuuguugacuucugggauagguguuauggaggcauuccaagaagaaucagauacauauca

SEQ ID NO: 4121766 - RNA, 72 nt, Human
ugccacaagcuuuauggcuuuaaacaacuuagguguaucaccuuacuguuugccugggccacagucugggca

SEQ ID NO: 4121767 - RNA, 77 nt, Human
ugccacacuaggagaggagugucuguguucccaagcuuaccaauucccauaugccucccugucuaccuguuguggca

SEQ ID NO: 4121768 - RNA, 74 nt, Human
ugccacccgcauuccaguucuaugaauucaagagauuuuucuuucaauuuccaggcuagaauuucaugguggua

SEQ ID NO: 4121769 - RNA, 70 nt, Human
ugccaccuccuuccucuuucaaauuuguuucucuuacuguugggaaccaagaguccaagugagguuggca

SEQ ID NO: 4121770 - RNA, 74 nt, Human
ugccacugagguuuugugguuauguguugcacaguauugugauggugagauauaacucauacagccagguggua

SEQ ID NO: 4121771 - RNA, 93 nt, Human
ugccacuucuucccaaacuacuagguuuuccuaaaauucugguuugucaugggccaggguccugaagaccaaguuuugggcagaaugugagca

SEQ ID NO: 4121772 - RNA, 71 nt, Human
ugccagaaucuagguauuuuauuguugaaagauacuuccgguaucaacuuaaagaaaagauacuucuggua

SEQ ID NO: 4121773 - RNA, 57 nt, Human
ugccagagccaggcuuuaggaaguggccacucugggaagucuguggguucaaaggca

SEQ ID NO: 4121774 - RNA, 70 nt, Human
ugccagcacaccaggucccgucuguaccugaggccaacuccggaguguggagaggacaugggugggggca

SEQ ID NO: 4121775 - RNA, 69 nt, Human
ugccagccagggagggcaaaugagaguugaaagccagcccacacuccauuugccaagccuugcgcugca

SEQ ID NO: 4121776 - RNA, 113 nt, Human
ugccaggacuucauuggggcuuuccugcaaugcacuucaagcaucucucuguuggaggaauuuugauagcagguacuugggguuauggaugggggagguaucugagccuggca

SEQ ID NO: 4121777 - RNA, 65 nt, Human
ugccaggagauaaaagagaugcuuuggcacuuuggggagaaaaaaagcuacucuuuuucucggua

SEQ ID NO: 4121778 - RNA, 61 nt, Human
ugccaggcgauugcuaucagcaacaaugccucuaaauugcugaaaaugcagcucccuggua

SEQ ID NO: 4121779 - RNA, 66 nt, Human
ugccagggagagagggcugccuggugugagguggaccccaccugcccaggagucucucugugggca

SEQ ID NO: 4121780 - RNA, 70 nt, Human
ugccagguaacaaggccgauagaaacaggaauuaucccuuugucuucuagauguuuuaauugcacgggca

SEQ ID NO: 4121781 - RNA, 128 nt, Human
ugccaguaucuguuagauuuuuggugaaaaaugguguuugugugggaguauacaguuucaggaaaucugguuuuaagcucuuaugauauuuauuuauauuuccuauaaaucuaauuugcuuccaggca

SEQ ID NO: 4121782 - RNA, 105 nt, Human
ugccaguaugacugcauuaucuagacaauuccauccuacgugggcacucgauacaaagauacguccacagugguggaauuguucaggcagagcagcagcacggua

SEQ ID NO: 4121783 - RNA, 98 nt, Human
ugccaguccguuuuuaauuauccaccuuugcaugauuuggauuauccuagcucagcuacuuacagguggcuccacugauggaaaaauggaccaaggua

SEQ ID NO: 4121784 - RNA, 56 nt, Human
ugccagucugccuagugggacagcagccuaugggcuugagggcuaggcagggggca

SEQ ID NO: 4121785 - RNA, 79 nt, Human
ugccagugagagaggucggggacacugcaaauggauucugauucucugccccauuuguauguccuugggccuccuggua

SEQ ID NO: 4121786 - RNA, 65 nt, Human
ugccagugcuuucuuauaucaggcggauuccauguguggaacauccaugugagaauagacuagca

SEQ ID NO: 4121787 - RNA, 75 nt, Human
ugccaucagggaggaagagagaagaugguguuuccuccucugggaauguccuucuccucuuaccugccugaggca

SEQ ID NO: 4121788 - RNA, 80 nt, Human
ugccaucaguaggccugucagagucaaugcuucaguuucauaacuguaauuggauugucugacuuccuauucaauuggua

SEQ ID NO: 4121789 - RNA, 55 nt, Human
ugccaugcccaccucccuucugacaguguguagguugacagaaggaagcauggca

SEQ ID NO: 4121790 - RNA, 77 nt, Human
ugccauuuauuagcugggcuucaggguguuacuaaaccuguaugcuccuguuucaucagcuauaaaaugaaggggua

SEQ ID NO: 4121791 - RNA, 60 nt, Human
ugccauuucucaggcuauuucacaguaaaaccaaauuacagaucagcagaggaaauggca

SEQ ID NO: 4121792 - RNA, 58 nt, Human
ugcccacauaaaacuuuagagaacugccuuuuuuguucucuagagcaugugcugggca

SEQ ID NO: 4121793 - RNA, 62 nt, Human
ugcccacuagaaccaaugacauuucuggauuauucagauggcauuaauuucuagugauggca

SEQ ID NO: 4121794 - RNA, 56 nt, Human
ugcccacugugucaaagaaauagcaauggggcaagugugacuaagcagagugggca

SEQ ID NO: 4121795 - RNA, 129 nt, Human
ugcccagaaugcagagugacccaggcuuggaacgcacugugucuucucagauuuccugcagcagugcuagcagagaggggacaguggcaagauguguccaccaccauccguuccucaguaucugggaca

SEQ ID NO: 4121796 - RNA, 86 nt, Human
ugcccagcaggcagagacugauguuagauccuguacccagcugcugcugggagaagggacagacucagcuucugacugcaggggca

SEQ ID NO: 4121797 - RNA, 59 nt, Human
ugcccaugcaugacagauggcucugacaucacagaucccacccugugcaggcgugggua

SEQ ID NO: 4121798 - RNA, 64 nt, Human
ugccccaggaacuccagagcuccucucagcagugccuugaagagggcucugagugcuugggcca

SEQ ID NO: 4121799 - RNA, 80 nt, Human
ugccccaggaguuucagaaauuguuauuauucucaaaacaguuguuuaaagaauguuuuugauacugcugaagaugggua

SEQ ID NO: 4121800 - RNA, 92 nt, Human
ugccccaguguucuggcaugagagaugggggugucccagcguauguuccaaaggauaucccugugauugugugcagaaguacauguuaggca

SEQ ID NO: 4121801 - RNA, 74 nt, Human
ugcccccucugaggugagcccagcuggcccuuuaagaagcuggggccacugcuggcgccgcuuggagaugggca

SEQ ID NO: 4121802 - RNA, 73 nt, Human
ugccccgguggcuuauguccagcagauauuugugaaguccucaguguuucccuggcacaagaaccuccuggca

SEQ ID NO: 4121803 - RNA, 71 nt, Human
ugcccgucugccugcuaguggcugccucggcucaccagugggcaccaggagguggcagccaggcagaggca

SEQ ID NO: 4121804 - RNA, 77 nt, Human
ugcccuagcaugaguaacuauccacuggguagguucacugugaaucacgugguuugagaguacgcgugcuuugggca

SEQ ID NO: 4121805 - RNA, 57 nt, Human
ugcccucaagcaacagagaggagcuacuaccaggggcucuucuagcuucugagggua

SEQ ID NO: 4121806 - RNA, 70 nt, Human
ugcccugcaaugcagaggcugccugaggaacgucuguggccuccauuuggccucuguauuguacgaggca

SEQ ID NO: 4121807 - RNA, 77 nt, Human
ugcccugggcauuuuucucuguuacagcauuucacucuugaaaugaauggcacuuagcagggaaggugucuuuggua

SEQ ID NO: 4121808 - RNA, 130 nt, Human
ugcccuuagcagugggggcagcagagccacuuggagcgccggcucaggccacaggacggcagcccgaaaccugcccggccgcuggugcuggucagugcgacaguguugccgcccccacuggcagucagca

SEQ ID NO: 4121809 - RNA, 98 nt, Human
ugcccuuggcuuuaugccucuguuccacauuuguaaaaugaggaugauaauaguauauaccucauaauguuggaguaaggauaaaaauaaaugaggca

SEQ ID NO: 4121810 - RNA, 62 nt, Human
ugcccuuggguaacuugcugauaugugaagcaugcuucaguucacacacguuuccaagggca

SEQ ID NO: 4121811 - RNA, 111 nt, Human
ugcccuuuauggaaucaaguaaacaaagcaguaguuuucaaauaguuauuucaguucaaccacagagagcucagagaauuuacugcugccuacucccuuuagagauuagca

SEQ ID NO: 4121812 - RNA, 60 nt, Human
ugccgcauuguuggaaauuuaguuuuuaaaauuuuuaacauuauuuugaacaaugcugua

SEQ ID NO: 4121813 - RNA, 76 nt, Human
ugccuaggaugccuaggacaugcuggcgcucucccccaggcaggccagcuguuacuagagccacucugcauuggca

SEQ ID NO: 4121814 - RNA, 85 nt, Human
ugccuaggauugucauaagcuagcugcaccauauuuuucccaugcuuaaauugagauaguauguuucuggcuuugucuccuggca

SEQ ID NO: 4121815 - RNA, 66 nt, Human
ugccuaggcuggagugcagugacuugaucguagcucgcugcauccuugaacucccaggcuuaagca

SEQ ID NO: 4121816 - RNA, 91 nt, Human
ugccuaguacugagccuuguacuagaaaggaugucaaaucaguucaaaggaugauagacaucuaucuaguugcgaaaacaaguacaaggca

SEQ ID NO: 4121817 - RNA, 57 nt, Human
ugccuaguaggguuguuguagggauucacaaaaaggcccuaugcccagacuaaggua

SEQ ID NO: 4121818 - RNA, 69 nt, Human
ugccuauuacacaguaaaugguaaauacauguacgcaugcaagcauguaacaaugagcuguguagugca

SEQ ID NO: 4121819 - RNA, 79 nt, Human
ugccuauuauuucacauaauccuccaguggcagaugucuuuaucccuauuuaccagggaaauuaagugauuugggggca

SEQ ID NO: 4121820 - RNA, 85 nt, Human
ugccuauugguuugggagcauuuuaaauggcagaugcuuuugauccaccuuucuucugucucugagaugacucccacccacugca

SEQ ID NO: 4121821 - RNA, 85 nt, Human
ugccuauugguuuugaagcaacuguauuaauggaagcucucugacauggugaguucucaguaaaguucuuugaaauggauuuuca

SEQ ID NO: 4121822 - RNA, 78 nt, Human
ugccuauuuccagaugaggaaacugaggcacagagagcuuaaguaacaugcccaaagucacucagcuaggaaguagca

SEQ ID NO: 4121823 - RNA, 84 nt, Human
ugccucacuaauuuugaccauuauacacuggcuuguauuauacuuagcacacagcaggugcuuaaugauuacuuacugaaggua

SEQ ID NO: 4121824 - RNA, 123 nt, Human
ugccucagccucccgagaagcugggacuacaggugcuccaaggugcuugaguuuggaaacaugagacaaaaccagaaacagagacccugggagagucuguggucuccauuuuuccgcugagca

SEQ ID NO: 4121825 - RNA, 61 nt, Human
uggugaacugguaaucaguccacuuugaccagggaggaaaugauuucugccaaguucacua

SEQ ID NO: 4121826 - RNA, 63 nt, Human
uggugaaggguggcauggcaggcagugcucaugcccugcuuguggcauugcuaucucugacca

SEQ ID NO: 4121827 - RNA, 56 nt, Human
uggugacccugacuucuggccagcgcaggacgccccaggccccagccaggguauca

SEQ ID NO: 4121828 - RNA, 57 nt, Human
uggugagauaacuuucggcaagaucaugaaagacugaugcggaaaguaucuucauca

SEQ ID NO: 4121829 - RNA, 57 nt, Human
uggugagcgaugcugcauguuccucccccaccagggugcaucaagguacgcucucca

SEQ ID NO: 4121830 - RNA, 67 nt, Human
uggugauaugauauuuagucuauuagagcuguaaugaaagugguaaugacuaagcaucauuaaacca

SEQ ID NO: 4121831 - RNA, 55 nt, Human
uggugauauuacucaauggucacuccuaguuuuugaucagaagugauauuaacca

SEQ ID NO: 4121832 - RNA, 76 nt, Human
uggugauauugaaucugagaauggcuugccucaguucugugaggcuucaauguauucacauucaguucuuccacca

SEQ ID NO: 4121833 - RNA, 106 nt, Human
uggugauggaugaacugggaugaaugagagauuggauaugugacucaggaucauccucugaggagaaucuaucccaguuuaacucauuugauccaggcaauuacca

SEQ ID NO: 4121834 - RNA, 67 nt, Human
uggugcagcgguaaggagagccugaagggggcagugucacccccuggcucuggcuuccuguugucca

SEQ ID NO: 4121835 - RNA, 77 nt, Human
uggugcauguacuggaccaaaauuacagucgcuccuauuugggggccuauucuaaggcugguuaaugccuggcacca

SEQ ID NO: 4121836 - RNA, 57 nt, Human
uggugccacccuccuucagcugauuaaucaucucuucugcugggggcguggucacua

SEQ ID NO: 4121837 - RNA, 98 nt, Human
uggugccaggccucuagucuacuggccugagccaggcugaugcuggcaccaccgggccgccacccugagcugggccaggggaaugagcccucucacca

SEQ ID NO: 4121838 - RNA, 69 nt, Human
uggugccauucaccuguagaccauucaguuacaccacugagggagagucuuagguuggagucuucacca

SEQ ID NO: 4121839 - RNA, 81 nt, Human
uggugccuguaaucucagcuacuggggaggcugaggcaugagaauagcuugaacccaggaggcagagguuggagcaagcca

SEQ ID NO: 4121840 - RNA, 64 nt, Human
uggugcucugccuaugccagcuuggcacccgaagaugugugaguggacgugaggcugaguauua

SEQ ID NO: 4121841 - RNA, 59 nt, Human
uggugcugagaugaagugcuccaaauagcuaauggccugggcuuguucacucaguacca

SEQ ID NO: 4121842 - RNA, 82 nt, Human
uggugcugccuugcuuacuccacugcaaaaguuaauacgcaacauaagcaguaauuggggagugaaguaugguuguuaacua

SEQ ID NO: 4121843 - RNA, 62 nt, Human
uggugcuucacagcaugagcuuuggaguuaagccaacuucaguuguaauccuggauccacca

SEQ ID NO: 4121844 - RNA, 79 nt, Human
ugguggagauuugaauaaauugagagcgaauguccagucuuaaggagacauuuauuacucagguuguugauuuuugcca

SEQ ID NO: 4121845 - RNA, 60 nt, Human
ugguggagcaggacuagcugagaauccagagacuguguucugcuuccugcuucucuccca

SEQ ID NO: 4121846 - RNA, 57 nt, Human
ugguggaggcgcugcuggccaggcucaggcugcugcgaggucggcuccccuccauca

SEQ ID NO: 4121847 - RNA, 72 nt, Human
ugguggcccugucccaggccuccucuaggcuccgcccccgcgcccgaggacggcgggaggcgggguccgcca

SEQ ID NO: 4121848 - RNA, 57 nt, Human
ugguggcucacgccuguaaucccauaacuuugggagcccgaggcaggcagaucaccg

SEQ ID NO: 4121849 - RNA, 60 nt, Human
ugguggcuuucuuuacauggcuguauuaucugcuuucacaccuuagagagaaagccauca

SEQ ID NO: 4121850 - RNA, 58 nt, Human
uggugggagugacguugccuucuaugcauagcaguguugcaaaguuuagcucccacua

SEQ ID NO: 4121851 - RNA, 63 nt, Human
uggugggaguuauuuacaaaagauguauuucauuuguuacuguguguguaacaacuccuauua

SEQ ID NO: 4121852 - RNA, 87 nt, Human
uggugggccauaaaugugcagaugaauaaacaaauucuauauuuguauuugugaguuuucauuuguaaauuuuugucauguacacua

SEQ ID NO: 4121853 - RNA, 71 nt, Human
uggugggcccgcgucccgccgccgagccagagccaaagacgaggucggugcgcgaggcgcggucccacaca

SEQ ID NO: 4121854 - RNA, 61 nt, Human
ugguggggauacagacaugaaauuuuuucucaguagaaauaguuuucccugguucuugcca

SEQ ID NO: 4121855 - RNA, 90 nt, Human
ugguggggcugucaggcguggggaaccuuuccugagagaagaaaggagccgcucuccagguggguucccgacucuggcuggcucccacca

SEQ ID NO: 4121856 - RNA, 130 nt, Human
uggugggggccggggagaagcaguccuuguaacguugggcugggguccacugccuggaaaugacacacugggggaggagacaccggaagccucaaucugcagggacucacagacuccucucccccuucca

SEQ ID NO: 4121857 - RNA, 81 nt, Human
ugguggguaauauggaaaguguuuucuucuguugugcauuucugugcuacugagguugaauaucuuugcaaauguuuauua

SEQ ID NO: 4121858 - RNA, 58 nt, Human
uggugguguauuuuucauuuuuggaacuacuuguguuggaauuuuaugaacacuacca

SEQ ID NO: 4121859 - RNA, 59 nt, Human
uggugucagugugaggucuuccacccgggucuccuggcuaugacuucguacugucucua

SEQ ID NO: 4121860 - RNA, 125 nt, Human
uggugucccugugggaagugccucaugcauggcacugucugcaguaugagcuacccaggugucccugucaccugcucugguccagcuguuccagugccucaaggucccuuacaggccaaaagcca

SEQ ID NO: 4121861 - RNA, 58 nt, Human
uggugucuagugaaggccuacuaucugacuuauguaugauggcuucucacugaccuca

SEQ ID NO: 4121862 - RNA, 62 nt, Human
uggugugaggaacccggaauguggggugucugcgggugcugcaaguuccaguguuccuccca

SEQ ID NO: 4121863 - RNA, 63 nt, Human
uggugugggcagcagcagguaccucccaagcauaggcccugucuggugucccugucuacagca

SEQ ID NO: 4121864 - RNA, 88 nt, Human
uggugugguuauauagaagaauauucuugaucuuagaugacaggauacauuuaggagucaaauguuuuaggaucuguaagcuauuuua

SEQ ID NO: 4121865 - RNA, 56 nt, Human
ugguguuaauggugugaaagccgguaccaaggcugcucaauagaccauaauaucca

SEQ ID NO: 4121866 - RNA, 64 nt, Human
ugguguucucauuuucaaaaggagaauagccacagacuauucccuagagugauugagagcauca

SEQ ID NO: 4121867 - RNA, 86 nt, Human
ugguguugcaaagaaacuuucuccuucuagaggugaauuccagcuuuuacagucagaggagccaaaguucugagccugcagcgcca

SEQ ID NO: 4121868 - RNA, 104 nt, Human
ugguguugccauugauaguaauggacaaacuugggaaguaugccauuuugagggugagaaucaugaauccaaaguuuacuauuauaguguugaugggacaacca

SEQ ID NO: 4121869 - RNA, 74 nt, Human
ugguguuggugaguuucugaucacaagacuguuccgcgguccucuuguugccggaaagaucucgaccaccacua

SEQ ID NO: 4121870 - RNA, 119 nt, Human
ugguguuguuaucauaagggaauaaaaaguaucucuuguuuugucugauuuggggcacaauccccuuagugugugaagcauuaagugccucuaaaacaagccucuuauugaccacacca

SEQ ID NO: 4121871 - RNA, 57 nt, Human
ugguguuuuguuauggcagccugagcagacuaauacagcugccuuuagagagaacca

SEQ ID NO: 4121872 - RNA, 58 nt, Human
ugguuaauggcagccauuuauguaagggcggcuucuuaauuauggcuuccauugacca

SEQ ID NO: 4121873 - RNA, 60 nt, Human
ugguuacacagcauguggacuugaacaggaauagucugagccccgagucugugcuaacca

SEQ ID NO: 4121874 - RNA, 93 nt, Human
ugguuacuuguaaucauagucaagagcaucuauuucacaguggcaaugccaaaccuguuugauaauguuuacugacaauuacaggcuuagcua

SEQ ID NO: 4121875 - RNA, 86 nt, Human
ugguuagagaaaagcagggaucaggaauccuauuagcagaugagggcuuucacggaucuugguucccuuucaccucuauuucucca

SEQ ID NO: 4121876 - RNA, 55 nt, Human
ugguuaguguauauuuggacuguggccaaauccccacuaaauuguauauuaauca

SEQ ID NO: 4121877 - RNA, 66 nt, Human
ugguuauuaguuaacauuuugaaaggcaauugugaacaugucuuuuagaaaaguugaauguaguca

SEQ ID NO: 4121878 - RNA, 67 nt, Human
ugguucaaaaaguuaggcuuaguugagauuuguuggugugaacaaacucagcucuccuaaugaacua

SEQ ID NO: 4121879 - RNA, 65 nt, Human
ugguucaaaagcaccugguuuauauaaucauacauccuguaacauuguuaugaaucaggucacca

SEQ ID NO: 4121880 - RNA, 62 nt, Human
ugguucacagguccugggagcaggugggcagccaagccuuuugccccaggccccuggaguua

SEQ ID NO: 4121881 - RNA, 57 nt, Human
ugguucagauauggagcugggauuugaauccuaucaccagacucagaaguuuaacca

SEQ ID NO: 4121882 - RNA, 84 nt, Human
ugguucguugaggauguuccaacugauucaccaugguaggugugauugaaccauggaaaugauggaacauuaaaucaauagcua

SEQ ID NO: 4121883 - RNA, 71 nt, Human
ugguucuggaggagagccuggugugaacuacaaacaagccacugugaauaccaaugaaucccugagaauca

SEQ ID NO: 4121884 - RNA, 78 nt, Human
ugguucuucaucucaaggcauaaccuuuuuagaaucucaacugaaucuucaaaauguucugcuugggacagaagucca

SEQ ID NO: 4121885 - RNA, 83 nt, Human
ugguucuuuaaucuguaugacuaagaguguggauuggcugacauuaugagaugcaauuaauuuacaugcuuaaguuaggacua

SEQ ID NO: 4121886 - RNA, 73 nt, Human
ugguucuuucugguccuucuuuucuagucacccagauggccugacacuugagagggacacggaauaagcacca

SEQ ID NO: 4121887 - RNA, 78 nt, Human
ugguugaagaugaugaagaugugaaggcuggauuugauaaugaagagucuucuuuguguucucucauuauuuaugcca

SEQ ID NO: 4121888 - RNA, 66 nt, Human
ugguugaugcuggcuguuggcuggggccuuaauuuggccugucagcagaaacgccacaugcaacca

SEQ ID NO: 4121889 - RNA, 74 nt, Human
ugguugauggccguggccagggucagggaugagcguuccacagacccaugacucucauucacagucuucagcca

SEQ ID NO: 4121890 - RNA, 58 nt, Human
ugguuggcuuuucaaugccuguaaagagaauuagagauaggccacugaaugccaauca

SEQ ID NO: 4121891 - RNA, 60 nt, Human
ugguuggugugagguuucuuagugugaugcauacaagauuaaaacuuauaccaugcacca

SEQ ID NO: 4121892 - RNA, 91 nt, Human
ugguugguuuuuggaucauuaguaacucauggauauaaguauauuuguuuuguuuuaauccauggcaguuauuaaauuuaaaaauguucca

SEQ ID NO: 4121893 - RNA, 58 nt, Human
ugguugugguccuccacaucgcugcuguuguagcaggggugugggauggacugaacca

SEQ ID NO: 4121894 - RNA, 99 nt, Human
ugguuuaaaagagauccaguauauucuucagacuacugaugauugcuaacauuuaguacaucagaaacagagucaugaaauuguauugauauuaaacua

SEQ ID NO: 4121895 - RNA, 107 nt, Human
ugguuuaagccucuaaguuuugcgugugguuuguuguuauauagcuugcagauaagcagcaggcugccuaacccuuaagugucacaugcggaagaggcaaggaacca

SEQ ID NO: 4121896 - RNA, 59 nt, Human
ugguuuauauuuugugugaucucuuaaagaaauagagaucagagcaauggauaaaauca

SEQ ID NO: 4121897 - RNA, 82 nt, Human
ugguuucaguuuugcacaugugccuguggcacauccauagggaaguauguaggagguagauggauaugcagcuuggaacgca

SEQ ID NO: 4121898 - RNA, 68 nt, Human
ugguuuccccauucacaguauggacgaaaugaguuccuagaguacucagaguuggaauggggaaggca

SEQ ID NO: 4121899 - RNA, 55 nt, Human
ugguuucucagacucuuugcaguuuuucauuguacaaugugggcaugagaaacca

SEQ ID NO: 4121900 - RNA, 88 nt, Human
ugguuucugguuguuggcuguauccugaaccuuacuguaaaaugguaacaauaguguuugcuagucacaauuuuaaauuagaaggcca

SEQ ID NO: 4121901 - RNA, 73 nt, Human
ugguuugacacaagugagugaccagaguuggugucuucuuggaacugaccuuguguuaccauaugacaaacca

SEQ ID NO: 4121902 - RNA, 56 nt, Human
ugguuugggugugccauuuucauuuaguuuauuauugaauauggaaugccuggcua

SEQ ID NO: 4121903 - RNA, 75 nt, Human
ugguuugucccuagagaaucaaauuuuuucuucacucccauauuucagaacuugauacauuuuuaggauaaacca

SEQ ID NO: 4121904 - RNA, 59 nt, Human
ugguuugucggucugcaguguuguaccacccuggugcucauuaggacugcaaauuccca

SEQ ID NO: 4121905 - RNA, 59 nt, Human
ugguuuugcuaaaauagaaagauuaguuugaaguucauccugcuguuuugguaaaauca

SEQ ID NO: 4121906 - RNA, 67 nt, Human
ugguuuugugagcccauaaaugccaggaagccuccaagauuucuagcuuugugaaguuuacagacca

SEQ ID NO: 4121907 - RNA, 72 nt, Human
ugguuuuuaaguaccaaaguaggaauuugacccuaagcauuuuaugucagaguccaugguacuuaauuauua

SEQ ID NO: 4121908 - RNA, 130 nt, Human
ugguuuuuuugaggucaugugaguaaguuuguuacauauucuauuuauuucauguccguacauaaaggggauguuagaaauuauuaguaauaucaaugagguuugaaaaccacugacuccaagaagagca

SEQ ID NO: 4121909 - RNA, 90 nt, Human
uguaaacuguuuguucuucagaggggaaagaaccuguguaaucaccugaagacaaacggucuuaacuuuccagaagaugacagcuuuaca

SEQ ID NO: 4121910 - RNA, 77 nt, Human
uguaaacuugccaggcaccaaaguaugcuuuaggauaucaccaugacuagugcccuuugcugccugccaugguuaca

SEQ ID NO: 4121911 - RNA, 68 nt, Human
uguaaagacugaagcaauucaaccaguguuuauauauauauuuauagggaauugcuuaagucuauaua

SEQ ID NO: 4121912 - RNA, 66 nt, Human
uguaaaguuuuauuguuccuucuauaacuagugaauaucuuggaggagauacuuugaaacucugca

SEQ ID NO: 4121913 - RNA, 83 nt, Human
uguaaauagugacugcagugucaaugccaacaguauauagggcacuugccaugugccaggcauuacauuagguaacugagaca

SEQ ID NO: 4121914 - RNA, 79 nt, Human
uguaaauuaauggacaaugccaauacaguuuuauuuacagaaacagaguaagccuguaggccauuggccagaguuugca

SEQ ID NO: 4121915 - RNA, 68 nt, Human
uguaaauucagaagcacaaaaccuagaguucaccaagacucuuagagugacauguugcugaauggaca

SEQ ID NO: 4121916 - RNA, 85 nt, Human
uguaaauuuucagaugcuuacauagcccaaguguggaagacugaauucuguguucaacuauuuggcuguuguuagcaaugaugca

SEQ ID NO: 4121917 - RNA, 72 nt, Human
uguaacacugguauuucauuuagugagaauauuuacuccauaauagcuaaugagugcucgguguuugauaca

SEQ ID NO: 4121918 - RNA, 60 nt, Human
uguaacagagcuuuuuuauagcagcacacuuguagcagcuguugagugguuuuacuuaca

SEQ ID NO: 4121919 - RNA, 67 nt, Human
uguaaccugcagguccccggaugcgcaccccaacggcgccugcgccuacgggggccucagccuugca

SEQ ID NO: 4121920 - RNA, 91 nt, Human
uguaacucuuugcacaggggaguuuuaugcaacagacagaaacuuucugaguuguucugauugccugaagaugcccuguuuuagaggagca

SEQ ID NO: 4121921 - RNA, 74 nt, Human
uguaacugcuuagaagguuuuaguuaucacuuccuaucauauagaagcuuacuuuagauuuuuuuccaguugca

SEQ ID NO: 4121922 - RNA, 56 nt, Human
uguaagaaaaguaaauagugacccagaagaauuugggucacggucugauucauaca

SEQ ID NO: 4121923 - RNA, 90 nt, Human
uguaagcacagagauagcacaagcaacuacugaaguuagcaaaauugaggugcagaacucggugagggcuuagcuaacuguuagcauaca

SEQ ID NO: 4121924 - RNA, 58 nt, Human
uguaauauaccaaacuguaauuuuucuaccuuacaagaagaacgguuggguauuuaca

SEQ ID NO: 4121925 - RNA, 80 nt, Human
uguaaucgaauucuugaaagacagaaucugucaaucuaaaauuuugugaaaagauaagcuguuuuucaagaaugaggaca

SEQ ID NO: 4121926 - RNA, 77 nt, Human
uguaauugcuuguaaagcccugaaaguagcuuagauguuuuuaacaaauuguguauucagguuuucaaauaauuaca

SEQ ID NO: 4121927 - RNA, 83 nt, Human
uguacaaaauuaggauuucagagacccagaucuuuuggcagauagcuagguccugacgcccuuugaaaucggaauauaguaca

SEQ ID NO: 4121928 - RNA, 129 nt, Human
uguacaaaugaggaaauaguggcuucauaggauaaacgguugcucauaguuacauggcuagcuagaguuuugcugggaugugacuccaggcaguuuuguuccagagucauuauuuuuuucuuuucuaca

SEQ ID NO: 4121929 - RNA, 61 nt, Human
uguacaaugcugagguuugggguaugaauaaucccgucacccaggcacugagcauuguaca

SEQ ID NO: 4121930 - RNA, 103 nt, Human
uguacagaaugagggaaauugcaucaguuuauacuuauaaaucuuagugauucuccugggcauuuugagaugaucugacugauagugaucccuuaacuuuaca

SEQ ID NO: 4121931 - RNA, 95 nt, Human
uguacagaugagaguacaaauuagcuucuuacauuucauccucaugaaaacccaaggauguggauggaguauuuauuauucucauuuuaaguaug

SEQ ID NO: 4121932 - RNA, 76 nt, Human
uguacagggagccaaguccuccaugugacuaggucaucugaccagguccuuuugagggcuacuaguuuuuucugca

SEQ ID NO: 4121933 - RNA, 64 nt, Human
uguacuaaauguuuuaucuuccuggcauuggaaaaaaauggggaagaaauagaacauuuugaua

SEQ ID NO: 4121934 - RNA, 58 nt, Human
uguacuaaggcuguguagaugucaucucaauugauucuuucaacacaguuuuaaggca

SEQ ID NO: 4121935 - RNA, 69 nt, Human
uguacuacaugguuaagaugguaaauuuuaugcuacguauauuuuaccacaauuuuaaacaauggugca

SEQ ID NO: 4121936 - RNA, 64 nt, Human
uguacuauagguaauguagaccaugaaauuuguuuccguuggucugcauuaucuguaauggaca

SEQ ID NO: 4121937 - RNA, 60 nt, Human
uguacucacucucucaaggccucugagguuauuagcucaaaggcucagagcaguaguaca

SEQ ID NO: 4121938 - RNA, 70 nt, Human
uguacucugaggaugcugacuuccagauagccauuuuuggguuaagggaaguucaagucuccugaguaua

SEQ ID NO: 4121939 - RNA, 62 nt, Human
uguacuguaugccaggcacuauuuuaguauuccaugagaaaguaaagcagaguugcaguaca

SEQ ID NO: 4121940 - RNA, 89 nt, Human
uguacugucaguccccagcucccaguguuguuuucugaugccggcucccucucuguauugaacggcaaugggaacaagaaugacuauca

SEQ ID NO: 4121941 - RNA, 87 nt, Human
uguagaaacaguuggguuguaaaauaucacaucucuuuggugacagugcugugauguggcuuuucuaacccuuccaacuauucuaua

SEQ ID NO: 4121942 - RNA, 62 nt, Human
uguagaagacacucugcagaguuaucucccugaggaugaagucgcuggaguguucaucuaca

SEQ ID NO: 4121943 - RNA, 71 nt, Human
uguagagacacugucuucaguuucacugcauccucuucacagcuguaauuaaacugaagacagaagcuaua

SEQ ID NO: 4121944 - RNA, 72 nt, Human
uguagaguuccuugcccacaauaggucauuaauaaaucuuugauaagugggugaagaggaaauauuuccacg

SEQ ID NO: 4121945 - RNA, 64 nt, Human
uguagaguuguuguaggaauuaaaugagcuaauucauuugaaauucuuagaacaaaaacucaca

SEQ ID NO: 4121946 - RNA, 61 nt, Human
uguagaugagucagggugcaccgggguaccagcauuccacaugcacccugacucaucuaca

SEQ ID NO: 4121947 - RNA, 61 nt, Human
uguagaugagucagggugcauguggaaugcugguaccccggugcacccugacucaucuaca

SEQ ID NO: 4121948 - RNA, 75 nt, Human
uguagcgguucccucugccagcuauuuuuagcauuguugcugccagcugacagcagagacaaaggcaccgaggca

SEQ ID NO: 4121949 - RNA, 61 nt, Human
uguagcugucagcaaucaagugguuaccagcaaagugaaaacgauggucauugcagcaaca

SEQ ID NO: 4121950 - RNA, 71 nt, Human
uguaggaagccuuauggggacaguuuugcucuauugacaacaucaguccucaugagacaagugaaacuaca

SEQ ID NO: 4121951 - RNA, 57 nt, Human
uguaggaggcagagagggaaagagcagucuuaggucucuuuacauuugccucuugca

SEQ ID NO: 4121952 - RNA, 55 nt, Human
uguaggccccauuccucaaagauuguaauucaguaaguuugaaggauggccugga

SEQ ID NO: 4121953 - RNA, 77 nt, Human
uguagggcccagagcagguuaacaguaaacaucacagaaaaaaugaauggauccugugcucuuuccacggccccaca

SEQ ID NO: 4121954 - RNA, 56 nt, Human
uguaggguucacccagcuaccucccuuucccgagaguucaaauggguagauucaca

SEQ ID NO: 4121955 - RNA, 65 nt, Human
uguagguaccuaaauggauaucauuucagggauaaguugacccuuuucauuugggaaaaucugcg

SEQ ID NO: 4121956 - RNA, 65 nt, Human
uguagguuuucuuauacuuuucauaguccacauuuuaugaaagcacgugggaagauaaaucuaca

SEQ ID NO: 4121957 - RNA, 80 nt, Human
uguaguaaccuaaggaggccuuugugcuccauuaagugguuuugcaaguuggaauacagggccuuugauggauuauaaca

SEQ ID NO: 4121958 - RNA, 70 nt, Human
uguaguccuccaagugaaagauauaugucacaucuccaggugagagacaggauaucugcucaugguuaca

SEQ ID NO: 4121959 - RNA, 55 nt, Human
uguagucuguuaaaguaagagcaagcaagcuuugaacucuuacagaauagacaca

SEQ ID NO: 4121960 - RNA, 65 nt, Human
uguaguguggccuaucuuugccagaggugcuugagaggucggugugcaggcaaagaugcauugcg

SEQ ID NO: 4121961 - RNA, 77 nt, Human
uguaguuaccauagaugguuagcucugggguugccaauccgaugcugacagagcagguaucuuuggugaaugaagca

SEQ ID NO: 4121962 - RNA, 88 nt, Human
uguaguugcuuuuuuaaaaauauagcggguccauagaaaauuaucauuuucauuugcuguuuacuguguuuugauuaaaaagcaaaca

SEQ ID NO: 4121963 - RNA, 66 nt, Human
uguaguuuucuucccucaaggcauguuuuaucuaacacuguuuuagggaagaaaauaaaagcugca

SEQ ID NO: 4121964 - RNA, 104 nt, Human
uguauaaaagcuuucccacauucauuacacucauaagguuucucucuaguaugaauuuucugguguguaaugaaguuuuucuuguggcugaaggcuuuucugca

SEQ ID NO: 4121965 - RNA, 74 nt, Human
uguauaacauuauacagagaggacagugguaaacuuaggacugcugcccuuucuauaugauguaauuuuauaua

SEQ ID NO: 4121966 - RNA, 78 nt, Human
uguauaagucacagguccuuauaagagcacucaggaauugucucucacuuguaguacuucagaccuggugaugauaca

SEQ ID NO: 4121967 - RNA, 65 nt, Human
uguguguguguauaaaagggaugaauaaaauuauuuaccugaucaucuguuauugcauguacaua

SEQ ID NO: 4121968 - RNA, 76 nt, Human
uguguguguguguguguauguguguguugaugucauaagaggucaguaucuugcuuauagacacauuuuccauaua

SEQ ID NO: 4121969 - RNA, 81 nt, Human
uguguguguguguguguguguguggucaugacugcccuccuuucacucuagcucaaucccuuacagccuauucaccacaua

SEQ ID NO: 4121970 - RNA, 72 nt, Human
ugugugugugugugugugugugugugugguguguguguguguguugugugcaugcaaacacguaaacauuca

SEQ ID NO: 4121971 - RNA, 88 nt, Human
uguguguuagaguuguuuuuagauccuuucauuugguuauaauaaagcagauggagaccuuggaugaacuggacacaacuugcacaua

SEQ ID NO: 4121972 - RNA, 65 nt, Human
uguguguuauuuucagccauuaaguucauagugaucuuuuacgauguauggaaaauaaacacaca

SEQ ID NO: 4121973 - RNA, 67 nt, Human
uguguguugauaggcauucauuggagaaaauuuguguuuccucuuauacaguguuuauuaaaauaua

SEQ ID NO: 4121974 - RNA, 81 nt, Human
uguguguuguguauguguguguguguuugucaugguacuggaggacgacaaaauaauuacuaacuuguacacagccuaaca

SEQ ID NO: 4121975 - RNA, 73 nt, Human
uguguuaaggugcaucuagugcaguuagugaagcagcuuagaaucuacugcccuaaaugccccuucuggcaca

SEQ ID NO: 4121976 - RNA, 55 nt, Human
uguguuaccugcacuggauuucugcucugcuugacuaaaagucccagcuaacaca

SEQ ID NO: 4121977 - RNA, 66 nt, Human
uguguuacugacacauuuuuguccccaauaagucuuuuucuuauagauuaguguuucaguugcaua

SEQ ID NO: 4121978 - RNA, 66 nt, Human
uguguuaguaacuaccuuuauugcauggacaagacaggucuauuaauugcuugaguuaguaauaca

SEQ ID NO: 4121979 - RNA, 74 nt, Human
uguguuaguuacucucaugccuaagacaaucauaaaaaucccaaguuugaaaagcaaaugaguuaacuaacuca

SEQ ID NO: 4121980 - RNA, 75 nt, Human
uguguuccaguucucguucggaacgcacguggagagcggaguaaaauguguguaugaacgaaagaauggauggca

SEQ ID NO: 4121981 - RNA, 55 nt, Human
uguguucuggcugugacagcugauuacagaggggcagcugggagggcagagcaca

SEQ ID NO: 4121982 - RNA, 126 nt, Human
uguguugcuggguuucuuuuguuguuguuguuuuacuugucuuguguguuuggggugauucaggacacuggauguucaucaacacauuacaaggcguagaacuuuuucugcuuauccugugacaca

SEQ ID NO: 4121983 - RNA, 72 nt, Human
uguguuggcuuauuuugcugaugacccaggcauugucaugugccucucauccuagugaaaaugaguggcaua

SEQ ID NO: 4121984 - RNA, 89 nt, Human
uguguugucuguagugugugacgugauuugaugugauggaaaagggaagcacauauauauauagucacacuuugcaggcacuuuacaca

SEQ ID NO: 4121985 - RNA, 63 nt, Human
uguguugugucaccuaucaugcgcagggcugcuauccaugaccugauuuucugaaacagcaca

SEQ ID NO: 4121986 - RNA, 106 nt, Human
uguguuuaggaauauccuggggguuuuguuaaaaugcagauucugacaaaguuaaucugggauggguuggagaugcugcauuacuaacaaacucccaggugauaca

SEQ ID NO: 4121987 - RNA, 58 nt, Human
uguguuucuugacgcugcucuaaggucucaccacagccuggcagucucaagcagcaca

SEQ ID NO: 4121988 - RNA, 66 nt, Human
uguguuucuugagcaauauagguuguaaaugucuuuauauauaaauuaaugugcccaugagacaua

SEQ ID NO: 4121989 - RNA, 72 nt, Human
uguguuugauagaugcagaucucagugugcuguuguuucauauaauuaagcaccuguugcacuucauaauca

SEQ ID NO: 4121990 - RNA, 60 nt, Human
uguguuugcagcagaaaagcagacacuaaacugaaauguguaaugccugugauaagcaca

SEQ ID NO: 4121991 - RNA, 73 nt, Human
uguguuuguauuugucuauguguaauagcauguguguacaguacaugcaugcacauauacacacauuaacaca

SEQ ID NO: 4121992 - RNA, 70 nt, Human
uguguuugugugugcauauguguuuuccuagugguuacaugcuuacuaggcaauuauguaaauaagcaca

SEQ ID NO: 4121993 - RNA, 87 nt, Human
uguuaaaacacaaauuguugggacucagccccaaaguuccugaugcaguaggucugggcuggggcucaauaauuuguauuuaucaca

SEQ ID NO: 4121994 - RNA, 82 nt, Human
uguuaaaaugcagacuccagggcuccaccccagauugagucagaaucugaagagguaaggcccuggacacagcauuuuaaca

SEQ ID NO: 4121995 - RNA, 125 nt, Human
uguuaaauagcaucaauguuagucuacucuguuuuugcacaugaaacuaggccaaucaaauuauuguuccaagcugaauaauuugugguuuagguuucauggccugacagugaugucuaaugaua

SEQ ID NO: 4121996 - RNA, 101 nt, Human
uguuaaauauuaagguccaagagguaaagguuuagguguacgauguugcuauuuuauaccucauucuuagcaaaaggcuuggcacauuguauauguuaaua

SEQ ID NO: 4121997 - RNA, 90 nt, Human
uguuaaauuaggcaugacuuuaacuucugacaugauggcucguauauuuguguggaacaaaauguugggagaaaguuguggaguuuuaca

SEQ ID NO: 4121998 - RNA, 67 nt, Human
uguuaaccacucaaggauucuggaacagaagcuaacaguuuucugcaacgagucuuugacuuaaaca

SEQ ID NO: 4121999 - RNA, 130 nt, Human
uguuaaggaaaugucagcacccugccauucauggugacugccucaguuucccugcagcccaggaagagggucgcagcuaauauagauggaggcaggauucagauggcuuucuuugcuacacucuggaaca

SEQ ID NO: 4122000 - RNA, 57 nt, Human
uguuaaguugccaguguaugacggaagcagcguuauuaaacgaacgcagcuuguaca

SEQ ID NO: 4122001 - RNA, 80 nt, Human
uguuaauaagcuggaacaucuugaggaagucacuaaagugcauuaguuucuguaucuauaagauguucauagcaauaaca

SEQ ID NO: 4122002 - RNA, 57 nt, Human
uguuacaaagcgcuuuaccucugaagcaugucucaggggcagcugugcuuugugcca

SEQ ID NO: 4122003 - RNA, 57 nt, Human
uguuacaguacuacaauucugccacaacuuuaagccucauuuguggagacuguagca

SEQ ID NO: 4122004 - RNA, 65 nt, Human
uguuacaugagcccagaaaucucccuuugauggcuugcacuagugggaguugggucucugucaca

SEQ ID NO: 4122005 - RNA, 119 nt, Human
uguuaccuggauuaucucauuucuucccucuucaaguaugagaaaggggacugaggagaaaggaacaaucugcagucaggcugacaggcuaggagggaggaaagauagacuugggaaca

SEQ ID NO: 4122006 - RNA, 126 nt, Human
uguuacucaaaaugugauugcagaucaauggcaucagcaucaucugggagguucuuagaacuacagaaacagaccucuccagaucugcugagccaggcucugcauuuuaucaaaaucaucagagca

SEQ ID NO: 4122007 - RNA, 77 nt, Human
uguuacugagggcacugggucuucuuuugaacauaucuuuaucagaccaaaggaagaugccaggacucuguguggca

SEQ ID NO: 4122008 - RNA, 66 nt, Human
uguuacuguguacuuaaucuguacuggacaaugguguaugugcauggauaaaaguauauuauaaca

SEQ ID NO: 4122009 - RNA, 65 nt, Human
uguuacuuaucucacgugaugcaaguaaaaaucucuguuaucaugacaucugaguuuaaguaaca

SEQ ID NO: 4122010 - RNA, 101 nt, Human
uguuagaaaaggaagaacacaugcgauagagagguaggaaauagaaucaacaugguuagaucugucauuucauuauuucauguguuuuacuacaguuaaca

SEQ ID NO: 4122011 - RNA, 73 nt, Human
uguuagaaugcucugagugaaaguuggauguguucuucuacaaauaaaaugugugaacuucagagcaucgaca

SEQ ID NO: 4122012 - RNA, 97 nt, Human
uguuagagaucugacuggcagcuucaggacacucggaagcaagggggacacucuauuaaggaucgcugaaguaugcccacaugucagguuucucuca

SEQ ID NO: 4122013 - RNA, 123 nt, Human
uguuagccuuccauaacacauuaaacauuuuauguauggauggcugaaaguauugagaaaagcugaaaaacuguuagccuuccauaacacauuaaacguuuuguguauggauggcuuaggaca

SEQ ID NO: 4122014 - RNA, 83 nt, Human
uguuaggcuggugcaaaaguaauugcuguuuugccuguacuuuuaauggcaaaaaauccaacugcuuuugcaccaaccuaaua

SEQ ID NO: 4122015 - RNA, 68 nt, Human
uguuaggcuuguuacaaaacagucaucucuugcaaagcaccugaagguugauguggaaagucugagca

SEQ ID NO: 4122016 - RNA, 83 nt, Human
uguuagggcagauauugggaaagaaacugacuaauugacccaggcuuucauuucaggcucaguuugguuuccauugccuaaca

SEQ ID NO: 4122017 - RNA, 84 nt, Human
uguuaguauuccuggauuccuaaccuuucacacgugcagccaucacugugggaacacugaggacuucaggaauggcucuugaca

SEQ ID NO: 4122018 - RNA, 87 nt, Human
uguuauaauuaauucaguagaaggggggcuguaguucucaaaugaucauuacagccucacauuuacuuacaagaguaaauaaugaca

SEQ ID NO: 4122019 - RNA, 89 nt, Human
uguuauacccuuugucaagcacagaagaaauaauggaaacuacauucaccuuuauuuucuaugcuugauagaacuagugguguauagca

SEQ ID NO: 4122020 - RNA, 74 nt, Human
uguuauagccuuauaugaacuauuagagcaccugccaaaucugcucucagugcagagaggcuaucuuuccaaca

SEQ ID NO: 4122021 - RNA, 67 nt, Human
uguuaucacucacagugcuauugacucaguccaggcacugaacuggacaccaggcgcucugagaaca

SEQ ID NO: 4122022 - RNA, 81 nt, Human
uguuaugacaaguguucuucauauauaaaguggaauaguaauggcuaagugacauaauguauaugaagugcuuggcaaaca

SEQ ID NO: 4122023 - RNA, 65 nt, Human
uguuaugcuaagugagaaaagacagucucgaaagguacauacuguaugguuccacuuauaugaua

SEQ ID NO: 4122024 - RNA, 67 nt, Human
uguuauuuaacuuuguagcaugggaaagauaguuccugucaagucauguccacaaaauugaauuaca

SEQ ID NO: 4122025 - RNA, 108 nt, Human
uguucaaagucuggcauuuagaaggugcucagcauacaucuguuaaaugaaucagguugagaaugaagcuggguggugcugagccuugcuguuauugcugcgggaaca

SEQ ID NO: 4122026 - RNA, 78 nt, Human
uguuccacugguuuuggaaaucaguacaagcugcuauccaguuugcaguaccucaguuccaaaaagcuuagugaaaua

SEQ ID NO: 4122027 - RNA, 55 nt, Human
uguuccaggcugcaagcaucaugggaucaucugauauacagcaaagucuggagca

SEQ ID NO: 4122028 - RNA, 74 nt, Human
uguucccacgugucuacugugcauuugaagaugaagauuauuuauguuuagagagcacuguagacacuuagaua

SEQ ID NO: 4122029 - RNA, 77 nt, Human
uguucccaguguucccugaacauauguugucuugagcagcuguguguccugggagcccuuuuguuaccaagggaaca

SEQ ID NO: 4122030 - RNA, 106 nt, Human
uguuccuaguagcccuuuagccauagagaugguagaacagucauaaggacuuguuuaauuccuuauaucuuuuuacaucucuccuucggguguuacuaccauaaca

SEQ ID NO: 4122031 - RNA, 56 nt, Human
uguuccuguuuaaugugcucaucauaaugcagugaaugacacuccagcggagaaca

SEQ ID NO: 4122032 - RNA, 76 nt, Human
uguuccuuuaaaauaauggugacuauauuguaucuaaaaauaaauaucaaaagaucaaagucccuuagugggagca

SEQ ID NO: 4122033 - RNA, 130 nt, Human
uguucgaugguuugggggugcuggugguccaggugccugggcaugagcuuguuggagucgaugcccuggcugaacagcaacugcucaauguccaggcucagguacugcuguuuccuccuggucaagggca

SEQ ID NO: 4122034 - RNA, 66 nt, Human
uguuuguuuguuuggaauauguggccuguguggaacuggacacugaagucacuaagcaggcaggca

SEQ ID NO: 4122035 - RNA, 79 nt, Human
uguuuuaaaagcagcucaagacuuaaauuugaguugaaaauuucuuauagcaaaugugacuuuugggcuucuaaaaaca

SEQ ID NO: 4122036 - RNA, 95 nt, Human
uguuuuaaauaguagggcuuacuuuucuauucgauaugugugguuuauaaaaacucgccuguauggagaagcaaggccugugauaaucuugaaca

SEQ ID NO: 4122037 - RNA, 96 nt, Human
uguuuuaauugaugguagaaaauuauugaaaauggcucuaaaaauaaauucaguagaguucauaauaauuuuaaaauaagcauuaaugauaaaaca

SEQ ID NO: 4122038 - RNA, 60 nt, Human
uguuuuacugaaaaugauuacuugauaaaaacauugucuagaaauagguuucagaaaaca

SEQ ID NO: 4122039 - RNA, 69 nt, Human
uguuuuauauauauguaauauguguguguauauauauauacacacguauauauacguaugugcgaaaua

SEQ ID NO: 4122040 - RNA, 60 nt, Human
uguuuuauuaaagguguuuuucuaggaggaaaaucuguagaaaagcaagggaguagaaca

SEQ ID NO: 4122041 - RNA, 80 nt, Human
uguuuuauucaugugagugaaaggacagaaaauuguacuuaauacugcacagaucugucaccauucagcuugaauugaua

SEQ ID NO: 4122042 - RNA, 70 nt, Human
uguuuucagaaccauuaguucauuauugcuuucuuuaaaagaaggcaacuguuugauaauguugaaaaua

SEQ ID NO: 4122043 - RNA, 64 nt, Human
uguuuucauguugcagcucagucagaaauauuuuuuacuggccuuuugcugaacaaggaaaaua

SEQ ID NO: 4122044 - RNA, 90 nt, Human
uguuuuccacuuucaacuguacgcuucauaagacauucauuauuucccaagauguucaaaaaagauacagugaaagggcauugggaaaua

SEQ ID NO: 4122045 - RNA, 119 nt, Human
uguuuuccgagucugcucugcggauagugagagaggaugcccucauauuuuaccaugagaguaaaguguuagugaaagguguuuauuucugcuuugccucagagacagagcuuggcaca

SEQ ID NO: 4122046 - RNA, 72 nt, Human
uguuuucugucacuuuuuuggaaucugugguuuauuauuauaauaagauuaacgaaaaagugacaccuaaca

SEQ ID NO: 4122047 - RNA, 64 nt, Human
uguuuucuuccuuuuaggucuguuaugcuucuguuauuggcaggacagccagaggaggcagaca

SEQ ID NO: 4122048 - RNA, 74 nt, Human
uguuuucuuuuaucuuuauuuugauaugauuucaaacuuauagaaagauuggaagaauaggauagaagaacaca

SEQ ID NO: 4122049 - RNA, 86 nt, Human
uguuuucuuuuucuucuuaguacauuugggacaauaagagaagacuuauuugcuuuuuaauguuccaugugagauuuaagggaaca

SEQ ID NO: 4122050 - RNA, 63 nt, Human
uguuuugggguauuuucaucauuuuaaucuggaugauguuauuuucagaaacauccuaaaaca

SEQ ID NO: 4122051 - RNA, 67 nt, Human
uguuuugggugugcuaagagcacuuucaaugauucuaaauugagaugagcuucagacacacaagaca

SEQ ID NO: 4122052 - RNA, 56 nt, Human
uguuuugguuuucaccgagucccccuggccagaguggagcuaugaaaaccaaagca

SEQ ID NO: 4122053 - RNA, 62 nt, Human
uguuuuguuagcaaggauaauuaugauucagaugcuguaauuuuaaccuugacuaacaugca

SEQ ID NO: 4122054 - RNA, 85 nt, Human
uguuuuuaaagccagauauacagcagugaauaagauaaaugaaucauuuugagcuuauaauugauguguggauauggcaaaagca

SEQ ID NO: 4122055 - RNA, 79 nt, Human
uguuuuucuagagacaucaucaugaaucauaacuucacuucauuauggucccugaucuaaugucucaucagagagguca

SEQ ID NO: 4122056 - RNA, 72 nt, Human
uguuuuuuagagauggggucucucuauguugcucuagccugugcaacagggaaaucucagcucuaaaauuca

SEQ ID NO: 4122057 - RNA, 79 nt, Human
uuaaaacucgaacuauauuuuucugagcaguguuuggagaaaagccuugcugaagaaaaaauauguuagauuguuuuga

SEQ ID NO: 4122058 - RNA, 85 nt, Human
uuaaaacugacggucuucauucucauagcccugggaagacauuuagguguuuuaauggggguugcagaaguacucucaguuuuaa

SEQ ID NO: 4122059 - RNA, 57 nt, Human
uuaaaagaauccuguuauccucaggccucugccuuguaggaagauccuuucuuuuaa

SEQ ID NO: 4122060 - RNA, 63 nt, Human
uuaaaagagacuuccuuuguuuccuagccaagggcacauaagacaaaagaagcugccuuuuaa

SEQ ID NO: 4122061 - RNA, 95 nt, Human
uuaaaaggaaaagugaucugugcagauagugauuucagaagcguccuuugaagugcuucuguuuauucugcaggauuuucucacuugccucuuga

SEQ ID NO: 4122062 - RNA, 87 nt, Human
uuaaaauaauugugggcagugugauauugacccuugcaagccacauucuugcccugcagauacacugcugccacacagcuggguuag

SEQ ID NO: 4122063 - RNA, 57 nt, Human
uuaaaaugguaccuauagaugucuaggucuuauagaaguguuuggggaucauuuuaa

SEQ ID NO: 4122064 - RNA, 125 nt, Human
uuaaaauuauaugggagcucauuaaaaaauauauaugccaggaugccucccaggagugagccugauugaauaagccugggaaggucuuagcaucuauauuuuaacaagcucaccaauaauucuga

SEQ ID NO: 4122065 - RNA, 67 nt, Human
uuaaacaauuaagacuauugauauuuacaaauauuuuuuagugggcaucagugucuuauguguuuga

SEQ ID NO: 4122066 - RNA, 55 nt, Human
uuaaacaccaagugcaaaccacuguucuaggcacuggguaccggaagguguuuaa

SEQ ID NO: 4122067 - RNA, 79 nt, Human
uuaaacagcuauuuuuuacacaucuguuuggcccuuuugcacgacaugcagucaggagguguaacgaauacagguuuga

SEQ ID NO: 4122068 - RNA, 68 nt, Human
uuaaaccaccagaagccauuauugcucaugacccugugaguugcauggggacuuccuggcugguuuaa

SEQ ID NO: 4122069 - RNA, 65 nt, Human
uuaaacugcagacucaguguucagaaugggaaaacuauaaaguucgagaacugagaugcguuuga

SEQ ID NO: 4122070 - RNA, 74 nt, Human
uuaaacuucugagcucaagcgauccucccacuuggaccuagccaggugcugggauuauggguauuagaguuuaa

SEQ ID NO: 4122071 - RNA, 61 nt, Human
uuaaagagaacucaaugaaugaauaugugaaugaaugcaugagucagugaguucuccuuga

SEQ ID NO: 4122072 - RNA, 89 nt, Human
uuaaagcuguaaacuuuccccaagugaauguuugguagcaguguucuaucucugcgaccacuaugcccuguucacuuuuacgguuuuaa

SEQ ID NO: 4122073 - RNA, 66 nt, Human
uuaaaggcuaugauauuauugagacaagcauaaaaaugagugucuucuucauucaucgguuuuuaa

SEQ ID NO: 4122074 - RNA, 68 nt, Human
uuaaaggggaguuagugauaaaaccaaggcagcacuuuuguguaucaaagcacagacuucaccuuuga

SEQ ID NO: 4122075 - RNA, 84 nt, Human
uuaaagugguaaaugauaccgaaacugcccggauuaucacuagauauucaggcaaggcuggucucauacucugguucacuuuaa

SEQ ID NO: 4122076 - RNA, 83 nt, Human
uuaaaguuugacuguacucauugaacugugcuugaucauuaguaauggcagcuaucuuuaaugagaugcaugucacccucuag

SEQ ID NO: 4122077 - RNA, 80 nt, Human
uuaaauauuagacaacucaaucacacucugcucuuuguagguaagacagacguagugugagaguaaaaugaaauaauuga

SEQ ID NO: 4122078 - RNA, 77 nt, Human
uuaaauauuggaaaacacaagugacugagcaguauggucacuuuacagcuuuucauauuuguguuauauaauuuuga

SEQ ID NO: 4122079 - RNA, 69 nt, Human
uuaaauuuuaucugcugucuguguaaacagaccaaguucucacucuauguagcagcagaaagaacuuag

SEQ ID NO: 4122080 - RNA, 60 nt, Human
uuaacacagggggagacaaaguuguaguuuuucuacuccuuugccuucacuccuguuuaa

SEQ ID NO: 4122081 - RNA, 83 nt, Human
uuaacagauuguaauaugguuuuucuagagcauacauugguaauauagcuuuugcucuagaaaaccaauauuacaugaguuaa

SEQ ID NO: 4122082 - RNA, 63 nt, Human
uuaacaggaguaacucuagaaagcugacccugaggauucuagaacuguuuacucacugauuaa

SEQ ID NO: 4122083 - RNA, 55 nt, Human
uuaacauuguccuuagcagauuucuaauuuuugguuuguucaggggcaaaguuaa

SEQ ID NO: 4122084 - RNA, 71 nt, Human
ugugagcuucaucuauugccagguguccuauagaugucuuagacacuucaaaugguuggaaaaugcucaca

SEQ ID NO: 4122085 - RNA, 58 nt, Human
ugugaggcgaggccagugagcuuuccuggugaggugccacuggcaaccccgccucaua

SEQ ID NO: 4122086 - RNA, 61 nt, Human
ugugagggcagaggcugugggucgcuguggagcaacuucaguguuuacucccugcccucca

SEQ ID NO: 4122087 - RNA, 66 nt, Human
ugugaguuacauuuggugacacuucaaacuaauuuugaagauucacugaguauaaucaagaucaua

SEQ ID NO: 4122088 - RNA, 64 nt, Human
ugugaguuugugcaauggugucaccuacgguaugaauacuggaggaacaauugauaaacucaca

SEQ ID NO: 4122089 - RNA, 69 nt, Human
ugugauauaaugacagagcacugaacuuggggacuuuggcucaauucacagcucugcuauuuaugcaca

SEQ ID NO: 4122090 - RNA, 80 nt, Human
ugugauauugcuaauuuaacuaccuuguuuaaaagcauuagugaaguccaguguaauaagugguauaaguuggggucaua

SEQ ID NO: 4122091 - RNA, 81 nt, Human
ugugaucagaagacauucucauaaggauucauauugaaugaaauaggauucugaucuauaguguuauauuucugaugcaca

SEQ ID NO: 4122092 - RNA, 87 nt, Human
ugugauccaaaucaugucagaagaacagacucacauguggucaaaaauguguuggaucggguacucugguguuugguuuggaaaaca

SEQ ID NO: 4122093 - RNA, 59 nt, Human
ugugauccaagaucaaauuaugccauagcuuugcaugcacugagagauguuggaucaua

SEQ ID NO: 4122094 - RNA, 56 nt, Human
ugugaucugaaggagcucugaacccuccagugagacaucagcccaucagacucaca

SEQ ID NO: 4122095 - RNA, 63 nt, Human
ugugaucugaaucaauagaauaacucaucauuacucugaguugcgaggcaagauuuagacaca

SEQ ID NO: 4122096 - RNA, 62 nt, Human
ugugaugcugacuguuuaguggagugauaccaaacaaccauggacaggguuucagggucaca

SEQ ID NO: 4122097 - RNA, 59 nt, Human
ugugauucagaauaugaaugguauuuaauuucuuugaaaucauuaauugcugagugaca

SEQ ID NO: 4122098 - RNA, 66 nt, Human
ugugauucaguguggcccaugaagaggauaaaguuaaaugccuuugauacggugacacgaaauaca

SEQ ID NO: 4122099 - RNA, 70 nt, Human
ugugcaaucuguugacuggacuucauagguuuguuaagaaugucagggaggguccaucaaggacugcaca

SEQ ID NO: 4122100 - RNA, 123 nt, Human
ugugcacacagcagcugcgugaucuauggaguuggcugagcaguuuggcgcguuggucagcaacuuccugcagcuucucagcccacgcagauccucaggucugcagugcugggcuuguguaua

SEQ ID NO: 4122101 - RNA, 60 nt, Human
ugugcacagcaaguugguagugagauaucaccugcugggacacugaagacuucuugcuca

SEQ ID NO: 4122102 - RNA, 66 nt, Human
ugugcacaugguagguauugaguaugugaauuauugaacauguacuuuagauaaauuaugugcaca

SEQ ID NO: 4122103 - RNA, 65 nt, Human
ugugcaccugguaaacacuuuguauaugguacuuaucauuauuaguguugauauuaggauggaca

SEQ ID NO: 4122104 - RNA, 87 nt, Human
ugugcacgggcgugcaaagacaugugcaggcacauuugaaugugugcgacauagugugcacauaugugucugcacaugcccuguaca

SEQ ID NO: 4122105 - RNA, 66 nt, Human
ugugcacugaugaggcaauagguacuaugcugagugcguuacaaggauuguuucauuuaauguaca

SEQ ID NO: 4122106 - RNA, 130 nt, Human
ugugcagauuugauccuaucaucauguuguuauuuggcuguuauguagacuucauuguuuacuugcuuuauagugucaauggucuauguacucgaguauauuuuugugauggccaguauuggucuguaca

SEQ ID NO: 4122107 - RNA, 61 nt, Human
ugugcagcccaugggggauagagaugaauaaacugcaguuucugcccuccaggagcucaua

SEQ ID NO: 4122108 - RNA, 125 nt, Human
ugugcaggagcccuggcccuggccccugccucuccccgacucuggucagcgccuggagcgagccucaggugcuguuggcagcgggcagagaucaggcaggggcaucccagggccaggcucugcca

SEQ ID NO: 4122109 - RNA, 79 nt, Human
ugugcaguguguccucagaauauauaccuaagaguagaauugcugaauuguagcuauguauucucagauuuacuaagca

SEQ ID NO: 4122110 - RNA, 126 nt, Human
ugugcaguuuggcgaagccgugcagccaccgcacccugugccuuuguagcugugccugccugugggcaaagcgcacucccaaggccaggcugccccaggugcaggccucuuugaccucacugggca

SEQ ID NO: 4122111 - RNA, 73 nt, Human
ugugcauggaggauaauaauugagaaagugcauaagaugaaauaauugcuuccuuaggucuucuuggugcaca

SEQ ID NO: 4122112 - RNA, 71 nt, Human
ugugcauggcugcugcagagcuggaggggguaaagcaacaguguuuucucaguugugcgagcagcauuaca

SEQ ID NO: 4122113 - RNA, 82 nt, Human
ugugcaugugugugguuugcauuaugauuuugugugauuauaaagauacguuugugcaagagauucaaaccauaaaggcaua

SEQ ID NO: 4122114 - RNA, 56 nt, Human
ugugcauguucucauuucuaacuuauuuuuaaugauagagaugagcugauagcaua

SEQ ID NO: 4122115 - RNA, 69 nt, Human
ugugcauugcgaugcagacgaccauauagauauauuaacauuuuggcaagguuuuucuuugcaggcaca

SEQ ID NO: 4122116 - RNA, 69 nt, Human
ugugccaugaggcucugauaugugcccugcacuguggggggugccaaaaauuagagcuacauggcuaca

SEQ ID NO: 4122117 - RNA, 93 nt, Human
ugugcccucuuccuggccagcugagagccccugcccugugucugccuccaccagccauagggcuccagcugucaguugccuugaaagggcaca

SEQ ID NO: 4122118 - RNA, 65 nt, Human
ugugcccuuugugucuggcugggguggaaagccaugcugccauccacagucagaacgggccuaca

SEQ ID NO: 4122119 - RNA, 70 nt, Human
ugugccgucagugccuuauacagagccaaccacaucauaggugcucaggaaauaaugucugugcggugua

SEQ ID NO: 4122120 - RNA, 61 nt, Human
ugugccuacuggagcuugcagugagccaagaucgugccacugcaauccagccugggcgaca

SEQ ID NO: 4122121 - RNA, 72 nt, Human
ugugccuagugauacaguuaauuaacauuaagggguaggccccuuguauuaguuugcugucgcuauauaaca

SEQ ID NO: 4122122 - RNA, 59 nt, Human
ugugccugcccugaaaacugcccauggcccugggugaggcagcauuugggcagggaaca

SEQ ID NO: 4122123 - RNA, 75 nt, Human
ugugccugucccgcauucuggucacauaugagccuucugcucuuuugcaaagacugaauugaugggaugggcuca

SEQ ID NO: 4122124 - RNA, 56 nt, Human
ugugcgaaaaccacaguagagguuuugugaagaagagcauuuguggcuuuugcaca

SEQ ID NO: 4122125 - RNA, 91 nt, Human
ugugcgcaucugagccuccuuuuccucaucuuuaucaaggaauuaauaauucccaccugaaaaagguagggccugaggcaaaugcgauaca

SEQ ID NO: 4122126 - RNA, 74 nt, Human
ugugcgccaauuugugacuggguucgugccuucaggaauucucuguagggcauguaagucaccauauuguaaca

SEQ ID NO: 4122127 - RNA, 61 nt, Human
ugugcuagagcuuguuucaguccuggcccagcugguuggaauuugugacuggcucugcaua

SEQ ID NO: 4122128 - RNA, 55 nt, Human
ugugcuaggugcuuguucuccucuggcaaccacagagcccagugacaucagcaca

SEQ ID NO: 4122129 - RNA, 57 nt, Human
ugugcuauuuuugcauauguguguguauauccacgcacauguacacauguaugcaca

SEQ ID NO: 4122130 - RNA, 73 nt, Human
ugugcucugacaguaagaccuuaccagccugcugcucucauuccuguagguugauauagaugcugucuggcca

SEQ ID NO: 4122131 - RNA, 66 nt, Human
ugugcugaagagaggaucuggguggagaucuccuuagugugccccauccagcccucaugucgcuca

SEQ ID NO: 4122132 - RNA, 56 nt, Human
ugugcugcaugacuugcuccugagcauaucugagcuaugaaaguccugcaugccca

SEQ ID NO: 4122133 - RNA, 68 nt, Human
ugugcugcccagccauaggaaaauguuuggguuucucauauuucaaaauggcuggagccugcaguaca

SEQ ID NO: 4122134 - RNA, 80 nt, Human
ugcuggggcaggcugggggcuggcuaggggcacggagagacaggcacucagcccagcagucuuagccugcagcccagaca

SEQ ID NO: 4122135 - RNA, 55 nt, Human
ugcugggguauggguguggccuggugggggcucaggggccaucucugccccagca

SEQ ID NO: 4122136 - RNA, 63 nt, Human
ugcuggggucugugaggagggcugcaccggcugugaggccugacugaccugauucuaauugca

SEQ ID NO: 4122137 - RNA, 81 nt, Human
ugcugggguguuuuggccuggguuuuuguugugcuucuuuggcugcaaacugggcugaucuuuagccaagacacaccagca

SEQ ID NO: 4122138 - RNA, 68 nt, Human
ugcugggugacaagaagagcauuugcaggguuucugguucuagugccuucauucuucccacccuggua

SEQ ID NO: 4122139 - RNA, 88 nt, Human
ugcugggugaccacaacuuguuuagaagagguuacuuagguauuuuuuucagaaaguaagagcucuugaacaauguggaaaucuagua

SEQ ID NO: 4122140 - RNA, 61 nt, Human
ugcugguagaguagguacaggaggggcccgcugcccucagcugccaccugcuccaucagca

SEQ ID NO: 4122141 - RNA, 86 nt, Human
ugcugguaucuuuucuauuauuaucuuugaaugggacucauuauugucugagcuauuuauuaaaauagugaaggaaaagaucagua

SEQ ID NO: 4122142 - RNA, 74 nt, Human
ugcugugcugcacguaauucuuacuguauaaagcucaaaauuuacaucagcaagaguguauguguggaucagca

SEQ ID NO: 4122143 - RNA, 129 nt, Human
ugcuguggccaaagacuucccucugcuccugggauccuguguugcuacuggaggaaacagggguaccaaccauuccgagguggccacacugggucacugccuuagcagagggcacacugagccacauca

SEQ ID NO: 4122144 - RNA, 120 nt, Human
ugcugugggccucgcagaccaugugaagggcuuaggauuuugcugugccugugauaggaagccacugggggaucuugagcaacuuccaauuccagcgucucucugggagguccagcugca

SEQ ID NO: 4122145 - RNA, 61 nt, Human
ugcuguguagaagagcuauccucauggcuuaagaauagaaagcuaagucauuuugccagca

SEQ ID NO: 4122146 - RNA, 80 nt, Human
ugcugugugaguuuaacacuuggagaaaaggaagcaacacaauugcacacuuugcugccagugccuaaacuaacagugca

SEQ ID NO: 4122147 - RNA, 69 nt, Human
ugcuguucggcagcaccuggagcuagaccagcuuugaugaaugggagcccaugcuguugggcccgagca

SEQ ID NO: 4122148 - RNA, 130 nt, Human
ugcuguugaguguagaaaauaaaaugugugaauuucuuuaucuugaguauugagauucuccccuuagaauaaaacaagaauuuuucucucaguguaaaaaugucaaguuuuauucuugaaaugaauagca

SEQ ID NO: 4122149 - RNA, 86 nt, Human
ugcuguugcgauuagaugaugacagcuagcuggcuuuuaaaauugaucaggaaguauucuggcagucauucaguguuguaauagca

SEQ ID NO: 4122150 - RNA, 55 nt, Human
ugcuguugguccucuuuggaccuggugaggccaccaggagccauugacugcagca

SEQ ID NO: 4122151 - RNA, 76 nt, Human
ugcuguugucacugcugguugcacagagcuaggaacugacaagacaucagagcuucugacagcugcugcaaaagca

SEQ ID NO: 4122152 - RNA, 66 nt, Human
ugcuguuuagcaauaaaaacacaugaguacaaucagcuuacuguaacccauuauugcugcauagua

SEQ ID NO: 4122153 - RNA, 100 nt, Human
ugcuuaaagauucauugccacaguuugcauaggaaaaacacucuuuuagaagacaaguuaguuuuccuaaguaagcaguaugaauaugaauuuagaagca

SEQ ID NO: 4122154 - RNA, 63 nt, Human
ugcuuaagcaaaguuuauaaggcucuuggugucccaaccaagaauacaggcuuuguauaggca

SEQ ID NO: 4122155 - RNA, 78 nt, Human
ugcuuagaaauuaaugugagcaagugagccuccucuuuuuaaagccauuuuggauugagaguauuuguuuucugagca

SEQ ID NO: 4122156 - RNA, 71 nt, Human
ugcuuagaguauucuuguauuuauaguuuucucuaugaagggaaugaguauucuuuauaggauucugggca

SEQ ID NO: 4122157 - RNA, 56 nt, Human
ugcuuaguaggcuaucugaaauauuaacuauauuaaggaacaaagccuuuugagca

SEQ ID NO: 4122158 - RNA, 99 nt, Human
ugcuuauauauaguuuaagaaaguacaguuucguauggaagaccagauuuuacuggucucacacauugugcuuuaauugaacugccaaccaauaaugca

SEQ ID NO: 4122159 - RNA, 66 nt, Human
ugcuucaagacaauuggcccaucuuuacuccaaguggcuguuaaugguuuauguuguugugaagca

SEQ ID NO: 4122160 - RNA, 76 nt, Human
ugcuucacgacaagauucaaguuaagcauuucuggcaaggucuugugcaauugacauugaaucagaucaugaggua

SEQ ID NO: 4122161 - RNA, 93 nt, Human
ugcuucaggggacaacaacgcacuucucgggggcgcugucugaucauuuagguggacuguugcccaccaggagacugucaguuuccuggagca

SEQ ID NO: 4122162 - RNA, 58 nt, Human
ugcuucaguaguaaauuguuauugaagcuucagucaauagcaaauugcuauuaaggca

SEQ ID NO: 4122163 - RNA, 63 nt, Human
ugcuuccuuggaaauucugacuucagggucuuaaauaguauuggggcacuauuucuggaagca

SEQ ID NO: 4122164 - RNA, 66 nt, Human
ugcuucucaggugaggcugaggcuguuggucuggagaccacaccuuaagaaacacuggacgaagua

SEQ ID NO: 4122165 - RNA, 77 nt, Human
ugcuucuccaguauuugcuguuuuccuuccccacugggcaaagccaggggaucugaguaggcagaagcugaagagca

SEQ ID NO: 4122166 - RNA, 129 nt, Human
ugcuucugagucgggaggugcauggguuggcggcaggaggaagcgucauggagccucuguuucugagcccauguguugagauuccagccucuagucagaaaauuccccuugcagcuucugccuggucca

SEQ ID NO: 4122167 - RNA, 58 nt, Human
ugcuugaacaacauggccuuuuccuaccucuugggauucugccuuguugcuucaauca

SEQ ID NO: 4122168 - RNA, 89 nt, Human
ugcuugaugacaccuacuuaguaggcauuuaagauggauaagguuaugauccucaugcaguugaauguuuaguaggggauuaacaagua

SEQ ID NO: 4122169 - RNA, 77 nt, Human
ugcuugcacaggcuuuauggagugacacaaugggaaaguccccuuucagucauuuacaugaaguugauuccacagca

SEQ ID NO: 4122170 - RNA, 75 nt, Human
ugcuugcauaacuuucuucacccuugcuguuaaagucaaaauaucaggggaaaaggagagaaaauuaugcaagua

SEQ ID NO: 4122171 - RNA, 83 nt, Human
ugcuuggcauuagccgaggugaggccagcagagggcugaugagccggggcuugcccucuggcagccuuggcuggaugccagca

SEQ ID NO: 4122172 - RNA, 98 nt, Human
ugcuuguagaccauccccccagaagaugguaugugcuccuggggaagucaagaauggcaucucaguggacgugucugucuuaggucaguuuacaagca

SEQ ID NO: 4122173 - RNA, 58 nt, Human
ugcuugucccucuuuaugauggcauuuaccccuuugcauaaagaugugggggccagca

SEQ ID NO: 4122174 - RNA, 130 nt, Human
ugcuuguuaggacaccaccagaaacaccaggccggguuuuuccuuucaaauuugggauccccuggaggguuaggagguaacaacugaaaugagaaagggguuuaauguguuucaaauguccauuaaugca

SEQ ID NO: 4122175 - RNA, 73 nt, Human
ugcuuuaagccaguuccacuuuuuuaucccugcucugauacagucagaggacaauagaauggaaaggcgggca

SEQ ID NO: 4122176 - RNA, 63 nt, Human
ugcuuuagggaauagaagaucugaaagacuaucauguuuuuuaauuuuccucuuccuggagua

SEQ ID NO: 4122177 - RNA, 60 nt, Human
ugcuuuauaaccauuucuguggguucagcaaucaccaaccagagagagguaaauugagca

SEQ ID NO: 4122178 - RNA, 86 nt, Human
ugcuuuauaauuauucuuuaaacauauauguuuuauacagccuucuaaauaaguaauguuugacaauguguugaaagggaaaagca

SEQ ID NO: 4122179 - RNA, 107 nt, Human
ugcuuuauacaacuuugaaagggaagaguuccucaauguaguuuuuguuuguaacaucauaaaugcuacacaggaauucucauuuguauucaguugguguuaaggca

SEQ ID NO: 4122180 - RNA, 61 nt, Human
ugcuuuauaucucucuucuuagggaauaugcaaacuccccaagaagaaaaggcauagagca

SEQ ID NO: 4122181 - RNA, 55 nt, Human
ugcuuucagccagugucuggaugcuaaaaaucagacugacuagucaaugaaagcg

SEQ ID NO: 4122182 - RNA, 119 nt, Human
ugcuuucauccccaucuggcauucaguguuccagguccuuccccaccucuaccccuagcaccugccuucucaaggacaugaaagcuagaauuugaaaugaaauugaggacugauaagua

SEQ ID NO: 4122183 - RNA, 69 nt, Human
ugcuuuccugauucaguggcaggcuggaccccaguggcagggcaagugucuguggugagcaggagagua

SEQ ID NO: 4122184 - RNA, 87 nt, Human
ugcuuucugcuuccucaggcuuguuauuuuauuaucauuuuaugaaauauccugugacuguaaaauacauaaguauugaagaaagua

SEQ ID NO: 4122185 - RNA, 61 nt, Human
ugcuuucuuuguggcacaaauugcuuuucucaaaagaagaaauuugcuaagcaaaggagca

SEQ ID NO: 4122186 - RNA, 59 nt, Human
ugcuuugcagugucuaacagaaaugggugcuccauaaauauuuguagaacugaaaagca

SEQ ID NO: 4122187 - RNA, 72 nt, Human
ugcuuugcuucuuucaucuuccccuugaggcuggcucccaaggccauacaaugaaaggggccugaaaaagca

SEQ ID NO: 4122188 - RNA, 68 nt, Human
ugcuuugugaaguugauuguuaucgucauguccaagaggaggucugacauuuuaucaauaucacagca

SEQ ID NO: 4122189 - RNA, 55 nt, Human
ugcuuuuaagaacaaugcugcuaagaauauucuuguaagcauugcuuagggugua

SEQ ID NO: 4122190 - RNA, 75 nt, Human
ugcuuuucuuuguuguuaucacaucaugggacucuugcacaaugcaugauggcucuccauuaacaagggugagca

SEQ ID NO: 4122191 - RNA, 68 nt, Human
ugcuuuugcugcauuccuugguuuaaaacaagucaggggccauuccagauucaaggaauggggaagca

SEQ ID NO: 4122192 - RNA, 75 nt, Human
ugcuuuugucacccaggcuggagugcaguggcgugaucucagcucacugcaaccucugccucccggguucaagca

SEQ ID NO: 4122193 - RNA, 92 nt, Human
ugcuuuuuuaaauugugccagcugagaaguguaaagugauauuucauuguuauuuuaauuugcauuucucggacuguuagugaaucugagca

SEQ ID NO: 4122194 - RNA, 103 nt, Human
uggaaaaagaucugaaaacacaaucuuggugcagaagaaagcagucauuuccuuaaugggaauuacuguaauuuucuacagcagacauucagagucauauccg

SEQ ID NO: 4122195 - RNA, 104 nt, Human
uggaaaaaugcagcauuaucagguuauaguuuuggaaaaucauagaugaaaacaguagacauuuuaagacauauacccuauauaaugcucagcaaauuuuuuua

SEQ ID NO: 4122196 - RNA, 89 nt, Human
uggaaaacucugcgcgggugagucagagugccagcgccaaguuuccuggcaugcaagaggaggcucccccgcucaggcagauuuuuuua

SEQ ID NO: 4122197 - RNA, 130 nt, Human
uggaaaagaagggcuuucuuuuaucuguuugaaaguggucaccuucucauuucaaggauuggccucauaaauuccaaggaaggacaaagaagauggcuaccagcaggagggagacagcagaagaaaggaa

SEQ ID NO: 4122198 - RNA, 65 nt, Human
uggaaaagcugacuguacuaaauaaagguggucaguugccuuuaucugauauucagcgauuucua

SEQ ID NO: 4122199 - RNA, 58 nt, Human
uggaaacaaagucauaagcucagaguucuccuuuguuccauucuguacuuaguuucca

SEQ ID NO: 4122200 - RNA, 84 nt, Human
uggaaacucuucucugaagugucauuuacauuucuacuugcuugcaugguggaaauguuucuugagcucagaacagaaagucca

SEQ ID NO: 4122201 - RNA, 111 nt, Human
uuaaauauauuuuuaccacaauaaugacuacaaaagcacuggguauuaauauuguucuuauugcugcuauugccauugcuuuuaugauguauuaggucuaaaucuauuuga

SEQ ID NO: 4122202 - RNA, 74 nt, Human
uuaaaucguugggagcaaauaggaaagaggaagagugggagcaaagccucuuccgguuugcuuuuaaauguuaa

SEQ ID NO: 4122203 - RNA, 79 nt, Human
uuaaaugagaauaauuuucauaguaaugaugaaagccaacauuaacacagcacuuauuaugggcuaggaacucauuuaa

SEQ ID NO: 4122204 - RNA, 62 nt, Human
uuaaaugugcaaacgugcaaagugucgaaugcagucuggcaaauagcauguaguacauguaa

SEQ ID NO: 4122205 - RNA, 86 nt, Human
uuaaauuacuaaaagcucugagaagcacugcaacagagaaaucuaauaguuuuuuguguauuccagggcuuuuuaaguuuauuuga

SEQ ID NO: 4122206 - RNA, 61 nt, Human
uuaacaaggugacugcauuaaaacauuuauuagucuguuuaugcuuuggcacucuuguuag

SEQ ID NO: 4122207 - RNA, 72 nt, Human
uuaacaauugaauuguacgcuuuacauaggugaauuuuaugauaugugaauuauacuuaguaaagcuguuaa

SEQ ID NO: 4122208 - RNA, 55 nt, Human
uuaacagaugucauuucggcggcggcuggcccacugcugcugggccauuuguugg

SEQ ID NO: 4122209 - RNA, 119 nt, Human
uuaacauaguuauuuugaugaauuuuuuaagaagugauuuuccucauucuguacuuucuuccaaagagugaaaaagaaaucgauuuugcugaguuuuuggaauaaaucaaauauguuag

SEQ ID NO: 4122210 - RNA, 84 nt, Human
uuaaccuuuuguuuuguuuuccuugcucacuuugugcaauagucacuagagucaguuagcgaauacuuaacaaauauugguuga

SEQ ID NO: 4122211 - RNA, 75 nt, Human
uuaacugcaccucuagguccagcacgguguagcuugaccuaucuuaagcaccucauguggaccagguauauuuaa

SEQ ID NO: 4122212 - RNA, 59 nt, Human
uuaacuucaacacucucuuguaacauguuacuuucuguuauaggugauguugagcuuga

SEQ ID NO: 4122213 - RNA, 111 nt, Human
uuaacuucuguauuugggagagcgguugagaaauaccuacuuagcucuggcaauaugacugaguuaaguaaacauuucccagacuguucauaucucaagcucccaaguuaa

SEQ ID NO: 4122214 - RNA, 83 nt, Human
uuaagaaaaaggucacuucauucacugucagguaaugagcccuagagguagaggcugcccaaugguagugucuuuuuucuuga

SEQ ID NO: 4122215 - RNA, 93 nt, Human
uuaagaaaaauucagaaacagcauaccaauguacauauaagauaaauaagcuuaugugguacaguaaguguucuguucugagaaauaccuuga

SEQ ID NO: 4122216 - RNA, 79 nt, Human
uuaagaaucugcuaugguguuuuuagaagauuaacuuuaaaauagauucuucauuaaaaugcacaguauugauuuuuaa

SEQ ID NO: 4122217 - RNA, 106 nt, Human
uuaagacauugaaagagagagugcuauuauuaauguggggcuuugggauaguuuccucaaaauguaaacacaaguaacuggcuucuuuuuguucuuacagucuuaa

SEQ ID NO: 4122218 - RNA, 97 nt, Human
uuaagacuuuggaguucuuuugggauagaauaugcaaccagguuuugaaaauuuggcauagcucuuuguuccuugaaggccaucuaagauguuuuaa

SEQ ID NO: 4122219 - RNA, 61 nt, Human
uuaagagacaggagaaugauguuccaaggacugggaagaaguucagaauucugucucuuga

SEQ ID NO: 4122220 - RNA, 58 nt, Human
uuaagagggugaugcuagcauuuccugugugcagauuuggcagccgucaucuauuugg

SEQ ID NO: 4122221 - RNA, 98 nt, Human
uuaagaugauuuuccuucagcaguagugugguaaauaaauguuuugugguaaauagacaacguauauuucuacauucuagaaaggugaauuauuuuaa

SEQ ID NO: 4122222 - RNA, 80 nt, Human
uuaagauuuaaaugcuuuaagcaaggguucaugguuuaucaugcuacucugccacauaaagguagauauuuaauuuuuaa

SEQ ID NO: 4122223 - RNA, 87 nt, Human
uuaagcaaugagacaaacaugauuuaguauaaugcagggugaauuaucacaugccuguuaggugcugauuauuuuacuuaaguuuaa

SEQ ID NO: 4122224 - RNA, 59 nt, Human
uuaagcaucacagauggcacuuuauagacagcuauuuuuguguacguguggguguuuaa

SEQ ID NO: 4122225 - RNA, 56 nt, Human
uuaagccacucaagagauagagcacuuccccuuugcucuguguuucagcugcuuga

SEQ ID NO: 4122226 - RNA, 70 nt, Human
uuaagccucacagguuuugauuugccagaauauaaaccguguacucuggccccaggaucuguguucuuga

SEQ ID NO: 4122227 - RNA, 73 nt, Human
uuaagcucuugcccuagugccuggugcacaguuaaguguucaagugucagcugguucauagucaagagauuga

SEQ ID NO: 4122228 - RNA, 84 nt, Human
uuaaggaaaaaacuuaacagcagucagugaauauuuaaaggauggccauauuauauaucuuauggauugcuuuaguuuccuuga

SEQ ID NO: 4122229 - RNA, 72 nt, Human
uuaaggauucaugagguuagaguggguccaccuggauaaucuaggcuaauccuccaaucucauggcccuuaa

SEQ ID NO: 4122230 - RNA, 126 nt, Human
uuaaggccuugucuuccugauccacccuugguucuguuuuuuucauguugguucuauuucuagacaggcuccauucaugugaaggcagcauagccauugguuucuucagguccacaugguccuugg

SEQ ID NO: 4122231 - RNA, 101 nt, Human
uuaaggcucuuuuagaaagagagacugagggcuaccccggggcaaacacugcaugacucuggcaguagauccagucucucugcuucagacaugggccuuaa

SEQ ID NO: 4122232 - RNA, 92 nt, Human
uuaagggauaccuuuugccagucuguucucaccucugaguucuaauaacauagaaucaggugaaauagucuggcuacauuaauauuccuuga

SEQ ID NO: 4122233 - RNA, 65 nt, Human
uuaaguaacuuguccaaaugagcaggucauagaacaagcugugcaacucugggcaagucacuuaa

SEQ ID NO: 4122234 - RNA, 79 nt, Human
uuaaguacuggggauacauuagugaacaaaagagacaaagacuguuuuccauaugaagcugaugcucuagauuacuuaa

SEQ ID NO: 4122235 - RNA, 56 nt, Human
uuaaguacuucccuguuggacaagccauuuucccagacaggcaaggagucacuuag

SEQ ID NO: 4122236 - RNA, 96 nt, Human
uuaaguauuuuaagaugucuucagggaagaaaugggacuuuacugaaaaugccuugaauuucaguuucagaucuucuuuggguuaaaaugacuuaa

SEQ ID NO: 4122237 - RNA, 73 nt, Human
uuaagucagaaguuucaaucccagcugauuaauaagagaaccaguugagauugccaaacuuguucagacuugg

SEQ ID NO: 4122238 - RNA, 62 nt, Human
uuaauaagguuuccuaaaguggcaacauuaacucucugucagccacaagggaauauuguuga

SEQ ID NO: 4122239 - RNA, 129 nt, Human
uuaauaauaaagaugaguuuuuggaugcuugagcagaggguagcuguccaccaaaauggauuagccugguccaccggguguggcccuggagggacagcugcucuauguuccuccaggaaccuuguuuag

SEQ ID NO: 4122240 - RNA, 60 nt, Human
uuaauauguugaaauuuauuagacuagcaccuggaucuuaguaagugcucagcaaguuga

SEQ ID NO: 4122241 - RNA, 94 nt, Human
uuaauauuucaggcagaaaaagcaccauuuaucaucuagguacaaugcucuguuacauuauuaccuaugaagaugguucuaaaugaauguuuaa

SEQ ID NO: 4122242 - RNA, 83 nt, Human
uuaauccaauaacaagguucaaauugaaggacuaacagcucaaaaauaagucaucuauggaucucaucuuguuuuuggauuaa

SEQ ID NO: 4122243 - RNA, 56 nt, Human
uuaaucuuuauucuuucuuagauaugcuguaguauauuauguagaguaaggguuaa

SEQ ID NO: 4122244 - RNA, 84 nt, Human
uuaaugcgagcgacucgggugguuuaugagaagugacacuuaauacccagcuucuuguaucugccgccgagcaguuaacguuaa

SEQ ID NO: 4122245 - RNA, 100 nt, Human
uuaauguuaaaagcuacaaggagagacuauaccaguacucuaggaauacauuaaaagggauacuugaguauagucgcuucacaaagucuuaccucauuaa

SEQ ID NO: 4122246 - RNA, 92 nt, Human
uuaauuaauugguuuaugcuguacucuugggaaguggguaaccagacccucuucccaagacuguauugcaagauuagacagggagugauuga

SEQ ID NO: 4122247 - RNA, 73 nt, Human
uuaauuccuacuuccugaaacugaagccguuuaugagaaacaguguguuucagagaggcuguaccagaauuaa

SEQ ID NO: 4122248 - RNA, 70 nt, Human
uuaauuuacauguaguucacugguggcauuaugaaaugcuagagguacaaacuacaucauaagggauuga

SEQ ID NO: 4122249 - RNA, 70 nt, Human
uuaauuuauacauaaucacagggauacugaaagcaaggauucucagaaaucugugaaugugcuagauuga

SEQ ID NO: 4122250 - RNA, 64 nt, Human
uuaauuuuaaccuguuugugucuuugaauacaaaguguaucuuuuguagacagguuauaguuga

SEQ ID NO: 4122251 - RNA, 66 nt, Human
uuaauuuuaugacaguguauuuuaggaauaaaugcauuccccaaaggggcacugacauauaauuag

SEQ ID NO: 4122252 - RNA, 69 nt, Human
uuaauuuucaugacaacucugugagauugguaacaaucacuauucccauuuuacagauguggaaauuga

SEQ ID NO: 4122253 - RNA, 129 nt, Human
uuaauuuuguuaagugccuauauauauaugaaagcauuggcaaaaugagcauuugaagaaauauuucuaugucauauuacuaaugcuggccaaugauguaagguguuauuaaaguauuuuuaauugaua

SEQ ID NO: 4122254 - RNA, 130 nt, Human
uuacaauaauuagcuaaaaagaugugagcacauuauuucaagauaguaaaaaccuggagaagaggggauggggcaggugacuacuauuuuaaaauauuaguguacuaauacuauuuugcuuuuuaaguaa

SEQ ID NO: 4122255 - RNA, 60 nt, Human
uuacaaugggagcccuuggacuuaagaaaaaacauguagugcaaggaguugcuauuuuaa

SEQ ID NO: 4122256 - RNA, 130 nt, Human
uuacacaaaguuguuuauuuauuuuugguccuaagaguuuugcacugugaaugcauuuaaaguauuuugaaauuugagaauuaguguaaugacauuuagacgaacuuaaaauuuuuaacuuuccuuguag

SEQ ID NO: 4122257 - RNA, 59 nt, Human
uuacacaggcacuuaaaaugcaguuuaaugccacaaccacugccaaagccccuguguga

SEQ ID NO: 4122258 - RNA, 63 nt, Human
uuacacaugcuuuguguguauguacaggugucuguuuugaggcguguccaugugcauguguaa

SEQ ID NO: 4122259 - RNA, 78 nt, Human
uuacagauguuuaaaugucacauacaauggcaagucucuccagauuugcuuuacaaugggcauuccguggaucuguga

SEQ ID NO: 4122260 - RNA, 119 nt, Human
uuacagcaauuugacauugcuaugauauucaagcaccaaauuaguaggcucaucucguugaauaggguagagaccaguuugaguguuguugaacuugugugaugaauuacgugguguga

SEQ ID NO: 4122261 - RNA, 78 nt, Human
uuacagcuugauguuuguguguucuaauucuaagaguucuuuauuccagaucauauagaguaguuaagacaacuguaa

SEQ ID NO: 4122262 - RNA, 61 nt, Human
uuacaggcucaacuaauguauuaauaacucuauggauguacauuucuugaugccucuguga

SEQ ID NO: 4122263 - RNA, 73 nt, Human
uuacagucagugaauggaagggucuggauuccaaaccagaacgcucauucuuuaccauucugcuguacuuuaa

SEQ ID NO: 4122264 - RNA, 78 nt, Human
uuacagucauuccuuggucaugcaagauaucgaugccuaugaugggucaggauaucacaugaauaaguauggcuguaa

SEQ ID NO: 4122265 - RNA, 93 nt, Human
uuacauagaauaguguaugauuucacuggaauuuuaacauuucugcaaaaagaguaaagaguccaagugggccacaauuacuauuuuauauaa

SEQ ID NO: 4122266 - RNA, 76 nt, Human
ugugcuguaauguuuauuuagcucagauuugcaauaugaaauguacauucugaauaggcauuuuaugagcaguaua

SEQ ID NO: 4122267 - RNA, 81 nt, Human
ugugcuguuauuucuacuucugucuaguuauuacaacaaaucaggauguauuaauguaaagaagauguaggaaagaguaua

SEQ ID NO: 4122268 - RNA, 67 nt, Human
ugugcuugaauuaagguaaugcuugauaugauuuaaaugaugucugugugaucuuggauaagguaca

SEQ ID NO: 4122269 - RNA, 93 nt, Human
ugugcuuucauucagcaggaucuguuucuucuagugaagaauuauucauucagauuaauucaacuuacaaaggagaagaguuccagagacaca

SEQ ID NO: 4122270 - RNA, 56 nt, Human
ugugcuuuggagaugaggacaugccucgugggcuaugcuccuuggcuucaaagcca

SEQ ID NO: 4122271 - RNA, 87 nt, Human
ugugcuuuggggguccaguccugugaguugccucccgucuaguaacgggcaggccugcccagcaggauggagagggcucccagcaca

SEQ ID NO: 4122272 - RNA, 57 nt, Human
ugugcuuuuuauaaggcagacugugugagcuauacuguuagaguuuuaaaaagcaca

SEQ ID NO: 4122273 - RNA, 84 nt, Human
uguggaaaaaggaggcuuugcgugugugcauguguaucacacaugcauguguguauucagagacuauccuuggacagauccaca

SEQ ID NO: 4122274 - RNA, 72 nt, Human
uguggaagugcaaaaccacaugguaaacaauugauauguuuuuguuuauuuuucuuguuugucauuaccaca

SEQ ID NO: 4122275 - RNA, 64 nt, Human
uguggaauauuagauuagguugauuaaucggucauucauaauuaacuagugauaauguucuaca

SEQ ID NO: 4122276 - RNA, 62 nt, Human
uguggaaugagcacaggcuuugaaaucacugaauacugacuucagacuugagcucuucuaca

SEQ ID NO: 4122277 - RNA, 85 nt, Human
uguggacagggauggggaggcuggggggcagaggcuugcugaugaguuuggugucuccccacuggucuuccagugcccauuugua

SEQ ID NO: 4122278 - RNA, 78 nt, Human
uguggacauuucccagggagcuuugucuucucauuccauugagugauaaggugaaagguuccuagaauaggucagaca

SEQ ID NO: 4122279 - RNA, 77 nt, Human
uguggaccaagaaaacaaugauaggguuugaaggaagaaauguuuugcaacagacucaucauugacuuugaaccaca

SEQ ID NO: 4122280 - RNA, 67 nt, Human
uguggacuuuguaauaguuuaaggucaaguaaaguuuccacuuuccuuaggcuguuugcagugccca

SEQ ID NO: 4122281 - RNA, 55 nt, Human
uguggagaugugagcaaggggauacagaucauguuuuccuucccuuucucugaca

SEQ ID NO: 4122282 - RNA, 89 nt, Human
uguggagcaacucccaauguuggggcuuacaggagagcuggggaaccaccugagacuuccugaugaggcccgaguugaccucuuccaca

SEQ ID NO: 4122283 - RNA, 61 nt, Human
uguggagccaagaucaugcucugcugauggaagcaagaugcaugauccugagcaacccaca

SEQ ID NO: 4122284 - RNA, 75 nt, Human
uguggagccagcagggucugagcucagcagcuucucaaaaaagccccccugagcugcuuugcuuuuggggccaca

SEQ ID NO: 4122285 - RNA, 58 nt, Human
uguggagcuguguggccuugggcaagugacuuaacugcucugagucucagcuaccaca

SEQ ID NO: 4122286 - RNA, 125 nt, Human
uguggaggccugaggggugcgccuguaugggaaguguauuaguacguguuucugcguccuuuucugucugugggugugcagagguuugugguguugcuccgucugcagguguucaggggucugca

SEQ ID NO: 4122287 - RNA, 65 nt, Human
uguggaguagcucuuugguacagaugacccuacucccggguacaauuccugucaagcuggccaca

SEQ ID NO: 4122288 - RNA, 62 nt, Human
uguggaguuagaauauaauuauguuaaugcuaaaaaaagguggcauuuguauucuaaccaua

SEQ ID NO: 4122289 - RNA, 59 nt, Human
uguggauaagacaagucagguauauagguaacgcccauguccuggaggcuucauccaua

SEQ ID NO: 4122290 - RNA, 58 nt, Human
uguggcaaagauuguguacaacuuaauaagagaaguguuguuacauucuuauggcaua

SEQ ID NO: 4122291 - RNA, 64 nt, Human
uguggcaagugacacagacggggacucccagcugggggucccuggaauuacuugacaucccaca

SEQ ID NO: 4122292 - RNA, 57 nt, Human
uguggcaauuuucuagcagauggcaguuaagugccuugcuuugacaaaauugguaua

SEQ ID NO: 4122293 - RNA, 72 nt, Human
uguggcauaagcucgguuugacacugaggguagugggagacaggucagugugaggggcuggguccugccaca

SEQ ID NO: 4122294 - RNA, 66 nt, Human
uguggcauguuucaucacaucaagauaauuaagccaauuuucacugaugcuuaugaaagugugaca

SEQ ID NO: 4122295 - RNA, 65 nt, Human
uguggcauuuaugacaaccaaagagugaaacaauuuuauuaagugguaauguucauggggcugca

SEQ ID NO: 4122296 - RNA, 69 nt, Human
uguggccaggccccugaugguggggacagccagggugaguggcuggagggagucagggggcuggucaca

SEQ ID NO: 4122297 - RNA, 63 nt, Human
uguggcccaaacggguccagugaaagucaguccugggacuuuggcugggacuauuggggaaca

SEQ ID NO: 4122298 - RNA, 129 nt, Human
uguggccuuaauuauagugcuauaagauaugaagucugaaacgcauuguuaucgauauaaaauggaaagacauuguguauucauaaaaucgaagauuauauuuagugugaaauuguuucgaaggucaua

SEQ ID NO: 4122299 - RNA, 61 nt, Human
uguggcuccacuccacauuaauggggcucucaauguuccacugauaugcaaaugggccaca

SEQ ID NO: 4122300 - RNA, 94 nt, Human
uguggcugauguggccuguguccuugugacauucuggcuugcaggucaacuggaagcuggagaguuucacagaugaugcuaacuacaaagccca

SEQ ID NO: 4122301 - RNA, 85 nt, Human
uguggcuugauuaucuuaaggaaacauuuuuccauagucacaaccuaguuuuaugcuggaauguucuuaaagauuuucuggucca

SEQ ID NO: 4122302 - RNA, 70 nt, Human
uguggcuuuuaaucuagauucggaucaaaggggggaacuucagugggcaaaauuuagcauuaauuccaua

SEQ ID NO: 4122303 - RNA, 55 nt, Human
ugugggaaucagccaggggggcccuuaacugcccaaggcugaucauuuucccaua

SEQ ID NO: 4122304 - RNA, 55 nt, Human
ugugggaucaaagcagcuuugcuguagucccagugcagcuuugcucuggucccca

SEQ ID NO: 4122305 - RNA, 60 nt, Human
ugugggcacuaaugacaugcaggcacucugucccaagcguuaaaucauucaguccccgca

SEQ ID NO: 4122306 - RNA, 70 nt, Human
ugugggcagagcagagccugcauuggccaucuccaucuggcccaggccaacaggccuugcucugcucaca

SEQ ID NO: 4122307 - RNA, 56 nt, Human
ugugggcucccccucacucuguucuggggauccuugcagacuaggaagagcucaca

SEQ ID NO: 4122308 - RNA, 75 nt, Human
ugugggcucuuaaacucugggaccagauggaucuggcuuugagaucuggcuggauucuuagcguucagggccuca

SEQ ID NO: 4122309 - RNA, 129 nt, Human
uguggggcaggacucagcuucccaugggcauugaugcugagggccucaguucccaguugacuguuggccagagguguccucaguucucugcuacaugggcugucugacacuuggcaucuugcuucauaa

SEQ ID NO: 4122310 - RNA, 74 nt, Human
uguggguucuggguguugauuuuacacuaaaaaaauuauuuuuggagucgaugaacacacaguauuugcucaca

SEQ ID NO: 4122311 - RNA, 71 nt, Human
ugugguauacaucucaugaaugauaaaucauugugccauugcugaucaauuacaaaugggacuguauuaca

SEQ ID NO: 4122312 - RNA, 72 nt, Human
ugugguccaggacuggugguacccuucacucugcaaagccccuguaagggagacccaccguccuggacugca

SEQ ID NO: 4122313 - RNA, 58 nt, Human
uguggucugcuccacggggugaguucugcuauuguucugacccuucuagcagaacaca

SEQ ID NO: 4122314 - RNA, 69 nt, Human
uguggugaguaacaucuggaaccgacacugaauucuuuuagcugauguuuaguugauguuacccacgca

SEQ ID NO: 4122315 - RNA, 66 nt, Human
uguggugauaaggguagcucucuucauccugguucaggagagggaaaaacucaugucauuuucaca

SEQ ID NO: 4122316 - RNA, 92 nt, Human
ugugguuauugauucaaauugcuuucuuuggggaacuguacuggaaccucacuaacacaguuaacuggagagcgaguucaauauaaggccca

SEQ ID NO: 4122317 - RNA, 68 nt, Human
ugugguuuaguuuugcaaaaguugggcucaaaacauugaaaacagcauuugaaaacuauuuaauuaca

SEQ ID NO: 4122318 - RNA, 56 nt, Human
uguguacagcaugguccagcagguucgcaggugaaggcugggcuuugacugacaca

SEQ ID NO: 4122319 - RNA, 124 nt, Human
uguguagcuggaaaacuaaggcagaagcuguaauauuauaucaucugugggcuuuuauaaugcuuuuauaaaagcagcacauggauaucaguguuuuaguuuuuuccauauguguagguucaca

SEQ ID NO: 4122320 - RNA, 92 nt, Human
uguguagcuuuuauugaucguuucguggccuuugacuccaaguccgugaaucaguuacaggucuaacuaaaugaauucaguauaggccagca

SEQ ID NO: 4122321 - RNA, 84 nt, Human
uguguaguauguauucuuuucucuaaaugaugaaaugcuaaagaaucauuucacguuguugaagaaaauaccguugcuacaaca

SEQ ID NO: 4122322 - RNA, 55 nt, Human
uguguauauguaaauauaguuguguucauaauagcacuucguuugcauagacaca

SEQ ID NO: 4122323 - RNA, 130 nt, Human
uguguaugcacugccuggauucuucaagcaagagaaggacauuucuauagugcaucuguuauggugacagguuacaagacagagcucugugaagcuccugcucccuuugggaugaaagcgugcaugugca

SEQ ID NO: 4122324 - RNA, 72 nt, Human
uguguauuccuuuuucaauugugaugucagaguuacauuagccuugcagaauaauuugaagagguuuucaua

SEQ ID NO: 4122325 - RNA, 71 nt, Human
ugugucaaggcaucagcccagccugccuuccuugucuuggcccuuggugcugcugcugugucucuggcaca

SEQ ID NO: 4122326 - RNA, 76 nt, Human
ugugucaauguaucuaacccggaacuaaguuuuccugagucccuuucucugugugguucugaguuagaguuggcca

SEQ ID NO: 4122327 - RNA, 79 nt, Human
ugugucacagugucugugcuuugcagcaaauugcuugacuugaguuuuuuccuucuaagaagcaaagauauuggaaaca

SEQ ID NO: 4122328 - RNA, 60 nt, Human
ugugucacuguuccuccagcuacaggcugauugauguacuauggaaagacaguagacaca

SEQ ID NO: 4122329 - RNA, 62 nt, Human
ugugucaggagauagcaaaggguucacauauauuuccuuaguguucaaauuuuuccuguaca

SEQ ID NO: 4122330 - RNA, 58 nt, Human
ugugucaugugugaggcucccuucuugguccuuggcuggcuguaucagauaggacaca

SEQ ID NO: 4122331 - RNA, 89 nt, Human
uguguccaauaacaauaaugcuguuaagaaucucuuccuuugcauuuuggcuuuuaggggugguuuuagcagcauguguucuggaggca

SEQ ID NO: 4122332 - RNA, 65 nt, Human
uguguccagugucagcucuggugugcuuauuaagggauaaaugacccaugcugaccucacacaca

SEQ ID NO: 4122333 - RNA, 65 nt, Human
uguguccuaccaugaauucacuccaugcuagccacauuggccuguauggcuauuccuuggacaca

SEQ ID NO: 4122334 - RNA, 64 nt, Human
uguguccucuuaccucugaccccagagcauguuugcugugggcuggauggagcugaaggacgca

SEQ ID NO: 4122335 - RNA, 77 nt, Human
uguguccuggcuuucuugcugcaugguggcuggauuccaagaaucagcaucguaagaaagaaagccagguagaagca

SEQ ID NO: 4122336 - RNA, 66 nt, Human
uuagguuuuggacauacuuuguuuaaugugccuuugagacaugcuaauggagaugccaagaaguga

SEQ ID NO: 4122337 - RNA, 83 nt, Human
uuaguaacucuuuaagccacuauuaaauaaugauuguauagcuacagcaguuucaauuuuaguguuuauaucagggucacuga

SEQ ID NO: 4122338 - RNA, 59 nt, Human
uuaguaauuggcagagcuggguuuaaaccuaguugacuuagcuuuagagccauuacugg

SEQ ID NO: 4122339 - RNA, 63 nt, Human
uuaguacaaaggcccuugauuacuuuuuuacgcugugauucggugacauaggucuugugguga

SEQ ID NO: 4122340 - RNA, 68 nt, Human
uuaguauauacugaugaguccuucguuacuguuaccaagugcauaacugguauaucaguguacacuaa

SEQ ID NO: 4122341 - RNA, 58 nt, Human
uuaguaugacaugcugucuugcugcacauccguauuuuggcacaguuugucauucuaa

SEQ ID NO: 4122342 - RNA, 76 nt, Human
uuaguauuugcccauucguuuaguccacaaaugcaucugugcuaggugcuggggauagaauugugaguaaagcuaa

SEQ ID NO: 4122343 - RNA, 77 nt, Human
uuagucaccucuguacaaauggcaguugaguucaguucucacugaacucuuuucccuuuuguaauaguuauuacuga

SEQ ID NO: 4122344 - RNA, 63 nt, Human
uuagucacuagaugccguauauauaggauaguuagcuaucgaauggcuucucaggugcacuga

SEQ ID NO: 4122345 - RNA, 61 nt, Human
uuaguccccagugugcagcucuucuccacuuuaaaaggaggaggccugaaacugaggcuga

SEQ ID NO: 4122346 - RNA, 75 nt, Human
uuagucgggaaagcuacugguguccucugccaagcagguuacaggggacaaggguagcauccauuaccugacuga

SEQ ID NO: 4122347 - RNA, 81 nt, Human
uuagugacaggaauuacauuuguguuacugcagauuguauucacaguguggaagugauuacaauguaguauaugucccuga

SEQ ID NO: 4122348 - RNA, 78 nt, Human
uuagugacuuuuguaaugagagcuccugguagcaagcaaccaauugcuacacuggcuguuuugcagaaagaacauuga

SEQ ID NO: 4122349 - RNA, 94 nt, Human
uuagugacuuuuugauuguccuuggaugaagcugggaucugugugaaaaaugaaauguacuaucccuauuccuagggauaaucacuaucacuaa

SEQ ID NO: 4122350 - RNA, 66 nt, Human
uuagugagagcgauaggagaaaguagugcuccaccuuucccgugacauccuggugcuugacacuga

SEQ ID NO: 4122351 - RNA, 57 nt, Human
uuagugauuucuaaggagagaaguagaacccaacugauucuccaaaggagacacuag

SEQ ID NO: 4122352 - RNA, 69 nt, Human
uuaguggcaauuauaauagcugugggaaauaaaaguaugaaaaaaucuuacuuccuacaguucuacuga

SEQ ID NO: 4122353 - RNA, 60 nt, Human
uuaguggcagcaguuauuaaugugaugcuagucuaugugucacaaaugauguugcacuga

SEQ ID NO: 4122354 - RNA, 67 nt, Human
uuaguggcaguuuuauauuucauguguaaucuguguuuauauuugcaaguaucaaacaugucaguag

SEQ ID NO: 4122355 - RNA, 77 nt, Human
uuagugguauuauuggguaguauaguaaauauauguuuagcuuuacaaagugcugcaccauuuuaaucucccacuag

SEQ ID NO: 4122356 - RNA, 74 nt, Human
uuaguguaugcuuagccagagauuuuauagcuauaauaucagcacagauuuauaggguauaagugauauacuga

SEQ ID NO: 4122357 - RNA, 69 nt, Human
uuagugugacagcuucucugaaauucaugugaucauuuacauauuguuucccaggagcuuuggcauuaa

SEQ ID NO: 4122358 - RNA, 89 nt, Human
uuaguuaauuacauauggguccaguuucaucugagguucuagagaucgugaaucagauaauugggcuggaguuauaaugguugaauuaa

SEQ ID NO: 4122359 - RNA, 59 nt, Human
uuaguuauauaacucaggugggcucagcagcaaggcugggaccucaguuauauggguag

SEQ ID NO: 4122360 - RNA, 68 nt, Human
uuaguucauauugaaagcaggugacaccagcauucugcuaggcaguuaacuacuuuuaguagaaguga

SEQ ID NO: 4122361 - RNA, 130 nt, Human
uuaguucuauucauagugccuucucaggcccagguucagcacaggugcucagacaaugaugguugguugauauuugcaugugcuaaggcuacgaggccaugaaaagaaaguaaucaagaaggaagauuag

SEQ ID NO: 4122362 - RNA, 57 nt, Human
uuaguugagauuugccaugaauuuucuggaccagacagugguggcaaugucagcuaa

SEQ ID NO: 4122363 - RNA, 87 nt, Human
uuaguugcuuuugaaggggcugggaaugagcaugugggaagagggauagacaugcaugucaucagcccuuuaauaaugaguagguga

SEQ ID NO: 4122364 - RNA, 56 nt, Human
uuaguuggaagaaaaacaaaugaaauaugcaagauguuuguauuucuaacagcuaa

SEQ ID NO: 4122365 - RNA, 91 nt, Human
uuaguuuugauagccaggaagaaaaguguuaaauuuuuacacuaacucuaggaugugacaugugcucaucuuggcuauucuaaaugacuag

SEQ ID NO: 4122366 - RNA, 130 nt, Human
uuauaaaucacucuugcagguauuuggagaauggacgaaugaggcaaaaauagagacaagaaagcaaauuucauuacugcaucucuccaggugaaacuugcagggcaaauggagaaaaaugaauuuguaa

SEQ ID NO: 4122367 - RNA, 77 nt, Human
uuauaacguaguuauagguacucugcagcauuuccccaaaguuagcaguaucauguuuccugugacuaucuuuguaa

SEQ ID NO: 4122368 - RNA, 60 nt, Human
uuauaacuuguauauguuauucagaguucagucacacuggauauacauagcaggaaauga

SEQ ID NO: 4122369 - RNA, 77 nt, Human
uuauaagcagccagccagaucaaacucagaugucaucccaugauuacauaguuuggauguuugguuuguugaaauaa

SEQ ID NO: 4122370 - RNA, 108 nt, Human
uuauaaggauugaguguggcacaaagaguucgauuuuuaguauuuaaauugaguaggaaacucaaauacagaagauccuuuccugggucacaccuuugguuuuuuuaa

SEQ ID NO: 4122371 - RNA, 61 nt, Human
uuauacuugauccuggcaggguaagaaguaguaguuuuaagcucccugaagggcaagauaa

SEQ ID NO: 4122372 - RNA, 80 nt, Human
uuauagacacauagauaggcagaagaacauuuuguaacaaugaggcaauuguuaacauguguauuguaugauguuuauaa

SEQ ID NO: 4122373 - RNA, 85 nt, Human
uuauagcaacuuaggaaacaaauacacccagucaauaucuguugaaugaacaaauggugcugcuuguguuccugaugagucaugg

SEQ ID NO: 4122374 - RNA, 74 nt, Human
uuauaggaaucugcaugugugauaaagugcuuagaaugagacacacgugcgcacauggaggaccguucuuauaa

SEQ ID NO: 4122375 - RNA, 129 nt, Human
uuauagguaacugugggucaucaccuuugagcugucagucuaccauggaggauugugcucuguucugggcaccccauuuaaagugguagauuggcaguagggaagauacacagauguggcauucuguga

SEQ ID NO: 4122376 - RNA, 72 nt, Human
uuauaguuaaauuguccuccuggcagggccuuugaaaucuguuggccuguguaaaagauuaguuuacuauga

SEQ ID NO: 4122377 - RNA, 87 nt, Human
uuauauaaagggaaguuaagggucccagucuguuuggggcaacagugggagcaggcuaagggaccuguuuaaaacuaauuuauauag

SEQ ID NO: 4122378 - RNA, 84 nt, Human
uuauauagcauuuuucaaggaggcaaagcaucaguagaaauguucucugggauuuuuuuaccugauguuuuaaugcugugauga

SEQ ID NO: 4122379 - RNA, 110 nt, Human
uuauauuaaaaccuauauaucagagauuuuuuguauauaaaagauaguuggaauuaauuucuccagcuuaaaguguacauagaauugugcuuugauuugcuuuaauauaa

SEQ ID NO: 4122380 - RNA, 118 nt, Human
uuauauuaggaaaacaauguauguaaccuuuuuugugagcugagaaauguauagucuaccaacaagauaagugcagauuagagcucuaaaauaaauacaugaaauagugcuaauauaa

SEQ ID NO: 4122381 - RNA, 102 nt, Human
uuauauuucucagaaugaaaguguugauuuuauagugcauuagaguuuguuuucauaaccugcuuugcucuuuagauuuaauauuuucucacuaguuuauaa

SEQ ID NO: 4122382 - RNA, 81 nt, Human
uuaucaaaagcguggaagcugacaggauggcauuauuagcguggcucugagcuaauccuguugccgauuuguugaggauga

SEQ ID NO: 4122383 - RNA, 69 nt, Human
uuaucaauauuauguuuugguguaauguaguaccauuucuaacuuacacuuuacagaauguuuugauag

SEQ ID NO: 4122384 - RNA, 83 nt, Human
uuaucaauguccagcccaguuuggugaauugcucuaucugggaauucgauuuuccaacagggcuucucaaaggagguuguuaa

SEQ ID NO: 4122385 - RNA, 90 nt, Human
uuaucacuuaauuguuuccacuuaucuuuuaagagagaaauuuauuuagcaucuuucucucuuuuggguaggaggucacagagcagauga

SEQ ID NO: 4122386 - RNA, 107 nt, Human
uuaucacuuuuuuuuuuuuuuuuggugcaaagcuuaacauucugcaaacuuuuuuuccccuugaguaugcauugcauuugucaugaagaguaaaaagaauguaauaa

SEQ ID NO: 4122387 - RNA, 99 nt, Human
uuauccaaauaauuuuaacuauaaaaggucagugcacuaaaaugagaguuucuuuaagaaauaucauucuggugcacagaacaacuccuuuuaggauaa

SEQ ID NO: 4122388 - RNA, 79 nt, Human
uuauccacucucccauucaugcauuuaauauuuauuaaccaccuaguauuaagcaaaauguauggaaagaaguggaugg

SEQ ID NO: 4122389 - RNA, 74 nt, Human
uuauccaguaccagaguccuucccaauugcaaaauguuuuauagacagguggcagagggcucguggauggauaa

SEQ ID NO: 4122390 - RNA, 82 nt, Human
uuauccucuucucucauguaggagggaauuguguaaauaagacuaaaaaccaguucuuuaaaauagugagaaagaaggauaa

SEQ ID NO: 4122391 - RNA, 117 nt, Human
uuaucgcuaauggaaucagauuauuugggaaauauuaaucuaugcauauucagacucagauacugagcuaaggaauucaaauaguuaguauuccuacauggauuugguuagugauaa

SEQ ID NO: 4122392 - RNA, 81 nt, Human
uuaucuaacagucauucauagaaucaguuugggaaggggaauuuucacugaacucucauagagaaacuguguuuuagauaa

SEQ ID NO: 4122393 - RNA, 55 nt, Human
uuaucucuaaguuccuuuccaagcaagggaggcaguauaaggagcugagagaugg

SEQ ID NO: 4122394 - RNA, 63 nt, Human
uuaucugcucuugaaaauguugaguuuguagccaacauuugaaaaucaagaaucuucagguaa

SEQ ID NO: 4122395 - RNA, 85 nt, Human
uuaucugguacgcugcauuacacauucuagggcacaguuauuucagaugaucuugauuaguaguggugaaacagauuccagauga

SEQ ID NO: 4122396 - RNA, 77 nt, Human
uuaucuugauguccuauuucucugugcaugauucuaccuucagacacagaugagacaaggaguggucugugugauga

SEQ ID NO: 4122397 - RNA, 90 nt, Human
uuaucuuuaugguuuuaaccacugucuguuagauuuucuguuguggcagaaaaaugaauucuucaguggcaagggacaugaugaaggugg

SEQ ID NO: 4122398 - RNA, 76 nt, Human
uuaucuuuuggguaguuauucugcacaccuuuaaaaugcauuuuacuuauuugugguggguggaguagaaagauga

SEQ ID NO: 4122399 - RNA, 112 nt, Human
uuaugagcaaauaugugauaagaggcucaucgcugacucuuugacaaaaugcagcauuuucuuuuaagcuacauuauguuaagagcagaauuuccucucuacuagcugauaa

SEQ ID NO: 4122400 - RNA, 88 nt, Human
uuaugauaguuuacugagaaugaugauuuccaauuucauccaugucccuacaaaggaaaugaacucaucauuuuuuauggcugcauag

SEQ ID NO: 4122401 - RNA, 78 nt, Human
uuaugauuuccagcaaacucuaauaacaaaauucaaauugcucuugcagaugagaauuuuuagagugcugggacauaa

SEQ ID NO: 4122402 - RNA, 130 nt, Human
uuacauaucuacugguugcaaggcaggaaauauuggugaaaugcuagcaaagucacaauuucuacucugaacaugauuugcaguguucaucaguauuuuucugaacccugcuuuaccauuuucuauauug

SEQ ID NO: 4122403 - RNA, 72 nt, Human
uuacaugacaaagcuuuggcucagagauguggagugaacugugcauagcaagcuuaaagccaguccauguga

SEQ ID NO: 4122404 - RNA, 130 nt, Human
uuacaugaugugcgacacuucaugaaaugauucuucuauuaucagauauuuaaguuaucaacagcauuuuguuguuauaaauaugacugaugaaggucuuuugcagaaauguuauaaacaugucugguua

SEQ ID NO: 4122405 - RNA, 74 nt, Human
uuacaugauugccuccaggcugaauaucuagaauaauauuaggggucugauagccuggaagaguuaacauguag

SEQ ID NO: 4122406 - RNA, 64 nt, Human
uuacauuaaagcaucuguaaagacccuuauuccaaauaaggucacauuuugaggugcuguguga

SEQ ID NO: 4122407 - RNA, 78 nt, Human
uuaccaaaaucuacugugugcuaggaacuacaccaggcaccaaaaugcaauguucucucuggcugccaguacugguga

SEQ ID NO: 4122408 - RNA, 76 nt, Human
uuaccacuuucagguccagucacuggucugcaguaaccauuuugugcaagacacuguccugggcaugaagggguga

SEQ ID NO: 4122409 - RNA, 129 nt, Human
uuaccagaggcaacuuagcagacguuaacagucuacgcuaaggcagccaaacuuggguuuugguuugaaaccuggcugugugaccuuggcaauucuuaauucugcuaaguuuauauggucucauaugua

SEQ ID NO: 4122410 - RNA, 78 nt, Human
uuaccaggauggcugccccaaauuguugcugguaucauuaaaauagucaacaaaaauguggagccuacagccuuguaa

SEQ ID NO: 4122411 - RNA, 99 nt, Human
uuaccagggugcuaaauagcuuuuguaugaugaaauuuuggcaaaauaauuuuaugucucuauuauuuaugucauaugaaaguuggaguuuucuggugg

SEQ ID NO: 4122412 - RNA, 60 nt, Human
uuaccauguuuuguugaugcuggacagucuuauccagaguaugcaggaaaauaugaguga

SEQ ID NO: 4122413 - RNA, 106 nt, Human
uuaccauuuuuuauuuucaauuuuggaggauuugucaucugaagauaaggugguauuaaauguauugauaaugggaucuuuagcagguuuuuuugggagaugguag

SEQ ID NO: 4122414 - RNA, 71 nt, Human
uuaccucuggggcaugggcuacuugaaguuugaguaacuuucuaggucucaguccuuuaauuaugggguaa

SEQ ID NO: 4122415 - RNA, 101 nt, Human
uuaccuguuuaaccacuugaugggcuggggaagcucacuccugugguuccagcaggagggcgcaucaucccauuaugucagaguggcaaggaacuggguga

SEQ ID NO: 4122416 - RNA, 129 nt, Human
uuacggcuucugacccagggcuucacuuuguagcaguguuuuucuucuguuuuugccuuuggcugauaccacugcuagagugcagauaagagaauguuacuaccagggggcuugagugucgggcuauga

SEQ ID NO: 4122417 - RNA, 89 nt, Human
uuacguuagaagcccugagucaucauugcggaaguuggccuaagcuuuugaaauacaguggugcacugagauaacuuuccaauuaguaa

SEQ ID NO: 4122418 - RNA, 68 nt, Human
uuacuacaagggcccuaaaagguagugccuccuagacuggagaagggaccuuugagagccccuaguga

SEQ ID NO: 4122419 - RNA, 71 nt, Human
uuacuacugcuuuacuacugggaaaagggaacauuaaggguuccuagcauccaugucaaguacugugguga

SEQ ID NO: 4122420 - RNA, 66 nt, Human
uuacuagaaaaacacaugcucuguaguuaagauggaugaaacugcaguuuguguugauuuugguaa

SEQ ID NO: 4122421 - RNA, 91 nt, Human
uuacuagaaagaacacugcugagaugccaggagcucuaaagaccugggugcgaagagccccgaggcuccuggcucuaagucuuucugguag

SEQ ID NO: 4122422 - RNA, 64 nt, Human
uuacuagcugagggaacuugggcuugccauauaauuucucuaagacuauuguccucagcuguaa

SEQ ID NO: 4122423 - RNA, 56 nt, Human
uuacucaaggcuccaggagcacagcauugcagucccugagcuccaggcgugaguga

SEQ ID NO: 4122424 - RNA, 76 nt, Human
uuacucugucacccaggcuggaguguaguggcacgauuucggcucacugcaaccucagccuccuggguucaaguga

SEQ ID NO: 4122425 - RNA, 63 nt, Human
uuacugaaaauucuucaggauuccuacaugugagcuauuggaaucagaaguuuuggucaguag

SEQ ID NO: 4122426 - RNA, 66 nt, Human
uuacugaacacauuucuggccaauuuagacuuaauguguauguuugcauuaaaucuguucauguga

SEQ ID NO: 4122427 - RNA, 58 nt, Human
uuacuggagugagcuguucuugaaguuauuucaaguucuaguguucacuucuaaguaa

SEQ ID NO: 4122428 - RNA, 67 nt, Human
uuacuguggcuuugcagggcuuguuauuugggaccacacccacagcuuccaaccaaggccaaaguaa

SEQ ID NO: 4122429 - RNA, 61 nt, Human
uuacugugugacccuggguagguuacucuaccucucugauccucccuuucucauacgguaa

SEQ ID NO: 4122430 - RNA, 58 nt, Human
uuacuguuccucucucaaagaggcuuucucuggaagccucucugcuuaugaauaguga

SEQ ID NO: 4122431 - RNA, 60 nt, Human
uuacuguuuucguugauuauaaagguaauacacacuuggcguaaugaauguaaacaguaa

SEQ ID NO: 4122432 - RNA, 81 nt, Human
uuacuucaggccaucugggcguauaggugcaagucacaggagaugcgauggcuuggcuugggcucagaggccugacaguga

SEQ ID NO: 4122433 - RNA, 58 nt, Human
uuacuuuaagggugucuuauuagaugaugaaaaguuggcugagacacccuucaaguga

SEQ ID NO: 4122434 - RNA, 56 nt, Human
uuacuuuauagaacacugggggauagauugcccagaaaauauguacuauaaaguaa

SEQ ID NO: 4122435 - RNA, 72 nt, Human
uuacuuuuuaugauaagaacugaaguaaaauauagcaaaauauuuugguucuuaggaguggaaaccuuguaa

SEQ ID NO: 4122436 - RNA, 63 nt, Human
uuagaaagauggaaaauggaacuugucuugaugacagugucugcuagguucaucaacuucuga

SEQ ID NO: 4122437 - RNA, 78 nt, Human
uuagaagauaaugacaucagaauggcauagaaaaguucucauucacuuugcaguauuuggauguaauguaucaacuga

SEQ ID NO: 4122438 - RNA, 97 nt, Human
uuagaagccugucaagagcucuuacuggaugugguaaugacuuugaacuugcuuucuucuguguuauuucugaauccauguuaugacaggcgucuaa

SEQ ID NO: 4122439 - RNA, 79 nt, Human
uuagaaggaaaaaaauuaaugugagucaaauuuggaacauugcuaaauuggauuaaaauaucuuuuuuuuuuuuuuuga

SEQ ID NO: 4122440 - RNA, 77 nt, Human
uuagaaguuuacaacugggcuugucagcuuuaaaagcacccuggaaggcuugacaauuuuacauguauuaauucuaa

SEQ ID NO: 4122441 - RNA, 59 nt, Human
uuagaaucuuguaucagaaguuguggaauuccagaguuucugaaguauauggguuuuaa

SEQ ID NO: 4122442 - RNA, 72 nt, Human
uuagacaggauguaugaaagcuggguaaaaauaguucccuaaaugauguuauuucauacaacuucugucuaa

SEQ ID NO: 4122443 - RNA, 73 nt, Human
uuagacauugagcuccucaagagcaggaacugcuuuaucuccacaguccagcucaggguuggcucaagucuga

SEQ ID NO: 4122444 - RNA, 81 nt, Human
uuagacuauaguauugguugcacacucuguuaauauacuaacugaaccguauacuuuaacguggcgaaccuuauaguauaa

SEQ ID NO: 4122445 - RNA, 76 nt, Human
uuagagacccagaugcugugauuguacaaccugauuucuuaaucugucaccugcaugcagcauaugaggccucuga

SEQ ID NO: 4122446 - RNA, 77 nt, Human
uuagaggcacagucuauguagaggagaaaacagaaugaguacccuuuccccugcuucuauauagcugcugcuuuuaa

SEQ ID NO: 4122447 - RNA, 56 nt, Human
uuagagguagaguuacauuagucuuaguauaaaggcaauuuuagaccugccuuuaa

SEQ ID NO: 4122448 - RNA, 56 nt, Human
uuagaguauagcuaacuguauuagguggaagcucaccuauauuuagcuaucucuga

SEQ ID NO: 4122449 - RNA, 57 nt, Human
uuagagugguccuuggagcccuuuuauacaaguaugggcuucucagggcuucucuga

SEQ ID NO: 4122450 - RNA, 80 nt, Human
uuagaguugcaguggcaagagggucuauuguugaagaucaucuuugugacauuauuuuauucuugcuaugaggauucuga

SEQ ID NO: 4122451 - RNA, 75 nt, Human
uuagauaaggaagugaauuggaaugaaguaacaguucuauauuagguaguuacacuaagcuacuucuauauuuaa

SEQ ID NO: 4122452 - RNA, 104 nt, Human
uuagauuaacaaggaauaucgugaucuuaacuguguguuuugcuauuaguaucccuuaguacuaggagaaaacuuacacugagauuaauucuuugucuuuuuga

SEQ ID NO: 4122453 - RNA, 60 nt, Human
uuagauucuaagauucuaagaaucucugcgucuagagguucuaagauucucagagucugg

SEQ ID NO: 4122454 - RNA, 80 nt, Human
uuagauugaaauacauaaaauugccauauuuguggguaaaaauugcucaaauauuggcaauuuuaggugguuuagucuaa

SEQ ID NO: 4122455 - RNA, 82 nt, Human
uuagauuggugcaaaaguaauugcgguuuuugccauuaaaaguaaugcggccaaaacugcaguuacuuuugcacccaccuaa

SEQ ID NO: 4122456 - RNA, 70 nt, Human
uuagauuggugcaaaaguaauugugguuuuggcugaaaaguaaaugcacaaagauuuugcacuaaucuaa

SEQ ID NO: 4122457 - RNA, 55 nt, Human
uuagauugugauacccagggacuaaauggaaacauucaggguuucacaauacuaa

SEQ ID NO: 4122458 - RNA, 78 nt, Human
uuagcaaaauaugacaugugaucucaagagguucccaaagcagaaccuuuaguccauuuagugucauucuugugcuag

SEQ ID NO: 4122459 - RNA, 111 nt, Human
uuagcaagaaaugauaggcugugauauauuuggaccagagcauuuuauagucauuuucaguauauauaguucugugaguuuaauguaucuauacuggacuuuucuuguuaa

SEQ ID NO: 4122460 - RNA, 71 nt, Human
uuagcacacaugcuucaugcaaaauucugagcaaaagaacugcagagcgaccuggagcauuuuacugcuga

SEQ ID NO: 4122461 - RNA, 122 nt, Human
uuagcagcuggaaagagagaguggccuuugacugagauagugugugaggaugucuucugaaaccauccuaagaaggaauuacaguuuauccaggaagagcgaguucuugagagagcuguuaa

SEQ ID NO: 4122462 - RNA, 65 nt, Human
uuagcaguuuccauuuuggucacauuacaaucaaugaugagcaacagggggauggccacuguuga

SEQ ID NO: 4122463 - RNA, 113 nt, Human
uuagcauauuuguauuuacuuugguacacucuucucacagucaguuuucagaucagaaauaauuaaaagaaagacuaaguaguugggagguaaaaguaaagacacguaguuga

SEQ ID NO: 4122464 - RNA, 70 nt, Human
uuagcaucucugggcuuugaguuuguucagcccuaaaacaggcaauaauaucuaccucagagggugcuga

SEQ ID NO: 4122465 - RNA, 66 nt, Human
uuagccuagcaggucaaaccagcugaugacuagccagcuccaauuacugaccugaccugcuucuaa

SEQ ID NO: 4122466 - RNA, 57 nt, Human
uuagcuaacucccaguucaauccacagcuugccacuugggaucuggaagcuagcuga

SEQ ID NO: 4122467 - RNA, 56 nt, Human
uuagcucacuauuucaggcuuuuaugccaguaacauaagagucuuuacugagcuaa

SEQ ID NO: 4122468 - RNA, 61 nt, Human
uuagcucaggcagugcccucuggccguggcaggcacugcaaugggcaccugcuugagagga

SEQ ID NO: 4122469 - RNA, 83 nt, Human
uuagcucauuuuccucaucgauaaaaugugggauaaugaggacacauucuccacagcauuauuagaaggaucaaauggacuaa

SEQ ID NO: 4122470 - RNA, 66 nt, Human
uggaaacugugggagaaggcgaugugaccagggacauuguuuagaauagccugcucauggugacca

SEQ ID NO: 4122471 - RNA, 77 nt, Human
uggaaacuuaccguuuggggaaauaagucauuguuugaaacaucccucaauuaucuccucaaagcagcaaguuucca

SEQ ID NO: 4122472 - RNA, 91 nt, Human
uggaaagaauauuaggaaguuauccauaguuuguuuacaugcuugcuaagugcauuauaaauuaugaauggcccuuuuaugguaauuucua

SEQ ID NO: 4122473 - RNA, 61 nt, Human
uggaaagaauugugacauuuaaggugcuuaguauuagguaccugaaguaagcauucaucca

SEQ ID NO: 4122474 - RNA, 70 nt, Human
uggaaagcucuggagcuuuaauugcuuuccuucuguuuuuggagaacaaagcaccacugagucaguucca

SEQ ID NO: 4122475 - RNA, 58 nt, Human
uggaaaguucugcuccaccgagcuuuuguaggcguugucagagagcagagcgguucca

SEQ ID NO: 4122476 - RNA, 78 nt, Human
uggaaauaaaucauuuagaggaaucugaaauaaaauuguagcaguugauuuauggcuucugugaagaauuuguuuuca

SEQ ID NO: 4122477 - RNA, 64 nt, Human
uggaaauaaccaucagccuucuucccaaguguuuucaacucagcauacugauggauuuuuucca

SEQ ID NO: 4122478 - RNA, 59 nt, Human
uggaaauagcuccaguuaagcacaucgaaaagauguuguuuuaaaugagauuaucucca

SEQ ID NO: 4122479 - RNA, 78 nt, Human
uggaaaucugaauaaauuagggacuuuaguuaauaacaauguauugauaucaguuugcugauuguaacagaugcgcca

SEQ ID NO: 4122480 - RNA, 71 nt, Human
uggaaaugcugacagacuauuaacuauagcagcacugcucuaauaaauggaauggccugucauaaucucua

SEQ ID NO: 4122481 - RNA, 64 nt, Human
uggaaauugugaugacagcugguggugggaaacaucacugaaauacugaaauuacuagugacca

SEQ ID NO: 4122482 - RNA, 66 nt, Human
uggaaauuguuaaaauggaguaaguuaucuauuugaggguaaacuaaccauuuuaauuucuuuuca

SEQ ID NO: 4122483 - RNA, 70 nt, Human
uggaacaaauuacaauuaacuuuguaguuauaaguuaauaugaagugguuaauauguaaauuugugacca

SEQ ID NO: 4122484 - RNA, 66 nt, Human
uggaacaacucccucggagccuccaagaggaaccaaccccacugaugcuuugauuugggauuuccg

SEQ ID NO: 4122485 - RNA, 79 nt, Human
uggaacagauaaggcucaggguuuaaguuucuugcucaaagacagacuguguuugaauccuaaguuucauuuuguucua

SEQ ID NO: 4122486 - RNA, 55 nt, Human
uggaacuaaguuucugguaccauaaauacaggaauggugcugagaugugguacua

SEQ ID NO: 4122487 - RNA, 76 nt, Human
uggaagacgagggaaggcaucacagaggcugugaggugaaccgacuucaaggaauggguccuucccuucagagcca

SEQ ID NO: 4122488 - RNA, 66 nt, Human
uggaagagcccaggcagagggaugcuugguuuucucuguaucguaaucaugucugggaugauuuua

SEQ ID NO: 4122489 - RNA, 97 nt, Human
uggaagaugucucugaauucagauauggagucuaaaaccacagaaugaaguagagcucaaugguuugggaaacauauuucugcaagacauccaacca

SEQ ID NO: 4122490 - RNA, 61 nt, Human
uggaagcaacaacuauggaccagaauguaaaucccauggaugguuuuacuugaugcuuuua

SEQ ID NO: 4122491 - RNA, 61 nt, Human
uggaagccaggggcugcuuaggagauaguauaaaugucuggaugguaaguggcuuggccca

SEQ ID NO: 4122492 - RNA, 58 nt, Human
uggaagcuggcugaucugacuugcuugcagaugucuguaacagcauuagcagcuucca

SEQ ID NO: 4122493 - RNA, 59 nt, Human
uggaagcuuccugaaugcucauuuacuaaggaguagaugagugaauuauggggcaucca

SEQ ID NO: 4122494 - RNA, 58 nt, Human
uggaagcuucugaccauuuuuggaauuuuuuggauaacucuuauggucuagguuucca

SEQ ID NO: 4122495 - RNA, 63 nt, Human
uggaaggcaugggaacuguucuccauuauggaaauauggguggaauauuucauaugucuucca

SEQ ID NO: 4122496 - RNA, 129 nt, Human
uggaaggcgggagcugaugagucacugagugugcuauugcaccaucauaauuguuagcaucauaaacaaugguauaugacgggguagagcagauuaaagagaaugaagugucuugugcaguucccucua

SEQ ID NO: 4122497 - RNA, 69 nt, Human
uggaagggcaugggaauguuuuugcuuuccagagaaagccacaguucuaugucugcuuuaaguuuucca

SEQ ID NO: 4122498 - RNA, 88 nt, Human
uggaaggucuugcaccuuucaucccccacaaggcugaggaacuugggcucugcccuguggacagugagaagugucgaaggaguuuuca

SEQ ID NO: 4122499 - RNA, 63 nt, Human
uggaaggugucagcaagucaaagccuucacauaucuguggcuuuuuauuacugacaacuaaca

SEQ ID NO: 4122500 - RNA, 75 nt, Human
uggaaguaauuuaucccuguaccgccuugugggguuggguguuucuugcccacugcaugaguugguauuacucua

SEQ ID NO: 4122501 - RNA, 88 nt, Human
uggaagucugguuuugaaguugguguggaaaguagcugcuguaugauucggaggcccauuuuauauccagccacuuccuggacaucua

SEQ ID NO: 4122502 - RNA, 129 nt, Human
uggaagugggagauagaaaauaaaggguggggucagguuccuuucuaaaaaccuaaaugcaugucaggcaaguagggcuuagaaaagaauuuacccuccuucaccucugucaccucaucccuccuucca

SEQ ID NO: 4122503 - RNA, 79 nt, Human
uggaaguguuuuagagguuagaggcugauaguggagaugauguuaccuccucuguuugugauuucuacgauuuucucca

SEQ ID NO: 4122504 - RNA, 57 nt, Human
uggaaguugaaucucagucauguacaccagaauaugaaugcgagaugacagcuccca

SEQ ID NO: 4122505 - RNA, 66 nt, Human
uggaaguugacuuuucugcgggaacuggcacuuuaaaguccagucaaaaggaagucaauguuuuca

SEQ ID NO: 4122506 - RNA, 100 nt, Human
uggaaguugauguacauaugcuguguuaauucuaucuugacuaucauuuccugaacagcaugauuaaguuaagcagcagauuauggucuacauuaaucca

SEQ ID NO: 4122507 - RNA, 67 nt, Human
uggaauaaagagugacuuuucagcugugacuauauuguuaaucauagaguugaucuuacucauuuca

SEQ ID NO: 4122508 - RNA, 70 nt, Human
uggaauaaauccaguguucaaaguuugaagaaauccggucggcuucaagcaagcgucuagauuuauccca

SEQ ID NO: 4122509 - RNA, 72 nt, Human
uggaauacaguguuuauguacagauuguuucgucuuuagacuuuaaauauccagucaaaacacuguuuucca

SEQ ID NO: 4122510 - RNA, 98 nt, Human
uggaauaccacuugaaaauagguugauuugaggaagcuaauugguuucuucuaagcuccuugaauuaaugcugcuauuauuuuucaacuaaaauucca

SEQ ID NO: 4122511 - RNA, 71 nt, Human
uggaauaucagacugagagaguaaaguagaauuaagaguugguugugcuuggcuacucuuaugagcuucua

SEQ ID NO: 4122512 - RNA, 59 nt, Human
uggaauauguggaagaacuuggugucagucaacuugccuccuggaagucacauguuuca

SEQ ID NO: 4122513 - RNA, 57 nt, Human
uggaaucuaaaaacgggcuugguuuuuuaccuaaaaucagucuugauuagauucaca

SEQ ID NO: 4122514 - RNA, 70 nt, Human
uggaaugaagcuggaaguuagguagacucuauccuuccugguguuuccuccaacucuccagcuuaugcca

SEQ ID NO: 4122515 - RNA, 120 nt, Human
uggaaugcuaggauauguaggauccauagggcaaauaguucuucugaaaugucuuaucugugacauuugaugacauuugguugagcuguugucaaaccuuuagcaaucuagagcauucca

SEQ ID NO: 4122516 - RNA, 88 nt, Human
uggaauucugaccuccugcaggcaggcucaaggcugacuuccaugggaacauggggagugccuugggcccccuaagauucagauacca

SEQ ID NO: 4122517 - RNA, 107 nt, Human
uggaauugcugagucaugugguaauuguguguguaacuuuaugagaaauugucaaacuguuuuucacaggaguuguaccauuuuacuuuccuaccagcaauguucca

SEQ ID NO: 4122518 - RNA, 59 nt, Human
uggaauuucucuguacugggaugcaaacaagagcugaaaauccuuaaagagaauuucua

SEQ ID NO: 4122519 - RNA, 65 nt, Human
uggacaaucagaccguucuggcuguccagucauuauuggauggccaaggagcagucccugauccg

SEQ ID NO: 4122520 - RNA, 57 nt, Human
uggacacauaucuuugauucccagaucuuuauagggagcuacagaguuugguguuca

SEQ ID NO: 4122521 - RNA, 68 nt, Human
uggacagagcgggacccugagggagcauagaauuggccaccacgagcccccaguguccagccuugcca

SEQ ID NO: 4122522 - RNA, 79 nt, Human
uggacagauggucaucguuucaggucgcccugaucuggacaagaaccaaaugagggauccagaggcagugguguguuca

SEQ ID NO: 4122523 - RNA, 62 nt, Human
uggacauaaaauucaguauuuagaguggaucgugcacauaaaugcugaaucuuuacuguuua

SEQ ID NO: 4122524 - RNA, 103 nt, Human
uggacauacagcucauacuguuuacucagcucauugaagccugccucccaugagauuugagaagcaggcucugguuggcaaguaaaggagagcaguuggccca

SEQ ID NO: 4122525 - RNA, 77 nt, Human
uggacaugucacacugaccacaucuguaagcaucuuaaguuguaacugcagauggggaucaguggcucccauuuuca

SEQ ID NO: 4122526 - RNA, 70 nt, Human
uggacauuaguagcuugcugugugauuguuaauuccaaucaguuuacauuaggucaagcugccaaguuca

SEQ ID NO: 4122527 - RNA, 119 nt, Human
uggacauuuugggcuggauguuucuuuguuguggggcggcuguccuggcauuggaggauguuaggcagcauuucugcuuauccaccagacaccuguagcaccaccccuaaguugugcca

SEQ ID NO: 4122528 - RNA, 129 nt, Human
uggacccaacacaagugguucccaguuuucaugugcccugccaagacugagugguuggauggcaagcauguggccuuuggcauggugaaggcaugaauauuguggaggccauggagcgcuuugggucca

SEQ ID NO: 4122529 - RNA, 58 nt, Human
uggacccaggcaggucuguccugcaaagucuuggugggacaccucaacucugggucca

SEQ ID NO: 4122530 - RNA, 77 nt, Human
uggaccuauguacugcccaguuagauaaaacuuaauccgugucugggauuagcaauuguuucauugaucagugucca

SEQ ID NO: 4122531 - RNA, 65 nt, Human
uggacgucgcacgucccuccugucacgaaacacacaaagaggacagagggcgaaggcgggguccg

SEQ ID NO: 4122532 - RNA, 86 nt, Human
uggacguggaaaagcagcccuggggaaccagaagaguugagguagagcuccucuaucagcuggcaguucagaggcuguuuccucca

SEQ ID NO: 4122533 - RNA, 87 nt, Human
uggacuacaacucccagaagacuuugguggagcuccccacuaucuucaugcucuauuacccugaagcuuccugggaguuguagucca

SEQ ID NO: 4122534 - RNA, 74 nt, Human
uggacuacuugaguucucauaauuuaucuaugucaucagcacucaauugacaauuuggaauucgaguaauucca

SEQ ID NO: 4122535 - RNA, 64 nt, Human
uggacugcagugcagcuguuaggcugaaauuaaacuugugagccuggagaaaagcugcaguuca

SEQ ID NO: 4122536 - RNA, 62 nt, Human
uggacuucauaauauugagcauguuugcuggagccacagcuuaaucaguaugagccuaucca

SEQ ID NO: 4122537 - RNA, 81 nt, Human
uggagaccugggugugggucaagcaaccagguaaucugaguuuuggcacuuuggaaagcuugaucugacgcuccuuuucua

SEQ ID NO: 4122538 - RNA, 61 nt, Human
uggagacugugcuaagggaguuaauagagaaauaccacuauuuccuuagccaguuuuucca

SEQ ID NO: 4122539 - RNA, 55 nt, Human
uguguccuuccaguuuuuccugcuaauacagguuggugcuuuuaggaaggacaca

SEQ ID NO: 4122540 - RNA, 95 nt, Human
ugugucucaucuucuuguauuuccuauaaccuuucucuuaugucucggcaaaagccaugcacaguagggguuacagggaguuacacugaggcaua

SEQ ID NO: 4122541 - RNA, 97 nt, Human
ugugucugggacugccugggggccagccugucucugcuccagggucccaggggucccuggcagagggggcaggugcuuggggaggacucaaggcaua

SEQ ID NO: 4122542 - RNA, 56 nt, Human
ugugucuuaguuuaggauucugacauuuaauucuucagaaccuaaguuaaaacaca

SEQ ID NO: 4122543 - RNA, 85 nt, Human
ugugucuuggagucuggaaugaugaagaccuugugcucuuaggcagguccuuccucuuuauuauuuuagaauucuucuggacuca

SEQ ID NO: 4122544 - RNA, 63 nt, Human
ugugugaagcacucugggugaucccuuacaagggagguaaauacaaccuguguuaucaaugca

SEQ ID NO: 4122545 - RNA, 79 nt, Human
ugugugacccgugcugugugauccaugcuggccaugugacccaugcuggccgugugacccaugcuggccgugugaccca

SEQ ID NO: 4122546 - RNA, 58 nt, Human
ugugugaggugguucugagaagagacauuugaaaguuuucauaaaccauucucaugca

SEQ ID NO: 4122547 - RNA, 57 nt, Human
ugugugauugcaggagauguggcuguagacaaagccugccuccccaucaguuauaca

SEQ ID NO: 4122548 - RNA, 57 nt, Human
ugugugcaagugacauuagaaaagcaaaagcucaggauaaacugugacuuguggaca

SEQ ID NO: 4122549 - RNA, 110 nt, Human
ugugugcaauugccagcaucugcuuugguguugcucuuggugcuggagcuuacuugcugcccaugugacaggagcagcucuaaaccaguggucgugagcucuguuucgca

SEQ ID NO: 4122550 - RNA, 56 nt, Human
ugugugcagcugaaaagcgcuguccugagcugagggugagcgcgcgcgcgcacaca

SEQ ID NO: 4122551 - RNA, 73 nt, Human
uguguggaaggaagugauuuucaugucaagguacgucaaaucagguugauaggaaaacacuccuuugauuaca

SEQ ID NO: 4122552 - RNA, 58 nt, Human
ugugugguuuucauauaaucacuccaagcaaaugcgcugaucacaugaaaaccaugca

SEQ ID NO: 4122553 - RNA, 66 nt, Human
uguguguauguauguaugugugugugugugugcgcauguacaugcacaccuauauacaugugcaua

SEQ ID NO: 4122554 - RNA, 59 nt, Human
ugugugucagggcuagagcugggaccacaaccugcucccagcgcugagcccugcaggca

SEQ ID NO: 4122555 - RNA, 59 nt, Human
ugugugucagguacugugcuagggacuaagaauguggcccuaaacaagacugacacaca

SEQ ID NO: 4122556 - RNA, 59 nt, Human
ugugugucagucuuguuuagggccacauucuuagucccuagcacaguaccugacacaca

SEQ ID NO: 4122557 - RNA, 72 nt, Human
ugugugugcacacgugcgugugcaugugugugucugcacaugcaaaugugcaugcauguuugugcauacaua

SEQ ID NO: 4122558 - RNA, 89 nt, Human
ugugugugcugaaaccugggccucagagauggucagugagaaggacuaggucauucauugccucucugggcccucuuagcuaccacaca

SEQ ID NO: 4122559 - RNA, 82 nt, Human
uguguguguguauaaauguguguauguacauauauauguauacauauauguauguauauguauuuauuuguauaugcauaua

SEQ ID NO: 4122560 - RNA, 57 nt, Human
ugugugugugugcacgcguguguguguguguaugugugugugugcccucaccacaua

SEQ ID NO: 4122561 - RNA, 65 nt, Human
uguguguguguguauguguguguauauauuuauaugugugucuauacaugugcacacacaucaca

SEQ ID NO: 4122562 - RNA, 81 nt, Human
ugugugugugugugugugugugugcauguccaugaauguucuucaccucaugaacaucucaaauaaccaugcuuccacaca

SEQ ID NO: 4122563 - RNA, 81 nt, Human
ugugugugugugugugugugugugugugugugugugugugaugguacacauguauggcacuuacauuuucacugagcagca

SEQ ID NO: 4122564 - RNA, 75 nt, Human
uguguguguguguguguguguguguguguguguguguguguguguguaguuauaccuuauacacauaugaaaaca

SEQ ID NO: 4122565 - RNA, 65 nt, Human
uguguguuacaguuuauguaugcuguacauguauggguauagacauaaacuuacugaaauacaua

SEQ ID NO: 4122566 - RNA, 61 nt, Human
uguguguuaucuuaguucaucucacaaaagcccuaggaagagaugacuacgaugaugccca

SEQ ID NO: 4122567 - RNA, 59 nt, Human
uguguguucccggagaugcugucuggggcccuuuuccugaacuucugaggaacugcaca

SEQ ID NO: 4122568 - RNA, 74 nt, Human
uguguguucuauucugauucguguggauuuguucaaguaaauaauaacuuugauaagaaucagggaggccacca

SEQ ID NO: 4122569 - RNA, 71 nt, Human
uguguguuuuucagggaacaucugacuacauucagaagcacgucaggaguuccuaugugggcagagacaca

SEQ ID NO: 4122570 - RNA, 74 nt, Human
uguguuacagcugcuuuugugaaauaaagauuguccauuucuuuuuaugauuauuuuaaagcagcuuuuaugca

SEQ ID NO: 4122571 - RNA, 65 nt, Human
uguguuaggcuuuuaucugaagccacagaccaaaucuuggaaucauucuuaaaggucugacugca

SEQ ID NO: 4122572 - RNA, 59 nt, Human
uguguuauuugguuauuguaauugggauuuuucccauugcauuuaucaaauauuuaaca

SEQ ID NO: 4122573 - RNA, 55 nt, Human
uguguuccagagcauccaggucuucuucggaaccuucccgggcuuuggugacaca

SEQ ID NO: 4122574 - RNA, 58 nt, Human
uguguucuggaaagcucacugaaucuugaaggagacaggggagccaggcuaggaagca

SEQ ID NO: 4122575 - RNA, 76 nt, Human
uguguuguaaggggauggauagcugugaagcuagccuaugguuucagggucuagaguaucuaccucuucuaacacg

SEQ ID NO: 4122576 - RNA, 76 nt, Human
uguguugugugggguuuuuuugguguguguguguggaaugacagauacauauagaaaacaucaacaaagugucaua

SEQ ID NO: 4122577 - RNA, 118 nt, Human
uguguuguuuucgucuugcuuuacacauguaagccuuucuguucaccugcucaaaaacuuauuuggcucugugagaacaaaggcuauaccugucaaguauucuccacagcccagcaca

SEQ ID NO: 4122578 - RNA, 118 nt, Human
uguguuucauaugucuuucauuccuuuaagauagcauacauguuguuacuuguuuugcacagaagaaacuagggcuuggcaauuuguaugucgguaaugucagauaagugaugucaca

SEQ ID NO: 4122579 - RNA, 105 nt, Human
uguguuucuucucaugauucuaggcauugaagauacagcagagaacaaaacauaaaaaaaucacuuaucuucugcagucuguguucucaugaggggaaacugaca

SEQ ID NO: 4122580 - RNA, 55 nt, Human
uguguuucuuuguuccuuguggggcagcccuuucccugaacacagaauaagcaca

SEQ ID NO: 4122581 - RNA, 61 nt, Human
uguguuugaguccucacagugccccaggaguuccuacccaccugugaacugcuuaaagcca

SEQ ID NO: 4122582 - RNA, 86 nt, Human
uguguuuguuuacacagaaauuaauaugcuuuaucauguacaauucaaaagaugaggcaauuguuuguguaauagggcuuaacaca

SEQ ID NO: 4122583 - RNA, 82 nt, Human
uguuaaaaugcuguguccagggccuuaccucuucagauucugacucaaucugggguggagcccuggagucugcauuuuaaca

SEQ ID NO: 4122584 - RNA, 80 nt, Human
uguuaaagagcucuuacucuaguguacuagugugucuaaguuuguagcugguaucauuccgaaguggagcucugaaagca

SEQ ID NO: 4122585 - RNA, 76 nt, Human
uguuaacaaugucagaauuacaguugauuuuuacuuccuccuuuggaauuuucuguguuucugaaguugucagaca

SEQ ID NO: 4122586 - RNA, 72 nt, Human
uguuaacacagaguaaguggucaauaauauuugcuaagaacaaagcuccauugaugcacugcuuguuuaaca

SEQ ID NO: 4122587 - RNA, 68 nt, Human
uguuaacauguggcugguaguugacaacuucacuguugaggaguucccaguccccagccacagagaca

SEQ ID NO: 4122588 - RNA, 98 nt, Human
uguuaauguuguuuguuuugcuuuguuguuuauucuaauuucuucaaaagagggaauauuagguaagauaaagcagaggaucuggaugacaauggaca

SEQ ID NO: 4122589 - RNA, 82 nt, Human
uguuaauuugauuguaggagcuaaaauauuuuauauguauaauauguagaaaguuauuuuacucuuaucagguaaauaagca

SEQ ID NO: 4122590 - RNA, 62 nt, Human
uguuacacauuaacaggcagcuaaugcagucucuguucgcauuuuuauccucguguguggca

SEQ ID NO: 4122591 - RNA, 60 nt, Human
uguuaccaaggcugcuucuaguggccuucggcggucuccuugggaguuuccaugguaaca

SEQ ID NO: 4122592 - RNA, 129 nt, Human
uguuacccaccacguugacauuugagucaguguacucaagagccagguaagcacagggaaacaaucauuuccuguagcaugaguggucuuaagacaucuagcuuccuguugagcaagguaagaaugaca

SEQ ID NO: 4122593 - RNA, 102 nt, Human
uguuacccagaugacagguaaccgccaacucaggguccuucacuucaggcggaaaauauuaagugcaaagggaucagauugggaagcugucaucuaguaaca

SEQ ID NO: 4122594 - RNA, 76 nt, Human
uguuacgccagaguguuaaaguacugugcugucuuccacagauccucaggcacagaauaacacucugggcugcaca

SEQ ID NO: 4122595 - RNA, 57 nt, Human
uguuacuccugguugagcuuggugcugaugaccuguuuacccagcccaggaguggca

SEQ ID NO: 4122596 - RNA, 74 nt, Human
uguuacuugacacagucaacuugauuuuucucugaaacaauaaaaggcaaagagaaaagcaacacgugucagca

SEQ ID NO: 4122597 - RNA, 75 nt, Human
uguuagagcaauaguuguccaucagcagaugaaauagaauucagcugucagaugcgauaaacuagugaauauaca

SEQ ID NO: 4122598 - RNA, 60 nt, Human
uguuagauguuccacauauauauguagaagaauggcuuucuagguguggaguuucuagca

SEQ ID NO: 4122599 - RNA, 75 nt, Human
uguuagauuggugcaaauguaauugccauugaaaguaauggcaaaaacugcaauuacauuugcacuaaccuaaua

SEQ ID NO: 4122600 - RNA, 104 nt, Human
uguuagccaggagggucucgaucuccugaccucgugaucugccagccuuggccucccaaagugcugggauuacaggcgugagugaccgugcccggcuggcaaca

SEQ ID NO: 4122601 - RNA, 76 nt, Human
uguuaggaagcuauuaaaaggcaagaguaugcuggcaaaaugauuucagugugugccuuuggauaccugcuuagca

SEQ ID NO: 4122602 - RNA, 78 nt, Human
uguuaggcuggugcaaaaguaauugugguuuugccauuaaaugacaaaaaccacaauuacuuuugcaccaaucuaaua

SEQ ID NO: 4122603 - RNA, 119 nt, Human
uguuaguagacaaaagugcugcagaauaguaaaagguaagagacauaaagcucauuaacgauuagaauugacaaguguugcauuuugccauuauuuuguuucauuauaguauuuuaaca

SEQ ID NO: 4122604 - RNA, 93 nt, Human
uguuagucuacauaccauuauuuguguucaagauuaguucuagugguugcuaauuuuacuuuuaauacuugaagcaauguaaugugauuuaca

SEQ ID NO: 4122605 - RNA, 73 nt, Human
uguuaucauguucaucguauuuaggcuggcuaccacugagaaagccuggauaauggugguacuuguggucuca

SEQ ID NO: 4122606 - RNA, 57 nt, Human
uguuauccucagcaagugaauuuucauaauaugaaaggccauuucugaggguuugca

SEQ ID NO: 4122607 - RNA, 57 nt, Human
uguuaucugagcaacgucgacgggggagaacaccccugcccgagguuaaagauagca

SEQ ID NO: 4122608 - RNA, 72 nt, Human
uuaugcaaauauucaagacuuuuccaucauuuaugauaacaguguugggaaagcuaggauauucaaguauaa

SEQ ID NO: 4122609 - RNA, 62 nt, Human
uuaugcacacaggcuuaauucaugggauguuaaaaucuuacugaacuaaaucuuguguauga

SEQ ID NO: 4122610 - RNA, 72 nt, Human
uuaugcagauggcaugaggaggaauugucagcgguugucacugaggaacugcucucucaccaucugacauag

SEQ ID NO: 4122611 - RNA, 73 nt, Human
uuaugcaguaauuguaaacugauuuggaaaaaaaggaaaucuaaaucugugaagcguuuacauuacugaauag

SEQ ID NO: 4122612 - RNA, 72 nt, Human
uuauggaucuuacugguaagugauguguaacacuuuugcccacauucuacuggccagaacuaagucacauga

SEQ ID NO: 4122613 - RNA, 121 nt, Human
uuauggguugguuuauagugcauugcccauagaugggcccaucuguccaacagucugugugauaccauaccuucuacagacaugggccgcucuugaggagugccuauaaaccugcuguuaa

SEQ ID NO: 4122614 - RNA, 83 nt, Human
uuaugguauucuuuuaugugagacaugaaaauuccaaacauccuguacuuacuaagguucugucuggcaaaggauuaccauga

SEQ ID NO: 4122615 - RNA, 68 nt, Human
uuaugucucccagaggcaguugguaacuuauuuacaacuuuagguuccucucagcucugggaacauag

SEQ ID NO: 4122616 - RNA, 88 nt, Human
uuaugugauuacagauccaagugaugaaauuuacuccaccucuugaugagaaggcagcaaagucacauggaaaaggguaggcauauaa

SEQ ID NO: 4122617 - RNA, 90 nt, Human
uuaugugguuagagagaaggggcuggugaauucuaggauggcuuugacuuccugaacauuaugcaagcuucauuuuuuucuaucauauaa

SEQ ID NO: 4122618 - RNA, 76 nt, Human
uuauguuauauuggcagaagagaagaugauagcugugaaaaauguagccuucuuugauuuuguuacuaagacauga

SEQ ID NO: 4122619 - RNA, 80 nt, Human
uuauguuuuaaaaauugcuauaugugaaugugaauguucaugcauuuacaugcauauauguguguguuucugugauauga

SEQ ID NO: 4122620 - RNA, 126 nt, Human
uuauuaaaaagaaccaccuuuauugggggaauuuggagugguauuugaaucaaauauuuccauguauuguauucauugcuuacccaauugaaaaguuuaguuucuccaugauuuucuuucaaauaa

SEQ ID NO: 4122621 - RNA, 86 nt, Human
uuauuacauuggugcaaaaguaauugugguucuugccauugaaaguaaugguaaaacccgcaauuacuuuugcaccaaccuaauaa

SEQ ID NO: 4122622 - RNA, 77 nt, Human
uuauuaguuuacuguagucuaaauauagucuuaguuuaccauauucuaaguuaauagggauuuuagugaauuuguaa

SEQ ID NO: 4122623 - RNA, 129 nt, Human
uuauuauauacaagauguagcuuaaguguucuggaaaugaguaaaagugaaucuuaugucucagauagaauguaggaguacuuuugcaugacaggaacuuggcagcuugcauuucuugugucaauauaa

SEQ ID NO: 4122624 - RNA, 92 nt, Human
uuauuauuacucauuccauaauaacaaugccagaugccuaucagccgcaaacuaugagauaugcacuguuguuauuggauaaguugugauaa

SEQ ID NO: 4122625 - RNA, 56 nt, Human
uuauuauuuccauuucucagaguaagaaauugaggcucugagagucugagugauga

SEQ ID NO: 4122626 - RNA, 81 nt, Human
uuauucacccauucauuucauucaacaaacuuuuauggaaugccaguguauguaaaggauugagaugaauaaagugaguga

SEQ ID NO: 4122627 - RNA, 63 nt, Human
uuauucacucauuuaacauuauaagccuggcacagggcauggugugagucuugagcuggauga

SEQ ID NO: 4122628 - RNA, 70 nt, Human
uuauucaucucugcauauagagucaggccugugguaggugcucaaggacuucucugcaugagauaaguga

SEQ ID NO: 4122629 - RNA, 63 nt, Human
uuauucuguuugccgaccaguaagaaggucacguggcuggagcugaguaagcaaggggaauaa

SEQ ID NO: 4122630 - RNA, 69 nt, Human
uuauucuuuucuccagaaucccagccuagccagaauccccaggccucccacuucuugaggagagauuag

SEQ ID NO: 4122631 - RNA, 58 nt, Human
uuauugaguaucugcuuggugucaggcucuauucuagguauuggggauacuacaguga

SEQ ID NO: 4122632 - RNA, 80 nt, Human
uuauugaucugcuacugugucccagccgccguggagcccucggucuaguggggaaggaggacaagaagcaagauuaauaa

SEQ ID NO: 4122633 - RNA, 59 nt, Human
uuauugccucaucugcauagguaaaucagaguggucagcagugcagggugaggcagcgg

SEQ ID NO: 4122634 - RNA, 57 nt, Human
uuauugccugauugaggucauuacccuauggugguaaugacaucagcaauguaauaa

SEQ ID NO: 4122635 - RNA, 70 nt, Human
uuauugcuguuguuauggcacuguccuugaaauugcagagaaaauacaggucaacgagagcaggcaauga

SEQ ID NO: 4122636 - RNA, 81 nt, Human
uuauugggcuccacacuccuuuuucucaucugauguuuuacaaauauuuuucuaauugccugagacagugugguccaauaa

SEQ ID NO: 4122637 - RNA, 90 nt, Human
uuauugucuccauuuauuuaggaggaaacugagguuugggaagguuagucacuuuaccgaaguuucuuccuaaaccagcggggacaauaa

SEQ ID NO: 4122638 - RNA, 55 nt, Human
uuauugugcaucuacugugugcaggcccugccuggacacuggggaugcgcagugg

SEQ ID NO: 4122639 - RNA, 66 nt, Human
uuauuuaaacucuuugaaccucaguguucucaucugugcagaugaugcucacuucagagaagauga

SEQ ID NO: 4122640 - RNA, 116 nt, Human
uuauuuaaucuuuauuaaauuaaauucuuuauuuguaaggcagggccaguaaaaccauaaauauuacuggcucugcuuuacaaacagggaagcacauguuccaagaaguuaaauga

SEQ ID NO: 4122641 - RNA, 129 nt, Human
uuauuuagagaucaaacuggcagaaugucagugggaaucugucgcguguuugguuuucugaagcacagaaagcuuaugaaugggcaagaugcugaauuccgcugugaugcccgaaacuuucuaaaaaua

SEQ ID NO: 4122642 - RNA, 64 nt, Human
uuauuuaguccucacaacaacuuuaagagcuagauaccuuuuaaggcacagagagguuaaguaa

SEQ ID NO: 4122643 - RNA, 69 nt, Human
uuauuuagucuuuuauucaaggcuaagucaguugcugcuuuggcuugcauauuggaaagacucagauga

SEQ ID NO: 4122644 - RNA, 93 nt, Human
uuauuucacuauggcacagugggaaaugaccuuuguaacaaaugccacaucagguaaaugggucauuuuacuuaaauugccuauaugagauaa

SEQ ID NO: 4122645 - RNA, 95 nt, Human
uuauuucaucaaagauguuuuuaaacugggagaauaacuuauuguauuggauuugaugcauuagaaccuauaaaaagcaucuuugcgacagauaa

SEQ ID NO: 4122646 - RNA, 91 nt, Human
uuauuucucuucuagacacugagcuuccaagauggggacuauguccuauccacauauuccagacaccaagcuuagugccugauugaaauaa

SEQ ID NO: 4122647 - RNA, 68 nt, Human
uuauuucuuuuucuuauuuuaugagauugacugaaaaguccaguacaauguuaaggaaagagagauag

SEQ ID NO: 4122648 - RNA, 124 nt, Human
uuauuugacuguagagguuaauccuuaacuguagguuugugguugggggccuucuuagaaaagcuguauuuuggcaggaaccuuaaccacaaauauuuaggggguuuucuuuguaguucaauga

SEQ ID NO: 4122649 - RNA, 87 nt, Human
uuauuugagacuaauuaaaggacugaugacugcaugcccgauuuuaugauuaagucaguuauucaauugguuuaaagcaucaaauaa

SEQ ID NO: 4122650 - RNA, 73 nt, Human
uuauuugcauucugcucauccugacaucucuuccucccacucuugauguuuggcaguuuuagagugcaaguga

SEQ ID NO: 4122651 - RNA, 110 nt, Human
uuauuuguuuaccuuuauauaucuugauuuguuccacaaagaauuuggaguggcuuguaagaauuguuagcucaacagugggauagauugauggauagagauauaaauaa

SEQ ID NO: 4122652 - RNA, 62 nt, Human
uuauuuuaccuguccauuaugugcugcuuucuauagacuaugcacaagggcaggcaagguga

SEQ ID NO: 4122653 - RNA, 55 nt, Human
uuauuuuaccuuccucugagcugcuaaucgccugccucugagcugggugagauaa

SEQ ID NO: 4122654 - RNA, 80 nt, Human
uuauuuuauguuuuccucauaugaguuuagaaucacuacaugaaaauugauucucugauggagaaagacauugaaaguaa

SEQ ID NO: 4122655 - RNA, 86 nt, Human
uuauuuucugauuugauaguguaaaauuuccaucugcuuucacuuuggagcaguuuggaaaauacuagaaaaaaauuaggagguaa

SEQ ID NO: 4122656 - RNA, 130 nt, Human
uuauuuugccuguuuuagauucuuccggaggaccccugggcuugguuccaaccuguauccaucagcuccugagguuggccaaccagaacggaggucuagcuguucagugaugaaaccggccuuugaaugg

SEQ ID NO: 4122657 - RNA, 57 nt, Human
uuauuuugguggcagcauuuucuaguuuuccugccagaaugucugccuucacaauga

SEQ ID NO: 4122658 - RNA, 64 nt, Human
uuauuuuuauggcauuuggugugacuacccucccauccuggagacaucagaguugugaagguag

SEQ ID NO: 4122659 - RNA, 64 nt, Human
uucaaaauguacagcugucuuuccucccaugaaagcccagggauggaguugguuuacuuuugaa

SEQ ID NO: 4122660 - RNA, 72 nt, Human
uucaaaauuguaagaagaaaaaugcugcaaaguuacaagauucuaugcaguguuacuugguuugcagaugaa

SEQ ID NO: 4122661 - RNA, 65 nt, Human
uucaaacaaaacucuuuccuauaaugcaaacucaggcggcaggaaauaucauggguuuuguugaa

SEQ ID NO: 4122662 - RNA, 63 nt, Human
uucaaacauuuucuacuuccaggacucaucuccaugcuguguccaguagagacuaugcuugaa

SEQ ID NO: 4122663 - RNA, 123 nt, Human
uucaaacuugacuauuuggcagacauuaucuggaaaaugaacaaauuaauucugucacuuccaagaaaauaagugacaguauuuguugccaaugaugaaacucaagcuuucaagaauuuugaa

SEQ ID NO: 4122664 - RNA, 92 nt, Human
uucaaagauuuggggaguuaaugccaaagauauguuagcagguaagaaucccacauccucuagacguuugcguugguccucaagacuaugga

SEQ ID NO: 4122665 - RNA, 76 nt, Human
uucaaagcgaauacaagccugccaccuggaggaaggacugcaccccuucagguacuaagugcugauucacuaugaa

SEQ ID NO: 4122666 - RNA, 57 nt, Human
uuccacuuucccugccuggguacucacaccuugugugcccaugugggagggguagaa

SEQ ID NO: 4122667 - RNA, 63 nt, Human
uuccagaaucuuguuucuuguguguuucugguuaggagaggccacaagagagauucuccugaa

SEQ ID NO: 4122668 - RNA, 57 nt, Human
uuccagaguugggggagugguuggagaaauaaacaacuaauuaccuaacauugugaa

SEQ ID NO: 4122669 - RNA, 64 nt, Human
uuccagcagccucugaccaggaaggccaaguacacggucagucucuggccagagccugcgggaa

SEQ ID NO: 4122670 - RNA, 72 nt, Human
uuccagcccugccuggcuaaacucaagucgcucaacuccugauugacucauagucuagguauuugguaggaa

SEQ ID NO: 4122671 - RNA, 130 nt, Human
uuccagcuagaauugagaaaacaucugagucaaugucauaaaguaggcaagcauuccauuuaauaguuuguaauauguuggcuaugguuugcuuuguuuuugcuuugcuuugauuuuguuuuuguuggaa

SEQ ID NO: 4122672 - RNA, 76 nt, Human
uuccagcugcuguaacagaauacuuuauaucaguuaauuaacaaacaacagaaguuuacugcuugcaguucuggag

SEQ ID NO: 4122673 - RNA, 94 nt, Human
uuccagcugucugugcucccuaauugguuuccacacugcagccagcaaagggucucuaagcugcugaugggugggauacggagggaagcuggga

SEQ ID NO: 4122674 - RNA, 55 nt, Human
uuccaggaagauucaacaaaagccacggcuucucugaguuuguuguuuccuggag

SEQ ID NO: 4122675 - RNA, 55 nt, Human
uuccaggaagcucucggccucuagcugaccgcguugcugcugagcuucccugggg

SEQ ID NO: 4122676 - RNA, 62 nt, Human
uuccaggaggcauucuuaguuuaaagguuucuuugucuuuucuaagugaucuccaguuggaa

SEQ ID NO: 4122677 - RNA, 67 nt, Human
uuccaggcaugucagacauaggcaaaauggcucuaauugccucacuuuuccuucugacgcuugagaa

SEQ ID NO: 4122678 - RNA, 71 nt, Human
uuccagggagcucugggccggacuccacuuucugggaauagaguuagguggccagugcucucagacuggaa

SEQ ID NO: 4122679 - RNA, 57 nt, Human
uuccaggggaagcagggaggagccaaauaacaggccuuuccagcauuuccuugugaa

SEQ ID NO: 4122680 - RNA, 66 nt, Human
uuccaggugacuuuuaaucuauauauguuugguaaaacuauauuuggaaagaaaaucauugaggaa

SEQ ID NO: 4122681 - RNA, 61 nt, Human
uuccaguucacuccauuucuggaaacaacucacccaucuccaggaaaaauggaaacuggag

SEQ ID NO: 4122682 - RNA, 63 nt, Human
uuccaguucccaugaggauuaaaaggaagaaguggacuuuaacuccagcgaugggacugugga

SEQ ID NO: 4122683 - RNA, 84 nt, Human
uuccaguuggcuguauuuucaucuuguccuuggaugacaggcuguguuaucagcagggaugguugaggugcagcugagauggag

SEQ ID NO: 4122684 - RNA, 63 nt, Human
uuccauaauaggcuuaagugaaguagguagugagacacgcaucauaugaugccuaugauagag

SEQ ID NO: 4122685 - RNA, 56 nt, Human
uuccauauuggaaggcacaggccuagagcaaugccuggcacacaguugacauggaa

SEQ ID NO: 4122686 - RNA, 87 nt, Human
uuccaucagcaagaccuuauuuuuaccuaauuuaugagagguauuucucuguucagaagaggugaaaguucuggcuucuggggggaa

SEQ ID NO: 4122687 - RNA, 77 nt, Human
uuccauccgcgaauguuuagcuuguuggaacaauugauuugucgguuccagaagcgaguaaacugaccugcgaggaa

SEQ ID NO: 4122688 - RNA, 58 nt, Human
uuccauccugacuuacaaagggguggcuuagagccccuggaguacuaaggggauggaa

SEQ ID NO: 4122689 - RNA, 80 nt, Human
uuccaugagaugaugguggguaauguguaaaagcugaacugcuucuugcugccaucaccacaccauguuauguuaaagaa

SEQ ID NO: 4122690 - RNA, 59 nt, Human
uuccaugaugaauucagcauugaggaaagaacagguaaccucagcuggguucucaggaa

SEQ ID NO: 4122691 - RNA, 87 nt, Human
uuccaugcccagagaaaguaauaugguuuuccucugcugcuuaacauauaguuacaccucagugagaagaucuuucuguucauggaa

SEQ ID NO: 4122692 - RNA, 91 nt, Human
uuccaugucagacauccagacauugaaguauuuuugucgauaaagugucaaggaaauugaccaaaguguucaguuugcggaugauauggaa

SEQ ID NO: 4122693 - RNA, 100 nt, Human
uuccauguguaguaacggggucuccauuucuaaguuggagaaguucaugguaucacuuggaagacuccuaggguuggagacagugacaccucauauggaa

SEQ ID NO: 4122694 - RNA, 67 nt, Human
uucccaacaaugcacuaucguaagugguguugcauaaacaucucauacuucgcugugcaugugggag

SEQ ID NO: 4122695 - RNA, 59 nt, Human
uucccacccccaaaugggcucuacuuugcagauaguaagagccccugguggagugagaa

SEQ ID NO: 4122696 - RNA, 73 nt, Human
uucccagaaucuuuggaagagcaaaaacucucaucuucaaagacaauugcuuaaaauuuuccaaggauuggag

SEQ ID NO: 4122697 - RNA, 60 nt, Human
uucccagagauaagacgucuuauuccuuucacuuagaggguguguguaugucucagggaa

SEQ ID NO: 4122698 - RNA, 66 nt, Human
uucccagagcagaugugcuaaagaaaggguaagcugaggcguuccuacucagaucagcuuugggag

SEQ ID NO: 4122699 - RNA, 65 nt, Human
uucccaugcccgguggguggaauucacagaauucuuccuguuuccuugaaagcuggacauggggg

SEQ ID NO: 4122700 - RNA, 64 nt, Human
uucccauggcaucuaaucccagugagugcuccaaagccaggcuguguaucagaugccacgggaa

SEQ ID NO: 4122701 - RNA, 80 nt, Human
uuccccaauuaccaauauuuuagagcugagcuuacagucaaauaacucuacuugcuuaggaaaaugguggaguugaagaa

SEQ ID NO: 4122702 - RNA, 99 nt, Human
uuccccacacucucuuauaauucaggauucaaaugugguucaggucaucaaucagcuacacuugcaugagucuugaauccagaagugagucagguggag

SEQ ID NO: 4122703 - RNA, 85 nt, Human
uucccccaacgaggcacacauuuuguauguguuuacaauuaagaauuugucauguauaagacacuguguucaaugcuagugggaa

SEQ ID NO: 4122704 - RNA, 72 nt, Human
uuccccgugguaauauaucaaagacauucauuacaggcuacuguggcucaggugauauauuacucaggggaa

SEQ ID NO: 4122705 - RNA, 98 nt, Human
uguuguugugagcuuugauuuuaaggucuuuguuauugccggauaaucaagcaaaaucugacuaauacagggcacuuugagugaggcucaucccaaca

SEQ ID NO: 4122706 - RNA, 78 nt, Human
uguuguuucaguaagcaaucuaaaagccuuaccuaauacauuagauaggugagaguguuuuuagguuagcagacaaua

SEQ ID NO: 4122707 - RNA, 79 nt, Human
uguuuaaaccaaaacucuuccuuucuuuaaaguauggucugcucuacugccagagacaaggaugaguaaaguuuagaca

SEQ ID NO: 4122708 - RNA, 130 nt, Human
uguuuaaacuagcauuaaaucauggaagucaaguuucucuuugaugggagucagugggaaauaaacucuacuuguucuuucaagagauagcaaaauauuuguuuccaauuuaaaugcaggaaguuaaaaa

SEQ ID NO: 4122709 - RNA, 106 nt, Human
uguuuaauauaugcuuuacauuuuggaaaggugaaguguacauugauuuuucuguuguuuuucuuguaguguuaccucuuucaaagguguaacaugcuauuaaaca

SEQ ID NO: 4122710 - RNA, 83 nt, Human
uguuuaaugguuuaguggaagugggagggaagauauugcaaaagguaauaugcuagugugcuuauacuuggacuuuuuagaca

SEQ ID NO: 4122711 - RNA, 72 nt, Human
uguuuacauaagccuuaaauguuucuaauauucuuacagggugggcagaacauuuguaggcuuaacugagca

SEQ ID NO: 4122712 - RNA, 81 nt, Human
uguuuacuguggagagaggugaaaagagauggagcagguaggguucugccaucaggacagcuucuuuucacuguagguuca

SEQ ID NO: 4122713 - RNA, 104 nt, Human
uguuuacuucauacuaaaacauuugcucuuuucuaaaacuuuuuuaguauaccauuggcuaccaggcuauacaaguguagaauagagaaaaggaugaaagaaca

SEQ ID NO: 4122714 - RNA, 68 nt, Human
uguuuacuucuuuccauggcuugcaaaccucuucuacugacaagucuacugggaaaggggggugagca

SEQ ID NO: 4122715 - RNA, 85 nt, Human
uguuuagcucugagaccauuaacaugauuuuggggaaucauuuugauuuucaggaaacauuuaauggcauuaaaaagacugaaua

SEQ ID NO: 4122716 - RNA, 82 nt, Human
uguuuaggcaagagugacuacgugaaagaaauauuuuagggcgagcaaauucuuuuaaaggauacucuugucuacaaagaca

SEQ ID NO: 4122717 - RNA, 97 nt, Human
uguuuaguuugcuggccugugggucuccaugaguucuguugcuuugggcugcacaaaugcugggaaccauuggaucagccaccccagccacuagaua

SEQ ID NO: 4122718 - RNA, 71 nt, Human
uguuuauaccuugguauaaccacucuccuguuuuggggaacuagguuucugguuuugcuccaguauaaaua

SEQ ID NO: 4122719 - RNA, 61 nt, Human
uguuuaucugugcuuauguuuaaauaauaguuuuguuagauaugguuugcauaaauaagca

SEQ ID NO: 4122720 - RNA, 79 nt, Human
uguuuaugggccuuacuuggggcugacuccaucacugaauccaggaguagucacagaaacccagguguggcagucaaca

SEQ ID NO: 4122721 - RNA, 66 nt, Human
uguuuauugagugccuacuauaggccuggcaagucuucuagguacugguuagcauugagcaagaca

SEQ ID NO: 4122722 - RNA, 59 nt, Human
uguuuauuuaacaggaagucuggagauaggcauccuaggccuggccugguggaucaaca

SEQ ID NO: 4122723 - RNA, 62 nt, Human
uguuuauuucuuuguuacugagguuauguaucuagacauguuucauaaagaggaaauaaaua

SEQ ID NO: 4122724 - RNA, 57 nt, Human
uguuuauuuuauuuagagagcugggaccuaccaugcucagauucugaauaauaaaca

SEQ ID NO: 4122725 - RNA, 77 nt, Human
uguuucaagaauuucugcaucucuggagaucuaugggauggcucugggcuccagauugcagcgaucacuguggagca

SEQ ID NO: 4122726 - RNA, 67 nt, Human
uguuucauggagagcugaauauuccuauuuccuuucuggcauuaaaauaucagcauuccaugguaca

SEQ ID NO: 4122727 - RNA, 110 nt, Human
uguuucauuuagaaaucugaaugauggaguguuggcagagggccaccagaauucaaaagagguugaguuuaauccuccagcccaacuguccacauuuagaaaugacaaca

SEQ ID NO: 4122728 - RNA, 57 nt, Human
uguuuccagaaggacaaagaaaagaaauacuuuucuccccagucuaaucuggauaua

SEQ ID NO: 4122729 - RNA, 83 nt, Human
uguuuccagcugcagccgagugacauuggugucaucaaugaccuuguggagcccacggaugucgcuuuccgcagacuggcgca

SEQ ID NO: 4122730 - RNA, 65 nt, Human
uguuuccauuguuuuugaaaugcuuugguuaucccaaucccaagaaauauuucccaauggaaaca

SEQ ID NO: 4122731 - RNA, 77 nt, Human
uguuucccuuugugaacaauacagcaugaaauagccuaguuccacccauauggaaggcuguuguuucacaacaaaca

SEQ ID NO: 4122732 - RNA, 79 nt, Human
uguuucuaaaugcugauuuagauaaaugcuuuucuaaccaaaaugaagcaguaugguauuuaagucaaccauggaaaua

SEQ ID NO: 4122733 - RNA, 87 nt, Human
uguuucuaauuuuaguucagccaaaggagcgagacauguguucaacauguuuucucuauuuuccuuugguucucuaagaugcugaca

SEQ ID NO: 4122734 - RNA, 97 nt, Human
uguuucuagcuguuucuuaagucaucugaaugaauguuccuuggcaguuguugagaagauuaaacauauuuaguguaugacuugaguacaagaaaua

SEQ ID NO: 4122735 - RNA, 82 nt, Human
uguuucuagguuuauguggucauugacauauuuguauauaagcacgcucaucuguaaauggucagauaaaccuaccgaaaua

SEQ ID NO: 4122736 - RNA, 81 nt, Human
uguuucucaauccuguuggcaguuauauugcaaugaaaauuaauuaacucauucaauaaauaugcuacaugguggggauca

SEQ ID NO: 4122737 - RNA, 119 nt, Human
uguuugaaaguugaacuggagacuugcauguuccaaagaauuuugcuccucgagagcucaaucuuccaggcaauuucuaacauuccauggauguucuuuaguuuuguucuuuucaaaca

SEQ ID NO: 4122738 - RNA, 101 nt, Human
uguuugaauuagauuguguucauuuaacuguucuuuaugagcuggacgccagguacugugcuagcaugggggaacacaaaugaauaaaaaauaagcagaua

SEQ ID NO: 4122739 - RNA, 88 nt, Human
uguuugaauuauuuagcuuuuguauucuucuggucugcuaauguuuagauacaaaucuacagccagaugcagaaaguuaacccaaaca

SEQ ID NO: 4122740 - RNA, 57 nt, Human
uguuugaggagggagcuggucuggugccaccauuuuccagcugucuguccuuaggca

SEQ ID NO: 4122741 - RNA, 124 nt, Human
uguuugcauuaccuguuaagaaagccagagugaaguucuaggaaauuaggagacaugcaaaacacagcacucuucuuaaaccacacaugugcucucuuaacauuauuggaauaauguauuaaca

SEQ ID NO: 4122742 - RNA, 74 nt, Human
uguuuggccauuguuuguaacuuuagaauugauccuaaaauaggucucagauagggagguuacauggucaaaua

SEQ ID NO: 4122743 - RNA, 73 nt, Human
uguuugggaagcaagugggaggagagcaggccaaggggcuauauaacccuucagcuuucagcuucccugaaca

SEQ ID NO: 4122744 - RNA, 58 nt, Human
uguuugggcagaagcugaaugucugugucuccaagcagccagccaucaugcccgguca

SEQ ID NO: 4122745 - RNA, 71 nt, Human
uguuugguaguuggggucggguuuguaguauugcagugugcuuuaacaagcaugggcuuugacaucagaca

SEQ ID NO: 4122746 - RNA, 57 nt, Human
uguuuguaaagcagagccaguaauauuuaugguuuuacuggcccugccuuacaaaua

SEQ ID NO: 4122747 - RNA, 59 nt, Human
uguuuguacucaaagccaugagaggcagcgcauagcugcagacuggaagagugcagaca

SEQ ID NO: 4122748 - RNA, 57 nt, Human
uguuuguagaaacaaaagagcuauccaucacuggggcagcuuauacuuucauagaca

SEQ ID NO: 4122749 - RNA, 59 nt, Human
uguuuguauguaucaauuaucugucugcauguacacaugcuugcauguacauauacaca

SEQ ID NO: 4122750 - RNA, 63 nt, Human
uguuugugagugcacaugcccacacuuacaugcacacauguuguguguguguacuucuaaaua

SEQ ID NO: 4122751 - RNA, 73 nt, Human
uguuugugcugccuggugggcagagaccuugauuuuaaacuugcuugucacauguccagcuacagcacaggca

SEQ ID NO: 4122752 - RNA, 130 nt, Human
uguuuguuuuaccauagaagcugaguucccauugcccuagcuuguaucacaugcccaucccucaaccauacacuagugcugcaguggugagcugguguauuauuaauaguuucuuauggcucccauaaca

SEQ ID NO: 4122753 - RNA, 78 nt, Human
uguuuuaaaagaauuugacauuucauaggugcucaaugaaugcuggagucuaugaaaugucagauucugcaauaggca

SEQ ID NO: 4122754 - RNA, 127 nt, Human
uguuuuaaugcuuucuuuucuaccugucugacauucucucucuaugaaaacugaucaaauguuggaagguaaguuucaaguguggagagagaccaagggagauggcaagaaggaaguugguaaauca

SEQ ID NO: 4122755 - RNA, 79 nt, Human
uguuuuaucauguguuuguaccuuuaaauaucauaugguuuaguugugcauguuuuugagauacaaacagauagaagca

SEQ ID NO: 4122756 - RNA, 79 nt, Human
uguuuuaucuucauuuuugauguuaaguagacaggagcugcuaauacugucuguaggacagagaaaugggguuugugca

SEQ ID NO: 4122757 - RNA, 103 nt, Human
uguuuuauuaguggccuauaucccugauauugguguuaagucuaaaauuaacaacuuugaauuagacuuugcuacaggucuuauggaucacauagauagaaca

SEQ ID NO: 4122758 - RNA, 107 nt, Human
uguuuuauuuaaugaggauaaagauuucuuuagcucaucagaucaucuuuggugacagaaccaggauaaauggcugaagaaauaguuuauaaacagaccuugaaacg

SEQ ID NO: 4122759 - RNA, 91 nt, Human
uguuuucaacuuuuccucuauugucugaaaguuugacgauaggaauuucugaaguaaacuugacaguagacagauuaaauagaagaaaaca

SEQ ID NO: 4122760 - RNA, 57 nt, Human
uguuuucuacuuuguguauugggacaggaacaugacagaauuacaauguagaaaaca

SEQ ID NO: 4122761 - RNA, 66 nt, Human
uguuuugauuuuuccaaauacauuuacuguauuugcugagugccuacuguguguuuggacaggaua

SEQ ID NO: 4122762 - RNA, 72 nt, Human
uguuuugcacuaggcucauuaaguccccagggcucuaguccauauggcgaugaaugaguuucagguaaaaua

SEQ ID NO: 4122763 - RNA, 55 nt, Human
uguuuuggucuggcuuuauaucuaucauugagguuauaggccacacuccagaaca

SEQ ID NO: 4122764 - RNA, 86 nt, Human
uguuuuguaauucauuuuggcuugagucgagauuggccgugggaaccuggcuuuauguacucaagucacuaugaggaaugaaguca

SEQ ID NO: 4122765 - RNA, 76 nt, Human
uguuuuguuuggcuugggcacuacaugucaugguuaacccaugucauuuuuacuguaggcuaagucccauaaauca

SEQ ID NO: 4122766 - RNA, 75 nt, Human
uguuuuguuuguuuagaugauacgcugagaaccaaaucuacccugucagcuuacucuucaagaacaagccaagca

SEQ ID NO: 4122767 - RNA, 82 nt, Human
uguuuuucaaauugcagguuguagcccauuaguggguccugaaaucaauuuaaugaguugcaaccaguauuuuuuaaaaaua

SEQ ID NO: 4122768 - RNA, 87 nt, Human
uuaaaaagauaacagaauccuguuauugccaagaaauuuggggguaagaccaugguggcaauuuaagcagguuuuguuuuguuuuag

SEQ ID NO: 4122769 - RNA, 71 nt, Human
uuaaaaaugcuuguaaauuuuccaugugaugucuucuuugacccauggguuauuuggaagcagcuuuuuaa

SEQ ID NO: 4122770 - RNA, 83 nt, Human
uuaaaagcuguguguucaauaaugugauauguauugauacauuuuggcaagugaaaucauaauauaaacauaacaguucuuga

SEQ ID NO: 4122771 - RNA, 105 nt, Human
uggccccacagccacagacucagcacauuugcaggugucgauuagucuaaccagcacuucacaggggacugggucauuuguagugcugauguuuucugucugcca

SEQ ID NO: 4122772 - RNA, 65 nt, Human
uggccccacugccaaggcuguuguacuagaaggaaaugggcauucagcccagagcaguggggcca

SEQ ID NO: 4122773 - RNA, 76 nt, Human
uggccccuucucugaggaaccugcccugguucccugguccaccucccagcuaguagaguucccugggaagggguua

SEQ ID NO: 4122774 - RNA, 62 nt, Human
uggcccugaaaauguuuguccggagcugauacacaucaauucugcauacauuucacuggcca

SEQ ID NO: 4122775 - RNA, 55 nt, Human
uggcccugacugauguggagggagcacaugaaagcgacuuucggauccaaggcca

SEQ ID NO: 4122776 - RNA, 82 nt, Human
uggccgauaguuucuucugucuugcuuccaggaaccuuuucuugguuugaagccaccgaaccagaagagagaauuuuuacca

SEQ ID NO: 4122777 - RNA, 55 nt, Human
uggccuaaaucucaugaucuuuucucauuuguaaagauacugaugauguaggcua

SEQ ID NO: 4122778 - RNA, 60 nt, Human
uggccuaggccuucauaggcauggaagcuucugcuuucagccucuuuggagccuuagcca

SEQ ID NO: 4122779 - RNA, 67 nt, Human
uggccuauuuaaauaaaucuccuuugaacucacguuauauuaaaugguggcucuuuuaaauuggcca

SEQ ID NO: 4122780 - RNA, 63 nt, Human
uggccuccucgcugcaucccauuccuccacacacagaggagacauggaauagugaggcuguca

SEQ ID NO: 4122781 - RNA, 70 nt, Human
uggccucuggagguggccagugguguggcagcuacagucuucaucauugaacacuucuuccuggaggcca

SEQ ID NO: 4122782 - RNA, 79 nt, Human
uggccucuggggaggcaguuucugauauuaguuugugucuguccuucccaggcacaagaaacugcuccccacaccucca

SEQ ID NO: 4122783 - RNA, 66 nt, Human
uggccucuuaaggaugacacaauaucaccuagcuggaggcuagguaugcaucuaguaagaguguca

SEQ ID NO: 4122784 - RNA, 58 nt, Human
uggccugcucacagucagauggcuaaucagcccagagccagaagcugcuugcaggcua

SEQ ID NO: 4122785 - RNA, 62 nt, Human
uggccugcugcugguuagauggggcacucccuggaauggcccaucacugcagcaaauggcca

SEQ ID NO: 4122786 - RNA, 76 nt, Human
uggccugugacugccucugggcagaugguagaucccucugauggggaacagggaggcccagagggagccaagccca

SEQ ID NO: 4122787 - RNA, 73 nt, Human
uggccuuaauagauaugccucuagaguuuuacccguaagcauaaugaaggcuguugguauauuuauuacguca

SEQ ID NO: 4122788 - RNA, 61 nt, Human
uggccuuccuggugacucaugagcauuacccagaguaugaccugugaguguccagagacca

SEQ ID NO: 4122789 - RNA, 65 nt, Human
uggccuugagaugcagcagccagucuaaggccacuauauguggagguugguguguccaguggcca

SEQ ID NO: 4122790 - RNA, 111 nt, Human
uggccuugccaugagggcacagcugcugcggaaagaugccaccgagaucagcuucaugacccgucuguguuuuccacagcagcuggagcgcaccccauggacgcugggcca

SEQ ID NO: 4122791 - RNA, 66 nt, Human
uggcgaucuccuugaauguugcugugagaauaccagccucacagaaguguguuucaggaguggcca

SEQ ID NO: 4122792 - RNA, 69 nt, Human
uggcggaguugggggcacuucgaggucgccuuggggcgagguggucgugagggggucccagauaugcca

SEQ ID NO: 4122793 - RNA, 63 nt, Human
uggcggcuugggggucuucacaggcucaaguuucugugucugcacugagcucucccagcccca

SEQ ID NO: 4122794 - RNA, 56 nt, Human
uggcggguguccagcggguggagccagagagcucccagccaugggccaccuagcug

SEQ ID NO: 4122795 - RNA, 85 nt, Human
uggcguuauaaucugucguaguaaaaagcagagaaguaaauacaauccugcucuccaaauaugacaagcugauuauaacaagcca

SEQ ID NO: 4122796 - RNA, 71 nt, Human
uggcguugucuauacauaaaagguagucagaauaaaaagaauucuagcaacauguguuagacaauagacca

SEQ ID NO: 4122797 - RNA, 69 nt, Human
uggcuaaaaauccacacuaggugaaagcucuugaaagacugauucauaacccagggugguuuuuaucca

SEQ ID NO: 4122798 - RNA, 76 nt, Human
uggcuaacaauagaugguaugcuauuccauagacuccugcuaucagagucugcauucacagcaauuaucuuuacca

SEQ ID NO: 4122799 - RNA, 77 nt, Human
uggcuaacagaagaaaacauauuggagaaaaaauuucugaagcacugauuuguacuccaauuugaucucugaggcua

SEQ ID NO: 4122800 - RNA, 80 nt, Human
uggcuaagccuggcgcccagugaaucagccaaggaugcagucaaccagcucuuuggcccuggggccagcuucgaggcaca

SEQ ID NO: 4122801 - RNA, 71 nt, Human
uggcuaaggaauuuuugaggauaauguuaauuacgugugauuuucaucuucagugauuaccuaaaaggcca

SEQ ID NO: 4122802 - RNA, 127 nt, Human
uggcuaaggugaauauggaggcugggcuucagacagcaagauuauuuuagaucccaugugcuggaaggacaaagucucuaauaaucuucugggcuuguagucuagacccagugacuacaucaggcua

SEQ ID NO: 4122803 - RNA, 125 nt, Human
uggcuaauaaaugauuucuauuaggagcuugggaggugggggaugugugaauguucuaaguacuugccauucugugucucuccacagccccuaaaccugucuuuccuagaaucacuugaaaguua

SEQ ID NO: 4122804 - RNA, 76 nt, Human
uggcuauccacagggaacaugacagccuuauaucuguuggauauauuggccuaauuuguuuuucucuguuuugcca

SEQ ID NO: 4122805 - RNA, 60 nt, Human
uggcucacaccuguaauccuagcacuuuggaaggcugagauagguggaucauuugagcua

SEQ ID NO: 4122806 - RNA, 65 nt, Human
uggcucagagaaucucuccuuaguuuaacuauuguucaagacucuccaggagguuguuggaguca

SEQ ID NO: 4122807 - RNA, 57 nt, Human
uggcucaguggcagccgcagcuaggaaggacuagaaaguggcuagaccgcggagcca

SEQ ID NO: 4122808 - RNA, 62 nt, Human
uggcucaugacuguaaucccagcacuuugggaugcuggcagggggcagaucacuugaagcca

SEQ ID NO: 4122809 - RNA, 60 nt, Human
uggcucauugagcuguuuuguaggauaaaaauauuuuguuuagaauuuaguuuugaguca

SEQ ID NO: 4122810 - RNA, 80 nt, Human
uggcucauuuguccucagcccugcauucugguuguugagggagaucauucacagagccagggcuaggaacuggugaggca

SEQ ID NO: 4122811 - RNA, 59 nt, Human
uggcuccauccaaggccuucuaggggaaaccauuagccuccagaagguaggauggaaca

SEQ ID NO: 4122812 - RNA, 76 nt, Human
uggcucgcacaguugccucgggaggcagggaacucauagagaagggccacacugcagcugaggccagcuaugcccg

SEQ ID NO: 4122813 - RNA, 82 nt, Human
uggcucuaacugugguucuauucuagaauuccugaacguguuccaggaguuauggcagaaucaaauaaguuccuuuuagcua

SEQ ID NO: 4122814 - RNA, 83 nt, Human
uggcucucaggaaccaaauagagacuggccuuguggaaauauuaaacuucuauuugcugguugcuucuguuuuccugaaguua

SEQ ID NO: 4122815 - RNA, 72 nt, Human
uggcucuucaaacuggggaacuuauuuauuaaauaguucuauaaugaaagcacuucccuagucuugugacca

SEQ ID NO: 4122816 - RNA, 63 nt, Human
uggcugagaaguucuggugggaaggaaccauggagggcccaucuggauauccuuccucagcua

SEQ ID NO: 4122817 - RNA, 56 nt, Human
uggcugagagucauccuguguggggagaagcggggccacgcguggacucucaguca

SEQ ID NO: 4122818 - RNA, 61 nt, Human
uggcugagugauauuugcaaagaguuccagccuaauaucucuuuuuguaaaucagcaguca

SEQ ID NO: 4122819 - RNA, 59 nt, Human
uggcugaucaauaggcuugaggaaacugacaaauacaauaagaucuguuugaugaguca

SEQ ID NO: 4122820 - RNA, 68 nt, Human
uggcugcaaaugauauuuagagcauaaaaaaaucaaaucuagcuuuaagugauuagaauuugcuguca

SEQ ID NO: 4122821 - RNA, 79 nt, Human
uggcugcaguuugaccuuguuuucuuaguuuuggguugcauggaacaauaggaagagaaaacaaauggaucacuguuca

SEQ ID NO: 4122822 - RNA, 74 nt, Human
uggcugccacagugaacauucugucagggguguugugcuccaaauauugucccuggcagaaugucucugggcca

SEQ ID NO: 4122823 - RNA, 58 nt, Human
uggcugcccuuucugagguguaucauugcugagaugaagcuagcaggaagagcaggca

SEQ ID NO: 4122824 - RNA, 101 nt, Human
uggcugccuggcucuggccguagagaugcugucaggcuaucugucuggaagaguagaugauggagcugauagaauuuaaaaauggccaagcucuguagcca

SEQ ID NO: 4122825 - RNA, 67 nt, Human
uggcugcugagaaggcagcugucccaugcccagauuagguuucuugcagacagugcuucucaggcca

SEQ ID NO: 4122826 - RNA, 77 nt, Human
uggcuggagaugcugggagaggacccauuaccaagcucaacugagcauuugcuagcaggccuuuuauuuccuugcca

SEQ ID NO: 4122827 - RNA, 81 nt, Human
uggcuggcugggaucugucuggaggccuggcaugaguacugagcugugugccacaaagucugccacacagaccaaccaaca

SEQ ID NO: 4122828 - RNA, 93 nt, Human
uggcuguaucuuuagaggcauaccagaguguggggaugcucaggucucaauaaaaucccugggcuucauaauugguccuagaagacacagcua

SEQ ID NO: 4122829 - RNA, 77 nt, Human
uggcugucuaugagccaggaagaaggccuuacuagcaaccaaaucugcuagaaccuugaucuuggacuucucggcca

SEQ ID NO: 4122830 - RNA, 72 nt, Human
uggcugugcauucucugauuuucacaaauaagaacuuuuacaucauuagugaaaugagaauguaugacacca

SEQ ID NO: 4122831 - RNA, 101 nt, Human
uggcuuaaugcccugaagacucucugauggucaauuuucaggcaguuuguguaggaaacauggccuggcaauggccucaggaagccuggcugugauuucca

SEQ ID NO: 4122832 - RNA, 80 nt, Human
uggcuuagcuacuuggguuggcaucagcugggcaguuuuucugcuggucuuaccuggagucacucauguagcugcaguca

SEQ ID NO: 4122833 - RNA, 108 nt, Human
uggcuuagcugggacugaggcauaaucaggauugggacucagaguugguacuuagccugaggucagaguuuagucuggaguuggugccaagucugggaucggggguca

SEQ ID NO: 4122834 - RNA, 76 nt, Human
uggcuucaauuuuccuucuaagaggaaggucagguuauuaaccugaccauuguuuccagagggugaaauucagcca

SEQ ID NO: 4122835 - RNA, 130 nt, Human
uggcuucaucuuuccuuacugguugucauccccugggccaccugcuuuuuugcauuuuccuuucucuugugagaugaugaagcucugugccccgauggggaugagagacagcacucugaguucaagucua

SEQ ID NO: 4122836 - RNA, 79 nt, Human
uggcuucugaugcuugaagccuacauucgucacugaggaaguuacccaggugacuguguaccagguuugcacgaagcua

SEQ ID NO: 4122837 - RNA, 80 nt, Human
uggcuucuggaaauuccagcuaggaaaagcuucccuuuguggcccguuuggaagcacucaggcugggauucacagaaaca

SEQ ID NO: 4122838 - RNA, 64 nt, Human
uggcuugccauaguuaccaggaaaugagugucuaugcacauucauuucagguugcaugguacca

SEQ ID NO: 4122839 - RNA, 91 nt, Human
uggcuugcucacauaguugaugacaccaugggaccagaacccuggcaucaccagacagccuggcuucauggcugugcaaucugagcagcca

SEQ ID NO: 4122840 - RNA, 58 nt, Human
uucaguaguugcuucccugacugcaaaggcaagcuuauuuaguugaguagcuccugaa

SEQ ID NO: 4122841 - RNA, 56 nt, Human
uucaguauauuacucuugucaacgcuuaaagauuuugucaggaggaauuugcugaa

SEQ ID NO: 4122842 - RNA, 87 nt, Human
uucaguauucauuucaguucagaggccuuucaccugcggcauguagauucuaaagggaccugggauugaguuucaagaaucacugaa

SEQ ID NO: 4122843 - RNA, 107 nt, Human
uucaguccaaagcauaugugcuuucauaguauuuauuuacauggaguucuggcuaaagcuauucugcaugaaaauaaacagauuuaugaaagguacuagugccugaa

SEQ ID NO: 4122844 - RNA, 73 nt, Human
uucagucuaaauuaucuuucucagauuuacuaccuaccacuggugaggcugacaaaagaugagguuagcugaa

SEQ ID NO: 4122845 - RNA, 66 nt, Human
uucagugaacuugaguacuucauuccuuuggcaggcuggauaaaugagaagccuagguguacugga

SEQ ID NO: 4122846 - RNA, 78 nt, Human
uucagugguuauugccuuguacauuucauuuaaaugauguuuuauuaugacucuaaaagugaagugugguccacugag

SEQ ID NO: 4122847 - RNA, 73 nt, Human
uucagugucaucuagugccccucucccuugaggcaggcggcuucgucuccauuuugggggggcagucacugag

SEQ ID NO: 4122848 - RNA, 82 nt, Human
uucaguguucuggaaaucugacugucacuaacuaagucuaguuccacucacagacacagucaguuucacagucugcauugaa

SEQ ID NO: 4122849 - RNA, 69 nt, Human
uucaguuguuuaguuauuguuacaguaugaguguuugauauuuaguuuguuauuuuaacuacaauugag

SEQ ID NO: 4122850 - RNA, 69 nt, Human
uucaguuuccuugagaaaggcacaaguuguuacuucugguaauuuugcuuuuacuuagaguggacugga

SEQ ID NO: 4122851 - RNA, 64 nt, Human
uucaguuugccaguauuucacugaugauuuucacauugauguucaucagggauauuggccugaa

SEQ ID NO: 4122852 - RNA, 64 nt, Human
uucaguuugccaguauuuuauugaugauuuucacaucgauguucaucagggauauuggccugaa

SEQ ID NO: 4122853 - RNA, 90 nt, Human
uucaguuuuaagagacuagagagauauaauauggcauggucuaaaauauacccauauaggaucucuucuaagaacuuccuaaggauugaa

SEQ ID NO: 4122854 - RNA, 70 nt, Human
uucauagacuugaguuuuugguauggcuaaauuuaauuauaugguacauacaagcauucaauuuuaugaa

SEQ ID NO: 4122855 - RNA, 56 nt, Human
uucauagggagcaucuaccuauuuauuauuaccacauaggugaugugacucuagaa

SEQ ID NO: 4122856 - RNA, 103 nt, Human
uucauauaaugcccuugaggucuauccauguuguguguauaguuuuuuccuuuuuauuauaaguagcauuccaugguauagauauaccacaacuauuaaugga

SEQ ID NO: 4122857 - RNA, 80 nt, Human
uucauauacuagaugccauuaagcaauuguugcuaauuuuuagguaugauaaugcuuuaauugcauguagugaaaaugga

SEQ ID NO: 4122858 - RNA, 66 nt, Human
uucauauauaugugugugugugugcauguguguauauguauccuuauacacauuuauauuagugaa

SEQ ID NO: 4122859 - RNA, 90 nt, Human
uucauauccccagggccugucacgacgcucaugaaaugguugcugaaugaaugacugaccggccgaaugagugagugagucuugugugag

SEQ ID NO: 4122860 - RNA, 62 nt, Human
uucauaucuucuugagauacuuacuaauuucaagucccaucuuggucacaaggaguugugaa

SEQ ID NO: 4122861 - RNA, 77 nt, Human
uucauauuggaguuuguuucugaccugugacaguuuguaccaggaaaaaaccucagaagcagauauuucaaaaugga

SEQ ID NO: 4122862 - RNA, 85 nt, Human
uucaucaguucaguucucugagugugcuugguaaccaguuauuuagcuugcaaacacucaaagccaucauugaaguuuuggugaa

SEQ ID NO: 4122863 - RNA, 129 nt, Human
uucaucuauucauuuauucccauugauuuccucacuaacauccauccagucaggcuuagaaagcagcagguggguuggugacagagaccagugggcugaguguaaccgugaaagucaguaggugacaag

SEQ ID NO: 4122864 - RNA, 99 nt, Human
uucaucucauuuagcaccgugucuguaugucaaucagcugcauauaucguaaauuguagccgcaugauaccagaucuccugcuguaaaugagcaaugaa

SEQ ID NO: 4122865 - RNA, 55 nt, Human
uucaucucuggguccauagaagagaacaguguuucugcaucuccccagaugugag

SEQ ID NO: 4122866 - RNA, 101 nt, Human
uucaucucuucuucaaaccuuuguugcaauauccaugggauucaacugugcagcugagucagugaaugguguaugcuaauccagguuuacugagaucugaa

SEQ ID NO: 4122867 - RNA, 72 nt, Human
uucaucuggcuguguucauccugcccaggucccggccccuggccacuuggucguggugcagcauggcgugaa

SEQ ID NO: 4122868 - RNA, 81 nt, Human
uucaucuguaaauggaagugucucugggaccugcucagcucugaccugcuuuggguccuuuuuggacuucuucaggaugag

SEQ ID NO: 4122869 - RNA, 56 nt, Human
uucaugaauacaaugagacaauauuuguauuauuguuuuaaccuaguguuuaugag

SEQ ID NO: 4122870 - RNA, 96 nt, Human
uucaugagcagggauuugugugugcuuuguuuaccaugacauccccagugccauggcuggcacacagcaaccacuaauaaauaccuguugaaugaa

SEQ ID NO: 4122871 - RNA, 57 nt, Human
uucaugagguaaaguuuaagcuaaguucucuggauuuagcuuauaaaugcuuuugaa

SEQ ID NO: 4122872 - RNA, 68 nt, Human
uucaugcugcaagcauucccugcaucugccuugcucaggcuuugugcugggugcugcagacaggugaa

SEQ ID NO: 4122873 - RNA, 81 nt, Human
uucaugcuggugaaaugacaugacggauguuagaguguuuugaagauauaaagcacagggugucugcauucagugguagaa

SEQ ID NO: 4122874 - RNA, 60 nt, Human
uucaugcuuuuaccgcuguuaaucaacugugggguucacaguauaguggcaggaaaugaa

SEQ ID NO: 4122875 - RNA, 124 nt, Human
uucauggcuucucagugugccaguauggccguuauuaaaguauuugauguuagaauaugacuuuuuaauguguugaugcuugaauagagcuauucucaagcuggaauaacugagacugaaugga

SEQ ID NO: 4122876 - RNA, 73 nt, Human
uucaugguggagcagauuugcuuuuagauucuugccuccucaauaauaacaaagccaagucagucuacuggaa

SEQ ID NO: 4122877 - RNA, 78 nt, Human
uucauguacguccucacccuggcuucuuucaaguuuggcugacuuuaucucaagccaggguuuguggaucuaugugga

SEQ ID NO: 4122878 - RNA, 60 nt, Human
uucaugucuuugauucugauaauuggauuuuccccaaucaucagaaucucuagauuugga

SEQ ID NO: 4122879 - RNA, 92 nt, Human
uucaugugugaaacuuucaugaauauaagaugcuccuaaaauugacuuuaauaaguagaaaucuuuguacaguuugaaggcauacauaugaa

SEQ ID NO: 4122880 - RNA, 58 nt, Human
uucauguuuccauauuaaugagaagaagcagcugaacauuaacaaauggaagcaugaa

SEQ ID NO: 4122881 - RNA, 58 nt, Human
uucauguuuugagccauucugagugaaacaauacuugugagaggcguucgaagcagag

SEQ ID NO: 4122882 - RNA, 130 nt, Human
uucauuacucacagaaacagcaguggccaaaguacaaacauuugcccugguucuuugagucucaggaaguugcacaggaaccagggcaaauguuuguacuccggccgcugcugaugcugugaauaauaaa

SEQ ID NO: 4122883 - RNA, 70 nt, Human
uucauuaucuguuccccuaugcucucuauuuuuaucagaaaucugagcaggaaagagcagagagaaugag

SEQ ID NO: 4122884 - RNA, 57 nt, Human
uucauucagguguauuuauggguuuauauuuacccaauaaauauaacaauggaugaa

SEQ ID NO: 4122885 - RNA, 80 nt, Human
uuccugaaucaccuucauucuuuuguguucacacuggcagaacuugcuguuucuaccagaagaaucauuuugauugggaa

SEQ ID NO: 4122886 - RNA, 56 nt, Human
uuccugaaucccaaggagagcuucagaaauugagccaggucuaaggacaucaggaa

SEQ ID NO: 4122887 - RNA, 59 nt, Human
uuccugagaaauuuguaccuggaauuucucuguacuucugguaugaagauuaucaggaa

SEQ ID NO: 4122888 - RNA, 62 nt, Human
uuccugagcuuuuaaccuagucuauuccaauuuuaagcugacaauagguaaaaagagaggaa

SEQ ID NO: 4122889 - RNA, 77 nt, Human
uuccugauguaauuauucuaaauccucuuagaggcaaauggaugcuucuggcagauugagugaguauauacuuggaa

SEQ ID NO: 4122890 - RNA, 79 nt, Human
uuccugcacccauguucaaagagaaauuguauuuucucauauuaauuauuauuuagaauuuucuuuguuauggcaggga

SEQ ID NO: 4122891 - RNA, 77 nt, Human
uuccugcagcgaggccagguguuccugggccgacggacugaguugucuggacagcagcaccucggccccuggagggg

SEQ ID NO: 4122892 - RNA, 82 nt, Human
uuccugcaggcuuuuugguugacuuaaaugugggcuuuggggcagggcagcaacacgagugagcuaaagaggccagcaggag

SEQ ID NO: 4122893 - RNA, 83 nt, Human
uuccugcaguuucugguaugggaaauuucaagaagacagaguuucuauuuuugaaguucccccauaucagaaacugcaaggaa

SEQ ID NO: 4122894 - RNA, 73 nt, Human
uuccugcccucgaggagcucacagucuaguaugucucauccccuacuagacugaagcuccuugaggacaggga

SEQ ID NO: 4122895 - RNA, 130 nt, Human
uuccugccugugucacagggguuguaaaagccaguacaauuuuacaaaggacgaauucccccaaggaagaucuugccugaguaaaauuguucaauauuuuggcuguuauuacugcucugacauccaggaa

SEQ ID NO: 4122896 - RNA, 58 nt, Human
uuccugcucaaugcugucgucgcuguccacggagcuacugucaccaucagagcgggaa

SEQ ID NO: 4122897 - RNA, 61 nt, Human
uuccugcuucucgaggugcagacugcaugaagcccguggaagaugcccagaaaagcaggga

SEQ ID NO: 4122898 - RNA, 83 nt, Human
uuccuggcauagagaagagcuugugggugugugugugugugcaugugcgcacacaugcaugcacaggagugugugucuagggg

SEQ ID NO: 4122899 - RNA, 57 nt, Human
uuccuggccuaagguaggugaccauggagagugaucauuauuccgaaaggucaggag

SEQ ID NO: 4122900 - RNA, 56 nt, Human
uuccugggguacuggagaaaauaaguauaauacugaacuucacagauccacaggaa

SEQ ID NO: 4122901 - RNA, 57 nt, Human
uuccugguaguaagacaucuggaauccauuuggaugugugguuuuuacaccaaggaa

SEQ ID NO: 4122902 - RNA, 59 nt, Human
uuccuggucagacuucuagguuugccccugcagaggccaggcccugaguaagcuaggag

SEQ ID NO: 4122903 - RNA, 84 nt, Human
uuccuguccccgcucccuucucugucacucacucuuucaucauaggaagcacagaugcaagggggaccugacugggcacaggaa

SEQ ID NO: 4122904 - RNA, 83 nt, Human
uuaaaaguuuaucagacaaacugugagauuguucuugucagagagaauugagaauaagauuacugguugucugagaugguuga

SEQ ID NO: 4122905 - RNA, 59 nt, Human
uuaaaauagccagugccccucugaagguuuaaaacucagaggggcacuggcuauuuuag

SEQ ID NO: 4122906 - RNA, 77 nt, Human
uuaaaauaugcucagcagaucucaggagaucucaggagaagggauccucagaguauuuguugaagucaaacuuuuaa

SEQ ID NO: 4122907 - RNA, 75 nt, Human
uuaaaauugcuugaaauguuugucaacugcuucauuaaagcccaaaggcagcauauauucagugggcaauuuuga

SEQ ID NO: 4122908 - RNA, 129 nt, Human
uuaaaauugcuugagggaacuuguuauaaugcagauuccugaguccuaccuccugagcuucugauucaguaggucuggaagcuggaguccaggaauaugcauuuuaacaagcuccccaagugauuuuga

SEQ ID NO: 4122909 - RNA, 64 nt, Human
uuaaacauggagagcucgggaucuuuuuggacagguucaaguucccuggcacugcugugauuag

SEQ ID NO: 4122910 - RNA, 68 nt, Human
uuaaagaaagacccaaggcccuacauggguacuuucuuccccaugcagggccuugggucuuucuuuaa

SEQ ID NO: 4122911 - RNA, 90 nt, Human
uuaaagaaauaaguuacauuucagaaugagaauggauggguccuacugaccauccucaucuuggauuugaagaauguagagaaucuuuaa

SEQ ID NO: 4122912 - RNA, 109 nt, Human
uuaaagaagcccauucacuguuuacuuggagguguuuccuguugagguccugcuggcugugaucacaauuuagacuuuuuaauuauaggugaacgggaugggucuuugg

SEQ ID NO: 4122913 - RNA, 60 nt, Human
uuaaagaguaaucauaggucaaaauuuaaaauugccuauuagaacaugauugcucuuuga

SEQ ID NO: 4122914 - RNA, 100 nt, Human
uuaaagauugacacaguagaaaguucacugguauauuuugcauuuuaaauagccugcuaaaauguaccgugugaacugcacaaaugcucuuagucuuuag

SEQ ID NO: 4122915 - RNA, 69 nt, Human
uuaaagcauaaugaauaucuagagacuuauaaauaucagugaccaucugggaauuuauuggcacuuuaa

SEQ ID NO: 4122916 - RNA, 61 nt, Human
uuaaagcauccugucagucuguucuuaaguaugaaaguguucggaaaucaggaugcuguaa

SEQ ID NO: 4122917 - RNA, 67 nt, Human
uuaaaggcaauaguauuaaacuggaaaaucaugguguaguccugaauccaguuuauacugucuuuga

SEQ ID NO: 4122918 - RNA, 66 nt, Human
uuaaaggcuuugauuccauugcccuuuuccuagauggggaagaaauggaaauccaagcaacuuuga

SEQ ID NO: 4122919 - RNA, 65 nt, Human
uuaaagggcuggccacaugauuugguaagggcaaagcugaacuacuuuaaagccaggcccuuuga

SEQ ID NO: 4122920 - RNA, 58 nt, Human
uuaaagucacaguuagacuacccaagucuauaaacuuggguauaaaacuuggcuauaa

SEQ ID NO: 4122921 - RNA, 66 nt, Human
uuaaaguucauuaaaugagccauccaguguaauuuaacugaauaaaaauggcucagauggcuuuaa

SEQ ID NO: 4122922 - RNA, 78 nt, Human
uuaaauaaauuaauacacaucauacacugggauuagugucuggcccacaggagugugugaguguuaacuaauauuuga

SEQ ID NO: 4122923 - RNA, 85 nt, Human
uuaaauagaguguucauuuggggaagaugguuggucuucauuauuucuaucuuucuaauucucccauagucuacauucuuuguaa

SEQ ID NO: 4122924 - RNA, 129 nt, Human
uuaaauauacuucaagggagaauaggucaauggaaugcagacaugggagaguugaggaaugcaacguuuuaagacucccgaugcugcauuuuccccacuaaguaugauucaugcuuccuucaagaacag

SEQ ID NO: 4122925 - RNA, 70 nt, Human
uuaaauccaaguugguagcugguguuuucagucccugccugaaaacagcagcuguuuaauuugcauuugg

SEQ ID NO: 4122926 - RNA, 83 nt, Human
uuaaauggaaaucgaugucuaaguuacauacucaggaguuaaauaauuaaugguaacuagauauagacuuucuacauauuuga

SEQ ID NO: 4122927 - RNA, 59 nt, Human
uuaaaugugccuaaaccuguaacuugucauaguucgauacauagguuggcuauauuuaa

SEQ ID NO: 4122928 - RNA, 100 nt, Human
uuaaauuucugauaaacaguggacaauuuugaguauaaguauguccgaauauugcauggaauauacuuauacuaagaauguacuugggauucaaauuuaa

SEQ ID NO: 4122929 - RNA, 72 nt, Human
uuaacauuuggcuuuggcaggaagaaaauguuucaguauagaaauaugugucucuaccaaugcaauuguuaa

SEQ ID NO: 4122930 - RNA, 85 nt, Human
uuaaccaucauaugguuucucuccaaguuguccucagaggccucuggcuggagauaguaggauccauaaauguuuaaaugguuaa

SEQ ID NO: 4122931 - RNA, 69 nt, Human
uuaacucagcaguauacucugaagauuagguaagaaauccaagauuuucucuuuguauaugcuaguuaa

SEQ ID NO: 4122932 - RNA, 69 nt, Human
uuaacuucugugugaguuuaguguuuuccguguuucacugaugaggaaaccaaggcucagggagguuaa

SEQ ID NO: 4122933 - RNA, 97 nt, Human
uuaacuuuaugccugccaagcagcaaacuuccacaaguagauaauuugaaagccugacuuuuauuugcucuugcugcuuggggcaaaaugaaguuga

SEQ ID NO: 4122934 - RNA, 85 nt, Human
uuaagaauaguaauaaguugugcuuugauaugcuacagcugaagcauguaugagccaucaaaguggaaguuuacuagguacuugg

SEQ ID NO: 4122935 - RNA, 61 nt, Human
uuaagaauuguuugcagugggcuuugcacuuuacaaagcaccaucagaugcaauaucuuaa

SEQ ID NO: 4122936 - RNA, 62 nt, Human
uuaagagcacugaagucuucuuaggaaagggaugugggucuugggaaacuugagucuuuugg

SEQ ID NO: 4122937 - RNA, 55 nt, Human
uuaagaggugaggccuuuaagaggcaauuaggccauuauggcuccuaccuuguga

SEQ ID NO: 4122938 - RNA, 57 nt, Human
uuaagauuuuguuacaguguguaacaaaaugguuacacacugugucauaaugcuuaa

SEQ ID NO: 4122939 - RNA, 57 nt, Human
uuaagcaaugcuaagaaaagugucaugccuacggugaucuuagcaucacuugcuuaa

SEQ ID NO: 4122940 - RNA, 68 nt, Human
uuaagcuuuuucccuucaccaguuguccuaaugggccuggcauugcuucugaaguggagagaguuuaa

SEQ ID NO: 4122941 - RNA, 60 nt, Human
uuaaggaaggagucuuaaaugggugccuacuuugugcacuuagacucucuuugucuuuaa

SEQ ID NO: 4122942 - RNA, 56 nt, Human
uuaaggaauuacgaaaauauuuaggguucuguucugaguugcuuugggauccuuaa

SEQ ID NO: 4122943 - RNA, 71 nt, Human
uuaaggagcuaggcaaagcucacggacuguuggcaaauagacauuuuguauuuagccugccuguuacuuaa

SEQ ID NO: 4122944 - RNA, 67 nt, Human
uuaaggccauuuuaacuuuuuuguugagauguuaaugucaacaaaacgguucaaaugaaggucuuga

SEQ ID NO: 4122945 - RNA, 106 nt, Human
uuaagguagguuaauaugauguguuagaaaaucuggugacauauguuaagauaauuggcaauguucuguuuuguaauucauaaauuaguauuaacuguacucuuga

SEQ ID NO: 4122946 - RNA, 77 nt, Human
uuaaguaaaauagaugggugugaaauagaugcuuuguaaaauacaaaguuuuauucaagcauuagucauguauuuaa

SEQ ID NO: 4122947 - RNA, 78 nt, Human
uuaaguaacagaaacuuauuuuaucacaguucaguucuggaagugaaaagucuaagauuaagguucuggaaaacuugg

SEQ ID NO: 4122948 - RNA, 55 nt, Human
uuaaguaagaccuuaugucuugaagguaguuuaggacauaaaaaugcugacuuag

SEQ ID NO: 4122949 - RNA, 59 nt, Human
uuaaguauucuacuaggguccuaugcauuuuaaaaggauuccugguggauacugcuuaa

SEQ ID NO: 4122950 - RNA, 90 nt, Human
uuaaguuaaacuuuauaaaaaugaggcgauggaccuaaaacucaguauguucugcuaggauuuguauagcuuucuuuugguuugauuuaa

SEQ ID NO: 4122951 - RNA, 127 nt, Human
uuaauaaggaugcuuugaauguucuuauacaagucuuugcauggacauguguuuucauuucucuuggcuaccuaucugagaauacaauuguucaguaauagaguagauauauguuuaacuuuauuag

SEQ ID NO: 4122952 - RNA, 82 nt, Human
uuaauauagaucuugcuauuuaaggaagucuuagaccauuucauaaguaaauagucuuuuaguaaagcgagaucuucauuga

SEQ ID NO: 4122953 - RNA, 124 nt, Human
uuaauaucguuaacauguucagacuaccugugaugguuaauacugagugucaaauugauuggauuuaaggaugcaaaguauuaauccuugguaugucugugaggguguugccaaaggagauuaa

SEQ ID NO: 4122954 - RNA, 78 nt, Human
uuaauaugguuuauaaagcuguauuuuaaguauuuguucauuuugaaaaaucuuagcacagcuauauaaguuaguuga

SEQ ID NO: 4122955 - RNA, 129 nt, Human
uuaauauuacaagaagacugaggaauuagugucuuuaaagcugguucauucauucauggucuucuuaaagaggaccuauugaguggaugaacuguuaauugcaauuucaagucgaguguuaauaggugg

SEQ ID NO: 4122956 - RNA, 77 nt, Human
uuaauauuuauggaauacuuaugcugcaguaggcacuguggaaaaugcuuuacauauaguguuucauuaaugcuuaa

SEQ ID NO: 4122957 - RNA, 68 nt, Human
uuaaucacaggcauagauugcuccuucaaaaguaauucucaucagugagcucuuuguguagugguuga

SEQ ID NO: 4122958 - RNA, 77 nt, Human
uuaauccuuuagguuaaaagaggaucaacauggcaacaaaguguuuuggaaauagccucuugugauuugaagauuaa

SEQ ID NO: 4122959 - RNA, 74 nt, Human
uuaaucucuuuggcucaaggauccucucucaguuuggguucccccggaaauggaccuugagacaaggauuuuag

SEQ ID NO: 4122960 - RNA, 80 nt, Human
uuaaucuuuuaguaaguguaguugaagccuucaacaauuuaauauaauugugcuguuaucacauuuuguaaaaugauuag

SEQ ID NO: 4122961 - RNA, 82 nt, Human
uuaaugagauguggcaguuuugacaucacaaaguuuugacauauuuuauuuugguaaugguguugcuguuuaaccucauuga

SEQ ID NO: 4122962 - RNA, 92 nt, Human
uuaaugagccuauccuguguucuagguauggucuuagauguuuagcuccaccuucccuaagauuccccaguuuugcaaguuaggcuuuuuaa

SEQ ID NO: 4122963 - RNA, 67 nt, Human
uuaaugcuuggaaagcacuuagaagagugccugcuacagggcgaacacuacgcugaguguguauuaa

SEQ ID NO: 4122964 - RNA, 89 nt, Human
uuaauggcauuuacuggcuuacaugccuuucuaucuccacuagaguacuauuugcuugaggguagggccguagggccauguguuauuaa

SEQ ID NO: 4122965 - RNA, 63 nt, Human
uuaaugguuagccuccuagauccuucuguaccuuaugccuuugcuccaggaggcugccauuga

SEQ ID NO: 4122966 - RNA, 129 nt, Human
uuaauuauuuuucuuagguguauauuacauauauguauguguauaugugugguacauauauugucucagguguauauuacauaaacaugagugaauauucuuagaaaaaauauucuuacaauauauuaa

SEQ ID NO: 4122967 - RNA, 63 nt, Human
uuaauuguacaaaggauuuggaagagauucugguuucuguuaucuuccuuuguauacuguuga

SEQ ID NO: 4122968 - RNA, 96 nt, Human
uuaauuuaaugcuuaggucauguuacauaccucauagacucaggaagauccuuuuugggagaaugcaggaugugcugauuuaguaguagaaauuaa

SEQ ID NO: 4122969 - RNA, 73 nt, Human
uuaauuuuccacucuguuuaucugacaguguggaugugcaauccaaacagauaaugagagagugggauauuga

SEQ ID NO: 4122970 - RNA, 71 nt, Human
uuacaaggcaacacaucauuguuaagcacaaaucuucugcuuuugaccauggcacauguuugccuauguaa

SEQ ID NO: 4122971 - RNA, 78 nt, Human
uuccaauuuguggugaguuaauauugugcaugaccauacagagcuugccccauuugugacucaccaucggaguuugaa

SEQ ID NO: 4122972 - RNA, 56 nt, Human
uuccacaggacuaaaugucaucauagaguuugugauugcacuuuccccugugagaa

SEQ ID NO: 4122973 - RNA, 61 nt, Human
uuccacagguuucagacuguucuccuagaaauaacuggcaaugcaaccugaaccuugguaa

SEQ ID NO: 4122974 - RNA, 73 nt, Human
uuccaccaggauaaaaccucuagauaguaccauucaaaacaaccuguuaucuagagugaacaucaugggagaa

SEQ ID NO: 4122975 - RNA, 60 nt, Human
uuccaccauguaacaagcucuguacugaacuauaaaaauacgggaaugaacaugguggag

SEQ ID NO: 4122976 - RNA, 67 nt, Human
uuccacucuacucuggccagucaccucucuucaucaauccuggggaugacuaaagagaaguagggaa

SEQ ID NO: 4122977 - RNA, 65 nt, Human
uuccacuuugggucugugcaggccucgauaacgugaggggaugcaucgggcccggagcaguggaa

SEQ ID NO: 4122978 - RNA, 56 nt, Human
uuccagaaaguucuggaacuggacuuaccaugcaggcuccggaaccuccucuggga

SEQ ID NO: 4122979 - RNA, 64 nt, Human
uuccagaccaugugagaggcgcaaggucucagagagacugugcauucugggugcauggcuggga

SEQ ID NO: 4122980 - RNA, 77 nt, Human
uuccagagacacauuuucagcucugccaaaccauaaugcuuaggcuuucguuuggauauagcugaggugucuuggaa

SEQ ID NO: 4122981 - RNA, 68 nt, Human
uuccagcauggccacggggguagguaaaagcagaaaaucauagcuuugcaagagcccagggccaggaa

SEQ ID NO: 4122982 - RNA, 80 nt, Human
uuccagccuucuagaaguccaaaguuaaauagaacguccagcagccuuuuaucuagcagggauuuuugugggggcgggaa

SEQ ID NO: 4122983 - RNA, 73 nt, Human
uuccagcuaguucagguuuucucauuuucuucauauguugaguaauuuuggaguauaaccuggauauugugaa

SEQ ID NO: 4122984 - RNA, 80 nt, Human
uuccagcugucgauucagcucuucagagauaucggggugcacacuugccucuuucucuggugguuggacugggguuggag

SEQ ID NO: 4122985 - RNA, 59 nt, Human
uuccagcuuguccuuucucugccgugacugacguuggccuggaucuaaggaagcuggga

SEQ ID NO: 4122986 - RNA, 75 nt, Human
uuccaggaaacagcaucucagcaucuccaggcugagacgggccccaggucgugacugagagcugaauuccuggaa

SEQ ID NO: 4122987 - RNA, 72 nt, Human
uuccaggauaugcuaaugacacucuagaaauaaugcuucuguuuuugagaauuguuagcauauauccaggga

SEQ ID NO: 4122988 - RNA, 80 nt, Human
uuccaggcacaaagucuaugcccgaugugcuuggcauccuuuauuaucagccaaaaaguacauuuaggugugccauggaa

SEQ ID NO: 4122989 - RNA, 64 nt, Human
uuccaggcauugugagugggcagguaugauaauuucuucaucuguaaagcccugguaccuggaa

SEQ ID NO: 4122990 - RNA, 57 nt, Human
uuccagguggcuuuccugggggagugccugguaauuuucccagaggaaugccuggaa

SEQ ID NO: 4122991 - RNA, 55 nt, Human
uuccaguuggagccugccuuuaucccugacguacuggauuggcuuccugcuggaa

SEQ ID NO: 4122992 - RNA, 80 nt, Human
uuccaguuuguacuugauaguccugaaacauucuaggaaggaaguccccagggugugagaaggaaguagcagaucuggga

SEQ ID NO: 4122993 - RNA, 74 nt, Human
uuccauaucguuaaaguucugacauucuaaucggaaaagaaaugaaccagcagacuuugacagguuuugugggg

SEQ ID NO: 4122994 - RNA, 76 nt, Human
uuccauauugccucuuaugguuugucagggaaggagcaacuaaaucaaaaccugaucaaagaggucagcauuggga

SEQ ID NO: 4122995 - RNA, 72 nt, Human
uuccauauuuaaagucuacuugaauacgauggugaugaaaaccaagacugucccauuuauguagacauggaa

SEQ ID NO: 4122996 - RNA, 67 nt, Human
uuccaucauggcuggcuucagucugauuuauugccauccacuccugaagccaagccagcugauggag

SEQ ID NO: 4122997 - RNA, 60 nt, Human
uuccauccacuccucagcucuauucccugcauaucucuaggaggcugugaggggaaggaa

SEQ ID NO: 4122998 - RNA, 101 nt, Human
uuccaucccaguaaguucccaugggauaaguuauuuuaguaaaucagaaaauuucucugaaagcaaaguaauucuuaauuuuuggaggcuugaaaauggag

SEQ ID NO: 4122999 - RNA, 78 nt, Human
uuccaucuuaacaccugcuuucuuggacuacucaugguaccaacuguugaguucuccaggaagcagacugagauggag

SEQ ID NO: 4123000 - RNA, 69 nt, Human
uuccaugaaacacacacgcgcauacuguguucaaggcagcuauguauuuguguguuaaaacagaaggag

SEQ ID NO: 4123001 - RNA, 73 nt, Human
uuccaugacuaguagauuaucacuuuuggguuugcucuuggaagugacaagaugcuaggaucccucuuuggaa

SEQ ID NO: 4123002 - RNA, 74 nt, Human
uuccaugcuaaugauggaagacauguucgaucucucucaaacucgaggauacauguuuuuuaucaauucaggaa

SEQ ID NO: 4123003 - RNA, 60 nt, Human
uuccauggcccagcaccuggcuuuuuguaaaaaagcaugccagccuucuguggccugcaa

SEQ ID NO: 4123004 - RNA, 68 nt, Human
uuccauggugacaaacaguagcugugaugucuguucaccuuuuugcagccauuguuuucuaccuggag

SEQ ID NO: 4123005 - RNA, 90 nt, Human
uuccauuaucccauauuucaugugcaccauaauucaccagaaguuuggauguugaauaccugcgguguccaugaacugguugucauggag

SEQ ID NO: 4123006 - RNA, 88 nt, Human
uuccauucaaaacaauguacacaugaauguuuaaauucaucagccuuucacuguguaauaaugugacauguuuacaguguugaaggaa

SEQ ID NO: 4123007 - RNA, 76 nt, Human
uuccauucuuguuggaaagaagcaacuucaguguuuuucacuaaacaaauugcaguugucuuuccuaauuuuggga

SEQ ID NO: 4123008 - RNA, 95 nt, Human
uuccauucuuuuauuauuucuguuccuucuaauuuuacaccugacugcucugaguggguguguuuguaggaggggguggaagauuaaagaaggaa

SEQ ID NO: 4123009 - RNA, 68 nt, Human
uuccauugcagcaccaauggcuuccugcuggaacccucccuuuagccacagguguuggccagugugag

SEQ ID NO: 4123010 - RNA, 102 nt, Human
uuccauugccaaggagccuuuguguugcugacaagagaggagcaggcugagagaaaacgcccuguuugucacaaaguuacaucugcgagcuccuucaaggaa

SEQ ID NO: 4123011 - RNA, 56 nt, Human
uuccauuguuucugucuucacuuccuuuuaccugggagaagcugauacugauggaa

SEQ ID NO: 4123012 - RNA, 95 nt, Human
uuccauuugcucucuuuccugcuccacuugggcaccccccaggcccaguuuccuugggugggaucagcugguggaaaggagggaggugcugagaa

SEQ ID NO: 4123013 - RNA, 65 nt, Human
uucccaagccuacaauguauuaguugguuuccacacuucauuuacauuauaggcugcugcuggaa

SEQ ID NO: 4123014 - RNA, 69 nt, Human
uucccacacucaguacauauggaagauuucucucuacuuugaaucuucucauguguaaugagguuggaa

SEQ ID NO: 4123015 - RNA, 65 nt, Human
uucccacugcuggcuccaggcuggagcgcaacugagaggggguguuacuggagucacagugggga

SEQ ID NO: 4123016 - RNA, 69 nt, Human
uucccacuuuccuucucacacuuggggcuacaccaguagagagguuguaugugcuugagaaggugggag

SEQ ID NO: 4123017 - RNA, 85 nt, Human
uucccagaaugcuggcuucuagcaguguugauuuuucuguccaaacaaugcaaaucacacaagcuggcagcaaggauucaaggaa

SEQ ID NO: 4123018 - RNA, 69 nt, Human
uucccagcucucucuucacaauaccuggaccaauauccucaaguucaguccugaggaagagcugcugaa

SEQ ID NO: 4123019 - RNA, 78 nt, Human
uucccaggaggguaauuggaaauauuaauagaagggacauuuuuacuugaaaaccaccaguauuugcauaucugggag

SEQ ID NO: 4123020 - RNA, 126 nt, Human
uucccauaacaagauguucaucucuggaggcuaucccggagagccaacugcacauaaauccauucuaauuaaauaugccacucuccagggguagaugccuucguuacaggacuuauuucaggggaa

SEQ ID NO: 4123021 - RNA, 60 nt, Human
uucccauaaggagauagucaaagcuucuugggauuaggauguggacauaucuuuugggag

SEQ ID NO: 4123022 - RNA, 74 nt, Human
uucccauuuagcaaaugucugaaggaauagcucacagaauuggcaguggaguucagaacauugguguaugggaa

SEQ ID NO: 4123023 - RNA, 73 nt, Human
uuccccagaugacaucaaaaggccauguuggugucaccaccaccuccagugcuaaauugaagucucaggggaa

SEQ ID NO: 4123024 - RNA, 65 nt, Human
uuccccaguuuaccaggcaggaaaaugaagcuuagcaaauaacuuggccaaggucacugggugag

SEQ ID NO: 4123025 - RNA, 73 nt, Human
uucccccuguagaaugaguaagccacaaggucauaacucuuucuuugguuuauuucuuccuaugagaauggaa

SEQ ID NO: 4123026 - RNA, 88 nt, Human
uuccccgaguggaguucccagcggcccgcggcugacggccagaucuguccugaggggucgugggagcccagcgccugccuugagggaa

SEQ ID NO: 4123027 - RNA, 74 nt, Human
uuccccugugcuauagaagguaccauauucacaugcuucaagaauuagaauauauuguaucuuucaugggggag

SEQ ID NO: 4123028 - RNA, 70 nt, Human
uucccgugucugcucuccgcagcccuccugggaggguuugaagagacagcugagagcggccagcugggaa

SEQ ID NO: 4123029 - RNA, 126 nt, Human
uucccuaaacacucaggaguuuaauugaguauuauuggaugauucacuuggcaguuaggaucuugcuguggaagagggucaccaguaugaauauucacuauugugaugaugaaauguauaggugag

SEQ ID NO: 4123030 - RNA, 60 nt, Human
uucccuacuagccuuaauguuuuccccaaaacugugagguggaauggguucuguagggag

SEQ ID NO: 4123031 - RNA, 88 nt, Human
uucccucuuucucugcuagacccuucauguaguuccccagcugugaccaguuugcaugggggagaggguagguaaaagagggagggga

SEQ ID NO: 4123032 - RNA, 62 nt, Human
uucuauuaagucaaaggcaguuggaccugcuguggaauucagcuacccuuggcuuaauagga

SEQ ID NO: 4123033 - RNA, 90 nt, Human
uucuauugaauuguucauucucuuagcauaguccuugugauugucuuuuuaacaguuaguauugucuaauagaguaaaugagaaaaagaa

SEQ ID NO: 4123034 - RNA, 72 nt, Human
uucuauuugccugaguuuuaauuuuuuucacugaaauaaguagaaggacagguuggggcuucaggaguagga

SEQ ID NO: 4123035 - RNA, 104 nt, Human
uucccuuucuuuucugguugccucauacucccagccagcugucucuucuccuuuaaggcugagccuggcaugggggucuggugggguacugaguagcgggggaa

SEQ ID NO: 4123036 - RNA, 55 nt, Human
uucccuuuguugauuuccuaguccuugguuacuagaggaguauuuucuaagggaa

SEQ ID NO: 4123037 - RNA, 80 nt, Human
uucccuuuuuguguuguacuucugugcauuugugccaaagcaugaaaugcaaucaagaguaccagcugcaagcuggggag

SEQ ID NO: 4123038 - RNA, 101 nt, Human
uuccgagauaccucugcaacuucguuaggcaugcaagauuaagcucgaauucaucucggcuuagucauacgcgcucugaaacugaauugugaaggauggaa

SEQ ID NO: 4123039 - RNA, 61 nt, Human
uuccggguguaacguacuacccagccaggcccuuucccuugcugugcuuuggaaccuggaa

SEQ ID NO: 4123040 - RNA, 61 nt, Human
uuccggucugagagcaggagaagggagaugaggugucccagcucaagcaguuaggcaggaa

SEQ ID NO: 4123041 - RNA, 86 nt, Human
uuccgugcugguuguggucugaggcaugaaugugggcuuuggagccaggguucgaaucucagcuuugccacauucuagcuguggaa

SEQ ID NO: 4123042 - RNA, 71 nt, Human
uuccguguuauguuugugaacagagccauuuucauugauaccgcuuugaaaacacacgaauagacacugaa

SEQ ID NO: 4123043 - RNA, 82 nt, Human
uuccuaacaaacaucuaccagaauugcuauaaaucugccuaguuccauguuuuggcagugcuggaagauuaaaaguuggaag

SEQ ID NO: 4123044 - RNA, 85 nt, Human
uuccuaagggcagggaccgugucugcccauucacugcuauaguucagcauggggcuggcacagucucuauuaacuacuuugugaa

SEQ ID NO: 4123045 - RNA, 74 nt, Human
uuccuaaugacaggugcuaugcaaucagcacuauuaccauaugcuggaaauaggcauuguagcuuaauaaggaa

SEQ ID NO: 4123046 - RNA, 60 nt, Human
uuccuaggauggugaagcaggauacaggaaagaccugaguuuggcuuccugugcugggga

SEQ ID NO: 4123047 - RNA, 63 nt, Human
uuccuaggccugccguggcucugccccuucuccagguuagagcucugcagcuggccucaggaa

SEQ ID NO: 4123048 - RNA, 117 nt, Human
uuccuaguggcacccacuccccagagcugggggagggcgucagaagcuggggggguuugugccuuuaacuccagcuuuagcucuccagggugggaggaguggguuggacauaagggg

SEQ ID NO: 4123049 - RNA, 63 nt, Human
uuccuauagaaagcuguguagacugcuuucuauaggagcagucuacacagcuuucuauaggaa

SEQ ID NO: 4123050 - RNA, 61 nt, Human
uuccuauccuuuuauguuuaugucuccucagaagacacaccugauauaaagagauggugaa

SEQ ID NO: 4123051 - RNA, 76 nt, Human
uuccuauguuugccuuugcaaagacucuugccuucaucaaauaagagcaaugguaaguuuuguauaggcaugggaa

SEQ ID NO: 4123052 - RNA, 93 nt, Human
uuccuauuccccggugaugugguuucuccacuaucuuguaacuuaauagaauuuacaagauaacggagaaagcacaucauuggagaauaggaa

SEQ ID NO: 4123053 - RNA, 63 nt, Human
uuccucaacucaaggaagacccacgcagauaugcucuauguuugcccucuuccaugagaggaa

SEQ ID NO: 4123054 - RNA, 60 nt, Human
uuccucaccagaacauguuguccccuuucaucaagggugcagcuucugaagguguaggaa

SEQ ID NO: 4123055 - RNA, 86 nt, Human
uuccucaccuuuguucccugggaagcacuugucacaugcccugugugucccagaugcuucgugggugagcacguauugaauuggaa

SEQ ID NO: 4123056 - RNA, 88 nt, Human
uuccucacuacucaggaugucggugacuauugauuuuuauuucauaaagaauuuacgguaguaauaccaauauaaaugacuucgggaa

SEQ ID NO: 4123057 - RNA, 62 nt, Human
uuccucagaaaucuugucaaggcaucuuggcuacaccuggauugccugugaauuuugaugaa

SEQ ID NO: 4123058 - RNA, 67 nt, Human
uuccucauuacuguauuguauagaauaguuucacugccauaaauaugcccugugcagaaauguggaa

SEQ ID NO: 4123059 - RNA, 56 nt, Human
uuccucauucuggggcauguugaagcacauguuucuccugcccaccagaagaggga

SEQ ID NO: 4123060 - RNA, 65 nt, Human
uuccuccaguaugccuaauauucuuagaagaagaugaaauuaggacacauacauguacagaggga

SEQ ID NO: 4123061 - RNA, 77 nt, Human
uuccucccacgcucaccccuaccucuuccugcacugagugucccugugcauuuugaggcugggggagcaggauggaa

SEQ ID NO: 4123062 - RNA, 57 nt, Human
uuccuccuacccugcagauacacucacucacauguuugcuguuucaaguaggaggag

SEQ ID NO: 4123063 - RNA, 85 nt, Human
uuccuccucucaguagcaucaccauucaaguggcuguuacacuuuuuauucuccaccugcuuuuggugauuuuacugaaggugaa

SEQ ID NO: 4123064 - RNA, 59 nt, Human
uuccuccucucaucuguccuaagccagguuuguggcuccagguacguaugggaggugaa

SEQ ID NO: 4123065 - RNA, 70 nt, Human
uuccuccuggggguuuauuuuuggacugcugagcaaugccuugacuuuagaagagcccuuuaagggggaa

SEQ ID NO: 4123066 - RNA, 75 nt, Human
uuccucuagcuuuugucuuccgccuuccccagguagguuuucuauuccuggaggcaaagcagaggcauggaggaa

SEQ ID NO: 4123067 - RNA, 65 nt, Human
uuccucuggcucugacacuacuguuauccuauccuugauaagugaugcucaggccuagaaaagaa

SEQ ID NO: 4123068 - RNA, 94 nt, Human
uuccucuuugcccaaagcugagcugucugaauggugaggauucucuccuccacuuugucuagcaacagcuuggcccuugauacugcaggaggag

SEQ ID NO: 4123069 - RNA, 128 nt, Human
uuccugcacacuuguuuuugacauauuacccagaucuucaucaccuggauaagcauuguucaauaaagcuuucuguggugauguaaaggaucuguauauuugcauauggguuaagugugauuauggaa

SEQ ID NO: 4123070 - RNA, 56 nt, Human
uuccuggccucucucugagcaguuccagauaggguugcucuccagggguccgggga

SEQ ID NO: 4123071 - RNA, 64 nt, Human
uuccuggcucucuguugcacagcugacuugugccauucugcuguugcuguauagaguuaaggaa

SEQ ID NO: 4123072 - RNA, 62 nt, Human
uuccuggcuugucacaucuacgugggacauuuagacuauccacgggcuggauaccuuaggaa

SEQ ID NO: 4123073 - RNA, 58 nt, Human
uuccuggggugaagauauuuuucuuccaucuuagagaaagcccccuucugcccaggaa

SEQ ID NO: 4123074 - RNA, 99 nt, Human
uuccugguaauucggaugcacauuaaaauuaaaguuuuauuuagagcauugguccccuaaguuagguagaaguuuacuuugaaguuugcaagccaggga

SEQ ID NO: 4123075 - RNA, 58 nt, Human
uuccuggucccguucuucacuguuuaaaccgcaggauuccuagaacacgaccguggaa

SEQ ID NO: 4123076 - RNA, 57 nt, Human
uuccuggugaccucacugguaggcugggcugggagugguuggugacguugccaggga

SEQ ID NO: 4123077 - RNA, 77 nt, Human
uuccuggugucccucagaugcacucugcguaccucucccugccguagaggcugaaaucugagggcuucaucaaggga

SEQ ID NO: 4123078 - RNA, 71 nt, Human
uuccugguuguccugauguagugacccuccccugccucuccccgggaagaaggugcuacacagggcaggaa

SEQ ID NO: 4123079 - RNA, 64 nt, Human
uuccugguuuauggaaagcaugucaaaauuuggugugugaaugugcaaguccacaaaaagggaa

SEQ ID NO: 4123080 - RNA, 60 nt, Human
uuccuguccugccccuguagaggcaaagagggugucugcacagcuggugcagggcgggga

SEQ ID NO: 4123081 - RNA, 55 nt, Human
uuccugugguaugggagugaugugggguucccagcuccagaacauagcacaggaa

SEQ ID NO: 4123082 - RNA, 82 nt, Human
uuccuguugaguuguuuaauuuggagauaucacaccuucacagaagcacacuguuugugauguuucuugaugcuuuuaggaa

SEQ ID NO: 4123083 - RNA, 86 nt, Human
uuccuguuguucaacuaagcucccaacugaagaggcugaaaucacagcccccucaaagaggaagcucuggcuuaaacaacaaggaa

SEQ ID NO: 4123084 - RNA, 71 nt, Human
uuccuucauuuauucaugaucuguagcugguuuuguacuacaguggcagaguugaauaauugaaacaggga

SEQ ID NO: 4123085 - RNA, 61 nt, Human
uuccuuccaaauugcccuucaguugaaugcuuuucucugagcuggucuauggacuugggaa

SEQ ID NO: 4123086 - RNA, 55 nt, Human
uuccuucccccucaagagaacuuaauuuacucaaaguccucccuggguagaggag

SEQ ID NO: 4123087 - RNA, 73 nt, Human
uuccuuccugacuuuuuucagccacagugagucucugagaccuaguuuuggcagaaggaaguaccagagggag

SEQ ID NO: 4123088 - RNA, 106 nt, Human
uuccuuccuuuccugaggguguccaggcuucacgucugcccucauugccagguaggugcagggacaccuuugugaagcuccugggccuuuagggaagacagaggag

SEQ ID NO: 4123089 - RNA, 92 nt, Human
uuccuucuaucuccuuaaaggcuccuuuucuuccauaauuucuugguagaaagcuggaagagcugggauuuuugccaaggaagguuuaggaa

SEQ ID NO: 4123090 - RNA, 57 nt, Human
uuccuuggccacacuggugcuuguucaauaagccaacauacagaguggccacaggga

SEQ ID NO: 4123091 - RNA, 66 nt, Human
uuccuugggaggaaaugagaugcuauauaagaagcugugguauauuaacuaguuucuuccucggaa

SEQ ID NO: 4123092 - RNA, 56 nt, Human
uuccuuucacguuuuaaugcacacuguuuaaggauguauuaggaaggaggaaggaa

SEQ ID NO: 4123093 - RNA, 75 nt, Human
uuccuuuuguauuuuucccagcuagcuucugcacccagaaccaacuauaauuuuggggauccagugcaaaaugaa

SEQ ID NO: 4123094 - RNA, 57 nt, Human
uucgacugcugcucaaaccaucugcugaguauaaggagguggucugcagcagcugaa

SEQ ID NO: 4123095 - RNA, 60 nt, Human
uucgaucugaucacccuggcuguucuguggagaacagacuuggaggagugaucagaggag

SEQ ID NO: 4123096 - RNA, 104 nt, Human
uucgcagcgucuuccaagucucuguucucuaaggaaauaugucacuugcugagcgaggguaggggaagugugguuucuuuacagaaccgggaagauucuccgag

SEQ ID NO: 4123097 - RNA, 71 nt, Human
uucgcauuaaaaaaugagcaagguuuucaaccaaacaguugagcaacugggcucauuuuuuaaacaccgaa

SEQ ID NO: 4123098 - RNA, 93 nt, Human
uucgcuugcccuggccuccaggcaguccugcagcagcaaacacaucaucagccuuaggagcuggccugugagguugaccacucuguaggugga

SEQ ID NO: 4123099 - RNA, 77 nt, Human
uucgguuaaucaguguuucaaauguaaucugggguuuagugccagguggcaugccugagacauaaagauuuuaugga

SEQ ID NO: 4123100 - RNA, 99 nt, Human
uucgucugaagacauuguuaccuaacuggugaguaggauuuauaugugccuuguugccuguaucuuucucacuuaguaaacuucauugucuuagcugag

SEQ ID NO: 4123101 - RNA, 91 nt, Human
uucguucucuauuuauuauuaguuagucaaauccaguuuuugaucuccaaaaauagaaggauugacugaguuggagucuguggggaaugag

SEQ ID NO: 4123102 - RNA, 68 nt, Human
uucguuucugcccccuugauggacuuuucccacuguaaacauaagccucugggugggcagcagaugga

SEQ ID NO: 4123103 - RNA, 70 nt, Human
uucuaaaaggcagaugacugagguacucgggggaaucaaagagaaauguucuucauuugccauuugagaa

SEQ ID NO: 4123104 - RNA, 74 nt, Human
uucuaaagaaguacuagaaauagcagugccucaaagugagggcuucuagaauuucugauauauauuccuuggaa

SEQ ID NO: 4123105 - RNA, 71 nt, Human
uuacaauaauugcaagugguuaauagaaacauccuuuuacagcuucuauuuaccaaauguaguuccugugg

SEQ ID NO: 4123106 - RNA, 55 nt, Human
uuacacaacaucuguauuauuagcauccuuuuuaaugagauagauggaggugugg

SEQ ID NO: 4123107 - RNA, 130 nt, Human
uggugcccuaggcagggcucauagcggcagaggcaggaauggauucgcugugagcugggucaggcuugcuccugcccuucacgaugguaucuuagguccugccaccuguguuccaggcguggggucacca

SEQ ID NO: 4123108 - RNA, 59 nt, Human
uggugccugugcaugaagagacagcaggcucucugauaucucuucccaucaggacacua

SEQ ID NO: 4123109 - RNA, 60 nt, Human
uggugcugccucuuugcccgggucugugccagcuccgacuccaggugcaggaggagccca

SEQ ID NO: 4123110 - RNA, 66 nt, Human
uggugcugucuacuuugugcaguuccugcuacuaaauagcagcuaaccuguauugagugauuacua

SEQ ID NO: 4123111 - RNA, 64 nt, Human
ugguggagccaggagaugaagcagguuugucuggcuccaaagcuguggucuuuuaguuccauca

SEQ ID NO: 4123112 - RNA, 73 nt, Human
ugguggccuucaugaagcugugaaaucucuagugcagggggucccccuguucugagcucuuagcuucacccca

SEQ ID NO: 4123113 - RNA, 90 nt, Human
ugguggcgugcgcuaggccgaagcugacccaggagcgugugcggcagugcaccagcgccuccgugggcagcaugugccaguccgucacca

SEQ ID NO: 4123114 - RNA, 78 nt, Human
uggugggccgacuggggaaggcggugacugcgcugaaucguagccagcaucuugcaagcuuccuguccaguuccagca

SEQ ID NO: 4123115 - RNA, 65 nt, Human
ugguggggaugagagcaggaaccauggccagaauugucugugcaucuguucauucguucccagca

SEQ ID NO: 4123116 - RNA, 116 nt, Human
uggugggugguggggauggaguucuccucugucuaccacgaggguaagucucuuuuuggcgcuuuuguggugauggagaggcacuccgggaaggggaaugucuccgccgccugcca

SEQ ID NO: 4123117 - RNA, 64 nt, Human
uggugguaaaggcagcauuugaauccagguccauuuggcuuuggaaugugcuguuauagcagca

SEQ ID NO: 4123118 - RNA, 78 nt, Human
uggugguaauauaugccagauaaaauucgccacuuuaaucaauuuaaguguauauuucaguggcaucgauuacccuca

SEQ ID NO: 4123119 - RNA, 75 nt, Human
uggugguaauauugaaugucaaguucuacccagaugauuggguuuuauagauguggacauucauaguuauuacca

SEQ ID NO: 4123120 - RNA, 119 nt, Human
uggugguaguaugaugucauagaaagagccuuaggcauagacugacgggcagcguuugagucccaucuccacuauuuucuagcucuuuggucuuuggcaguucacuaagcaagccacca

SEQ ID NO: 4123121 - RNA, 93 nt, Human
ugguguaccuucaauaaauguuaugcccaucauccaagcaucuccaaacaugauuguguuuagaaauggguuacauuuagagaugguauguua

SEQ ID NO: 4123122 - RNA, 55 nt, Human
ugguguacucucaagcagaugucucuacuuuaggcaaacauguugugagauacca

SEQ ID NO: 4123123 - RNA, 82 nt, Human
ugguguccucagcauguccuguuuuggcuugcucucaguuuccuagagacuagcauaguggcuugcacaugguagacacuca

SEQ ID NO: 4123124 - RNA, 68 nt, Human
uggugucugggacucagauugugcuguucauggacagagagaauuggguuuacagaauauuuucacca

SEQ ID NO: 4123125 - RNA, 71 nt, Human
uggugugaggacuaaaugaguaccaucuguaaauccuuagagcagcaggugcaaagugcuagcccacacca

SEQ ID NO: 4123126 - RNA, 68 nt, Human
ugguguggugugugagaugaggauucucagagauuuccucacaauuuuaauacacagucaauauacca

SEQ ID NO: 4123127 - RNA, 67 nt, Human
ugguguugcugcuggcuggcugcaugacccagccaggguucaaaguccugucagguagccuacacca

SEQ ID NO: 4123128 - RNA, 87 nt, Human
ugguguugucaguguucuggauuuggggcauuuuguuguacaaguuaucaauacuugccuuaugguuccaggucuuguauuucacua

SEQ ID NO: 4123129 - RNA, 74 nt, Human
ugguuaaaugagggcugacaugauugggagaguugccugcagugugucuuguucuguucaguucuuauuuauca

SEQ ID NO: 4123130 - RNA, 66 nt, Human
uucuguuuuuaucauccuguucacuuuuuccagauaaauaaagagacaggaaacaagaaggcagga

SEQ ID NO: 4123131 - RNA, 58 nt, Human
uucuuaaagaggcaaaacacagggaugacugaccuccucuaccguguuucuuugggag

SEQ ID NO: 4123132 - RNA, 72 nt, Human
uucuuaauucucucuagaagcugagauggggcaagggauugcacuauguacauggagagcaauugaauagaa

SEQ ID NO: 4123133 - RNA, 78 nt, Human
uucuuacagguauuuccuuuaaagaaacucucaaggauuagaagucuucuugauucaagggaguaaaguugugaugaa

SEQ ID NO: 4123134 - RNA, 76 nt, Human
uucuuacuguauauaguuuagguucgaaugggaucaccauaggugugcuuaugaccuuaacuguaacagcgaugaa

SEQ ID NO: 4123135 - RNA, 59 nt, Human
uucuuaucuaauccaugacaguguugugaggcaggcauuguccuguuuagggauaagga

SEQ ID NO: 4123136 - RNA, 63 nt, Human
uucuuauugucacugagugaaaagguaauucucguugaauuuacgaaaagugacuaauaggaa

SEQ ID NO: 4123137 - RNA, 55 nt, Human
uucuucaaccaucuacauaaacacauauuaauuguguuggggauuuuuugaagaa

SEQ ID NO: 4123138 - RNA, 75 nt, Human
uucuucacauuuuagugguuugucaguguuugacaauuaaaccucaaauuuagauauaugauuauaauggaagag

SEQ ID NO: 4123139 - RNA, 66 nt, Human
uucuucagaaaacgauuuugacuagugcugggcacagcaguagacacauuuguuuuuccucaagaa

SEQ ID NO: 4123140 - RNA, 74 nt, Human
uucuucaguccuuucaauggugaccuuuuauggaggcaacaacaaagaaugucaccagaagaaggagggaagaa

SEQ ID NO: 4123141 - RNA, 64 nt, Human
uucuucauccuaagaauguuuaaaugucacaaaggauuuuaaagcaaaaacuaggauggaugga

SEQ ID NO: 4123142 - RNA, 73 nt, Human
uucuucccugccagaagguuccugcugcagcucuccugcuaguuuagcuuagccuucugguuugagggaugag

SEQ ID NO: 4123143 - RNA, 85 nt, Human
uucuuccuaggugacagcaacacucaauucugcagaaguaaccagucaguuuugcucuggguucuugcuguuacugaccuaagag

SEQ ID NO: 4123144 - RNA, 80 nt, Human
uucuuccucugauauuacucugauuuaguaaauguaccaacagaaugcaguauuuacuagggagagauuuagaguaagaa

SEQ ID NO: 4123145 - RNA, 83 nt, Human
uucuuccuuacaaguucauggcugguccacucccuggaggcugugccacacagaccccagagaucagcugcccuugagaagag

SEQ ID NO: 4123146 - RNA, 71 nt, Human
uucuuccuucuuugcuccuucuuucuacccccagucucccuggggugggaucuguggagccucaggaagaa

SEQ ID NO: 4123147 - RNA, 65 nt, Human
uucuuccuuguucuucugggagagacauccaaaagacucucaagcuaaguuugaacaaggaagaa

SEQ ID NO: 4123148 - RNA, 68 nt, Human
uucuucuuaauguccugggaacuaucugugcagacuaagaauaauuuguuccuuaggcauuggaagaa

SEQ ID NO: 4123149 - RNA, 76 nt, Human
uucuucuuggcacaaauuucugaaauaagauaagcagaugucuugguuuuagcaaaucuguugcuucaaguaggaa

SEQ ID NO: 4123150 - RNA, 85 nt, Human
uucuucuuggucacccauugcccucacagucaguucuuagucugaucuuuuaugacuucagauaugugagcaaaccaaugaggaa

SEQ ID NO: 4123151 - RNA, 70 nt, Human
uucuucuuucccccugugguaccccuuguucagaaaaguuugcuaaaugucuacaggaaggaaagaagaa

SEQ ID NO: 4123152 - RNA, 67 nt, Human
uucuugaagacuaagcgguucuuuucaauuuuuggguauucagaaaggguugccugguuacagagaa

SEQ ID NO: 4123153 - RNA, 89 nt, Human
uucuugaaucgaauauaugugugucuuagcauuggaaggccaaauaucuagcuuuccaguuucuaaguacaguugagucccauuaagaa

SEQ ID NO: 4123154 - RNA, 130 nt, Human
uucuugacccgguggucauaugguaugcacauuaugauauguuaaaaaauauauauguauguguguacauaucuguuguggacaugcauacauauguuucauguacuuuguccauauuccacaauaagaa

SEQ ID NO: 4123155 - RNA, 71 nt, Human
uucuugaggaaccaaaucagcuugcacauaguucaaaaucagaaaugguugcugauaugaguucuuuugaa

SEQ ID NO: 4123156 - RNA, 69 nt, Human
uucuugaugauuugcagagggaguguuauuagggagcuaacacuuaaaccaaaauguaauuaucaggga

SEQ ID NO: 4123157 - RNA, 84 nt, Human
uucuugauguaccuauuguaagagguuuggcuguguaauaacaaauaauauuagccacucuuuuuagcacggggacaccaugag

SEQ ID NO: 4123158 - RNA, 56 nt, Human
uucuugcaucaagacagccuguccagcuagcaaggcagguuguuaaacuguaagag

SEQ ID NO: 4123159 - RNA, 63 nt, Human
uucuugcauuuuggagaaugcugaauuaaaauuguaggucagucuucuaaagggaugcaagga

SEQ ID NO: 4123160 - RNA, 80 nt, Human
uucuugccauuucauuuugggguuugucaucuuuuaaguuuuuccuuagaagcuucuaaaaugaccucagaauguaagaa

SEQ ID NO: 4123161 - RNA, 92 nt, Human
uucuugcccccaugguuaucauagacuaaauaguuacagguaggcccauucauugcuuccauuuggauacuuuugguuacuauaagcaagaa

SEQ ID NO: 4123162 - RNA, 65 nt, Human
uucuugcccugcgugucucugucucauggccaccuuccugagccguguucaacugcuggcaagag

SEQ ID NO: 4123163 - RNA, 94 nt, Human
uucuugccugaauuaauuacagugaagauugcaaagggauuauguucuaauucuguaaucccuuuuucauuuaauagauagcauuuugcaagaa

SEQ ID NO: 4123164 - RNA, 79 nt, Human
uucuugggaguauuuauacuggcuaguguuuguucuuauagcgguccaucucugcccaguuugggagccuuuccaggaa

SEQ ID NO: 4123165 - RNA, 97 nt, Human
uucuuggggaaaauguuagacaagggaugaaugaagcacuuauguucugcuaagguaaauguaugugcaucauuuacauuuggaacauaaucaagaa

SEQ ID NO: 4123166 - RNA, 65 nt, Human
uucuugguuuggaaacuuggauggaaaaccucgaauuuuuuugaguugauugguuucccuaagaa

SEQ ID NO: 4123167 - RNA, 89 nt, Human
uucuuguuccucaguaagaaacccaggaauuucuuaccugugugauagaguaauaaagaugugggcuuugaaacugggaaacacuagaa

SEQ ID NO: 4123168 - RNA, 72 nt, Human
uucuuuaacugguuucacgucagcuuuuuccucugauuugagagguggaguuaagugugaacugcuuaagaa

SEQ ID NO: 4123169 - RNA, 57 nt, Human
uucuuuagcugcgaagggaguggaaaagacgacuaagccaagagcaugcaugaggaa

SEQ ID NO: 4123170 - RNA, 78 nt, Human
uucuuuaguuggcugucucauggaucuacagucaggaguggcucuggcuguacagauaaagacuguaaauuuaagggg

SEQ ID NO: 4123171 - RNA, 130 nt, Human
uucuuuaucuugccuuuaaaagcaguuguuacccuuuucccuuucuuguauuucuagcuguguuaguggcucuauuaggaacaacugcagguacaagaaagccugcugcugacuuaaaccaagagaagaa

SEQ ID NO: 4123172 - RNA, 76 nt, Human
uucuuucaauuuuacauaggggauaugggcuaugaagugggcuugucccauaucugacccugaaggcuugagagag

SEQ ID NO: 4123173 - RNA, 64 nt, Human
uucuuuccaaccagauauugguuuguaguuaaucaguuauuauuauuauuuugguuggagaggg

SEQ ID NO: 4123174 - RNA, 129 nt, Human
uucuuucuaaugggagccaccacauugcguuccuuuaauuacacagugucaugucguguuccccugugaaaugacacggaggaacaugaggugaccugggauaacugugaugaauugcaucccgaagag

SEQ ID NO: 4123175 - RNA, 81 nt, Human
uucuuucuguagagaaugaguugguacauaaggaaccucauuauagugacuuauguacccacucauauuccccagagagag

SEQ ID NO: 4123176 - RNA, 65 nt, Human
uucuuucuguccauaaugagacauaccucauuuguacuguccugagauuuauggagggauaagga

SEQ ID NO: 4123177 - RNA, 82 nt, Human
uucuuucuuucccaugccaguuuugagaugcaccucuuacuuggcagguguuccucuguacuggguacugggacagagagaa

SEQ ID NO: 4123178 - RNA, 62 nt, Human
uucuuucuuucuuuuggcuucugcugcuacucagaaaaggagacuccaaaugaaagaggggg

SEQ ID NO: 4123179 - RNA, 67 nt, Human
uucuuuggcuguccucuuggcuggugguaaugaggaacccuggauagaauaaagggcaggcgaaggg

SEQ ID NO: 4123180 - RNA, 121 nt, Human
uugaauccaauauuuuuucuucucggaaucccaggcauaucuacauuauccaagguguggauggagauguauuuuggaaggauuuagagaugucuguucuuauugaaaaaauaaaauucaa

SEQ ID NO: 4123181 - RNA, 63 nt, Human
uugaaugagauuuccagaaagcgcaaugcaaguguuaaauuuguaucucuggaaauucuucaa

SEQ ID NO: 4123182 - RNA, 80 nt, Human
uugaaugaguuacuagggauauucuguacaggcauaggcuauauauguguuuugaacucaucuacugcugacucauucag

SEQ ID NO: 4123183 - RNA, 56 nt, Human
uugaaugcaugguucacucugucauuuccuuucagggucugcucagugucguucaa

SEQ ID NO: 4123184 - RNA, 63 nt, Human
uugaaaucucaaagauggccagaagagacgagucugcugucuauagcaucuaugagaaaucaa

SEQ ID NO: 4123185 - RNA, 61 nt, Human
uugaaaugccguguuucuuacguucaacuucuguugcacguacaugucaggguaacuucag

SEQ ID NO: 4123186 - RNA, 67 nt, Human
uugaaaugguuuugugaaaaugcuuugauaacuucccacucaaagaagagauuuacagagcuuucga

SEQ ID NO: 4123187 - RNA, 59 nt, Human
uugaacacuuacuauguuccaaguauuaauccagaugcuuaauguacgugaguguacag

SEQ ID NO: 4123188 - RNA, 62 nt, Human
uugaaccaaaggauccuuccguugucaucuaucaaaguggacaauuucaccuuuugguucaa

SEQ ID NO: 4123189 - RNA, 130 nt, Human
uugaaccaagagaaauggcuuucccuaggaguuuguuagaaaugcagagucucaggcucccggaccugcugccugggaagcugcauuuuaacaagauacucgggugauuugugcacaccuuagaguucaa

SEQ ID NO: 4123190 - RNA, 67 nt, Human
uugaacccaugagguggagguugcagugagccgagaucgugccacugcacuccagccugggugacag

SEQ ID NO: 4123191 - RNA, 58 nt, Human
uugaacuguguacucuucuccugccaugcaugaaugaaaggagaugauccagagucag

SEQ ID NO: 4123192 - RNA, 75 nt, Human
uugaacuguugcaauucuguuguguuuugcuaaaaucuuaacgagaggauauuuacaaauuugccaauaguuuaa

SEQ ID NO: 4123193 - RNA, 56 nt, Human
uugaagcauuguggcuuguauuuugcaaagcaacugcgggcacauccauguuucaa

SEQ ID NO: 4123194 - RNA, 93 nt, Human
uugaagcauuuauagccuuauaggguagaauuauguacuuuuguuauugguacauaaaauacugccauguauuucuuuuauauuugauuuuaa

SEQ ID NO: 4123195 - RNA, 59 nt, Human
uugaagcccugucuccuguacuucuagaaugugacugcauuuggagacagggucuuuaa

SEQ ID NO: 4123196 - RNA, 56 nt, Human
uugaaggcaacugacaggguuugcaucaaaccuuugugugucugugccuguaucaa

SEQ ID NO: 4123197 - RNA, 80 nt, Human
uugaaggcucuuuaguccuguacucauuuagauugacucucacuucuggucccuuuuuguggugcagacuaaagccucaa

SEQ ID NO: 4123198 - RNA, 68 nt, Human
uugaaggugggaauucaccagguauccaccccuuucuguccaggaaccugucugccucccaccaucaa

SEQ ID NO: 4123199 - RNA, 95 nt, Human
uugaaggugucugagucccuccuggccucacaguccuggguucugggguauagcuguaacugagguggggccgggaggaauggggacuaauuugg

SEQ ID NO: 4123200 - RNA, 72 nt, Human
uugaagucagccugaggucauaggaugcaacuuuccuuagaaaauuuugcccuauccuucauaaaccuucaa

SEQ ID NO: 4123201 - RNA, 59 nt, Human
uugaaguccuaaucuccaggacgucagaaugggacugaauucagagauagggucuuuaa

SEQ ID NO: 4123202 - RNA, 59 nt, Human
uugaaguccuagccccugguaaaugagaauguaacuuuauuuggaacuagggucuuuaa

SEQ ID NO: 4123203 - RNA, 59 nt, Human
uugaaguccuugccucuugcaccucagaauauaacuuuauguggagguaagguuuuuaa

SEQ ID NO: 4123204 - RNA, 61 nt, Human
uugaaguggaagccuacucuugugguuauguugcuuaaccacucauugguuucucuuucag

SEQ ID NO: 4123205 - RNA, 73 nt, Human
uugaagugggggaacgagaguucuggaaggcuuacucaaaguucucauuuggacacucuuuccuucaauucaa

SEQ ID NO: 4123206 - RNA, 69 nt, Human
uugaagugucaaauuaaauaaucugggccucaagagaagacuacucugauuaggaguuugagacuuuga

SEQ ID NO: 4123207 - RNA, 63 nt, Human
uugaauaaaguagcuuucagugccaagguuaauguaucaacuucagguaguugcuuuguugaa

SEQ ID NO: 4123208 - RNA, 55 nt, Human
uugaauaagauaagauuucugcucucauagggcugagagcuguguaucuguuuag

SEQ ID NO: 4123209 - RNA, 70 nt, Human
uugaauacuguaggauuugaggaaaugugggugugaaacagaacauuucuuuucaucucuauauuuuuaa

SEQ ID NO: 4123210 - RNA, 80 nt, Human
uugaauaggucugacagcauuuggaaaaagacagcuuaugaugugggcaucauggucuuauuucacugucauccuuuuaa

SEQ ID NO: 4123211 - RNA, 60 nt, Human
uugaaucacgguauucugcacggggugccaagcccugugguagguguccugugauggcaa

SEQ ID NO: 4123212 - RNA, 81 nt, Human
uugaaucaucugcaaauauuagcuuagacauauauccucuuguaugucacugccuuuauucuguccaguaugacgugucaa

SEQ ID NO: 4123213 - RNA, 96 nt, Human
uugaauccugccuuuuucaguuacuguuuaugugaccuugagaagauucuuagccucucuaaaccuuuacauaacgguaugaaaaaugggaaucaa

SEQ ID NO: 4123214 - RNA, 86 nt, Human
uugaaucucuuccugcaacgcaguucaccugcagccugggaaaguguucuagugccaucuugagcugcuuuguggaagggacccga

SEQ ID NO: 4123215 - RNA, 82 nt, Human
uugaaucugccacuuuggagugcucagagaacaaaguuuuuaaaauaaguaguguagcauucuuagaguuugguucuuucaa

SEQ ID NO: 4123216 - RNA, 85 nt, Human
uugaaugaaccauggggcucuucugguugucacauuuuaagaaucuagaaauggaagcauauggaaagcuauuagguuggugcaa

SEQ ID NO: 4123217 - RNA, 66 nt, Human
uugaauggagacccuaaggaagagguagaaauuacuuguucaauaacucuuagaggucuuuuucaa

SEQ ID NO: 4123218 - RNA, 84 nt, Human
uugaaugguguaggucuggagaaaguugaguuugugaucauuugggaaugcaaugccaguuucuccacagcuucugacuuucaa

SEQ ID NO: 4123219 - RNA, 82 nt, Human
uugaaugucacaagacuuauuuguguagaaaacagaacacucaccaagguguauucuuuacaguggguuuugaaucauuuaa

SEQ ID NO: 4123220 - RNA, 71 nt, Human
uugaaugugaggugccucuaagucuauuaagaggugauguuaaguagacauuuagauaucucgcuguucag

SEQ ID NO: 4123221 - RNA, 55 nt, Human
uugacaaaggaauugaaucucugggagcgguucggaauuuuucuuccuguguuaa

SEQ ID NO: 4123222 - RNA, 56 nt, Human
uugacaaagugcuaaaccacagaggucugagaaagacacucuuaagccuuugucaa

SEQ ID NO: 4123223 - RNA, 80 nt, Human
uugacaaauuuacuugauguaugaugaguaggcauuuuauagauaugccauauucuacuucauauaucaagaagugucag

SEQ ID NO: 4123224 - RNA, 81 nt, Human
uugacaaggccugagcagaggaggcugccaacuguagaaauugcaaguuauaaagaaauucucuguuuucuaccuugacag

SEQ ID NO: 4123225 - RNA, 68 nt, Human
uugacaccagcaucccauugugggucuugauccucuucacaaccauggcccugauggagcuggugcaa

SEQ ID NO: 4123226 - RNA, 55 nt, Human
uugacagccaccacccucaugaaaucauagaugacaucaacaguggugcugugga

SEQ ID NO: 4123227 - RNA, 55 nt, Human
uugacagcuacggagcagcugucuacuccggcaaaugcgucuaaugugcugugaa

SEQ ID NO: 4123228 - RNA, 65 nt, Human
uugacagcuaggaaauugaggcugagacaagugaagugucuugcccugguuucccagcuagugag

SEQ ID NO: 4123229 - RNA, 61 nt, Human
uugacagggcaaguuugagauuauuuuccaaugagaaguucuagaacugugcccuucucag

SEQ ID NO: 4123230 - RNA, 55 nt, Human
uugacauuuuguuggcagccuucagagcacuucaggcuucucugcaagauguuaa

SEQ ID NO: 4123231 - RNA, 58 nt, Human
uugaccagggagcaccgcugcggccgaucagaggagcaggaacuggaacccuggccga

SEQ ID NO: 4123232 - RNA, 63 nt, Human
uugaccauaccuccaggcaguucaaaaggccaaaugcuuccuacugccuggggugcuggccaa

SEQ ID NO: 4123233 - RNA, 64 nt, Human
uugacgucugguguccaaacaugaugucaauauugauauuaucucaagggauagcagauuucag

SEQ ID NO: 4123234 - RNA, 67 nt, Human
uugacugccaaggcuuuuaaacugucaaggaauugcugccagaaauccuugaagagugggcggucga

SEQ ID NO: 4123235 - RNA, 55 nt, Human
uugacugggccagacagagauccuugcuggggaucucucugguggucacagucag

SEQ ID NO: 4123236 - RNA, 75 nt, Human
uugagaagagggaaaggugugcaaguugggagcuauuauucguuccacaggacagccacguuucagucuucucag

SEQ ID NO: 4123237 - RNA, 76 nt, Human
uugagaagcugucgugugcaagugacagaaauaccucugagcagagagucuaguccuugacugacaugucuuccag

SEQ ID NO: 4123238 - RNA, 56 nt, Human
uugagaaggggagaagcuaccaggaucuuauuucuuuacucuuuucuccuuuuugg

SEQ ID NO: 4123239 - RNA, 116 nt, Human
uugagaauaugcugguguggcugguuaugaggcugacaggguagacagagggcagagggugccuucuuuucaacuuuguuucucuggcuccgugccuggugcacaguaguccuuaa

SEQ ID NO: 4123240 - RNA, 124 nt, Human
uugagaaugaaauccuuucauguuaucuucuuuuguuuagucuguuggacauuuuccuuuggauucaaguguuuauugauuggucuagggggugugacaacuagagugacuuccuacuucucaa

SEQ ID NO: 4123241 - RNA, 127 nt, Human
uugagaauuuaagguauggccucucuuuucaggaauccaaggaaaggcacaaauucagcauuuugcauuuaucugcagggagucagagacugccuaacccuugccuugaaagccugccucaguccaa

SEQ ID NO: 4123242 - RNA, 106 nt, Human
uugagacaaagagucucgcucuggcacccaggcuggagugcagugucgccaucucggcucacugcaaccuccaccucccgggguuuaagcaauucucuugccucag

SEQ ID NO: 4123243 - RNA, 104 nt, Human
uugagacaagagucuugcucugucacccaggcuggagugcaguggcucgaucucggcucacugcaagcuccaccucccggguucaugccauucuccugccucag

SEQ ID NO: 4123244 - RNA, 104 nt, Human
uugagacagaguccugcucuuguugcccaggcuggagugcaauggugcaaucucggcucacugcaaucucagccuccuggguucaagcgaugcucuugccucag

SEQ ID NO: 4123245 - RNA, 102 nt, Human
uugagacagagucucgcugugucaccaggcuggagugcaguggugugaucucagcucacugcaaccuccgccucccggguucaagcgauucuccugcuucag

SEQ ID NO: 4123246 - RNA, 103 nt, Human
uugagacagagucuugcucugucacccaggcuggagugcaguggcgugaucucggcucacugcaaccuccgccucccggguucaagagauucuccugccucag

SEQ ID NO: 4123247 - RNA, 102 nt, Human
uugagacagggucuugcucuguugcucaggcuggagugcaguggugugaucauagcucacugcagccucgcucuccugagccaagggaucauccuuucucag

SEQ ID NO: 4123248 - RNA, 67 nt, Human
uugagacaggugucugcaaguuacugggaauuaggcagagaaccaggcauugacaccugaucaucaa

SEQ ID NO: 4123249 - RNA, 104 nt, Human
uugagacggagucucgcucuuguugcccaggcuggagugcaguggcaugaucucagcucacugcaaccucugccaccuggguucaagcuguucuccugccucag

SEQ ID NO: 4123250 - RNA, 103 nt, Human
uugagacggagucuggcucugucacccaggcuggaaugcaguggcgcgaucucggcucacugcaagcuccgccucccggguccacgccauucuccugccucag

SEQ ID NO: 4123251 - RNA, 103 nt, Human
uugagacggaguuuugcucagucguucaggcuggagugcaguggcgcgaucucggcucacugcaaccuccgccucccggguucaagcgacucucccgccucag

SEQ ID NO: 4123252 - RNA, 76 nt, Human
uugagagagaucaucaucaauauuccaagguacccguggagcugggaggcuggauucaugcugggauuuuucucag

SEQ ID NO: 4123253 - RNA, 77 nt, Human
ugguuagaaccucuccacagaguaggggaugagggggcacaccccaggcacauccacucugugagaucucugggcca

SEQ ID NO: 4123254 - RNA, 68 nt, Human
ugugaaaccuguaggcgagggauggacaguucacagagugagcugcuucugccacugccaauaucaua

SEQ ID NO: 4123255 - RNA, 55 nt, Human
ugugaaagauuaucugcaaugagggcugcuagaaagucagccugcugaucucaca

SEQ ID NO: 4123256 - RNA, 78 nt, Human
ugugaaagucgcccaagcauuguguuuaacagcucuaaugccaaagugguuguucauuagcgcuugggcacugacaca

SEQ ID NO: 4123257 - RNA, 102 nt, Human
ugugaacuaucagguuggugcaaaaguaauugugguuuuugcauuuuuuuaauggcaaaaacugcaauuacuuuugcaccagucuaauacuuuuagcucaca

SEQ ID NO: 4123258 - RNA, 65 nt, Human
ugugaagaugcucuccauccaggagugucugaguccuggcuggagcaggcaucuuguuuaacaca

SEQ ID NO: 4123259 - RNA, 130 nt, Human
ugugaagcaccaguugacccgcaggugggggugccaacugguaggcuguaggguuagcucuggccucuggcagccagccaguugucuccuaagaaaauacuguggcgugaaugcaaaaugugauucauca

SEQ ID NO: 4123260 - RNA, 103 nt, Human
ugugaaggcaauauuuuguuaacuaugaguggcguagagguaggggguuauagauuacccucauacuuuaaccuauuuuccuacaauguauuuucuuuccuca

SEQ ID NO: 4123261 - RNA, 96 nt, Human
ugugaauauuaaagcacauuuaaguaugaaauauagcaccuuguuuauagugagugcuuaauuauauuauuauaugugaauguguauauauacaca

SEQ ID NO: 4123262 - RNA, 66 nt, Human
ugugaaucuguacucuagaguuuuucaaggggcagcccaagcaucuuaaaaaguaucagauucuca

SEQ ID NO: 4123263 - RNA, 76 nt, Human
ugugaaugugggagagcuggcaaugcagccaagugauggcaugccuagaaguugaagcuuucuuauguaaauuaca

SEQ ID NO: 4123264 - RNA, 62 nt, Human
ugugaauuucuggacccuuugagaagagugagcuauaauuuuucucuauccaaagauuuaua

SEQ ID NO: 4123265 - RNA, 62 nt, Human
ugugacaaaguauuuuuagguuuguagcagaauuuuacuuuugcuucugauacuuugauaca

SEQ ID NO: 4123266 - RNA, 67 nt, Human
ugugacaaauguuucuacagcguccacugagccaggcucaguaggucccugggacauauaugaaaca

SEQ ID NO: 4123267 - RNA, 75 nt, Human
ugugacacuaaaugagucuacaguacuguugaacaaccuaucaguagaguagaugauuuggugaagaaaaucaca

SEQ ID NO: 4123268 - RNA, 59 nt, Human
ugugacagguggggaaacuaagguaugguggcaugccuugccucaggccccaccccaca

SEQ ID NO: 4123269 - RNA, 55 nt, Human
ugugacauauugagguacugagguauugagguacugagguacugagguugugaca

SEQ ID NO: 4123270 - RNA, 92 nt, Human
ugugacccaagagaaaugaagcuguauuaauuugguuuguuguuagggaaaagcacuagccaaguuuuacgacuaauuuuuccacuuucaca

SEQ ID NO: 4123271 - RNA, 87 nt, Human
ugugaccuaauuauuuaacuccuuuggagagaccccuuugaauaugugucucgucaaacaucagauguuguugguagugaggucaca

SEQ ID NO: 4123272 - RNA, 59 nt, Human
uugcugcccuuuucaccuuuguugcucugcacaggacaauggagggaccagggaagcag

SEQ ID NO: 4123273 - RNA, 62 nt, Human
uugcugccugcuucaccagacguguuuugagcauguuugcauaaaguggaugcaggcugcaa

SEQ ID NO: 4123274 - RNA, 71 nt, Human
uugcuggccagugugcaagaggccaccagcugcccuguucagcuucuggaugagcucacgcuggcccguaa

SEQ ID NO: 4123275 - RNA, 83 nt, Human
uugcugguuucaugaggugggcuuggugccaacaugcagaaaggauacuacagguuggauuccauagucuacagcaugagcaa

SEQ ID NO: 4123276 - RNA, 68 nt, Human
uugcuguuguucugucuuucugcugccuggccuuggucaagggugcagucacaggaaaugugcagcag

SEQ ID NO: 4123277 - RNA, 63 nt, Human
uugcuucccagcuggcugagcacugguuuauagacuucuguguacaaauuuagccagcagcaa

SEQ ID NO: 4123278 - RNA, 75 nt, Human
uugcuucuagcugacauuugagagagauauacaguagguauauauguauaaaauggaaugucagaauugaaguaa

SEQ ID NO: 4123279 - RNA, 77 nt, Human
uugcuugaacccaggagccggagguuguggugagcugagaucgcaccauugcacuccagccugggcaacaagagcga

SEQ ID NO: 4123280 - RNA, 70 nt, Human
uugcuugaacccaggagguugcagugagccgagaucguguuauugcacuccagccuggguaacagagcaa

SEQ ID NO: 4123281 - RNA, 77 nt, Human
uugcuugaacccgggagguggagguugcagugagccaagauugcgccacuguacuccagcucugggugacagagcaa

SEQ ID NO: 4123282 - RNA, 77 nt, Human
uugcuugaaccuggaaggcagagguugcagugagcugagaucgugccacugcacuucagccugggcgacaagagcaa

SEQ ID NO: 4123283 - RNA, 75 nt, Human
uugcuugagcccagaaguugaggcugcagugagccaugaucaugccauuguacuccagccugggcagcaaagcaa

SEQ ID NO: 4123284 - RNA, 75 nt, Human
uugcuugcaucuauuuuugcauaguuaugcuaguaucuuuuaagcauaauaacaccugaauaggaaaguaggcag

SEQ ID NO: 4123285 - RNA, 77 nt, Human
uugcuuggaguucccugagucucccugagucuccaggcagguggggagcagccgcgucucagggcagcuccaggugg

SEQ ID NO: 4123286 - RNA, 82 nt, Human
uugcuuggauguaguaaauuuuuguucaauauaaauuaacaauuauguacugaguucuuauugaauagaaaucauugggcaa

SEQ ID NO: 4123287 - RNA, 67 nt, Human
uugcuuggcacagcuccaggcaugcggacuaugguguguaauugcugccccuggagcuccacagcaa

SEQ ID NO: 4123288 - RNA, 76 nt, Human
uugcuugggcccaggagcuggagggugcagugagaugugaucacaucacugcacuccagccugggcaaccgagcaa

SEQ ID NO: 4123289 - RNA, 92 nt, Human
uugcuuguagccaagacagucuagcaguaggguuccaggugacuucugaggccucguuggcuggaacacuugcucuugaagcuuucauguaa

SEQ ID NO: 4123290 - RNA, 125 nt, Human
uugcuuucuuuacagaauaaacaacugaaguccucauagacugacugcuugccuugacauuccacagaaaaggcaagccauuaaucaugagguagucaccugaacuacuccucaaagaugagcaa

SEQ ID NO: 4123291 - RNA, 104 nt, Human
uugcuuugaagugagguaaacuguaguucagaaucuguucccagcauuuucuggccaugugcugucucugagccuuaguuucugcacucauaaaauuaaaguaa

SEQ ID NO: 4123292 - RNA, 57 nt, Human
uugcuuugaucucaugucagucucuacccuugacuuugacauuuggauucauaguaa

SEQ ID NO: 4123293 - RNA, 59 nt, Human
uugcuuugucugcuuuuuggucucuuggucacagcagggcaugaaaugggcagaagcaa

SEQ ID NO: 4123294 - RNA, 76 nt, Human
uugcuuuguugccuaggcuggagugcagugaugcgauuucugcucacugcagccuccaccuuccagguucaagcaa

SEQ ID NO: 4123295 - RNA, 86 nt, Human
uugcuuuucuaccucugccucugguuuuggucccuggcagcugcugauuuagggcaaaaucccagagcucagagucagaagacuaa

SEQ ID NO: 4123296 - RNA, 61 nt, Human
uugcuuuuucuuuguguaacauuugugcuauuaugaauauggcacauacagaaaagaguaa

SEQ ID NO: 4123297 - RNA, 66 nt, Human
uuggaaagcaagcuggacauacagaguucucaauuuuaugccauugugcccugacuugcuucccag

SEQ ID NO: 4123298 - RNA, 67 nt, Human
uuggaaagguuuaugaguuuggaaggggugugacccauaccuguuccauucauauccuauuggcuag

SEQ ID NO: 4123299 - RNA, 69 nt, Human
uuggaaauaugcuccauucuuuucccuuugacuccagauuuaagaaaauuaaauggggcagcuuucuga

SEQ ID NO: 4123300 - RNA, 83 nt, Human
uuggaacuuaaggagcuuaaacuuuuauaacuugaagcagaaauaugugcuuuuuacagaaguuucagcguuuuagguuucag

SEQ ID NO: 4123301 - RNA, 69 nt, Human
uuggaagaccagaggccuuguccagaagaguaaagauuccagccagcugggccuauggucugaauccaa

SEQ ID NO: 4123302 - RNA, 122 nt, Human
uuggaagaggcuaaauaauaucaacauuaugcuuuucaguuuuaaauuuugaaugucuggaaaacuuaccagaaaaguuuucugagacugacauuuguugccuauguguuaauuucuucuga

SEQ ID NO: 4123303 - RNA, 72 nt, Human
uuggaagcuguggucagggaugagagugcuggggauguguguggaccagcuguacccuggcuaugcuucuga

SEQ ID NO: 4123304 - RNA, 57 nt, Human
uuggaaggcagcauuuguccauggaauuggagagagacgggggcugcugcuuuccag

SEQ ID NO: 4123305 - RNA, 70 nt, Human
uuggaagggauggagggaaagaagugaaaggcgggucuuagccuuuuacuucugcauuuccccuagccaa

SEQ ID NO: 4123306 - RNA, 70 nt, Human
uuggaagugauagauccauauuuugguaaaaaacuauggugccaucuaugucuaguuaaaaaacuuccaa

SEQ ID NO: 4123307 - RNA, 72 nt, Human
uuggaaucuuguaucuuggaacuguaacauuggaugugucccaagcacagucauuagauacaaugucuccaa

SEQ ID NO: 4123308 - RNA, 75 nt, Human
uuggaaugagaugcccucugaaguuagauuccuacugucccagagaaacugaaacauagggccacuacauuucaa

SEQ ID NO: 4123309 - RNA, 88 nt, Human
uuggaaugcugaggugggagaauugcuugagcccaggaguuugagacaagugccugggcaacauagcaagaccuugucuguauuuugg

SEQ ID NO: 4123310 - RNA, 69 nt, Human
uuggacaggaagguacaccaaaguucaaguuuugaagagcaaagccauugaauuuagugccuuuucuaa

SEQ ID NO: 4123311 - RNA, 79 nt, Human
uuggaccaucucuaagguuccugagaucaggaagagcaccugauucaauucugguccucaggaacuggcaaaggucuag

SEQ ID NO: 4123312 - RNA, 113 nt, Human
uuggacccugaaggcaagaauccacccaguuuugcucaccauggaaugcuggccagcaccccacaguuuccagcacagggcaagcuacugugugggcauagguauggguccaa

SEQ ID NO: 4123313 - RNA, 79 nt, Human
uuggaccucaauuuuaauuuuguuauagaacucugugagaaaaagcuuauagacacguuguaacaaacacuguggccaa

SEQ ID NO: 4123314 - RNA, 56 nt, Human
uuggacuccucuuuccucuuggucucgggaaaagagacaaagggagagguguuuaa

SEQ ID NO: 4123315 - RNA, 79 nt, Human
uuggacugaaucuuucucacacugcugcuuuugguuaauggcucucaagagaaucuaaauguagaaagauuuacuccag

SEQ ID NO: 4123316 - RNA, 59 nt, Human
uuggacuguucuaucuuggaaugaaucaucuugaccucuuuguuccaaggagcauuuga

SEQ ID NO: 4123317 - RNA, 86 nt, Human
uuggacuuucugaucuguauauuuuucaaugcaauguaaguuuacauauccauauauuuauagaaggauuauagaaaaaggucuga

SEQ ID NO: 4123318 - RNA, 70 nt, Human
uuggagaauaccucuuuacacagugcaucaaacacaauaguguguacuuaaagguuagcuauucuaccaa

SEQ ID NO: 4123319 - RNA, 59 nt, Human
uuggagauguaaaauucagagagaaucagggcugagucucugagccauagcagucccaa

SEQ ID NO: 4123320 - RNA, 85 nt, Human
uuggagauuugucuuaagaaauugcauuugugguaauacuuuuaaauagacuacuuuuugcaaauauuuuuuaaaugaacucuga

SEQ ID NO: 4123321 - RNA, 55 nt, Human
uuggaggauugcucucagcccaguacaacuguucuucuacugagacuuucuccaa

SEQ ID NO: 4123322 - RNA, 60 nt, Human
uuggagggaagcagaucauaccagaccacgaauggccuuauguguccuguuuuauacuaa

SEQ ID NO: 4123323 - RNA, 71 nt, Human
uuggauaccauggcaguuuauucacgguacagccgcagguuaaucugugagacuaagaugcaaguauuuaa

SEQ ID NO: 4123324 - RNA, 60 nt, Human
uuggaucaguguguggauccucccaggacuuccucggaagugcugggcacacauuuccaa

SEQ ID NO: 4123325 - RNA, 67 nt, Human
uuggauccaggagcagggagaagaggaagguaaugcuuuuuacuucauuccugacuucaacguccag

SEQ ID NO: 4123326 - RNA, 79 nt, Human
uuggaugagacuaacauuuacauuggcagacuuugcguaaagcaggcugccuuccauaauguacguaggccucauccga

SEQ ID NO: 4123327 - RNA, 62 nt, Human
uuggauucacuguugguagaguggccaucaagccagaaccuagccaaccaacacggagccag

SEQ ID NO: 4123328 - RNA, 70 nt, Human
uguggcaaaggugauggaaugucacuucugugguuagguuacaaaagauugugacuuccaucuugcugca

SEQ ID NO: 4123329 - RNA, 59 nt, Human
uguggcagaguaaggacccagugggaacacagaucuaccugaagccaaagucugcuaua

SEQ ID NO: 4123330 - RNA, 61 nt, Human
uguggcagcugcugcaggagcucugugggauaauugaguagaacuguucagcugaacuaca

SEQ ID NO: 4123331 - RNA, 67 nt, Human
uguggccagccuugucaucgcuuuuccugguuaaagauggcaaaagugacugccagugcugggcaua

SEQ ID NO: 4123332 - RNA, 69 nt, Human
uguggcucaggaucuaagcagaauguggagcucugacuccugccauucagaaugccaucuugagcuacg

SEQ ID NO: 4123333 - RNA, 82 nt, Human
uugcaguaccaacacuggggugaccacuacacuugccacauugugcagcaaauguauguuuuccuauguaucuccacuguaa

SEQ ID NO: 4123334 - RNA, 56 nt, Human
uugcagugcuucgcaaaggggcagcagcauggcugucaccaaagcaggcacugugg

SEQ ID NO: 4123335 - RNA, 130 nt, Human
uugcaucauacuccauggauugauauaccacaguuuggccauagguuauuuauuauauuuuguaauuacaaagaauguggcauugaauaaccuuggacuuuguauuguuggccaucugucuuccagguaa

SEQ ID NO: 4123336 - RNA, 94 nt, Human
uugcaucucugaguccuuuauagaauccaguuguuguauuuuaagcagaauacugguuggaaauuacuguagaggcauacuagccagaauguag

SEQ ID NO: 4123337 - RNA, 67 nt, Human
uugcauguccaggguauuguggauauugugguucugucauugcuaauccucaacuuuuggauugcag

SEQ ID NO: 4123338 - RNA, 65 nt, Human
uugcauguguaauuuuucuaaagguucccauauuccucuacccucuagaaugguuacagcagcaa

SEQ ID NO: 4123339 - RNA, 61 nt, Human
uugcauguguauaaaaguuggaaaucaguacaguguaaucagcuuuuauuuuacagagcaa

SEQ ID NO: 4123340 - RNA, 67 nt, Human
uugcauucauaggaagaaaaugggcaaugcagaaggaacauuggccuagagaagcuuacugaagcaa

SEQ ID NO: 4123341 - RNA, 61 nt, Human
uugcauucccagccaaguuagugccuguugcuggccagcacuaacuuggcugggaaugcaa

SEQ ID NO: 4123342 - RNA, 70 nt, Human
uugcauuuuagauguuuucuuugggugguucuuguagccaucacagaaauaaacauaccuuaguuugcaa

SEQ ID NO: 4123343 - RNA, 101 nt, Human
uugcauuuuauaaaguccucuuaaaagcugugggggcaggaaucuguggugaucauucaucacccugcccacacagcaauuuuaaguuacuuuaaaggcag

SEQ ID NO: 4123344 - RNA, 62 nt, Human
uugcauuuugccaauuuguuuucagcugaucuuuauguacuaacaaauuggcagaaugacaa

SEQ ID NO: 4123345 - RNA, 125 nt, Human
uugccaaaccaaguguuguguguauugauuugccucccucucugccacuggacauugcugcuguguuucugacaugacggccauccgugacacagaggcaggaaauccaugaggcaugguggcaa

SEQ ID NO: 4123346 - RNA, 58 nt, Human
uugccaaaucaaagguggcuaugcuaauauucuguagcagaaauaccacauuuggcaa

SEQ ID NO: 4123347 - RNA, 69 nt, Human
uugccaugcauaggaaauguuuuuugacagcacagcuggcuccaggauauaucucuaguguuggggcaa

SEQ ID NO: 4123348 - RNA, 66 nt, Human
uugccauuucccauggaccugccucaccaacccacagcggacaggcaguccccagggguguugcaa

SEQ ID NO: 4123349 - RNA, 60 nt, Human
uugccauuuuucuuugacugaguccauugauaucaguuggcugcaaaggaaaagugguga

SEQ ID NO: 4123350 - RNA, 55 nt, Human
uugcccaaguuccagcugcugcucccacaaucacuagcugugcaacuuugggcaa

SEQ ID NO: 4123351 - RNA, 88 nt, Human
uugcccaugaggaaaugccuccagggcuucgugucucagugcucucaaagagacccagagagcggggccuuucuuucuccgugggcaa

SEQ ID NO: 4123352 - RNA, 78 nt, Human
uugccccaguuauccagcaugcugucuacacgcuuuccugccucaagacagccaaugcuggaagaugcuaugaggcaa

SEQ ID NO: 4123353 - RNA, 66 nt, Human
uugccccuccaaggcacugagauuuccuuguggaauucuagcagauauuggaaauuuugguggcaa

SEQ ID NO: 4123354 - RNA, 88 nt, Human
uugccccucuuucaagaaaggcuuaacagaagaccuuugagcugguucuuaaaggaagauugagcuuuuccaagcaaagcagggucag

SEQ ID NO: 4123355 - RNA, 61 nt, Human
uugcccuucugaguauaaucugcugcuuguucauuauuacaugcaggcugcucagaagcaa

SEQ ID NO: 4123356 - RNA, 69 nt, Human
uugcccuuuuguacacuuacuauauaucuugcugccagcaguuaugggggaaaggguacaaaggggcag

SEQ ID NO: 4123357 - RNA, 80 nt, Human
uugccggugcuuagagcuggaaaacugcagguagggcugagauggauccuguuugucagcgucuguucuguacuuugcaa

SEQ ID NO: 4123358 - RNA, 88 nt, Human
uugccuaaaucuuuauuacauuuaguuuuguuuucauaucuuuuaaagagaugaaaaggguacugaggagauugagggauguggguga

SEQ ID NO: 4123359 - RNA, 121 nt, Human
uugccuacuaccagaggaagauaaagcuuaguggugaugucucuauuauugucuguacaauuacaaagcgauuacauuacacacuaggugcucaaccuguguuaugaugaguagagggcag

SEQ ID NO: 4123360 - RNA, 71 nt, Human
uugccuacucugcguggcugcugugagcgugaaaugggaucaugugcggaacagccacgcaugguccguga

SEQ ID NO: 4123361 - RNA, 69 nt, Human
uugccucauuuucuggugaaaugggcuuaaucaacuacaucagucaauuuccuacuauaaaagagguaa

SEQ ID NO: 4123362 - RNA, 58 nt, Human
uugccucugcggugcuuggcauguggaugauuuccaggugaauaugcagcagaggcag

SEQ ID NO: 4123363 - RNA, 65 nt, Human
uugccucuggguucuauaacugagucagauaccagcaaaccucagggacgugagcucagagucaa

SEQ ID NO: 4123364 - RNA, 71 nt, Human
uugccucuuauguccaugcucuuaauuagacacauuaguagguuauuaacaugaguuggagauagggguag

SEQ ID NO: 4123365 - RNA, 68 nt, Human
uugccugagccugggaggcggagguugcagugagcugagauugcaccacugcauuccagccugggcga

SEQ ID NO: 4123366 - RNA, 66 nt, Human
uugccugcuugaauacuuguguuuggagcaugugaggggugguuccaagucacuuaagaugggcag

SEQ ID NO: 4123367 - RNA, 56 nt, Human
uugccugggcugggcugggugccaaacacuuaaugcacacagcucugcucagggaa

SEQ ID NO: 4123368 - RNA, 61 nt, Human
uugccuuccaggacuuggcaggagaugacaacaacagucacuucugaagugucuugggcaa

SEQ ID NO: 4123369 - RNA, 85 nt, Human
uugccuucgauaaaagguaguuuauuguauaugguaguuuaugguacagccaagacuaaauaaugauuuacuggauaaaaggcaa

SEQ ID NO: 4123370 - RNA, 82 nt, Human
uugccuucuuaaugcauaaacuguguuugucucugcugccgacagaggcaaaacccauacaccuuuauaacauugagagcaa

SEQ ID NO: 4123371 - RNA, 56 nt, Human
uugccuuggguucacaucuaggccuugucacuaacuagcugugugaccuugggcaa

SEQ ID NO: 4123372 - RNA, 98 nt, Human
uugccuuuuagguuucagaguucuguccuccccacucuuuaucuccauauuacagggcuggcguugggacagaagucaagaaaaugacaaaguggcaa

SEQ ID NO: 4123373 - RNA, 70 nt, Human
uugcuaaaagagcuugguugauuuugcaacaccugcaaaggucuaguaaaaaggccaagcccuugugcaa

SEQ ID NO: 4123374 - RNA, 130 nt, Human
uugcuacuucuguuuuuuuaaaaaagcaagauccccaacagaaaaggauguguagaacuguaaugcccacauaauguugcgaugggacuacuguuggcacauuugggguuuggaggcccaggagagugaa

SEQ ID NO: 4123375 - RNA, 75 nt, Human
uugcuagaaccaaccacaagaguuucugauucaguaggucuaggguggagccuaugaauuagcacuuucuagcaa

SEQ ID NO: 4123376 - RNA, 66 nt, Human
uugcuagauccagaauggcuuuucacucuuagcgcuuaucugugaauucaguuugacaucuagcag

SEQ ID NO: 4123377 - RNA, 59 nt, Human
uugcuagggcacucagucuggaggcagucuggccuacacagaggcugaugucuuagugg

SEQ ID NO: 4123378 - RNA, 66 nt, Human
uugcuauucuguuuuuccagguuguaauuacagcaaacgauugauuggaaaacauuuaaauagcaa

SEQ ID NO: 4123379 - RNA, 58 nt, Human
uugcuauuuccugaaauaagcacuacucagcuuuggggagcugcuucaggcaauguaa

SEQ ID NO: 4123380 - RNA, 84 nt, Human
uugcucaagguugcacaguugauuuaugcuggugccagcuuuggaaggcuuguaucuucagcacagauccugugcucuuugcaa

SEQ ID NO: 4123381 - RNA, 57 nt, Human
uugcucacuuugacuauuugcagauuacaaauuauuugaggucaaagaagugagugg

SEQ ID NO: 4123382 - RNA, 57 nt, Human
uugcucagcaaaggggaugcguccuaagaacuauuaggcaguuucauuguugugcaa

SEQ ID NO: 4123383 - RNA, 56 nt, Human
uugcucagcacuggagccagcuagccccacauuuggaacuggacucugcugugcaa

SEQ ID NO: 4123384 - RNA, 66 nt, Human
uugcuccugccagcacugccuccugagguccacgucucauuguuccaggagcaugcuggcuggcga

SEQ ID NO: 4123385 - RNA, 68 nt, Human
uugcucuaaaaaugcagcaauuaauggauaagaacccuggcccaauauggcuccauuccuuuaggcaa

SEQ ID NO: 4123386 - RNA, 57 nt, Human
uugcucugacaguggugucauugagaacgauggugacaaggacagguugcagggcaa

SEQ ID NO: 4123387 - RNA, 76 nt, Human
uugcucugucacccaggcuggagugcaauggcacgaucucagcucagugcaaccuccgccuacugggcucaagcaa

SEQ ID NO: 4123388 - RNA, 67 nt, Human
uugcugagucaugcaguguguaucuacuuaauugaacucaauuaagugaaccagcuguacucuacag

SEQ ID NO: 4123389 - RNA, 69 nt, Human
uugcugauuguagccacugugaugaauuaaucuauuagagcuuuucaauuuauguggcuauucauucaa

SEQ ID NO: 4123390 - RNA, 77 nt, Human
uugcugauuugggggugcugccauugccucuaagugugucaaccuuuugcaaacauucagggcuccaaagucaguag

SEQ ID NO: 4123391 - RNA, 66 nt, Human
uugcugcauuuuuucugugugccagguacugugaggacuuagaggacacagagauaagugagacaa

SEQ ID NO: 4123392 - RNA, 116 nt, Human
uugcuggugaaagaggauacaaagauaccuccagagacagggcagggagugugguguacuuaccacauuucuggaauugacuugggaagugguguucacuucuuuuaucaaagcaa

SEQ ID NO: 4123393 - RNA, 66 nt, Human
uugcuguaaugugggaagccagagggugccguguuuuaucagccuggcucauccugguugcagugg

SEQ ID NO: 4123394 - RNA, 78 nt, Human
uugcuguagauugugggauauugacugaaguaccagauucugaaguagaaaaaugaggucaauauccuuuucuggcaa

SEQ ID NO: 4123395 - RNA, 99 nt, Human
uugcuguguucaguggguuacuuuuggagaacaugauaugcucuagggcccacauguuaccuuguucuccaaaaauagcauuuccuacucauuaagcaa

SEQ ID NO: 4123396 - RNA, 63 nt, Human
uugcuguugcuaucauugcugcuauuuuuauuccacucaagggcaguaucugaagccacacaa

SEQ ID NO: 4123397 - RNA, 64 nt, Human
uugcuguugcuuaaguucacccuaggagcaggaaaaaugagggugcauuuaacagaaacaggaa

SEQ ID NO: 4123398 - RNA, 61 nt, Human
uugcuuaaagggaguagagagagaggucaaagagcagaccuauuucuaaaccuauaaguga

SEQ ID NO: 4123399 - RNA, 57 nt, Human
uugcuuauacagauggugugcuauucaugaauggcuuuacuuugaucugauaagcaa

SEQ ID NO: 4123400 - RNA, 65 nt, Human
uugcuucauauuuguggcuugccuucuauuucuauuggacagcacuggucuaaagucugaagcag

SEQ ID NO: 4123401 - RNA, 57 nt, Human
uugcuuccucuaguuucuugaaggcaugcauuacugucuucacauuggaagaaguag

SEQ ID NO: 4123402 - RNA, 66 nt, Human
uugcuucucuccucagaacaggcccucuagcuccagcagguggcacugccccugggauucaagcag

SEQ ID NO: 4123403 - RNA, 55 nt, Human
uugcuucuggaucuuaauguuugcaugaacaaaacauuaagaaacgagagagcaa

SEQ ID NO: 4123404 - RNA, 104 nt, Human
uugcuuuuaaaaaugccuguacagaguucugaguguacuggucacuauuuuucuuaagcugagaggauuuuuguaguacuuagcaauuuuguauaacauagcaa

SEQ ID NO: 4123405 - RNA, 91 nt, Human
uugcuuuuauuuaggaaagacaaaaugucauuccaaaacuagaagaaauuguuuggggggaaauauuuugucuaauuuguagggaaagcag

SEQ ID NO: 4123406 - RNA, 103 nt, Human
uugcuuuuggcugcuggaagcuguagcuuuucaaaacguucacacauuucaauguaucgucgauguuuuuaaauagacuuacagggaggguggcacacagcaa

SEQ ID NO: 4123407 - RNA, 64 nt, Human
uugcuuuuugcuauuuugagucuauucugcagcauagagguauaccaaaaaggcaucugagcag

SEQ ID NO: 4123408 - RNA, 93 nt, Human
uuggaaaccuuugggaaaacauuucaaguaguuugcuuuccaagccguuuucuugguaaaguaaagauugggaaugugucaccuaaagcccaa

SEQ ID NO: 4123409 - RNA, 129 nt, Human
uuggaaacucagucccgugaguaggacguccaccucauuggugguguuuaaauauuaagugucaaaugcuagagacaguacaaaacccaccagagggggccuuccuaacacguuggcauaaggauccaa

SEQ ID NO: 4123410 - RNA, 74 nt, Human
uuggaaauaacaugcuaugugucugaaucacauacagucaucugugauuagucaauagcuaugugucaacccaa

SEQ ID NO: 4123411 - RNA, 71 nt, Human
uuggaaauggaugugucuggcuccccugcaaggguacacugcccuuggaaacagacauguccaucauuugg

SEQ ID NO: 4123412 - RNA, 80 nt, Human
uuggaaauguguaaagcuuuucuuuguucagugagucuuuucauuauuuaaaauagagagcagcuuugcgguuuucucaa

SEQ ID NO: 4123413 - RNA, 64 nt, Human
uuggaagaaccaugcacugcagggagggggccgccccaugacagcugcaagcagguuauuccag

SEQ ID NO: 4123414 - RNA, 56 nt, Human
uuggaagaagguacuguauauauacauauauauguauguuucauaucuucauuugg

SEQ ID NO: 4123415 - RNA, 76 nt, Human
uuggaagagaauggcaaagaaagugagaaaucuaaaucacauuaaaauucuacuuucucugucauuaaaagcccag

SEQ ID NO: 4123416 - RNA, 57 nt, Human
uuggaagauugcuguucuacaguuucucagucagaagggcugucagcagcuucacga

SEQ ID NO: 4123417 - RNA, 69 nt, Human
uuggaagcagcuagcccacuagucaguauucuuucugccucugugcugcaccgugggagcuguguccaa

SEQ ID NO: 4123418 - RNA, 87 nt, Human
uuggaagcuuugagagcagaagccccuccagaccaagaacuccugauugugucuuucccuugggcuuucgcaguuuucagcuucuaa

SEQ ID NO: 4123419 - RNA, 95 nt, Human
uuggaaggauauagcaauuacuuggucuagugagugagcauaguuguguuagcuauagcucaaagaagauuaugugauuaauguuuauuugccaa

SEQ ID NO: 4123420 - RNA, 99 nt, Human
uuggaauaaggggaagggugugguuugaagggagauggaggaaagaaaaaguaauuucacuaucucuccacaaugccaguguucauacuugaauuuuga

SEQ ID NO: 4123421 - RNA, 72 nt, Human
uuggaauauucaaucagcuaugguugcuuaugaggaacaccuuggaaguaacaaugcuguugaauuguuuga

SEQ ID NO: 4123422 - RNA, 106 nt, Human
uuggaauauuuauugaguuacuguuaugcaucaggcacuaggaauagaaagaaaaauauucugucucuguacuggguguucagaauuuagugaggaaaauagccaa

SEQ ID NO: 4123423 - RNA, 72 nt, Human
uuggaauggcugauguaggugcuguauguauaguugaggcuguuugugcccugccuacaucaccuuuaccag

SEQ ID NO: 4123424 - RNA, 116 nt, Human
uuggaaugugguccuuagcuuugcaagucuagauccuguguuuuauuggugcagucagagaaaacugguuuucuggaauuaaacucaggagacucaugcuuaauccacaauuccaa

SEQ ID NO: 4123425 - RNA, 63 nt, Human
uuggacaacggcaaaggaauguagagauuuuggaucaaagccucacaguuuucuguaguccaa

SEQ ID NO: 4123426 - RNA, 63 nt, Human
uuggacaccagaauugcuaggaaaauugaucucagaauuucuugcaucacucugcuguuccaa

SEQ ID NO: 4123427 - RNA, 70 nt, Human
uuggacagggaaguccaugggggcgguggggcacagguuccauggccgacugguuuaccacuguauucaa

SEQ ID NO: 4123428 - RNA, 84 nt, Human
uuggacauaugcucauuuacuugcuuauaaucaaaacauuaaaaaacuguuuugaacucaggcuagguguaaguauuggacuaa

SEQ ID NO: 4123429 - RNA, 58 nt, Human
uuggacuguuacuguauuuaaucaucuaacacaucuagaggaagacaguaaccuccag

SEQ ID NO: 4123430 - RNA, 73 nt, Human
uuggacuguucugccaagaucaacguugccucacuucucacuauaaacuugaaaccuuggcaaacaaugccaa

SEQ ID NO: 4123431 - RNA, 70 nt, Human
uuggagaaguccuuuaauaucacauaguguaaauauacuugcacuuaauuggagauaaaggcuguuccaa

SEQ ID NO: 4123432 - RNA, 86 nt, Human
uuggagacagcuauuaauugcuucccaagggaggucuuuggcacuaagucagagucucuuuugcgaagaguguuuaggugugcuaa

SEQ ID NO: 4123433 - RNA, 67 nt, Human
uuggagagaacagaugugaaaugcuaagccaaaugagugugugagcuuuucacaucugucccuuuaa

SEQ ID NO: 4123434 - RNA, 56 nt, Human
uuggagagcaguaaaccacacuuguuuaaaacaaacaugcuggugaugccuuccga

SEQ ID NO: 4123435 - RNA, 60 nt, Human
uuggagagcugacaucaugauguugggaaaugaaaccaauguuugugugucauuuucugg

SEQ ID NO: 4123436 - RNA, 59 nt, Human
uuggagaggagguagggacagccucucuguucauggaaaucucccaucauccucuccag

SEQ ID NO: 4123437 - RNA, 80 nt, Human
uuggagaguuuguacuucauugguucuacuuugucugagagcagauggagcccuaaagugaagcuauuauuauuuuucaa

SEQ ID NO: 4123438 - RNA, 66 nt, Human
uuggagauggucuccagagcauaauucacagccacuuguggcagcagccauggaaggcccuuccaa

SEQ ID NO: 4123439 - RNA, 59 nt, Human
uuggagaugguucagaauuauaaagauuaucugaaucuuuaucugugagcagucuccaa

SEQ ID NO: 4123440 - RNA, 65 nt, Human
uuggagauugggcugcuaucuuccuugauuuuuacaugucaaagagauggcucucagaucuuuga

SEQ ID NO: 4123441 - RNA, 73 nt, Human
uuggagccucugugggaaccugcacuuugugcuuuuccagaagcagaggagcaaguugcuacaguggucccag

SEQ ID NO: 4123442 - RNA, 77 nt, Human
uuggaggauagguuguuguauuauuaagagagcaggcagguccuuugaauuccaguacaauaacucuucuccucuaa

SEQ ID NO: 4123443 - RNA, 60 nt, Human
uuggaggggccacugcagagcucgcgguccuugaggacacggcuggcggugccuuuccgg

SEQ ID NO: 4123444 - RNA, 70 nt, Human
uuggaggucaaauggagggcuggguggggccagcucaaaccuucuauccccagcucuuuugaaauuccag

SEQ ID NO: 4123445 - RNA, 69 nt, Human
uuggaggugagcuucucaugaacagggcuuccugggaccucuuauccugucuuacaugagucaccccaa

SEQ ID NO: 4123446 - RNA, 69 nt, Human
uuggagguuugaaaauauguguacuugguuuuauuccuuuccacauuacuguguugugcagacuuucaa

SEQ ID NO: 4123447 - RNA, 113 nt, Human
uuggaguuuugauuuacuguccuauuuauuuuuacugcacaaaggaaacacuuauuccuuccuguuuugcauuucagaagaaaauucgggaugguccaaaugacagacuccaa

SEQ ID NO: 4123448 - RNA, 63 nt, Human
uuggauaucugcugaugcaccuuccucucuuuccacaggcuggugacaucuagagacauccaa

SEQ ID NO: 4123449 - RNA, 130 nt, Human
uuggauccugagagaaaggaguagcaggaacugacccuccuggggcacuuagaagcaaacugacaguauugcuccagccugcuucagcaguuggucauguccuugagaccuaauccugaucuaagcccaa

SEQ ID NO: 4123450 - RNA, 60 nt, Human
uuggauguuugaaaucacguacauggaaaugaucucuaugugcaugagggaggauagcaa

SEQ ID NO: 4123451 - RNA, 71 nt, Human
uuggauucagucuugcagauucauuuguaacagcucacaaaaacaagucagauuuguauuauugguuccaa

SEQ ID NO: 4123452 - RNA, 85 nt, Human
uuggauuuguggcacuaugaguuauaaguggaccacggaaaugaaacuaauguccacccuauaauuuuuuaauguacaaaauuga

SEQ ID NO: 4123453 - RNA, 63 nt, Human
uuggcaaauccuagcuaucacggcuuuauucucucaaagagucaguagugagguauuugccaa

SEQ ID NO: 4123454 - RNA, 73 nt, Human
uuggcaacacauggaaaaauuuccaguacccaauuaaaguuaugcaggcugauuuucauucauauguugccaa

SEQ ID NO: 4123455 - RNA, 80 nt, Human
uuggcaagcacacacgcuggagaggaagaaacgggaucaguuucaauuucacuuuccaggcuuuuuguguuucuugcuag

SEQ ID NO: 4123456 - RNA, 86 nt, Human
uuggcacagagcaguguugagugucuguuugcagguuuucgcccuguuauucaacagauauuuauugagcaccuacucuguggcag

SEQ ID NO: 4123457 - RNA, 55 nt, Human
ugugugugcauuugucaucugugcuagaggagcaaagaugaguccggcagacaua

SEQ ID NO: 4123458 - RNA, 76 nt, Human
ugugugugugugugugugugugugugugcaugcgcacgugcgugugugaaggaauauauacucacauauguacaca

SEQ ID NO: 4123459 - RNA, 72 nt, Human
uguguguguguguguguguguuuugaacuuagagcacaacucaauucagacuagacacauuucaagcacuca

SEQ ID NO: 4123460 - RNA, 57 nt, Human
uguguguguguguguguguuugggcuggagagcuguaaaggccauaaucacggagca

SEQ ID NO: 4123461 - RNA, 57 nt, Human
uguguuacauuaggaaaacuaaguaucuuuaacuuagaguuuccuuguaugaacaua

SEQ ID NO: 4123462 - RNA, 89 nt, Human
uguguuacuaugaggguggcacugguggcucuauuuauuuauucauuuauuuagacagagucucgcuaugucacccaggcuggagcgca

SEQ ID NO: 4123463 - RNA, 75 nt, Human
uguguucaagcuccuaagagcaacugugcuuuucuggugauuuggcaugagguucuuggccagcauugauauaua

SEQ ID NO: 4123464 - RNA, 84 nt, Human
uguguuccuggugaauuccuggcaccaccacuucuagguggguauggaaucaggaagaaggguguuagggagccauugaauaua

SEQ ID NO: 4123465 - RNA, 129 nt, Human
uguguucggaucucacaugaagaaaugaaccuggaauuuaguuaauuccauuuucuuuacuaucagagcuuuaagugacucagcugaauucagaguugaauuuuuucuccaaaugagaucugagauuua

SEQ ID NO: 4123466 - RNA, 76 nt, Human
uguguucucuagagguucagaccaagaauugcguuuugaagacugagagcugggccugacacuuacuagggacaca

SEQ ID NO: 4123467 - RNA, 79 nt, Human
uguguucuuaucauuagaccaaacuagagcugauagguugaaaaugucagcuuucaguuacuaaugaagggaaauguca

SEQ ID NO: 4123468 - RNA, 67 nt, Human
uguguugaaugccugcugugugccagacagcucagugccugggugcguggacacagagauuaacaca

SEQ ID NO: 4123469 - RNA, 68 nt, Human
uguguugagaacuaaugauguacuaggcacuauuuugugugcuuuagauagauuuagucuuuacaaca

SEQ ID NO: 4123470 - RNA, 63 nt, Human
uguguugcaguagcaguaguugcaguggaugcugcuucugauucaugguuauugccaaacaca

SEQ ID NO: 4123471 - RNA, 59 nt, Human
uguguuggauguacauaugucuguuagcuuuuaguggcagacagagugcagucuacaua

SEQ ID NO: 4123472 - RNA, 55 nt, Human
uguguuggcuguacauguaucuguuaccuuuuaguggcagagugcagucuauaca

SEQ ID NO: 4123473 - RNA, 97 nt, Human
uguguugggaaaaugugcauaucucauuaacuugccuagcaucaaccucugaacacugggauaggugauagacuguaagguuaccuuucucaaugca

SEQ ID NO: 4123474 - RNA, 60 nt, Human
uguguugggauuacaggcaugagccaccacaccuggcuccucccugacuucuacagcaca

SEQ ID NO: 4123475 - RNA, 57 nt, Human
uguguugguaaacuuucucagggcuguuauucaaagggcucugaccauaucaagaca

SEQ ID NO: 4123476 - RNA, 71 nt, Human
uguguugguauugaggaaaguauuucaauuaggacagauaguuagaagucucuuaguaauauccaaccaca

SEQ ID NO: 4123477 - RNA, 81 nt, Human
uguguuuauucuugugguuugauucaguaugaccuuuggagccucacuuuggacuagacaucgagcuacagaguggaaaua

SEQ ID NO: 4123478 - RNA, 84 nt, Human
uuacacgccgucuguucugcuaauugagugucagggucagaugcuccuucuccuggcaggucagcaggagcagcgugccuguga

SEQ ID NO: 4123479 - RNA, 62 nt, Human
uuacacuugaaaacaggauuuauuuucagccucccuuaucugguuuccuuuuuucaagguga

SEQ ID NO: 4123480 - RNA, 55 nt, Human
uuacacuuuugacaaaccugagcauuaagcuaagggaagauuaugucaagugugg

SEQ ID NO: 4123481 - RNA, 57 nt, Human
uuacagaaaagggguuguccuucauaaacuaaaagaaguuaacccacuucucgguga

SEQ ID NO: 4123482 - RNA, 64 nt, Human
uuacagacaaagugcuauaggguggggacagaaaggugagccagccauagcucuaugccuguag

SEQ ID NO: 4123483 - RNA, 57 nt, Human
uuacagaguagugcagaacucacaguagcuucugguaauucugcaugugcucaguaa

SEQ ID NO: 4123484 - RNA, 69 nt, Human
uuacagauuaaaaugcugaggucuacaaaacuaaauucauuuauauaaggagaccucacagaucuguga

SEQ ID NO: 4123485 - RNA, 67 nt, Human
uuacagcuauguguauacguguguguguuugcuuuuagacaucaucgugcacauacauaagcuuuaa

SEQ ID NO: 4123486 - RNA, 73 nt, Human
uuacaggacccccugccuugggcaauaugaaguuuuauaaaguuauacacaauuccagaggcagcuucuguaa

SEQ ID NO: 4123487 - RNA, 124 nt, Human
uuacaggaugaggaugcaaccagaugaguguaaauaaccugaggucuauaauuuauuaagugcucaacaaauaguaguaauuguuaucuuauuuauguaugcuuauuuucucucagauauguaa

SEQ ID NO: 4123488 - RNA, 59 nt, Human
uuacaggcaaggguuguuaccauggcauucgauaugcgugacaggcacccuggcuguga

SEQ ID NO: 4123489 - RNA, 59 nt, Human
uuacagggggaugagauugugaccauguuaaauacaucaacauuuguaucucccagugg

SEQ ID NO: 4123490 - RNA, 74 nt, Human
uuacagguagagagggaccauuccugugccaaauagguuaauuuuuggcagagagacucuccuugaucuaguaa

SEQ ID NO: 4123491 - RNA, 96 nt, Human
uuacagugaucguuguugaguagugauucugauguaagacaagcucacagcuugugaccacaaggaucauuauaugaacugcaaggaucauuauaa

SEQ ID NO: 4123492 - RNA, 56 nt, Human
uuacauauugccucuggcugcuuucacaguaugacagcacaguagaguaguuguaa

SEQ ID NO: 4123493 - RNA, 56 nt, Human
uuacauucuggaaaggcacagaccaaagggccaggcugggccagccagacauguga

SEQ ID NO: 4123494 - RNA, 68 nt, Human
uuacauuuaccucguaauauauguauauauauauauuaggaguuaaauguauuaggagguaaauguaa

SEQ ID NO: 4123495 - RNA, 77 nt, Human
uuacauuuuuaauuucacagcucagugaggugggcaaaagcaguauuaccaaccucauuuaacagauuaaaaaguga

SEQ ID NO: 4123496 - RNA, 84 nt, Human
uuaccaaguauuguguuuaaaaaaacaguugaggagaugugauuccucugcugugccuuaaaaugcaaguugauacuuacguaa

SEQ ID NO: 4123497 - RNA, 55 nt, Human
uuaccacacuuauuuacauugggucucaaaaccuaauugcuauuuaaugugguga

SEQ ID NO: 4123498 - RNA, 106 nt, Human
uuaccacuguuaauguguuuaaauaauuaggggccugugucaaagacucacauaccuguccacagaagccuucccugguuguuugaaagucuuaaaaucuugguaa

SEQ ID NO: 4123499 - RNA, 65 nt, Human
uuaccagaugggggacuaugagaaugucuacaaacuuuucugagauuuggguuccucaucuguaa

SEQ ID NO: 4123500 - RNA, 58 nt, Human
uuaccagcugcugccugugggucgggccuuuaauuagcucacaucuggcagcugauga

SEQ ID NO: 4123501 - RNA, 89 nt, Human
uuaccauuuaggucuucuuaagagucaauccagcaaauaaugcucuagggcaauuugauacuuaaaaugaugagaccuuucccugguga

SEQ ID NO: 4123502 - RNA, 62 nt, Human
uuacccugggcuuggccugcucagccggucugggcuuccugggcaaacacaacucaggguga

SEQ ID NO: 4123503 - RNA, 74 nt, Human
uuaccuaacuucucugagucuugguuucuuaccugaaggaugaggacaaucccuaacucagagaguuaauguaa

SEQ ID NO: 4123504 - RNA, 99 nt, Human
uuaccuccauugaggcucaguuuuaucaucugugaaauggggacagucagcccugucucacagguaauaggacacaugggcccaguauccuggacauaa

SEQ ID NO: 4123505 - RNA, 56 nt, Human
uuaccugagcggauuuguugcaggguccagacugcaagaaccuagcgaucagguaa

SEQ ID NO: 4123506 - RNA, 68 nt, Human
uuaccuucccacacaauuaagucauuuuucuagucugucuaaaguguaaauaauuugagggaagguag

SEQ ID NO: 4123507 - RNA, 59 nt, Human
uuaccuuuaugcaguaugcaaccauaaaauugguuucuauacacugauauaaggaguaa

SEQ ID NO: 4123508 - RNA, 57 nt, Human
uuacgaccuuugucaugcuugggauuuguggaaauuucacagugguaaggguuguga

SEQ ID NO: 4123509 - RNA, 92 nt, Human
uuacgaguagacauuacccaguuaggagacugugauaggaucugugauucauaaaguacagucucuuugagugauugucuugucacuuguga

SEQ ID NO: 4123510 - RNA, 73 nt, Human
uuacggcucagggccuccccggcagucuuucgugacugagcucaagaaggcugcauggaggcuguggcuguga

SEQ ID NO: 4123511 - RNA, 74 nt, Human
uuacgggaagcuuggauaacuguaugggggacuuuaaaauuuaucucucugugauaguuuuucagcuauuauga

SEQ ID NO: 4123512 - RNA, 55 nt, Human
uuacuaagucccuggguccaaggcagcucugcagagccuagggucacuucaguga

SEQ ID NO: 4123513 - RNA, 78 nt, Human
uuacuacaacuuaauauuucuccaaauguuuucaaaauggcauaauuggaaaaacuggugaaaugcagucugcaguga

SEQ ID NO: 4123514 - RNA, 57 nt, Human
uuacuacaagauucuguuuuauugcuauccguggcuuuauuuacagacuugaaguga

SEQ ID NO: 4123515 - RNA, 97 nt, Human
uuacuagcaaccugacauuuauuugaacaacuauuuuuuuaagagaaguaauucagacaaauuguugcuucaugaaugagugugagucuguuguuga

SEQ ID NO: 4123516 - RNA, 81 nt, Human
uuacuauauacuauauugcugaugagacagcaaauugaauaucacugacaaguugucucaacagugaaauguguuugauga

SEQ ID NO: 4123517 - RNA, 93 nt, Human
uuacuauggcaaauagcugacagauacaaucagauuuggaauuuagauagauuuguuuguacacuguguagagaauggauuggaacaugguaa

SEQ ID NO: 4123518 - RNA, 69 nt, Human
uuacucaacauuuaacagugaaaaaguggaaaaauccagcuuucauagcugaaaauguugaauauguaa

SEQ ID NO: 4123519 - RNA, 74 nt, Human
uuacuccauccucaaacuaaauuuccugaaaaagauuaguuaguucagaauuuugguuugguugguugguuuaa

SEQ ID NO: 4123520 - RNA, 88 nt, Human
uuacucuuccaaggucaaauuugcagguucaagaaacugauugagaaagccuggucauugucagagccuguacugauaaggacaguaa

SEQ ID NO: 4123521 - RNA, 68 nt, Human
uuacucuugcuuugcuucacaguuccguagagauaucucaggggugccugugagcagaugcugaguga

SEQ ID NO: 4123522 - RNA, 55 nt, Human
uuacugaauaucucugagccagaaaugauuguagaugcucaggauguagcaguag

SEQ ID NO: 4123523 - RNA, 83 nt, Human
uuacugaaugugaugcuaaacauaugucuaauuuguguauagauuugcagagaaaauguauauguuggguuauguuacaguaa

SEQ ID NO: 4123524 - RNA, 60 nt, Human
uuacugaucccccaggugacccacagcgggaaauuauacuucaacuggcaggauuaguag

SEQ ID NO: 4123525 - RNA, 58 nt, Human
uuacuucagauuguggaaggcauucaccagcuaaaaguuccuuuccaauucgagguag

SEQ ID NO: 4123526 - RNA, 79 nt, Human
uuacuugauaucaauaagucagugggagaagugugaagucuuaucuugaucagaacauucucauugacugcuuaaguaa

SEQ ID NO: 4123527 - RNA, 62 nt, Human
uuacuugccuggacucugcugguauuucagcuugagaucccagaccagagccaugcagguag

SEQ ID NO: 4123528 - RNA, 72 nt, Human
uuacuugucagcaguuuuuaguggaggaaaaacugcaguuaaagcaccuuuacugagaacuuugagcaguaa

SEQ ID NO: 4123529 - RNA, 62 nt, Human
uuacuuuacuacauccacagauggauuucuaaagaaugucgccugugaguauaguaaauuaa

SEQ ID NO: 4123530 - RNA, 77 nt, Human
uuacuuuccacaauauagucucccauuggccugcuguuuacuuucauucugccacagcagggacuacgugaaaguga

SEQ ID NO: 4123531 - RNA, 76 nt, Human
uuacuuugaacauuuuucugcaaguguagauacccagcguuuaagcuggaauuugcuuugagaggcuuuuagguga

SEQ ID NO: 4123532 - RNA, 70 nt, Human
uuagaaaaguauauuuacuuacugugaauuugcagugauggaaaucacagugaggaguuacaguuucuaa

SEQ ID NO: 4123533 - RNA, 58 nt, Human
uuagaaaauggaggugggagggugguucuugacauccuuagacauguucauucucuga

SEQ ID NO: 4123534 - RNA, 61 nt, Human
uuagaaacaaagaccugggugcuagcugugcuuauugcuacaagcaugucauuguuucuag

SEQ ID NO: 4123535 - RNA, 74 nt, Human
uuagaaacagugcauauaugaagaguaugauggcauguuuauaagcugcauauacauguaccccgauuuucuaa

SEQ ID NO: 4123536 - RNA, 83 nt, Human
uuagaaagagacagccuggcuuaaucugucuucugaaacgcaaggucagcagacuggaggauaucagcugccacucuuuuuga

SEQ ID NO: 4123537 - RNA, 65 nt, Human
uuagaaagggugucugaaucugcaagggugggaugcagaauuaaaucaaaggacacuuucucuga

SEQ ID NO: 4123538 - RNA, 56 nt, Human
uuagaaauuucuccugaguagugcucauuugacacacucuucccagaagguucuga

SEQ ID NO: 4123539 - RNA, 82 nt, Human
uuagaaguaguugcaggcugaugaguuugguuuuuguuaacaaagaacaagagcuagacuuugucaggaggcagccaccuaa

SEQ ID NO: 4123540 - RNA, 104 nt, Human
uuagaauaucuuccaucucaugucaaaugaaugcugaacggggguuuugauuauuuuuaguuaaucgaaccugaauacaguaauuuugaugaguuguauucuag

SEQ ID NO: 4123541 - RNA, 55 nt, Human
uuagaauccagcucucucugagcucccuuugagcucugacauucugugacucuga

SEQ ID NO: 4123542 - RNA, 125 nt, Human
uuagaaucuccuguuuuuguuuuguuuuaauuacugaugccuguguuccaccacagagauacugauuuaauuggcauggggcauaacggagaucagaauuuuuaaaagcuucccagggaguccaa

SEQ ID NO: 4123543 - RNA, 76 nt, Human
uuagaaugagauaucugaugaaaauacucugauucucgacaagaauguagaguauguuucagaucgucuuuucugg

SEQ ID NO: 4123544 - RNA, 95 nt, Human
uuagacugcgauuaacucucuuuguaaucauucccuugguucgaugauguuguggagcugaggaauaauaacaagguugguugguuuguuuuuaa

SEQ ID NO: 4123545 - RNA, 100 nt, Human
uuagacugugagcuccuugagggacuuugucauaaucacuguuacaucccagugccucacacuaugccuggcccuuaagaagugcucaauaaaugucuga

SEQ ID NO: 4123546 - RNA, 77 nt, Human
uuagacuucuucaauuauuggaaagaaagauucauuuuauuaccuugucuuuaaacauaucuguugagggaguguga

SEQ ID NO: 4123547 - RNA, 66 nt, Human
uuagagaaaagcuugcuugcuugaguauaauuauuguuuugccugaguuuguaaacuauucacuaa

SEQ ID NO: 4123548 - RNA, 57 nt, Human
uuguuuccagugggaggugcagugugaauuccuagccugccauauaccuggaaacag

SEQ ID NO: 4123549 - RNA, 77 nt, Human
uuguuuccuuaagccugccuuuuuacuuuguaaaaguucaccuaugaggcaaguuaucagggcaguuagagaaacag

SEQ ID NO: 4123550 - RNA, 82 nt, Human
uuguuucgaaauacaugaggaacaacuaucuguguuaacauuuuuggcaauuucaugguauuccuuuauguagaagaacuaa

SEQ ID NO: 4123551 - RNA, 77 nt, Human
uuguuucuugccugcuuggaguccuccagcaccaggagaaguugguggguuuggcaggauaccaagucccaaaacaa

SEQ ID NO: 4123552 - RNA, 67 nt, Human
uuguuuggaauguugauaaacauaggcauauagauauaaaaugccuuguuuacagauauccuuauga

SEQ ID NO: 4123553 - RNA, 71 nt, Human
uuguuuuagaaaggggugaaucaauggaguaggcaaucauugcccauuacuaacuccuuuucuucugacaa

SEQ ID NO: 4123554 - RNA, 111 nt, Human
uuagauuaagguuaggguugaggaaggugaauguuauuagagguugaucucauuauuaggagcuucucaccuuuggauaaucuuuguguuucugcccuggcucuuuccuag

SEQ ID NO: 4123555 - RNA, 67 nt, Human
uuagauuacaguauuggucacguuuguaucucacaagaaacuaaaggaccaaaaugcugaugucuag

SEQ ID NO: 4123556 - RNA, 83 nt, Human
uuagauucucauaggagcgugaaccugauugugaacugcacauggugagggaucuagguugcaugcuccuugugagaaucuaa

SEQ ID NO: 4123557 - RNA, 88 nt, Human
uuagauuuuguacagauuacauuaggauauaucuauggagaaagucugaaguuuuagucaaaauguagaaacauuuguacauauuuaa

SEQ ID NO: 4123558 - RNA, 85 nt, Human
uuagcacauggauauaguuggaauuauaaagggauuuauuuucuaaauuuaaaaaugcuuuuuauagcuauguccuauguccuaa

SEQ ID NO: 4123559 - RNA, 127 nt, Human
uuagcauaugugcuuucuaaaauacaauauauuauguuagucccauuauaugacuucuagauaucauguacagacaaguacauaggaggggcucaccugaauaguauuuuucuauuuuauauguuaa

SEQ ID NO: 4123560 - RNA, 59 nt, Human
uuagcaugugcaagggccuggaggcaagaaugagcuuggcacucucccugcacugguga

SEQ ID NO: 4123561 - RNA, 81 nt, Human
uuagccacauuggccaaauuugguguaacuugacauuuuaacaucugcaacccucuucacuaguuuggucaguaggguuga

SEQ ID NO: 4123562 - RNA, 67 nt, Human
uuagccauuugaggucuucauuuauuuuccugucuuucugauacagugagugaccuccagugccuga

SEQ ID NO: 4123563 - RNA, 116 nt, Human
uuagccgguugaacuauuuauuacgugucuccguuccugguuauuaugccaguaaauugcucaggcagaugcagggauggaugaugggcauauaauucacucuuuuucacggcuag

SEQ ID NO: 4123564 - RNA, 93 nt, Human
uuagcuaguggaugugucugcaagauagccaagucccuggcaacccugaggcucugugauuuguguggcuuggugaggaccucuacuggcuaa

SEQ ID NO: 4123565 - RNA, 98 nt, Human
uuagcucgaguaggagagcacuguucaagcaugucguccauuaaucauugauaaccaguguuuagugugcagacaugcaagacugcuaaucuggcuaa

SEQ ID NO: 4123566 - RNA, 63 nt, Human
uuagcuguuuauuucuguaugugcauuuccuagcagucuacacauacagaugguuccagcugg

SEQ ID NO: 4123567 - RNA, 129 nt, Human
uuagcuuuucauuaugacugcuuuucucuguguuacuuaauuagaaucugcagcuuuuggcaggaaaauagucaaccaagcagauuucuaauaagcaaugucuuuaggggagaaagucgaagugagcaa

SEQ ID NO: 4123568 - RNA, 88 nt, Human
uuaggaaaaugaucuuugcaaacuuugucacuuaccguucaaguuauagaaucaauaguaggcuugagauugcaguagcauuuccuaa

SEQ ID NO: 4123569 - RNA, 60 nt, Human
uuaggaaacacgagggggauuucaugugaacgagaaauaaacuuccacuguguuuuuuaa

SEQ ID NO: 4123570 - RNA, 62 nt, Human
uuaggaccacauugagagucauuaacaaaaagggacaaguuaaaacuauaaauguggcuuaa

SEQ ID NO: 4123571 - RNA, 89 nt, Human
uuaggagacaugauuagacguugcugugagauagauuuuagacuugaacauguagaagagcuguucaacguagcaaugagcauuccuga

SEQ ID NO: 4123572 - RNA, 68 nt, Human
uuaggcaaacugauuauuggugacaaggcugauauggcagcaauagcacugaaaauuagcuuuccuga

SEQ ID NO: 4123573 - RNA, 59 nt, Human
uuaggcauuagagaaaugcaauuuuaaaccacagugagauacaucucucagaugucuaa

SEQ ID NO: 4123574 - RNA, 74 nt, Human
uuaggccuggaacuuuaggauccuggcucauucucuaugggggugagugagugugugaaguacuggaugccuaa

SEQ ID NO: 4123575 - RNA, 76 nt, Human
uuaggcggagaaagugaguaacagcuggauggagagaaacaacgggcuuuucucccgcuggcugcucuuccccugg

SEQ ID NO: 4123576 - RNA, 59 nt, Human
uuaggcucuaucaguuauuuguguugugcaaagcacugcauuaaaugcuagggaccuaa

SEQ ID NO: 4123577 - RNA, 56 nt, Human
uuaggcugcauuccaggcccuuuguauucucucccagaccugccaugacagccuga

SEQ ID NO: 4123578 - RNA, 63 nt, Human
uuagggaagcaggaaugagugauacuaauaucaguuuuauuuuacaucaugcuacuucucuga

SEQ ID NO: 4123579 - RNA, 70 nt, Human
uuagggaaggagcagggggaggaggacucggcgagcuccugugugcccaccugcucucacuucuccuuaa

SEQ ID NO: 4123580 - RNA, 60 nt, Human
uuagggagagggcauagaccuccuuauaaaucuuaugaaaucuuuguacccuuuuccuag

SEQ ID NO: 4123581 - RNA, 84 nt, Human
uuagggccucaugcaucugcaggggaagccaguuuguucuuuugauccagaaggguuaauuuucgcugcaggugucaacucuga

SEQ ID NO: 4123582 - RNA, 71 nt, Human
uuagggcuggacuguuuauguuaacaugauaccacauauauguacaaucagcaguucauaaaaugccuuag

SEQ ID NO: 4123583 - RNA, 130 nt, Human
uuaggggagccauggcagggagagugccuuccacccugaggccacccagaccuggaggagaugcaggccccagcucugcuaaagggccuuugaggugggugggacugucucccaguugggcagcucuuga

SEQ ID NO: 4123584 - RNA, 91 nt, Human
uuaggguugggauuaggggaguuauuagacagggagucagggccuccugccaugggaacuucuugucagugauuucuucccuuggcccuga

SEQ ID NO: 4123585 - RNA, 57 nt, Human
uuagguaaggauggugacaguaaucaaaugccacuacuguguaccaucuauaccugg

SEQ ID NO: 4123586 - RNA, 56 nt, Human
uuagguagccccacaguacauguuuauauugagcacaauuucuguggcuaaccuaa

SEQ ID NO: 4123587 - RNA, 74 nt, Human
uuaggugauaaugucuguguuucagugcagcgaguagguggagcuccugcugcaucuguuagauuaucaccugg

SEQ ID NO: 4123588 - RNA, 102 nt, Human
uuaggugucuaagcaaaacagccugucuuuuuuuggagcaauuguauuauuguuucaacuguuaagauaugcaguauuaugacuuuuaaaaaagacauuuaa

SEQ ID NO: 4123589 - RNA, 103 nt, Human
uuagguguuugccauuguacccccacucagaaugacugaugcugugccaugcacauaauaaauguuccugaugcugggguuugcauuggcugggacuaccuga

SEQ ID NO: 4123590 - RNA, 58 nt, Human
uuagguuuugcaaaguccauugaaguaaucuggcuacaguguggugugcacagcuuag

SEQ ID NO: 4123591 - RNA, 58 nt, Human
uuaguaaaugcuugcaacaucccaggugcuauauuaagcacuuugcaugugugucuaa

SEQ ID NO: 4123592 - RNA, 70 nt, Human
uuaguaacugaucaugugggaggauauguuccuuagaacauuaaaaaucauucaugguuaguauuacuga

SEQ ID NO: 4123593 - RNA, 65 nt, Human
uuaguaaucguggugguuaauuccaugugucaacuucacuggguuaagaauguuacgauagcugg

SEQ ID NO: 4123594 - RNA, 90 nt, Human
uuaguaauguugguaucuaguauaugacagaaaugaaaaauaacguauuuuguauuuaugcaagaaauuaucuguaccgaucaaaacuga

SEQ ID NO: 4123595 - RNA, 60 nt, Human
uuaguagauugugaucaguacuuagcccauagaaggugcugaauaaauaaagucuauuga

SEQ ID NO: 4123596 - RNA, 69 nt, Human
uuaguauaucgguaguuagcuccaaacacauguaacuaacauuuaguuacagcuaacugcuguuauuag

SEQ ID NO: 4123597 - RNA, 73 nt, Human
uuaguauuauuuuccuuccgguagguggaccuauguuguguugguaaggcuuauugcaagguaaaauugcuga

SEQ ID NO: 4123598 - RNA, 63 nt, Human
uuagucaggaaaagcuuuccuggaagguuccuagcagacuuccuuuuaugucuuccuggcuag

SEQ ID NO: 4123599 - RNA, 63 nt, Human
uuaguccccaugugcucuggccccucugccccgaagagagccaggaaguggcguggggucuga

SEQ ID NO: 4123600 - RNA, 80 nt, Human
uuagucuaguagggacaugccauuaucucauuuccaauuauuggaucuggauuaaugagugaguaugcccauggggcuga

SEQ ID NO: 4123601 - RNA, 77 nt, Human
uuagugaccacugaauaugacugccuacauggaaacaguuaggaagauguguuuagcagguuuagaucaagcacuaa

SEQ ID NO: 4123602 - RNA, 79 nt, Human
uuagugcagucuucuagaguaaggaacaaaugaaguccaaucacucccauuggcauuccuucucaggaauauuuccuaa

SEQ ID NO: 4123603 - RNA, 92 nt, Human
uuaguggcuuauagguugcuuguuuuugccuucucuacaguuauagcuagugaaagucaaagacagcuaccuuccccucucagagucauuga

SEQ ID NO: 4123604 - RNA, 84 nt, Human
uuaguggggaggggagguccagcugaucugcccgcuuugaugcaaggaacaguagacgaucuccuuuaauuauacccucacuaa

SEQ ID NO: 4123605 - RNA, 77 nt, Human
uuagugguauuauuggguaguaugguaaauauauguuuagcuuuacaaagugcugcaccauuuuaaucucccacugg

SEQ ID NO: 4123606 - RNA, 62 nt, Human
uuuagaaugccacuuggcauguaauucauacuccugaaguauuugcuacugguaauucugga

SEQ ID NO: 4123607 - RNA, 78 nt, Human
uuuagacaggagcuccagcccagggaagucauuugagcccuggaucaagcuguaccugaaacuggagcucccucugga

SEQ ID NO: 4123608 - RNA, 68 nt, Human
uuuagacauggauucagggaugugaauauuagcaaaauauugaacaaucaaaagaauucaugugugaa

SEQ ID NO: 4123609 - RNA, 91 nt, Human
uuuagagaauccuucaggcagagguaccaagauugauuuacguaggauuaagguucuuuuagugccucaaugacuuaaagcagucucugaa

SEQ ID NO: 4123610 - RNA, 55 nt, Human
uuuagagaguagaggacagacaagggugugcccugguggccucucacauucugag

SEQ ID NO: 4123611 - RNA, 65 nt, Human
uuuagaggcugccuaucacaacuauugagaauuucccuucuuuucaggugacgguaaccuuugaa

SEQ ID NO: 4123612 - RNA, 85 nt, Human
uuuagaggggaaaacaaauucucuaaagaaaacaugaaggaucuacucaauuucaugacuauacagaauaugaucuccaucugaa

SEQ ID NO: 4123613 - RNA, 70 nt, Human
uuuagagucuuuaggagaaaugagaaugaggaauugaccuuuuguaagcuuacuucugaggcacucugaa

SEQ ID NO: 4123614 - RNA, 67 nt, Human
uuuagauguuuaauccggcuguuuuaaauacuauucccauuuuguuacaguauauuagauauuugaa

SEQ ID NO: 4123615 - RNA, 74 nt, Human
uuuagcaaguauggauccaagggaaauuauuuuuaaauuuuuguaaaacugaaccuugagaucuuuguguuaga

SEQ ID NO: 4123616 - RNA, 55 nt, Human
uuuagcauuaagcuuuucaaauuuuagcuuuuagugaggaaagcuuaaugcuaga

SEQ ID NO: 4123617 - RNA, 61 nt, Human
uuuagccuuugguccagauugcuggucuguaaggaccucacugauuggaccagauucuaaa

SEQ ID NO: 4123618 - RNA, 59 nt, Human
uuuaggacagaguaaacucauaauucuguguguagaaggcaaggcugcacugucuuaaa

SEQ ID NO: 4123619 - RNA, 106 nt, Human
uuuaggacaggcagaaaugaaccucaaccucagcugugaggauuuauguaguuugaaagaagagugcauguguuugccacagugagcugcaggaaugccuccugaa

SEQ ID NO: 4123620 - RNA, 72 nt, Human
uuuaggcagacaucagauugcuuuuccuuaacacaugcuuguuuagagcuguggaggagaagcaagccuaag

SEQ ID NO: 4123621 - RNA, 80 nt, Human
uuuaggcaucuaaaucacuuuaauguauuuaagcgcauaauuagaaugcauuagacuauggcugaucuuagguguucaaa

SEQ ID NO: 4123622 - RNA, 62 nt, Human
uuuagggaugucagaacagggaucaucacugcaguccccaucccugucuaauaugccaugaa

SEQ ID NO: 4123623 - RNA, 130 nt, Human
uuuagggcccagacaaagcucugcucuucaguacaagaggccaccugcccucccaauggacaguccucuauugggagggcagguggccucuuguacuaaagaggguagggcugugucuaagucacuucug

SEQ ID NO: 4123624 - RNA, 59 nt, Human
uuuaggggaaaaucuuugguuugucuguuauuaauuggcugugagauuuucguccugaa

SEQ ID NO: 4123625 - RNA, 57 nt, Human
uuuaggggguuaccacugugggcaacugaguuuugguccugcugggaacccucugaa

SEQ ID NO: 4123626 - RNA, 61 nt, Human
uuuaggguuucucuccagugugaauuaucuaaugauuaguaacaucugagaaacacuuaaa

SEQ ID NO: 4123627 - RNA, 63 nt, Human
uugcuggaugguuugguaaaaguauguuuaguuuuguagagaaacaaccaaaccaucuuccaa

SEQ ID NO: 4123628 - RNA, 71 nt, Human
uugcuggcucuggacgucgaucuaugucuaccuacaaacacaaguggaccaggcuaguucagagcuucaga

SEQ ID NO: 4123629 - RNA, 68 nt, Human
uugcuggucauuuagauguggacuuauguuauuccaggcaacuggaaaucauacauauugaucuguaa

SEQ ID NO: 4123630 - RNA, 73 nt, Human
uugcuguaaggcuacugucagcuucagggcagaacuguuucugagacugcagugagccgcuuagccacagcag

SEQ ID NO: 4123631 - RNA, 60 nt, Human
uugcuguguuaaccagcuuuaguuuauuaucucagaacucuggcugcaccauuauaguag

SEQ ID NO: 4123632 - RNA, 78 nt, Human
uugcuguuguuacccagugcuguggagggagaugauuuggcauggacucccauuugcaagcuggguaaccugaggcaa

SEQ ID NO: 4123633 - RNA, 71 nt, Human
uugcuuaccagagcuuacaugcuagaaagugauuuuucucuuuguaaacuaaauugaguuacugguaguaa

SEQ ID NO: 4123634 - RNA, 76 nt, Human
uugcuucaacccaggagguggagguugcggugagcugagaucaugccacugcacuccagccugggcaacagagcaa

SEQ ID NO: 4123635 - RNA, 59 nt, Human
uugcuucauuuucuuugaagaacguuuucacuuacuuccaugaaagugaaauggagcaa

SEQ ID NO: 4123636 - RNA, 63 nt, Human
uugcuuccagggacucauacagcuguuguaucagcagggaaaugugucagucuuuggaagcaa

SEQ ID NO: 4123637 - RNA, 59 nt, Human
uugcuucucggucuuucagguucauuauggcagcuccaucacugaaggcaccagggcag

SEQ ID NO: 4123638 - RNA, 77 nt, Human
uugcuugaacccaggagguggagguugcagugagcugagaucgcgccauugcacaccagccugggcaacaagagcga

SEQ ID NO: 4123639 - RNA, 76 nt, Human
uugcuugaacccgagagguggagguugcagugagccaagaucuugccacugcacuccagccagggugacagagcaa

SEQ ID NO: 4123640 - RNA, 68 nt, Human
uugcuugaauccgggaggcaaaaguugcagugagccgagaucgugccauugcacuccagccugagcaa

SEQ ID NO: 4123641 - RNA, 75 nt, Human
uugcuugagcccaggaaguugagacugcagugagcugugaucaugcacugcacuccagcuuaggcaacagagcga

SEQ ID NO: 4123642 - RNA, 75 nt, Human
uugcuugagcccaggaauuaagcucgcagugagcuacgaucauaucacugcacuccauccugggcaacagagcaa

SEQ ID NO: 4123643 - RNA, 118 nt, Human
uugcuugugacaccgugaagauaggcuacaacucuccacauuugcuaggucuacuaagagucuauacaaacaagcuuauggaagugcaaauugugugaugaguguggcucacaggcaa

SEQ ID NO: 4123644 - RNA, 71 nt, Human
uugcuuuauaauuuuguuucucucuuccugccuggcuaagaggagaaagaagacgaacauuguagaaguaa

SEQ ID NO: 4123645 - RNA, 62 nt, Human
uugcuuuaucuaagcauggccaguugaaaucaagcuguggauaagccaugaagauagaguaa

SEQ ID NO: 4123646 - RNA, 82 nt, Human
uugcuuuauuuugugagggauuacuaccaaaagaacaauaaacuuucccuucgguucuguacucccucucaaggcugagcaa

SEQ ID NO: 4123647 - RNA, 70 nt, Human
uugcuuucuauuagugugguuaggauggauauuuuuggauuccacuucuauuggucaugauaaaaagcaa

SEQ ID NO: 4123648 - RNA, 56 nt, Human
uugcuuucucucuaccccacuuuguagauauucuuuaaaaggagagagaaaaguaa

SEQ ID NO: 4123649 - RNA, 82 nt, Human
uugcuuugguuuuauaguuaggaagaccuggguucauacagcuauuccgugggccucaguuucuucaacuguagaaaagcag

SEQ ID NO: 4123650 - RNA, 73 nt, Human
uugcuuugucacccaggcuggagugcaguggugcuguauuggcucauugcaaccuccuccuggguucaagcga

SEQ ID NO: 4123651 - RNA, 71 nt, Human
uugcuuuuaucaguuguguguauacacgcacacauacgcauggccaugcauacacacaaugguucuggcaa

SEQ ID NO: 4123652 - RNA, 75 nt, Human
uugcuuuuccuauuugauucuguaaaauaacaggaagguuucuauugugcuaccagaauuacaaaaguaaggcag

SEQ ID NO: 4123653 - RNA, 86 nt, Human
uugcuuuugcugcuucuuuuguggguuugcacuugugaccuaaaguaaauaaaauagcauaaaauaggaagcuggggugggggcaa

SEQ ID NO: 4123654 - RNA, 60 nt, Human
uugcuuuuguagaugaaugggguuuuuuauuauuguaaaaguuuucauuaauaaaagcaa

SEQ ID NO: 4123655 - RNA, 83 nt, Human
uugcuuuuuggccccagccuaguuuucuuucauucccaugucucaucuuuuaugcagcugcagagagcaggcugggaaagcag

SEQ ID NO: 4123656 - RNA, 97 nt, Human
uuggaaaacuaaaguagaauauaugguuaguauugccuauaaaugccaaaacacucauaugggguaguagaucauacuuuucucucaaguauuuuga

SEQ ID NO: 4123657 - RNA, 58 nt, Human
uuggaaaacuuacacagagcugugcuguguccaaaaugcuguucaguagguuuuccaa

SEQ ID NO: 4123658 - RNA, 103 nt, Human
uuggaaaaugugagauguugcugcauaaugacaauaaucauuaacuuuagguuuauucugggguuaaugaauuauuauagugcagugaaaaauuauucuccaa

SEQ ID NO: 4123659 - RNA, 61 nt, Human
uuggaaaaugugcucugaggugcagagggcuuauuuggaagugcucugaaagacacaccag

SEQ ID NO: 4123660 - RNA, 64 nt, Human
uuggaaaauuugcugauggcauuugagcugggggcacuaguuaaauguucaguaaguaaucuag

SEQ ID NO: 4123661 - RNA, 106 nt, Human
uuggaaaggauuaaaaguuugacaaaacuuaaaaauagcagggaugugggaaaauugacauucucuugcacuguuguuagaaauguaaauugguauuccuuucugg

SEQ ID NO: 4123662 - RNA, 57 nt, Human
uuggaaagggaggaauguagaccgaaaagaaucucugcagacuuguaccuuuaccaa

SEQ ID NO: 4123663 - RNA, 79 nt, Human
uuggaaccuggcagcuccguggccuuccggagcucugagggcugugggcuaugggaggguuggaugggguugucuccaa

SEQ ID NO: 4123664 - RNA, 82 nt, Human
uuggaaggcuuucucaguaauguccuggaauuacgguuacagccugcauuucauguuaacugaacagaaaaccagccuccaa

SEQ ID NO: 4123665 - RNA, 104 nt, Human
uuggaaguuugaagauuuggguugguguuuuaguucuuggccucaaaucauuuguagaacgaagauggucuaguugaaccauaugaaccccuuccagcucucaa

SEQ ID NO: 4123666 - RNA, 55 nt, Human
uuggaaugcauaaacuuaagguuuugucaauguaaaaccugaggcaguguuccag

SEQ ID NO: 4123667 - RNA, 66 nt, Human
uuggaauggccagcuagcacuugcauuguauaguuaacauugugcuauaagcgugguucuuucuaa

SEQ ID NO: 4123668 - RNA, 76 nt, Human
uuggagaaauugcuuuaucucuuaugccucagguuccucaucuguaaaauggguagaauaauggcucuuacuucaa

SEQ ID NO: 4123669 - RNA, 84 nt, Human
uuggagaaguguuggcuuucaaaugguuucugaaguuaggcagauguuuacucucugucaugguuugaaugcucgccccucuaa

SEQ ID NO: 4123670 - RNA, 66 nt, Human
uuggagaaugauucuuugcucacuuuuagaccacgugguuccuguaggaaagagaacauuccccag

SEQ ID NO: 4123671 - RNA, 61 nt, Human
uuggagagguacacccuuuaaacuugagaacauaaaguuugaaaacaacugccuuggccaa

SEQ ID NO: 4123672 - RNA, 71 nt, Human
uuggagcucagagagguugaacaacuugcucaaggccacccagcuugcaagugggaccugucugauuccaa

SEQ ID NO: 4123673 - RNA, 56 nt, Human
uuggaggaagcucaugggggaucuguguauuucuuagguuucucccuguucuccaa

SEQ ID NO: 4123674 - RNA, 110 nt, Human
uuggaggauaaaaagaaaggccuuuuugugagggaggagaauacaggacuuucacuagcuguuccuccuagaugucuucagagaaacauuuugucucuuugucucuuuga

SEQ ID NO: 4123675 - RNA, 62 nt, Human
uuggagggacugagcuucagucaagcacccuacugugggggucacugacugagucccuugaa

SEQ ID NO: 4123676 - RNA, 64 nt, Human
uuggaguagaugguuauggauuagcaaauuguauagcuuguuaaguucuaugaaucuacuccaa

SEQ ID NO: 4123677 - RNA, 79 nt, Human
uuggaguaugugagggugaggugcgcugcaggugauuaaacuacugucucucagcucaaaauucaccuuugcuacccag

SEQ ID NO: 4123678 - RNA, 61 nt, Human
uuggagucauauggaauucacaucaaaaaaggugcucauuugguuuaccguauuauuccaa

SEQ ID NO: 4123679 - RNA, 60 nt, Human
uuggagucucuaggggaaaaucuauuucuuugccuuuuccaccuucuagagauuguccag

SEQ ID NO: 4123680 - RNA, 92 nt, Human
uuggaucaaaguugcaacauauuacuuccugguauaaaauguauuuuauaugcugaauucugugccacaagaaagcugcaacuuugaucuga

SEQ ID NO: 4123681 - RNA, 123 nt, Human
uuggauggauguuucaaugaggacaacaguaguuugaaugcaguaugcauuuuucacauaacauggaaaguagugccauuuugcucuuugucuugcaguuggaauaugagauaacccaugcag

SEQ ID NO: 4123682 - RNA, 55 nt, Human
uuggaugugucagugugggcaugcucccuuaugcaagccugagccagccaugcaa

SEQ ID NO: 4123683 - RNA, 61 nt, Human
uuggauuaacuguuauaugccagcacugcucaaggucuuaguauaucagcagugaauucaa

SEQ ID NO: 4123684 - RNA, 65 nt, Human
uuggauuagagaucacucugaugaccucaucuuaacuugaucaucugcacagauccuauuuccga

SEQ ID NO: 4123685 - RNA, 65 nt, Human
uuggauuauacacauacauguacgucacaugugugcacacaugcauacauguuuguguauuuugg

SEQ ID NO: 4123686 - RNA, 97 nt, Human
uuggauuggaauucugagugugucauugagagacgaggugagacauuuuuaaaauguugauguuuucagugagcacaggcagauuuucacaaucuaa

SEQ ID NO: 4123687 - RNA, 84 nt, Human
uuugcuucagagaguggcagguuuuuaauuaauuuuaauaauguaaaauuccauuaggaaacuuccaucaguucauugugcaaa

SEQ ID NO: 4123688 - RNA, 102 nt, Human
uuugcuucucaaacucacuguuaauggaggacuacaggacauucacauagacugagaaauuuuccacugucauucauaauguggguucuauugagaagcaga

SEQ ID NO: 4123689 - RNA, 78 nt, Human
uuugcuugaacccaggaaguggagguuacagugagcugaaauuacaccacuuuacuccagccugggcaacagagcaag

SEQ ID NO: 4123690 - RNA, 59 nt, Human
uuugcuugacccuugugcugaaccaaaaucuuuuccaagguucugaaggguucaguaaa

SEQ ID NO: 4123691 - RNA, 65 nt, Human
uuugcuuguuuguuuugacaagugcgguuuaguuuuaugauaauauuucagagcacacaaguaaa

SEQ ID NO: 4123692 - RNA, 56 nt, Human
uuugcuuuaaguuccauucuucccguuccucuagaggaaccaggaacuaaagcaga

SEQ ID NO: 4123693 - RNA, 73 nt, Human
uuuggaaaauauugaacugguugaaauuaguuauaauguucuaagaaaugauauuaguucaauguauuucaga

SEQ ID NO: 4123694 - RNA, 112 nt, Human
uuuggaaagcaugguuuagaaacuacaggcauugucaaguggccgggucuuuuauaauuugaauaggcauaacacugauguccucuguguuuccaaaaacaugguuuagaaa

SEQ ID NO: 4123695 - RNA, 59 nt, Human
uuuggaaauguguuucgaaaacugguguccccauuuaggacccagcacauuauuucaga

SEQ ID NO: 4123696 - RNA, 57 nt, Human
uuuggaagcuucacauugaacuugggugcuagagagauacccuuggagacuuccaga

SEQ ID NO: 4123697 - RNA, 59 nt, Human
uuuggaauaggaccuuauuuuuguucaguauauuggacaaaguaauuccugcuuccaaa

SEQ ID NO: 4123698 - RNA, 78 nt, Human
uuuggacugaagaguuugcaauuguuccauuguagugaauucacuagugaagcuaaccugcugauuuuucgucucaga

SEQ ID NO: 4123699 - RNA, 57 nt, Human
uuuggagaacaaaucuacaccuuagaggaaggccucugcugucugacaguucccaga

SEQ ID NO: 4123700 - RNA, 68 nt, Human
uuuggagaggcagucuugcucuguuacccaggcuggaucccagcucacugcaaccucugccucccagg

SEQ ID NO: 4123701 - RNA, 64 nt, Human
uuuggagauguacaaguaaaauauguguguucuucauugcacacaucuauauugcaucugcaga

SEQ ID NO: 4123702 - RNA, 63 nt, Human
uuuggagccucaccuuuagucccacccuggccagccaaaccagggucagccuggggcuccagg

SEQ ID NO: 4123703 - RNA, 73 nt, Human
uuggcugcuauagguagaucugucuaauugcaggauggaaugaauccauuuacaguuuauguaaagcugccaa

SEQ ID NO: 4123704 - RNA, 57 nt, Human
uuggcugcuggucuuuggauaugguuauggucuaugucuugauuucaguaugugcaa

SEQ ID NO: 4123705 - RNA, 63 nt, Human
uuggcuggaggucauguaauauggaagcucuuuagccuucuuuguacaugcacuucuuuucaa

SEQ ID NO: 4123706 - RNA, 75 nt, Human
uuggcuggggcccggccugucucccuagaccuuuuucucugugagaggagaccaggucuuuauggcuccaacuaa

SEQ ID NO: 4123707 - RNA, 67 nt, Human
uuggcuucccaguuugaccauuagacuuuggaaaaaauuuucuaaacuaggguuaaaggaaagccag

SEQ ID NO: 4123708 - RNA, 68 nt, Human
uuggcuucugcauauuuuuagagacaaaugcuuuaucaagaaggguccugaacaaauggcauagccaa

SEQ ID NO: 4123709 - RNA, 78 nt, Human
uuggcuugaagaucuaucaacauauaauauuugaguucuuguuugagauuuagauaagguaugucauguucaggucaa

SEQ ID NO: 4123710 - RNA, 68 nt, Human
uuggcuuucuggaggccagcugccaccuggggcaaaguauccagguccaagaucauucugaaggccaa

SEQ ID NO: 4123711 - RNA, 78 nt, Human
uuggcuuugcauucugggugacuacgugaucaccaugauuagugaucaaguuuaucucuuaagacauguaagagccaa

SEQ ID NO: 4123712 - RNA, 91 nt, Human
uuggcuuuuguggauauuaaauuaguaaaacauuguauaugucauugacauauauauuauuuagcaugaugaaauauucaugauguacuaa

SEQ ID NO: 4123713 - RNA, 87 nt, Human
uugggaagagagaagccucucuccagcuuggcagauucauugaggauguugcagagcuggggaggguguuaauuguguacuucucaa

SEQ ID NO: 4123714 - RNA, 78 nt, Human
uugggaauuugaaacugccacuccuccccacuuagugagccccaucugagcuggaggacaggaggguaagaggcccag

SEQ ID NO: 4123715 - RNA, 72 nt, Human
uugggacauggacugcugaacuaaggcaaaguugagcgacuccuuugacuucuugcaguccagcuaucccaa

SEQ ID NO: 4123716 - RNA, 61 nt, Human
uugggaccuccaggaccucucuuagugucauacugagcagaagagaucugugaggcuccaa

SEQ ID NO: 4123717 - RNA, 66 nt, Human
uugggacuugggucuguccugcugugcauccauagugggugcuuuagaaacgggaggcccacccga

SEQ ID NO: 4123718 - RNA, 95 nt, Human
uugggagcaucauugacuuuagagcuuuaggugccuugacaauggcucaauccauggggcacagagaagguuuuaguguaaaaaaugagccuuaa

SEQ ID NO: 4123719 - RNA, 64 nt, Human
uugggaggagggaaugcaaccccagauuggccccugaucugguuuuggcugugucccugcccaa

SEQ ID NO: 4123720 - RNA, 83 nt, Human
uugggagggaaacugaggcagggcuugcauaguccuuuggaaugugucuagacuugcuggcuccuugcuucuagcccuccuag

SEQ ID NO: 4123721 - RNA, 71 nt, Human
uugggaggugaaguuaaugcauuagcacaucccucguaugcauuauacauuaauuucuccagauauuccag

SEQ ID NO: 4123722 - RNA, 56 nt, Human
uugggagugaagaauuaggcuauuuggggagccaaaugauaugcuuguauuuccaa

SEQ ID NO: 4123723 - RNA, 65 nt, Human
uugggaucaaauuuuaaagcuaaaaauacuaaacuacauuuuuuagucuggggaagggaucccag

SEQ ID NO: 4123724 - RNA, 63 nt, Human
uugggaugaaaacagugucagguaaggaguuaaguagccuuaucuuggccuaaguucacugaa

SEQ ID NO: 4123725 - RNA, 63 nt, Human
uugggauggggugggaccaacagaggaacagauauuuguuugcuauauccuacuucauaccaa

SEQ ID NO: 4123726 - RNA, 119 nt, Human
uugggccagauaauucuuuguggaggguucucuugguguguugucgggcauuuaguaacauucccucuacccacagaaugccaaugagaccucccgaccaugaccaguugugaccacaa

SEQ ID NO: 4123727 - RNA, 61 nt, Human
uuggggaagaguugacuuuggauuaccaaaucuaguccuccauauucaguaacuuccucaa

SEQ ID NO: 4123728 - RNA, 82 nt, Human
uuggggaggaggcuggcgccgccugccggaagccuaaggaaacucagggcucgagggaagccggcuuccagccgccccccag

SEQ ID NO: 4123729 - RNA, 70 nt, Human
uuggggaugacuacuuaugggaaguaucuacuuaugggaaguaugacuacuugugagagauuaucucuaa

SEQ ID NO: 4123730 - RNA, 74 nt, Human
uuggggaugaggccacugucccugccuuccugggagccaggauguugauugaauggccauuucacucucuccaa

SEQ ID NO: 4123731 - RNA, 108 nt, Human
uuggggauuguuuuuaaggaauuggauucuuucuaggcugugagccuuuagacuuuuuuauuagcuaaucacaucuuauuagaguaucucuuccaaagcaguguucaa

SEQ ID NO: 4123732 - RNA, 80 nt, Human
uuggggcacugucccccuccgagaccaggugaggaaugcugagaaauaugugggccugggaaggugacacacagccccga

SEQ ID NO: 4123733 - RNA, 58 nt, Human
uuggggcagagaggauacggcaacucucgauuuuguugugaaccuaaaacugcuguaa

SEQ ID NO: 4123734 - RNA, 87 nt, Human
uuggggcaugguguuggguuucuuauacuauauugucaucuggacccaauccaguaauucaagaaauaagaucuagcucaucccuaa

SEQ ID NO: 4123735 - RNA, 65 nt, Human
uuggggcuaaagauguguucuuuggagucaaugaugaugacauucgaugguauuuauagccuuaa

SEQ ID NO: 4123736 - RNA, 60 nt, Human
uuggggcuaggagugcaagccacccaggggcuccugacgggcugcucaccuaggucccaa

SEQ ID NO: 4123737 - RNA, 72 nt, Human
uugggggaaggcagcuuucugaggcugaagaauuuccugaaggggccacagcuggaggcugucuacucccaa

SEQ ID NO: 4123738 - RNA, 55 nt, Human
uuggggggaugauuggagaggcuuucucuuauaccccuaaacugcagccccccag

SEQ ID NO: 4123739 - RNA, 68 nt, Human
uuggggguaacaggugguaguuugugcucaaauucuagcuguagcaucuacuaguuguauggccugaa

SEQ ID NO: 4123740 - RNA, 59 nt, Human
uuggggucugggucaaggggugugaggccacuaacccacacuuuaugucuagaucuggg

SEQ ID NO: 4123741 - RNA, 59 nt, Human
uugggguggaagugaggaucaucaggagaguuacuguaagggaccugcacucaucccag

SEQ ID NO: 4123742 - RNA, 66 nt, Human
uugggguggggcaggaacaaaucaaaugauggaaugucaucuuuuguuguucuuccauugcuccag

SEQ ID NO: 4123743 - RNA, 67 nt, Human
uugggguguucuauaaauaucagccacauuucccaaagcuguccaugguuuauacagaagaccccaa

SEQ ID NO: 4123744 - RNA, 62 nt, Human
uugggguuacggugcaugcccuccaucaucuuguuaggaggagggagcauguuagcuuucga

SEQ ID NO: 4123745 - RNA, 62 nt, Human
uugggguuuuauggcaaaaagacugggcauguccaacuggcuugucugcuauaaaaauccag

SEQ ID NO: 4123746 - RNA, 66 nt, Human
uuggguaaaucacuccuaauaaucagucaaucagcuuguauuguuaugccagugauacauaccuag

SEQ ID NO: 4123747 - RNA, 80 nt, Human
uuggguauuuuacaacuuugugcugauuugauauggacagaucaucccaguguuuuaucagacaaaguauaacacuccag

SEQ ID NO: 4123748 - RNA, 67 nt, Human
uuucugcuaguauauauaugucugaagacaaaauuugacagucuccagcauguuugugcugcugaaa

SEQ ID NO: 4123749 - RNA, 73 nt, Human
uuucugcugccugacaauuuagguuugccacauccagagacucagccggcaagccuuacagcuacagcaggaa

SEQ ID NO: 4123750 - RNA, 61 nt, Human
uuucugcugucacucauuugcuucagggcugacuuguuuugaagccagugggcagcagaga

SEQ ID NO: 4123751 - RNA, 62 nt, Human
uuucugcugugcuuucuugcguauuuucuuaauggauagauaggacaaugguacagcagaaa

SEQ ID NO: 4123752 - RNA, 57 nt, Human
uuucuggcuuaguuguuguauauaacuaggaguuaauguaucaauuaagccaaggaa

SEQ ID NO: 4123753 - RNA, 67 nt, Human
uuucugggucaaaggauagucacauuuuuauguuuuugauguauuuugccagacugucucccagaaa

SEQ ID NO: 4123754 - RNA, 83 nt, Human
uuucugggugaaauauuuugcuucccccuguucuaguucaguuagcugaauugaguucugggaaguucuguuccacguagaaa

SEQ ID NO: 4123755 - RNA, 60 nt, Human
uuucugguccugcaauugccaguuuggagaagcagaguggcauagugaggggcacagaga

SEQ ID NO: 4123756 - RNA, 58 nt, Human
uuucuguaccuccucuugccccauccguagaguaaggagggcuagaccagggcagagg

SEQ ID NO: 4123757 - RNA, 91 nt, Human
uuucuguauaucucugugauacaaauaaacauaugcucauucuauuagccaaguauuuguggauuuguauuggugaaauaaaauauagaaa

SEQ ID NO: 4123758 - RNA, 124 nt, Human
uuucugugcccacuaaucaacuucuguucauccccaaccccaggccugcgcauuucugacugugcuuguuagaaaagccccagcuggagggggugagcagucccuguugcugugaccacggaag

SEQ ID NO: 4123759 - RNA, 87 nt, Human
uuucuguggucaccuucaugaccuaucaccagccaggggucugcaaauggaugggcuggagauaugucuggaacauuaucguggagg

SEQ ID NO: 4123760 - RNA, 55 nt, Human
uuucuguuguacuuaaacuagguauguaacaaugcuuagugaccuauaagagaaa

SEQ ID NO: 4123761 - RNA, 79 nt, Human
uuucuuagguuuaggcaaacucauugucagaaauauuaugaacguauuugagcaguuugugcugaacgcuauacagaaa

SEQ ID NO: 4123762 - RNA, 76 nt, Human
uuucuuaguacuuuguacugugcuuuucuuauuuuaggaguuuaaugaauaugauuaaguauagaguauugaggag

SEQ ID NO: 4123763 - RNA, 56 nt, Human
uuucuuauguucacauaauuccaccuugguaagguggucccaugcaauauagggaa

SEQ ID NO: 4123764 - RNA, 78 nt, Human
uuucuucacccaaaacuguauguugagaugacagccucacaaagugaugcagcuuaagcaugcaguuugaugcagaaa

SEQ ID NO: 4123765 - RNA, 75 nt, Human
uuucuucagacauuguaaacuuuauucacuaccuggcaguagguguaaaauaagaauuuacuugucaagagggaa

SEQ ID NO: 4123766 - RNA, 130 nt, Human
uuucuucauuucccugaccuguggguacuugaggguggccggggagugguguguggggagggagauggcuguccuucuucaugaaugaaucuuugaccuccuuaguuuacucucacuuccaaagaaguua

SEQ ID NO: 4123767 - RNA, 56 nt, Human
uuucuuccccacugcaggcucucaaggcugagauaguccugaguugggugaagaga

SEQ ID NO: 4123768 - RNA, 122 nt, Human
uuucuucugaguaauuuuggccuccagccugaguaaggauaguucuagaccuauaguucuuaaaccuagaugaguaauuauaagaauuaccuaggggaggagccaagauggccgaauaggaa

SEQ ID NO: 4123769 - RNA, 57 nt, Human
uuucuugaaguccuaacccucagugugaugguauuugggggcaaggccuuugggaag

SEQ ID NO: 4123770 - RNA, 128 nt, Human
uuucuugaauguuaguaagugaaauaaaaggugagaaaauggcuuuuuagacuuugguacccugacaagaaauuaguggauuaagagaaguuucuuaucgcaggcaucaucuugcuauucuuugauga

SEQ ID NO: 4123771 - RNA, 111 nt, Human
uuucuugcuuuagaagugcuacugucauuuacauucucuaguaauccaauugugaauuuuauggauauauaugagcaugugaggacagggugccaguggaaagcuaagaaa

SEQ ID NO: 4123772 - RNA, 97 nt, Human
uuucuugguuucuugaaagaggaaggagauguauuaauuagcuuuucuguuaaucuguaguaaugauauuucccauuucucucacacagccaaggaa

SEQ ID NO: 4123773 - RNA, 70 nt, Human
uuucuuuauuauuucacccccaaggagagggcaaaaaaaauuaaguuauggggugugagaaguagaggga

SEQ ID NO: 4123774 - RNA, 57 nt, Human
uuucuuuccagagugauuggcacagguugaggggcugggaguuacuuaggaaggaga

SEQ ID NO: 4123775 - RNA, 78 nt, Human
uuucuuugcaucuccgugccccaauccuggaccuguucuggugcacaggaagcugguuacgaagggaugcaguggaga

SEQ ID NO: 4123776 - RNA, 81 nt, Human
uuucuuuucuuuaggcauuguguagcucugagagcuuucuauauaucuggcuucuauggugacacagugacaggaaagaga

SEQ ID NO: 4123777 - RNA, 68 nt, Human
uuucuuuugacuucuaucuaguaagaagcaggcugaugggcuucuuucugggaagaguucagaagaaa

SEQ ID NO: 4123778 - RNA, 69 nt, Human
uucuugggaaucagacaguucuggauucaaaccucauucucacauuugaaucaacugucugaccaugga

SEQ ID NO: 4123779 - RNA, 86 nt, Human
uucuuggucuggacccuggaacuuucagcagaguuuuaaacaaaaacuacacgcugcuuguuuccauggcuccccucaccaaugaa

SEQ ID NO: 4123780 - RNA, 71 nt, Human
uucuuguaucauaauugcuccagugauauauugccaauauaucacuuuugaagagaauugacaugcaagga

SEQ ID NO: 4123781 - RNA, 62 nt, Human
uucuugucccauugauaggcaaaaguacuaaauagucuacauuuuuguuaaugguaugggaa

SEQ ID NO: 4123782 - RNA, 129 nt, Human
uucuuuaaaaauuuugacuuucuuauguagugcuucuguuguugacaguaacuccaacugccucuuguuuguaacugaaguucauacaacagacuaugagccaaaguuagugauuaacuguuuggaaag

SEQ ID NO: 4123783 - RNA, 75 nt, Human
uucuuuaagguuucuaggauacucuaaauguauuccuucaaugcaguuaaguaauguccuagaagccugaaagga

SEQ ID NO: 4123784 - RNA, 91 nt, Human
uucuuuaccuuuuaucaaugcaguauguuuuccccaugaguguaguuuucuaaucuggcugacauccuguaugagaucaaaagugugagaa

SEQ ID NO: 4123785 - RNA, 60 nt, Human
uucuuuauagcaucuaggaugauugcaguauuuugcuaugauaaauaaugcuacaaagaa

SEQ ID NO: 4123786 - RNA, 72 nt, Human
uucuuucacucaagaaauguuuacugagcaucauuuaugugccugugcuuggugucauuuccauugaaaggg

SEQ ID NO: 4123787 - RNA, 89 nt, Human
uucuuucauuagaaucuucagcaauucucuucacuacugucuagauuuaucaguuuuacaggugggaaaacuaagcuucagagagagaa

SEQ ID NO: 4123788 - RNA, 72 nt, Human
uucuuugagcuaaaaggagcacuagagauuaucuauugagguaguuuccaaauauuguuuuagcacagugga

SEQ ID NO: 4123789 - RNA, 56 nt, Human
uucuuugauggacagaugauggauuuauguccuauccagaaugcuguaaucaagaa

SEQ ID NO: 4123790 - RNA, 89 nt, Human
uucuuugcugaaggggaggaggaggaagggcugccugccgggcucagggugagccucccugcuguccuuccuacccuugcccuagagaa

SEQ ID NO: 4123791 - RNA, 86 nt, Human
uucuuuguucaugguuagaaauauuugcuuuuaaaguauuucuggugcuaaaggacuagucuuucuaccaugaagcauauaaaggg

SEQ ID NO: 4123792 - RNA, 62 nt, Human
uucuuuguugggaacugcugaguaggaauauaaacaaaauuacuuugcaggagaacagagaa

SEQ ID NO: 4123793 - RNA, 125 nt, Human
uucuuuguuuacccugagcuuaagucaaaggaugcauaugcaucuguguacauuggugugcauucuagugugugcauauguguuugcaugaggaaugacuuuuuaagguuaagcgugaaaaagaa

SEQ ID NO: 4123794 - RNA, 114 nt, Human
uucuuuuaaaaguuauucuugucauucauugugaucugcagcucugaaagauacaccuacgaacauguucauagaaagagcauaguauuauaaauggcuagacuuuuagaagga

SEQ ID NO: 4123795 - RNA, 129 nt, Human
uucuuuuggaaaauaucagcugugagugaaggcagguuggggaaaagcacuaaggccuggucucaucuaccaggaagguuucccccucugccuuuuccuuacugagugaauuuaccaagucauggagag

SEQ ID NO: 4123796 - RNA, 93 nt, Human
uucuuuuggcacugucucaauaugcaaagcguguuaucugcaaaauaccugugcagaaaacauuguguguauaagaucuaaagccuaaaagga

SEQ ID NO: 4123797 - RNA, 58 nt, Human
uucuuuugugaauugcuucuucaagucuuagaucuuuggcugggggaaggcaagaggg

SEQ ID NO: 4123798 - RNA, 56 nt, Human
uucuuuuuaccaacucucugauaugcaaauguaugucuggaguaccauaaaaagga

SEQ ID NO: 4123799 - RNA, 65 nt, Human
uucuuuuuaucuucccauaagaccaccucucuuguuuguugcugaggauggggggauaagaggag

SEQ ID NO: 4123800 - RNA, 130 nt, Human
uucuuuuuccaacugugcuaauaguuauugggggaaauucagccagauauugggcggaauucacccccaauauuucacguagguuguuuucauuuucccuaaauguuggcuggucugagaaauaaaggga

SEQ ID NO: 4123801 - RNA, 99 nt, Human
uuuauuuuaugggugacuagauuaagaugccaguuuugagaauuaauuguaaauaucuuuaaagcccagucuuaauucuuggugcaacuguaaaauaga

SEQ ID NO: 4123802 - RNA, 60 nt, Human
uuuauuuuccuaguucuaagaaauguagugaagauagucauucaguccuagggaaauaaa

SEQ ID NO: 4123803 - RNA, 124 nt, Human
uuucaaaacauuuauccauuuucauaaaagauuucuuaaaauucaagcuagguuuucuuccuuuauuugaaaagggaauaugguaauuuuaggaauaugauuauauaugcauauguggaagaga

SEQ ID NO: 4123804 - RNA, 56 nt, Human
uuucaaaauguauggggaaaauaugugaauaaaauauugugaccaucauuuuggaa

SEQ ID NO: 4123805 - RNA, 62 nt, Human
uuucaaagugcuguucaaaguagcaucucaugauguuugcugucugaaaguaaucuuuggaa

SEQ ID NO: 4123806 - RNA, 55 nt, Human
uuucaaauagcaacuaccugcugugacagcgguagggacaauauguuauuagaaa

SEQ ID NO: 4123807 - RNA, 65 nt, Human
uuucaacagaucugucuucagguuugcucauucuuucuucugccagcuugaaacuacuguugaga

SEQ ID NO: 4123808 - RNA, 65 nt, Human
uuucaagagcaggaaaaaggucacugcuuuaauccuguuaauugccuuuauucuggcucuagaaa

SEQ ID NO: 4123809 - RNA, 61 nt, Human
uuucaagcacagagcaacucaaaucagcuuccccggaacugggauccagaugcucuugaaa

SEQ ID NO: 4123810 - RNA, 78 nt, Human
uuucaagguaguaagaugggggaaagaaauaguuuauucccauuuaaaauguuuuuuuacuuuuuugguacuuugaaa

SEQ ID NO: 4123811 - RNA, 56 nt, Human
uuucaaggugcugacauagcaugugcaaacacauggcagaaucaugcaucuagaaa

SEQ ID NO: 4123812 - RNA, 78 nt, Human
uuucaaguauuaucuguuugcgcuucuggguuuaguaaacaucguaacuguccauagcaagaggagcagaaauugaaa

SEQ ID NO: 4123813 - RNA, 87 nt, Human
uuucaagugcccuuucccugcagcccuccuuucacucccagguucccuugggguaagugggggcuggggggagugguaaagauggaa

SEQ ID NO: 4123814 - RNA, 79 nt, Human
uuucaauauguuaauguuauuguggguuugucgauucuuuauauuuuagaccuacauacggaaauauuuacgggugaaa

SEQ ID NO: 4123815 - RNA, 69 nt, Human
uuucaaugaugcugaagguagcgugucaaaauauggaguacacuacacgaaguuuuaagcucauugaaa

SEQ ID NO: 4123816 - RNA, 63 nt, Human
uuucaauucaugucuucaaaugaucaaucagcuuuugaucauuugccucaagugaaagugaga

SEQ ID NO: 4123817 - RNA, 64 nt, Human
uuucacagagaaauauaacaggccugaugucuuccugacaauucuguuauuuucuuguguggaa

SEQ ID NO: 4123818 - RNA, 65 nt, Human
uuucacagcugauaccucuucccacaaaaaggaaaaaaagggggaagaugauauuaauugugaaa

SEQ ID NO: 4123819 - RNA, 65 nt, Human
uuucacagcugggauggauaggggauauauguguauguguguacauaucuauccuagauuugaag

SEQ ID NO: 4123820 - RNA, 56 nt, Human
uuucacaggggcaaccuccauguggagacacauggugauucagugcugccugggaa

SEQ ID NO: 4123821 - RNA, 94 nt, Human
uuucacaguaauuuuuaucauaugucacucaugggcauauaugugugucuguguguguguguguguguguguguguaagaaauacuaagugaaa

SEQ ID NO: 4123822 - RNA, 56 nt, Human
uuucacagugagcuaugucuuguguuuauaaaagcaaggguggugauauuguggaa

SEQ ID NO: 4123823 - RNA, 98 nt, Human
uuucacaguuuuaguuucauaauucaaucaaaugacagcuguucuaaagauaaaaugauguaaggacuucaauugauuuguguaauuacaacuggaag

SEQ ID NO: 4123824 - RNA, 67 nt, Human
uuucacauucagcucauuaauggucuaguacauuguauuuuugauuuaaagauggcugaauaugaga

SEQ ID NO: 4123825 - RNA, 105 nt, Human
uuucacugaagacagauucagccuaauucaugaauauauugaauuagcaugacuacaugcuuuauucaggucacugaggagacugaauuuaucugcuuaguggga

SEQ ID NO: 4123826 - RNA, 61 nt, Human
uuucacugggcuaacaucaaggcaucagccgggcugcauucuuucuguaagcuccauggaa

SEQ ID NO: 4123827 - RNA, 73 nt, Human
uuucacuuagauuuccuuacuggguggucacaggugugggugaacuaccacaaguaugaagaacuaaaggaaa

SEQ ID NO: 4123828 - RNA, 82 nt, Human
uuucacuucuccaaccucagccagacaugacccagucuggcagaggucugggucaugucuggcugagguuggagaagugggg

SEQ ID NO: 4123829 - RNA, 57 nt, Human
uuucagacaggcucagagccgucaucugcuugaagagucuggggggcuugucugaag

SEQ ID NO: 4123830 - RNA, 87 nt, Human
uuucagacucuauguaagagcacugugguaugcugagcagaaacaccugacucuaacacuguaaugcuuucuaugcgaguuaagaaa

SEQ ID NO: 4123831 - RNA, 61 nt, Human
uuucagagcccugcuccuccccaaggccaggugcagcaauuggagaggaagggcacucaga

SEQ ID NO: 4123832 - RNA, 57 nt, Human
uuucagaggugcuuggaaugcugauggaguugaaucagcaagagggccugacugaga

SEQ ID NO: 4123833 - RNA, 76 nt, Human
uuucagauaaaauacagugaaagugagcaaggcagaaaaagucaacagaugcccaggcuccuacuguauucuggag

SEQ ID NO: 4123834 - RNA, 80 nt, Human
uuucagcuugaauuucauuuguuuccuaccauuucucuucauauuauuaguggugguaaaaguuaauaaaauagcugaaa

SEQ ID NO: 4123835 - RNA, 124 nt, Human
uuucaggaaauguuuauggugauaguagcauuaagauaauaagauaugcuguccauacauauuacucaaaggaugacauucuguuaagucucauaaaguuauagucaugaagagauuauugaaa

SEQ ID NO: 4123836 - RNA, 58 nt, Human
uuucaggaaugugacuauuuuuucagcaagcuuucugugcugugucacauuuaugaaa

SEQ ID NO: 4123837 - RNA, 85 nt, Human
uuucaggaggaaaugaacgugcaaccauagagugcucagaaaggugucuggcucuguaaguguugcagguaugguuccccaggaa

SEQ ID NO: 4123838 - RNA, 87 nt, Human
uuucagguauauuuuguauauacucuuaugcuguacccaaauuaaagguuuaaaacagaagaguguauaauuuuaauauaugagaaa

SEQ ID NO: 4123839 - RNA, 59 nt, Human
uuucaguguaagguuuccaggaguaacucgagcugcuucugaaacuuuuacuauugaaa

SEQ ID NO: 4123840 - RNA, 60 nt, Human
uuucagugugagugucuuauuuuaagccuagcaucggugaacuaaagugcucacaggaag

SEQ ID NO: 4123841 - RNA, 64 nt, Human
uuucaguguuaugacuuucauuccugaagggaaaauguaggagcuggguaguaauacacuggaa

SEQ ID NO: 4123842 - RNA, 56 nt, Human
uuucauaaccagcucuagccaguuguagucacagcauggagugcuguguugagaag

SEQ ID NO: 4123843 - RNA, 130 nt, Human
uuucauacuguuuaaguucuguuucaugguuuguuuucuuucagcauacacuaucaugucuggcuuaugacagaguucugcuuuccaauaaaaucaccaauagcuaugugugguucuugagcacuugaaa

SEQ ID NO: 4123844 - RNA, 66 nt, Human
uuucauaugagcaugacaccuaccauauuaagucacaaacacacgugacugucaugccagaugaga

SEQ ID NO: 4123845 - RNA, 89 nt, Human
uuucaucagaugcaccugaggcucuaaacucagucccauccucaacuaggaacauucuggcaguggggccucaguguugucaugagaag

SEQ ID NO: 4123846 - RNA, 109 nt, Human
uuucauccucauucuuuccacauuugauaaaccuaugcuaagcuguggcucauuaauaaugguccaggcuggaaaugucaaacucugcagaaggcaagagagggaggaa

SEQ ID NO: 4123847 - RNA, 79 nt, Human
uuucaucucaaaaggcuauuuccugugaaucaacucaaauucaaaugggucuguuuaggcaaaauagcuacagaugaag

SEQ ID NO: 4123848 - RNA, 61 nt, Human
uuucauguuuauggaaaaugaggacgucuuccuaguuacauauucuaugauuaacaugaga

SEQ ID NO: 4123849 - RNA, 61 nt, Human
uuucauugucagagcuuugaauaaaugggauaaucaaucacccacaaagugugacuugaag

SEQ ID NO: 4123850 - RNA, 68 nt, Human
uuucauuuccuagccucucuugcaguuagaugugggcauaugacuaagcucuagcuaguggaaugaga

SEQ ID NO: 4123851 - RNA, 75 nt, Human
uuuuaucaguuaaaucauuacugacagagauuuacuuuuauuugauguuagcagugauuugggcagcagaugaaa

SEQ ID NO: 4123852 - RNA, 56 nt, Human
uuuuaucuaccuaugcucauuuccuaugauuuuggggugaggugggugagauagga

SEQ ID NO: 4123853 - RNA, 58 nt, Human
uuuuaucuuccucugccuggugaucgaucaucagcacaacguacagagaaagauggaa

SEQ ID NO: 4123854 - RNA, 70 nt, Human
uuuuauggaaagguacagaauaaaaaguggcagauguuccccuguguacuuucuuguuccuuucauaaaa

SEQ ID NO: 4123855 - RNA, 63 nt, Human
uuuuaugugugucgcaauaguguaguuaguuaauuauagcuuucucauuagcaccacguagag

SEQ ID NO: 4123856 - RNA, 95 nt, Human
uuuuauuacuuacagcaguuaaaagguaugcuaccaaucauaugcaaaacaagaaaagauugcagaguacauuuuuuuacuggguggugguagaa

SEQ ID NO: 4123857 - RNA, 89 nt, Human
uuuuauuaggcuggugcaaaaauaauugugguuuuuaccauaaaaguaauggcaaaaacugcaauugcuuuugcaccagcccaauaaaa

SEQ ID NO: 4123858 - RNA, 73 nt, Human
uuuuauuauaggaaugcuggcccagagauaggaauauagcaacuaauugaggccaaaaaguccuaugaagaaa

SEQ ID NO: 4123859 - RNA, 130 nt, Human
uuuuauuauuacuguauugaacuuaaggacuguccugagccagacugucagagaggacugagguaucuggggagguaucuggggagguaucuguagucugacuacauggggcagcuucagauuaauaaga

SEQ ID NO: 4123860 - RNA, 62 nt, Human
uuuuauucccagguaaaaguagagcucagcauuauguaggugcugcuguccugggacuaaag

SEQ ID NO: 4123861 - RNA, 100 nt, Human
uuuuauuuacaggugucauccaacaggacaggguugaugaccuguucaacagcuugaaacguugauucccugucacaauggaugacauuuguaaguaaag

SEQ ID NO: 4123862 - RNA, 60 nt, Human
uuuuauuuauaagccacuugcugcaugacccuccaaguagaccuguggcuuaaaauaaag

SEQ ID NO: 4123863 - RNA, 98 nt, Human
uuuuauuuugauucuaugcauagguaggcccucgacgggacugguuaguguauaauccagcuuugucuggucuucgaaugcuauaguuuuacaugaaa

SEQ ID NO: 4123864 - RNA, 130 nt, Human
uuuucaaguagcuuuuguucaauguagaauucugguaacaguauaaacuccuaaaagccaggcaguccuagguuuuaauuucaguuuuuauuaguuuccagggaugcuauaacaaauugccaccuuuuaa

SEQ ID NO: 4123865 - RNA, 128 nt, Human
uuuucaaguguuuaaguucugcuuccucuuugauuaacacuucugucuuuaugucauuucucucucuugcauuuuacaauaggcagucaagagaagcaaagccucaccuucaacacuuugcuugaaaa

SEQ ID NO: 4123866 - RNA, 67 nt, Human
uuuucacaggaugcuguuuuauaauaagguauuuuaacuuauuuuauaaaucagcucugagugaaga

SEQ ID NO: 4123867 - RNA, 86 nt, Human
uuuucagaaagauuuuaagaaagacuuaaauugcaguuaccucuguguaucugguaaagcuggagaggucuuuuaucuuuggaaaa

SEQ ID NO: 4123868 - RNA, 70 nt, Human
uuuucagacaguaguaguuaaacuguguauuuguaucuaaauaaaagguuaacacuacuggcaugcagaa

SEQ ID NO: 4123869 - RNA, 80 nt, Human
uuuucagcucccgguuucuuugcagugcugucaucucuggagacaggcgcuggcagagagaaaagugcccauguagaaaa

SEQ ID NO: 4123870 - RNA, 78 nt, Human
uuuucauaggccaguguccuuucuuaaaauaacuaguaaccaaaaaacuuucaggauuauuucaguggcuuuugagaa

SEQ ID NO: 4123871 - RNA, 61 nt, Human
uuuucauauucaaauacucugcuugguuccgcauugccaagcuuguaaggagucaugagga

SEQ ID NO: 4123872 - RNA, 111 nt, Human
uuuucauggcuacucuuaagaauuuuccuuaauaguuggucuucauuaaaugcuuucuucaauuucacuggaauaguggagacugggauuuguaagaggaagcuguggaaa

SEQ ID NO: 4123873 - RNA, 82 nt, Human
uuuucauguggcagugaccaagaagccucccagaacaugaaaagcaagguugucugagggccuuggcuccugcccgugaaga

SEQ ID NO: 4123874 - RNA, 69 nt, Human
uuuucaugugggucugcacuuuucaaaccuuggugucaacuaggaacagaugggcucagauccugaaag

SEQ ID NO: 4123875 - RNA, 78 nt, Human
uuuucauuucucacugugucaugccaauuauauggcugguccuaagcaguguacaugacagagagagccaauuggagg

SEQ ID NO: 4123876 - RNA, 74 nt, Human
uuuucauuuguuuuguguguguuuguuuguuucaagcuaggagugacucaaagaugcauaaaugccaauggaag

SEQ ID NO: 4123877 - RNA, 63 nt, Human
uuuuccaaaaguuuguucugugcaauuuaagugccuuguuguaagggagaagaaauuggggaa

SEQ ID NO: 4123878 - RNA, 55 nt, Human
uuuuccacucuaugauagaaggguuaauaauaccuacaucaagggagugguagga

SEQ ID NO: 4123879 - RNA, 75 nt, Human
uuuuccagcaaacaggaaugaggagaaaaggucaaggacaucuagccuuuaucuuccugauucagauuuggaaaa

SEQ ID NO: 4123880 - RNA, 106 nt, Human
uuuuccauugucagugugauccugguuaugcuccuccagauugugagccgccaauaucaucaccaggaggaaguguuaaugauggauuuuagcuuacgguagaaaa

SEQ ID NO: 4123881 - RNA, 81 nt, Human
uuuuccauuuuguugaugaagaauugaggcccaaaauuauaaaagaaccugucuaaugucacauaucaagaaagugguaga

SEQ ID NO: 4123882 - RNA, 71 nt, Human
uuuucccauuuaaacacaagcuuucaggaugcaaugcuuuaaccuaaagagugucuuuaugguggagaaga

SEQ ID NO: 4123883 - RNA, 103 nt, Human
uuuucccccuacaugugcuuaauuugcaggaaguuuaacaucugugaagcugcucaucugacggccccagagauuaaagucuguuuauuggcauaggggagag

SEQ ID NO: 4123884 - RNA, 84 nt, Human
uuuuccccuccaagugcuauauucucucuuucuaauggaaaauuccauugucugaggguuugagagaauagcaggguaggaaaa

SEQ ID NO: 4123885 - RNA, 65 nt, Human
uuuuccucuguuauuagugugaaggcuuuuacuccccagcaauuuaucaucacuucagaggaaaa

SEQ ID NO: 4123886 - RNA, 72 nt, Human
uuuuccugccugaacccugacuacuuagauaauaucccauuuuacaaaugucaggaaguugaggcguagaga

SEQ ID NO: 4123887 - RNA, 81 nt, Human
uuuuccugucuuguucugugcuucuuacauuguauagcauaauguuuaaauguaaaguugggcacaaaugguaccugaaag

SEQ ID NO: 4123888 - RNA, 68 nt, Human
uuuuccuuagcuucucugcgaggucacuuuucaaaaauuuuagucuaucucagaaaagcuaaggagaa

SEQ ID NO: 4123889 - RNA, 64 nt, Human
uuuuccuuguugaaaaugucugcaguaaacaaauauugccugacaguuuacaacuccaggaaaa

SEQ ID NO: 4123890 - RNA, 74 nt, Human
uuuucuaaauuagcuuuccuacuaauaaauaaaauauuuuucuuaugcucggucaggaaagcuaaaugggagag

SEQ ID NO: 4123891 - RNA, 81 nt, Human
uuuucuaauaagucaaaaugaauuugugauuuaauguuccucuuauuucaaaggaauuugauuuugauguaguuuggaaaa

SEQ ID NO: 4123892 - RNA, 71 nt, Human
uuuucuaauuuaguuacccucccuguuaaauuuaguuuucuaguguaaaaaugggguacuacuuuggaaag

SEQ ID NO: 4123893 - RNA, 63 nt, Human
uuuucuaccacagccuguuucuuuuuguucgcuuuucagagaaaauaaauugaugguggaaga

SEQ ID NO: 4123894 - RNA, 78 nt, Human
uuuucucacaguucugaagacuagagccugagaucaaagcguuggcaggguugguuucuucugggggcugugagggaa

SEQ ID NO: 4123895 - RNA, 127 nt, Human
uuuucugcuuguuagguugucggaauuuugcuuuuguggaccuuuccuaucaccuuuuccugccucaugguuguaguguuccagaagcaaacaagauucccuuguugaaucuugauuuaguagaaag

SEQ ID NO: 4123896 - RNA, 76 nt, Human
uuuucuguucugcugcugcagcuacacuaucuacuuguuagcauaaccagggccaccagcaacagaugcuagagga

SEQ ID NO: 4123897 - RNA, 67 nt, Human
uuuucuuauuggcauauuuauguugaggucauuaggaauucauuucauuucuauggcaaugggaaaa

SEQ ID NO: 4123898 - RNA, 55 nt, Human
uuuucuugaauguauguauguugcuucaagucauucaugcacacauugaagagga

SEQ ID NO: 4123899 - RNA, 56 nt, Human
uuuucuugguuuauuuuucucuauuuucuucugugguagggagaauuccaagagga

SEQ ID NO: 4123900 - RNA, 128 nt, Human
uuuucuuucuauauccucuucuuuguuagagaggguugaaccuauaaacuacauuucucagucucuaguuacuugacuuuagcccugcucugccaauaagaagcacuaacauaagguuagaaggcaag

SEQ ID NO: 4123901 - RNA, 57 nt, Human
uuuucuuugucuuuauaugcugggcauuuggugccuagcaggaccaugacaagaaaa

SEQ ID NO: 4123902 - RNA, 127 nt, Human
uuuuuuccccugagucaucugugauuacauuuucauguuacaguauauuguucagggaucauuguggagacugaagagaaauguacacauggcuuuauguaggucauggugaaagacagagagaaag

SEQ ID NO: 4123903 - RNA, 63 nt, Human
uuuuuuccggaugcccagaaguuaggauuauugaagcccuauccugcuccugguuggaaagaa

SEQ ID NO: 4123904 - RNA, 73 nt, Human
uuuuuucucauuucugguuuggaaaauugaggcaaauucugggcaguagagucagaaccaagaugaggcugaa

SEQ ID NO: 4123905 - RNA, 79 nt, Human
uuuuuucucugacccccuuaaauauuuccuauauguuaaaucagauuaaaaugaagguggguacaacauugagaagaaa

SEQ ID NO: 4123906 - RNA, 105 nt, Human
uuuuuuggccuuguuuguuuaaaugauguucgggcuguuccccugauuaauaaagucguaaacacagucaggagcagcuucugaaccaugugcaaaagcaaagaa

SEQ ID NO: 4123907 - RNA, 60 nt, Human
uuuuuuguguguuccugaaggcacgauauaacgacagaaguuuuuaggaauuccaagaga

SEQ ID NO: 4123908 - RNA, 61 nt, Human
uuuuuuucaggggccuccagaguacucucucaaauuuacuucaugagagcccugaggaaaa

SEQ ID NO: 4123909 - RNA, 92 nt, Human
uuuuuuucccucuuugauccuaguuucauagauguccucugucuacuaggcagcauuuuugaucccacuaggauugagcucaaggaaagaag

SEQ ID NO: 4123910 - RNA, 64 nt, Human
uuuuuuucucucuguucuacacaacucuacuuuccgugauuuucaguggacaggguggagaaaa

SEQ ID NO: 4123911 - RNA, 57 nt, Human
uuuuuuucugauugcaugacguguaguccucuuuucuugucagcaauuaggagaaaa

SEQ ID NO: 4123912 - RNA, 60 nt, Human
uuuuuuugauuuuacuucaaguucugggauacuuuuaaggacuugcuuuugucaggaaaa

SEQ ID NO: 4123913 - RNA, 65 nt, Human
uuuuuuuuaaguucucugaaaugaaaaagucuuauagacuuguuuuuaggagaaguuauaggaga

SEQ ID NO: 4123914 - RNA, 55 nt, Human
uuuuuuuuccucugaaguccuuguccuuuauugggcaaggggugagggaagcaga

SEQ ID NO: 4123915 - RNA, 130 nt, Human
uuuuuuuuuuuuugcuaucuggauaguugacauuggacuucauguuucuauuagcucacggaaggaggccugugggaucagucuggaauauugauuccuguggggguguaugggugcaagaaaaggagag

SEQ ID NO: 4123916 - RNA, 82 nt, Human
uuugccuguuccagggauauuagagguaacuguaccaccuaggaguuaaguaugguuauuacugcuguuccagggagguaaa

SEQ ID NO: 4123917 - RNA, 84 nt, Human
uuugccuguuucuaugguuuauauuacugucaugccuauauucuugugggaguuucaaauaagaaucaagauauaacuggcaaa

SEQ ID NO: 4123918 - RNA, 62 nt, Human
uuugccuucaguuuggcuuaauaucauucaccauuuuagauagugggauacuggaagguaga

SEQ ID NO: 4123919 - RNA, 109 nt, Human
uuugcuacaaagcuuucuuaaggugcuacuaggcauagaugacauccacaaccuaaaagaagagugucagugccuuggguauuuugaguauguguuuacauugugcaga

SEQ ID NO: 4123920 - RNA, 76 nt, Human
uuugcuagcugcuguggauucagagaugaaaagacauaguuccuuuuauucacagaauuuacaggagugauacaaa

SEQ ID NO: 4123921 - RNA, 61 nt, Human
uuugcuaggagcucaucugagggaagagacacagaccuucccuggagcuagucugagcaga

SEQ ID NO: 4123922 - RNA, 57 nt, Human
uuugcucugacaugccccagcauguuuuaggauagugguuggauaugucagagagaa

SEQ ID NO: 4123923 - RNA, 107 nt, Human
uuugcugcuuguuuuucaagugugagucuacugaugcuauacuucucagauuuuggaaaaugucuguagcuaguaucagcaugguaauaaugagaaagaccagcaag

SEQ ID NO: 4123924 - RNA, 97 nt, Human
uuugcuggaauuuucuacucagcccauagaagugaaagaauacaaaaagccaguuuucucuuuggaggggcugaauggagagaagaguuucagcaaa

SEQ ID NO: 4123925 - RNA, 70 nt, Human
uuugcugucuaggagaggacaaauagaaagggguugacaugcauccaacugccucuucucuggcagcaga

SEQ ID NO: 4123926 - RNA, 72 nt, Human
uuugcuguggguccuccugugugcccggcccuguccuaagugcugggaagauaugagugaccaacagacaaa

SEQ ID NO: 4123927 - RNA, 99 nt, Human
uuugcuguuguugcuuuuuaauuaggaggcagaggaauaaacuucuguuaccuggaauugcccccuaaguggaaaacauccuuugccuacaauagcaga

SEQ ID NO: 4123928 - RNA, 67 nt, Human
uuugcuucaaaaggcagcuuaaugucaucauugacucccugaaucauuuucugccuuuggaaccgag

SEQ ID NO: 4123929 - RNA, 58 nt, Human
uuugcuucaucucaugcugccuccccaccuccccugugcucaggccagaugaggcaag

SEQ ID NO: 4123930 - RNA, 77 nt, Human
uuugcuuuccucaggacuuucaaauagaaauguuauuaaauauuuccuuuuugucaguguuugcacuugaagguaaa

SEQ ID NO: 4123931 - RNA, 59 nt, Human
uuugcuuucugacggguacauaugacuaaguauauacaccuguuuucagaaaaugcaga

SEQ ID NO: 4123932 - RNA, 110 nt, Human
uuuggaaggauaaaaugagauuggacagguauuaugaagccuauuuuacagauggaaaagcuacuacucauaaaucuuccugaaauuuguucaaguuagucuuuuccaaa

SEQ ID NO: 4123933 - RNA, 55 nt, Human
uuuggaauagcauagaagcucaucuguauaacaagaguuaauaugguguuucaaa

SEQ ID NO: 4123934 - RNA, 64 nt, Human
uuuggaaugaaaucaacuaggagacaccauggggaaucguuguccugagucugauuucucugag

SEQ ID NO: 4123935 - RNA, 88 nt, Human
uuuggaauggacuccuguucauguugaggcauagggacuugguuugacgucuguuacucuacccucaaaugaauaguaugucuccaga

SEQ ID NO: 4123936 - RNA, 77 nt, Human
uuuggagaugaagcuguuuauuuuagcagccccuaaacaggcuuaugcugcugcgaauugcagucuguucuaccgaa

SEQ ID NO: 4123937 - RNA, 129 nt, Human
uuuggagcucugccuaauuuuuugcguuuuucuuugacuccugccuucuccuguuuugcaguggguggaaacaacagguguagcaggagcaucaaauggagaaucaggagaucccaggucugguagaaa

SEQ ID NO: 4123938 - RNA, 96 nt, Human
uuuggaggagacagaagacuuguaacauugaguccacuaaacagggugucaccuguugaugagcacaaaguugaaggucuguccagucaccccaga

SEQ ID NO: 4123939 - RNA, 76 nt, Human
uuuggaggcuagaagucagaggucaagaugucuuuauagcuggcuucuugugacaccuuucuucuuggcuuguaaa

SEQ ID NO: 4123940 - RNA, 71 nt, Human
uuuggaugcugucauaugcugcuuugagugaaccagagaaacagccauuugcagcaugagaaagccccaaa

SEQ ID NO: 4123941 - RNA, 117 nt, Human
uuuggauggauugaguuauguauuauuguuaccauuuuauaaguuaaaguauggaaauucaaguaguuugcucaaguuaggugggaaaaccaugauuauaacuuaguucuuucugaa

SEQ ID NO: 4123942 - RNA, 82 nt, Human
uuuggauuuuauucugguggcaaugaggcgucacugaaagaauuucagcugaggcaugaugcuaucagaugagagauuuaga

SEQ ID NO: 4123943 - RNA, 65 nt, Human
uuuggcacauucugucacauucuaccugaaaagaggguuuucugacugauagauugugaaccaaa

SEQ ID NO: 4123944 - RNA, 107 nt, Human
uuuggcagggugcguggcucauaguaagugcauaauaaauguuaauuauuuuuauucauuuauuaaauacuuacugagagucugcuauguccaggcaccaugcuaag

SEQ ID NO: 4123945 - RNA, 62 nt, Human
uuuggcagguggauggcauggggagagcccuuucagacaguggguccauccaucauguuaaa

SEQ ID NO: 4123946 - RNA, 55 nt, Human
uuuggcugcagccccagcauuuccuucagauuauugauggaguucugcagucagg

SEQ ID NO: 4123947 - RNA, 72 nt, Human
uuuggcuggcuagugggcaggauuaugucugagaaaaccuccuuuuaaucaaucugaugcuugccagccaag

SEQ ID NO: 4123948 - RNA, 120 nt, Human
uuuggcuguaguauaucauaacugugaguucugugagucugccuagcacaucaccaaaucuggggauggacuuggggacuccaggcacagaaccauaacuggaauagacuuacaggugaa

SEQ ID NO: 4123949 - RNA, 65 nt, Human
uuuggcuuguaaaaugaaaagcuaucaagcugaauugccuugaaaguuuuauauuauaagcuaaa

SEQ ID NO: 4123950 - RNA, 130 nt, Human
uuugggaauauaguuaaaaggguuaugugauuguuuuuagguacauuuuaaguguugacuaauaaaaggcaaauaucagaacaaaagaacaguuuaacguagcauuuucaaaaccuuucggcauucuaag

SEQ ID NO: 4123951 - RNA, 130 nt, Human
uuugggaaugguggagucucaguuuuccugggaaacaaguuuguagacuagccauaaaaacagcaaacccuucugcaggugucuguucauacaaacauuauuguuuuccagaaggaaguggaacccucug

SEQ ID NO: 4123952 - RNA, 65 nt, Human
uuugggagaggaauagcucaaauuaguuccauaagcaaauugggaaauuucucuagcucuccaaa

SEQ ID NO: 4123953 - RNA, 76 nt, Human
uuugggaggcugaggcaggaggauugcuugagcacagaaggugacucgcucccuuuugucuuauuuccauccugaa

SEQ ID NO: 4123954 - RNA, 59 nt, Human
uuugggauugauaaggaauaccagaaggaacccugaguuuuucucuaaguagucccaaa

SEQ ID NO: 4123955 - RNA, 62 nt, Human
uuugggcaguccuggaauuuguggacuuugaugaagucaaacagaaucucaggcuacccaga

SEQ ID NO: 4123956 - RNA, 68 nt, Human
uuugggccuugcuggacaaggagcugaggaagaacucuggaguccuggaaucagcuacugggccuaga

SEQ ID NO: 4123957 - RNA, 58 nt, Human
uuuggggaagagacauuuguaccugauucaauauaggcuuguuugugauuucuccaga

SEQ ID NO: 4123958 - RNA, 81 nt, Human
uuuggggacacugauauucuugaaaucaugguuuaauuuugcucuuuuaccuugaacacaagaauuauugcuugccuuaaa

SEQ ID NO: 4123959 - RNA, 59 nt, Human
uuuggggacauuuaucaacuacuuccaagugaagagugauuguaucagugucucccaaa

SEQ ID NO: 4123960 - RNA, 75 nt, Human
uuuggggaggagcaggaaguggugaaguugauagaaggcccaacccacucuaccuggcuccauggaaucccugaa

SEQ ID NO: 4123961 - RNA, 59 nt, Human
uuuggggauugugagaagacuguaucauauguguguaacagucucuuggaauuuucaga

SEQ ID NO: 4123962 - RNA, 55 nt, Human
uuuggggcauggggaguuuucaacagugcccagaaaauucuaacaugcagccaag

SEQ ID NO: 4123963 - RNA, 81 nt, Human
uuuggggguauuucuuuggggagaucagaaaguggguuuagauuaccaugauuacuuucugccuuacaggagucccuugaa

SEQ ID NO: 4123964 - RNA, 97 nt, Human
uuuggguuuaguaguccuggaggagccaggagggaaguccagguagucugauuccacugucuguccugcucuccgugaccuuaaacugucucccaaa

SEQ ID NO: 4123965 - RNA, 84 nt, Human
uuugguaaccccaggaaaaggagacuuuagcacugagcaccuccuccuucagcugccacgagguuuccuuauccguccuccaga

SEQ ID NO: 4123966 - RNA, 123 nt, Human
uuugguaaguaauucagggagaauaaauuaucaccagacuuggguuuugguaacuuaaguguuaaaguuagcaaauaccacaaucugcauuugauuucugugcuuuuccuguuauuuaccaag

SEQ ID NO: 4123967 - RNA, 62 nt, Human
uuugguacccuuggaacaguugaugauuguccaaacacaaaaauucucaggggcauacuaag

SEQ ID NO: 4123968 - RNA, 76 nt, Human
uuugguaccuugcuccagcuucccucagcuguggaaaggauucauuuggcuguauggcuggucucaugguaucaaa

SEQ ID NO: 4123969 - RNA, 86 nt, Human
uuugguauuuaaaagguagauucuccuucuaugaguacauuauuuaugauuaaucauagaggaaaauccacguuuucaguaucaaa

SEQ ID NO: 4123970 - RNA, 78 nt, Human
uuuggucaaacauuuugagugguuucugugagaauguuuuuguaugagauuagcauuuaaauccauggacugacuaaa

SEQ ID NO: 4123971 - RNA, 78 nt, Human
uuuggucaauagauucucccaucaugagauguucccaaacaguaacaaugguaauauuucgaugggaucugaaccaaa

SEQ ID NO: 4123972 - RNA, 56 nt, Human
uuugguccugggcacugauuaacuugacauaaaagcagugaaacaauaggaucaaa

SEQ ID NO: 4123973 - RNA, 59 nt, Human
uuuggucucugugcauccuccuagcacaccuuaauggcacaugauguauggaggcuaaa

SEQ ID NO: 4123974 - RNA, 63 nt, Human
uuuggugccacaagaauacaaagcagagaauuucuaggcugauuugauuacuaguggccugaa

SEQ ID NO: 4123975 - RNA, 61 nt, Human
uuugguggaccucaucagaaccggacauugcugucacggauuugacugagguccugccagg

SEQ ID NO: 4123976 - RNA, 60 nt, Human
uuuggugggaaggcaagaugaccagcuuuugaguugaguccagcucugccucuuacuaga

SEQ ID NO: 4123977 - RNA, 59 nt, Human
uuugguucuuagacaaguaaccuuaguuccacugaaggaaaauuaucaugagagccaaa

SEQ ID NO: 4123978 - RNA, 59 nt, Human
uuuguaacauuauggacugcuuuucauggcuuauaauaaagcagugccaucuguacaaa

SEQ ID NO: 4123979 - RNA, 69 nt, Human
uuuguaauauauucagccuucaguuagaguguggauuaaauuugacuucugauuaaggaugaaugcaaa

SEQ ID NO: 4123980 - RNA, 91 nt, Human
uuuguacagugaaaggagcuuuuccuuugaaaggugagggcuuccaacaugaaguuaccuuagcaggggugaagauucuacauuggacaag

SEQ ID NO: 4123981 - RNA, 60 nt, Human
uuuguagacagaauaucauguuccuuguucccaaggucuagcugaaaaguuguuuacaag

SEQ ID NO: 4123982 - RNA, 77 nt, Human
uuuguaggauguguuuugguaauuucugcuuugcaugaguaaauuucagaucccuguuuucaagacaaucuugcaga

SEQ ID NO: 4123983 - RNA, 120 nt, Human
uuuguauauagauagauagaaucuuuagcucaguguucauuuugaaguacuucaagguuuagccugggagagaauuuuaggggaagaugcugcuguugauguaucugcucuauauaugga

SEQ ID NO: 4123984 - RNA, 69 nt, Human
uucucucuguuauggauuuuacuguuuauauuaauuuacuaacauuuuagugagguucaagagggagaa

SEQ ID NO: 4123985 - RNA, 62 nt, Human
uucucucuuacuugcucacucugaugaaacaaguaccauauuggcaagcaacugagggagga

SEQ ID NO: 4123986 - RNA, 70 nt, Human
uucucucuucaguuucccuaaagccaauuaggcacucauaauugccauuugggaaauggauuugggagag

SEQ ID NO: 4123987 - RNA, 76 nt, Human
uucucucuuuccagguaucaagcuucaggccagcaugggcugggaucucagcaacaggugccugugaaggggagaa

SEQ ID NO: 4123988 - RNA, 55 nt, Human
uucucugacagccacauagaggcuuugccaaccugaagcagggcugucagcagaa

SEQ ID NO: 4123989 - RNA, 69 nt, Human
uucucugaggacauugagacuggagacuaagaucaacaggauguuuccacgucucaguuccaaagagag

SEQ ID NO: 4123990 - RNA, 72 nt, Human
uucucugccccuaaacaugcaagagcuucuggguccucugaaggccacauacaagccauggggggaugagaa

SEQ ID NO: 4123991 - RNA, 58 nt, Human
uucucugcuuaugcccauccugucugugguuaucaccaggccaggguugagaagagaa

SEQ ID NO: 4123992 - RNA, 57 nt, Human
uucucuggagaguaucuucuuaucuguugugagagaauugagauuuucuccaaagaa

SEQ ID NO: 4123993 - RNA, 56 nt, Human
uucucugggaucuggcaaaaggaauucagaaacuguaucagucagaucugcaggag

SEQ ID NO: 4123994 - RNA, 109 nt, Human
uucucuucuuucggcaaugacuuaaguaacuuugcuuuuguggguaaaggccuuggggcauuuuugucacaggaggagggaucugggcuugucaguuuggagaagagaa

SEQ ID NO: 4123995 - RNA, 60 nt, Human
uucucuugcaguuuugcaugaccacguaacugaguucuggacaaugcacauguaagagga

SEQ ID NO: 4123996 - RNA, 80 nt, Human
uucucuugucauacagauggcucucuucuugguggugccccagcccacccucaagggugucuauaaguaggagaagagaa

SEQ ID NO: 4123997 - RNA, 104 nt, Human
uucucuuguugggugguucuguuaggagaggaggcucugggaucgucccguugggcacaggauguucugggguucucuuguuggaugguucugcugggagagga

SEQ ID NO: 4123998 - RNA, 81 nt, Human
uucucuuugcuccucucugcuugguguaugugagucuaugugugacggggugugugagagcagaauugaggggugaaggag

SEQ ID NO: 4123999 - RNA, 58 nt, Human
uucucuuuuaccacaauaaucaucacaaauaauccuguuuggaagguggagaagagga

SEQ ID NO: 4124000 - RNA, 56 nt, Human
uucugaaagaauaagauguuuacagugccauuuggagcuguuggcuucucuuagaa

SEQ ID NO: 4124001 - RNA, 71 nt, Human
uucugaaagcucugcuggucaaggcugggucccugccugucugauuggggaggccuggccagucuucagga

SEQ ID NO: 4124002 - RNA, 55 nt, Human
uucugaaauguugagaguccauuugugagacuggaaacuuggaacgucuucagaa

SEQ ID NO: 4124003 - RNA, 57 nt, Human
uucugaagcucccuuuuguaguuaagaguuaaaagucccgaggcgagcucuucagaa

SEQ ID NO: 4124004 - RNA, 58 nt, Human
uucugacagucucuucuuuagcuugaauucccaaacaggcuccuagggauuuuuagaa

SEQ ID NO: 4124005 - RNA, 66 nt, Human
uucugagaaauggguucacauacacccugcccucuaagaauggcgaguuguggagcucacucagga

SEQ ID NO: 4124006 - RNA, 56 nt, Human
uucugagcaagcuggacagucugagaggcaguuccuccagcucuuauguucaugaa

SEQ ID NO: 4124007 - RNA, 63 nt, Human
uucugagccagagucaguuaugaggaugguggcacccguuacaagauugaguuauggcuggag

SEQ ID NO: 4124008 - RNA, 91 nt, Human
uucugagggggcaaaacaucuacaggagaaugucacuggaucauuucaaaaaucuauguguauuugauucuaggacuaugucucuucagaa

SEQ ID NO: 4124009 - RNA, 55 nt, Human
uucugagguagccacucacugggugccagaaaacccugagccuguuuauccagaa

SEQ ID NO: 4124010 - RNA, 79 nt, Human
uucugaucuuaacacucaugcucagcuggugcucuaauacucaagagcaggagaaagaguaugggcucugugguuagaa

SEQ ID NO: 4124011 - RNA, 73 nt, Human
uucugaugagagaggugcuagccugaccugaacaggagaugcugacaggcagugcugggcauguugcacagag

SEQ ID NO: 4124012 - RNA, 62 nt, Human
uucugaugccuguuccugccagauugcugggcacugcccuggagugugacgaggcauuagag

SEQ ID NO: 4124013 - RNA, 68 nt, Human
uucugaugcugaccuuuacacucacauggaaaauuuccaggcugugcaauuaggguaagacauuugaa

SEQ ID NO: 4124014 - RNA, 88 nt, Human
uucugauguuggugaguguugaauaucguguucuuguuuuuuaaaaguaugaauccaggaguuauuuagcaaaagcaugacaugagga

SEQ ID NO: 4124015 - RNA, 55 nt, Human
uucugcagugugcagggccuguuucccuccucaagcccagcccauucaugcagag

SEQ ID NO: 4124016 - RNA, 64 nt, Human
uucugcaucuggcugugccuuguuucgaaauauaauggaagcaacacugccuucaggugaagaa

SEQ ID NO: 4124017 - RNA, 82 nt, Human
uucugcaugugccuguguguuuuguauguaaauucgaucagcaagaucagucauuucacaaagaacagaugcagguguagga

SEQ ID NO: 4124018 - RNA, 67 nt, Human
uucugccagggcggggcaggcaggccugggggcagaggcgggccuggccucuccccaccuggcagaa

SEQ ID NO: 4124019 - RNA, 72 nt, Human
uucugcccaguuugugcucagguuguggagacaaggcuuccuacgagaugcacacacagaaauuuggcagaa

SEQ ID NO: 4124020 - RNA, 57 nt, Human
uucugccuuggcagggugguccugagaguggugggugccacccuguccggggcggag

SEQ ID NO: 4124021 - RNA, 64 nt, Human
uucugcuaccuuucuguaccuuaaggaacaaucauucaaggcauuuuacagaacuggaguagaa

SEQ ID NO: 4124022 - RNA, 111 nt, Human
uucugcuguguaguuuuacauggucccauucugcguuaauguuuuaugcaugagguagccuggcuggauuuaaggcagagagggccaguucuugaaccugagauagcagaa

SEQ ID NO: 4124023 - RNA, 77 nt, Human
uucugcuuguauuagguuggugcaaaaguaauugugauuuuugccauuacuuuugcaccaaccuaauagaauaugaa

SEQ ID NO: 4124024 - RNA, 68 nt, Human
uucuggaaaaacuuccaacccagaagccuaaauacaguuuggaugcuuagguuggugagacuucagag

SEQ ID NO: 4124025 - RNA, 76 nt, Human
uucuggaaguguucacauuacaaggccauauuugaauaaccccauuacaacggccuaauaaaugugaaggucagaa

SEQ ID NO: 4124026 - RNA, 67 nt, Human
uucuggagcagauucaagcagcaaauauuuacugaacacuugcuaugugcuggaaauuguucuagga

SEQ ID NO: 4124027 - RNA, 64 nt, Human
uucuggaguucaggucccuaaaccgcuuuccucaauuuugagagaaggggcacugucucuagag

SEQ ID NO: 4124028 - RNA, 59 nt, Human
uucuggaucaugggaaagggaucaguaugcaguaacgugguaagguuccagaucuagaa

SEQ ID NO: 4124029 - RNA, 74 nt, Human
uucugggaauuucuaaggugagguagaaaaucuucagcaaggaggaaaccuauauagucuuagaagccaaugaa

SEQ ID NO: 4124030 - RNA, 81 nt, Human
uucugggaccugcuguggcugaagaugcagggaugggucaaugcaguccguaccugggagggcuucagucuagugggagaa

SEQ ID NO: 4124031 - RNA, 104 nt, Human
uucugggaguacauuuuuuaggggagaguaagaaagggcacaguugcuucucagguagcgugagguugagagcccaggauucuuucuuccuuaagaauccagaa

SEQ ID NO: 4124032 - RNA, 57 nt, Human
uucugguauagaaaaugacagggccuuguucaggcuucucagaagucugugccagga

SEQ ID NO: 4124033 - RNA, 76 nt, Human
uucuggugcaccgugaagcuugagaacuacuguccuagaauaauuccaggaugucuucaagcucagugcaguagag

SEQ ID NO: 4124034 - RNA, 100 nt, Human
uucugguuugagguuacuaaaaguaaagcugcugugaacauuguuguaccaaucuuuguauacacguaccuuuucuuuucccuuaaguaacuaaguagaa

SEQ ID NO: 4124035 - RNA, 68 nt, Human
uucuguauauuguaaagacucaacaccuuacuaacuggcuuugugaguaacucuacauauguacagga

SEQ ID NO: 4124036 - RNA, 90 nt, Human
uucuguaugcucccaugacccuggcagguagccucacaguccacgcagauugugacgguaucugccagggucaugggagcauuaagugaa

SEQ ID NO: 4124037 - RNA, 60 nt, Human
uuuuccucuguauuugaaaugcuuugaaagcuacaagauuuccuagauacagaagggaag

SEQ ID NO: 4124038 - RNA, 62 nt, Human
uuuuccuguuguaugucuuaauuuuaaaaauaaagaacuaaggcaugcuagcaguaugaaaa

SEQ ID NO: 4124039 - RNA, 129 nt, Human
uuuuccuuacauuauaauuuuauguguucaugaugcuaaccauuuggauauuuggaagcauauggaagguugaauauuucacuuuauauccagauguuugguguuauucaauacugauauauaggaaaa

SEQ ID NO: 4124040 - RNA, 78 nt, Human
uuuuccuuaucccuauugcuggaacagaaugccaagacaugacauguauggcuucccaggaaaggagaagugggaaaa

SEQ ID NO: 4124041 - RNA, 83 nt, Human
uuuuccuuuacuucuugucucaugccuauucccaugcuuguuagcauuuccaccuauaggugagcaacagaaggaagggaaaa

SEQ ID NO: 4124042 - RNA, 65 nt, Human
uuuucguccacagucuauuuuuagucuauuauuuagauagaauaauaucuauccuguggugagaa

SEQ ID NO: 4124043 - RNA, 100 nt, Human
uuuucguguuagucucuccugcugaacugcaugugucuuagggauuguaaguaugccaucuguguauagcaguuuccagucuagugcaugacacugaaaa

SEQ ID NO: 4124044 - RNA, 68 nt, Human
uuuucuaacuguuccuauggggaggcgaaucuguaacaagcuccucugccuuuagugaaaguugaaaa

SEQ ID NO: 4124045 - RNA, 69 nt, Human
uuuucuauuaugaggggcagagggcaucucuaggaaaggagaugccaacugaauuuccaugauagagaa

SEQ ID NO: 4124046 - RNA, 68 nt, Human
uuuucuauucaacuugacuguuucaccagcuaaaacuggugaaugauuugaaaguugaguuuugaaag

SEQ ID NO: 4124047 - RNA, 76 nt, Human
uuuucugaaagagcauuuuguaaaauccuugcuuccuuucaauuuaagugguuucuuagaauguuuugcuagaaaa

SEQ ID NO: 4124048 - RNA, 64 nt, Human
uuuucugaaagugacauaccuuacauauguuuguugagguugcaagcauaggauguccagaaaa

SEQ ID NO: 4124049 - RNA, 77 nt, Human
uuuucugauuuagaaucuuuaaaauucauaguuguuuuuacagucugagauuagggaagauuuuaaaguagugaaga

SEQ ID NO: 4124050 - RNA, 71 nt, Human
uuuucuggggaaggauaugauuagacuaaugaaauaauggaauuaggcuuauuugucuuuccuacagugaa

SEQ ID NO: 4124051 - RNA, 64 nt, Human
uuuucuguacaauuauuuaaauggugaaaccaauguuucuaucaucuagaugaugguuagaaaa

SEQ ID NO: 4124052 - RNA, 78 nt, Human
uuuucuguuuccucauuuaucuguugggaagcuaacugugaccuuagcgucccagcagauaaaugaggaaacagaaaa

SEQ ID NO: 4124053 - RNA, 86 nt, Human
uuuucuuagcauaaguauuuuaaggcugcccguguaucuccagauagauuugacagcagauaaaauaaaauuaucuaauuagaaaa

SEQ ID NO: 4124054 - RNA, 73 nt, Human
uuuucuuaugugcagcuauauguugucccacugauguguagggcuagagugauagcaguggauguggagaaag

SEQ ID NO: 4124055 - RNA, 59 nt, Human
uuuucuuccagcuguaggaccuagggccagcucuuuguuagccaucagcuggaggcaag

SEQ ID NO: 4124056 - RNA, 85 nt, Human
uuuucuuccuguccaccugaagcagcacuaaugggccccagaaaccuucuggaguguauugggucugcuggcgacaggcagagag

SEQ ID NO: 4124057 - RNA, 98 nt, Human
uuuucuuggcaaguccaaacccuggggcugcucugccuggugguccgaggcgagggggacagagcgagcgccccaggacggcgacuucccacggagga

SEQ ID NO: 4124058 - RNA, 91 nt, Human
uuuucuuggcuguuguucaugcuugcugccucauuguuccaagauggcugacaaagaagcaagcaucacaucuucauucgggccagggaga

SEQ ID NO: 4124059 - RNA, 84 nt, Human
uuuucuuguguagcucggaauggaacaacagcggucccuuucauugacaaggcauccuccaucuccaucggacugccaagagag

SEQ ID NO: 4124060 - RNA, 55 nt, Human
uuuagggcuggaggucuucaaugguauacaccaugagguaaagaucagcuuuaaa

SEQ ID NO: 4124061 - RNA, 130 nt, Human
uuuagucaaagcacagcagaacaauguggaacacaagguugacacuuuuucaggugucuauaagaagcucacagauaaggauguuaauuuugauuucccauaguuuccguuguaaacaaaaaugacuaaa

SEQ ID NO: 4124062 - RNA, 64 nt, Human
uuuagucgguucagggucacccaguaguguugcucugggcugcggaugucuuuggaccacugaa

SEQ ID NO: 4124063 - RNA, 56 nt, Human
uuuagucuuuggguugugggugggcugcaagcccugcuggcuuccugagggcugag

SEQ ID NO: 4124064 - RNA, 130 nt, Human
uuuaguggaggccaaaaccagguuaagacucagucaccucauuaguaucuuguuuaggcaccuccaauuuaguagcuaggcaaaguauuaaugagugacugauuuuuaaucuacuuuuggcucuagugaa

SEQ ID NO: 4124065 - RNA, 62 nt, Human
uuuagugugaaagcagccauagauuaauauauaaaugaugaacauggcuguguuccaguaaa

SEQ ID NO: 4124066 - RNA, 68 nt, Human
uuuaguuccaauucaugugagcggacucuucucuaaguggaagauuuuggaacaugaaauggacugga

SEQ ID NO: 4124067 - RNA, 79 nt, Human
uuuauaaugaaaagagguuuaacugacucacagcuccacauggcugaggaggccucacaaaaccuacaaucauggugaa

SEQ ID NO: 4124068 - RNA, 55 nt, Human
uuuauaccccaccuggggcaagccauagacagugauuggcagugugggguaugaa

SEQ ID NO: 4124069 - RNA, 129 nt, Human
uuuauauauaauacacacaugcauguauaauacauauguagacaucuagauuuauguguguauguaucuacagauauaaauacagaugucugucuguauguacacaugcauguauaauacauauauaga

SEQ ID NO: 4124070 - RNA, 86 nt, Human
uuuauauuugaguaucuuauugcccugaggcacuccauccauugaaauaaugguuucugugcuuuagggggaagaacagauaugaa

SEQ ID NO: 4124071 - RNA, 74 nt, Human
uuuaucagaagcagaacacuagauuuaaaggcuuuccaaagccuaaugaguaaguccaguguucucucugugaa

SEQ ID NO: 4124072 - RNA, 66 nt, Human
uuuaucagagauauguguggacguaugcauuuagauagaaauauucuacuacauaggucugguaaa

SEQ ID NO: 4124073 - RNA, 57 nt, Human
uuuaucagaguccccaaaagaaauagaaggcuauuucaaguggggacauuugagaag

SEQ ID NO: 4124074 - RNA, 73 nt, Human
uuuauccagucuaccauugaugggcauuagauugauuccaugucuuugcuauugugaguagugcugcaaugaa

SEQ ID NO: 4124075 - RNA, 59 nt, Human
uuuauccaguguuggaauuuuuccugcuuuuuagauuaguucaagcaaugcuggaagaa

SEQ ID NO: 4124076 - RNA, 61 nt, Human
uuuaucgggugcccucauauagugagcaaucuauacaacugugcaugguauccuugaugag

SEQ ID NO: 4124077 - RNA, 60 nt, Human
uuuaucuuguagaaagaucauucuggcugcuaagcagagaauggcuuauacagaaguaag

SEQ ID NO: 4124078 - RNA, 57 nt, Human
uuuaugacaagcauuacugauuuuccauuucuagaagucagagaauguuuucaugga

SEQ ID NO: 4124079 - RNA, 59 nt, Human
uuuaugaucuucugucuaaucauguuaucagagaugacugugcaagcagagagcauaaa

SEQ ID NO: 4124080 - RNA, 60 nt, Human
uuuaugauuuagaaagauucacugagagaaaaauacuuaguguuuuuuuaaaucugugga

SEQ ID NO: 4124081 - RNA, 118 nt, Human
uuuaugcaguagaaaccugaaugccuuucaacuacauacaggcgauggauaaaaucagugauguacaaauacauccccuguauguaguugaaaggcauucagauuucuacuguguaaa

SEQ ID NO: 4124082 - RNA, 75 nt, Human
uuuaugguaacuugcaaggaguuaauguacugugaauucauucuuguacauugauuucugcauuagcuccgugaa

SEQ ID NO: 4124083 - RNA, 90 nt, Human
uuuauguguuuauuugcucagaaaguauuuaaguccauauuuuuuugucgaaacuggaaauugugcuuuguuaaguguaaacaacauaaa

SEQ ID NO: 4124084 - RNA, 85 nt, Human
uuuauuaaagggucgggaaagggaggaacacaugggggcuuuagggggcacugauaauguccucucucuuauccuaugugauaga

SEQ ID NO: 4124085 - RNA, 108 nt, Human
uuuauuaauagcuugauuguuacuaggauuuugaaaacgugggcucuguggcagggagacaugcacacacaguucuaauuaacaccaaucacaaacgcuaaugguaga

SEQ ID NO: 4124086 - RNA, 67 nt, Human
uuuauuauagugguggggacugcuauugccucccacaauaucuuucacucccuucuauaguaauaaa

SEQ ID NO: 4124087 - RNA, 63 nt, Human
uuuauucuuuucuguauuuaggacagguggaggaguuucacacugaugugcagaaauagugag

SEQ ID NO: 4124088 - RNA, 85 nt, Human
uuuauugaacuauuggucaucuuuaacaauuuacaauguauucauuauaaaguggaaguguuaaagggguuuuuggaggaauaag

SEQ ID NO: 4124089 - RNA, 59 nt, Human
uuuauugacccaaagcgagagucaauauuuaccuuggcucucacucuauggucaguaaa

SEQ ID NO: 4124090 - RNA, 69 nt, Human
uuuauugcugagaaggauuccauuguauggauauuccacauuuuguuuauccauucuccgguuaaugag

SEQ ID NO: 4124091 - RNA, 87 nt, Human
uuuauugggcuggugcaaaagcaauugcaguuuuugccauuacuuuuaugguaaaaaccacaauuauuuuugcaccagccuaauaaa

SEQ ID NO: 4124092 - RNA, 96 nt, Human
uuuauuguagugaauauguuagaguguagcaggaagaggcaauauauucaauacuggucuuuuccuuuauuauuucacuuauauuuaagcaaugga

SEQ ID NO: 4124093 - RNA, 71 nt, Human
uuuauuguugcaaguuuuauaggcagauuaaugggaagcagccccagucuuauccugaaaacaacaauaaa

SEQ ID NO: 4124094 - RNA, 61 nt, Human
uuuauuguugggucuuaagcugaguuuacacacuuggugucagaaugauuccggcaaugaa

SEQ ID NO: 4124095 - RNA, 77 nt, Human
uuuauuuauaaacucucugcugcugagcuuggggccuggagccccaggaaugagcaggcaggggagacugagaugga

SEQ ID NO: 4124096 - RNA, 59 nt, Human
uuuauuucucugugcuugacuuucccauuuauaaaauggggauggugauaggaaauaga

SEQ ID NO: 4124097 - RNA, 86 nt, Human
uuuauuugauaguuaaugauagggagaggggugauagaacaaauggguauuaucuuuucuucuuuccuauaauuaauuaaaaugaa

SEQ ID NO: 4124098 - RNA, 76 nt, Human
uuuauuugcuuacuguccauugguauauuaggguucuccagagaaacccaaccaacuggauagauagauagauaga

SEQ ID NO: 4124099 - RNA, 92 nt, Human
uuuauuuuagggacauaauuaggcaguugaucauucgaagcuaaugcuuuacuaauaaugagcuugucuaauuguguauuccacagaaugaa

SEQ ID NO: 4124100 - RNA, 93 nt, Human
uuuuguucuuucgguccuguacuugaugagauagaaacagaugacaagaaaacguguugauauuggaauuuaguuagagaauuaagaacaaaa

SEQ ID NO: 4124101 - RNA, 66 nt, Human
uuuuguugcaaucuuaggguucucacuauuuuaacauuagcuuagaacauguggauugcaaaggaa

SEQ ID NO: 4124102 - RNA, 60 nt, Human
uuuuguuugcuucagugcauugcagagcacacccaugcaguguguuuggagcgagggagg

SEQ ID NO: 4124103 - RNA, 81 nt, Human
uuuuguuugggacuuguggaugcaguguauuaggauggaggcgggauuuucuuaaugcuuaauuuucacaagccuccaaaa

SEQ ID NO: 4124104 - RNA, 89 nt, Human
uuuuguuuuccuguguucaccugcugucugcuuguucuuaguggcagauggagggagaguagauaucagguguauuauggagcacagaa

SEQ ID NO: 4124105 - RNA, 85 nt, Human
uuuuuaaaguacguaugcccaggccccaccccagacuaagucagaaucucugggaaugaggcuugggcaaugacauuuuuaaaaa

SEQ ID NO: 4124106 - RNA, 62 nt, Human
uuuuuaaauaugcuuuuggcuucgaguggcaauaacuagauucaagacagcauauuuaagaa

SEQ ID NO: 4124107 - RNA, 58 nt, Human
uuuuuaagccucuugguuauuaaauuacuuugcagauaacugagccgaggcuuaagaa

SEQ ID NO: 4124108 - RNA, 84 nt, Human
uuuuuaauuaacauauuaauuaacacauauuuggagagcuacuaauguaggccugguacuguguuaauaagaguuaauugaaaa

SEQ ID NO: 4124109 - RNA, 89 nt, Human
uuuuuacagagcacugauuggugcauuuuacaaaacucuagcuagcuacagagugcugauuggugcauuuuacaauccucuuguaagaa

SEQ ID NO: 4124110 - RNA, 81 nt, Human
uuuuuaccguauucuaaucaguuuaacugucaagagccaccuguggcuaguggcuaccaaauuggacagagugguuuuaga

SEQ ID NO: 4124111 - RNA, 92 nt, Human
uuuuuagcaagaaaugugguuacuguuggccaccacagucagaaccagaggacaccaugcuggcuaauggaaaccagaugcucugguaaaga

SEQ ID NO: 4124112 - RNA, 66 nt, Human
uuuuuauacuuugcucaagauucacauucccccaaagagggaguccaauuggucagaguaaagaaa

SEQ ID NO: 4124113 - RNA, 81 nt, Human
uuuuuaucagucaagguccuugaggaaacagaugugaccaauagguuacagauggcacacucaaggggugauugaugagaa

SEQ ID NO: 4124114 - RNA, 73 nt, Human
uuuuuaucugaccucacuucuuaauuuagcuccauuucagaucccuugcuaaguuagaagggccagaugaagg

SEQ ID NO: 4124115 - RNA, 61 nt, Human
uuuuuauuggaugcauaccauacaucagggacucuuucaagugcugggcaugcaguggaaa

SEQ ID NO: 4124116 - RNA, 81 nt, Human
uuuuucaaaugagcaaacagagguugaauaacuuguaugagguaacauaaccaguaaguauucgagucuccauuugaaaaa

SEQ ID NO: 4124117 - RNA, 105 nt, Human
uuuuucaacaaaugcuuccaaugcuucuaucacauuguaaguggucuguaugacauuaagucagaucccguguauaguaagcuggauguucaaguuguagaagaa

SEQ ID NO: 4124118 - RNA, 63 nt, Human
uuuuucaagcuccauugccacugguacauucccagcgaugaccuggaauggguccuugaaaaa

SEQ ID NO: 4124119 - RNA, 88 nt, Human
uuuuucacuacgcuugagcuccuacuuauuccagcaaugcugccacaugcugugugggagcaaaugacugggagauccgagugaagaa

SEQ ID NO: 4124120 - RNA, 83 nt, Human
uuuuucacuuugaggaaaaugggacaggcuguagaugacaucaaucuucuuggucuuucgucucuuuuuugaugagugaagag

SEQ ID NO: 4124121 - RNA, 84 nt, Human
uuuuucaguacuguguucugagcaggcagcgugaauugguuauuuucaauggucaaaagaaagcucagaacacauauagaaaaa

SEQ ID NO: 4124122 - RNA, 73 nt, Human
uuuuucccucaauucuagagccuuacauugugguugaguuuauagguuauuuauuggcuuuaggaaggaagaa

SEQ ID NO: 4124123 - RNA, 71 nt, Human
uuuuuccuaugugcuauggguguuuaguuuaauuugagaaucaauaugacucaugcaugacacuggaaagg

SEQ ID NO: 4124124 - RNA, 93 nt, Human
uuuuuccugguuaacuuaaaaaucuuugaaagcauguaucaaaauuguaugacaugugcuuguaauguuaaauguuuuuguugaauggaaaaa

SEQ ID NO: 4124125 - RNA, 92 nt, Human
uuuuucgaagaguggccuuaggauuggauuucucuuccuguuccugggaagaauuagagauauaaccuaaaggucacuauucuucugagaaa

SEQ ID NO: 4124126 - RNA, 55 nt, Human
uuuuucuaguuucugagguuguauauuccuucuguacagucagggaauagaaaaa

SEQ ID NO: 4124127 - RNA, 72 nt, Human
uuuuucucuaauaugaggcuaaccaugauguccuuucccaggaaggacaaucucuccuuuaucagggaaaaa

SEQ ID NO: 4124128 - RNA, 107 nt, Human
uuuuucucuuaauuucaccagggaggcugagacucugaauuuuucccccuugcaggagggaauaauuuagauuuucuuccaucccugucagaaguugaacagacgaa

SEQ ID NO: 4124129 - RNA, 77 nt, Human
uuuuucucuuuugauaguugcugagcaggcucucagaccugcacauaggcuuuucagaaccaaagcgcagagaaaaa

SEQ ID NO: 4124130 - RNA, 63 nt, Human
uuuuucucuuuuugggguggggugggauaggagccuuguucaccccacccugaggaggaggga

SEQ ID NO: 4124131 - RNA, 76 nt, Human
uuuuucuucucaaaggaggugacuguagggaggguuggauaccaagggcucacccaacucacuucugagagaaaga

SEQ ID NO: 4124132 - RNA, 97 nt, Human
uuuuugaaacagaauuggucaguagagaggaagaggauuugcaagggguauuuacaagucacuuccuuucuaaauguuggaucucagaauucagaga

SEQ ID NO: 4124133 - RNA, 79 nt, Human
uuuuugaacauuccuaucuaacuccuuaagcucugcguagaccccuugagagcugaagauauguuaacuggaucaaaga

SEQ ID NO: 4124134 - RNA, 76 nt, Human
uuuuugcaagauguauuaguuguccagggcugcaguaacaaaauaccacaaacuugguggauuaguacagcaaaaa

SEQ ID NO: 4124135 - RNA, 60 nt, Human
uuuuugccugagagugaaaauaauggauaauauccauuguaaccacccauuagacagaaa

SEQ ID NO: 4124136 - RNA, 69 nt, Human
uuuuugcuaccuuugaucuggaauuuuaaucuuauuugguuaaauuauuucuagugagguguucaaaga

SEQ ID NO: 4124137 - RNA, 81 nt, Human
uuuuugcuuauugcuuucaagacuguuucaaacaugauuucuuucgguauacuaucuuugacaguagugagaaaacaagag

SEQ ID NO: 4124138 - RNA, 56 nt, Human
uuuuugcuuuuuugucaucuaaagauuaaugaacuucagauggcaaaaugcaaaga

SEQ ID NO: 4124139 - RNA, 75 nt, Human
uuuuuggcaaaguaaucugauuuuauagcuaucucuuuaaaugagaaggcuucuuuuucagauuucuuccaagaa

SEQ ID NO: 4124140 - RNA, 61 nt, Human
uuuuuggcaaauaaccauuuucuuacagguuuuuaaucuaaagaugguuaugugcuaaaga

SEQ ID NO: 4124141 - RNA, 57 nt, Human
uuuuugguacaugcaauagcaauuauuauuuguguaaugcuugucuugugccaagaa

SEQ ID NO: 4124142 - RNA, 60 nt, Human
uuuuugguaucucguaauuagauguuuuauugugagacauugauacugagauacaaagaa

SEQ ID NO: 4124143 - RNA, 74 nt, Human
uuuuuguaguguugauagauguugcuuguguuuaucuauuugaaaugccacuaaaucugugaauacaauggaaa

SEQ ID NO: 4124144 - RNA, 76 nt, Human
uuuuugugaaaggcuaugaguuugguauaauacucuaaugagauaaguguauaaaaacauagcuaucauacaaaaa

SEQ ID NO: 4124145 - RNA, 91 nt, Human
uuuuuguguuuggaaagucuacauaucuacauguguuucuguauguguauacagauacagaucuagauacaugcuuucauagacaagaaaa

SEQ ID NO: 4124146 - RNA, 64 nt, Human
uuuuuguucuguuugaauauagcuauacaauuucugauaaguggcuauauuuguugaauaaaaa

SEQ ID NO: 4124147 - RNA, 66 nt, Human
uuuuuguugauuacuguguugcugacauuaguuauggaagcacuuuaagcaacagaucaacagaaa

SEQ ID NO: 4124148 - RNA, 71 nt, Human
uuuuuguuuguuugguugguugguuguuuuuuaaggaauaauaauaacuggcacauaucacauaucaagaa

SEQ ID NO: 4124149 - RNA, 90 nt, Human
uuuuuuaaucugugaaagagcuuugcauuauucagaagcaaaauauuaauguuguuauuaauggggcacaggcaaucauaguagagaaaa

SEQ ID NO: 4124150 - RNA, 72 nt, Human
uuuuuuaccuaguuuuuaucuuuuguuucucacagcacuuuuuaaaggaaucuuuggcagcuagguaaagaa

SEQ ID NO: 4124151 - RNA, 83 nt, Human
uuuuuucaaauaugauuguccuuagcaaauuauauuuuauuuuaacaguggcaauuugagggcacaauuuugcuuugaaagaa

SEQ ID NO: 4124152 - RNA, 129 nt, Human
uuuuuuccugccaauuuuaguuuuuaucuuugugcuguauuuaauuguaucaucacaggccacauuaaaucauuucuggaagaucaguuuuaaauaaauagaugaauaaaaaaauagcaguuaaaaaaa

SEQ ID NO: 4124153 - RNA, 113 nt, Human
uuuuuucucuuuccauuucaguggcuucauuucugccagaauuuaacauugacagggugauguugccucuuuucuggggggaaaaagaagcucucuguugucaagaaaaaaaa

SEQ ID NO: 4124154 - RNA, 57 nt, Human
uuuuuucuguuacaguuagaaugaggaaacuuauguugcugccuguuauggagagaa

SEQ ID NO: 4124155 - RNA, 73 nt, Human
uuuuuucuguucacuggauuguauguaugaugacuggagcuucugcagccagaauacaaucaugaggaaaaag

SEQ ID NO: 4124156 - RNA, 97 nt, Human
uuuuuugaaacaggacaggguacaaauaaauagaaaaacacagcucuaaaagguuagauguuuugauauuugcugaaccuugugcugauguaagaaa

SEQ ID NO: 4124157 - RNA, 90 nt, Human
uuuuuugcgagauagaaauucuugauagagagcuuccagacugcugguggcagggaagaaaucugguuaagagauucagaaagcagaaaa

SEQ ID NO: 4124158 - RNA, 63 nt, Human
uuuuuugcucacaucaagguuuuucaggagcuccucagaaauaaugaaugauggggcagagaa

SEQ ID NO: 4124159 - RNA, 87 nt, Human
uuuuuuguuuucucugauaguuucauuggacugaggugguagcuaauaucauccuguauccucagaccaugaaaagaacauaaggaa

SEQ ID NO: 4124160 - RNA, 64 nt, Human
uuuuuuuaaacagacuucugcgucugguauagaaugcuaauaucuagaaguuuguuuaaaagaa

SEQ ID NO: 4124161 - RNA, 89 nt, Human
uuuuuuuguucuuucuaaacaucauaggcaugcaugauuuguauagcaaaaaucaaaaugcuccagugauggugaugagaauuuggaag

SEQ ID NO: 4124162 - RNA, 104 nt, Human
uuuuuuuuaaagccacauguaggcugaauucauuuaauuugacagaauaacacuccuuacugcuaauccugaucaauuuuagcuuugugugucuuuggguugga

SEQ ID NO: 4124163 - RNA, 108 nt, Human
uuuuuuuugcgggggggggcaggggucaauacacauauuauuauuguauuauauguauuuauaugcauaauguauguauugacuauugacucccccuuccaaaaaaaa

SEQ ID NO: 4124164 - RNA, 68 nt, Human
uuuuuuuugguuuguuuaccaacuagauuuugcucugguuaagaccgcaugguacaaaccaagagaga

SEQ ID NO: 4124165 - RNA, 63 nt, Human
cgucuccuguguucgagccauuccccugccucagccuccagaguagcugggacuacaggugcg

SEQ ID NO: 4124166 - RNA, 81 nt, Human
cgucugcaagcugcccugugccagacuuccuggaacucuuaggauggaggcccaggguggggaugggggaggaugcagccg

SEQ ID NO: 4124167 - RNA, 107 nt, Human
cgucugcaguccugagcuuggcaggcagggagaguucaggcauggccacauucacacucucacucccugaccugacaaagccucagugucuccagugcugcaccacg

SEQ ID NO: 4124168 - RNA, 57 nt, Human
cgucuucuaaguaucaaagcagagauucacuuuucauuucuggguauuuggaagaug

SEQ ID NO: 4124169 - RNA, 79 nt, Human
cgucuuucauuguucuauucauaaacaguugggauguuucuacauuuuggcuauuguaaauagugcugcuaugaagaug

SEQ ID NO: 4124170 - RNA, 73 nt, Human
cgucuuugugaagugguuugaaauuuccugcuauguuuagguacaggggaagagcccuuuacauggaaggacg

SEQ ID NO: 4124171 - RNA, 72 nt, Human
cgugaacauaaaguacugagagacucuugccagaaaccaauggggcaaagaucuuauuuagcuuuaaucaug

SEQ ID NO: 4124172 - RNA, 70 nt, Human
cgugaaucccacagguggagcuugcagugagcuggauuggcuacugcacuccaaccugggugacagagcg

SEQ ID NO: 4124173 - RNA, 83 nt, Human
cgugacuuccaaaguugcugcaucagggcaaguuuaugugacacaggcauacacuggcccuugauugcaucagccaagacacg

SEQ ID NO: 4124174 - RNA, 69 nt, Human
cgugacuuccagagcuaggucggagaggcauugcggcuucuuccuugguuuccuggauagguaguugcg

SEQ ID NO: 4124175 - RNA, 74 nt, Human
cgugauagggcagguguggugaccagagaugggugaccaggcucgcaugcccugcaccacugccgugauucacg

SEQ ID NO: 4124176 - RNA, 66 nt, Human
cgugauucuuugugcagccauuuucugccaaugcucuucuugggugcagcagugucugcagucaug

SEQ ID NO: 4124177 - RNA, 94 nt, Human
cgugccaaacacuguuuuuguugguggaauugaugcuaggguauuguauuuguaccucauuuuuaccuuaacauacaucaugaacaaugggaug

SEQ ID NO: 4124178 - RNA, 60 nt, Human
cgugccgggcgucucccaggcucagggucuugcucagggccaggcugauggccuggcaug

SEQ ID NO: 4124179 - RNA, 63 nt, Human
cgugccuaggcuuggcacggaggcaaaugggaagaagaguggcuguggacaggcuggggcaug

SEQ ID NO: 4124180 - RNA, 124 nt, Human
cgugccucagcccgggacaaggggggaggcggcggccgagcccggagaggagcucuucaggcaggagcccagccugggcucggaggagcagcuggagcuuccgcuuucccgggaaacgggcucg

SEQ ID NO: 4124181 - RNA, 66 nt, Human
cgugccuuguuaggugauaaagauacccuugcuggaaagcagcuuuguuuacucccugcaagcacg

SEQ ID NO: 4124182 - RNA, 61 nt, Human
cgugcucacgucacuccagccgcacuggccuccuugccauugguggagugugcugagcaug

SEQ ID NO: 4124183 - RNA, 102 nt, Human
cgugcuuuuuuuggucuucuaguuuucccacaacagaucuguauuaaacaucaaauuuaguuuagagaauuggggaugauuaauuagcccagcagacuuaug

SEQ ID NO: 4124184 - RNA, 60 nt, Human
cguggagaugcaauguagaaucuggccgcuggccggaucuucucuacuuccauccucccg

SEQ ID NO: 4124185 - RNA, 59 nt, Human
cguggccacaguggagcugagcaugaccagcaguugcugcagcaucuccuugugccaug

SEQ ID NO: 4124186 - RNA, 80 nt, Human
cguggccaucacgccacaguuucccggaggggccauccacagucuucuggguggcagugauggcguggacuauggucaug

SEQ ID NO: 4124187 - RNA, 129 nt, Human
cguggcgggugggcaggcggcccgggcgaggggcucgcagccugggcgucagcguggucauggccgucguggcuuccgccgcgggccucggcgcagagauccuagggccgcggcgcccuuccggucccg

SEQ ID NO: 4124188 - RNA, 55 nt, Human
cguggcucacgccuguaaucgcagcacuuugggaggccgaggcaggcggaucacg

SEQ ID NO: 4124189 - RNA, 76 nt, Human
cgugggcaguagaagccagaugguccauuuuuaugacauuuuacaaguugugucagugccauuugucuugccuaug

SEQ ID NO: 4124190 - RNA, 56 nt, Human
cgugggugcagcugggaacggggaaaacccagccugaaguccagcccugcccgacg

SEQ ID NO: 4124191 - RNA, 59 nt, Human
cgugguaugagaguguguguuugcauucauaugugcccacacaagcacucguacauacg

SEQ ID NO: 4124192 - RNA, 62 nt, Human
cgugguccuuggugcugcucccacagguucacaagacugugguugcagugccaaguaucacg

SEQ ID NO: 4124193 - RNA, 66 nt, Human
cguggugguggagcgggcccaggccgagccguucugcuugcccuggugcagguuccacaggcugcg

SEQ ID NO: 4124194 - RNA, 64 nt, Human
cgugucuucggccuuucccucgcuguaauuugaauauuuaggcuguagguuggugcuggacacg

SEQ ID NO: 4124195 - RNA, 61 nt, Human
cguguggucccggcaaggcaaggcgggcaagacgcacaaguucucugccggcaccuacccg

SEQ ID NO: 4124196 - RNA, 82 nt, Human
cguguguauucaaagguccaguuugaauuacugugaggccaguggcuagaaagcaguguaguugggacuggagauucacaug

SEQ ID NO: 4124197 - RNA, 68 nt, Human
cgugugugccaaaucccauaauaaauccuguuauaugagaggauuuauuaugggauuuggcucauaug

SEQ ID NO: 4124198 - RNA, 73 nt, Human
cgugugugccugcuuguguggaugcagcgugggucucugcacggacccugcguguauccacacugcauauaug

SEQ ID NO: 4124199 - RNA, 72 nt, Human
cguguugcugugugcacguccagccuauugcuucugaccacagcauggacucuaugaugcgccagcaacacg

SEQ ID NO: 4124200 - RNA, 69 nt, Human
cguuauuuuuaaguagccuuauugaggcaugauucauaugccauaaaagccaccuauuuaaaguauacg

SEQ ID NO: 4124201 - RNA, 70 nt, Human
cguucuggccgcgccacccuugccccagccgccgagcggcugccugggcaggaggcgcugagccggccug

SEQ ID NO: 4124202 - RNA, 58 nt, Human
cguugcagaagccuguuguuccugcucuucagauaggauuucacagucuaucugcccg

SEQ ID NO: 4124203 - RNA, 56 nt, Human
cguugucuauuuauucuacugugcuuaacaugguaacaggcaaauuuuagacaaug

SEQ ID NO: 4124204 - RNA, 57 nt, Human
cguuuaaaaccaaagaaagccucugcccuggcaagguguaugcucugguucuaaaug

SEQ ID NO: 4124205 - RNA, 74 nt, Human
cguuugaaauauucagggcaaugacccugcaaggccaguaagaacuggccuguguccuccuugcccugcagacg

SEQ ID NO: 4124206 - RNA, 80 nt, Human
cguuuguugugugagugaagcuuuagcugaggaaaacuacuaauguuauguccagccccuuuuacucauucauauaaaug

SEQ ID NO: 4124207 - RNA, 76 nt, Human
cguuuucaaguagucacacaugauauccagagauuuagauucugccuuuggcauaugcaguagacauuugaaaagg

SEQ ID NO: 4124208 - RNA, 88 nt, Human
cguuuucuucugggucccuuugcuguugaugaugugauacagacaguugcuguggacgucauuaaagcaguggacaagaagccugcag

SEQ ID NO: 4124209 - RNA, 61 nt, Human
cguuuuuguagcuguagacaguguuugcuguuggagcaagcacuuguaucuuacuaaaaug

SEQ ID NO: 4124210 - RNA, 129 nt, Human
cuaaaauucuuuauuccauauuaugugucugagggcugaaacauaauccuucuggaggcaaaauucaggacuuguuauuuuuacgcugcuagguauuuuuaaacauauaaaauggaaaggaauauuuag

SEQ ID NO: 4124211 - RNA, 59 nt, Human
cccuuccgccaauccuaugaagucggacagcuaccugauuuuacagaugaggggaaggg

SEQ ID NO: 4124212 - RNA, 77 nt, Human
cccuuccugaggugcugagcacagugagugcaccauccaaccagaagcaacagcuguggaaagagccuuuggagggg

SEQ ID NO: 4124213 - RNA, 75 nt, Human
cccuuccugcugggucuaacucugguuuuuaggguaaguaccaggggaacaaggccuaaugagcaggugucaggg

SEQ ID NO: 4124214 - RNA, 67 nt, Human
cccuucuaguccauucuucacacccucugcucuuuauacagaggauggaagacaggcauggaagugg

SEQ ID NO: 4124215 - RNA, 59 nt, Human
cccuucucuccuccacugcguuuggggccauuuguuuuaaaaguggagagagaagcugg

SEQ ID NO: 4124216 - RNA, 68 nt, Human
cccuucugacugcccuuguccuggcacaccuccguagguuugccauguuuaaguggcaauuagaaggg

SEQ ID NO: 4124217 - RNA, 57 nt, Human
cccuucuguaaaugcugacuggcugucacugauggcaagauggagaagcagcaaggg

SEQ ID NO: 4124218 - RNA, 99 nt, Human
cccuugacagggacaauuucugggagggacucagccuuuagcaaccaguauccaaccuuccuggcagcuggaagaaugagugccucguuccuggaaggg

SEQ ID NO: 4124219 - RNA, 86 nt, Human
cccuugcagguuuuuuccuaaggcucauuuuaaaauguuacaucuugaguucauccuggguaagaggagaaccuuuuaggcagggg

SEQ ID NO: 4124220 - RNA, 69 nt, Human
cccuugccgauugccaccucuuuaaacgcuguuccuucacuuagcaggugggaucaagcuggcaagagg

SEQ ID NO: 4124221 - RNA, 55 nt, Human
cccuugcuccaccgcaucccgggcaggaggagcccuggagcaucaggaggaaggg

SEQ ID NO: 4124222 - RNA, 61 nt, Human
cccuugcuuagacgucaaguacagcccucagcacuggauagaggcuggcgcugggcggggg

SEQ ID NO: 4124223 - RNA, 122 nt, Human
cccuuggccacuugcuuccuucaaaagccccaaggccccgcuguguccugggggacuucagguucgcagaagcagccuggauccuaggcucagcugggcucccucugcagcaagaaccuggg

SEQ ID NO: 4124224 - RNA, 64 nt, Human
cccuuguuugcagaauggcacccccacccacaacucuggcuguccagcuuucuguagaaaaggg

SEQ ID NO: 4124225 - RNA, 61 nt, Human
cccuuuaaggaaaggaaggaugagaaguauguggcacuuucuguuuuugcuccauaaaggg

SEQ ID NO: 4124226 - RNA, 63 nt, Human
cccuuuaaggucugauuuucagcagggcagagagacuucuuuugaaaguuaggauuuagcugg

SEQ ID NO: 4124227 - RNA, 72 nt, Human
cccuuuaugguaagggguuggucucuucauaaaacuuggaguauccacaauaaagcccuuugcuaugacugg

SEQ ID NO: 4124228 - RNA, 77 nt, Human
cccuuucauccaccaccagcagcagcagguguucuaggcaaagggauauuuacugcuguggugaagggauggagugg

SEQ ID NO: 4124229 - RNA, 94 nt, Human
cccuuugccgcugccgggagggcggugagguguccugugagcccuccagcugcggcccgcaugagaccugccggccauccgguggcagcuuggg

SEQ ID NO: 4124230 - RNA, 68 nt, Human
cccuuuggaagaggcucacugagguaaauauuaaggucacuaggucucaggagcagcuguaggaaggg

SEQ ID NO: 4124231 - RNA, 74 nt, Human
cccuuuggucaacguauguaguugugaagucaugaaauugugaagucaugaaaucugaguauguuuccacuggg

SEQ ID NO: 4124232 - RNA, 66 nt, Human
cccuuuucagucccuauucacaauaaauacagaggcaaauuuaugugacagggucauugaaaaggg

SEQ ID NO: 4124233 - RNA, 60 nt, Human
cccuuuuguucuuuccgaacugcagccagcgauggcugcaguucacaggagcaagcaggg

SEQ ID NO: 4124234 - RNA, 61 nt, Human
ccgaaacaucuggaggccccguuuguccgugggauaagaaugggcuugagcauggcugugg

SEQ ID NO: 4124235 - RNA, 103 nt, Human
ccgaaucugaucugcucacaaggugcgcagaagucaggugugggauaucauggggaggguguccuggccuagaguuuguguuccuuuucagcaucuuacuagg

SEQ ID NO: 4124236 - RNA, 82 nt, Human
ccgacaauucagugugcugucccccgugucugggcuggcuuggugggcugggaauggcgggggaaugggacacuuauuuugg

SEQ ID NO: 4124237 - RNA, 67 nt, Human
ccgagaugaguugcauccaucggcucccgauuaccaagaaucaagaggcgauggauggaaaccuugg

SEQ ID NO: 4124238 - RNA, 59 nt, Human
ccgagcuggccacgcugagcccugugcccucuccagggcuggugcccuuggccagucgg

SEQ ID NO: 4124239 - RNA, 55 nt, Human
ccgaggaguagggugucuacggggcgggcccguguagaccagcugugcuccucgg

SEQ ID NO: 4124240 - RNA, 64 nt, Human
ccgaggcaagcuugaaauuggcucuuccgagaugaaaaaggagaggcaggaguggcuugcccgg

SEQ ID NO: 4124241 - RNA, 58 nt, Human
cuaauguacaguuucuagacucaaauuaagaaauaugggucuggaaaauggcuuguag

SEQ ID NO: 4124242 - RNA, 60 nt, Human
cuaaugucgcugaauagggggaugucaugaugaaauucuggccuaucacagugauucuag

SEQ ID NO: 4124243 - RNA, 90 nt, Human
cuaauuagacucacuucuuuuacuauaaaaccuuaagagaauauuuugaucaagagaguuuuuuagugaaaucuagagggacaagauuag

SEQ ID NO: 4124244 - RNA, 71 nt, Human
cuaauuaguuggcuaugcaaggaacguacccgagccgcccggguagacaacuuuguaauagcccugaagag

SEQ ID NO: 4124245 - RNA, 93 nt, Human
cuacaaaauccuuuuauuauaguguguuagugacauaggcuuuuccaugacagccuggaguugaaacuauuauucaauagaaacaauuugugg

SEQ ID NO: 4124246 - RNA, 67 nt, Human
cuacaagccaaugagagaggccucagaagaaaucaauucugcugacaccuugaucuuggaauuguag

SEQ ID NO: 4124247 - RNA, 78 nt, Human
cuacaaggaacacuacaaggcugggagauaauuggagaaguuuuguuuuguuuuccggaucuugaugguuuccugugg

SEQ ID NO: 4124248 - RNA, 68 nt, Human
cuacacuuugguugacuuugugauaucuacuuauaauauaucaucacaacaguuauaacuagguguag

SEQ ID NO: 4124249 - RNA, 81 nt, Human
cuacagaaccucucugagcaccaguguauucgccuguaaaguaagggugaguaacacaguaugcuuacagggcaguugugg

SEQ ID NO: 4124250 - RNA, 57 nt, Human
cuacagaguaucuaaagagguaaaggcuagaagugagacuuugaaagauaccugugg

SEQ ID NO: 4124251 - RNA, 71 nt, Human
cuacagauuuggggaguaaaguuaacuggcucuaaaauuuuaaauggguuaauuuagucaacagacugugg

SEQ ID NO: 4124252 - RNA, 87 nt, Human
cuacagccacaucuggggacaagaugauuuuugauccuacuaugagcaggaagaaaaagaagucauuuauguuagaugagggugggg

SEQ ID NO: 4124253 - RNA, 72 nt, Human
cuacagcucccagaaggcccugcgccaagaguacacggcgggccgcggcgcguggccugcugggaguuguag

SEQ ID NO: 4124254 - RNA, 74 nt, Human
cuacaggcuucagauuucucaguuguuuccucaggcaaacaauaaaucuucugagcauugaucuaagccuuugg

SEQ ID NO: 4124255 - RNA, 65 nt, Human
cuacaguaugaaaccuuuacucucuauacuaugcaugauauaauggaugagggguucguauguag

SEQ ID NO: 4124256 - RNA, 77 nt, Human
cuacagucuugcucccagagaccaagcugagaaugucuaaauuugaucaggugggguuggggugaggcucuaaguag

SEQ ID NO: 4124257 - RNA, 68 nt, Human
cuacagugauuucucugguuaauagaugcaugcauuuccaugcauuauacuuuuagaaauuucuguag

SEQ ID NO: 4124258 - RNA, 69 nt, Human
cuacaucaaguaaucuucaaaaagugcugaaauuggacagugcuggcuugaucauuucuuggacugugg

SEQ ID NO: 4124259 - RNA, 55 nt, Human
cuaccaagccccaaauaaugaggggugagaggcucacuguucaagggccuggugg

SEQ ID NO: 4124260 - RNA, 120 nt, Human
cuaccagugcugcuuagauuggcaaaugcccaugcaguuugaagagggcaggcggaugacuggaugccugccaggaagugugugggccugaugccacugcuggacuccauagccugguag

SEQ ID NO: 4124261 - RNA, 69 nt, Human
cuaccaguucuggcuuuacuucccauccagcagcacacuggauauugaagaaagucagugaaauguuag

SEQ ID NO: 4124262 - RNA, 59 nt, Human
cuaccauagcaguaaugauuuaggauauauuaaugucauuuugucucacugcuauguag

SEQ ID NO: 4124263 - RNA, 77 nt, Human
cuaccccaacgcugaggaggcugagagagcuaaggcugagacuccccaguucucuuccacagccuccucacauguag

SEQ ID NO: 4124264 - RNA, 101 nt, Human
cuacccccuuccucaaaacacuuuccugccaucuauugggaacuuguaguaacuacacauaucuaagauagaugacaaugaaauugaggaguagggggugg

SEQ ID NO: 4124265 - RNA, 57 nt, Human
cuaccccuuccuagcuauagucaguaaauggagccccuaagcaaggagcagggguag

SEQ ID NO: 4124266 - RNA, 122 nt, Human
ccuggcuaacuuuuuaaauuguuuguagagauggggucuugcuaugauucccaggcuggucuugaauuccugggcucaaguaauacucccaucuuggccucccaaagugcugaguuuacagg

SEQ ID NO: 4124267 - RNA, 79 nt, Human
ccuggcuaauuccaaguagcaucccaucacagcaggcaugaacaccugaaugguaccugcuacuggcagauuuccuagg

SEQ ID NO: 4124268 - RNA, 73 nt, Human
ccuggcuccacaggcauguuacauuguuccaggagcauccguagggaacaguaacugucugcuguguuccagg

SEQ ID NO: 4124269 - RNA, 58 nt, Human
ccuggcuccugcacagaucuuuagugccacacagagauggcugauggcaggagccagg

SEQ ID NO: 4124270 - RNA, 57 nt, Human
ccuggcucuucugugucagcccugcauccuggguugaaugcuguucuuggagcuagg

SEQ ID NO: 4124271 - RNA, 58 nt, Human
ccuggcuggggccuagcaccagaaggcaggcgcucuucucaggagcccccaggucagg

SEQ ID NO: 4124272 - RNA, 59 nt, Human
ccuggcuuccaccauggccccugcuucagacaacgggaagcagaggccagaagcacagg

SEQ ID NO: 4124273 - RNA, 75 nt, Human
ccugggaagucuugaagagcacuguaaauuugaaggucuuuggaaaauuuuagucuuggaacaagacaguccagg

SEQ ID NO: 4124274 - RNA, 73 nt, Human
ccugggacaggguggcugauagggcucugugcugugauggggaugggccccguccaccugcucugcucccagg

SEQ ID NO: 4124275 - RNA, 97 nt, Human
ccugggacauggugugugcgcuucuuccugagccagguugagguugggaccacugauccauuggaagccuggugagggguacagccaguucuccggg

SEQ ID NO: 4124276 - RNA, 89 nt, Human
ccugggacgcugacuccaagguggcccugaugucaugugcuccauggagccuaggggguccugggccaccccgagaguguugccccagg

SEQ ID NO: 4124277 - RNA, 116 nt, Human
ccugggacucagagcaucugcuaugcugucccugcccuucaccccaauacaaacaccuacguaugguaggggagguggcaggagaaggggcuuggcugggaggcuggguugccagg

SEQ ID NO: 4124278 - RNA, 61 nt, Human
ccugggacucucacauugcucacuuagcuggagcaacaggugagaaaacgaggguugcagg

SEQ ID NO: 4124279 - RNA, 125 nt, Human
ccugggagccuguggcuacugauccuauugccucggucaucagcccuccuguuuuccuaggugacauagagggcuuguaggguggcuguagggugguggaaaaagaagcagaacugaauuccagg

SEQ ID NO: 4124280 - RNA, 107 nt, Human
ccugggagcugauuuaaaaugcagauuuuuggcuuuauccccaaguuacugguucaguagcuguugggagagggcuagaaauugcguuuuuaauaagagccccuagg

SEQ ID NO: 4124281 - RNA, 85 nt, Human
ccugggagcuuguuaacagugcagaaucucaggcccuacccggaccuacagaaucagagucugcauuguaacaagauucuucagg

SEQ ID NO: 4124282 - RNA, 74 nt, Human
ccugggauaguggcugguaggaauguguggauuacaaaugaagcuacacaagucccuccauacucucuugcagg

SEQ ID NO: 4124283 - RNA, 68 nt, Human
ccugggaucuggauccuauggaggggacaccugguccacacucagugcuuuggauccuggauuccugg

SEQ ID NO: 4124284 - RNA, 57 nt, Human
ccugggaugagaacccagaauuggggcucugaucuccauucaccaaaucaucccagg

SEQ ID NO: 4124285 - RNA, 65 nt, Human
ccugggcaaaggagucaggguagccuguaaauccucaggcacccaggcacuuuccuuucuucagg

SEQ ID NO: 4124286 - RNA, 59 nt, Human
ccugggcauaaaucacuccaagcguaaauuucccauguuuuggagaucacguguccagg

SEQ ID NO: 4124287 - RNA, 55 nt, Human
ccugggcccccuuaggccaaugcauggccacccuccaggccucugggggcccugg

SEQ ID NO: 4124288 - RNA, 66 nt, Human
ccugggccucucagcucccgcggguccuucuucgacccgcagaaagacccugagaacggcgccggg

SEQ ID NO: 4124289 - RNA, 80 nt, Human
ccugggccuggaaauagguacugcauugcuucugcuguauuguauuggccaaagcaguuacgggccuaucuagguucugg

SEQ ID NO: 4124290 - RNA, 67 nt, Human
ccugggcugcuuuaaaacugauacaugaagcagaaaguucacaguuuuccuuaaagcagaaaucagg

SEQ ID NO: 4124291 - RNA, 92 nt, Human
ccuggggaagcggauggagcaaauggggcugcaggagucccaggagucccaggagcuucugugccucaucugguucaggauuuucuuccagg

SEQ ID NO: 4124292 - RNA, 78 nt, Human
ccuggggagaaagagguuucccaaccaggccugucacaguaagcagccaaggacacggagccuccugucucucucagg

SEQ ID NO: 4124293 - RNA, 85 nt, Human
ccuggggaucugaaucaagugcuucaacuaguguggucccauagaccaggacuucaaaagcugacauucauuccaaucaccuagg

SEQ ID NO: 4124294 - RNA, 80 nt, Human
ccuggggaucuuguuaaaaugcagauucugauuucauaugucugggauggggcauucugcauuuuuaacaaguucccagg

SEQ ID NO: 4124295 - RNA, 79 nt, Human
ccuggggccaguuccucucagaguuacaggauguauccuuaaucauggcuugugggaggcagaaguuacugcccccggg

SEQ ID NO: 4124296 - RNA, 84 nt, Human
ccugggggcugggugaaaugcaggcuuggauucagcaggacugggguagggccugagagucugcauuucuaaucagcucccagg

SEQ ID NO: 4124297 - RNA, 127 nt, Human
ccuggguauccauggcuuacccaaaacaccuuaaauacugagucugaagcuaaugauuuauuuucugucuuggacagaauuggcacaggcagugcaguaggguauggggagguuagggaagcguggg

SEQ ID NO: 4124298 - RNA, 55 nt, Human
ccugggucuauagacuucaagacugagccagaaugaagcaagucuauugcccugg

SEQ ID NO: 4124299 - RNA, 61 nt, Human
ccugggucucuguccuugcucuaccaaugacaggaagaaauagacaugguagugauucagg

SEQ ID NO: 4124300 - RNA, 77 nt, Human
ccugggucuucuacuguguugagcuguugcugggguguccccagugucuguugcuuuugcaguggacaguacccagg

SEQ ID NO: 4124301 - RNA, 65 nt, Human
ccuggguuaggaguaauuuguuacagcaagaugauacuugagugacaggcugcuucuggcugagg

SEQ ID NO: 4124302 - RNA, 56 nt, Human
ccuggguuggagagcaauggugugaucucagcucacuguagccuccaccucccagg

SEQ ID NO: 4124303 - RNA, 83 nt, Human
ccugguccaggccccauucacauaaucugcagcaagcgugugaggaaugugcaugagagugugaagguuucuggaguaccagg

SEQ ID NO: 4124304 - RNA, 90 nt, Human
ccuggucuauaaaggcaugaaaugcugagaggugcuucuuagcuauuuuuuguggggcacuuuuaaguauuuaaagagcuuuuccccagg

SEQ ID NO: 4124305 - RNA, 86 nt, Human
ccuggucuccccugacccuuccacggggcuccccgcucuucugcccccagaagccagcagacagcccugcggacgaggaggccagg

SEQ ID NO: 4124306 - RNA, 60 nt, Human
ccuggugagcugggugcacggcagaugccauagucacagcagugccccagcuacaaaagg

SEQ ID NO: 4124307 - RNA, 82 nt, Human
ccuggugcgccuggcccguggcgggucccuggaggacgaggacaccccggagcccaggguaccccaagggcaggugugcagg

SEQ ID NO: 4124308 - RNA, 68 nt, Human
ccugguguugggagguguuccaguguugguaugggaaucauucgauggcgccagcaccgcccaguagg

SEQ ID NO: 4124309 - RNA, 73 nt, Human
ccuguaacacaugagucacuugauuaaagaaauacucaaauaucaaguuugugauucucucugugugggcagg

SEQ ID NO: 4124310 - RNA, 78 nt, Human
ccuguaagauugagcugcagacauagauaagcgagcuggaagcuugcaugaauaaaugccugcagcucugcuaauagg

SEQ ID NO: 4124311 - RNA, 85 nt, Human
ccuguagcuucaggaaauaucuccuggcagaggugacgcaucuuuugucaacucaccaguaaauauacccaugaaagccuacagg

SEQ ID NO: 4124312 - RNA, 57 nt, Human
ccuguaguaccucagaaguaccuuuuguaaaagguauugcacaaagagaugcacagg

SEQ ID NO: 4124313 - RNA, 106 nt, Human
ccuguagucacugaaauagagacauuguauacuuguguguuuuuacaagugcaauaggauuucacauacaagugauauaauuguuucaaacuauaguaguuagagg

SEQ ID NO: 4124314 - RNA, 88 nt, Human
cuagugugugcugcucuucuucccucauaaaagguaacuucuuuugcugcuuuuuauucauagggauggagagaaaccuauucacuag

SEQ ID NO: 4124315 - RNA, 93 nt, Human
cuaguuauucgguuggugccaaaguaauugugguuuuuguuauuaaaaguaauggcaaaaugagcaauuacuuuugcaccaccuaauagaugg

SEQ ID NO: 4124316 - RNA, 56 nt, Human
cuaguucacaagugcauuucaggaggggcuucaugaaaguguaucuugugggaaag

SEQ ID NO: 4124317 - RNA, 60 nt, Human
cuaguucacucagucucccagggguuaaaggguccguugagacuucuagaagugagauag

SEQ ID NO: 4124318 - RNA, 55 nt, Human
cuaguucuagaucccugaggaaucgccacaccgacuuccacagugguugaacuag

SEQ ID NO: 4124319 - RNA, 55 nt, Human
cuaguucuagaucccugaggaauugccacacagacuuccacagugguugaacuag

SEQ ID NO: 4124320 - RNA, 55 nt, Human
cuaguucuagaucccugaggaauugccacacugacuuccacagugguugaacuag

SEQ ID NO: 4124321 - RNA, 67 nt, Human
cuaguugaaauuaagagagaguuugaugcuaauauguagacaaauauuccuugauuggauuaauuag

SEQ ID NO: 4124322 - RNA, 64 nt, Human
cuaguuugguuagauaagucucccaauugcagugucagcaugcagacuagucuaguccagagag

SEQ ID NO: 4124323 - RNA, 95 nt, Human
cuaguuuuauguuuacucaaacauguauuucuauguagugaagaagagaauacaaguucugggucuauccugcuuagaaguauguaacaugcuag

SEQ ID NO: 4124324 - RNA, 82 nt, Human
cuauaaacacauaacauacauuagcucauaugauuaauauaauccuugacguaaaugcuaacgauguaaagaugugggauag

SEQ ID NO: 4124325 - RNA, 77 nt, Human
cuauaacaugcauuuucuauucacucaguaguuuuuaaaucuguuggguuaauaaaugguagaguguagcugugugg

SEQ ID NO: 4124326 - RNA, 66 nt, Human
cuauaauacugaaaguauuuucaaaucuaggaugaccaggauagaggaauuguucaguguucauag

SEQ ID NO: 4124327 - RNA, 130 nt, Human
cuauaauagcauuauuaucacuuagggcagcugggucaucucugauauuuuaaaugucaagccauuuuggcaauuauaucaccagagaucuggcucaaguaugaccaaagaauugacuguucaucuauag

SEQ ID NO: 4124328 - RNA, 57 nt, Human
cuauacaguaaccacagugauuuggauugacaucaugccugcuggguaacuguaugg

SEQ ID NO: 4124329 - RNA, 55 nt, Human
cuauacucuuucuucagccaagugcucagagguagaggagcugaagugaguauag

SEQ ID NO: 4124330 - RNA, 60 nt, Human
cuauacuuucagggaucauuucuauaguguguuacuagagaaguuucuuugaacguguag

SEQ ID NO: 4124331 - RNA, 60 nt, Human
cuauaguuacaacuguuugaaugucagagcauuugaugagucaagacauuguagcugugg

SEQ ID NO: 4124332 - RNA, 114 nt, Human
cuauauacccagucuuguugcaguuugcugagcggguggagcguuaccuugggaggcccugaucccucccugggcggacauucucccacagccaaacucucaagaaauguaugg

SEQ ID NO: 4124333 - RNA, 72 nt, Human
cuauauugugucuaaaugaaaagagaugccugcuuauuuuuagagguauuucuuauuuuauuuugacauuag

SEQ ID NO: 4124334 - RNA, 86 nt, Human
cuaucacaaucuucuuccuacgcacuuccagaaucuuucuuuuaggaggguuuggcaauauuuguggaacacuaagcaugugguag

SEQ ID NO: 4124335 - RNA, 59 nt, Human
cuaucacaauuccuauaguuugugaggcacauuaaauucaucagcugucauugugauag

SEQ ID NO: 4124336 - RNA, 70 nt, Human
cuaucagccugaugaccuuggcaagucacagaaaccucucugugacucaauguucucaucuguaaaaugg

SEQ ID NO: 4124337 - RNA, 93 nt, Human
cuaucagcuccaaguggcacagagcuuugucccaguuggcacggugcccugggagcuggguacagccugugccuauggccagggagagggugg

SEQ ID NO: 4124338 - RNA, 65 nt, Human
cuaucugaugacaaacuuuccugaugcccguuucuugucugggcauugagaauugacauucauag

SEQ ID NO: 4124339 - RNA, 87 nt, Human
cuaucuuagguauuuuucaguucuacaagagcuuuguaccugauucuaaugcacagcuccugguaagcugggggacccuggguauag

SEQ ID NO: 4124340 - RNA, 129 nt, Human
cuaucuucuacaccugcuccuucauuuuccuuucucuggagggcugagagagauuuacuggucaaaaggaagagcuccucacuucggguucaggaaucuuacugaaggaaaugaaauggucacagaaag

SEQ ID NO: 4124341 - RNA, 66 nt, Human
cuaugacaacacauggugcugaauuugucagauaaguacaauauucggaucauguguauguguuag

SEQ ID NO: 4124342 - RNA, 66 nt, Human
cuaugaccccagcaugaauaaggcucugugugugaaaagugaauggguagcaauguggggucaugg

SEQ ID NO: 4124343 - RNA, 85 nt, Human
cuaugcaugcccuggaaagagaaugaaugagcccuuuuuaauuuaucaacugguuuucuuccaucucuuuacuagugagccaugg

SEQ ID NO: 4124344 - RNA, 76 nt, Human
cuaugccuacagguaaacauacugcugucuucuuggaagaccgagaaguauaaagaauguuuaugugcaggucuag

SEQ ID NO: 4124345 - RNA, 85 nt, Human
cuaugggagugggagcgagggucugaguggaaugguagcaugauuuaauuuuacaggauuacccuggcugcuggcuugagaauag

SEQ ID NO: 4124346 - RNA, 105 nt, Human
cuaugggauuauuguuguguacuaggaagagcauaccauggaauuggaauaggaauuccuacucuguacuuucuuguugugugaucuugguuauuuugcccaugg

SEQ ID NO: 4124347 - RNA, 74 nt, Human
cuaugguaagagaaaugcaugcaugucaucaccaaagugagaacugccuguauuuaucuauguuacgcaaaugg

SEQ ID NO: 4124348 - RNA, 73 nt, Human
cuaugugaaauaugaacucacaggaagcugacaguaaagaaagcuaauagugucuagugaguuugaugcauag

SEQ ID NO: 4124349 - RNA, 105 nt, Human
cuaugugacuaaggaagacucaaugcaugagucacucagugcagaauguaccauugauauauuguuucugaguuuucauguauaauucacuuccacagugcaugg

SEQ ID NO: 4124350 - RNA, 57 nt, Human
cuaugugcugggcauuguguuguagggaggcacuuugcauuaagugucugcauaugg

SEQ ID NO: 4124351 - RNA, 71 nt, Human
cuaugugggguggggaagguuacugggccugaaacuccagcauucagagauggccucccacacuuccaugg

SEQ ID NO: 4124352 - RNA, 63 nt, Human
cuauguguccauguguucucaucauuuaguucccacuuauaagugaaagcaugugguauuugg

SEQ ID NO: 4124353 - RNA, 78 nt, Human
cuauguuccaugacuaugcaugaaacaagcugucacuguauuauaaaggcucagcaauucauucauggcauaauauag

SEQ ID NO: 4124354 - RNA, 76 nt, Human
cuauguugcgagaagguucuguauuauuuaaaacugaauuauucuguuccuaaaucuggaggaccucacaacaugg

SEQ ID NO: 4124355 - RNA, 72 nt, Human
cuauuacuguggggggcuuugcucagugggcuaugcaggcuuggggcuggagcugaguucccugggcaaugg

SEQ ID NO: 4124356 - RNA, 83 nt, Human
cuauucagguucucagugcagcaaggaauuuagaccagugcuucucaaauuucaauaugcguauagauuaccugaggaacuag

SEQ ID NO: 4124357 - RNA, 65 nt, Human
cuauucugguuuccggaucucuaaaaguauuucagauuuuaggaagcugauggaacuagagguag

SEQ ID NO: 4124358 - RNA, 70 nt, Human
cuauucugugggucacucuauccugcuuagucaucuggcuugguaguccagguuauccuucuaggaaugg

SEQ ID NO: 4124359 - RNA, 65 nt, Human
cuauugaagugugggaaguagguggcgaggacugaaagaccugucauuuuccaccauuuuuguag

SEQ ID NO: 4124360 - RNA, 91 nt, Human
cuauugcugcacaacucccaacuccuuaggaaagggcugugcaugguaaagucauucacacccaaauucuaacaguagaugucagcacuag

SEQ ID NO: 4124361 - RNA, 71 nt, Human
cuauuguaaaggauaacuuucaagaauuguuuuuaacaauuugaauuguuguuauuuucuguuuacaguag

SEQ ID NO: 4124362 - RNA, 78 nt, Human
cuauugugcccauggucacagagcuuaauuaauugucaaggagacaagaguaagauaccugggacaguuggacaauag

SEQ ID NO: 4124363 - RNA, 81 nt, Human
cuauuuacauaguauucacauuguuuuagguauuauaaauaaccuaaugaugauuuaaaauauaugggaggauguggauag

SEQ ID NO: 4124364 - RNA, 98 nt, Human
cuauuuaguauuuacagagcagcuuuauuaaugauugucuugcagaaagucaaggcaggaaggucuuuuaauaaagcacacaugaaaauaacgggaag

SEQ ID NO: 4124365 - RNA, 74 nt, Human
cuauuucaagucucagaguccuacuuauucccugugacuuuugcauggaagacuugcugaggcugugaauuuag

SEQ ID NO: 4124366 - RNA, 130 nt, Human
cuauuuggugcuacuucuacuccucaugaccaaagcuggcuuucaugguuuacucauguacuuacugaugaaacccugagacuuggggccagugacuguucagagguccaugugaagaugcgcugaaugg

SEQ ID NO: 4124367 - RNA, 57 nt, Human
cuauuuguacagcauuaguaauuuuugcucaaucaaaagacuaugcugaauaaaugg

SEQ ID NO: 4124368 - RNA, 67 nt, Human
cuauuuuuccuucuagagcagauuucaggcagcaaauucagcugggaauucuagugcaggauaauag

SEQ ID NO: 4124369 - RNA, 64 nt, Human
cucaaaacuacuggauuaguaacuuaaccucucugagcuucaguugcagaauccagagaaagag

SEQ ID NO: 4124370 - RNA, 62 nt, Human
cucaaaauuuggggucccauggucauuuuacacagguaaaaauuauggaguaucccaaagag

SEQ ID NO: 4124371 - RNA, 110 nt, Human
cucaaagcucuccccaggccagcgucuaccaaccuuucuaacagguguuuucugagacagcugugcaggagaaggggcuggggaugggggcguguaaaagagagcuugag

SEQ ID NO: 4124372 - RNA, 87 nt, Human
cucaaaguuuguagccucuacaaagucccauugccauggaagggaacauucacaggcuccgggguugugggcaggggcaucuuugag

SEQ ID NO: 4124373 - RNA, 107 nt, Human
cucaaauuaauggaaugauaaacuagugcaaagggcuguugagaaguaggguucccuccccaucuuuuucagaauguccuuuucaugcuauuauuucagaacuugag

SEQ ID NO: 4124374 - RNA, 94 nt, Human
cucaaauuucuggcuggacauggugguucacaucuguuuucccagugcuuugggaggcugaggcaggaggaucacuugaggccagaaguuugag

SEQ ID NO: 4124375 - RNA, 80 nt, Human
cucaacacacaugguagcagguacaagucaaaaucaauuacaaauuugaguuugcugcacuguaguaaagauaaguugag

SEQ ID NO: 4124376 - RNA, 62 nt, Human
cucaacacguccucgagaagcgccuacuaccugucaggccagagccuuugggcguuguuggg

SEQ ID NO: 4124377 - RNA, 63 nt, Human
cucaacagcucugccauacucccauucaguggguccugaaggagaugcuuaagagugguugag

SEQ ID NO: 4124378 - RNA, 69 nt, Human
cucaacaggaggcagggaugcugcuuaggcaguuggcuaaccagaagcaauggcaucuugcuuuucgag

SEQ ID NO: 4124379 - RNA, 64 nt, Human
cucaacagugauucugcaugaggaaagggauccucccaguccuccaugacaucacucaauugag

SEQ ID NO: 4124380 - RNA, 61 nt, Human
cucaaccuugacuuuccuuggggcuucagaucuggaagaggcucagugggaacaagcugag

SEQ ID NO: 4124381 - RNA, 55 nt, Human
cucaacugggaacuguuugccuuugaaggaaugucaggcacaguuccuaguuggg

SEQ ID NO: 4124382 - RNA, 99 nt, Human
cucaagaguuuagaaugggaggaaguggcagauaggcaacagauaugacaagaucauucuauguccuuucucccauuccugacccaucucauucuugag

SEQ ID NO: 4124383 - RNA, 65 nt, Human
cucaagaucagcucccgagucugagaucucuucucucaauggcauuggagcuggcugugccugag

SEQ ID NO: 4124384 - RNA, 73 nt, Human
cucaagccucuggggccucaucuguaggaugaaaaucauagcaggucugccagcgcccauggagagguuugag

SEQ ID NO: 4124385 - RNA, 57 nt, Human
cucaagcucuuuaaacuuaugucauuuauuugguauauagguagugaggaguguggg

SEQ ID NO: 4124386 - RNA, 74 nt, Human
cucaagcuggugcagugauugcaguucacuucucuuccaaacaacugguguucugcucugugcacuuguucagg

SEQ ID NO: 4124387 - RNA, 65 nt, Human
cucagugaguugugcugaggaccaccagcuggacauugcaaguguuuucaccagaauucacugag

SEQ ID NO: 4124388 - RNA, 79 nt, Human
cucagugucugguuggcucuacguccaaggccacugccggcugcagagacguggugagggcugaggccagacagcugag

SEQ ID NO: 4124389 - RNA, 69 nt, Human
cucaguguggcuagaagugucuuguugagggcaaagaccaaacacgaggucucuggcuacuaggcugag

SEQ ID NO: 4124390 - RNA, 89 nt, Human
cucaguuaauugugaauugcuuaugccaggugagagagaauuggugucuaccccucucaccugacauaagcaacucugaauuaacuggg

SEQ ID NO: 4124391 - RNA, 105 nt, Human
cucauaaaaauuuaagugaugugauuaagcauuucagaauuugcaaaugaagauuaugaguucauggagauuugggaaagcuugacacauguagaaaccccugag

SEQ ID NO: 4124392 - RNA, 60 nt, Human
cucauagaugucaccuugcuguacccuaacaugguaaaaaaggcaaggcagcucucuggg

SEQ ID NO: 4124393 - RNA, 60 nt, Human
cucaucacuggaucauuagauauuuacauuauaaaaucaucugauguguuuaaugguggg

SEQ ID NO: 4124394 - RNA, 75 nt, Human
cucaucauuuaacaguagucuuaauuucauguacaaaugggcauuuguacauuuggaugugcuuaagugugugag

SEQ ID NO: 4124395 - RNA, 66 nt, Human
cucaucgacuuggcucacaaggacgguugcuacgaagcaguauucuccugugguggaggaaauggg

SEQ ID NO: 4124396 - RNA, 129 nt, Human
cucaucuuugaaugcgguggaucuaagcauguugaccgagaacuauccauggaagagggcagacacccugccuggcacauaguacucuuucaauacaugguagcuauucuuauuagcauagguggugag

SEQ ID NO: 4124397 - RNA, 63 nt, Human
cucaugagccacuggcaaaugaaaugaugaguuauuucaccauguaaaccauguggcugugag

SEQ ID NO: 4124398 - RNA, 79 nt, Human
cucaugagcuugauuuuuauauggcauucagaauauucugaaugauauauugggaauaaucacaccaaguucucaagag

SEQ ID NO: 4124399 - RNA, 82 nt, Human
cucaugaucuuauguauucuucacacuaacccugugagauaugauuagcuucaguguacagugaagggauuaaggaucagag

SEQ ID NO: 4124400 - RNA, 58 nt, Human
cucaugcauucaugguuucuguuucuccaauuugauucaaggagccuugagcagugag

SEQ ID NO: 4124401 - RNA, 58 nt, Human
cucaugccagugccuuagaaaucuaugcucucgugcuuuucuaagugcuugguuuggg

SEQ ID NO: 4124402 - RNA, 60 nt, Human
cucaugccuguaaucccagcucuuggggaugccaaggcugguggauuaugaggucaggag

SEQ ID NO: 4124403 - RNA, 103 nt, Human
cucaugcucuuuguggugugacuucaggaaggcacuugguguguucacucccaccaugggaaacuuggcaaaauacacgagggccuucuacacacaagcugag

SEQ ID NO: 4124404 - RNA, 97 nt, Human
cucaugguucaacucacuuuccuuauggauggggaaacugaagccuagagaggugauguaccuuguccaagaugaacuaguugguuagagccauggg

SEQ ID NO: 4124405 - RNA, 57 nt, Human
cucauguagcucucaggccacacauuuauaugaugguucaguuuugaguagcaugag

SEQ ID NO: 4124406 - RNA, 65 nt, Human
cucauguccagacauuuuauagcagucucacuuuuggugggggugauauagugugcugggaagag

SEQ ID NO: 4124407 - RNA, 85 nt, Human
cucauguguuuauuuaguacauauaaucugcccugguuccaagacauuccuacagaagauauguaguacuuagugcauacaugag

SEQ ID NO: 4124408 - RNA, 129 nt, Human
cucauuacccugcccucucauggacugggcuaacugaaggccaagcucccagagaagcuggacucacugugcgggauuacugaggguguggcugccaggcuacagucacaggaaggccagacuguugag

SEQ ID NO: 4124409 - RNA, 56 nt, Human
cucauucacucuacccuuccuuccucacaaaaccaaggcucuuggagugaaugcag

SEQ ID NO: 4124410 - RNA, 68 nt, Human
cucauucauucccgcagccaccacucagcgcgucccaugugccaggggcugaugguggggaugaagag

SEQ ID NO: 4124411 - RNA, 63 nt, Human
cuaaggaggugugaggacacagugguucacacugaggaaccuggcuuguuucuaccuccuugg

SEQ ID NO: 4124412 - RNA, 83 nt, Human
cuaaggccuugaagaaaaauugcaugucugcuucuccuccucuccgcaagaagaaagcauuagacaggcauucaaguccuuag

SEQ ID NO: 4124413 - RNA, 127 nt, Human
cuaagggagugacaucuaucuuuaauuauauaugggagcuauuuauagaggcugaugccucauuagucuaaccaggaaauaguuauuuguauuuauuagaaaaguguuaaaaaauuaaaauucuugg

SEQ ID NO: 4124414 - RNA, 84 nt, Human
cuaagguacugggcagaaggccaaagauagcacagcugcucugugcucuguuggcuucuuuugucaauugcuaugugaccuuag

SEQ ID NO: 4124415 - RNA, 114 nt, Human
cuaaggugacaucaugccaaggccuccugauggagaggaacauuuucuggaggaaaguuuugaccuuuagaaaggaaucuucauuucaagcaggcuuuuggcuuccagccuuag

SEQ ID NO: 4124416 - RNA, 76 nt, Human
cuaaguacugugaaaggagaaauggaaacuagguuaacuacuuaguguuuugcuaauccuauuaaucgguaugaag

SEQ ID NO: 4124417 - RNA, 91 nt, Human
cuaaguguucucagguaaagcugucaaggcaggaggcugagugaggacacaccagcuuuaccugccuuggggcacuccugggauugauugg

SEQ ID NO: 4124418 - RNA, 70 nt, Human
cuaaguuacuaacauuuggaaggcuuaugaaagugaagcauaguuaugagccagcaauguuuuuauuuag

SEQ ID NO: 4124419 - RNA, 63 nt, Human
cuaauaacaugaacuacuuucugaaaauaaagaagguaaugucuucccaguucuaguuguuag

SEQ ID NO: 4124420 - RNA, 66 nt, Human
cuaauagagcuucggaacucuguugugagcaauuuggaaauucacaucgaguuucggguucauuag

SEQ ID NO: 4124421 - RNA, 63 nt, Human
cuaaucauaccugcaaaguuccuuuugccauguaaggugacaugugaagguuucagggguuag

SEQ ID NO: 4124422 - RNA, 57 nt, Human
cuaaucaucuuucucuuaaagcauuugaaauuggguagaaggagagggagggauugg

SEQ ID NO: 4124423 - RNA, 55 nt, Human
cuaaucauuuuaacuugcaugcagugugagcacuaacuagcaguaaaaugguuag

SEQ ID NO: 4124424 - RNA, 62 nt, Human
cuaaugcuuugggguugguacugucaacucuauuugacauauuggcaaacuggaggcaugag

SEQ ID NO: 4124425 - RNA, 61 nt, Human
cuaaugggccuguuucccuucagggccuugaggggccuggaugguaaaugaggccccuugg

SEQ ID NO: 4124426 - RNA, 59 nt, Human
cuaauguuagacuggccaaguuuucugaaucaaagcuuggaauauauuguuugacauag

SEQ ID NO: 4124427 - RNA, 83 nt, Human
cuaauuguguuugcaauagccuuauuuccaaaugaguuuacauuuugaggaaguaugggcuaggaugucaacacugaauuugg

SEQ ID NO: 4124428 - RNA, 62 nt, Human
cuacaacauaacgggcauucaguaaauauucauuuguaucuagugagcuugcaugugugugg

SEQ ID NO: 4124429 - RNA, 116 nt, Human
cuacaacucagacagcagagccacccucaggaggcugcaacccugaggccccaggggccuguaggucagccuccuuuucuguagcacggggugucugaaugccuggaacauggugg

SEQ ID NO: 4124430 - RNA, 129 nt, Human
cuacaagaucaggcaguuccuggacuguucgaccacugagaaugaccugucccugugugagggcuucaaugaggccccaaagcagugcaaguacaaccauggucugagcucccugccuugaagacguug

SEQ ID NO: 4124431 - RNA, 77 nt, Human
cuacaagccucacagguuaguuguguggauccaugagacacugugugagggacacacaccaccugucagucuuguag

SEQ ID NO: 4124432 - RNA, 101 nt, Human
cuacacaugaggagcugccuuuucuaccagugacaggcccagugggaugcaggaagcagccugcccucgcuguggucaguuaggggguacauuaucuguag

SEQ ID NO: 4124433 - RNA, 91 nt, Human
cuacaccccuuguuuaacuuaaucugcuugaugauuucugcuuuggaguuuggauuucguugaaagcaugauagguuguagcauagugaag

SEQ ID NO: 4124434 - RNA, 74 nt, Human
cuacacuguagcauguaauuaagauguagucauaaaucaggaaaacauuauaucuuguuuaggugcacaggugg

SEQ ID NO: 4124435 - RNA, 63 nt, Human
cuacagaaucuaccucaagccauugcuuaccaaaucuuuguuaauggauuggagacucuguag

SEQ ID NO: 4124436 - RNA, 63 nt, Human
cuacagaguuaguuaaguuagagugacaauguugagauuguagaucuucaucuaauucuguag

SEQ ID NO: 4124437 - RNA, 55 nt, Human
cuacaggaucuaauguaacugaaaaugguuuguuucaaguugcuagaugcuguag

SEQ ID NO: 4124438 - RNA, 78 nt, Human
cuacaggguccacuuggacauugaucuuggaaguuucucuguguccugaaugguaauaaugcaaguggccccugauag

SEQ ID NO: 4124439 - RNA, 98 nt, Human
cuacagguaagcucaaaggagaccaggucagagauggugaaccugccuguacaagccacugccaccauuggccagucuccacagagcuugugcugugg

SEQ ID NO: 4124440 - RNA, 59 nt, Human
cuacauaaauuuaucacagacuacuggcauugagauguacuagucugagugaaauguag

SEQ ID NO: 4124441 - RNA, 73 nt, Human
cuacauaguguuagcugcugauuaaauauguuguuggggcagcagguaggaggggucauaguugaugggugag

SEQ ID NO: 4124442 - RNA, 108 nt, Human
cuacauguugauauuuucugugucucugcacuugcacauaagcuuugugaaacuuuaucaccacagccuaaagcaaugcauggcauaugguaggugcucaauagauag

SEQ ID NO: 4124443 - RNA, 60 nt, Human
cuaccauggcauguaaacuauuucuuggacuugucuugauuagugaaacaugccuaguag

SEQ ID NO: 4124444 - RNA, 57 nt, Human
cuacccaggucuaucaaguugggcucaucucccagggcccagcacaggaccuggcag

SEQ ID NO: 4124445 - RNA, 89 nt, Human
cuacccagucucaguuauucuuuuauagcaauacaaaacagacuaagacagcuggguuucuauagaaguagucaacuguagauuuguag

SEQ ID NO: 4124446 - RNA, 117 nt, Human
cuaccccugcagugccaacucugcagugcccacaucucucaucaggacagcuguagagucauugccugccugucagggggagugggaaaugagcagauugcagacacugggagguag

SEQ ID NO: 4124447 - RNA, 70 nt, Human
cuacccuuuggaggcagcugggcuggugguuugggcuagccaggcuucccaagcagcugcaaaggggugg

SEQ ID NO: 4124448 - RNA, 55 nt, Human
cuaccucacuuuuuccaucccauucucugggaaucagaagaagcuugagaaguag

SEQ ID NO: 4124449 - RNA, 63 nt, Human
cuaccuccagguaacuugagaacaugagaagcccuuuuguuguucucuuuugccuaacuguag

SEQ ID NO: 4124450 - RNA, 65 nt, Human
cuaccugaaaagguuguggugaaaauuaaaugauauaauguauaccaaguacuuauuuagcgugg

SEQ ID NO: 4124451 - RNA, 75 nt, Human
cuaccuuccaagcaccuuguaagaauuaaauuaguuaauauaaguaaaguucuuagaacaaggccuggaacauag

SEQ ID NO: 4124452 - RNA, 61 nt, Human
cuaccuuucugacucuugggauuacggguuaucacuguuucuuugauggaaggaaagggag

SEQ ID NO: 4124453 - RNA, 57 nt, Human
cuacgcuguuugguccaggcauaggagaugagcccuggccgggaagggacagugugg

SEQ ID NO: 4124454 - RNA, 87 nt, Human
cuacuacaugauaacagaagguaauuguugagaauguguacauacauacacauagcauaaagaaugacucuagucuguaguguggag

SEQ ID NO: 4124455 - RNA, 70 nt, Human
cuacuagaaagccauuacaaaauuucauaugggaaaugauguuugucugaaguaagguuaguggcaguag

SEQ ID NO: 4124456 - RNA, 62 nt, Human
cuacuccugccacacagaugcugucuuguccccaagauggucccuacauguggcaugauuag

SEQ ID NO: 4124457 - RNA, 69 nt, Human
cuacugcuuugacagggaugacaugagccaucacaucggauccucacugccacuauugcaaagcugugg

SEQ ID NO: 4124458 - RNA, 70 nt, Human
cuacuuaugaccacgugacuugcuuuuuucaauagaaugugaaucagaagugauguguguuauuuaauag

SEQ ID NO: 4124459 - RNA, 68 nt, Human
cuacuugagccauuuugguaaugauaacaauuugauaaaauuaaagucauaagaguggauccgaguag

SEQ ID NO: 4124460 - RNA, 63 nt, Human
cuacagggacuuacaauagaugaacccaacuaugaguauuuauauguaaguaccuuuaugugg

SEQ ID NO: 4124461 - RNA, 60 nt, Human
cuacagucucuucuauggaaagcuguuuaucaugagcuuucuaggcagagaugacuguag

SEQ ID NO: 4124462 - RNA, 67 nt, Human
cuacauccuguuugucacuagaaaauagaaaagagcuauuuauuuucagaugggaagcaggagguag

SEQ ID NO: 4124463 - RNA, 69 nt, Human
cuacaucucuucugagcaauuccuguuuuuggaauuugaaaauggauugauucuuagaaaaggugucag

SEQ ID NO: 4124464 - RNA, 72 nt, Human
cuacaugucuaagacuuguuagcaagauacagucuuccauugccaguuuuggagucaggcuuagaugugugg

SEQ ID NO: 4124465 - RNA, 129 nt, Human
cuacauuuuauaucaguuuuuuggagcagcccauuuguaauuuggggaauucaguuagaauagaaaccuuuccugaauugaacucaguuaauuguguggcuuugccuguuuccugauauguaaaguaug

SEQ ID NO: 4124466 - RNA, 74 nt, Human
cuaccaaaucagugauggugaaacaguauauuaguuuguuagggcugccauaacugauaccauagacugggugg

SEQ ID NO: 4124467 - RNA, 79 nt, Human
cuaccacaauacagauguuaaagcaauuuccaaggauuuggcacauugcuugcccauuguaaguacauauuugugguag

SEQ ID NO: 4124468 - RNA, 92 nt, Human
cuaccacucagagcuguccuaccaggaguccuuccacagcuccauaaaccaaggugagagggcccuggaugagggcagucgggggugagugg

SEQ ID NO: 4124469 - RNA, 57 nt, Human
cuaccaucucugcagauuguacagaauuaucuguggcaggaugcggaagaugcagag

SEQ ID NO: 4124470 - RNA, 71 nt, Human
cuacccggguccgccguccccuaggaaagagcuccgacgauuggagcuuugggggccggggaugggggugg

SEQ ID NO: 4124471 - RNA, 60 nt, Human
cuacccugggucucaaucauccuaacagauguuugcuuaggaaggacgggacuugggugg

SEQ ID NO: 4124472 - RNA, 88 nt, Human
cuaccucugaaguuuuucccagagaagugaagauguaauuuuauucacucgaaugaugugaguuuuuauucucagcucucagaggcag

SEQ ID NO: 4124473 - RNA, 112 nt, Human
cuaccugaauuccaaguggugucaugaacaaguacauacauaauauagcaguuaagugcaaauuuggaaucuguauguauguauaaaguugcuguugacaugguucuaguag

SEQ ID NO: 4124474 - RNA, 68 nt, Human
cuaccugauucucauuuucuuguucacucauaauucucuuugaaguaaacaauguaugaggacaggag

SEQ ID NO: 4124475 - RNA, 89 nt, Human
cuaccuuaaucuccuaguuggcucugauccacugggacauuuauuccggcuuuauuauguggccaugugacugugggagcuuaagguag

SEQ ID NO: 4124476 - RNA, 58 nt, Human
cuaccuugggguuuuguugcucuguaggagcucgcuggagucacuuucccgggagugg

SEQ ID NO: 4124477 - RNA, 60 nt, Human
cuaccuuuugguacccaaagaugccaacaucuaaagggucugaggguaagguuaagguag

SEQ ID NO: 4124478 - RNA, 100 nt, Human
cuacuagaacccaaaagcugauggaagcuucagaaaacauccucggucucuauauuacccuaggaacuauucuaaguuucucaguuucaguccuauguag

SEQ ID NO: 4124479 - RNA, 89 nt, Human
cuacucauucaucuacuuugcacagaaggauaugucaucuaauauauggauaaacaugaaguucuguguacuggauaauggcugagaag

SEQ ID NO: 4124480 - RNA, 64 nt, Human
cuacuccaagggcagccauagaacuuccagaugguugggggaaaguaguagccuuuggagucag

SEQ ID NO: 4124481 - RNA, 82 nt, Human
cuacucgcggcugcggugaacuuggauggugcuacucucaccacaaaccacaguccgucacaaauugccguguggugaguag

SEQ ID NO: 4124482 - RNA, 76 nt, Human
cuacucuuuauuauugugaguauaacugcauuuaaaugaacaggauaaauauaagagcagucuccauaagggguag

SEQ ID NO: 4124483 - RNA, 94 nt, Human
cuacugaauuaauccuguacuucuaaaugagaaaaaggugacaaccucaaauuacccagaaagcuacauuuggagaguauaggaauuuuaguag

SEQ ID NO: 4124484 - RNA, 55 nt, Human
cuacugaguccuucagcugccauucuuagacuggcaccaugaaauauuccgguag

SEQ ID NO: 4124485 - RNA, 58 nt, Human
cuacugcaugaugagagggguucucuguguucaacagugcuguucacauuauuaguag

SEQ ID NO: 4124486 - RNA, 57 nt, Human
cuacugggagaaacugacaccuuagauacugcauuugggagagagaauucccagugg

SEQ ID NO: 4124487 - RNA, 74 nt, Human
cuacugguggcccccuaaacgagcuggcagucuuuaacuuuaguucauaaaaccaggguggcauuugccagagg

SEQ ID NO: 4124488 - RNA, 61 nt, Human
cuacuguaguuaaaguuuuguagaaacagcacaguuuuuuaagacuggcugaacuuaguag

SEQ ID NO: 4124489 - RNA, 73 nt, Human
cuacugucugccagcuggagaccaaggaaagcugaugguguaguuugaagccugaaagcuggacaggcagugg

SEQ ID NO: 4124490 - RNA, 56 nt, Human
cuacugucuuccuugguaacaacaucuucuagguaaaauauuugggaauacaguag

SEQ ID NO: 4124491 - RNA, 110 nt, Human
cuacugucuucuuccuuuauuggucuuguuuuucuuguuuguuuuguuuauuguuugguugguuuuuuagcacagaacagagaaauagccaauaacauggagggcagagg

SEQ ID NO: 4124492 - RNA, 91 nt, Human
cuacugucuuugcuaaaccuuugugcuugcaauuuguaagucaaguacaaaugaguuguaaggcccaaagaaacaaaguuugcaacauuag

SEQ ID NO: 4124493 - RNA, 55 nt, Human
cuacuguuguguuuuaaagguagaaaccuuccuucgugauguugcauugcaguag

SEQ ID NO: 4124494 - RNA, 99 nt, Human
cuacuuacauuggauaucauuuuuaaugaccuggaagaagugauaaaaauaauuugauuauucuugcaggcaguaauaggaaauuauccauaaaagugg

SEQ ID NO: 4124495 - RNA, 91 nt, Human
cuacuuagaguaaggacagauaaauuuaagagaauaaauuugguugaaauaucuaauuuaugacagaagauaugcugucuacacugauuag

SEQ ID NO: 4124496 - RNA, 64 nt, Human
cuacuuaugggaaauuuuauuuuggaagacgaaauuguuaaacaaagaaaucucccauugguag

SEQ ID NO: 4124497 - RNA, 86 nt, Human
cuacuucauucuguucccacagucacugggagaaguuggaguaaggacuucugaaacccccaguguggguccugaagaauguguag

SEQ ID NO: 4124498 - RNA, 56 nt, Human
cuacuuccugucuucagucucuuugauuucuuuaaagacucuccagagggaaguag

SEQ ID NO: 4124499 - RNA, 58 nt, Human
cuacuucuaaguacauggugauaaaguaugauggauugcuuaggugcuuaagaaguag

SEQ ID NO: 4124500 - RNA, 108 nt, Human
cuacuugcaugcugaccuuucucucuguaaucuaagccaccaguaguuuccugccauuucucggggcauugggcugggauggagcaucaaggacaaggcguguuuuag

SEQ ID NO: 4124501 - RNA, 67 nt, Human
cucccugugucggacgugggcagcagaacgccccuuugaugccccguccuguacacuaagaagggag

SEQ ID NO: 4124502 - RNA, 60 nt, Human
cucccuguguuucaccaaaagagucuaggauuugaggcucccugggaggagacagaggag

SEQ ID NO: 4124503 - RNA, 128 nt, Human
cuccgacgcuaacccgcugcucccagccuccgcuuccuguuuucgagggauuagcuaggacugugcaacaccagucuccgcucucggagucggcacgggggcugguggguggcgggaugaacucgggg

SEQ ID NO: 4124504 - RNA, 56 nt, Human
cuccgacuuucucaccguguucugagccuuguaccagagcagggagugguuguggg

SEQ ID NO: 4124505 - RNA, 57 nt, Human
cuccggccugccuuaacccccuuuuugaauuagagggugggcaacauuuggccugag

SEQ ID NO: 4124506 - RNA, 60 nt, Human
cuccgggcugugagcuaaugcggcaccacugcuguuugcauagcugcacagcccuaggag

SEQ ID NO: 4124507 - RNA, 59 nt, Human
cuccggguuagagcaggugaucugguccggugugaccuccccugacucgaaacccagag

SEQ ID NO: 4124508 - RNA, 58 nt, Human
cuccguugaucuggauaugggaguuucauggcccaggggcucucuuuccucaguggag

SEQ ID NO: 4124509 - RNA, 129 nt, Human
cuccuaaaguugcuagguucuuguuuacauuccuguuagcaucuaagcauaaaagauauaggauguuucuugaugcuguauccuuagauacuaacagggaugaaaacaagaaccuagcaacuuuaggag

SEQ ID NO: 4124510 - RNA, 58 nt, Human
cuccuaaccagccucaccuccccacugaacagaugggaaacugaggcucggugaggag

SEQ ID NO: 4124511 - RNA, 91 nt, Human
cuccuaccaguuuacaagagcugauaguccacaugucuucccaacucuguucugugacaucaauauuaguagcuugaaauuggugacggag

SEQ ID NO: 4124512 - RNA, 111 nt, Human
cuccuacuguauuggagagggguucucaucuuuaguagguucuggagauucagcugaagucuccuguugaacugguaaagguccagucucuuccgaugacucuguaggcag

SEQ ID NO: 4124513 - RNA, 60 nt, Human
cuccuagagauuggauuuaauggccaaauggcuggauuuggccguguccaugucucagag

SEQ ID NO: 4124514 - RNA, 61 nt, Human
cuccuagagcacaaaaggccauugugaaucaucccagugcugcacuuauggcucugaggag

SEQ ID NO: 4124515 - RNA, 90 nt, Human
cuccuaggauucuuugguaaaugucaugggaagucacuaggccaacaggaugaucagaacugguauuuaucaaggagaaggcuccagggg

SEQ ID NO: 4124516 - RNA, 57 nt, Human
cuccuagggcugugcagugugcagcuggaauggcuacacacagcugcccuuagguag

SEQ ID NO: 4124517 - RNA, 107 nt, Human
cuccuauaauauaacuaugacauguuagggacagaguauguguaagaacuacauacuuuguccuuaacguacauuuauucugaaguuacuaaugcaaaaauuaggag

SEQ ID NO: 4124518 - RNA, 59 nt, Human
cuccuauggguacuuugauuuagaaacuaauguuggugucuaugugguauuccugggag

SEQ ID NO: 4124519 - RNA, 87 nt, Human
cuccuccccuagacacacagggcugcgccugaccccaggccaucagcaggcggaggcagggggcaguggguggcagugagggaggag

SEQ ID NO: 4124520 - RNA, 86 nt, Human
cuccucccugccagugauguggggaccguccuggcuggccacuaccagcuguuugacucucuccccacuugcugagaggggcugag

SEQ ID NO: 4124521 - RNA, 67 nt, Human
cuccucugacagugugaauauugacuugcacuuauaaaggucagacaguuccacuaguuaauaggag

SEQ ID NO: 4124522 - RNA, 69 nt, Human
cuccucugcugucccuuccacagugucugguggaagugcuaaugacagggaaagggacagcagcaggag

SEQ ID NO: 4124523 - RNA, 62 nt, Human
cuccucuggcuuccuggaggcauuggggauugacaggcuuaucugggacagggccugaggag

SEQ ID NO: 4124524 - RNA, 78 nt, Human
cuccucugucucucacagguaccagcacccucccugguucaggcagggaaugaggaauagguuugugugagaugggag

SEQ ID NO: 4124525 - RNA, 77 nt, Human
cuccugaacauggugcuuucaaauuuccuguuucacaacgacugagagguaauuugaagugcaaaaaugugagugag

SEQ ID NO: 4124526 - RNA, 60 nt, Human
cuccugaccucgugauccacccgcuucggccucccaaagugcuuggauugcagguaugag

SEQ ID NO: 4124527 - RNA, 60 nt, Human
cuccugaccuugugauccuccugcccuggccucccaaaguacugggauuacaggucugag

SEQ ID NO: 4124528 - RNA, 70 nt, Human
cuccugagcacccuaccugccacugagagugcccgacucucuaguguagugcaggaaggaguguggggag

SEQ ID NO: 4124529 - RNA, 63 nt, Human
cuccugagcucugaggaagcuugccuucuuuugagcuaccugauccuucuucugagcaagggg

SEQ ID NO: 4124530 - RNA, 65 nt, Human
cuccugauuugccaaggaguucugaguccagauuuaccugacccugggcucuuagguagcagggg

SEQ ID NO: 4124531 - RNA, 55 nt, Human
cuccugcaguccaaaccucagagcuccuuuggggaggaggcgaggcgugcaggag

SEQ ID NO: 4124532 - RNA, 78 nt, Human
cuccugcauauuguccuugauauuauuuacuguaacuaggauuuaucucaauaauaaugcgaggagaaaaugaaggag

SEQ ID NO: 4124533 - RNA, 86 nt, Human
cuccugccuggcucccucucccugagucagacacagaucugccuauuuggccagacugagucaggagaggaugggggccaugugag

SEQ ID NO: 4124534 - RNA, 66 nt, Human
cuccugcucucauggcacaacgugcucaccauuuguucagucgggcaccaggccauggagcgggag

SEQ ID NO: 4124535 - RNA, 55 nt, Human
cuccuggaugcaggcugucugccaccuuccugcagcauccgccugcuuccugggg

SEQ ID NO: 4124536 - RNA, 73 nt, Human
cuccuggcuuucccagaccagguccaacaugguucccacccucccaacguuuccugggggagaagccgaggag

SEQ ID NO: 4124537 - RNA, 73 nt, Human
cuccugggauggccuccuuccugucuggggcccacaggcagcuuguccuggaggaugggccaagccaccggag

SEQ ID NO: 4124538 - RNA, 56 nt, Human
cuccugggcaggagagagucugccagugacagcugaggcagcucaggcccagagag

SEQ ID NO: 4124539 - RNA, 61 nt, Human
cuccugggcuucgaaggcucccgggcccaguaagaaggaggugggugccaagguugaggag

SEQ ID NO: 4124540 - RNA, 67 nt, Human
cuccuggggugggguuacucauucugccuagggugagguggaaggaugaaauggccccacagaggag

SEQ ID NO: 4124541 - RNA, 64 nt, Human
cuccuggguaucccuuccucgggguugguuugucacagccagcucugggccaggaacccuaaag

SEQ ID NO: 4124542 - RNA, 130 nt, Human
cuccugguggcucaauggcacuaucugugacuguguuggaugcacacagguggucaucucccaguacagugugagucauucagcaccucaagucacugaagagugccugacagacccuaggcccuccuag

SEQ ID NO: 4124543 - RNA, 61 nt, Human
cuccugguuccugucuuaaauaaucuuuuaaagguaaaguuuccaagacagaagccaugag

SEQ ID NO: 4124544 - RNA, 59 nt, Human
cuccuguggucaagggugggacucacccucagcaaguuucacuuuaaccccacaggcag

SEQ ID NO: 4124545 - RNA, 67 nt, Human
cuccuuacuguacaccuacagaaaaggagaguugguggaggcucuccuguagguguacaguaaggag

SEQ ID NO: 4124546 - RNA, 67 nt, Human
cuccuuacuguacaccuacaggagagccuccaccaacucuccuuuucuguagguguacaguaaggag

SEQ ID NO: 4124547 - RNA, 71 nt, Human
cuccuuaucacacugcauuuugauagugccuuuaauggugguggcaaguuaaagaauagauggguagggag

SEQ ID NO: 4124548 - RNA, 65 nt, Human
cuccuucacuguagggaucccuucucauuucucacagggaucccuucuggcagcagugugagggg

SEQ ID NO: 4124549 - RNA, 70 nt, Human
cuccuucuagauagagagcuacugcgagaacuuugcuuucaagcaacugcuuuuugaucucaggagagag

SEQ ID NO: 4124550 - RNA, 71 nt, Human
cuccuucucuuccccuuaguuuccuuuaagagugauaaaaauggaaaagggggcugagguggaggaaggag

SEQ ID NO: 4124551 - RNA, 67 nt, Human
cuccuugcacccaugagaugccaagugccugcugugaacacaguaguauuuucugugauguaggggg

SEQ ID NO: 4124552 - RNA, 84 nt, Human
cuccuuguccugcaaccucacauggcauaagagaagacaggcaaaagaaacuaaugcugugugcucacguaguggaagauagag

SEQ ID NO: 4124553 - RNA, 76 nt, Human
cucgacaaguauagcacacuggggagauacaaagauggaguagcugcaccccuuccccaggugcucacugucuggg

SEQ ID NO: 4124554 - RNA, 61 nt, Human
cucgauagcagcgcuggcccucugccuugaacgccacggcggcacgcaggcugcugucgag

SEQ ID NO: 4124555 - RNA, 73 nt, Human
cucgauagguggugugcgaagagcguguuuuccaaaaauggcugcgacuguauuucccacauucucuauuuag

SEQ ID NO: 4124556 - RNA, 79 nt, Human
cucgcagucuuuaucucgcuccuggauuggcagggagcugaaagaucagaagcaggaggaaugaagucaacacagugag

SEQ ID NO: 4124557 - RNA, 68 nt, Human
cucgccaucaugccccgcuacagugcaggagcgcagcugcugccaggcuuagagcaggggcuggugag

SEQ ID NO: 4124558 - RNA, 125 nt, Human
cucgccucuguauuucuauguauguguguguacuuaugucauuuaaauguuuguauauguguacguguauacauuuggugcauauuuacuaaccuaaccuauuuccaugcauagcacauagugag

SEQ ID NO: 4124559 - RNA, 105 nt, Human
cucgcggccccucagaccccacgcggaggaggucaggaggugacacagguucgcggaagaaagcgggacucaucuuccucauuucuccagggauuuagguguggg

SEQ ID NO: 4124560 - RNA, 99 nt, Human
cucgcggccgcagacccccucuccacugcagccccgcaggcagccucuccggcgugggcuucaccgcgggguugcaggggggccaagaugaggcgcggg

SEQ ID NO: 4124561 - RNA, 74 nt, Human
cucgcucuaacaccacagugugguuuggacguggccacagugccguacaaaccacagugugcugcuggggcggg

SEQ ID NO: 4124562 - RNA, 64 nt, Human
cucggaagcaggcaacaguggcggauacugugaguggcaugaguccugugaccugcauccugag

SEQ ID NO: 4124563 - RNA, 92 nt, Human
cucggcgcucauccccagcacagcccuccccaggcugcggcaaagacuguugcuguccugcugagggaugugcccccggggauucaaucgag

SEQ ID NO: 4124564 - RNA, 82 nt, Human
cucggcuucuccagcggacgcugcuggcuccauucucuuaaguuugaugaagcaagccagccaguucacuaggaaaguaaag

SEQ ID NO: 4124565 - RNA, 118 nt, Human
cucgggcgacagcaucauuuauaucuuccacgcacacaaucuuuucugcaugugcgugagucucgauuacaggcaguugagguuugugugguaggcauuaugcauuuaugagccagag

SEQ ID NO: 4124566 - RNA, 68 nt, Human
cucgggcgagcaguucccagggaggugagcugugcagacccagggccuccaccgaacgcucucuugag

SEQ ID NO: 4124567 - RNA, 128 nt, Human
cucggggaggccauuaccauggcugcucucugucugcccugugaggguccuugggguggcugcacucuggggauggugcuggggcugacugacucacgcggucguguaacacaucagaccuuccaaag

SEQ ID NO: 4124568 - RNA, 59 nt, Human
cucgugcuggggaggcagcagagaacacagucaccuugacauguuuucuuccccgggag

SEQ ID NO: 4124569 - RNA, 56 nt, Human
cucguuccuagcaaggcugcuccaucugcaugggcucggcgcugcugggaucuggg

SEQ ID NO: 4124570 - RNA, 107 nt, Human
ccuucaaucagcgcaguuccacccguguuuacugagccugugcccucaucaggccucuguggggugcugggcucaggugggggaggcagggaacugugggaugaggg

SEQ ID NO: 4124571 - RNA, 67 nt, Human
ccuucaaucauaaguauaacugguacagguuaagcaugccuuaccugaaaugcuuaggaccagaagg

SEQ ID NO: 4124572 - RNA, 96 nt, Human
ccuucaccuacauucauauacagauauguuccaugcaucgcuaauugaugguuaaugcuaagugggagaugucuacuguggagcuuuuggagaugg

SEQ ID NO: 4124573 - RNA, 58 nt, Human
ccuucagccaguuuucuuuguugcagaaguauuugucugguuaggauucugcugaagg

SEQ ID NO: 4124574 - RNA, 78 nt, Human
ccuucagcucaauggcccagggucuacagccucaagaccuccuugaugcuacuaccugggcugaaagcugauucaagg

SEQ ID NO: 4124575 - RNA, 102 nt, Human
ccuucaggaacagaguggcucuggaccucagcuacagacugcagcuaauucauaaaugucaacagucaagaggaggggaaccagaacauuuugucuugaggg

SEQ ID NO: 4124576 - RNA, 72 nt, Human
ccuucagggcaggcgagcagcugcuugaugggaaaauauacuaaacaccaagcagagcgccugcucagaggg

SEQ ID NO: 4124577 - RNA, 122 nt, Human
ccuucaucacuugguuaagguagugugcuaggcuucuccacauaaaguuacaauuuuccccuuucuguacucuacucugcagaagcaagucacuaagacuaucgagccuucagggaugaagg

SEQ ID NO: 4124578 - RNA, 71 nt, Human
ccuucauuuucuucuaacuuguauguauaguuuucucaucgaaaauucauuuuuguagguuaguaugaagg

SEQ ID NO: 4124579 - RNA, 90 nt, Human
ccuuccaauauuuuggcuacuucaugguccauguauuuuuuagaugacagagcauugcacgacaugagaggcuguggaguacaaggaagg

SEQ ID NO: 4124580 - RNA, 78 nt, Human
ccuuccacccgaugggaggcuguaacuugggcacuggggugacuuuuuccaugcccuugucaucuccagggugggagg

SEQ ID NO: 4124581 - RNA, 76 nt, Human
ccuuccaggaaagcaggaaauucccgaggucacacuucagauugaucucagaaaaccucuuucuugauagugaagg

SEQ ID NO: 4124582 - RNA, 76 nt, Human
ccuuccccaaaaccugccagcugagaaggguguccccucaggguggacucugucauggcuggacaggcagggaggg

SEQ ID NO: 4124583 - RNA, 55 nt, Human
ccuucccuagaucucagcgccuucauuuuagaaaugaaaaguucgaucuagaagg

SEQ ID NO: 4124584 - RNA, 78 nt, Human
ccuuccgggcugcuggggaggcgccucgacguuccaucuggagagccucgacguuccgcccgagcccggcgcgggcgg

SEQ ID NO: 4124585 - RNA, 68 nt, Human
ccuuccucuguggcuugccuuucuguccaccaagaacaaagggggagaaaagagagucagagaguagg

SEQ ID NO: 4124586 - RNA, 70 nt, Human
ccuuccuggagcccaugcagauagccuccaaaacacaaagcagccaucugcuuccugggcuccaugacgg

SEQ ID NO: 4124587 - RNA, 111 nt, Human
ccuuccuguuauaucuuuuauguucuuccuucaauuuggaaggagagaaaauaucuucuugcauuuucuaggagggcaaauagguaaauaggugauuauaagacaacaagg

SEQ ID NO: 4124588 - RNA, 57 nt, Human
ccuuccuuucucccuacaccaaggcacaaucaagggugaauggggcaggaaggaugg

SEQ ID NO: 4124589 - RNA, 71 nt, Human
ccuucuaccaccagcuuacagucucaccccuggccuggguuaguggggggagcugcaagcuggaaaggggg

SEQ ID NO: 4124590 - RNA, 59 nt, Human
ccuucuauggagaucuccuuuggggucuaggcaaaucccuggaguaaauucuuggaagg

SEQ ID NO: 4124591 - RNA, 76 nt, Human
ccuucucaggaccuccagggaucucugagucucugggccagcccagugacuccugggccucugagaggccugaagg

SEQ ID NO: 4124592 - RNA, 69 nt, Human
ccuucuccaggcugauaggguccaaaguugucuucaguggcuaacauuugcgaguggguuuggggaggg

SEQ ID NO: 4124593 - RNA, 62 nt, Human
ccuucucugcagguaguuggcuacaggggucuaccaaaaccaaucuauuucugcaguaaagg

SEQ ID NO: 4124594 - RNA, 55 nt, Human
ccuucuguaaacugauuuuucaccaagauugaggagaaucuuuccccacagaagg

SEQ ID NO: 4124595 - RNA, 100 nt, Human
ccuucugucuggguaaccgagucuccacugguccuuccuaaaaaagggaaagacuuuauuauaguggcaauagaagaggcauggucuccaguuuggaagg

SEQ ID NO: 4124596 - RNA, 129 nt, Human
ccuucuguggagcuugccaggccuugguguuugcucugccccuccccagguggcugggggaaggaaaaggcagucacaugaggaaggggaaggaaaggcagucacaugaggccuccagcuccaggaaag

SEQ ID NO: 4124597 - RNA, 61 nt, Human
ccuucuucuguguggcccaagaugacucaccaauaugucuguauucuacccagugagaagg

SEQ ID NO: 4124598 - RNA, 72 nt, Human
ccuucuuucacccaguuaaauccucucugggcuuagaaaggcucaggaacccccgcugggugaaacuccagg

SEQ ID NO: 4124599 - RNA, 62 nt, Human
ccuucuuuccuuucuuuaccaagggccuuuuuuggcuuuggcccugguuuuagaggagcagg

SEQ ID NO: 4124600 - RNA, 128 nt, Human
ccuucuuuuagauaugcuggcaaauaauuacuguagauauggcuggaauacugaaaggcuguacucuggucauuucagauugccugaggaguaaccacccagucugcugcagcaugaauucaggacgg

SEQ ID NO: 4124601 - RNA, 60 nt, Human
ccuucuuuucuuuacgguguaggaguuguaaaaucaauuucaugugaagaagagauaagg

SEQ ID NO: 4124602 - RNA, 65 nt, Human
ccuucuuuuuacagcuuucuucuuguuuuggccagaacuggaggguccaucuugugaaaaggagg

SEQ ID NO: 4124603 - RNA, 107 nt, Human
ccuucuuuuuccuuggugacuacaggccggcaucagagaguccgauuuauaacaugggcucuaccuuugcaaugcaguuacuuucuuuuccuuggggagagggaagg

SEQ ID NO: 4124604 - RNA, 55 nt, Human
ccuugaaagccaggcagaggaaccugaguuuaccuugugguccugguauucaggg

SEQ ID NO: 4124605 - RNA, 85 nt, Human
ccuugaaguauaauauggcauauaguccagcauaaacauacacacccauccuugugagguuauuaugccuauuauacagacaagg

SEQ ID NO: 4124606 - RNA, 127 nt, Human
ccuugaagugguuguuccagugacucugagauuaagcucaacagcugggcgucucugggaaagcuggcagggcuggcaggauccacagggauguugaguucuuagucuuccaagcuggacuucaagg

SEQ ID NO: 4124607 - RNA, 129 nt, Human
ccuugacauguggcguuacaugaaagucaguguggcacguguucuguggcaugggugcuggcaucccaaguagcaggauacaugauuguuggucuauauaugacacaugacaaauguccaugucacagg

SEQ ID NO: 4124608 - RNA, 60 nt, Human
ccuugacuagugcuuaggacuucuuaggaaccacaguuccuauuucaaagcuuaucaagg

SEQ ID NO: 4124609 - RNA, 71 nt, Human
ccuugagaaauuaaugaugggaucucugaaacuucauugaagacagcagauacuuucauugaagaauaggg

SEQ ID NO: 4124610 - RNA, 79 nt, Human
ccuugagaggguucaagagcugaggaggaugagggccagcccuaggccauuccuucucuugaucauuucccucguaagg

SEQ ID NO: 4124611 - RNA, 75 nt, Human
ccuugagugguuggauccauguggauugauacuuucaguugcguaguuaguucauagaauguaacaggaucaggg

SEQ ID NO: 4124612 - RNA, 130 nt, Human
ccuugaugauuugauuuuuuuaaauaguuaugguugugaaaggaaggcaugaaaaguggaagauauuuuaaaggcagauuauggcuuauccuuaauuauagcugcagcugagcugaggaguuggguuggg

SEQ ID NO: 4124613 - RNA, 72 nt, Human
ccuugcacaagacggagguuguggcagcugcuugagugacagcaaaggacgaacacucuguacugugugggg

SEQ ID NO: 4124614 - RNA, 85 nt, Human
ccuugcccagggccagcucugauuuugaccuccagaugcuuccuacuuuuucuggcuccucaucacaguugguggugauguaagg

SEQ ID NO: 4124615 - RNA, 56 nt, Human
ccuugcccugcguuaccaucucuuucucaacaggaaaggggugcaacaagggaagg

SEQ ID NO: 4124616 - RNA, 80 nt, Human
ccuugcccugugccuggcccaguggugucaccugaggaauggggaaugagcaccucuggguccuggucuaggguacuugg

SEQ ID NO: 4124617 - RNA, 76 nt, Human
ccuugccuaaggagagagcuuugcuggaacaauuggaggacaacugccagccccuuagggcucucccgggcaaagg

SEQ ID NO: 4124618 - RNA, 67 nt, Human
ccuugccucuaauuagcucugugacccugggcaaaacuguccacuugcauuaauguggaggcacagg

SEQ ID NO: 4124619 - RNA, 59 nt, Human
ccuugccuugguccuucgcaggaaugagccaccaggcuguggaggagaaggggucaagg

SEQ ID NO: 4124620 - RNA, 62 nt, Human
ccuugcucucuuugaaagaucuuauuaaauacaaugaucucauucuuucaaagggagugggg

SEQ ID NO: 4124621 - RNA, 56 nt, Human
ccuugcucuuuagguggcagcauaacuuuguuguuaacacaauucuggagagaagg

SEQ ID NO: 4124622 - RNA, 81 nt, Human
ccuugcugauuuuagagcuucuguucaugccugcuggcagcaugccaguacagaaggagcuuuggauucacuaaugcuugg

SEQ ID NO: 4124623 - RNA, 81 nt, Human
ccuugcugccccugcugcagagagcuuuccauccuccgcaccgcguggucaggcugcucugcggcgugcgggacagcgagg

SEQ ID NO: 4124624 - RNA, 60 nt, Human
ccuuggagguccuggcuggguuuuaaugacugguauccuuccccaggaccuugagucagg

SEQ ID NO: 4124625 - RNA, 56 nt, Human
ccuuggccucagauuauugcacaguuggacaaugacugugguucuguggcucaagg

SEQ ID NO: 4124626 - RNA, 68 nt, Human
ccuuggcggggcugccacaucuccagucccugcgcggcagggcacagucugcagccccccagccuagg

SEQ ID NO: 4124627 - RNA, 65 nt, Human
ccuuggcuuccugcacuugaguuucagcccucuggagcuucauauguugcagagaaugccuaagg

SEQ ID NO: 4124628 - RNA, 66 nt, Human
ccuuggcuuccuucccucuagacaagugaagcuuuacucuuugaggaggaaaaggggguaccaggg

SEQ ID NO: 4124629 - RNA, 55 nt, Human
ccuuggggaacuucaguauuauaagaaaacuuauaacacugauuuguucucaggg

SEQ ID NO: 4124630 - RNA, 87 nt, Human
ccuuggggagguggagaaagcccugggagauuuucuggguuuguuugaggaccugaauccccagggccuuccgguugcuucccaagg

SEQ ID NO: 4124631 - RNA, 92 nt, Human
ccuugguuuucaguucuucgugaggcucugcaucgcacaggcacugugucucaggggaucagagccuuuuaagaguuggggaugccugaagg

SEQ ID NO: 4124632 - RNA, 81 nt, Human
ccuuguaauuuguucccaagcagaauagauauguucuuauauuuggaugcucuaggucugauggggcagaaaauuacaugg

SEQ ID NO: 4124633 - RNA, 73 nt, Human
ccuuguauagccacacuuauucucaugcacauguaauuuuuaacugugauggauagaguuuggcguuccaggg

SEQ ID NO: 4124634 - RNA, 82 nt, Human
ccuuguaucuuuaucccucguuggagccuaacauaaacuguugcaugugguaaguuuucacugaggguuuauugauugaagg

SEQ ID NO: 4124635 - RNA, 115 nt, Human
ccuugucaccugccuuuacacucagccugccccacccucgcuccauuucggugaucaauucauccacugaauggacauuuggggguggagcgaguggugauaaaugcacauuagg

SEQ ID NO: 4124636 - RNA, 63 nt, Human
ccuuguccucugguuuccuguuucuggccaguggggagccuugacaggagaucugaggaaagg

SEQ ID NO: 4124637 - RNA, 124 nt, Human
cuacuuuacacaauauugggcaucuucaugacagcuauugacgucuuuaauuauuuuuaacuccacuuauauuauugagcucaguguagucauggcuuucagaagcacaaaaacaaaauaguag

SEQ ID NO: 4124638 - RNA, 78 nt, Human
cuacuuuuaaauaccaaacuuccugagcagucuaauugcugcucuuuggaacaagaagaaauggcuauuuaaaagaag

SEQ ID NO: 4124639 - RNA, 74 nt, Human
cuacuuuuauggagcauacauucuaguuggaggagagagaccacaaauagguaaauguaugcugugcggcagag

SEQ ID NO: 4124640 - RNA, 62 nt, Human
cuagaaagcagcuucccuggcuccuggugcaucacaugaggaguggcagggcugcucccuag

SEQ ID NO: 4124641 - RNA, 66 nt, Human
cuagaaauugcaggucguguggaagugacguuucguguucuuuuaauagagauccuguguuucugg

SEQ ID NO: 4124642 - RNA, 81 nt, Human
cuagaagggcuguucaagacuaggaaauuuuauauuccuugaauuuuguggaguuucaaaaugcuuugacacuuuucuuag

SEQ ID NO: 4124643 - RNA, 61 nt, Human
cuagaaugagggacagcuaaagagaaauuucagaauauccuuagagcuaucccuagaauag

SEQ ID NO: 4124644 - RNA, 69 nt, Human
cuagagaaaaagcuuagguacgcgucuccaaaugaugguuucuuuuucuacaccuuagcuuuuucauag

SEQ ID NO: 4124645 - RNA, 80 nt, Human
cuagagacagucuauacuggacuguugugauuucaaagggaaauauuuacaacucugucaguauagcuguuccaguuuag

SEQ ID NO: 4124646 - RNA, 65 nt, Human
cuagagaggugguguuggguggcagaaagagccaggguuugaaaccuagcucugccucuuacugg

SEQ ID NO: 4124647 - RNA, 114 nt, Human
cuagagauaaauaaauaugugcaaggaaaauaacuuugaggucacugaauuccaggaaacugagaucacugaaauucugugucccagagugcaauauuuauuucacaacuguag

SEQ ID NO: 4124648 - RNA, 61 nt, Human
cuagagcuguucugugcacucagcuuuccaacauuaagcaagaugugaggacaugcucugg

SEQ ID NO: 4124649 - RNA, 67 nt, Human
cuagaggagauggugcagcagagaauacuguuauaaagcauuauucuuaugucaucauggcuuccag

SEQ ID NO: 4124650 - RNA, 65 nt, Human
cuagauagcgagugucuuaggggcacgggucuaauuucagugcucacugaacucuugcugucugg

SEQ ID NO: 4124651 - RNA, 78 nt, Human
cuagauaucuuuuuaguauaacuauguguuugguauauaauauguguacauacacaaauauacuguuuugagaucuag

SEQ ID NO: 4124652 - RNA, 69 nt, Human
cuagauggucugaaaggcagcggaaucccaggggugagcccagagucuucuguuuuucagcagcucuag

SEQ ID NO: 4124653 - RNA, 66 nt, Human
cuagauggugguugcucaaaaaauuaaacauggaauuaccauaugauucagcaaguccacuucugg

SEQ ID NO: 4124654 - RNA, 71 nt, Human
cuagcaacucacugcugcugugcuauuacaacuuagcaaggauugagagcacugguagcuggaggggcuag

SEQ ID NO: 4124655 - RNA, 70 nt, Human
cuagcaggcuaauguaagcuuguacucccccaaauuaaaagggaucaguggcauauauuaguuaugcuag

SEQ ID NO: 4124656 - RNA, 59 nt, Human
cuagcaucuccuuaggguaaggaaggcaaaaugcccauuccugaucccagauugcuuag

SEQ ID NO: 4124657 - RNA, 97 nt, Human
cuagcccucaauaaaguuaaucaguuuuagcuagagcaaaccagcuaacauuaagaaguuggucucuggcuauagcugagauguagaugacaccuag

SEQ ID NO: 4124658 - RNA, 65 nt, Human
cuagccucggaggaccuuggugcugagggagugucccuugccuucagugucccuuugcaggcugg

SEQ ID NO: 4124659 - RNA, 75 nt, Human
cuagcucaaaguccuugcuuuuucugugacaucauauaggggaauuuacagauuagcuggggccauugauucugg

SEQ ID NO: 4124660 - RNA, 118 nt, Human
cuagcucauaaacuccgacuuaaaagccagucucaguuacucucccugguacuuggaggucccagugccagagagagugacugaggcuagcuuauaagucggaguuucuccaggcugg

SEQ ID NO: 4124661 - RNA, 91 nt, Human
cuaggaauaaacuuagaugugcaggacuuuuaucaaggacaggacaaaauuuugcugaguggaaugaaagauuugcauucuauguuccugg

SEQ ID NO: 4124662 - RNA, 55 nt, Human
cuaggaaucaccaagauucuagaucguacuuucuaggaaucuuggugauucugag

SEQ ID NO: 4124663 - RNA, 55 nt, Human
cuaggaggugacaggugggaaaggcugcgaccucacucaucucugagccuccugg

SEQ ID NO: 4124664 - RNA, 86 nt, Human
cuaggauaagaacacuuggaacuuaguaauaugacaugcuuuucauuugguuguuuuguuuuaauuuccacagaucugcuuuuuag

SEQ ID NO: 4124665 - RNA, 75 nt, Human
cuaggaugugagaaaaauuccuaaggguuugaguucagagauccuggagaccagaaggaagcuucgaacagcugg

SEQ ID NO: 4124666 - RNA, 59 nt, Human
cuaggcaguaaaggauaccaagucucauagaugaucuggaaugucugauucugcucuag

SEQ ID NO: 4124667 - RNA, 77 nt, Human
cuaggccuugguuuccuuaacagccuaaagggacagggagguggacccuuuguggcaggagcggagaccgggccugg

SEQ ID NO: 4124668 - RNA, 67 nt, Human
cuaggcugugcauugcaugacaucucuuguggauaccugagcaagaaacagcaguacacaugccuag

SEQ ID NO: 4124669 - RNA, 62 nt, Human
cuagggagcagcccugccacuccucaugugaugcgccaggagccagggaagcugcuuucuag

SEQ ID NO: 4124670 - RNA, 114 nt, Human
cuagggauccccugagcugaguuccuacagagggaagaugguccaaucuuacuacacugugagcucauccccaugguccgucgccuuccaguugccugcucagcccgucccugg

SEQ ID NO: 4124671 - RNA, 63 nt, Human
cuagggcaguucaacuucauaguggugcagacggcgcucuguugguuagcugagcuggccuag

SEQ ID NO: 4124672 - RNA, 84 nt, Human
cuagggccacauagcuagucaguagugaagccuggauccaaacccagaucugucugucugcacagcucaugggaaaaacccuag

SEQ ID NO: 4124673 - RNA, 67 nt, Human
cuaggggaagaggacuguggcauccuagcaccaccaaguaucagcugggguaccaaaccucuccuag

SEQ ID NO: 4124674 - RNA, 71 nt, Human
cuaggggcaugaaauagagaauucaguagcccaauaaauauaguacacauucuugucauuucauguucuag

SEQ ID NO: 4124675 - RNA, 61 nt, Human
cuaggguggccugcugggaucagacaccauguggaggacaccaucucagaggccauccuag

SEQ ID NO: 4124676 - RNA, 87 nt, Human
cuaggugaggggaugccaggagccagcuucuuagcauucucagugaugccgaccuagcucccuggcucucccucauuuucucccugg

SEQ ID NO: 4124677 - RNA, 118 nt, Human
cuaggugauauaggggcaaauauuaauaacuaugacuauuuaucaaguguuuccuggggcugguuucagccacaaaggcaggugcugaauauucugagcugcccuuuuaagcacuaag

SEQ ID NO: 4124678 - RNA, 86 nt, Human
cuagguuaacuagauuauaugucaucacagacacccucuacaucuuagggggugucugugauggcauauaaccuaguuucuucugg

SEQ ID NO: 4124679 - RNA, 84 nt, Human
cuagguuuuggcuagguugcagguuccaagcugcucuccugcugugucggugaguucugguuaaccugcaaccuccugaugugg

SEQ ID NO: 4124680 - RNA, 76 nt, Human
cuaguacauguacuuaugcuuauuguuuaugggagggcuagacuuuuauuaaugaguacaaguuauuucugacuag

SEQ ID NO: 4124681 - RNA, 116 nt, Human
cuaguaugcuuucauccacaguguauguacaugauuucauuugcuuuucaccaaccuaucagagacaaaugguaauuaugucuaguaagugcaaacacuaaacacgagcagcacag

SEQ ID NO: 4124682 - RNA, 92 nt, Human
cuagucuuguauuguacaguggguguagucuuccuccugaguuuccuugagaugagggcugcacucaaaaacaaagaggaaaacaaggcugg

SEQ ID NO: 4124683 - RNA, 58 nt, Human
cuagugaacgugguacuauggaaggcuagaaagcccgccauucaaccauguucucugg

SEQ ID NO: 4124684 - RNA, 65 nt, Human
cuagugccucaguuggaaaugcagaacucacccaucuucugcguugcucacgcugggagcuguag

SEQ ID NO: 4124685 - RNA, 112 nt, Human
cuagugcugccacccccuugggucggugagcauggcugcucuggauggaguccuguguuccagaggcccaggucaagcagccaccgucccuaggcacgguccccaagcaugg

SEQ ID NO: 4124686 - RNA, 101 nt, Human
cuagugggugcagagccagacaggaggcacuucccgucucagccucagccucuaucuccaccggcauggcuaagugcugcugucagcuucucacccgcugg

SEQ ID NO: 4124687 - RNA, 67 nt, Human
cuagugucucuucuauuugagacuauuucuacaagcagaaaaacucaaaucagggaggaggaauuag

SEQ ID NO: 4124688 - RNA, 75 nt, Human
cuaguuaucaucacaauuuuaugacccucucacuugagaguggaaugacaaugugguuauguaaccuaagacuag

SEQ ID NO: 4124689 - RNA, 55 nt, Human
cuaguucuagaucccugaggaaucaccacacugacuuccacagugguugaacuag

SEQ ID NO: 4124690 - RNA, 110 nt, Human
cuaguuguguuugagugccauuagaauguaaauuccaagggcaggacauuucugccuguuuuguuucugcuuuuguuuguuauauucccagcaccuaaaaccacaccuag

SEQ ID NO: 4124691 - RNA, 56 nt, Human
cuaguuuaaagcagcugaaagggcucuuugugccucucuccuugacuuugagcugg

SEQ ID NO: 4124692 - RNA, 61 nt, Human
cuaguuuaugcgaugggaacauuuuaguuggggcuuuuguucauucaucacaugcagcugg

SEQ ID NO: 4124693 - RNA, 65 nt, Human
cuaguuuccuaaaacuacucuacugcuuacucgguagcugagggaccauguuucaggagagcuag

SEQ ID NO: 4124694 - RNA, 55 nt, Human
cuaguuugcaugcaguugcugguauggcacugcucagcagccugcugcagauaag

SEQ ID NO: 4124695 - RNA, 71 nt, Human
cuauaaaaugagaauaguuguaguaucuaucucgugaauuuauuaugagaauuaaauuauuuucucugugg

SEQ ID NO: 4124696 - RNA, 60 nt, Human
cuauacuuucagggaucauuucuauaguguguuacuagagaaguuucucugaacguguag

SEQ ID NO: 4124697 - RNA, 59 nt, Human
cuauacuuuucucugacuuuguauaguaucuguaacuuuaugauacagggaaggguugg

SEQ ID NO: 4124698 - RNA, 57 nt, Human
cuauaggacugagauugucaguuugcuagcaaaagggacuacucucagcuccuagag

SEQ ID NO: 4124699 - RNA, 73 nt, Human
cuaucaagccugcgcugagaaguucuuuagagugguacuuccuaaauacauuuacagucguggcuuggcauag

SEQ ID NO: 4124700 - RNA, 59 nt, Human
cuaucacagaggguuguuuugagccauguaacgcucucagaacaguucuuggugcauag

SEQ ID NO: 4124701 - RNA, 64 nt, Human
cuauccauuaaagccuuggaaauugcugguaaauauguaaaaaaucaagugcuuaaauggauag

SEQ ID NO: 4124702 - RNA, 75 nt, Human
cuauccgagucucaguuucuuacucuguauaacaagaguuguugugaagguugaagaaacuuaguaaaucagugg

SEQ ID NO: 4124703 - RNA, 78 nt, Human
cuauccguggacaguuacugagcuugaguaaguuuuugaugucaaaauaauucaggucacagucugaacauuugacag

SEQ ID NO: 4124704 - RNA, 81 nt, Human
cuaucucauguguuauuguuuguuucuuacucaucucuuagauuuuuaggugcuggaguagaagaaaaaaugccugagugg

SEQ ID NO: 4124705 - RNA, 88 nt, Human
cuaucugcauuauauuuguacaauuagcagaggcuaaaagaaacuugauaauuucuuaguuuggugaauugaaauauaagcauauuag

SEQ ID NO: 4124706 - RNA, 69 nt, Human
cuccaacuaaaguccuguuguagcauagacagugaaaugcuaugacaucagaagacuuuaaaauugcag

SEQ ID NO: 4124707 - RNA, 94 nt, Human
cuccaagcccaguucucuuuccacuggaggcuggauaucagaggcgucuggcuauaauuuaugggaagagguccaagcugggcagcuguuggag

SEQ ID NO: 4124708 - RNA, 73 nt, Human
cuccaaggaaaaguccaggggcuggaggcggcgacccgucuguggcaguccagacccuggacucgauucggag

SEQ ID NO: 4124709 - RNA, 74 nt, Human
cuccaaggucuauguguugucaggccuuuaugacucugaggccugcaucuuacugacagcacaugcaaucggag

SEQ ID NO: 4124710 - RNA, 73 nt, Human
cuccacaggcacaggcugcucugcacaggggcugguggggggacuucccaccaggcagagcuguccaugggag

SEQ ID NO: 4124711 - RNA, 70 nt, Human
cuccacaguguccgcgguuugcguugugggccggaggcuccgcagcgggccaauccggaggcguguggag

SEQ ID NO: 4124712 - RNA, 57 nt, Human
cuccacccagcucccuggaaacugucaaggauaacucuggcaggagcuggguaggag

SEQ ID NO: 4124713 - RNA, 128 nt, Human
cuccacccccuucaaaauagcuuuucgucaaaauuauaacugcuuuguuuuauugaauugcugaaauuuaaugguuuaaugggugaaggcaugaaggaaaggcuguaaaaaugugaauaaugguguag

SEQ ID NO: 4124714 - RNA, 66 nt, Human
cuccacucaacaagcccaguguauggccuagaacucccaucauaccugugcaccaauugaggagag

SEQ ID NO: 4124715 - RNA, 80 nt, Human
cuccacuuaaacaugcccagugacagggaucuuacugcuccuaagguucucuguucccuugggcaguuucagagcugggg

SEQ ID NO: 4124716 - RNA, 82 nt, Human
cuccacuucccuguccuugccccacagccaacuucacccucagcaagggccuuggcaugggccagggagagcugaggucaag

SEQ ID NO: 4124717 - RNA, 55 nt, Human
cuccagaaagcagccagaugaacaugaaguuauguucauugaacuauuuguggag

SEQ ID NO: 4124718 - RNA, 59 nt, Human
cuccagaaggugggggagccacuagagguaaggagccuggaccccucgaucaucugggg

SEQ ID NO: 4124719 - RNA, 86 nt, Human
cuccagagcauugcuggacauccuuuggaaauaaaugaugugcaagauguaauuucuaccguccagggaugccagccauguuggag

SEQ ID NO: 4124720 - RNA, 55 nt, Human
cuccagaggaaagcacauagugggacagaaaccagagugcucuagacuucugggg

SEQ ID NO: 4124721 - RNA, 73 nt, Human
cuccagaguccuugucugauugcuguggcgcugagcuaugccagggcccuagggaaugagacauuacguggag

SEQ ID NO: 4124722 - RNA, 66 nt, Human
cuccagcuucugcccagagacucucggggcuuuccccacccugcucugggcuggaggcaguugggg

SEQ ID NO: 4124723 - RNA, 66 nt, Human
cuccagcuugggugggaggaggugguuccucacacagagaaagccuccucuucuacucgccuggag

SEQ ID NO: 4124724 - RNA, 57 nt, Human
cuccagucuucucauguaucccuuggaacaauacagcucuuacugaggggucuggag

SEQ ID NO: 4124725 - RNA, 83 nt, Human
cuccagugaaggcacguggguggauacuggccacagcuuugccuugggccuuaagguaaccaccccaugggccugacugagag

SEQ ID NO: 4124726 - RNA, 58 nt, Human
cuccagugagcgcggggcauggucuugccacuugcacugagcccuggcucgccuggag

SEQ ID NO: 4124727 - RNA, 64 nt, Human
cuccagugcgucuuaguaaaccaucucugugaaaugguuaaguuuacuuagaagguaacuggag

SEQ ID NO: 4124728 - RNA, 85 nt, Human
cuccauaaaaacugacccauccuuugcaucaacaauaguggcuugaugacgcucuucaguagaggauuuugcauuucauaugggg

SEQ ID NO: 4124729 - RNA, 67 nt, Human
cuccaucuccaaaagagauuaauaagauaaauaaaaguuuauuugccagaauuucucuuggggagag

SEQ ID NO: 4124730 - RNA, 61 nt, Human
cuccaucucuguaccucagggggcuaaaaguaguaagugcagagcccugggcacaugguag

SEQ ID NO: 4124731 - RNA, 80 nt, Human
cuccaugagauaaaaagucgagguaaaacgguuccuuugggggaaagacuuauuuugacuucaccugguguuucgcggag

SEQ ID NO: 4124732 - RNA, 75 nt, Human
cuccauggaaugucacaguugcaacaugaaucaacaaugauuccugucaccagacuugaugccuuccaucucgag

SEQ ID NO: 4124733 - RNA, 86 nt, Human
cuccauuggcuaccacagugggccacaagaaguucaggguugauaacaagaagcagggaccuuggcccauguaguagcagauguag

SEQ ID NO: 4124734 - RNA, 70 nt, Human
cuccauuguuccucacguggacagaugaugcguccugguaaagcauguauuuuccaaaaggaaguuggag

SEQ ID NO: 4124735 - RNA, 56 nt, Human
cuccauuguucgcgcagcugcaagccugcaaucccauggcugugagaaacauggag

SEQ ID NO: 4124736 - RNA, 79 nt, Human
cuccauuuccgggagcacagcugucuugcaagcuguccgaacggcagccccgugcccagcagcuggccaccgagugggg

SEQ ID NO: 4124737 - RNA, 62 nt, Human
cuccauuuguauuccaggaaugugauauauguauaaugugauauccuggaauccaaauggag

SEQ ID NO: 4124738 - RNA, 68 nt, Human
cucccaaguuucuacaugccucuuucacccuaugagaaggugguguggaauagugggaaaauugggag

SEQ ID NO: 4124739 - RNA, 58 nt, Human
cucccaccuuggcuucaguagcucacccagcucacaggggagcugcccugggcuggag

SEQ ID NO: 4124740 - RNA, 77 nt, Human
cucccacuggcuggccucacugagggaccugcauccuaaucucaggguggcaggaggaugaggcggcuacuugggag

SEQ ID NO: 4124741 - RNA, 55 nt, Human
cucccagccaggcuugguggugggcagaucccaagcugaacuuguuugcugggag

SEQ ID NO: 4124742 - RNA, 58 nt, Human
cucccagggccaucgagucacuucaaugagugugucugccuguaaggcccgaugggag

SEQ ID NO: 4124743 - RNA, 67 nt, Human
cucccagguugauucuuucccugacacaaaacaggcacuaugggcaaagacaccugcagccuuggag

SEQ ID NO: 4124744 - RNA, 127 nt, Human
cucccaguuguuucugcauuggugggagguuggugggagauuggcuggagugggagaaguuuauagcucauauuucaucucucacucugcuaccaugccucagugucaggacaagaaauaacuggag

SEQ ID NO: 4124745 - RNA, 65 nt, Human
cucccaugaggccauggcugucacuaaauacuuucugucuuugggaacagcaguuggcucuggag

SEQ ID NO: 4124746 - RNA, 72 nt, Human
cucccauggaggcagcaauaagcccugggcagaggaagagggaauguugucugaggcuguuguaccagggag

SEQ ID NO: 4124747 - RNA, 89 nt, Human
cuccccacugcagagcagcuggcugcaucuagaaguuucugcaccuccgucugggcaucagauguuuaccucuggucugcggguaggag

SEQ ID NO: 4124748 - RNA, 80 nt, Human
cucccccaaaggauggugguuugcaucccauucccgccaacuggcugauggcaggugauagccgagucacauggaggggg

SEQ ID NO: 4124749 - RNA, 59 nt, Human
cuccccccacaguguucuugccaaugagagaaaugagcaggagcauuguugugguggag

SEQ ID NO: 4124750 - RNA, 88 nt, Human
cucccccggaacucgcgaauccccugucggaacaguggcucagacggcagccccuccccacuguuggcccgaaggggucuggguggag

SEQ ID NO: 4124751 - RNA, 68 nt, Human
cuccccucuuuuaguucuaacuggagagcaaggcagagacccuucacagaugcugagagggcugggag

SEQ ID NO: 4124752 - RNA, 55 nt, Human
cuccccuuucccagaagcccgagcaaagcuggcucuguacgcaggaugaggggag

SEQ ID NO: 4124753 - RNA, 58 nt, Human
cucccgcaugagaugcugcagcugagaauucacucagcugcagaugcucagcgggcag

SEQ ID NO: 4124754 - RNA, 84 nt, Human
cucccgccccguucccaggaagccucuccaagcgaccccugcccagagcgcugaggcuccucgggaggacaaacggcgcggggg

SEQ ID NO: 4124755 - RNA, 61 nt, Human
cucccgcccugacacagcugcuccugggaaccuagugcagacccacguccagggccaggag

SEQ ID NO: 4124756 - RNA, 88 nt, Human
cucccguccaaauuagauugguuacucaauuugacugagugcuuagaaauuagucaauaaggcaacuaauuaauaauuugacuggggg

SEQ ID NO: 4124757 - RNA, 62 nt, Human
cucccgugauccuggaggagagggucugaauauauguggccaccccuaaagacucacgggag

SEQ ID NO: 4124758 - RNA, 64 nt, Human
cucccuaauaauagagguggcauuugaguuguuaccaaguggucaaaucucuuauuucauggag

SEQ ID NO: 4124759 - RNA, 76 nt, Human
cucccucaaugccacccugaccccacggcuggagaacccugugcuuauguggugggcagggccacuguugauggag

SEQ ID NO: 4124760 - RNA, 57 nt, Human
cucccucgucucucucugacagguauucagcuaccaccuacuagagagggcagggag

SEQ ID NO: 4124761 - RNA, 56 nt, Human
cucccucucuaaggcaaagagauauuucaauguuaccugggaccugagaaaggggg

SEQ ID NO: 4124762 - RNA, 71 nt, Human
cucccugaggacaggcccuguccccacucugccauauugcaggugucaaacacugggccugacuuugggag

SEQ ID NO: 4124763 - RNA, 77 nt, Human
cucccugcuguguguggggaggacgggcgccuuccugucacccacaggcucugugcauccuccccaagcacagugag

SEQ ID NO: 4124764 - RNA, 72 nt, Human
cucccugggcagauguggcucuccuugggcagguguggcucuccuugggcagguguggcucuccuugggcag

SEQ ID NO: 4124765 - RNA, 64 nt, Human
cucccugugucaucagcuguggcuacaaggacaggcuugugcagcagaauauggcugcagggag

SEQ ID NO: 4124766 - RNA, 59 nt, Human
cucccugugucuucacuuggccugauugccaaacccagcgccuucugagauacuggggg

SEQ ID NO: 4124767 - RNA, 70 nt, Human
cucccuuccucaaucaucuucuggggcucccuauuggucaaaaccaaugggaagccagaagacaagggag

SEQ ID NO: 4124768 - RNA, 56 nt, Human
cucccuucugagccuuuuguuaaguucucauggggauccacgaaccucagagggag

SEQ ID NO: 4124769 - RNA, 80 nt, Human
cucccuucugaguuguaaagcugagaaagagguuugguuuguaaggccaaaccauuagguuuuaucuacucagaugggag

SEQ ID NO: 4124770 - RNA, 98 nt, Human
cucccuugauucuaaccauggagugucaccuuccugguuauuggagaaaucuauagcagcuucauuaaaccagagugacacucuacagauuuuaggag

SEQ ID NO: 4124771 - RNA, 69 nt, Human
cucccuuuggcagggcaucagacacguggaccacuuuggguuuaucugucgggagucuuccggaggugg

SEQ ID NO: 4124772 - RNA, 62 nt, Human
cucccuuuguguaagucaaggagaaauugauuaagucauuuugcuugagugcacaaaaugag

SEQ ID NO: 4124773 - RNA, 90 nt, Human
cuccgcagaggcaggcucuucccagcuccacgagaggcggagaauugcaacuucuuccucucugggaacggccuaucuagcuccugggag

SEQ ID NO: 4124774 - RNA, 84 nt, Human
cuccgccugugcucugcagggccuuuuagcaucuucucaucuggugggaggaaugcaggcccuuggaaguacgaaugcagggag

SEQ ID NO: 4124775 - RNA, 75 nt, Human
cuccgcgcuggaagcccacguuuggugauguauguguuaugauggccacguguccuucccccaucagcgacgggg

SEQ ID NO: 4124776 - RNA, 60 nt, Human
cuccgcuguguguuuuugugcccucaggaauguguggaugcagcaaaugacaacagugag

SEQ ID NO: 4124777 - RNA, 58 nt, Human
cuccggguagcugaggcccuggaaguaguagugcugguacauggucucauacugggag

SEQ ID NO: 4124778 - RNA, 90 nt, Human
ccuugucuaucuuauauacuguagcaucucuagugacuaggccacagugccuggcacauaguaggugcucaauaaaugaucagugacugg

SEQ ID NO: 4124779 - RNA, 83 nt, Human
ccuugucuguggaaaaauguggugacugaguaaaguuguuuuuuaacuuccaaaccucaguuucuucaucucccuaacaaugg

SEQ ID NO: 4124780 - RNA, 77 nt, Human
ccuugugaaucaacaugacaggagaagagagugaugagaaauaaaaucagucucccuuuuccucugugaauacaagg

SEQ ID NO: 4124781 - RNA, 84 nt, Human
ccuugugcacuuguccucuucaacugccaggcagucuagcucuggcaauaggcucuggacagugaggaguuuuguagcaggagg

SEQ ID NO: 4124782 - RNA, 72 nt, Human
ccuugugcuuacuugcuauauuucuuuagggaaaaaguucuuagacaggaaacaguugguaaugcauauugg

SEQ ID NO: 4124783 - RNA, 130 nt, Human
ccuuguggaggaaaggcuggugggaggaaagaaggcuuguugaguaucuacugcacacccggcccuggggcuacggcuggaagcuggacaggccggguccuugcccuccugagaccugccuucuaguggg

SEQ ID NO: 4124784 - RNA, 75 nt, Human
ccuuguguaugugaguaccugucaugugcccacguauccugguggcacaaaagguacuucauguagauugucagg

SEQ ID NO: 4124785 - RNA, 99 nt, Human
ccuuguuauauaccuuccuauacauuuccuucauaacauuuaucacaguguuaaauuauugagggauugucaggcuauaggugguacuugaugacaagg

SEQ ID NO: 4124786 - RNA, 61 nt, Human
ccuuguucuguguggggagggaggcagcgcggugguuaucaaccucacccugcagaggagg

SEQ ID NO: 4124787 - RNA, 125 nt, Human
ccuuguugauuauaauauuuggagaucuuauuguggagaagggaagaauacuggaaaauauagaauauucugucuuuuuauacaucuaagugaaagaguuuuuaaaagauauuauaauucagagg

SEQ ID NO: 4124788 - RNA, 75 nt, Human
ccuuguuugcccuaggaucucacagauccacucuccccuuuggagcuccucuguccagagguccuggagacaggg

SEQ ID NO: 4124789 - RNA, 94 nt, Human
ccuuuaaccugagagcauuccacacugaagucugcuuuucuugaagcaaaaauucuaguguccuuggacuugcuauuuuaucagggaucaaagg

SEQ ID NO: 4124790 - RNA, 78 nt, Human
ccuuuaagacauggagggaaugucuagcauucuucacggaaaugugccugugaggagcauuaacuccuguuauacagg

SEQ ID NO: 4124791 - RNA, 76 nt, Human
ccuuuacagcugcuggcaagcuugaaacuggcaucacaccaaacucuagaacuaagcagaagccaguagcaaaagg

SEQ ID NO: 4124792 - RNA, 87 nt, Human
ccuuuagcuuaaugacccagcuucuugugccuaaguuacagucugggacugcugcaggaacuuaagaagcuucauuagucuuuuagg

SEQ ID NO: 4124793 - RNA, 99 nt, Human
ccuuuagggcugcugaacuugguuaugcaauuucuuugcugcauggagguaucagccaaagagaccccauauccacaagguauugcacuugcccagagg

SEQ ID NO: 4124794 - RNA, 62 nt, Human
ccuuuaucuguggaaguguuuacucaugagauaaacgucuauuaacaucuuuccaguagagg

SEQ ID NO: 4124795 - RNA, 64 nt, Human
ccuuuaugagauccuggggugagcacuuugacaaggcagucacccccaaaggagcucgcaaugg

SEQ ID NO: 4124796 - RNA, 96 nt, Human
ccuuuauuguugcuucuauuguggcuuuauguaguuaaacccagaaaaguuagaguuuccaaauaugaagccauaggacagaggauaagaaagagg

SEQ ID NO: 4124797 - RNA, 69 nt, Human
ccuuuauuuuacuaugacgggaagucuuccuauucuuaaaagauuagccugcucuuuagugaaagaugg

SEQ ID NO: 4124798 - RNA, 75 nt, Human
ccuuucaauauacagagacuuuauggcacaaaauauaguuuguuuugguaauaucucugugcgcacuugaaaagg

SEQ ID NO: 4124799 - RNA, 65 nt, Human
ccuuucaucaacauuugcauccuuccacucaagauucagaguucggcaggaaagcguugaauggg

SEQ ID NO: 4124800 - RNA, 96 nt, Human
ccuuucccaaaggcaggcccccugugcagcuucaacuauucacucuauuuauaauguuguuccuggauauugggcuugcuuccacuuguggccagg

SEQ ID NO: 4124801 - RNA, 84 nt, Human
ccuuucccagcucuaugacauuauaaaggauuauugugaaaaugacaguaggguuugggaguuacuaguaaagcuggcuaaagg

SEQ ID NO: 4124802 - RNA, 80 nt, Human
ccuuucccuccagagagaaaggaggccgcucccaaguccguccuugccccguggccuuccuguuccuuugaagggggggg

SEQ ID NO: 4124803 - RNA, 66 nt, Human
ccuuuccucgagguauagggaggguaucucucaaaugaggagucuacgaccugcuucaggggaagg

SEQ ID NO: 4124804 - RNA, 56 nt, Human
ccuuuccugccuggaccucugcuugagaacaggaagaggugugggcgggguugagg

SEQ ID NO: 4124805 - RNA, 55 nt, Human
ccuuuccugugcuuucuguuuuaugauuugaauaugacagaguccagaggaaagg

SEQ ID NO: 4124806 - RNA, 57 nt, Human
ccuuuccuguguccuuuuaagguugacacagugcuuuaagagccuaacacagaaagg

SEQ ID NO: 4124807 - RNA, 73 nt, Human
ccuuuccuucuguguuaucauuucaguacguaggugguugccuuguacagggaaguaauacaagcgggaaagg

SEQ ID NO: 4124808 - RNA, 58 nt, Human
ccuuucuaacagauuguggaucgcuuugaagagcagcguccuacauucauaggaaagg

SEQ ID NO: 4124809 - RNA, 56 nt, Human
ccuuucugacagugauggggggccaggccugguacccccauccaugucaggagagg

SEQ ID NO: 4124810 - RNA, 92 nt, Human
ccuuucugccugcuguuucugagccagagcuacaagugucugugugaguuauggguucuuaucucuuggcaauuagagcagcucagcaaagg

SEQ ID NO: 4124811 - RNA, 63 nt, Human
ccuuucuugaugaaugcuaagaacuagagugggguucagguuuuaaccauucacaagugaagg

SEQ ID NO: 4124812 - RNA, 61 nt, Human
ccuuucuuuagcaauucuuucaugccauccauauguugugauuacaagggccaaagaaagg

SEQ ID NO: 4124813 - RNA, 67 nt, Human
ccuuugaagauacagcucuggccagaugugggcacuccuauguuccuggggcuguggucaaagaagg

SEQ ID NO: 4124814 - RNA, 73 nt, Human
ccuuugacuucccagacuuguguuucuuuccaacagaggcgaauaaacacucuugguaugugaagauuaaagg

SEQ ID NO: 4124815 - RNA, 56 nt, Human
ccuuugauuucccccgucucagcuaguuaguuucuugagaggggagagaacagagg

SEQ ID NO: 4124816 - RNA, 56 nt, Human
ccuuugcaauccuguaggccuuucucaaggaagagccauauauauuuugcacuagg

SEQ ID NO: 4124817 - RNA, 66 nt, Human
ccuuugcaugugguagaagguuccuuuucagauacauuuguguagaaccuaugccacauguuuagg

SEQ ID NO: 4124818 - RNA, 80 nt, Human
ccuuugcccugccagcugacccgugggaggcgggacuggccuaacaguucucuaauccaaggucagcucgggugcggagg

SEQ ID NO: 4124819 - RNA, 73 nt, Human
ccuuuggaaauauccagguagaugucuucucuuugggaaacaguuggaugaaaaggccugguguuuaggaggg

SEQ ID NO: 4124820 - RNA, 57 nt, Human
ccuuuggcugacuuuuaugcacacuaaaguuuuaguacugauagggucaaucaaggg

SEQ ID NO: 4124821 - RNA, 60 nt, Human
ccuuuguccaucgugccucaugucucauggcuuguggagugagagacugguggauacagg

SEQ ID NO: 4124822 - RNA, 76 nt, Human
ccuuugucuagugccucuugucuacgguuuucugcuagauacagaaaguaucaagggaagcauuuuggaucaaagg

SEQ ID NO: 4124823 - RNA, 58 nt, Human
ccuuugucuuggccucaguuuucuguucuaugaaaagaaaauagugguaggacaaagg

SEQ ID NO: 4124824 - RNA, 63 nt, Human
ccuuuguggaugcagacgcugucacacucauuaauuaguuaaucugcacagccccgcaggagg

SEQ ID NO: 4124825 - RNA, 86 nt, Human
ccuuuuagaauacuagaugucccaagugugccaugccaaacccuuuugcuuugaaugcccuggacuucuaguauucaaugaagagg

SEQ ID NO: 4124826 - RNA, 67 nt, Human
ccuuuuauacucagugauaucacggcuucuccguagcuguuuuauucacgucugggagauaaagugg

SEQ ID NO: 4124827 - RNA, 78 nt, Human
ccuuuuauaguaugagauaggaauguuuaugugggguuucaucaguggauauauuuauauaggcuuccauaugaaggg

SEQ ID NO: 4124828 - RNA, 112 nt, Human
ccuuuuauguacucuaaagauguuuuaucauagaagugcaauuucaggaagagucauaugcuuugauucugagggagcauucugccagcugucuucauggaguaagcaaagg

SEQ ID NO: 4124829 - RNA, 81 nt, Human
ccuuuuauuuuuacucagcaaguauuuucugaaugccucuaacauacaaaguuuuagguagggaaauagaaaauuaaaagg

SEQ ID NO: 4124830 - RNA, 91 nt, Human
ccuuuuccucuccauaaaucuguuaucugcugcuguggcucagaugccucauccugaggaaggugcagagauuuuugggguggucucaagg

SEQ ID NO: 4124831 - RNA, 62 nt, Human
ccuuuucuaaucuuaagaaugucuuuagaagguuacugaaaguuucuuguacuuggagaagg

SEQ ID NO: 4124832 - RNA, 55 nt, Human
ccuuuucuauguaccagcagugaggacuuuauuuauugcauuaugguaggaaagg

SEQ ID NO: 4124833 - RNA, 61 nt, Human
ccuuuucucccugaguuuguggcuaaguuccaggaggcuuaugucacagcuuugggaaagg

SEQ ID NO: 4124834 - RNA, 78 nt, Human
ccuuuucugacagaagcagugugaacccauguaacuaucaggaauugucacguaggguauauucuugugucaggaugg

SEQ ID NO: 4124835 - RNA, 129 nt, Human
ccuuuugaaccacagagauaauuuauuagaugccagaauguguuauuagagaaggaguaaugaagaagaacacucuuuuauguuaauacuuuuuuacauuuuguauaugucgcuauguuaggcaaaggg

SEQ ID NO: 4124836 - RNA, 56 nt, Human
ccuuuugaagguguuguuaagugauaucuccuagguguaguaacauuuuuaaaagg

SEQ ID NO: 4124837 - RNA, 110 nt, Human
ccuuuugcucggcuuuguugccaauuucaugccauguauugcuccauguuuugugcuucaugaagcugucacaggcauaaaaguggucugaccagggucguaguaaaagg

SEQ ID NO: 4124838 - RNA, 72 nt, Human
ccuuuugugucuguugagauuuuuuuaguuucagcuguuagaaacuaaaccuggcuuaguaagcagaaaagg

SEQ ID NO: 4124839 - RNA, 93 nt, Human
ccuuuuguuccaauccccaagcucuuuccacuaaaccacugcagaauagcaaucaugauuuagaagaaauuaauccuagguauggauaaaagg

SEQ ID NO: 4124840 - RNA, 80 nt, Human
ccuuuuuauaaucuuccuauuuuugagguguuggaacauuagucuucaaggccuucuugggagagauugaacuggauggg

SEQ ID NO: 4124841 - RNA, 56 nt, Human
ccuuuuuccuccuuggugucuucaacugaacaagggcuugaagggaggaaagcagg

SEQ ID NO: 4124842 - RNA, 97 nt, Human
ccuuuuucuuccucuuacuaacuauacuuauccuugguuuucuguuaagucauuuaaggaauuuaaggaauuuauaguuguacuuggagggaagggg

SEQ ID NO: 4124843 - RNA, 59 nt, Human
cgaaagcugugcacuggguccaggaugacuugcacacccuguucacugcacaguuuccg

SEQ ID NO: 4124844 - RNA, 77 nt, Human
cgaaaucgugcaguguuuggauccauagcgaggguguuguaaaucauuugucgcuacugguaaaauacugacuuuug

SEQ ID NO: 4124845 - RNA, 61 nt, Human
cgaaggcacugacugugcaggggacggaguucguuucucaucccccacucucagugccucg

SEQ ID NO: 4124846 - RNA, 126 nt, Human
cgaaggcauuuaacugucgcaagcaggaggcaggccucggagccacaguggauugauuccauccucgaaauggagccuacccaagcuguagguggcgcucuuccugcuuucuccagugugcuuuug

SEQ ID NO: 4124847 - RNA, 91 nt, Human
cucuaaaguccuuccacagcuggggcagggaugggaaacuauggugaccucaagugcucccauauccugcccuuccuagggcagaauggag

SEQ ID NO: 4124848 - RNA, 71 nt, Human
cucuaaaugcuuguauugggggaaaaaagcuggagguuaauuuuuuagacauccaauuuaagaauuuagag

SEQ ID NO: 4124849 - RNA, 69 nt, Human
cucuaacuccugaccuuaccuggaaagcauguaaaucugccugcagggccagacuggguuggacuugag

SEQ ID NO: 4124850 - RNA, 70 nt, Human
cucuaacucuccuacuuaagacagcuuuggaguuuggacucaagcagcuguugcugggaggagagaagag

SEQ ID NO: 4124851 - RNA, 84 nt, Human
cucuaagaagguacaccugcaguuuguugugaccccguuucagaacggacagaaccaagugcaggcuuacucuauuugguagag

SEQ ID NO: 4124852 - RNA, 129 nt, Human
cucuaagcaugauauugggugugugguuuaagcugcccuuugacuccagagcccuuuguccaagugugacaaaauaucagcaaagggugacaugagcuacagccgccacccucgggucaggcguugggg

SEQ ID NO: 4124853 - RNA, 77 nt, Human
cucuaauccccauuuuucuugucucuaaauugaugcuacaaauagugucuucuucauaaggagagugcugaguaggg

SEQ ID NO: 4124854 - RNA, 81 nt, Human
cucuaccauguacugccuacgucugcuauaauucagugguucuucacuguuagagcaaacguauguuuugugaugguugag

SEQ ID NO: 4124855 - RNA, 71 nt, Human
cucuaccccuggaugacucaggaaaaacaacgcaaggaguggagguggcuuccugggugguccugguagag

SEQ ID NO: 4124856 - RNA, 87 nt, Human
cucuacucaugcaguuccuuuugccuggaaaguuacuuccuucacaaaugccaggacagcauuuucagcaucucugcaucuguagag

SEQ ID NO: 4124857 - RNA, 68 nt, Human
cucuagacaacuugcuguggguaacuuacugcacccauucuacaacuaguaagcugaauuuucuagag

SEQ ID NO: 4124858 - RNA, 56 nt, Human
cucuagagccaaagucuugggggguugugcuucccucugacccacuggacucugag

SEQ ID NO: 4124859 - RNA, 70 nt, Human
cucuagagccucagucuauuuccagcagguguguggcccacaccuggaguggggauacugaggccaggag

SEQ ID NO: 4124860 - RNA, 95 nt, Human
cucuagaugacaaguagaaggcagguuuuaaaaugucugaaaauugcaacuucagcgcuuuugcaacaccugcuuuuacgaucugucacguggag

SEQ ID NO: 4124861 - RNA, 71 nt, Human
cucuagcacuuaguacagcugacauuggcagcuauuuguugaguggcugagugagcggucuuaggcuggag

SEQ ID NO: 4124862 - RNA, 91 nt, Human
cucuagcuucuucugcaguaucuguaaacacccguaagcuuuccugggggaaauuugcauggugauacacuucugcuaggagaguucagag

SEQ ID NO: 4124863 - RNA, 68 nt, Human
cucuaggauuuaaauccuuaaccacuauucuauacuauuugagccaguuagaguuuuuagguccugag

SEQ ID NO: 4124864 - RNA, 55 nt, Human
cucuagggaagaaugagagcccagaaaauugucacugcgccuuccuuccugggag

SEQ ID NO: 4124865 - RNA, 62 nt, Human
cucuagggaauauaauguaugccauucugaaaggugguauuucagcuuuuguaucuuugggg

SEQ ID NO: 4124866 - RNA, 82 nt, Human
cucuaggucucugcuacaguuguaaaguucuagguguguguuugacaugcuuuuuaaacuuaauuggaaagcagagcaggag

SEQ ID NO: 4124867 - RNA, 96 nt, Human
cucuaguggcuuuucuggaaggcucugcugccugucuggugccagucuucugucuuggacugggcaacagggccucccagaacuuuucuacuaggg

SEQ ID NO: 4124868 - RNA, 71 nt, Human
cucuaucuuugucugucagcucuuccucccagaaguagcucagagacuugcugagcacaccuaggguagag

SEQ ID NO: 4124869 - RNA, 69 nt, Human
cucuauggagacuuuaaaaagggcaaauaggccauaaucccagcccuugcuuauuuauagucaauagag

SEQ ID NO: 4124870 - RNA, 63 nt, Human
cucuauuagcugaauaaugcauuguugggagagaaauaguccaguaaaacagcuaacguagag

SEQ ID NO: 4124871 - RNA, 69 nt, Human
cucuauucuuuuaauuucugucugcagaagggcuaauauucaggacagaaauaaggaauauaauaagag

SEQ ID NO: 4124872 - RNA, 94 nt, Human
cucucaagucccaucuuccaggugacccucucaccugcuucuaagccuuugaauggguuguaagagguugggggcuggggguuagggaugagag

SEQ ID NO: 4124873 - RNA, 69 nt, Human
cucucaccuuguggcugugggucaaaaaucagcaaaaaaucaaugacaauaccuacaucauugugagag

SEQ ID NO: 4124874 - RNA, 62 nt, Human
cucucagauccucuccgaaugcguaguaacugcgaugaauucccgcagagggcuucugagag

SEQ ID NO: 4124875 - RNA, 78 nt, Human
cucucaguuacuugacacaaccaauugaaucuugcucaaggcaguggaaguuggguuugugucaguugcaaccaagag

SEQ ID NO: 4124876 - RNA, 60 nt, Human
cucuccagggcuggggguaggaggaugcaaggacuuccuggccuagcucacccuggagag

SEQ ID NO: 4124877 - RNA, 60 nt, Human
cucuccagggugagcuaggccaggaaguccuugcauccuccuacccccagcccuggagag

SEQ ID NO: 4124878 - RNA, 65 nt, Human
cucuccagucauauucucagucaaggcuucccugacagucccacuacuagaaagucacugggggg

SEQ ID NO: 4124879 - RNA, 56 nt, Human
cucuccaguuauagcugauuugaaacuucccaaugaaucaggagucgcggggagag

SEQ ID NO: 4124880 - RNA, 126 nt, Human
cucucccaguuuucucaacauaagacucacggagacgacauagaagagggaagagacauuacaauucuuauucauucaucugguguuaguccucacguuaguuaguauucagcaagaacuggagag

SEQ ID NO: 4124881 - RNA, 65 nt, Human
cucucccaugugcagagaugggagcaccaaugucuauggaaguuccagguuucgcuacaggagag

SEQ ID NO: 4124882 - RNA, 61 nt, Human
cucuccccagagaacacuugagugauuuuccuaucagucagcaguggguccugaggguggg

SEQ ID NO: 4124883 - RNA, 88 nt, Human
cucuccccaugaaggagcaccacagguugaggggaccacaucaguugguccuggaguauuucuguggugucugcuuuaccuaggagag

SEQ ID NO: 4124884 - RNA, 72 nt, Human
cucucccgugacaguaacugagagauguaauauccuccagccgguggaagaaguugguccucagcgggaggg

SEQ ID NO: 4124885 - RNA, 70 nt, Human
cucucccuaagacacauucauacguucaacugaacauuuauugagcaccuacuaugugcuagggauagag

SEQ ID NO: 4124886 - RNA, 129 nt, Human
cucucccuccuccagccccagcagccaggggccuggagguuggcggagggcugagcagcccagcuuccugcuuccuggccucacaagcaggccucugugaaguugccagggcuccaggggcaggggcug

SEQ ID NO: 4124887 - RNA, 126 nt, Human
cucuccucuauauacuguuggugucuccuacaggcugaacucaaugaugagucagagaaccaagaagacugguugaugaggucaggcuccagggggcgcugaaacaggugaagaaugggggagaug

SEQ ID NO: 4124888 - RNA, 62 nt, Human
cucucuagaggcccaccuugagucacuucauuaccauaaacuaucagguguggucaagggag

SEQ ID NO: 4124889 - RNA, 91 nt, Human
cucucucacuuucucacuuuucaauccccagcagauuuccauacccacaaagacaucuguacagauaucaggagugaggaccgagccugag

SEQ ID NO: 4124890 - RNA, 57 nt, Human
cucucucaguguaauacaggauuguugugaagaucaaaguaauuaacacugagaaag

SEQ ID NO: 4124891 - RNA, 60 nt, Human
cucucucaucuggaaagcagaagaaaaauuaagcaagucuguucugcacuccugagagag

SEQ ID NO: 4124892 - RNA, 70 nt, Human
cucucucucucucugccagccccagggaugaccuagagucuaacccugacagauggcaggggagcaagag

SEQ ID NO: 4124893 - RNA, 91 nt, Human
cucucugaaaaccuauccaccugaaauuguccucuguaugggauaggagcucaauaauggcaggauaaauuuauaaaugauagacagggag

SEQ ID NO: 4124894 - RNA, 57 nt, Human
cucucugagucucagcuuccuuaucuguaagauagggacaguauccaucucacagag

SEQ ID NO: 4124895 - RNA, 63 nt, Human
cucucugauguggcagcugcaucuaaaugcuuuuuaguuguuucacaugccagcauucaggag

SEQ ID NO: 4124896 - RNA, 64 nt, Human
cucucugcccccacuaaguugagggcccucucagaggaagggggucaaaaggugggggagggag

SEQ ID NO: 4124897 - RNA, 56 nt, Human
cucucuggcccauccuguugccuggagcaaccaggggcagccugacccccagagag

SEQ ID NO: 4124898 - RNA, 55 nt, Human
cucucugggggccaugccaagaacuccccuccaauggcgccugcccccagaggag

SEQ ID NO: 4124899 - RNA, 61 nt, Human
cucucugugcacuucucuuuauuugugaagcaguuggcuccagagauugagugacagggag

SEQ ID NO: 4124900 - RNA, 61 nt, Human
cucugaacuggaacuuaguuuuuuaaauccugucuagguaaauuaccuuuccagugcaggg

SEQ ID NO: 4124901 - RNA, 102 nt, Human
cucugaaucaaggucaugugucagcauccuuugggacagugcuuacuuuucauauagugucuuucccguuugaagguguuuucacugauccgccuuacagag

SEQ ID NO: 4124902 - RNA, 69 nt, Human
cucugaaugaucuaguuuuguagacaauagagagaaaacaauugauuguaaaacagaucauuaucugag

SEQ ID NO: 4124903 - RNA, 78 nt, Human
cucugacaaucaaagucccagcugcuuagagacaagaguccugaccugaacuggggucuuuagaauuuggauucagag

SEQ ID NO: 4124904 - RNA, 77 nt, Human
cucugacauucugccaccaacacacaggaagcaaacagguuuuuuucuacugguguugguguacuuugugcucagag

SEQ ID NO: 4124905 - RNA, 67 nt, Human
cucugacuccucuguugcuaggcccagcagcaccucguggcucccagggcagcgcagaagaguagag

SEQ ID NO: 4124906 - RNA, 57 nt, Human
cucugacuccugccccccucuuggggcuucccacaggauccugguacaggagcagag

SEQ ID NO: 4124907 - RNA, 59 nt, Human
cucugaggucagugcugcaguuauccccauuuuaaagauaagaaaacugagacucagag

SEQ ID NO: 4124908 - RNA, 58 nt, Human
cucugaguagauagggaaccugcagccgggcugcucaagggccucuguguacuggggg

SEQ ID NO: 4124909 - RNA, 65 nt, Human
cucugaguuucauuucccuccucuguauaaaugagaggcuugcacauggcuagugaagcucaggg

SEQ ID NO: 4124910 - RNA, 76 nt, Human
cucugauuuuugacaucaauacccuagaauaggcaauaacauaugcaacuauuuuagauaaugauaaaaagaagag

SEQ ID NO: 4124911 - RNA, 56 nt, Human
cucugcaaucugagcacuuguaagaaaacuggaaagggcacagucagguugcaggg

SEQ ID NO: 4124912 - RNA, 106 nt, Human
cucugcaaugugucaggagauucaucaguguccuuaucacuuauguuuucucauauugguuauaagucagggucauugugauuuuuucagacagcguaugaaaggg

SEQ ID NO: 4124913 - RNA, 69 nt, Human
cucugcacguauaaucagucuguuucuccaaauuaggagguucgagcagaguguuuguuacuuguagag

SEQ ID NO: 4124914 - RNA, 55 nt, Human
cucugcagaggcccaaggcugagacaugcaaguuuccuugcuggcccugcuggag

SEQ ID NO: 4124915 - RNA, 80 nt, Human
cucugcaugaugaacaaaugagcaaaugaagaacacacauacagauucucucccacacgcucacauguucauuugcacag

SEQ ID NO: 4124916 - RNA, 94 nt, Human
cucugcauuuuccuagaaggccucccucuggcugucagacagaucaggcuggugaccacgagccagggggacgcuuucuggcccaaccacagag

SEQ ID NO: 4124917 - RNA, 91 nt, Human
cuaucugucgcuuuccugaggggucucaugcccauccuucuccaacuuuucuaaugaugucugagauucuguucagaaaaaugacagacgg

SEQ ID NO: 4124918 - RNA, 75 nt, Human
cuaucuuucgauucuagcuuaaggugguuuaaacuacaugaaugagcuguauuucuggcuggaguuacaggguag

SEQ ID NO: 4124919 - RNA, 74 nt, Human
cuaugaaaauggguauacaaauaaucucuuugagacccagccuucaguucuuuuggauguauacccagucgugg

SEQ ID NO: 4124920 - RNA, 129 nt, Human
cuaugacuacaacuucugcgguagguaacagagaggccaccucagcagcaugcaguaaagcaguucucacaauguuuguugagucaaugauuccuuuuucuaccauauucacagaaucuccaaucauag

SEQ ID NO: 4124921 - RNA, 73 nt, Human
cuaugagauuuuaaaacuucacuuuauggggagacuuuaacaccaucgauguagagggacgaaaucgccauag

SEQ ID NO: 4124922 - RNA, 55 nt, Human
cuaugcaguggggcaggugaggcuuggccugcccagccuguccugagugucaugg

SEQ ID NO: 4124923 - RNA, 110 nt, Human
cuauggaacauauuucagauugauacauuauuguuaaagaacauuagcaaaagccacauuuucuucauagcaguagcaccuugugagagaacugagguauagguucuuag

SEQ ID NO: 4124924 - RNA, 67 nt, Human
cuauggacuugugaguguucuccagagguacaggauuuaacauccuggugaggacuccaagauauag

SEQ ID NO: 4124925 - RNA, 76 nt, Human
cuauggaugccuuucuaggaauacacuuuccgggguuccuuuuuucccugagaugugaauuucagagcuuccaaag

SEQ ID NO: 4124926 - RNA, 130 nt, Human
cuauggcagaagugauuggucuguuaggaggaagauacucagaaguugauaaaguaguugaaguaaguucucucuuuuaaaaaaauguuuuaguuauuuaguccuacuaccauaccaaauauuuuuauag

SEQ ID NO: 4124927 - RNA, 79 nt, Human
cuauggccucuuucagggcugagacucugugaugaugauuucuuauuuuguccacacagaacaguaaaagaugccaugg

SEQ ID NO: 4124928 - RNA, 67 nt, Human
cuauggugucuggccagaaagacuugaugucuaaaauuagacauuuggagacugguuagaggcauag

SEQ ID NO: 4124929 - RNA, 130 nt, Human
cuaugguguuguuugguuaggucacuuuggcuuugaaucuggguacuuguaauacuguagucuaaacaguauuagugguaucugugauuuccuuaguggcuuggaguaugguugcuaguaaaggcuguag

SEQ ID NO: 4124930 - RNA, 58 nt, Human
cuaugucaguaugaggcuccuaaaauaauuuuauuuuaggcagcuacauacuaacugg

SEQ ID NO: 4124931 - RNA, 78 nt, Human
cuaugucauagaacacagaugggcguggcgcuugcugucugggcaaagccacgucuacauuugguuuuuauaauauag

SEQ ID NO: 4124932 - RNA, 78 nt, Human
cuaugugugagguuuuaauguucaucucaaaggaucauacugaugauuacaugagagaauguaaauacuggcguguag

SEQ ID NO: 4124933 - RNA, 67 nt, Human
cuauguuaauacacuauaugaucacauauguuagcaagagguauggaaucgggaguguugacgucag

SEQ ID NO: 4124934 - RNA, 56 nt, Human
cuauuaaacacuacugugcacuuacuuauguucuacaugggcaguguguuuaauag

SEQ ID NO: 4124935 - RNA, 84 nt, Human
cuauuaggcuggugcaaaaguaauugugguucuugccauugaaagugauggcaagaacugcaauugcuuuucacaaccuaauag

SEQ ID NO: 4124936 - RNA, 67 nt, Human
cuauuaucagcuagauaagucaagcaagcccucuugguugaagugauauuugagcugagaauuauag

SEQ ID NO: 4124937 - RNA, 111 nt, Human
cuauuaugucaucuaagugcugaaacauuagccauauagaaaaagagcucuuauagguagucucuuaauuuuuucuaaguguguuuauauuucuauuuagugaccacauag

SEQ ID NO: 4124938 - RNA, 86 nt, Human
cuauucacauuugcuuccuuuacuauagcuuuguuucagugucacauagcacuggaguucaugguaaagucagcaauucaccaugg

SEQ ID NO: 4124939 - RNA, 68 nt, Human
cuauucacuuugucaaauggaaaguaaaaguuuucugguacuuugcagcuugauaaaaugucucuuag

SEQ ID NO: 4124940 - RNA, 111 nt, Human
cuauuccccuuucuccuccucccuccccaccuucgcggucccugccucucuccuucccaucccacggggcagggacucagugagggaggcucaguuggccccggugagugg

SEQ ID NO: 4124941 - RNA, 95 nt, Human
cuauucuaagugaggaagaacaaggcuguuuccaaugccacaucaauuagguggugagggagcuuucuuuguugaguguuuccgcuucagacuag

SEQ ID NO: 4124942 - RNA, 72 nt, Human
cuauugaaugaagucccuuuuuacuaaauuuggauaucuagugaguuuucaagggacauuuauuuuaaguag

SEQ ID NO: 4124943 - RNA, 63 nt, Human
cuauugauggcggccucuccauaucacccucugagagcaugugggaaaaguggccaucuuuag

SEQ ID NO: 4124944 - RNA, 69 nt, Human
cuauugcacaaacacagucagacuucauuagaacaagcauggaaaucugagauguaacaugugcaucag

SEQ ID NO: 4124945 - RNA, 55 nt, Human
cuauugcauuugcaucuucauccuuuuaaagauggagcaacuuaaaugcacauag

SEQ ID NO: 4124946 - RNA, 74 nt, Human
cuauugcucagagauguuugggcuguacaauuucuguagauauggcaucuggagcagccuuuucuaagcaaugg

SEQ ID NO: 4124947 - RNA, 73 nt, Human
cuauuuaucuucauaccucuaguucuucuuuuagucucugacuuacaggaggugcuagguguuuauugaguag

SEQ ID NO: 4124948 - RNA, 60 nt, Human
cuauuucuguauccugcugucagauuuucuccacaguuuagcagaguuauauggaaguag

SEQ ID NO: 4124949 - RNA, 82 nt, Human
cuauuuuaauguugauuugcauaauguuuggccuagcaagaacaauacugaaugcuaauagcuacagaaugcaauaaaaugg

SEQ ID NO: 4124950 - RNA, 59 nt, Human
cuauuuuauggugucucauaauagcaauuucuauuuguuuuauguacuucauagaguag

SEQ ID NO: 4124951 - RNA, 75 nt, Human
cuauuuuauugucucacaaacaggaugcccagcguggauggguaucagcaaaauccuguuguaggcaguaauuag

SEQ ID NO: 4124952 - RNA, 59 nt, Human
cuauuuuuuuggugggauauuucuggaaaaaacuuucuagaauuuugcuaaaagacuag

SEQ ID NO: 4124953 - RNA, 75 nt, Human
cucaaacauaaauaugcaaggcaucgaagcaauuaccguugccccauccuauucauguuucugugcauguuugag

SEQ ID NO: 4124954 - RNA, 89 nt, Human
cucaaagguaggaaccuuguguuaucuuuuuuguucauacugucugagcacagugcaggagacauaauagggacuccaaaaauguugag

SEQ ID NO: 4124955 - RNA, 59 nt, Human
cucaacuaggccuguguucuaaacuggcagugaaugauuauccacaggugugguuugag

SEQ ID NO: 4124956 - RNA, 77 nt, Human
cucaacucucucuggcucccagcaaguacaacuauuuauaaaagaugagguuugccagggaacagggagaggcugag

SEQ ID NO: 4124957 - RNA, 95 nt, Human
cucaagaacagaugugcuucuaaaucaagccugucucaccagugcuaauauuuaguaguggucaaguuuguuggagagcucaucuguaacuugag

SEQ ID NO: 4124958 - RNA, 63 nt, Human
cucaagagaaauucauguggcagcuuaagcaucuucaguauguggcacagaauuucuuaggag

SEQ ID NO: 4124959 - RNA, 68 nt, Human
cucaagccuggguggucuugcuucccaggauaggaucucuguuucuggggaacccccggguucuugag

SEQ ID NO: 4124960 - RNA, 69 nt, Human
cucaagggcaggugugaguggacggugaagguggcugucaccaggccaaaaucauauuuacuucuugag

SEQ ID NO: 4124961 - RNA, 60 nt, Human
cucaagucagaaauaaaagcauuuauagaauuucaugguuuuaaguuuucugaacuugag

SEQ ID NO: 4124962 - RNA, 71 nt, Human
cucaagugugcauguguguguguauguguguguauacaugcauagggaaccucaugcauuaaacauuugag

SEQ ID NO: 4124963 - RNA, 67 nt, Human
cucaaguucuuagacaagcuuguggcagguccuaccuacuacaugucugguuuaaggaagaagugag

SEQ ID NO: 4124964 - RNA, 67 nt, Human
cucaauccuuguucugucuccuccacucaaauuccugaaggugguuugcagacagaauaaaagugag

SEQ ID NO: 4124965 - RNA, 83 nt, Human
cucaaugaucggcacggugggggcugagggccaggagcaaugagcaccuggcuggcuggaccacaccugcagagaucaaugag

SEQ ID NO: 4124966 - RNA, 83 nt, Human
cucaauggcuauuaguaaugugcucaagucccuguguguuauuacgccaacacacaaauuguaggauaauugcuggcacugag

SEQ ID NO: 4124967 - RNA, 95 nt, Human
cucaauuagcaccugggcaugguuuggucuuuguaguggauaaugucuggccacacaaagauggggcacgggccaggucaguucugcugacuggg

SEQ ID NO: 4124968 - RNA, 70 nt, Human
cucacaaaaauuuuaucuucauuccuaucuacaccaaaagggugcagagauuggaagaugaauuugagag

SEQ ID NO: 4124969 - RNA, 61 nt, Human
cucacaaagauugaaagauauacuguucucacacuuuuguguguguguguguuucugugag

SEQ ID NO: 4124970 - RNA, 111 nt, Human
cucacaauacuuguguccuucauauguauuagguguuuuacagacauuuuuucuaucauaauucuauauaauaaguguuagguaaacaucuuaacagaugaggaaacugag

SEQ ID NO: 4124971 - RNA, 65 nt, Human
cucacaccuggucuuugcaugagcauguuucaguaacacaugugggcacacacacagguagugag

SEQ ID NO: 4124972 - RNA, 74 nt, Human
cucacacuguuuaugccaaagccaaacgcaggcuucgaagcagagucuguggauggacuggcagaggugauggg

SEQ ID NO: 4124973 - RNA, 58 nt, Human
cucacaggagucauaauuacaguggaggcggcauaccauuguagugagaguucuggag

SEQ ID NO: 4124974 - RNA, 68 nt, Human
cucacauauuccauuucaaguuuugaauguggcccgucaucucauuauuuuggacuggaguguuugag

SEQ ID NO: 4124975 - RNA, 60 nt, Human
cucacaugguggaaggggcuaucuuucucccuguggccucuuuaaucccauccauguggg

SEQ ID NO: 4124976 - RNA, 77 nt, Human
cucacauucagguggcauguuagauucacugcugacuauugcuuuguuucacaguagccauuucaugaguuugugag

SEQ ID NO: 4124977 - RNA, 91 nt, Human
cucacauuuccaccccagauacaugaagaugaauguauggcaugauugaacuagaacauguuaucucagcuuaugucugauuggaucugag

SEQ ID NO: 4124978 - RNA, 80 nt, Human
cucaccacuugguuccaaagacagaaagcuugugucaaagcgaccugucacagcuuucacgauuuggaacaggugaagag

SEQ ID NO: 4124979 - RNA, 60 nt, Human
cuccagagauaccugauuugcugguaucugcccaguauuuccuggcuuaucugcuguggg

SEQ ID NO: 4124980 - RNA, 56 nt, Human
cuccagauagaguccuguuaguauugugauuuuugcucucaaaacuuucacuggag

SEQ ID NO: 4124981 - RNA, 70 nt, Human
cuccagccaaccaugccuuaauaugaaccacugugaaacugacacuagagguugaugagaggugcuguag

SEQ ID NO: 4124982 - RNA, 73 nt, Human
cuccagccucagcggcuggaauucgggugccccccuuccucgggagcuggagaaacugcagcugaggcgggag

SEQ ID NO: 4124983 - RNA, 79 nt, Human
cuccagcucccccauaucucaaaagcagcuuugugggagugccaauucuccagcagagucucugagggggguuuuggag

SEQ ID NO: 4124984 - RNA, 59 nt, Human
cuccaggagcagaggguggucagcagggucccguguugcaaggcccuagcuucaaggag

SEQ ID NO: 4124985 - RNA, 65 nt, Human
cuccaggagcuggccagaugucccaaagagcccugagggcucaugcauauggggucagcccagag

SEQ ID NO: 4124986 - RNA, 59 nt, Human
cuccaggccagggaaguggacaagguaaugagcuccuaggaauguccauuugccuggag

SEQ ID NO: 4124987 - RNA, 62 nt, Human
cuccagggagggagggucgggguccugggggcuucuggagccugggccuccugcccuuugag

SEQ ID NO: 4124988 - RNA, 55 nt, Human
cuccaggguuccagaagauauuccagaugaugacacugggcacuggggacuggag

SEQ ID NO: 4124989 - RNA, 60 nt, Human
cuccagugcacccagaggauuuugaaggcuuaugccaacaauucuuuggggcaguuggag

SEQ ID NO: 4124990 - RNA, 77 nt, Human
cuccagugcguggcagggguauuccagcugagcuuaacuagcucucaggggccaggagaccccugcugccauuggag

SEQ ID NO: 4124991 - RNA, 120 nt, Human
cuccaguguccugaagcccgguuccugaugauuccuggguccucacaaucccaggcccugucagcucuggggucucagggaugggaggccccagguucuggaagcuguugugcacuugag

SEQ ID NO: 4124992 - RNA, 86 nt, Human
cuccaguuccaagaguaaauucaaauugcauaugccagaaauuauuggcuucagcauagguuauggauguuauucuggccaaggag

SEQ ID NO: 4124993 - RNA, 66 nt, Human
cuccaguuuacaggguugcuuuuggaugggugaagccaagucacaagcauaccugugauuugagag

SEQ ID NO: 4124994 - RNA, 65 nt, Human
cuccauacacccuaugcccaaaucuggaaauccaaguuuccaaauauuaugauuauaggauggag

SEQ ID NO: 4124995 - RNA, 67 nt, Human
cuccaucagccccauggugugcuccagcaggcucaggaggcaggcacuggagaugggguugucggag

SEQ ID NO: 4124996 - RNA, 122 nt, Human
cuccauccaaauagagcuuguggacuucaucagccuagaccaaagaguucacggaggccaaagggagccacucuggugggcucagugggcucuacugaaaaguuuagacuucauuuggggag

SEQ ID NO: 4124997 - RNA, 57 nt, Human
cuccauggaaugugaguuguuuaguucuuuuuugaacugucagaaaaauccauggag

SEQ ID NO: 4124998 - RNA, 67 nt, Human
cuccaugucuuacaccugaaacccucccaccagccugggagcccguuuuacaggugagaaaauggag

SEQ ID NO: 4124999 - RNA, 60 nt, Human
cuccauucaauucuaaagcccuuagucaauuaucuguaggggccugggaacugaguggag

SEQ ID NO: 4125000 - RNA, 113 nt, Human
cuccauuucuuuuuaaauggcaacagugcaaaagcuuccuugcaugcuagaaagauugauuucccagagucaaaauuuuucagaaucauugcuuuugacacuugucuauggag

SEQ ID NO: 4125001 - RNA, 106 nt, Human
cuccauuugugucagaacuuucuugauacagcagccugugauccugacuuauugggagcggggauggcugccugcaucaggaggcuggggucuggcauggcugggg

SEQ ID NO: 4125002 - RNA, 129 nt, Human
cucccaaagaacguuaucaucagugacuccaggagguccuucucccaccuuguugagauguagcuucccucaacaagaugggagaaggaccuccuguuauucaaaggcaacaugacuauucuaagggag

SEQ ID NO: 4125003 - RNA, 63 nt, Human
cucccaaagugcuaggauuacaggcgugagccaccgugccuggcugauuuuagaacuucugag

SEQ ID NO: 4125004 - RNA, 67 nt, Human
cucccaaagugcugagauuacaggugugagccagcacgccuggguaauuuuuguauuuuuaguagag

SEQ ID NO: 4125005 - RNA, 102 nt, Human
cucccaaaucucugcagacagagcucugcaggcacagcugaggacggccucucuuugggucccccagacucaucccugggagcucacaacuggcagagggag

SEQ ID NO: 4125006 - RNA, 82 nt, Human
cucccaaguggugagcagggcugaagucgcaggccuacuggacccugcauuugaagucagacaggcugcuggcggcuuggag

SEQ ID NO: 4125007 - RNA, 59 nt, Human
cucccacguucaucugccuuaauagugacuagcucuaaguccagaaggagaacugggag

SEQ ID NO: 4125008 - RNA, 79 nt, Human
cucccacucacucuucaugcuaugcucaacuggcuuccagaaccauugaguuucuguuguguuggcugagaaauggggg

SEQ ID NO: 4125009 - RNA, 105 nt, Human
cucccagacucuaauuccagcacagaggcggauccuugcauuucuguggacccgcaggaaagucuguaaaggaaccgcgcgcuuggcugggugccaggucuggag

SEQ ID NO: 4125010 - RNA, 63 nt, Human
cucccagauguccgugguauuuugcuaagggggaacacuuggagcaggcuccgggcuugggag

SEQ ID NO: 4125011 - RNA, 85 nt, Human
cucuugguaccugugguugugucaaguguauagcaggugaguucuaagcugcugugcacuaaccacacccacggguaugcaaggg

SEQ ID NO: 4125012 - RNA, 72 nt, Human
cucuuguaacagucaguaucccaggcaaauauuuacccaacauguacuuauuuaauggcuacuggauaggag

SEQ ID NO: 4125013 - RNA, 120 nt, Human
cucuuguauauucacaagugcucaugguagaacuacagaaguuucccuugcuuacaucaagagcuuuuaacaauuguagcauacuuucuuuaguuugcccacacgugugacauuuaggag

SEQ ID NO: 4125014 - RNA, 64 nt, Human
cucuuuccauugcccagcaguaaccucuguuaaaguuuauugggugcucuggaaauggucugag

SEQ ID NO: 4125015 - RNA, 61 nt, Human
cucuuuccugugaaaugccagaccaugaaagacuguuuggcugugauuugcacgagaugag

SEQ ID NO: 4125016 - RNA, 62 nt, Human
cucuuucucacgauuacggccaucugugugcuggcaauggcaguaguugcaugagagcagag

SEQ ID NO: 4125017 - RNA, 58 nt, Human
cucuuucuucuucuggcugcaccugggguucugcccacuggccuagaggaagaaaugg

SEQ ID NO: 4125018 - RNA, 58 nt, Human
cucuuucuuucucucaugugcauacacucaugauaugcauguaagggagacaccugag

SEQ ID NO: 4125019 - RNA, 77 nt, Human
cucuuugcucaagauccagaaauaggaguacuuuaugggaaaaaucucucuccuguugucauggaauaaguuaagag

SEQ ID NO: 4125020 - RNA, 109 nt, Human
cucuuuggggaugagcacucugcucaugacucauuaacuuuuuuucuaagugugaaagcuuuuuaaggaagaaaugaauagguggagaugccuuauuaacuucaaggag

SEQ ID NO: 4125021 - RNA, 65 nt, Human
cucuuugucuaccacagacaucgucuccauggaaccuacaauauguuucugagguggacgaggag

SEQ ID NO: 4125022 - RNA, 92 nt, Human
cucuuuucauagaagaauaucacugucaggcugacuuuuagggucauguuccuaaaggccaauaaagacaagcuguguucucaugacaacag

SEQ ID NO: 4125023 - RNA, 82 nt, Human
cucuuuuccuagccugcauacagcugccuucuaacuauguccucacauggccuuuucucaguguguguuggggggaagagag

SEQ ID NO: 4125024 - RNA, 115 nt, Human
cucuuuuucaggauucuggaacauaccaccuguuuuagucuuuaaucaucucuccacucauuacaggugcagaagguugaagcagcuggaaacaucuguucccagagaaaaggag

SEQ ID NO: 4125025 - RNA, 68 nt, Human
cucuuuuugugggggaggaguugugugcauucuguuuaaugugauuuucucacucccuuacccaagag

SEQ ID NO: 4125026 - RNA, 66 nt, Human
cugaaaaucagaggaagcaucaaguucucagaaaaccuucggggcaacuuaacuguuucuuagcag

SEQ ID NO: 4125027 - RNA, 59 nt, Human
cugaaacagaugugugcauuaauccacauucauuugguaaauguauuguuuuguuucag

SEQ ID NO: 4125028 - RNA, 57 nt, Human
cugaaacccguccagauggaggacccgguuuccauuaaaccuggauggaguucucag

SEQ ID NO: 4125029 - RNA, 61 nt, Human
cugaaacuccaugagaaauugcaagauaaaauugcccagcaagcaugcucuggaauuucag

SEQ ID NO: 4125030 - RNA, 106 nt, Human
cugaaagaaccaccgcuguagccucucauggcagucuggaaaaugccagggggaagccgacugcacagauggccagaggcagcugcaugcucccgauuucuuucag

SEQ ID NO: 4125031 - RNA, 70 nt, Human
cugaaagcccauuaagucuguuaacuggagaaccuacacguaacaucuccagguggcuugggcuucucag

SEQ ID NO: 4125032 - RNA, 72 nt, Human
cugaaagcuuuuuccaaggaugugucucucuauagaacuucuuuagaauaauaucacuguggaaccuaucag

SEQ ID NO: 4125033 - RNA, 59 nt, Human
cugaaaggguuacauaguaaguuccugaccugcuaaggaagacuagguagcuauuucag

SEQ ID NO: 4125034 - RNA, 74 nt, Human
cugaaauagugcugggaagggagucaagauacugggguucaagucuuggcucuccucucuccuaacuaugucag

SEQ ID NO: 4125035 - RNA, 96 nt, Human
cugaaauauccaggaagucuucccagaggaggugccagcuggauauuggaggaugaguaggugguaccugaaugaagggaggaaagggcauuuuag

SEQ ID NO: 4125036 - RNA, 69 nt, Human
cugaaaugacuggcuaacuuugcugauaaacuuccugacagcaauaacucaaagccauuuaugcuucag

SEQ ID NO: 4125037 - RNA, 130 nt, Human
cugaaaugcuauuuugugaaaguugggaauuuauauaaaaucaguuagugguaggauugaugagauguuuaccaggccugguagguagcugauuucuuguuugacuucucaacugaggcaggaaaguagg

SEQ ID NO: 4125038 - RNA, 123 nt, Human
cugaaauuguauuacugugaaaucguaccagaagcuuugcucauaaccaucuaugcauuucgcuuacaugaauguugcaaagacuuuuugauauaaucagauaaacacagaaaauauuuaaag

SEQ ID NO: 4125039 - RNA, 72 nt, Human
cugaacacauuucucugacuguagugugcuaguuauuugccagcccucugccuauuauggaauuguguuuag

SEQ ID NO: 4125040 - RNA, 74 nt, Human
cugaacacccagcucacucucgccuucuuccucuggagagaggaccagaggccagagucagcucugggguauag

SEQ ID NO: 4125041 - RNA, 70 nt, Human
cugaacacucaggcaccaacugccacguccaaaccaagggcuugggguguuggauggagcaaguguccag

SEQ ID NO: 4125042 - RNA, 110 nt, Human
cugaacacuugggaggcaugugggcugggcuagggcacagccacucuggacccuccugcugagagccccagcugagacacagacccuuggccaaccccaggaauguccag

SEQ ID NO: 4125043 - RNA, 64 nt, Human
cugaacagauugauugcuugaugguucagagggaaccagcucauaauuuucaaaacuguuuuag

SEQ ID NO: 4125044 - RNA, 58 nt, Human
cugaacaggcucugauggauucugccaacacagggccccaaaucucagggcuuuucag

SEQ ID NO: 4125045 - RNA, 61 nt, Human
cugaacccaggaaguugcagugagcugagauugcaucacugcacuccagccugggugacag

SEQ ID NO: 4125046 - RNA, 57 nt, Human
cugaacucagguugaugaacauuauauauuauuguuguuuguuuauucuccugacag

SEQ ID NO: 4125047 - RNA, 63 nt, Human
cugaacugacagacugccugcucugaaacugcaccaacagucccuggcuauuuugucauucag

SEQ ID NO: 4125048 - RNA, 63 nt, Human
cugaagaacaccugcugcccaguggcagguguucccagaccacugggcagcagguguucccag

SEQ ID NO: 4125049 - RNA, 59 nt, Human
cugaagagcaaaccaacuggacuaauucuuacuccuuaguucaggugguaguuuuccag

SEQ ID NO: 4125050 - RNA, 55 nt, Human
cugaagagcucuccuguccccucugccaugugaggauacagagagaagucugcag

SEQ ID NO: 4125051 - RNA, 89 nt, Human
cugaagauaugggcaacauguugagcaagggcugcuguuauauugagaagugagcuuuagaauuguucagcaaguuucuucuuguucag

SEQ ID NO: 4125052 - RNA, 60 nt, Human
cugaagcaggaggggaggcgcugggagcacgcaggguugggccuccaccccaggcuucag

SEQ ID NO: 4125053 - RNA, 55 nt, Human
cugaagcuuuacuucaaauacaagaaacagcugguguuugugauuuaaggcucag

SEQ ID NO: 4125054 - RNA, 72 nt, Human
cugaagcuuuggaagggcaggguugagcagagugcauccuauuuuccagcccuucuuccaaccagcuuucag

SEQ ID NO: 4125055 - RNA, 80 nt, Human
cugaaggaaagguuucaucuacuuuucauccuaaaaauucuuaaaggcuugggaaauggauuggagcuuuagaacuucag

SEQ ID NO: 4125056 - RNA, 80 nt, Human
cugaaggcggcaguugguccccagcuccagcccauuguugccagguggagacacaggaccagacugcccaguuccuuggg

SEQ ID NO: 4125057 - RNA, 61 nt, Human
cugaagggauuauuuuugcauguccccaucagaagagcaacaugaaaacugguuccuucag

SEQ ID NO: 4125058 - RNA, 74 nt, Human
cugaaguuaaacuugccuuuauuccuguuuguggauuagcuaggauaaaaugaggaaguuugcaaugcucuuag

SEQ ID NO: 4125059 - RNA, 58 nt, Human
cugaaguuaaucagagguacaaauggcuggcuaugccucucugacacguaacuucugg

SEQ ID NO: 4125060 - RNA, 59 nt, Human
cugaauagaguuuucucugggaaggaguaagauuccucucccagggagagccugagcag

SEQ ID NO: 4125061 - RNA, 64 nt, Human
cugaaucauuuauuuuugacagcagagccauaggccaugcuucacauguguagauaaaauucag

SEQ ID NO: 4125062 - RNA, 61 nt, Human
cugaauccagagcuauuucguccaaccaagcuucagcauggagaauuacacucuggaucag

SEQ ID NO: 4125063 - RNA, 74 nt, Human
cugaaucuccgugggguuuagggagacgaaaggaccccagaucgacguccccucguucccacuuuggggaucgg

SEQ ID NO: 4125064 - RNA, 61 nt, Human
cugaaugccagcuaccugcauuauggccucgguucuaggaagggaagcauggcacuauuag

SEQ ID NO: 4125065 - RNA, 76 nt, Human
cugaaugccuuauuguggauacgcagccugggaggcagugggucccccaggcacagauuaucccaauagagguuag

SEQ ID NO: 4125066 - RNA, 73 nt, Human
cugaauggaaaggauuccaaggccagagaaaagggugggccuuuccucuggccuuggaauccuuuccauucag

SEQ ID NO: 4125067 - RNA, 55 nt, Human
cugaaugucgaucagcuugggucagagucuuugccguggcuggacuggcauucag

SEQ ID NO: 4125068 - RNA, 85 nt, Human
cugaauucagagaaguguggguuuuauggagcccuguaauuuucaagcaguuccacugauggccuacaaauguacugaguguaag

SEQ ID NO: 4125069 - RNA, 98 nt, Human
cugaauugaaaaagaugauuucucuuggcaauauguugcuuuaucuaagcaacauacagaguacagagauauacaacaaacccucuuuuuuaugucag

SEQ ID NO: 4125070 - RNA, 56 nt, Human
cugaauugaagcacuugagaaucuugaaucacggauucuccaggcaaccauuucag

SEQ ID NO: 4125071 - RNA, 59 nt, Human
cugaauugcuuuacaagccguuuaagaacaauuuaauauuccugugugcagcaguucag

SEQ ID NO: 4125072 - RNA, 65 nt, Human
cugaauuuacauguauuuuggaaaaaguccuggaaaacuuguucauugaguacauaugguuucag

SEQ ID NO: 4125073 - RNA, 71 nt, Human
cugacaacugccuggggcaucagucaagguuccuguucuggagcacaggggaagccccaggcaugguccag

SEQ ID NO: 4125074 - RNA, 77 nt, Human
cugacaguagaaugcugagucuuaucucuuaucucuuuguugggguaguagauuuuauuucauguucugcuccacag

SEQ ID NO: 4125075 - RNA, 84 nt, Human
cugacaguaugauauuaaguuuuugugaucuggagccauuuuuagcaaaaucucuggaguaagagcuaugaaauuaaaugucag

SEQ ID NO: 4125076 - RNA, 78 nt, Human
cugacaguucuauauagcagagucuucaagggcaggccagauauggcuuugcuuuaguggcucuauuugacuguacag

SEQ ID NO: 4125077 - RNA, 66 nt, Human
cugacaugcagagcgucugggcagcggcccucaccccuguccccuuuaccuccgcagcccugucag

SEQ ID NO: 4125078 - RNA, 70 nt, Human
cugacauugauccagcagccgaauaagccugcagggaauggcgacucuuggcagcgggucaggcuguggg

SEQ ID NO: 4125079 - RNA, 110 nt, Human
cugaccacaucugcugaccauccucuguggcgugggaaguggugguguguaagaacacaccugcccuuaacacugugugcauggggaccagggaagggcggugauggcag

SEQ ID NO: 4125080 - RNA, 84 nt, Human
cugaccauagcuggccaaccacuggucugagguacaaggcauaggccaugaccuugggugugaguggaguggaagcugagguag

SEQ ID NO: 4125081 - RNA, 83 nt, Human
cugagcuuagcaauggagaagcagcuucuugaugaagccccauccuguggguuccaucaaagaaauuuccaaaguugaggcag

SEQ ID NO: 4125082 - RNA, 80 nt, Human
cugagcuucuagcugauguccaacaauaggugccagcaugugaguucagcuggcaccuauuuggaccuggaugaguucag

SEQ ID NO: 4125083 - RNA, 74 nt, Human
cugaggagaccaucaacuaauuuggaccugugaguuuuuuagaaaaggagugggguggucguggucuccuucag

SEQ ID NO: 4125084 - RNA, 62 nt, Human
cugaggaggggcucuugggcaugaagggcuuugagcaucuuggucccugagcucuuucacag

SEQ ID NO: 4125085 - RNA, 59 nt, Human
cugaggcaccggcaauguucuguuucuucaaccacgugcagguuacacggugcgcucag

SEQ ID NO: 4125086 - RNA, 57 nt, Human
cugaggccaugaauggauguuccuucaacccaaggagcaagcuuuccuggucaucag

SEQ ID NO: 4125087 - RNA, 55 nt, Human
cugaggcucagaaugagugagcaaccuucagugguugcacagacaaugagcccag

SEQ ID NO: 4125088 - RNA, 59 nt, Human
cugaggcucagagagguccacauacuuguuuaaguguuaaagggggcuucugagcccag

SEQ ID NO: 4125089 - RNA, 57 nt, Human
cugaggcucugagaaagccaaauguccucucuuucaggauggcuucucaaagcccag

SEQ ID NO: 4125090 - RNA, 55 nt, Human
cugaggcugagacaggugaaaugaugugauccacgucgccugacaccagacccag

SEQ ID NO: 4125091 - RNA, 73 nt, Human
cugaggcugggucggcagggggccagcagcccgggugaccccugccuggcuccuaaugcugcccagacugcag

SEQ ID NO: 4125092 - RNA, 65 nt, Human
cugaggcugguucccuugaucuuuccugaccccaguuuugggaggagacaguggagccgcuacag

SEQ ID NO: 4125093 - RNA, 85 nt, Human
cugagggaaguuaguaccugguauacuuagaaaucccagaauuauggagagaaggaagcuaucagcuacuaucagcuugccucag

SEQ ID NO: 4125094 - RNA, 58 nt, Human
cugagggagaaggaaggcugaagcaauaguguuugcaguuguugccuucccugauuag

SEQ ID NO: 4125095 - RNA, 55 nt, Human
cugagggagcuaugaauagaagaacccuguguucuccccuguccagcuccccugg

SEQ ID NO: 4125096 - RNA, 76 nt, Human
cugagggaggaccugaacuuggauguggccuggcuugggcccggaggccagcaugcaguucuaaggcucugcucag

SEQ ID NO: 4125097 - RNA, 72 nt, Human
cugagggaggccuccagccacaugccagugaggaacugaauccucagaaagcaacugaaggccuuaguucag

SEQ ID NO: 4125098 - RNA, 59 nt, Human
cugagggccugaggaccuagaugaucaucuuaauuuagauugcuccuuggcccacacag

SEQ ID NO: 4125099 - RNA, 69 nt, Human
cugaggggaauggugaggagugcauugagagggucaccuucaguuuugcuuuuaaucaugaacuaacag

SEQ ID NO: 4125100 - RNA, 57 nt, Human
cugaggggauggccaguccuguuccauggaagugagaaacaguaccauuuaucucag

SEQ ID NO: 4125101 - RNA, 72 nt, Human
cugaggggcaaagcuuguauagggaaagauaaauccgugguggguucugguuucugacaagucugaacucag

SEQ ID NO: 4125102 - RNA, 90 nt, Human
cugaggucaucucauccuuaagagaacuuuuaggaccagacaggaaugcucaucucucugugcccaguaguucucuggggguggccugag

SEQ ID NO: 4125103 - RNA, 55 nt, Human
cugaggugagcuucccugggcuccggaggcacuggaguagcgaggcccaccuuag

SEQ ID NO: 4125104 - RNA, 56 nt, Human
cugaggugggagaggagaaagagagagagaguccuuuaaguccucuuuuauauuag

SEQ ID NO: 4125105 - RNA, 78 nt, Human
cugagguuuuagguuucuggauuuauuauggcacccaguagcaaagcuggagucaaguguuuucaaggcuuccauuag

SEQ ID NO: 4125106 - RNA, 69 nt, Human
cugaguaaacugcauuaaagcaucagucuuucuugucuagaguagaacugguggugaucaguuauucag

SEQ ID NO: 4125107 - RNA, 81 nt, Human
cugagucacuauuuaacagggucccagcuggcuaaaguaugaccuccaucuggccagcaugagaccuggugugguggccag

SEQ ID NO: 4125108 - RNA, 76 nt, Human
cugagucuccucccaggcucuuccaggacccagcuucaauaaccugggcuuuauugaaaccuggggggaauuugag

SEQ ID NO: 4125109 - RNA, 74 nt, Human
cugagugggcaugaaauggccaaccuucggccacccacagcuccuaggugccuggcgccguuuuaugcaugcag

SEQ ID NO: 4125110 - RNA, 63 nt, Human
cugaguguuaaacauguucacagcaucccuacuggcaaaggugcuggcuugucuaauauacag

SEQ ID NO: 4125111 - RNA, 65 nt, Human
cugaguuacagcuggcguggggaaaucuaggagacaggugguucccuuaacagcuguauauuugg

SEQ ID NO: 4125112 - RNA, 61 nt, Human
cugauaaggaaucccauuauauggaaaauauaauccaccaaaaugagauuccuuaugauag

SEQ ID NO: 4125113 - RNA, 84 nt, Human
cugauaauauuauucgguuuugacaauuagguagaaaaagcauucaaagaagugcuuuuuuauugcagcugguaauacuauugg

SEQ ID NO: 4125114 - RNA, 127 nt, Human
cugauaccuacuguguuccaaguucuuucuggaguuugcggggacagagacaugaacuaaacaaggucauugccuuugcagagcuuaguauuuaguggggucaggauugggguagagauggggagag

SEQ ID NO: 4125115 - RNA, 58 nt, Human
cugauagagcauuagugugagagucuggauuucauaaagucucuccuggcucuaucag

SEQ ID NO: 4125116 - RNA, 82 nt, Human
cugauagcauaacuaaaggccaugauggaggaucaguauccacguugcuuguuccuucuggcuuuuacaucuaugauagcag

SEQ ID NO: 4125117 - RNA, 62 nt, Human
cugauaguauaagggacucugucucaguugaagaagcaagcaugauagaaaccuuuaaucag

SEQ ID NO: 4125118 - RNA, 74 nt, Human
cugaucaaaucaccaaacucacuggcacacacugaguggcaacaccgggggccuggaguguugguauuucucag

SEQ ID NO: 4125119 - RNA, 75 nt, Human
cugaucaucuagucuggccacuucuuuucauacaaggggaaacuaaaccccagggaagugaaugacagauaucag

SEQ ID NO: 4125120 - RNA, 84 nt, Human
cugaucauggggauguagaagauggcaacugcacugaugugagagacacagguaccaaaagccuuuuucugcuccucuggggag

SEQ ID NO: 4125121 - RNA, 82 nt, Human
cugauccaggagcacugcaguuugagucuaccagccuccucuccuuaggaguagggcugccucaggcaccuccuggccucag

SEQ ID NO: 4125122 - RNA, 56 nt, Human
cugauccaguagccugggguggggcacaggauguccugcugcuggggucugggcag

SEQ ID NO: 4125123 - RNA, 94 nt, Human
cugaucuacaaauuuggaagaacugaagagcuguggaccugagaucacuccuuaaaucacauuuucuuuguguuauauucuguuuguagauaag

SEQ ID NO: 4125124 - RNA, 77 nt, Human
cugaucuggacagggucugaugguccucacuugaccuaagcugagcucucccaggcugugagcauccccaaggucag

SEQ ID NO: 4125125 - RNA, 76 nt, Human
cugaugacgggguguaccacucuacuaaggguucccaacaugaaggugagggggccccugggaauucugugauugg

SEQ ID NO: 4125126 - RNA, 64 nt, Human
cugaugaguguuagcaguaaugauaucaguuucuacauguuaacauacuguuuaauauucacag

SEQ ID NO: 4125127 - RNA, 86 nt, Human
cugaugaguuccaaauuuggaucuuuaggcuuggcuuuaccugcacuccaggccugaauuucugaguuuacuggaauuuccaucag

SEQ ID NO: 4125128 - RNA, 66 nt, Human
cugaugcccagguuccucuccagaugaaauaaauuacaguaucugggaguaaggccuaggcaucag

SEQ ID NO: 4125129 - RNA, 75 nt, Human
cguucuuaguugguggagcgauuugucugguuaauuccgauaacgaacgagacucuggcaugcuaacuaguuacg

SEQ ID NO: 4125130 - RNA, 59 nt, Human
cguucuuuucauauuuacauggaggaauuucuguggccacauggaugugagacagaaug

SEQ ID NO: 4125131 - RNA, 82 nt, Human
cguugacauaaauacuaaaggcuugagcauuuguugaaugaguuuaagauuauacaacauguaaagugguuuaaugucaaug

SEQ ID NO: 4125132 - RNA, 58 nt, Human
cguuuagaaagugcuacugaccugaaaauugcauuuugaggagcagcgcuuuuuaccg

SEQ ID NO: 4125133 - RNA, 88 nt, Human
cguuucaaacacugacauucuaacauuguacagauauguuuagaugaggugccugaacuaagaguugggaaaucagguuucugagaug

SEQ ID NO: 4125134 - RNA, 55 nt, Human
cguuuccuuuuggaauuagagcucgaaaacgagaacuggugaagggagggccgcg

SEQ ID NO: 4125135 - RNA, 67 nt, Human
cguuuuggucagguuggucucgaacuccugaccucaggugauucaaccaucuuggccucccaaaaug

SEQ ID NO: 4125136 - RNA, 73 nt, Human
cguuuuucucuuguucaucugucuuuuguuacaaggccuucagccaauaaccuaagauggguagaaggaaaug

SEQ ID NO: 4125137 - RNA, 84 nt, Human
cguuuuugacuaggcaucuucuuuggaugaaagaauauggucgccaucuguaacacacagaggagaaucuguaauucaaaaaug

SEQ ID NO: 4125138 - RNA, 91 nt, Human
cuaaaaaguauguacauguaguccuaaugcuggugaagauacaguuagagguaucaucaaacauggacauuagggguauacuuuuuuuuag

SEQ ID NO: 4125139 - RNA, 75 nt, Human
cuaaaacuucacuaaucacugaacuccaaaagccccuagucucacugguggaccacagugacagugauauuuugg

SEQ ID NO: 4125140 - RNA, 69 nt, Human
cuaaaaucuucacaaucuggcuuagcauugugcaauagaaacauaaagcaggccacauaugugauuugg

SEQ ID NO: 4125141 - RNA, 59 nt, Human
cuaaacaugaacuacauuuaggguauuguauuauggagucccuaagguauucauuuugg

SEQ ID NO: 4125142 - RNA, 101 nt, Human
cuaaaccagugcagauuugcuggcccacugagccucccagaugagaaccugcauuucaacaagguccucagugcagcaaaguuugagauauacugggcuag

SEQ ID NO: 4125143 - RNA, 91 nt, Human
cuaaagagaagcagaacaccguauggacacccucuccugccucuugcccaaggcauggccucugugcuuguugcugcugcuuuucuauuag

SEQ ID NO: 4125144 - RNA, 85 nt, Human
cuaaaggggauuuuugguggaauuuuuaguuuucuauguauauguugccugagaacagagauaauuuuacuuccuuccucuuugg

SEQ ID NO: 4125145 - RNA, 65 nt, Human
cuaaaguguguggguucuaaauucagaaaaaucauauuuccgaguuuuggaccuacauauugaag

SEQ ID NO: 4125146 - RNA, 129 nt, Human
cuaaauagcagugauguguguaaucuuucuuuguuucaggcugugucuuuaaacaauaaaauuacuuucaggccaaguuggggggaauuguuuaaguagccuguuaaguaugcauuaagccuauuauag

SEQ ID NO: 4125147 - RNA, 60 nt, Human
cugcaagugucuguacaggauacuagcuuuaaucuugagcuccucagaagacauuugggg

SEQ ID NO: 4125148 - RNA, 84 nt, Human
cugcaauauucaugugauuugagguacauaaauccaguuucagcuaucuauguauccuuaagguccuagucaugaacaacguag

SEQ ID NO: 4125149 - RNA, 71 nt, Human
cugcaaucuuaccucuuccucugcauuuuuuggggggagugacauuuuaaugggaggcaggagguuugugg

SEQ ID NO: 4125150 - RNA, 73 nt, Human
cugcaauguuaagaucacaccuggaggaugguauuuccucccaggcuguaagagugauguugacaaguuggag

SEQ ID NO: 4125151 - RNA, 126 nt, Human
cugcaauguuugcauuuguugggugccucuggggccucaagaaugucucuggugaggcgcuggaucauuuuaaucaaugcgcuaagugacgauuccuguggcaccggcccacauugcaacaaccag

SEQ ID NO: 4125152 - RNA, 97 nt, Human
cugcaauuaacuuccucagaacacugggguaucauugagccuacugcagcagcaauuugcuaaaugguacuccagugaucagaaagagugagugcag

SEQ ID NO: 4125153 - RNA, 66 nt, Human
cugcacagaggucggucugccauccucuugcaagauuaaugccuguagucccacucucugcugcag

SEQ ID NO: 4125154 - RNA, 56 nt, Human
cugcacagcugggcaagauauaucuagaaaaggaaauuaguuucucagaugugcgg

SEQ ID NO: 4125155 - RNA, 56 nt, Human
cugcacaguaagcuucagagaugagaauccauuuuucuauuugccugacugugcgg

SEQ ID NO: 4125156 - RNA, 55 nt, Human
cugcacaguguuggaagcugcccucuuggcuugguugagccagcacagugaccag

SEQ ID NO: 4125157 - RNA, 78 nt, Human
cugcacaugcucugugugguuggccugaucuauaagagacuaaauaaugaccaggcuugcugcuagagcacuuuguag

SEQ ID NO: 4125158 - RNA, 61 nt, Human
cugcacauguucaucaugacaauguacucaggaguucuaagucaugaugagcauccugcag

SEQ ID NO: 4125159 - RNA, 60 nt, Human
cugcaccauuaauuuaugugagaauguguuaacagcauuuucaauggcugauggaugcgg

SEQ ID NO: 4125160 - RNA, 57 nt, Human
cugcacccaggccuggucccagguugccuagcaaccgggggcugcucugggaugcag

SEQ ID NO: 4125161 - RNA, 79 nt, Human
cugcaccuauggcacuuggucacuuccugcggguaacugugaagaagaagaggaagugacuagguaacccaaagcacag

SEQ ID NO: 4125162 - RNA, 95 nt, Human
cugcacgugcuccuaaucuaguuccagggacaaacaagguuggggauaguuccuaucucccacaaagaguuuuaacuggauguaggugucugcag

SEQ ID NO: 4125163 - RNA, 56 nt, Human
cugcacugcccuaaaaccuuugaccagagauucugggaaggcuuggacagugacag

SEQ ID NO: 4125164 - RNA, 65 nt, Human
cugcacuguguauuccuuggcuuaugucuccuucuuccaucuugaaagccagcagcacaguguag

SEQ ID NO: 4125165 - RNA, 83 nt, Human
cugcacuucuaacaagcuuccaggugaugcugaugcugcuggccucaggaccacacuuugaggagcaaaaagcaggagugggg

SEQ ID NO: 4125166 - RNA, 84 nt, Human
cugcagaaagcaagcuagggauggaugaugccuggcaaugaaagucguuuucaaagaccauuaacuaucagcugcuuuacucag

SEQ ID NO: 4125167 - RNA, 83 nt, Human
cugcagaacuauccauucugacaccuaauucugugaggaaacugagucccagagaagguggucagagugcugguuagaggcag

SEQ ID NO: 4125168 - RNA, 61 nt, Human
cugcagagaauggugaaguauuucugucugauuucaugaagcuugucaccauuucuuucag

SEQ ID NO: 4125169 - RNA, 72 nt, Human
cugcagcaaccauggcuacacacccugaauuuccugggacucucucaaguucacauguggucaugcugucag

SEQ ID NO: 4125170 - RNA, 59 nt, Human
cugcagcaguaguccccaagugcauucauauauucaaugggaagucacuacuguuacag

SEQ ID NO: 4125171 - RNA, 109 nt, Human
cugcagccucagggcaaaccuggccuuaaccugcucagccccagcucacccugggcaggccagggguguuggcauugaggggcagucagagucugccaggauggugcag

SEQ ID NO: 4125172 - RNA, 56 nt, Human
cugcagccuccugggguacaugacacuugcgaaagugacgugaguggaggcugcgg

SEQ ID NO: 4125173 - RNA, 95 nt, Human
cugcagcuacucaacaccucucaggaggaggcccagcccagggagcagcucccugcugugucccaccuggaaaggcauugagucugcuggugcag

SEQ ID NO: 4125174 - RNA, 104 nt, Human
cugcagcugggcucaccugcggcugggcucaccuguggcuggcauuacuccuguugcugaccuccccugcagcugggcucaccugcggcugggcucaccugcgg

SEQ ID NO: 4125175 - RNA, 57 nt, Human
cugcagcugucucuacugggcaaggauaggaggcccaggagggggaaauggcugcag

SEQ ID NO: 4125176 - RNA, 102 nt, Human
cugcagcugucuugguucuuccaauuucaaaaugucuuugaagaagugacuuagccacuucuucaaagacauuuugaaauuggaagcauuaagaaacuguag

SEQ ID NO: 4125177 - RNA, 75 nt, Human
cugcagcuugucugcugccuggagccuuuuguuucucagggaacauggagcugccuggcagugggggagcccuag

SEQ ID NO: 4125178 - RNA, 66 nt, Human
cugcaggcagaagggauggugagggggcgcaacccucugcccugucagccccacuucugccugcag

SEQ ID NO: 4125179 - RNA, 65 nt, Human
cugcagggcccucuggcaggccaggcccggcuccuuugucugccucagccgggggccgcccgcag

SEQ ID NO: 4125180 - RNA, 77 nt, Human
cugcagggcugcugccucaacauuuuagguucugauagcuguauucucaguccuggagugacagguguagccugcag

SEQ ID NO: 4125181 - RNA, 60 nt, Human
cugcagggguguccuguauuggcaucgaccugucguuaauccagcaaacacacccugaag

SEQ ID NO: 4125182 - RNA, 66 nt, Human
cugcaguccgaggcgcaccggcgcuccuucggcggcacggaggaccgccugucgugcuucgcgcag

SEQ ID NO: 4125183 - RNA, 65 nt, Human
cugcagugaggaccugccucuauuuaccauccagguggaacaagaagcaggucgcuuuagagcag

SEQ ID NO: 4125184 - RNA, 71 nt, Human
cugcagugggugggugucugacaguuuagaggggacucuggaccuugaaaauucacccaccucgucugaag

SEQ ID NO: 4125185 - RNA, 67 nt, Human
cugcaguguuccugaaccaugugaguaguguucauuuuaaacucaaacacaugcaaggcaccugcag

SEQ ID NO: 4125186 - RNA, 56 nt, Human
cugcaguuggcugagaccccccaggguuauuucuccuggucucagugcagcugcag

SEQ ID NO: 4125187 - RNA, 69 nt, Human
cugcauaauuugugguagugggggacugcguucgcgcuuuccccugccuuacuggaaguugaaagguag

SEQ ID NO: 4125188 - RNA, 62 nt, Human
cugcauccaggccaggucacagaaggggcccagucaccccgagaccugugucugggaugcgg

SEQ ID NO: 4125189 - RNA, 70 nt, Human
cugcauccauguugcugcaaaggaucuaauuuccuucuuuuuaauagcuguguaguauuccaugguguag

SEQ ID NO: 4125190 - RNA, 55 nt, Human
cugcauccuaaccuccaugcagucaucacuggcugcacugcccuucaggugacag

SEQ ID NO: 4125191 - RNA, 87 nt, Human
cugcaucucucuucucccucugccauaagaccaacacaucccagaagggguggcuucuucugccagaaggaagaaaacagggagcag

SEQ ID NO: 4125192 - RNA, 107 nt, Human
cugcaugcuuguuuguaucacccauuccacagaugaaaauuaaguuuguucaaaaccugcaguuuuuauucugagacaggggaaggugaaacaaagaaaguaugugg

SEQ ID NO: 4125193 - RNA, 62 nt, Human
cugcaugucaaggcacucaggauauugcacauucuuggcaaucuuguugccugugacaucgg

SEQ ID NO: 4125194 - RNA, 95 nt, Human
cugcauguucagccacugcugcuuccgcuaaaaauuaaucccauuuuuccccugaauggagguauuucucagcaggaagcaguauguccaugcag

SEQ ID NO: 4125195 - RNA, 69 nt, Human
cugcauucauaagacuuugcucuugugagaauucgcucaugccccaaaagcaaagaucuuugauugaag

SEQ ID NO: 4125196 - RNA, 64 nt, Human
cugcauucccaaugcuguucugagucugcaggcguugccuggacaggguaggcaggaagugcag

SEQ ID NO: 4125197 - RNA, 70 nt, Human
cugcauuguugagggcagaaugaaggugggcaagggcaaggucagguucagacuagucccagugguguag

SEQ ID NO: 4125198 - RNA, 97 nt, Human
cugcauuugguauugggacuguugucuaaaccauaaccuaaacuacuuuaugcaguuagguaauagucucaucucagauaacaaaaggaagaagcag

SEQ ID NO: 4125199 - RNA, 90 nt, Human
cugccaacucccuccccucucugcgcucccaggucaaggugcaauaauaucauuuggggacagaguggggguaaaggggcaguagggcag

SEQ ID NO: 4125200 - RNA, 107 nt, Human
cugccaccucuccauagucagccccacucagggcuugaguguccaggaggaguccugccugcuggccuggcccugaggcccuguguggugguccugaggggcgguag

SEQ ID NO: 4125201 - RNA, 94 nt, Human
cugccaccuucccuagugucuuguaccaucuucagugggcagaacuuggccagaaaaaggagcccaaaggaaggacaaggcagaggagggucag

SEQ ID NO: 4125202 - RNA, 71 nt, Human
cugccacuguaaguuugaaaauaacaauguuauuuucuauuuuguuauuuuugucuuugcaguaccugcag

SEQ ID NO: 4125203 - RNA, 88 nt, Human
cuccugaggaauguuccacagugcucaaacacaagugcaggacacuacucucuuaaugccacuguagaguauggacaagcuugaggag

SEQ ID NO: 4125204 - RNA, 60 nt, Human
cuccugcaagccuccccaagcagucaauaaauuugcuugauucaaaacaggagguaggag

SEQ ID NO: 4125205 - RNA, 77 nt, Human
cuccugccuccacagccccuccaguggcagggacaggucuugggucuuugucaucuuggugcugugagagguaggag

SEQ ID NO: 4125206 - RNA, 65 nt, Human
cuccugccugugggacugaggagcagcccaagaacuggggucccacgggucuccgcagcagagag

SEQ ID NO: 4125207 - RNA, 65 nt, Human
cuccugcgguacuacugugcuugcuguguguucaucucugcaggaagcagacagagcggcagggg

SEQ ID NO: 4125208 - RNA, 55 nt, Human
cuccuggaagcccgcccugcugccaucacuggcccgaggaccccggcuccaggag

SEQ ID NO: 4125209 - RNA, 78 nt, Human
cuccuggcauuuucagcagacugcaguuuucugagaaugucuguguuuuccagagcaugucugcucagaauguaugag

SEQ ID NO: 4125210 - RNA, 130 nt, Human
cuccuggcccggccuucugacagccagccccgcuccuucaagugcaguaccugagcaccggccgauaauccacgccaaagagcugcugcugccgcuggaggugguugggagugucgauggguaccaggcg

SEQ ID NO: 4125211 - RNA, 78 nt, Human
cuaaaucucccaaacucauuucuucaucuacagucaccucccuguaucccugaacaccuggguauugggagauguugg

SEQ ID NO: 4125212 - RNA, 64 nt, Human
cuaaaugggcauguuuguguuccaauaaaauuucauuuauagaacagaggguugcccagauugg

SEQ ID NO: 4125213 - RNA, 93 nt, Human
cuaacaaauuaagucucuaccugcuuuugacuaacaggagcaucuacacacugugcuuuccuuaauaagcagguauaaggggcagucugggag

SEQ ID NO: 4125214 - RNA, 58 nt, Human
cuaacaaugaaaaaggagcugguggacaaauaugccugcuuccuugcuucauugcugg

SEQ ID NO: 4125215 - RNA, 114 nt, Human
cuaacauacaaaacuggugguuucaaggguauuauuguuuaaagccauguaaaguuuuagaaaaggaaguuuauuuaaagaaaaauacuaagugaauaguaguguagguguuag

SEQ ID NO: 4125216 - RNA, 89 nt, Human
cuaaccuccaucucagucugcuuccuggagaacucaacaguugguaccaugaguaguccaagaaagcagguguuaagauggaauuuugg

SEQ ID NO: 4125217 - RNA, 96 nt, Human
cuaacuccaccguguguuuccaagacgagaggcucucuguuugucccuuuccuaagaauaaacaucuguuucucuucuggguuugguggacauuag

SEQ ID NO: 4125218 - RNA, 70 nt, Human
cuaacuucccugugggcagguaguggguggcagagcuggauuccaacuacuggugcucaggaaaucuuag

SEQ ID NO: 4125219 - RNA, 90 nt, Human
cuaacuuugcugacucagggaacauuuuaauuacaauaaacauccuuccacuuaauguauuuugggaguuucuuucagcaaauguauuag

SEQ ID NO: 4125220 - RNA, 130 nt, Human
cuaagacucaguuucuucaucuguauaguggaggugauguuagugccagccuuagguauuacuugugaacuuggggcagugcuuggcacaugacugaacacccacugauuucugagacuaagaguuucag

SEQ ID NO: 4125221 - RNA, 86 nt, Human
cuaagacucuugacuauagaccauuuuacaauagugugggaugucuuaaccauacaaauuguaaaagguuuucagaauuucuuuag

SEQ ID NO: 4125222 - RNA, 64 nt, Human
cuaagagaaauaguugcauguuucuuuugagauguugaacaaauacugcugcuauuccuuuuag

SEQ ID NO: 4125223 - RNA, 91 nt, Human
cuaagagagucuaguucucuucuuuggggugggcucacguuaaaguuagaagucagaaggaagagaggaaagauuagaaaaccucucagag

SEQ ID NO: 4125224 - RNA, 56 nt, Human
cuaagagcucugcaaacagucuucaacagauaaacugcuuuagcuagugcucuuag

SEQ ID NO: 4125225 - RNA, 67 nt, Human
cuaagaggaaaaugaguuccagaauccaugaacuacucauugaacuaaaacugguuuguucucuugg

SEQ ID NO: 4125226 - RNA, 59 nt, Human
cuaagauuucagacucugugguuauggauuauaaacaugagucacaguaucagucuuag

SEQ ID NO: 4125227 - RNA, 79 nt, Human
cuaagcaaguuguccuguaaagacuaaccaguugucaaaaucucacugagauuuuuaagguuuguuuauauauguuuag

SEQ ID NO: 4125228 - RNA, 60 nt, Human
cuaagcauuuggauaaaguuccuaaugguauuccacuuucuagcuuugccaaaaacuuag

SEQ ID NO: 4125229 - RNA, 72 nt, Human
cuaagcgggauaucuuaagcuguauugucaacuaccauuugaaaugcaguuuucaaagacuauucugacuag

SEQ ID NO: 4125230 - RNA, 127 nt, Human
cuaaggaaauuucccaggucauguagcaaauauguuggagcagggauucagcugaaggaggcuaauacuggccuccuuccugugagucacugcacauaucagacugccucucuccauguuuccuuag

SEQ ID NO: 4125231 - RNA, 59 nt, Human
cuaaggcaguuugggccaccaucuuaugcauuucucaagagcccuaaacccugccuugg

SEQ ID NO: 4125232 - RNA, 57 nt, Human
cuaagguacuugaucucccagauccuggcaaccagggccuacagcuuaaguccauag

SEQ ID NO: 4125233 - RNA, 78 nt, Human
cuaagguaugcaacuuuuucugggauggaggguggaagauucaaagaaagacaccuuguuacccaaagagugccuugg

SEQ ID NO: 4125234 - RNA, 83 nt, Human
cuaaggugggguaugguugugugugugugcacacgugugcacgcacugugcaaaugacaggcacacaaauguacccaaagugg

SEQ ID NO: 4125235 - RNA, 76 nt, Human
cuaagucaccauuauaugugcagacagcauguucuucgggcacaaacuuauguuucauauguaucaagucacuuag

SEQ ID NO: 4125236 - RNA, 62 nt, Human
cuaauaauuggcuaucauucugaaauucucuggagagcuuuucaggcugaugucgauguuag

SEQ ID NO: 4125237 - RNA, 92 nt, Human
cuaauagcagccauucuguacuuauugaaagccccugugccuacugcugucuuaaguauucaggaggggcuuacaagaggguuuucuauugg

SEQ ID NO: 4125238 - RNA, 130 nt, Human
cuaauauuuagauauaguagguaguuuauucaugaaaaggucuauuucuuagaguaugcuuaaguuaagacaaaaaauaggaucuuuucaugcuuauuuuuuauccuuuauuuuuucuucucauuguugg

SEQ ID NO: 4125239 - RNA, 129 nt, Human
cuaauguacacacaauucgaggaguaaacugaugucuguuuuacucauugcuggaucuagaacuagaaugguuuugggcacaugggaaauuuucaguaaauauuuguugaaugaaugaauacaugaaug

SEQ ID NO: 4125240 - RNA, 92 nt, Human
cuaauuacccugcagcagugagggcauucagugcugggaccuuucccaggcucugagccucacucuuucaaugugcgcugccggucuauuag

SEQ ID NO: 4125241 - RNA, 85 nt, Human
cuaauuccacucaugcaaaggucccaacucccaacaccaucacacuggagguuaggauuucaauguacagacuuuguggagagag

SEQ ID NO: 4125242 - RNA, 68 nt, Human
cuacacaggauguguucaaucaccaaagguauuuauugaaugccagcuaugaaucauguacugcguag

SEQ ID NO: 4125243 - RNA, 99 nt, Human
cuacacaugcacagagcuggaaggucuguccccacugccacuccagagugcgagaaagggagaggcagugggauggggacucucugcuucgcauguugg

SEQ ID NO: 4125244 - RNA, 60 nt, Human
cuacacuuguucgacugcaggaaaacccuacagguugcugggcugcagugggggagguag

SEQ ID NO: 4125245 - RNA, 55 nt, Human
cuacagaaacacuggacauguguucaggggauguguacaagaguguuuacuguag

SEQ ID NO: 4125246 - RNA, 79 nt, Human
cuacagaagaccauuagcugcuauucaguagcucccuaaugaggcuaccgaugcugagagacugcugguauaucuguag

SEQ ID NO: 4125247 - RNA, 73 nt, Human
cuacagcauccuucaaugggaaguuuuagggcugcucuguccagcuucuaaagugugaagccaagaugugugg

SEQ ID NO: 4125248 - RNA, 57 nt, Human
cuacagccuccacaggccaagugaccuugccaaggccacacagcuggagggugcuag

SEQ ID NO: 4125249 - RNA, 68 nt, Human
cuacaguggccagccagggugcugaugugaggggcccuuuguaaagcagugugguugugucccuguag

SEQ ID NO: 4125250 - RNA, 60 nt, Human
cuacauggcauucacucccacagggcaucugccacugccugugagcugugugccagcaag

SEQ ID NO: 4125251 - RNA, 81 nt, Human
cuacaugguguucuucacugaugggacagcucaagaauauuuucaauucugguuucugugucaguugacaaauacauggag

SEQ ID NO: 4125252 - RNA, 82 nt, Human
cuacauguuaucaugcaugucuugcccugauuaguagucauuuccaguguuuacuuguuggguuaagaugugauacaugcag

SEQ ID NO: 4125253 - RNA, 63 nt, Human
cuacauucacuuguugaagguggcaaagccccuguggccugaacccggagugauuauguguag

SEQ ID NO: 4125254 - RNA, 85 nt, Human
cuacauucgugcguaguacgaauuugugccugcuggguccuuguaccuuuacgccaggcagaaaucuccguaaucgucaguguag

SEQ ID NO: 4125255 - RNA, 56 nt, Human
cuaccacccaggacaaaauauggaaugucacuggcacuccaagagccugggggugg

SEQ ID NO: 4125256 - RNA, 96 nt, Human
cuaccaguauccuguguauccuguuguggccagaaagcuacugacaccauuagugcuuuacagggcacaaagggagcuaaggaagcuuaaggcuag

SEQ ID NO: 4125257 - RNA, 77 nt, Human
cuaccagucuugucugagggagucaugauuaaggaagccuccuuaggcuuuguucagcuuccugggugagaaggaag

SEQ ID NO: 4125258 - RNA, 100 nt, Human
cuaccauacccagccugucuuuuaaauuggaaacuuccuaacuucuuucguuauauuaucaaagaauaguuaaguuuagggcauguuguggguagugugg

SEQ ID NO: 4125259 - RNA, 77 nt, Human
cuaccauggccagcacagcuccacacagaacacgagcugccuuguguaccuaccguuugugugcgucuggccugggg

SEQ ID NO: 4125260 - RNA, 63 nt, Human
cuacccaauucugccuuuguacugugaaagcagccaucacuguacauaaaggaauagguguag

SEQ ID NO: 4125261 - RNA, 82 nt, Human
cuacccuggcaccugcuuuucuauuggcauauccacgacaaugcugagcucaguguggggccaggaucagggcucgguguag

SEQ ID NO: 4125262 - RNA, 94 nt, Human
cuaccucaucacccagcuguggcccacuuacgucaugugugauauguguucugcugugugauaauggugguguucugcugugugaugaugguag

SEQ ID NO: 4125263 - RNA, 88 nt, Human
cuaccucugagacaucucauccugcccuaaaacagcacuguaaaucaaaaucuugguuuguuuuaucaagauggcaugucguuuguag

SEQ ID NO: 4125264 - RNA, 65 nt, Human
cuaccuuccagggagcccaaccuacaacaccaagauaaauugcuuguauuuuuuccuggcggugg

SEQ ID NO: 4125265 - RNA, 67 nt, Human
cuacgcgauauucccuccugugcggauccaccucugcgcagcucagugagggaacuugugucuguag

SEQ ID NO: 4125266 - RNA, 76 nt, Human
cuacgucuggccuuuuuagcuuguggaacuuaucauccccgccauccaguaaaggcuacaaaggccccgagacuag

SEQ ID NO: 4125267 - RNA, 80 nt, Human
cuacuaaaugauauauugucugcaaagguuuauaaagauaaucuuggugucucuuaguacauagauuuaucauauagaag

SEQ ID NO: 4125268 - RNA, 108 nt, Human
cuacucucccacuugcugcuuugaggagggcuuccauggggagcccccuaccaccugaguuguaugggguaccuuauagaagcccaacaaagggugggcucccagugg

SEQ ID NO: 4125269 - RNA, 70 nt, Human
cuacucugggcuuguguuagcugacaaggcacauugguuuucccguuuacucacauuaagcccuggguag

SEQ ID NO: 4125270 - RNA, 60 nt, Human
cuacucuuggagacauauuaugaacaggaguacauuucugcaggcucaucucaagaguag

SEQ ID NO: 4125271 - RNA, 84 nt, Human
cuacucuugugugcguccuugcuauauguucuuaacagaaaauuacuuuagaacuuaguagcacaagaaguacacauagagcag

SEQ ID NO: 4125272 - RNA, 56 nt, Human
cuacugagagcacaccccugugugaaugguccaacugcaguaucugcuuuggguag

SEQ ID NO: 4125273 - RNA, 69 nt, Human
cuacugcaucugugccuaacauagugccugacacuuaccagguguucauguaaguauagaaagcagugg

SEQ ID NO: 4125274 - RNA, 63 nt, Human
cuacugcaugcauugaauucuagggugcaaugauaacuucuaggaccaacauagcagcagugg

SEQ ID NO: 4125275 - RNA, 83 nt, Human
cugaccuccaaaagggaggggcugcccuggugucagggccuagggcguacagauggcuccacaaggcagcuccuccaggucag

SEQ ID NO: 4125276 - RNA, 66 nt, Human
cugaccucucuguaguggagucuccuguccuggucugaccagagugagacccaggugcugggucag

SEQ ID NO: 4125277 - RNA, 55 nt, Human
cugaccugugcagugacugguggcccagcaaacagggccuuguaugcagaggcag

SEQ ID NO: 4125278 - RNA, 57 nt, Human
cugaccuugugauccacccaccuuggccucccaaagugcugggauuacaagcgugag

SEQ ID NO: 4125279 - RNA, 57 nt, Human
cugaccuugugauccacccgcuuuggccucccaaagugcugggauuacaggcgugag

SEQ ID NO: 4125280 - RNA, 57 nt, Human
cugaccuugugauccaccugccuuggccucccaaagugcugagauuacaagcgugag

SEQ ID NO: 4125281 - RNA, 57 nt, Human
cugaccuugugauccacuugccuuggccucccaaagugcugggauuacaagcgugag

SEQ ID NO: 4125282 - RNA, 57 nt, Human
cugaccuugugauccgcccacuuuggucucccaaagugcuaggauuacaggugugag

SEQ ID NO: 4125283 - RNA, 57 nt, Human
cugaccuugugauccgcccgccuuggccucccaaagugcugggauuacaagugugag

SEQ ID NO: 4125284 - RNA, 57 nt, Human
cugaccuugugauccgccugccuuggccucccaaagugcugggauuacaagcgugag

SEQ ID NO: 4125285 - RNA, 57 nt, Human
cugaccuugugaucugcccaccuuggacucccaaagugcugggauuacaagcgugag

SEQ ID NO: 4125286 - RNA, 64 nt, Human
cugacgcuuuccuaguuggucccagcacugagcagaacugugcuagagaagcagggaagcacag

SEQ ID NO: 4125287 - RNA, 70 nt, Human
cugacggaacucuggaucucauacaccucauaauuccuccaagauggcugaggucuggggcuucugcaag

SEQ ID NO: 4125288 - RNA, 97 nt, Human
cugacuacugauuuucacuuaaaucuguugagaaaaaggcaauuuugcuuuuguuucuuagcaacagauagcuugauccugaaagucuaaugguaag

SEQ ID NO: 4125289 - RNA, 95 nt, Human
cugacucacaaacgaaagguucuucuucaguagucauuagaaaaauuguguuuuugauuucuuaagaggaacauuuuugugucuucacacaucag

SEQ ID NO: 4125290 - RNA, 88 nt, Human
cugacucacagguguguaguacagcugcugccucauccacuuuauuccaccacaaggucauuuaaggccagcuggcucugugcgucag

SEQ ID NO: 4125291 - RNA, 63 nt, Human
cugacucccuccccaaagcuggcgcuucugugagauuccagacucugguggaggguguagcag

SEQ ID NO: 4125292 - RNA, 83 nt, Human
cugacuccuugaguuacagcucuccaagagaaaucauauuuuauucccuuuucaugagagcacauaauuauuuuaggagucag

SEQ ID NO: 4125293 - RNA, 86 nt, Human
cugacugcacucugcucggcucaugcuucuguugcggcacugugcuccuugcuguucuaggagcugugagcaugccucugccucag

SEQ ID NO: 4125294 - RNA, 78 nt, Human
cugacugcagcucugcuuccuuguacaggucuguugugggcaucccgaccugcgaguccguggugcagcugcagccgg

SEQ ID NO: 4125295 - RNA, 56 nt, Human
cugacuguaauucuguucuuaauugcuauucaaaugaggaaaggagggcaagucag

SEQ ID NO: 4125296 - RNA, 104 nt, Human
cugacuguuguuuaaagacauucgguuuuucuacuauacaguuucucuugaauauccgaauuacugagaugaauagauggcaagaugucuuaaacauugauuag

SEQ ID NO: 4125297 - RNA, 63 nt, Human
cugacuucacaugaauggccuggaggggaucauauuuuuaaacaggaaaucagugugaauuag

SEQ ID NO: 4125298 - RNA, 86 nt, Human
cugacuucccagcacccaccucugaguuggccugucuugucugucacuaccagagagaggcccccucaggcugcagggcugagcag

SEQ ID NO: 4125299 - RNA, 128 nt, Human
cugacuuugcugcaugggaaagggcagggauaaggagcagggcugccccaguccagccggauccaggcucugauggacauggcagcccucacuccuucuccuccagcccuguggggugcagcuguugg

SEQ ID NO: 4125300 - RNA, 57 nt, Human
cugacuuugugauccaccugccuuggccucccaaagugcugggauuacaggugucag

SEQ ID NO: 4125301 - RNA, 99 nt, Human
cugagaaacagacgggugcugacaacucuuugguggaaaaauaaguugcagacuuauacaaguugcccaaaugauuaucaagccgaguuuguuuuucag

SEQ ID NO: 4125302 - RNA, 55 nt, Human
cugagaaaggaccucaaacagggaaagccaacacccugaaccaaggcuuucucag

SEQ ID NO: 4125303 - RNA, 59 nt, Human
cugagaaaugcauuuuuccagcacuucuuuuuacugcugggaugggauguccuucuggg

SEQ ID NO: 4125304 - RNA, 58 nt, Human
cugagaacaucauauuuugccugguauacagaaccagcugcccacuauguguucuugg

SEQ ID NO: 4125305 - RNA, 69 nt, Human
cugagaaggugacuuuaaaacagucugaguguauaaauugcaaucagacuauuaaagucucuuuuaaag

SEQ ID NO: 4125306 - RNA, 60 nt, Human
cugagaauaguaauaauuucuggcauuuguagguguuagagaagcuguaauuauucaaag

SEQ ID NO: 4125307 - RNA, 93 nt, Human
cugagacagaauacguagaaaugugugaauugagagaagagcccuaagguucuuacauuacuuuacauguguuuuuuaaaaaaauuguuuuag

SEQ ID NO: 4125308 - RNA, 58 nt, Human
cugagacagacagugcagacacccucuccucauagucccugcacugaacaugucugag

SEQ ID NO: 4125309 - RNA, 55 nt, Human
cugagacccagacaccugaggaggaagugcugccuggcuagugcuggugucucag

SEQ ID NO: 4125310 - RNA, 82 nt, Human
cugagacccugccaaggauggccccgauuccaggcagcugauaaaagcgagcucuucagggucacuuuaggcauuuccucag

SEQ ID NO: 4125311 - RNA, 78 nt, Human
cugagaccuccuggauggagcugcccucgccaccgggcccuuggcccugcacggagcucuguccaauaaaguucucgg

SEQ ID NO: 4125312 - RNA, 64 nt, Human
cugagaccuuggacuccauccuucugccaaauuguggcugagggugguggcuuaaggugcugag

SEQ ID NO: 4125313 - RNA, 95 nt, Human
cugagacucaggggccaagggacuugcucaaggucauugggacgucugucauggagcagauuugaaaaccugagccucccggcuccccaguccag

SEQ ID NO: 4125314 - RNA, 61 nt, Human
cugagacuuuggcauuuacagucacagcacaugcagggagagucaaaugccaaugucacag

SEQ ID NO: 4125315 - RNA, 55 nt, Human
cugagagaaaaauguuccagcuggugugggugguaccagcacaugcuucucugag

SEQ ID NO: 4125316 - RNA, 81 nt, Human
cugagagcaguugugccuguccagggacugagggagagaaacacacaucugucccccaacuggaagaacagcugaacucag

SEQ ID NO: 4125317 - RNA, 63 nt, Human
cugagaggcacaaggcauuucgguuaaguuauauuggccccaaaguacccuuuugcuacucag

SEQ ID NO: 4125318 - RNA, 64 nt, Human
cugagaggcaugcacagaugugcugugggaacccuaacauaggacacuuagcugagccucaaag

SEQ ID NO: 4125319 - RNA, 57 nt, Human
cugagaugguagauggauguuaaggugaauguuucuuaaugucuugagacauuucag

SEQ ID NO: 4125320 - RNA, 71 nt, Human
cugagauucagcccacaguggguaguauugagagagggcugggagcugccccagcugggggcuggacuggg

SEQ ID NO: 4125321 - RNA, 108 nt, Human
cugagauuuagaaagguuauaguaagaggcaaagucacagcuaaauagcuaagucuucugaacuucaagcucugugaccuuaaccucuauguaauaaaaugauuuugg

SEQ ID NO: 4125322 - RNA, 80 nt, Human
cugagauuuauaggaacaggccuuuuaacuuuacaagauuggauucuagcaugaguuauccgaaggcacugagaucuuag

SEQ ID NO: 4125323 - RNA, 102 nt, Human
cugagauuuccccgggcaacacaugaaaagagcucgauugucaguguuagggagacagacguuuucagcacuggacagcgagucucaggccugaggguucag

SEQ ID NO: 4125324 - RNA, 69 nt, Human
cugagcaauuucagcucucacucagggauaaaucaaaaauuaccuaaagugaguugauggaaaacucag

SEQ ID NO: 4125325 - RNA, 80 nt, Human
cugagcacccugugucagaccucugcagcugccaaugucuuccuccugcagcuguggcaggugucuggggcaggugccag

SEQ ID NO: 4125326 - RNA, 56 nt, Human
cugagccaagagcucaccucguguggcuggcccuccgccauguccucuuggcucag

SEQ ID NO: 4125327 - RNA, 67 nt, Human
cugagcccagaaguuagaggcugcaaugagccaugauagugccauugcacucuagucugggugacag

SEQ ID NO: 4125328 - RNA, 64 nt, Human
cugagcccgggacccgccgucaauggcgugggugcucccacccuguucccgguggccgggccag

SEQ ID NO: 4125329 - RNA, 67 nt, Human
cugagcccucggggcuguauuccccagggacuaugucccgaaaaggaggucagugccugagggugag

SEQ ID NO: 4125330 - RNA, 66 nt, Human
cugagcccucuugucuauaugguagaucaaaacaaguuuuaucuaaagacagugagaggaaagcag

SEQ ID NO: 4125331 - RNA, 57 nt, Human
cugagccuccauuucaucaggugaauaaccauccuggcugguugugauggggcuuag

SEQ ID NO: 4125332 - RNA, 73 nt, Human
cugagccugcagugagggaggugaguccuuuucccugcaggggucaagagagaacucccuucgccaggcgcgg

SEQ ID NO: 4125333 - RNA, 62 nt, Human
cugagcgaggaguuggagcuuugccauaaaccaaguaaagugaaaacacuaguucuugccag

SEQ ID NO: 4125334 - RNA, 74 nt, Human
cugagcggggcccuggggcugaagguccuccacuggagcugcacccuggcgacccggcuccaggcccagcagag

SEQ ID NO: 4125335 - RNA, 130 nt, Human
cugagcugaaaagccggcagacauugcccuggggccuuggcagagggcugggcucaggacaccuccuccugggcucagacucugguuaggaugugcugacgugaugucuggcgguuugacacuggcuugg

SEQ ID NO: 4125336 - RNA, 62 nt, Human
cugagcugaaacuugagaggcuacacacuacaggaaaaauaggccucacagaauuaguucag

SEQ ID NO: 4125337 - RNA, 56 nt, Human
cugagcugggaguggauagugggcacagccagccccagcucucccucucaguugag

SEQ ID NO: 4125338 - RNA, 77 nt, Human
cugagcuguguguuagucucaaagccguuggugcacuugcgcccacagccuggccugaguuaaggcagagcacuuag

SEQ ID NO: 4125339 - RNA, 79 nt, Human
cugagcuguugguuuaaauuuccauuagugucaaguuucagcacuugcauguuauagaauuuuaacucaguggaaucag

SEQ ID NO: 4125340 - RNA, 70 nt, Human
cugagcuucugugcccacugugggaucuuaacaaugucugcuggcugguccugggcagcgggacgcucag

SEQ ID NO: 4125341 - RNA, 56 nt, Human
cugaggaccggggucucugggguguuccccggaaacuacgugacacccguuuccag

SEQ ID NO: 4125342 - RNA, 56 nt, Human
cugaggagcugaaggcccuccaggcccaguuugaggaugccaucacagcccaucag

SEQ ID NO: 4125343 - RNA, 64 nt, Human
cugaggagggagaauuaggcuuaauauaaugucaaaauauuauuucuauuacucuucuucuugg

SEQ ID NO: 4125344 - RNA, 89 nt, Human
cugaggauucacgcgugauggauauggaagugccucgcacccagggggcccuggcuagauggcagcuuucauuguccacagagccucag

SEQ ID NO: 4125345 - RNA, 77 nt, Human
cuacuucauaggucacuguacagguuaaaugagauauuuuguguaggguucuuagcacuguaaguggccuauaguag

SEQ ID NO: 4125346 - RNA, 74 nt, Human
cuacuucaucagugcauggacagauuuagagaggugugguaaccucucaggcugcacagcaggguuagaggugg

SEQ ID NO: 4125347 - RNA, 64 nt, Human
cuacuucuuuugaguuagagaaugacugagccuuuaagucaguuuuuacggucacagggagaag

SEQ ID NO: 4125348 - RNA, 65 nt, Human
cuacuuuccaggcaccugaugccucacugcugcucugcuuggcauucuuagggccugggguguag

SEQ ID NO: 4125349 - RNA, 94 nt, Human
cuagaaaaucagaaccuaaaucaucuauggauuuugauguuuuuuagauuuaaaagauggaaaacauugagauaccaagggguucaauauuuag

SEQ ID NO: 4125350 - RNA, 75 nt, Human
cuagaaaaugcuuuauacaaaacacuuaauagguuccuauagugugaaaguuguaaaguaagaugacuuuucuag

SEQ ID NO: 4125351 - RNA, 57 nt, Human
cuagaaauguagauucuuaguguccuccuaccagaccuacagaaucgagcauucugg

SEQ ID NO: 4125352 - RNA, 106 nt, Human
cucauuuggggccaaacuuaugauaugcauuuaccuggcauauaccaaccaaacagaauggcugcaauauaggcacaggugagagguacaaaauggcugcaguggg

SEQ ID NO: 4125353 - RNA, 72 nt, Human
cucauuuuucuacugcccacauuguaccuuuucuaucugugcaaaggucacuguuugcagugaagagaagag

SEQ ID NO: 4125354 - RNA, 61 nt, Human
cuccaaaaucacaugagccaauuccuuaaaauaacucucuauuggcucuguuucucuggag

SEQ ID NO: 4125355 - RNA, 101 nt, Human
cuccaaauuaugaucaagugaugggagaagcagcagccaagugccagagagagucugugaguggacauguggcugcuguuccucaugaauguuggugggag

SEQ ID NO: 4125356 - RNA, 77 nt, Human
cuccaacugcagugcguucuuguucucauuguucuggacagagagaagcaaucagcagccacccacugcagcuggag

SEQ ID NO: 4125357 - RNA, 77 nt, Human
cuccaacugcagugugcucuuguucucauuguucuggacagagagaaacaaucagcagccacccacugcagcuggag

SEQ ID NO: 4125358 - RNA, 59 nt, Human
cuccaagcacucaggcuucuuuugagaacaggagcaaaggcaagcccaggcacuuggag

SEQ ID NO: 4125359 - RNA, 96 nt, Human
cuccaaggauggugcuuagcauauggucagcacucaguaaauaucuguugaaugagugccugaacauagaguagcuaagaaaaacuauuuuugaag

SEQ ID NO: 4125360 - RNA, 68 nt, Human
cuccaaggauucuggacccuuggccauauuugccucuagcuuuaggucaacagauuucuaacauggag

SEQ ID NO: 4125361 - RNA, 73 nt, Human
cuccacaggccccucugcugggagcgcauacacaaaagugaggcuccuugaaagggggacucugucugugcag

SEQ ID NO: 4125362 - RNA, 66 nt, Human
cuggcggaguugggcgggcggccgcggcggggagcggcgcugucggcugcucggccgaguccucgg

SEQ ID NO: 4125363 - RNA, 62 nt, Human
cuggcguucugugaacaucccugaaaugaaaacaguggaugcaggaacacagcgaccuccag

SEQ ID NO: 4125364 - RNA, 79 nt, Human
cuggcuagucaagaucaaucaauacuccuuagacagcaccaauuugagguucugacaaguguuauuuuuugaaggccag

SEQ ID NO: 4125365 - RNA, 78 nt, Human
cuggcuauuagccuaaaguggaaucaagaaacuauucugucuugucuuucccucuaagcuuuagauuuagugagccag

SEQ ID NO: 4125366 - RNA, 68 nt, Human
cuggcucagccuggcccuuucaugaacaaauggaaaugaguaucucaggaggggcaaggcuuagccag

SEQ ID NO: 4125367 - RNA, 65 nt, Human
cuggcucaggaaaguugcugcugacugcacaaagaucugagcagugaccuucuugcuuaaguugg

SEQ ID NO: 4125368 - RNA, 64 nt, Human
cuggcucaucucugcauccucuauggugugccuggcacacuggaggguccagggauguuucuag

SEQ ID NO: 4125369 - RNA, 55 nt, Human
cuggcuccacucccugccugaccccuccuggggucucugggauaaacugggccag

SEQ ID NO: 4125370 - RNA, 59 nt, Human
cuggcucugaccgcgcuggccugggccggagagcccaggaggcgugucucagagaaaag

SEQ ID NO: 4125371 - RNA, 86 nt, Human
cuggcugaaaauacuuuuuuaagaccuaguaccagacuucuuuagagaaguaauuacuaguuuuuaggaaaagugacuuugaauag

SEQ ID NO: 4125372 - RNA, 65 nt, Human
cuggcugaucuccugaaugucuuugcugcaaccucagcuccgugcuucucggggagguuagccag

SEQ ID NO: 4125373 - RNA, 77 nt, Human
cuggcugcacaaacauggaagcagcaucugcuuggcuucuggugaggccucagaaagcuuuuauucauggcagaagg

SEQ ID NO: 4125374 - RNA, 126 nt, Human
cuggcugcuccugggaauaagugccaaaucuggggucagacagcccuggggccagucuuccuuggguacuggcuuccuccuucaggagcugcacugggcccacugguauccuaucccuacagcugg

SEQ ID NO: 4125375 - RNA, 58 nt, Human
cuggcugguaauggaacgacagaguugagaaggauuuuaaauccaggaccagacucag

SEQ ID NO: 4125376 - RNA, 55 nt, Human
cuggcuguauuaguuugauccugggagggauuaaagaccaaauaacuacagucag

SEQ ID NO: 4125377 - RNA, 68 nt, Human
cuggcuguggucauuaggagguugugggggacucuguuccugcuuuucagagcugagaucaccgcugg

SEQ ID NO: 4125378 - RNA, 61 nt, Human
cuggcuucagagcccacacuguuaaucacuauucuauaugauuaacaaagucugaagucag

SEQ ID NO: 4125379 - RNA, 68 nt, Human
cuggcuucccucucuccagggcugccuuacaaguaaugagggagggaguaaaugagagagggaaacag

SEQ ID NO: 4125380 - RNA, 72 nt, Human
cuggcuucccuggcuguguucaggugcguggacuggguguguggcauggaccccagacaagccaggguccag

SEQ ID NO: 4125381 - RNA, 71 nt, Human
cuggcuuccuuccucucuuuccuaauucagcccaagagucacugagcaggcacaagaaagggaggugacag

SEQ ID NO: 4125382 - RNA, 59 nt, Human
cuggcuugguggucacagcccugaggaauggaguuucuggagaaucaccaccaggccag

SEQ ID NO: 4125383 - RNA, 56 nt, Human
cuggcuuuucaaacuguucagucauauuuuuuugaagaacagucugggaagcacag

SEQ ID NO: 4125384 - RNA, 116 nt, Human
cugggaaaucucacugucuucauuguugacauaccaagagcaaagcugggagguuugagcacagagcucuauggugagugucugugaagaagacaugauggagaaguuucuaccag

SEQ ID NO: 4125385 - RNA, 76 nt, Human
cugggaacaaucaaguuuaaucauugagcauuggagacacucuccaagggcaacaauggaacacacuguaucucag

SEQ ID NO: 4125386 - RNA, 58 nt, Human
cugggaacaggcacugcugucaggagcuacugccugggccuaccagccuguaucccag

SEQ ID NO: 4125387 - RNA, 55 nt, Human
cugggaagcuucgagcaggaaaugaagaaaucuaaagucugguucagugucccag

SEQ ID NO: 4125388 - RNA, 63 nt, Human
cugggaaggcagucacuguccuauucauacuucugcuggggcuagaaugaaugccuauuccag

SEQ ID NO: 4125389 - RNA, 91 nt, Human
cugggaagugccauuaucugauuuguaauuuuagaaagaucguuuuaucuuucaugagcagagcagguucuagagagugagugcagcccag

SEQ ID NO: 4125390 - RNA, 60 nt, Human
cugggaaguggcaggacccgaccuaugcaaaugccaugucuuccugaaacccuguuccag

SEQ ID NO: 4125391 - RNA, 69 nt, Human
cugggacauuuaaucuauguuuuguuuuguuuuguuuuacaauuauaagaauaauuaaguuaguccuag

SEQ ID NO: 4125392 - RNA, 89 nt, Human
cugggacgucaugucucugcaggugcaggucgggcggcccgaggugcugcuggauggccuggaaccuggcagggacuaugaggucucgg

SEQ ID NO: 4125393 - RNA, 73 nt, Human
cugggacuucgggacucagaaagguggcagcagaauuguuguggcucuugaggcucucgugugauggucucag

SEQ ID NO: 4125394 - RNA, 70 nt, Human
cugggagaaaggauaggaaugugcuuugggcuaugucagauggcagacagaucccaguucuuauucucag

SEQ ID NO: 4125395 - RNA, 119 nt, Human
cugggagaagcucagaggcuguuuaggaauccagaucuagacuguccuggggcccuacccagugaaauuugucucagugugauugauggguuuuauacacugucuugagccuuuccugg

SEQ ID NO: 4125396 - RNA, 129 nt, Human
cugggagggggacaggugaccacgcaggaaggcuuccuggaggagguguccucacucaugaaagaaggugauagugacagugcuccucuuggggaagagcccuccauccugaccugcugcccccacccg

SEQ ID NO: 4125397 - RNA, 66 nt, Human
cugggcaccugaagauuuagagauugaagauacagccuuauucaacuucaaauccucagggccuag

SEQ ID NO: 4125398 - RNA, 55 nt, Human
cugggcaccuuugcagcaggcucggccacgaggccugcugucacagcgggcccag

SEQ ID NO: 4125399 - RNA, 60 nt, Human
cugggcacuuuggggagccuaccacugagccuagacagugcccccagccugggugcccag

SEQ ID NO: 4125400 - RNA, 59 nt, Human
cugggcagcuccauaccacccacugucacuuggacuuugaggggcagagagguguccag

SEQ ID NO: 4125401 - RNA, 65 nt, Human
cugggcagugcagcuauagaacauuuucaucauugcagacuuucuauugggcagcauugcuucag

SEQ ID NO: 4125402 - RNA, 63 nt, Human
cugggcaugcuaugaacacaggcuugucagggacucugaaaaccugugccaaaguguguuagg

SEQ ID NO: 4125403 - RNA, 64 nt, Human
cugggcccccggcgcuggagcucuguaucucagggacugagaauaacagccuguguucccccag

SEQ ID NO: 4125404 - RNA, 64 nt, Human
cugggccuaugacuguggagguggcaucugggcuggcccugaugcuauaagccacaguggacag

SEQ ID NO: 4125405 - RNA, 58 nt, Human
cugggccugucagggcuuuuuggagacaagcaacagaaaccaacccuggcuggccuag

SEQ ID NO: 4125406 - RNA, 61 nt, Human
cugggccuuagggcacucccuuugcagagcacucauuaggaacaugugcuuuggggcccag

SEQ ID NO: 4125407 - RNA, 70 nt, Human
cugggccuuuuucuuuaaaggaacucuguuuaccauucauuagauaguccauuuggagaaauaugugcag

SEQ ID NO: 4125408 - RNA, 63 nt, Human
cugggcuaugagaagauuagagcugaauuuacuuaccauagcuuuaaauaauacaagguccag

SEQ ID NO: 4125409 - RNA, 128 nt, Human
cugggcuauuuccuuauagcuggagcagcagugggcauagcagggucucaggagucaggaggauccccacugucacccuggcuggacuggaccguggcucacuccuccuagagggauaucaagcccag

SEQ ID NO: 4125410 - RNA, 72 nt, Human
cugggcucagugucucacuccuguaaucccagcaccuugagaggccgaggugggaggauuacugaagcccag

SEQ ID NO: 4125411 - RNA, 57 nt, Human
cugggcugagcuguggaaacuccccugaaggggaaugcuucccacagcccagcccag

SEQ ID NO: 4125412 - RNA, 60 nt, Human
cugggcugcgguucucugaagccaccccguguuucagauguacgagugcaguugcuccag

SEQ ID NO: 4125413 - RNA, 65 nt, Human
cugggcuggagagcuccuauuugcugucugagauuuauacucagauguaguugcuccagccacag

SEQ ID NO: 4125414 - RNA, 66 nt, Human
cuggggaaaagcacuucaggagcaguuugcuacagcaagcaaugcugcugacuguucccuccuugg

SEQ ID NO: 4125415 - RNA, 62 nt, Human
cuggggaacaauuugccacacuuuccuaguuuacuuuagccucugggcaguugcuuucccag

SEQ ID NO: 4125416 - RNA, 71 nt, Human
cuggggacaggagacuuacagcuaccuauguguggaugccauccuuaggagccugagucaaggguucccag

SEQ ID NO: 4125417 - RNA, 97 nt, Human
cuggggaccuagcagaugccugaaggagcuggguuuggcaccuuugccagcuccaggaccccagcucuuuuagcggcaucuccauggcauuccuugg

SEQ ID NO: 4125418 - RNA, 75 nt, Human
cuggggaccucucaaccuucuuuagaagauggaggggcuuccuucuucauggucugguucuccaggggcucccag

SEQ ID NO: 4125419 - RNA, 82 nt, Human
cuggggagcuugucacugugcuggcaaugacucagggaacauuuccuggaggagguggguugcaggagcaagaagccaccag

SEQ ID NO: 4125420 - RNA, 60 nt, Human
cuggggaggaggcugcagccuuggaguuuguugagcauggugggcacagccuccccccag

SEQ ID NO: 4125421 - RNA, 72 nt, Human
cuggggaggugaugguuuccuaccuuccaacccacugacccagggaggcagcugaccuagcaccauccacag

SEQ ID NO: 4125422 - RNA, 58 nt, Human
cuggggauauugcaaagaauuaaaccuauuaaauuagaaucaaaugucauauccccag

SEQ ID NO: 4125423 - RNA, 81 nt, Human
cuggggaucuuguuaaaaugcagauugucauucaggagggcuggccuguccugggauucugcauuucuaacaaguucccag

SEQ ID NO: 4125424 - RNA, 81 nt, Human
cuggggaucuuguuaaaugcagauuuugauuuaguagccuguggcauggcccaaaauucugcauuucuaauaaacucccag

SEQ ID NO: 4125425 - RNA, 73 nt, Human
cuggggcaagguagggcaaaguagggcaccugggacaagcuuuccaccccucugggccccugcuucuccuugg

SEQ ID NO: 4125426 - RNA, 59 nt, Human
cuggggcaucauccauucuuucguauauucacagauauguaugguauguccugccccag

SEQ ID NO: 4125427 - RNA, 57 nt, Human
cuggggcauugggagaggccugggacucuggaccuggucugucuuucuuguccccag

SEQ ID NO: 4125428 - RNA, 86 nt, Human
cugcccagccccuggucccagucccuuuccaccguuggcuucaucaagcuccuugcgggguuggggcugcauggccaggguggcag

SEQ ID NO: 4125429 - RNA, 76 nt, Human
cugcccaucuugaauuguaguuccucagcuguaaaaugaaggagcugauugaacugagcuucaagaucacuugcag

SEQ ID NO: 4125430 - RNA, 64 nt, Human
cugcccauggcuccuggcugugguucuucuuggucugggucccacaucucagggcuacaggcag

SEQ ID NO: 4125431 - RNA, 55 nt, Human
cugcccauucaaccagcuacagaaucccaggccugcuguuggaucagugggucag

SEQ ID NO: 4125432 - RNA, 90 nt, Human
cugccccaguggcagauuuuccaguuggcagugccccuugaccagugcuggagcgucaguggggccacuccagucugugccugguggugg

SEQ ID NO: 4125433 - RNA, 82 nt, Human
cugcccccucucuguuuugugagcuccuuggagguagggaucgaagcuuuucccucccucugggcuccagcacggagcucag

SEQ ID NO: 4125434 - RNA, 93 nt, Human
cugcccggaccccaguugcguaagacacggggaccuucacccauuuguucauucaacaaauggcaggcucuuugcuaguugcuaggguggcag

SEQ ID NO: 4125435 - RNA, 67 nt, Human
cugcccucaggcugguccccacaguggaaagccugcuuugcuuucuugcugugccccagcagggcgg

SEQ ID NO: 4125436 - RNA, 55 nt, Human
cugcccucuagaggaggacugaaaaagggauuagccagauuucuuugcagggcag

SEQ ID NO: 4125437 - RNA, 61 nt, Human
cugcccucuagggaugcacugggcuggacaacagcccaccaacauuacccuguaagggcag

SEQ ID NO: 4125438 - RNA, 68 nt, Human
cugcccugagauuuguaauuuuuguaggaaaacuaagauuccugauaaagauucagaucuuucuucag

SEQ ID NO: 4125439 - RNA, 115 nt, Human
cugcccugcaguugugcuguguuuuucccaggcugggucuggccuuuggcaaacagucagcugggcuagggccugcuaugguuuggaaaggcagcuucagagguaccaugggcag

SEQ ID NO: 4125440 - RNA, 78 nt, Human
cugcccugcuucagcucacccucugugggcugcacccacuguccaaccagucccagugagaugaaccagguaccucag

SEQ ID NO: 4125441 - RNA, 60 nt, Human
cugcccugggcccuauccgcugucagcugccugagcugaagagagaugcguccagcucag

SEQ ID NO: 4125442 - RNA, 58 nt, Human
cugcccuguggcucugagucaugagaaaaccagacauaagcgagcaucacagggacag

SEQ ID NO: 4125443 - RNA, 57 nt, Human
cugcccugugguuguggguucucugugcaaggcaggucucacccauccccagggcag

SEQ ID NO: 4125444 - RNA, 129 nt, Human
cugcccuguguggagacgggcugagugacauguucuucaggaggugagcaagaagggggcaucaucucccacccuuccuccaccugcacacaccuggcacgugugcuccuccaccuuucugcaagggag

SEQ ID NO: 4125445 - RNA, 81 nt, Human
cugcccuuuuagaaaagguuugccgaccucugcuuuagaggguuaugaacagggaauggcacaaucugacgggaaguuuag

SEQ ID NO: 4125446 - RNA, 76 nt, Human
cugccgagaucagaguaggauuuggaacccaagcaccagggaaccaauguuaggcucugguuuuagauccuggcgg

SEQ ID NO: 4125447 - RNA, 70 nt, Human
cugccuagccuucuucaugccaugaugcauacauacaaaauuauacggacuacauggagaggcuaugcag

SEQ ID NO: 4125448 - RNA, 71 nt, Human
cugccuaguucuggguggccaguauuuagaaaugguuaauuugcuucugauucugcccccugaagcugcag

SEQ ID NO: 4125449 - RNA, 109 nt, Human
cugccucauuacuccuaagacugcacaguacacaaaaggaguuaguuugccacgugccaaaacauggcugugggugcuggcuccacccugcagagggaaacugaggcag

SEQ ID NO: 4125450 - RNA, 61 nt, Human
cugccucauucuggccuugguuccucugucuaaugggggaccugaacauaaaacgaggcag

SEQ ID NO: 4125451 - RNA, 56 nt, Human
cugccuccaggcucaccuugacaagcuacugauggagcggggucggcuggaggggg

SEQ ID NO: 4125452 - RNA, 65 nt, Human
cugccuccauggggucuggcccaggcugcacacuguaggugcucuggggccagcuccugaggcag

SEQ ID NO: 4125453 - RNA, 59 nt, Human
cugccucuccccagaguggccccaccaaccccuucuguagcccucuguucaagaagcag

SEQ ID NO: 4125454 - RNA, 82 nt, Human
cugccucuuccaucaacuucaacuauuuauaaauucucccaaguuccccaagggaguuagauuugaaugauguaaagagcag

SEQ ID NO: 4125455 - RNA, 55 nt, Human
cugccugcaugcugccauagcugguaggcuucuccaagcagcagcugccaggcag

SEQ ID NO: 4125456 - RNA, 75 nt, Human
cugccugccucugaguccugcacucacccguccaccaggacagggauggcugucaggauguaguguugcugggag

SEQ ID NO: 4125457 - RNA, 63 nt, Human
cugccugccugccugcuggccgggacuccugagucaggcucucuggcccuggggugugggcag

SEQ ID NO: 4125458 - RNA, 57 nt, Human
cugccuggcuccauccuugagcucugggcaccaccuagggugagggagagccugcag

SEQ ID NO: 4125459 - RNA, 122 nt, Human
cugccugguagagguuagucacuugguaguguagaguggugggggugucuguggauguaucugcuucucaaacagacauucagcuaagucuauuauugcccaacauuaaccuccacuagcag

SEQ ID NO: 4125460 - RNA, 70 nt, Human
cugccuguuaaacugucaccuaauguauuuuuagaaauauauaaucuaaaaaagacagaggaugaggcag

SEQ ID NO: 4125461 - RNA, 85 nt, Human
cugccuguucucacuuucuuucgaagacgugauuaaguuuccacauuuguuuggucccucaaaaggcaaagaugaaguacaggag

SEQ ID NO: 4125462 - RNA, 77 nt, Human
cugccuguuuuccacaugaaaauuaauguaauauuuuguuuagaaaucacauuguaggucauuugcaaaugaggcag

SEQ ID NO: 4125463 - RNA, 55 nt, Human
cugccuuggaaaaugugguaauuaaaaagugcuuuaauauaacauccaggagcag

SEQ ID NO: 4125464 - RNA, 67 nt, Human
cugccuugugauggagaagcaacaucuggaccuaagaccuagcagacagcugccuccaccacagcag

SEQ ID NO: 4125465 - RNA, 56 nt, Human
cugccuuuugcccuucuuuggaaugugauuuucauccagggaagaaaugagggcag

SEQ ID NO: 4125466 - RNA, 84 nt, Human
cugcgagggagcuguagagcagggagcaggaagcuguguguguccagcccugaccuguccuguucugcccccagccccucacag

SEQ ID NO: 4125467 - RNA, 59 nt, Human
cugcgcagggguggcgccagaaugaucaaagucaucauggggcacucaucuuugugugg

SEQ ID NO: 4125468 - RNA, 63 nt, Human
cugcgcaguggauuaaggagggcagcuccuuugggggcuggccagagccuguccauugaguag

SEQ ID NO: 4125469 - RNA, 60 nt, Human
cugcgcggcuccgcgggccccaccggaaaucccggcccgggguggccucggagcgcgcgg

SEQ ID NO: 4125470 - RNA, 100 nt, Human
cugcggacuucaccacucacauucacuuuacuuuguuaaucuggcugcaaggaaauuucuuagcccuugacacaguaugugaagagaguucuguuggcag

SEQ ID NO: 4125471 - RNA, 55 nt, Human
cugcggccccgacuucagcgguugggcuaggcugugcugacuguuuggguggcgg

SEQ ID NO: 4125472 - RNA, 61 nt, Human
cugcgggccagggcugcauaaucaaaguuagacaguuguuaugcaagcuuccuggucucag

SEQ ID NO: 4125473 - RNA, 63 nt, Human
cugcguccagcccuaagcugaaccuucugugggcugcagaagacgccugggugcuguacucag

SEQ ID NO: 4125474 - RNA, 68 nt, Human
cugcgugggaaggggaagagaccgcagagucagggacccccugccuccucuccuuccccaucccucag

SEQ ID NO: 4125475 - RNA, 117 nt, Human
cugcguggucaguuuugcaucucgcccuuuucuccagcuuucuuccuucugucugugcuacaaguaauggacggggaagaaaagcaaagaaagaauugcagagcuuggaaaauucag

SEQ ID NO: 4125476 - RNA, 58 nt, Human
cugcguucgccuccuuucugaggauggggucuuuacagggcagaagcaggcagugcag

SEQ ID NO: 4125477 - RNA, 58 nt, Human
cugcguugcccagugccacggccacuaugacauguggcuucugagcauugaaacgugg

SEQ ID NO: 4125478 - RNA, 67 nt, Human
cugcuaaaaugguauuuuuaaagauucugugguauucauaauaauuuugaaagcaccauuugaguag

SEQ ID NO: 4125479 - RNA, 59 nt, Human
cugcuacacaguucugccuaauggcaugaaaacaugccugcuaggcuggugugugccag

SEQ ID NO: 4125480 - RNA, 72 nt, Human
cugcuacauugugagcaacuccagggcugggacugugcucccagaaucuccagugcuacagcaguguggcag

SEQ ID NO: 4125481 - RNA, 64 nt, Human
cugcuagaguggcuaagccugcagaugccucuagagaaagguccucaggauggcggccuggugg

SEQ ID NO: 4125482 - RNA, 69 nt, Human
cugcuaucacaaacacaucauucaugucgucagucagcauguugcaggcauaaccgauguugauggcag

SEQ ID NO: 4125483 - RNA, 83 nt, Human
cugcuauguuuuagaaugagcaugaagccaguuugguuauuuuauuaaagaagaauuaggugcauguuuacaaaaacaagcag

SEQ ID NO: 4125484 - RNA, 75 nt, Human
cugcuauuucagucacuucuucucugacccaaaagguauagaguccacgcagagacauaugauugagacagacag

SEQ ID NO: 4125485 - RNA, 79 nt, Human
cugcucagauucugccaggggcacuugcggcucaaaguacauucaagucucaagggaugucucuauaggguagaggcag

SEQ ID NO: 4125486 - RNA, 96 nt, Human
cugcucagugugcagacugagggccagcagccucagcaugacugggagcucacuagcaguucaggccggcugacucagaacccacauucuagcaag

SEQ ID NO: 4125487 - RNA, 58 nt, Human
cugcucauccauggaggcgauuguucuuggccgguccuuccugcagggauggaugcag

SEQ ID NO: 4125488 - RNA, 84 nt, Human
cugcuccuccauugguccacugugaaauugggacaaaagauaucuuauuuuuuaggauucacauggauucaugauggagagcag

SEQ ID NO: 4125489 - RNA, 59 nt, Human
cugcuccuccccaucaggcagccucucuugcggcuggugacgauuaggaggaaagccag

SEQ ID NO: 4125490 - RNA, 69 nt, Human
cugcuccuggcccugagcucccaggugccaugcaauggcucgccuggggcagcuguggggcuugaacag

SEQ ID NO: 4125491 - RNA, 57 nt, Human
cugcuccuggucauccuccacucucugacucccccagguccuggagaugcuggacag

SEQ ID NO: 4125492 - RNA, 68 nt, Human
cugcuccuggugacucccagauaaacuaccugcacuuuggucuuuaucuugggcucagcauucagcag

SEQ ID NO: 4125493 - RNA, 85 nt, Human
cugcuccuugaaggauccagcugcagcccaguuucuucccaccagugccugguguagcugggcagugcuuggauucagggagcag

SEQ ID NO: 4125494 - RNA, 65 nt, Human
cugcucuaacugcauuaguuuuucuagacuuuuuucuauuguggauuaagaaguuggaaaugcag

SEQ ID NO: 4125495 - RNA, 72 nt, Human
cugcucuauccaguguguaugagguuugcagugggagcguccuuacauuaacuuacguccacaugguggcag

SEQ ID NO: 4125496 - RNA, 79 nt, Human
cugcucucaaggagcucacagaugaaucaguaguaauaauuauaccaacggcugacauuuacugagcacuuacuagcag

SEQ ID NO: 4125497 - RNA, 69 nt, Human
cugcugaauuacagaaaaaagcacaacaccaucagaaguuacagguguagcauuuuauguaauaaguag

SEQ ID NO: 4125498 - RNA, 56 nt, Human
cugcugaccuucagggcugcuuccaucccuggugggggccguccuggggauuauag

SEQ ID NO: 4125499 - RNA, 64 nt, Human
cugggggcuagagagaugaaauaucuuaucuagaaaaugagagguuuugaaucuagcagccuag

SEQ ID NO: 4125500 - RNA, 95 nt, Human
cuggggucaaagauucagcugccaugguccaggcuccaggcuggggaggauguuagggauugguguggucaggaccagcgcugcuaugacugcgg

SEQ ID NO: 4125501 - RNA, 87 nt, Human
cuggggucaggugaccugaauuccuauccugguuguacccaagcaggcugggcaauaugggcaagacauggcuucucugagccccag

SEQ ID NO: 4125502 - RNA, 75 nt, Human
cuggggucuaucaacugcaugagcugucaguggaggccacggcggccucuccguugcugaccucuuguuccccag

SEQ ID NO: 4125503 - RNA, 68 nt, Human
cuggggugggucuggaaggagagcuuccugcagugaagaacuccgaugcuuccagggccaccugccag

SEQ ID NO: 4125504 - RNA, 68 nt, Human
cugcuggaggaaaucucaccgcgccggggcagccuucgccaccggcaggaccucauuuccuucugcag

SEQ ID NO: 4125505 - RNA, 55 nt, Human
cugcuggcaccuccagggauggaguccucccagaccucuccugugggugcagcag

SEQ ID NO: 4125506 - RNA, 73 nt, Human
cugcuggccggguucaucgaggcugcugggucaguuugacaccugcucagcccuggugagguuggcuaugugg

SEQ ID NO: 4125507 - RNA, 79 nt, Human
cugcuggccucugccagcucuaaacggcucuguggucuggcaaggccaaggcaaugugcagcuggugggaggucggugg

SEQ ID NO: 4125508 - RNA, 59 nt, Human
cugcuggccuuacuuuuuuagcauacagggauuggaagugaaagaaaagagaccagcag

SEQ ID NO: 4125509 - RNA, 63 nt, Human
cugcugggauagaaguaucucaguguaccagcauucacuaagcuauaaaaucugugacagcag

SEQ ID NO: 4125510 - RNA, 66 nt, Human
cugcugggauauuucauguaaaugguggacauuuuagacaccaugugcauccuuaaucucccuagg

SEQ ID NO: 4125511 - RNA, 83 nt, Human
cugcugggcucugcaaaaguagauacuugauaauauauuuauuuuucauuuuaaaaagaauuuguauuugcaggaaaugguag

SEQ ID NO: 4125512 - RNA, 55 nt, Human
cugcuguaauaggagcguuuugcugaaaaagaacagaaagcccuauguacagugg

SEQ ID NO: 4125513 - RNA, 87 nt, Human
cugcugugaaauuccuagaucauaagugaaagucuaacucagagccaucagggccaugaguagcgauuucauuuuuaguucauacag

SEQ ID NO: 4125514 - RNA, 65 nt, Human
cugcuuagcuccugucaucuccacacggaccuguuuuaaggagaagcuggaggaagacuaagcag

SEQ ID NO: 4125515 - RNA, 88 nt, Human
cugcuuaucaggcggcuuugugccuuuaaggggagcugagugguguguacaugggucucugaaaggcggaaaucugcaagaugugcag

SEQ ID NO: 4125516 - RNA, 60 nt, Human
cugcuuccaguuccucaccacauauauguuguguuagcuauguaggaguuauuggaacag

SEQ ID NO: 4125517 - RNA, 57 nt, Human
cugcuucucucccucauaaucguacaauucccucaguacaugcuugagaggaugcag

SEQ ID NO: 4125518 - RNA, 74 nt, Human
cugcuucuuagcagcuaaggacucuugggaaaguuacuaaacuucccaaagcuuugucugugaacuggaggcag

SEQ ID NO: 4125519 - RNA, 55 nt, Human
cugcuugacuuugauaaaauugcggaaaauugcauggaucuaagaggucaaggag

SEQ ID NO: 4125520 - RNA, 99 nt, Human
cugcuuggcauucaggacagucacuauuggugcagaucucuuguuaauugacaucuauauaacagauccacuauggugcugaugagcugugaccaacgg

SEQ ID NO: 4125521 - RNA, 56 nt, Human
cugcuugucuucgaggggugcacucuuaucuuugggggccccaguguggcacgcag

SEQ ID NO: 4125522 - RNA, 58 nt, Human
cugcuuuagacggcuuucgcugaccucggacaggaagacggcgaagcgcuuggaguag

SEQ ID NO: 4125523 - RNA, 63 nt, Human
cugcuuuggacaacuauucuuggaaacuaauuucaauuaagcaggaacaggguguccuggcag

SEQ ID NO: 4125524 - RNA, 100 nt, Human
cugcuuuucauccucaauacauugguuucaaggacacugagcuuuguaaagucccuucacuuuacugggccucaguguucucaucugugagaggaagcag

SEQ ID NO: 4125525 - RNA, 79 nt, Human
cugcuuuuuaaaauuguaguuuaaacuucagugacacguuuugccguuugcuaauuuaaagcuauuuuuaaaagagcag

SEQ ID NO: 4125526 - RNA, 73 nt, Human
cuggaaaauugaucaaggauuuauuuaagcuccauagagugggcucuggaaaguguccuugauggaaauucag

SEQ ID NO: 4125527 - RNA, 56 nt, Human
cuggaaagucaggucagaaacuggggcagagccucugcugaaaaugugcucuccag

SEQ ID NO: 4125528 - RNA, 77 nt, Human
cuggaaaugagcuacagacccaccuuggaagaaccugcaguugaggggcuucuuucauuugguuuuguacuuuucag

SEQ ID NO: 4125529 - RNA, 70 nt, Human
cuggaacugaaaacucaaggauuuagacgaagcuacccaguuuguuuaaucauuugaaguuuuguuucag

SEQ ID NO: 4125530 - RNA, 64 nt, Human
cuggaagaggccacagcugacagcacaggagaccaacuggcuggaggcucuggccauuguccag

SEQ ID NO: 4125531 - RNA, 66 nt, Human
cuggaagagugcagguuuguuucauaaacaucgcuuauggaaacuauaaaagcaccuucuucacag

SEQ ID NO: 4125532 - RNA, 75 nt, Human
cuggaaggauugagguaggcauuguucaaaaggcuggguagcgguccaggcuggggcaguggcuuuucacccuag

SEQ ID NO: 4125533 - RNA, 55 nt, Human
cuggaagggccugggaagagucgugcuucuaauucugaacaagggcaccuuccag

SEQ ID NO: 4125534 - RNA, 91 nt, Human
cuggaagugcacagcaccgagaaggaagcaugccuuugcuggcagagucagauggguguuugugacuuugcucggggaagugcaugcccag

SEQ ID NO: 4125535 - RNA, 66 nt, Human
cuggaauggaccccaagggaugcgugugcucaugagagaggagcgcugugcgcccuggguccucag

SEQ ID NO: 4125536 - RNA, 65 nt, Human
cuggaaugugcuagggcuguggccaccugggccccugcuggagcugcagcuguggauguucucag

SEQ ID NO: 4125537 - RNA, 57 nt, Human
cuggaauucuagaauucauggaguccuagaguggacuccaggacuugagaauuccag

SEQ ID NO: 4125538 - RNA, 58 nt, Human
cuggaauucuuauucugacuucagaggguccaucuucuuagucuucuuagaauuugag

SEQ ID NO: 4125539 - RNA, 65 nt, Human
cuggacaaccacaaggccaauaaacaagucuucagggagaccauggccagcuguagguugugcag

SEQ ID NO: 4125540 - RNA, 97 nt, Human
cuggacacauuuauucuacuauauucucugcugcuuuuguguauagauuuggaaaaugaacucaaaagaccagagagcugaggauaguugguaucag

SEQ ID NO: 4125541 - RNA, 109 nt, Human
cuggacacuugaacuuuuaaggagcagaggcuguggagcacuguuccuggcauggauuuggccagccuggggcacuucuccaaacccucucucgcuguccaaggugcag

SEQ ID NO: 4125542 - RNA, 76 nt, Human
cuggaccugggaugcagagcccugagggugcaggggaugggccaagggcucccugagggcucagcccccagcccag

SEQ ID NO: 4125543 - RNA, 119 nt, Human
cuggacucauugauuuucuccucccccccacuuacauugucauucuaugcuauucaguuguauuuuauaauugggugguggcaguaaugagaaagaagaguaugagaaaugauguuuag

SEQ ID NO: 4125544 - RNA, 67 nt, Human
cuggacucuugccagaacuacggugcaagccccauuguguggcugcagauuguagucuguuaaccgg

SEQ ID NO: 4125545 - RNA, 65 nt, Human
cuggacugugaggucugggugaggaggaaugguguuuaauucucauguauaucuucaguguucag

SEQ ID NO: 4125546 - RNA, 73 nt, Human
cuggagaagguggccugcaggaccccacagaagcaacaacagcuuaccuuccccuguggugccagaucgccag

SEQ ID NO: 4125547 - RNA, 65 nt, Human
cuggagaaguacugagacauuuagagguuaaacuaaacucagagugccauaaaguccuucuugag

SEQ ID NO: 4125548 - RNA, 97 nt, Human
cuggagaccaggaggcgcuaaaaggcagcccugcgcugcccccugguggccgauguggacacugcagccaggaagccuuucccucccggccuuccgg

SEQ ID NO: 4125549 - RNA, 63 nt, Human
cuggagaugcuauguaguuugguugcaagguggcugucaaucacaaaugcaaguugucaccag

SEQ ID NO: 4125550 - RNA, 65 nt, Human
cuggagauuuugcauuucuaacaagcugccaggugaugcugaggcagcugaagcugcaguuccag

SEQ ID NO: 4125551 - RNA, 95 nt, Human
cuggagcauggaauuucuauucaccuuugugaauaugcagaaaauaugagagcauauucuguguaugucauaauguuuaguuuuguguaauuuag

SEQ ID NO: 4125552 - RNA, 88 nt, Human
cuggagccgagcagugagccacagcuuuccuugugcacuugccugagcucagcaguggugugaggagggcucugacugugaagcccag

SEQ ID NO: 4125553 - RNA, 70 nt, Human
cuggagcugccagacgggcacaggcgagggcaccucacccuugaggcggccuuccuggcaguggcuccag

SEQ ID NO: 4125554 - RNA, 62 nt, Human
cuggaggccagaaaaagacagcuccaguguccuucuaggcugggggugguucuugccuccag

SEQ ID NO: 4125555 - RNA, 69 nt, Human
cuggaggcucuucaauaggucaaugguuuaacaauauuuaguacauucaucccauggaagaguucucag

SEQ ID NO: 4125556 - RNA, 61 nt, Human
cuggaggcugcaccguuuccugcugcccacgaugaacaaagcaggaaacugucuuuuccag

SEQ ID NO: 4125557 - RNA, 66 nt, Human
cuggaggggaccuugggacaagggcuucuuugguagcccuggccagguucacaggcuuccuuucag

SEQ ID NO: 4125558 - RNA, 68 nt, Human
cuggagguaugggauugauacccguccgucaacucucuggcaaagaaggaacuauaaucccauuucag

SEQ ID NO: 4125559 - RNA, 59 nt, Human
cuggagucuucagcuugcugccaaguuuugugaccuagaggcaggcaggagguuuccag

SEQ ID NO: 4125560 - RNA, 61 nt, Human
cuggagugccauaccugcguaggcggcugaguugaucugcacaggcguagguugacuuuag

SEQ ID NO: 4125561 - RNA, 83 nt, Human
cuggaguggagggagggaggugcugguucacggucauucucuguaaccaauuggcauccccugagaucuccaguccgcucugg

SEQ ID NO: 4125562 - RNA, 66 nt, Human
cuggaguguuauagugacuuccacaucaucuuuaccaucucucuugacuggagucagugacaccag

SEQ ID NO: 4125563 - RNA, 56 nt, Human
cuggaguucaguggcgugaacaugacucaccacagccuugaccuccuggacuccag

SEQ ID NO: 4125564 - RNA, 65 nt, Human
cuggaguuguuauuguaagaggugacugcauauugccuugcauuacacuaaugugacaacaauag

SEQ ID NO: 4125565 - RNA, 74 nt, Human
cuggauauuucccauuucccccaaaugcagccugguaaccacuguauuuguuguuaaauggagaggauuucuag

SEQ ID NO: 4125566 - RNA, 79 nt, Human
cuccaccuggucucucccuugaccuguggggauuauggggacuauggggauuacaauucaagaugagauucaggugggg

SEQ ID NO: 4125567 - RNA, 59 nt, Human
cuccacguauguguacagucauggcuguacagucauggcuucuaagugauaacguggag

SEQ ID NO: 4125568 - RNA, 74 nt, Human
cuccacguugccuuuccuguucuaguuguugccaucacuguguggagagaaaguugaauggagggacgguggag

SEQ ID NO: 4125569 - RNA, 57 nt, Human
cuccagagacacuucucaugauuguucaacuuuugguucugugaggugucucuguag

SEQ ID NO: 4125570 - RNA, 58 nt, Human
cuccagagguccccgcggcacucucggccggcaacggcucccgcgcggggccuuggag

SEQ ID NO: 4125571 - RNA, 61 nt, Human
cuccagauaggaggggguccccagugucugggagcuguggacucccaauucuugucuugag

SEQ ID NO: 4125572 - RNA, 67 nt, Human
cuccagcucgcgagcucugcucccuuauucugggaaaugucccacugcaggggugugugagcugggg

SEQ ID NO: 4125573 - RNA, 57 nt, Human
cuccagcuucuugacuuggugguugacaacaaagugcgcaaaaauagaagcugugag

SEQ ID NO: 4125574 - RNA, 59 nt, Human
cuccaggacagauucagggccaaguacggccgcagugacuugguccauguguccugggg

SEQ ID NO: 4125575 - RNA, 71 nt, Human
cuccaggacugaggacagagcugcucuucuucuucuacguuacuguggcccucuugucuggcagccuggag

SEQ ID NO: 4125576 - RNA, 57 nt, Human
cuccagggagcugcgggagccacaugcaggccccucaccuucaguucccaauggcag

SEQ ID NO: 4125577 - RNA, 62 nt, Human
cuccagggagcuuucccaggacccugguuccauuagucaccccaggcucugagcuccuggag

SEQ ID NO: 4125578 - RNA, 55 nt, Human
cuccaguaucuguaggaaaaggaaacuuuucuuuuaaaagagagcagaaauggag

SEQ ID NO: 4125579 - RNA, 63 nt, Human
cuccagucuagguccuacuuauuuaggaugguccugcucaagucucaaggccuagauucggag

SEQ ID NO: 4125580 - RNA, 55 nt, Human
cuccagucuaguagagccugcuugauugaaauugauuagcucuagaugauuggag

SEQ ID NO: 4125581 - RNA, 62 nt, Human
cuccagugagcaaguaaugaaggccuaugcuauggcucccucaaaccaccuuguuacugggg

SEQ ID NO: 4125582 - RNA, 55 nt, Human
cuccagugcacuggucuuuucagaccugccuccuggaauauccagaugccugggg

SEQ ID NO: 4125583 - RNA, 75 nt, Human
cucugcaauuucauggccuacuuugcuucaauauacucaagacaggaaguugcagcaaggucaugaaauguagag

SEQ ID NO: 4125584 - RNA, 92 nt, Human
cucugcacaagccaggucuucacuuuacugaagccccagcugaccccucugggcucaaacuuuacugaagugaagaccuggucugugcagag

SEQ ID NO: 4125585 - RNA, 60 nt, Human
cucugcaccuacacaacaggaagucccacaugcuggguucuaguugucccagguucauag

SEQ ID NO: 4125586 - RNA, 71 nt, Human
cucugcagacacuggcugauugaggagagcuuucuggggagaggauucuggaaguguuagaaucuggaggg

SEQ ID NO: 4125587 - RNA, 77 nt, Human
cucugcaggcucuggcggcucuuucaauaucucaggaucuggagacauguuucuggggaugccugggcucaacggag

SEQ ID NO: 4125588 - RNA, 56 nt, Human
cucugcaguugugcgccaauauaggucgauuacccagggcauccacgaaugcagag

SEQ ID NO: 4125589 - RNA, 65 nt, Human
cucugcaucaggcauuauggaugaaaggggacagucucaaccuucaaaauguuugcagugcagag

SEQ ID NO: 4125590 - RNA, 71 nt, Human
cucugcauuaagcuccaaguugcucugagaccugauuuaggggggucagaggaacuggacuaaagccaggg

SEQ ID NO: 4125591 - RNA, 55 nt, Human
cucugcauuuuaacagaugauuaguuauacauguuuguuugcuugaagagcagag

SEQ ID NO: 4125592 - RNA, 83 nt, Human
cucugccacgugguaaaagcuuccggggggaggcauuaguuauuucugucugaggaguuuuugaccaaacguaaacaucagag

SEQ ID NO: 4125593 - RNA, 120 nt, Human
cucugcccuguccagaccugccgggucccgcccaaguccgaccugagguuccaggggcguggggacacuccccaccccuugucuuuggggucguguggaccgcccggcgacggggaggag

SEQ ID NO: 4125594 - RNA, 98 nt, Human
cugcacccuccucucucccucucuuuccuacaccuuggacagacagccugagauuccagggcgugugugaaggaaagccgaggagggcagggccgcag

SEQ ID NO: 4125595 - RNA, 78 nt, Human
cugcacggagaaggaggcgaagcgugugcggguagacacgugagcacgcuguuuccuucugauguaaacacugggcag

SEQ ID NO: 4125596 - RNA, 65 nt, Human
cugcacuuuuccuuagggucagccagaucugguaaguagguaugcucuucuagggauaaaggcag

SEQ ID NO: 4125597 - RNA, 80 nt, Human
cugcagaagccaaauuggccuuugucaucaagaucagagguaucaauggugugagcccaaagguccaaaagguguugcag

SEQ ID NO: 4125598 - RNA, 65 nt, Human
cugcagaaggggaguggcuagugugugagggaggcaaugccccaccauuaagcauuucucuguag

SEQ ID NO: 4125599 - RNA, 80 nt, Human
cugcagacaugggaguguucagaacaaagguaaaugaggugguccucacagacccuugcugagcucuuaucccgugccag

SEQ ID NO: 4125600 - RNA, 75 nt, Human
cugcagacccucgggugaguuggccuuuuucgagcaaggagaccaugaaaacauaccuucucaggggaucugcag

SEQ ID NO: 4125601 - RNA, 119 nt, Human
cugcagaucaagacuuuuaaaguucacuuccugacuugcagcagcucuuugaauguuuuccaagcuugcaagcaugcuguuguaaaguaaaagugaagcuuuuaaaguuugcacagcag

SEQ ID NO: 4125602 - RNA, 57 nt, Human
cugcagaugcauagguacacuccguugagaucagcagagcauggcuuacaucagcag

SEQ ID NO: 4125603 - RNA, 58 nt, Human
cugcagcaagagaagugcugacuguuaauguguacacuaggcacuucucuuagcucag

SEQ ID NO: 4125604 - RNA, 130 nt, Human
cugcagcagauguggccuguacagggccggcacggggcggugccuggcaguggggcccugggacguggcagguccgagggcuggacgcaggggcccugcagcugcagcccuggaggucagcugugggaag

SEQ ID NO: 4125605 - RNA, 66 nt, Human
cugcagccaguauccucugagauuuugucguuagaaaucagggucuggaguaggaugauggcuagg

SEQ ID NO: 4125606 - RNA, 57 nt, Human
cugcagccauuucccccuccugggccuccuauccuugcccaguagagacagcugcag

SEQ ID NO: 4125607 - RNA, 62 nt, Human
cugcagcuaaggaaugugguugacguuagucagaaaauacgcuccaaauuaccuggcuguag

SEQ ID NO: 4125608 - RNA, 64 nt, Human
cugcagcucaggaaggaaggccggccuugcaggagggggccuggggccagcuugggcugagcag

SEQ ID NO: 4125609 - RNA, 57 nt, Human
cugcagcuccuucuggcaugugaaauugccugauaagccagcuaacugagucugcag

SEQ ID NO: 4125610 - RNA, 80 nt, Human
cugcaggaaaccuaaauuauugucaugucuacuuguucuuaauagguccaagagaacugaaauaggacaggauuuuucag

SEQ ID NO: 4125611 - RNA, 67 nt, Human
cugcaggaaucagaggggaagcgggcgccucgaaaccuaccacuugcuccccagggaccguccucag

SEQ ID NO: 4125612 - RNA, 73 nt, Human
cugcaggaugagugaguacauuuaugaaugaaucuuccauuuaaauauugaguuccuuaucucauaccugcag

SEQ ID NO: 4125613 - RNA, 64 nt, Human
cugcaggcgagugaacagacucucaacagcacgauuaagcccugagauuuaaucauuugcucag

SEQ ID NO: 4125614 - RNA, 67 nt, Human
cugcaggcucgaagacacggaugcaucucaucacacauccaacugacaccccguuucuucccuguag

SEQ ID NO: 4125615 - RNA, 62 nt, Human
cugcagggauugcuucuguauaugcaggccuucuugcaucuauaggauuagguuuacugcag

SEQ ID NO: 4125616 - RNA, 58 nt, Human
cugcaggguuuuucaaggacaaccaagguauugauuuggcaaccaaaaacuccuguag

SEQ ID NO: 4125617 - RNA, 86 nt, Human
cugcaggucaggggggcagcuguccuggccaugggcaucuggacccugguggagaggagcagcuaccucagcauccuggccuccag

SEQ ID NO: 4125618 - RNA, 61 nt, Human
cugcaggucaucggccagugucuucuucuuggagaagccaaugauacgggugaucuugcgg

SEQ ID NO: 4125619 - RNA, 59 nt, Human
cugcagguggcagcggggcaccaggggcucauuccugguggccucaguggcuucugugg

SEQ ID NO: 4125620 - RNA, 74 nt, Human
cugcagguggcugggcugacgcugcuggcugucggggucuacucagccaagaaugcgacagccgucacuggccg

SEQ ID NO: 4125621 - RNA, 56 nt, Human
cugcagguuuguaguacugagaauaauagagcguuuucagacccuacauuccucag

SEQ ID NO: 4125622 - RNA, 68 nt, Human
cugcaguacaagaagcaucucucgggcgaugaugcgcauagacagagggauuuuuuagucaauugcag

SEQ ID NO: 4125623 - RNA, 81 nt, Human
cugcaguucccacagccacgcccccugcccauuuugauucagaaaauggugggcaguggggaaugcuggggagaugagcag

SEQ ID NO: 4125624 - RNA, 87 nt, Human
cugcauaauaugccucaucuuguacucaucccugccucagcuccaggcuucauggagguaggauagauaggaagaccugcaaugcag

SEQ ID NO: 4125625 - RNA, 71 nt, Human
cugcauaauuagcucuuugacuaaucuugcuuuugccuuaggguaagaggcaguuuaggaugcaaaagcag

SEQ ID NO: 4125626 - RNA, 61 nt, Human
cugcauccaacaugaucauaaauggccagucccagcagcuucccacauggcuggaugacag

SEQ ID NO: 4125627 - RNA, 59 nt, Human
cugcauccaggcugcaggcccagcccaugcagggcucuacaccugccagucuggagcag

SEQ ID NO: 4125628 - RNA, 80 nt, Human
cugcaugaucucagcaugaacuccagcagacagacaaagagucugcaguaaguuaauagugcugguaaacaucauugcag

SEQ ID NO: 4125629 - RNA, 94 nt, Human
cugcaugcaaaccucagguggggugugggagugaagaguaacagguguaauuaaccugcccacacuuccuucccaagucuagcuguugcagcag

SEQ ID NO: 4125630 - RNA, 82 nt, Human
cugcaugguuuuggcuuaacuuguagcaauagauaaaugaaguuauuuauccaaaguagauuaagucacaugaaaccugaag

SEQ ID NO: 4125631 - RNA, 72 nt, Human
cugcaugucucugugguuagacuauggcugugucuccugcacaggaagucaguuaaccauagacauacucag

SEQ ID NO: 4125632 - RNA, 71 nt, Human
cugcauuauucuaguccaagccaguaguaucaucacaacuucuagauuggcucagguuauucuuaaugcag

SEQ ID NO: 4125633 - RNA, 123 nt, Human
cugcauugacaguugaaauccugagcuucuuugugggcuccagaaucagagauuuaaaauuucucacauaccuuccgggaguucuagcuaagcaugagcugagaaagguuuccacuagugcag

SEQ ID NO: 4125634 - RNA, 80 nt, Human
cugcauuuaauuucagugcaagcucacggcuuugcauucacaucccagcaccgauacuuaaacauugaaauggugugcag

SEQ ID NO: 4125635 - RNA, 63 nt, Human
cugcauuugagauuauuaauuugacgggggagggcucccauuaauauuguucuucuuuagcag

SEQ ID NO: 4125636 - RNA, 102 nt, Human
cugcauuuuuugaugugggggcacuuuacugccucaucucuagugguugauguuccuccucucuaaagaaggcacagugcugcuaagauugagaaaucacag

SEQ ID NO: 4125637 - RNA, 74 nt, Human
cugccaacuuuccugagucuucagcuuuucucuuacauucaacaagauaaagaagcauuggaccaggggcccag

SEQ ID NO: 4125638 - RNA, 101 nt, Human
cugccaagcuggucaaucaaggucaugcagggauuguuggcauccaugguagagagccaugaauuucuaaucucugucaagaucaggaugccaacuggcag

SEQ ID NO: 4125639 - RNA, 84 nt, Human
cugccaaguuuucucagcaagacccccaccguguacagaauaacugucagauaaaugggugguuucugcuggaguccuuggcgg

SEQ ID NO: 4125640 - RNA, 64 nt, Human
cugccacaagcuggcccuguguggucaagggaaguucuggagaaaaagggccagcugugaguag

SEQ ID NO: 4125641 - RNA, 68 nt, Human
cugccaccccaaggggggcccucaggacaaauauuuuuucauuagagggguccugccuuggcuggaag

SEQ ID NO: 4125642 - RNA, 92 nt, Human
cugccacccucccugugugccagaagggccucuggucccaugggcaccuucccugcagaucuaggguccuucagggggcgcagcgugugcag

SEQ ID NO: 4125643 - RNA, 86 nt, Human
cugccagacacuccccugggcaggcaaugugcccaggcccuggcaugaauuccacagaauccuguccacucugggagugcugggag

SEQ ID NO: 4125644 - RNA, 71 nt, Human
cugccagagucacuugccaccuuuaccuugguauccuuauucauggaugggggcugguugacucucugcag

SEQ ID NO: 4125645 - RNA, 66 nt, Human
cugccagagucuucugacccugugacagaagauuucugugugugcuccauggggaagacucugcag

SEQ ID NO: 4125646 - RNA, 65 nt, Human
cugccaggcagcagcgaggauggugaccgagaagguggggaccacguccugguggcuguuggcag

SEQ ID NO: 4125647 - RNA, 98 nt, Human
cugccagggcacuugggaauggcaaggaaaccguuaccauuacugaguuuaguaaugguaaugguucucuugcuauacccagaaaacgugccaggaag

SEQ ID NO: 4125648 - RNA, 81 nt, Human
cugccagggccagccaggcccuacaaacguguguucuggaaagcaaggaggagucuguccuggaccuggcuggcuuugcag

SEQ ID NO: 4125649 - RNA, 55 nt, Human
cugccagggcccuacucaguuuaauuuccaaaacugauuaggcauuaccuggaag

SEQ ID NO: 4125650 - RNA, 60 nt, Human
cugccaggugcaaacucccagcagguuucacaacuguuucugcuaggaguuugcauucag

SEQ ID NO: 4125651 - RNA, 74 nt, Human
cugccaggugugagcagaaaccaugaguacuugggaaagagaggcagguaccagguagcugcugauacugggag

SEQ ID NO: 4125652 - RNA, 102 nt, Human
cugccaguugggggacuggcugaauuuugcaaggcaucuguagaaccaacccugggugaaaacagcaaagucuugaaaaguggccaguuugucacugugcag

SEQ ID NO: 4125653 - RNA, 94 nt, Human
cugcccaccacagagccagucagcaucugcacugugcugggucagaugucucuccagcgguauggcaaaugcuggcuggcccagggauggggag

SEQ ID NO: 4125654 - RNA, 66 nt, Human
cugcccagaaucacucacucgaugccuuuugggaucgaugacauuugauuuguaaugagugggcag

SEQ ID NO: 4125655 - RNA, 56 nt, Human
cugccccaccccaaccugaggucagagcugaggcguaggggccgggguaggggcag

SEQ ID NO: 4125656 - RNA, 58 nt, Human
cugcccccaggcugcauggcugggacagccgcacuccacgcaucagccauaggggcag

SEQ ID NO: 4125657 - RNA, 59 nt, Human
cuguauauaauguaugcauggguacacauauaugcacaugcauucuauuugucaugcag

SEQ ID NO: 4125658 - RNA, 93 nt, Human
cuguauaugauucccuugccaaauuaaagagcuuugauucaauguagaaacaugaaaugcaaagcucuuuaauccuugacaaggauugugcag

SEQ ID NO: 4125659 - RNA, 60 nt, Human
cuuaaaucguuauaauguuaagccuuuaucaguggagguauagaauugaaaggguuuaag

SEQ ID NO: 4125660 - RNA, 55 nt, Human
cuuaacacuccuaacuacagucucagaaacccaugagaaguuuggggguguggag

SEQ ID NO: 4125661 - RNA, 69 nt, Human
cuuaagguagucagccucuguguacacaguuuaaauuaucuguaaacaugcauggcugcuuaaauuaag

SEQ ID NO: 4125662 - RNA, 74 nt, Human
cuuaagucuaguauccuucuugacuuugaaaguaucuuccacuucugaaagucaggaaggauacuagacugaag

SEQ ID NO: 4125663 - RNA, 84 nt, Human
cuuaaucguaucugcaaagucccuuuugucauguaagguaacauauucacagguucuggggaucaaaaugcagauaccuuuggg

SEQ ID NO: 4125664 - RNA, 71 nt, Human
cuuaauucaucacuuucaauaaaguaaaugauagacauagaguuuguuaaaauauaggaagugugguuaag

SEQ ID NO: 4125665 - RNA, 79 nt, Human
cuuaauuuuaucucaccuuccaauacagccugagauaagaacuugugucugggcuuuguaaugggagguagauuauagg

SEQ ID NO: 4125666 - RNA, 80 nt, Human
cuuacaagcuuugccacauucuucacauuugcaggguuucucucccguaugaauucucuuguguauaguaagguuugaag

SEQ ID NO: 4125667 - RNA, 68 nt, Human
cuuacaagggagccugagugacaacuccggaggccagccauugagagauuaccacgcuuccugagagg

SEQ ID NO: 4125668 - RNA, 63 nt, Human
cuuacaauggaagaggcuuaagauuuauguauuugaaacauugaguucuacuuccauuucaag

SEQ ID NO: 4125669 - RNA, 77 nt, Human
cuuacaggacacuacaacgugggacuuuguuucuuccauauuuggaagauaaauuuauguguagacauuuuuguaag

SEQ ID NO: 4125670 - RNA, 119 nt, Human
cuuacaguauacuuuccaacacccauauggugagggacaucacucagccaacagauguggcuuuaugguuucagugacugucucugcacauagaggggccagggauagauaaaggugag

SEQ ID NO: 4125671 - RNA, 60 nt, Human
cuuacauacaccaccuuggaucuuucagauugcuaagaguuuuggggggugugucggaag

SEQ ID NO: 4125672 - RNA, 71 nt, Human
cuuacauuuaaucaugugucaugucaugaauuugcaaggaauguaauggaauacagugguaugaauguagg

SEQ ID NO: 4125673 - RNA, 73 nt, Human
cuuaccuaguaaauacugacuuaagaaauugcuaugcugaauucagucaauuaucucuaggucaucuagugag

SEQ ID NO: 4125674 - RNA, 129 nt, Human
cuuacuauauuuugcauuuccccagggugucaauuuuaugaaacaaagugacgggaugauuucuaucacuugagaagcuguguuaaaaaaaucugaugcacuggcaacagcaaaaauuguuaugguagg

SEQ ID NO: 4125675 - RNA, 70 nt, Human
cuuacuggagaaggaaccccaggaggagcaccugagaagccaguucaucaugauguuccccucuaguuag

SEQ ID NO: 4125676 - RNA, 125 nt, Human
cuuacuguuuuaaaaauguagugucacuuggcacaagacuuguuuuauagcuguguuuuaaaaaauacucucaauaaagaaaguguugugaggaagcugaugaauugcucuuuaggauaauugag

SEQ ID NO: 4125677 - RNA, 84 nt, Human
cuuacuuauucuaacaccugucagaugugauuauuaaguacaauauuauugcugacaugguguugacaccucugcauaagugag

SEQ ID NO: 4125678 - RNA, 66 nt, Human
cuuacuucagaccccagaaugaagccagugggcuaucuccgcuguucagcgugggugugaacagag

SEQ ID NO: 4125679 - RNA, 84 nt, Human
cuuacuuguuuguaaaauaccauuccuugucacuacucucacuacuugugacauaccauaagguaauuuugagacuucagugag

SEQ ID NO: 4125680 - RNA, 80 nt, Human
cuuacuuuuauucccguacuguuuaucuuugaggaaguuucuauuucaaguauuauuacagauguaggaauaaaggugag

SEQ ID NO: 4125681 - RNA, 72 nt, Human
cuuagaaaaacuagcuuuaguuuuggaaggaguuaguguagguuuuuccagauuggacuuaguccuuuuaag

SEQ ID NO: 4125682 - RNA, 85 nt, Human
cuuagaacaugcaggacuuuguggaugauggaaggaggcuagauuuucuuauccauguuagguaaaggcacuggaugguuuuaag

SEQ ID NO: 4125683 - RNA, 78 nt, Human
cuuagaacuggcacaaugucacuuuugcuacaugcuauuauuagccaaagcaaguuucagggacacccagauucaagg

SEQ ID NO: 4125684 - RNA, 63 nt, Human
cuuagaauuuugccuacuacaaacagcaaugaguaacccugaaaaaguggggagagugcuaag

SEQ ID NO: 4125685 - RNA, 56 nt, Human
cuuagaggcccuuaacgagauccaugcuccaugcuucucguuguauggucuugggg

SEQ ID NO: 4125686 - RNA, 76 nt, Human
cuuagaguuauggaaauguugagcuucaugguaccuuagaaauuaaugagaaucaacauuucauccauggaucagg

SEQ ID NO: 4125687 - RNA, 72 nt, Human
cuuagaucuuuaauuuucucaucugugaaaugggaaguccuaacagaaaauggagaaaauuguggauuuagg

SEQ ID NO: 4125688 - RNA, 129 nt, Human
cuuagauuaaggacagucugugcaguucucaagcggcugucugucuucacaucucgcugcucaagugagggacgugggcuguggggagaggcugaaacugucaagauggcugcaacuggaaaugggaag

SEQ ID NO: 4125689 - RNA, 127 nt, Human
cuuagcacagcauuuggccuucaguauguggucaaugaagauacacuauucuuauuuuucuuauuaggcucagagcaguaccuguuuuuucaaccaucgugcuagagacugcuaacugcucccuagg

SEQ ID NO: 4125690 - RNA, 71 nt, Human
cuuagcagcuuauucaguaagcacauacuuggcuuuuaaugaguauugcuuaaauugaugaguugaauuag

SEQ ID NO: 4125691 - RNA, 82 nt, Human
cuuagcagcuuugggggagguagucuguggcaaagcuaaaccacauucuccauagagcccugaccccaagguaacaguugag

SEQ ID NO: 4125692 - RNA, 81 nt, Human
cuuagcuugugucaggagagaucaggacagcacugggguagugaagccaucugcauguucugaaucuuuucugcagcugag

SEQ ID NO: 4125693 - RNA, 56 nt, Human
cuuaggaaaagaagacauuucuacaguauuuguaguaaugugaugcuuuuccucag

SEQ ID NO: 4125694 - RNA, 86 nt, Human
cuuaggaacucauuuaacuuuuccaagcugugauuugcuuuguuguaaaaugaaauacaguugggaggagguaauaagcaucugag

SEQ ID NO: 4125695 - RNA, 81 nt, Human
cuuaggcugcaauaugaugucugagaaauguaccagagagacucaccuggaaauaucccagagaauuaauugcagacacag

SEQ ID NO: 4125696 - RNA, 76 nt, Human
cuuaggcuuccuuuaaagacugcauaacuuccaaaagucaagggaauuguuuggcuuuuuaaaaugugagccugag

SEQ ID NO: 4125697 - RNA, 55 nt, Human
cuuaguaguaagagucauauguaggauaccuacuaugugcuucgugcuauucuag

SEQ ID NO: 4125698 - RNA, 55 nt, Human
cuuaguaguaguccugguaccagagcccagucuggcucuauaacuccuagcugag

SEQ ID NO: 4125699 - RNA, 69 nt, Human
cuuagucaagucauucuauuucucuauguuuugauuggaagcagagagaaacagaaugauuugacuaag

SEQ ID NO: 4125700 - RNA, 77 nt, Human
cuuagucuuuagaacacucuccugaaaauuaagugagaacuauuaguugacccucuaggaagugucuggaaauuaag

SEQ ID NO: 4125701 - RNA, 78 nt, Human
cuuagugucaucauuugcuugacuauggcuugcaauugauauuguuagaaguaauccagcaaauuucaagauauuaag

SEQ ID NO: 4125702 - RNA, 85 nt, Human
cuuagugucuccugccuggggacaaaggagggcauaucuaaugauccuucuacuuguuuguccugucccaugccagagcacugag

SEQ ID NO: 4125703 - RNA, 58 nt, Human
cuuaguucuugggugaacuuuuggcuuccuacuaaguuagaauuuucacagagcuagg

SEQ ID NO: 4125704 - RNA, 104 nt, Human
cuuaguuucuuccacaaacuuucauguaucucuuucaccaaauaggacaccaacuggcaaguagacgagagguaaaugaaagguugacuaaaagaaaacaugag

SEQ ID NO: 4125705 - RNA, 107 nt, Human
cuuaguuuuaaugcagaagucagauggcauagguuggaauucaguuugacccuguacugcgguuauuaauuuccuuaugccucgaguuccugaucuauaaaagugag

SEQ ID NO: 4125706 - RNA, 56 nt, Human
cuuaguuuuugcccuggaguuuagagagagaauucaaauucccuggcaaaagcaag

SEQ ID NO: 4125707 - RNA, 55 nt, Human
cuuauacauaaaauggguguaguggauugaauuuauaccaaaagauauguguaag

SEQ ID NO: 4125708 - RNA, 79 nt, Human
cuuauaguguuuuccucauucccuuccuuuuuaaacagauguuugaaaaaauugguagaggauggaagagaaaugugag

SEQ ID NO: 4125709 - RNA, 76 nt, Human
cuuauaguucugacaaaccacugcuccagcugaauauuuuaugaagcuacaguuuggcuuguuagcagucucaaag

SEQ ID NO: 4125710 - RNA, 61 nt, Human
cuuaucagcacagggacaauagcagauguaauuacagcuuucugucaccugugcuugaaag

SEQ ID NO: 4125711 - RNA, 57 nt, Human
cuuaucaucuccugcugugguuauaauuguacauuugucucuccuggagaugguaag

SEQ ID NO: 4125712 - RNA, 123 nt, Human
cuuaucauuaacuguaacuuaguuagcgugauauuuuugauccuuaaguuuuuaacaucguauaaagaauuuuccauccaaaguaacaugaggcagagcuaccugaauuucaguggugauaag

SEQ ID NO: 4125713 - RNA, 88 nt, Human
cuuauccauuucuccuuugggcauuugcuuaaugccaggcauuugugucaggcacugugcaagggucucgaaauagaaggacaauaag

SEQ ID NO: 4125714 - RNA, 85 nt, Human
cuuauuaaacuuuuccuaggcccucaaagagcauaagugaauaaagacuuauuccuagagcuugggagugugaagguuuggugag

SEQ ID NO: 4125715 - RNA, 73 nt, Human
cuuauuaccaguuacagcuuauguuugaagucacaauaaacucuucuucaaacaugaaagcuugauuuuugag

SEQ ID NO: 4125716 - RNA, 66 nt, Human
cuuauuauaaaauccuguuugacuaugggucaaauugcuuguggaaaaaauagaauuuuuaauaag

SEQ ID NO: 4125717 - RNA, 77 nt, Human
cuuauucauucaugacagggcucccugagcuaaaucaauuaguucauaauacaaagaguucugcaugcauaaauugg

SEQ ID NO: 4125718 - RNA, 83 nt, Human
cuuauuccagccuguauguuuguucugcaucacagaaaaaaguagagaugcuuacuggauggcaggauagagguuagaguaag

SEQ ID NO: 4125719 - RNA, 75 nt, Human
cuuauugaggguaaugauguuuuuaaagaacauagaacauucuuuauguuuuaaaagaaucaugccuucauuaag

SEQ ID NO: 4125720 - RNA, 86 nt, Human
cuuauuucaagucccaguauuucauucagaauuguuauugcagggaagacccuggaaacuuaugaggagauuacugaagaaauaag

SEQ ID NO: 4125721 - RNA, 99 nt, Human
cuuauuucuaugcuuaucuauauaccuauauauaucaucuuccaguuuuuccauagaaacgaauguguguauguguuuguguguaugcauuuguauaag

SEQ ID NO: 4125722 - RNA, 90 nt, Human
cuucaaaaccucacucugcugaaaucgccuuguguuugagaagcucugugggaugaggcaggaggugguguccagggugaggaggugaag

SEQ ID NO: 4125723 - RNA, 70 nt, Human
cuucaaagggccacugggcugcugaagcuaagcgccucucaucugcaucagaauuccaguuucuuugaag

SEQ ID NO: 4125724 - RNA, 65 nt, Human
cuucaaaguauaaugugaaacuggcuugcacuggauaugagagaaauucacauuuugcucugagg

SEQ ID NO: 4125725 - RNA, 58 nt, Human
cuucaagucgccaaaugcugaauuauucugcaucgaaagcgcaguaguggcacuggag

SEQ ID NO: 4125726 - RNA, 97 nt, Human
cucugccuaguuaaugaccucuuauuuaccuggauucuuacuuccuuuuuucuaagaguacaaauuuaggugaacuguuaggugaaagauuccagag

SEQ ID NO: 4125727 - RNA, 72 nt, Human
cucugccugugucacucacugcguuaugucccaugcugggauuugggcauuuagugcaggacacacacagag

SEQ ID NO: 4125728 - RNA, 115 nt, Human
cucugcuauuauaccucucuuugacuuucuggcauuucaggcaucuauaguagaaucuuauacuaucuggaaaaauccaaguguuagaaagugguuugguauaagaagccuagag

SEQ ID NO: 4125729 - RNA, 61 nt, Human
cucuuucucgccgcccgcaguccgacgcagacaggucgauagcugguuaaugcagaaggag

SEQ ID NO: 4125730 - RNA, 64 nt, Human
cucuuucugauucgcugggaccugccugggagaguugggcaauacccagugaagcauggaagag

SEQ ID NO: 4125731 - RNA, 81 nt, Human
cucuuucuuugcaucuaccuuuuugugguuuagggagggcuauuugccuuugacauggaaagggaagcaaggaacauaggg

SEQ ID NO: 4125732 - RNA, 62 nt, Human
cucuuugcuaauguugcauuuucaguaacacaauugagaauacugcauuguuaggaacagag

SEQ ID NO: 4125733 - RNA, 57 nt, Human
cucuuugcucacuucaccuuaugggcaguguccugcagguuucugugagcagagcag

SEQ ID NO: 4125734 - RNA, 62 nt, Human
cucuuuggggugccccacuggucucaagggaauccaacacagucaggaugcauccccaagag

SEQ ID NO: 4125735 - RNA, 73 nt, Human
cucuuugugacaggaauucuuaaaaugguguguaugcacaacugccuguaucacuaacaagaagucacaagag

SEQ ID NO: 4125736 - RNA, 95 nt, Human
cucuuuugaagaaacugggauaaaaggaaagccuguugugacaaagcuggcccauuuguagcauaggcauuuuccccuuuuucccggcguaugag

SEQ ID NO: 4125737 - RNA, 59 nt, Human
cucuuuuucagccuuaccaaagaccuugacucaggaagaagugagugugggaagaagag

SEQ ID NO: 4125738 - RNA, 129 nt, Human
cucuuuuucaguuauaaauaaaauugcacuguaaaacauugcagcuuaauugcaggaaacccaaugcauuuuuuguuguuguucugcaagugguuaauagcuuguuuuuuucuuuauauggaguuggag

SEQ ID NO: 4125739 - RNA, 124 nt, Human
cucuuuuucugucuucuuguuucaccagcauaguagguggcucuugccauuauuguaauuagauauggcuguugcacaucuaagccugugcacauggguccuaggcaggaagaagaaagaagag

SEQ ID NO: 4125740 - RNA, 81 nt, Human
cucuuuuuuccuuccuugcuagccugagcuacuagugccucuuucacagaacuuaggaauguaaagggaggacgcaaagag

SEQ ID NO: 4125741 - RNA, 66 nt, Human
cugaaaacagaaagaugauuugaaauggcuucaagcaagugcauucaaauuucuuccugguuuuag

SEQ ID NO: 4125742 - RNA, 95 nt, Human
cugaaaagaaaguguagucaaugaacauuuauucugagauuaagcuuugcugcugauugcuuguauaauguguucaucuuacaauucauuuccag

SEQ ID NO: 4125743 - RNA, 82 nt, Human
cugaaaauacaauagcuuuucauugcucuuaggauacaggaucaugcugugucugaugucugaaaugcucuugucucuuuag

SEQ ID NO: 4125744 - RNA, 119 nt, Human
cugaaaauguaucucaguuugccuuuauagcaucuguuucucuuugugaguuaagaaagucacacugggagagaaacgggugcuggaaggcugcucuuacaagagacuauuaaccucag

SEQ ID NO: 4125745 - RNA, 72 nt, Human
cugaaaccaaacaucuuucuauugcaaguuaacagcaccugagcuuggcaucuaagguaguuuggacacuag

SEQ ID NO: 4125746 - RNA, 56 nt, Human
cugaaacuacaguaaggagaacgugggagaaauguuccuccuaucuugaguuucag

SEQ ID NO: 4125747 - RNA, 67 nt, Human
cugaaacuauggggaggggagcagaguucaaguaccaaauugugguucacccuucucuggcuuucag

SEQ ID NO: 4125748 - RNA, 76 nt, Human
cugaaaggaaauagguucacugucuugaggagcaaaacauccuuaguuacccaagagugaacuuugagacuuucag

SEQ ID NO: 4125749 - RNA, 56 nt, Human
cugaaaggccaagcaugagguggacagagaagugaccauuacaucuggccuuuugg

SEQ ID NO: 4125750 - RNA, 67 nt, Human
cugaaaguauaaagggcccuaaggaaggcacacagaaaauauucuggggguucauuugugcauucag

SEQ ID NO: 4125751 - RNA, 65 nt, Human
cugaaauaguuucauagaacuuauguuuauaaauauuucauaagaacuagcugagaccauuuuag

SEQ ID NO: 4125752 - RNA, 85 nt, Human
cugaaaucaugcuucucagaaaugcuggcuguuaugagacaauggaguaaaugccuucaaguaucugaggaaaagugauuuucag

SEQ ID NO: 4125753 - RNA, 70 nt, Human
cugaaaucuaguuucugauaagcacauuuuaaggcacagcaaguguauuaucagaaacugugggcuuuag

SEQ ID NO: 4125754 - RNA, 61 nt, Human
cugaaaucucagcucaugcaauuccagagagaaucucuaguucaacgaguugggguugcag

SEQ ID NO: 4125755 - RNA, 89 nt, Human
cugaaaucuguguaggcuuuuggaaaagugaaacuagaugcaaagcacaaugauguaauucuggcaauuuccacugacacagaacucag

SEQ ID NO: 4125756 - RNA, 56 nt, Human
cugaaaugguugccuggagaauccgugauucaagauucucaagugcuucaauucag

SEQ ID NO: 4125757 - RNA, 97 nt, Human
cugaaauucagggaaagaaggggaggauuguccuggggucuaccagcugacucugccacaggacaaucucgucggguccuucugcuuugagucuugg

SEQ ID NO: 4125758 - RNA, 106 nt, Human
cugaacgagggaagccgugaaguguugugcagaguugaagacaggagagcugacuuuuagcugucacccugccaccaaauagcuccaugagcuucuccucuuugag

SEQ ID NO: 4125759 - RNA, 95 nt, Human
cugaacuauaguuaaauugaugugacugaagugucuagaccuguacauuuuauauagagguuucaaauucuagccacacgaugauuauaauucag

SEQ ID NO: 4125760 - RNA, 116 nt, Human
cugaacucucuuccuuuuuucaccacugcccuugaaauacgcuuggggcgggcugcgugucucccagaauccucccggggcacaagggcgaacguggaggcaggaggagccaacag

SEQ ID NO: 4125761 - RNA, 77 nt, Human
cugaacugacaaagucuuuccuuuaguuucugcuaggucagacuuggugcuaaauggaggagaguuugucaguauag

SEQ ID NO: 4125762 - RNA, 100 nt, Human
cugaagauuccugcucuccugcugagguggagauugcagugagcugagaucgcaccauugcacuccagccugggcaacaagagcaaaacucagucuccag

SEQ ID NO: 4125763 - RNA, 60 nt, Human
cugaagcacagauaguuuuguuaauaacaugacuguuauuugaaacuuucuuguuuccag

SEQ ID NO: 4125764 - RNA, 68 nt, Human
cugaagcagggagcagucuuugcaccgauccacacaacucggugucagcucuuagcauuuugugucag

SEQ ID NO: 4125765 - RNA, 64 nt, Human
cugaaggaagacuugagaagguucccuaaaacucaacuaggaaaugucaaaagccuucccuuag

SEQ ID NO: 4125766 - RNA, 57 nt, Human
cugaaggagcauagucaguuuuucuuuaagaaaacgugcacuugugcaccuacucag

SEQ ID NO: 4125767 - RNA, 87 nt, Human
cugaagggcucagaaggaucaagucauccugaucccagccaaccugagcuggcaaggaccugacauuguguuuucucagccuuaaag

SEQ ID NO: 4125768 - RNA, 60 nt, Human
cugaagggcuggaucucucugagcaucuccaguugcuccagggcugccagacccucacag

SEQ ID NO: 4125769 - RNA, 67 nt, Human
cugaagguaucuuuccuacuuugcugaucauguagcuaaagucaggcuguguaccuaacuaaaucgg

SEQ ID NO: 4125770 - RNA, 57 nt, Human
cugaaguauuuagggauggaauuacacuacggugugauguacuuuaaaauacuucag

SEQ ID NO: 4125771 - RNA, 65 nt, Human
cugaauacacucaggugggcauaagccauagaaaugcaaaguaguccagccuuggguguagccag

SEQ ID NO: 4125772 - RNA, 72 nt, Human
cugaaucaggguuuucuaccucugugauagguaacuagauugcuagaaacacagggagggaaacucuuucag

SEQ ID NO: 4125773 - RNA, 88 nt, Human
cugaaucuucaucgcaaaccuuugaguguauugucuuuccuauuuuacagcuaugaaccacaagauucaaagggguggaaagcuucgg

SEQ ID NO: 4125774 - RNA, 72 nt, Human
cugaaugaugaaggauuuuuuguguugaacuuuuagaaaauuucaaccagaguuuuucuuaauaugauuuag

SEQ ID NO: 4125775 - RNA, 78 nt, Human
cugaauggaucuugagcaagcagcucauccuguguugaggaccugggauagggcuauugcucacaaaggaaaauucag

SEQ ID NO: 4125776 - RNA, 101 nt, Human
cugaaugucacuguaaagaaacgaaaaacaggaggcgacgugugcugggcagaugggacauggcuuucuguguuuccguagguaauugcaacagcauuaag

SEQ ID NO: 4125777 - RNA, 66 nt, Human
cugaauuagaugaaaaaggcucugcuugauguaauauugcgagucuuuaaugaucauguauuucag

SEQ ID NO: 4125778 - RNA, 81 nt, Human
cugaauuuggaaugccuugguugcaagcugaaguuagauuuuaacuaguacauagucaguagcaagguauuuugagcaagg

SEQ ID NO: 4125779 - RNA, 71 nt, Human
cugaauuuuguaauugaacgucugugucugcagcaaaagcacagaacauuuuuagaugcagauaguaucag

SEQ ID NO: 4125780 - RNA, 73 nt, Human
cugacaaagguuuccgagcuuuaauuuacuagaacauauaacgggcaaaggagaggcugggaaacacagucag

SEQ ID NO: 4125781 - RNA, 75 nt, Human
cugacaacugaaguguucuggggacagcgucccaugaaacagaugaacaccucucccuagggccaggacagucag

SEQ ID NO: 4125782 - RNA, 74 nt, Human
cugacaagcucagccucugcgcucugugcugucaagugcugcccacccaucagugugcagaggcagccuguggg

SEQ ID NO: 4125783 - RNA, 85 nt, Human
cugacagauuguuaagcuacgugaggcuaccagagugggcagaggacaguccccugucccaggccucauguugccacaucagcag

SEQ ID NO: 4125784 - RNA, 56 nt, Human
cugcccuuguccugcagguggcugggagcccgagccccacaccugccgggcagcag

SEQ ID NO: 4125785 - RNA, 90 nt, Human
cugcccuugugcugcucacauguguguuagcacauguaacagacauauacaugaauaaggcaugaugugcaguggcaaaugaggggguag

SEQ ID NO: 4125786 - RNA, 76 nt, Human
cugccggaaguuuaccagcucacuuucggcgucgcgcccgccuccguggagcaggccggaaguggcuuuccggcag

SEQ ID NO: 4125787 - RNA, 71 nt, Human
cugccgucaccucuucccccuguccacagagccgggagccaggcucuccauagaggcaggagggacugcag

SEQ ID NO: 4125788 - RNA, 77 nt, Human
cugccuagcauucagaacugagagcaacacauuucuguuguuuacaaguuacucagucugaggcauuguuacagcag

SEQ ID NO: 4125789 - RNA, 56 nt, Human
cugccucaccacagcuguuucucuucgagaaaucuuggagucugugguagaggcag

SEQ ID NO: 4125790 - RNA, 71 nt, Human
cugccuccugucuucuggaguugugaccucaggguggcccagguggaucggcuucagaggccaggaggcag

SEQ ID NO: 4125791 - RNA, 77 nt, Human
cugccucggagagcugucacucagaccaugcagacuucaguggagaaccugcaggacuucaggacucugagaggcag

SEQ ID NO: 4125792 - RNA, 67 nt, Human
cugccugccaggccuggggugcugucagggugggccccccaggagagccccccaggugagguagcag

SEQ ID NO: 4125793 - RNA, 77 nt, Human
cugccugccucuggagcccauccucuuaacuguugugcuaaucaguuucugggugcuccuggggcaguucuuugcgg

SEQ ID NO: 4125794 - RNA, 60 nt, Human
cugccugcgcucgcucucgcagggcugggaagccuuggcaggguggaggaugcagggaag

SEQ ID NO: 4125795 - RNA, 57 nt, Human
cugccugcguugccucgugccuggaauccuagcacauugggaggccaaggcaggcgg

SEQ ID NO: 4125796 - RNA, 56 nt, Human
cugccugcuuuucugggagccgggcacacaguaggcgcucaccacgcagcaggcgg

SEQ ID NO: 4125797 - RNA, 65 nt, Human
cugccuggaagguucucuuccagaaccugcagagagcuacugcuagaggauaggaccuuaggcag

SEQ ID NO: 4125798 - RNA, 60 nt, Human
cugccuggaaugccagcuucucccagugugcaaauuacuagcucaaucauuccuggguag

SEQ ID NO: 4125799 - RNA, 59 nt, Human
cugccugugucuggguggccagaguauaaaauauuccagucacaaaacauauuaagcag

SEQ ID NO: 4125800 - RNA, 74 nt, Human
cugccuuacuccauuuguuuuagcuacauagacauaacucugauaccgcuagaagcagaugucugaguaggcag

SEQ ID NO: 4125801 - RNA, 63 nt, Human
cugccuuccuggucacugcuguucccugaguccucagcaguagccugaccguggaacugguag

SEQ ID NO: 4125802 - RNA, 62 nt, Human
cugccuucucauacaggaucucuuauuauugucauaauagucuugugagugaggaagggcag

SEQ ID NO: 4125803 - RNA, 65 nt, Human
cugccuugcccuggccccucacuccgaggccagcgccaugcugcgccuggggcugugcgcggcgg

SEQ ID NO: 4125804 - RNA, 56 nt, Human
cuguggcucugcagucccaacaguugcagcuguucuaggacaccgcaggggcauag

SEQ ID NO: 4125805 - RNA, 68 nt, Human
cuguggcugaggcuggagugcaguggcacaaucuuggucaacugcaaccuccaccucccagguuccag

SEQ ID NO: 4125806 - RNA, 84 nt, Human
cuguggcugcagggcagggguaggggagcacaguccaugcugccagcagcagcucccacugcagcccugagcccucgcccccag

SEQ ID NO: 4125807 - RNA, 67 nt, Human
cuguggcugcuggagagaacuagcccaguuauuggaaaagcguucucuguagcacacaaaggcccag

SEQ ID NO: 4125808 - RNA, 57 nt, Human
cuguggcuggccuuauugcugcuuccagccacgaggcaugauaaggugugcccacgg

SEQ ID NO: 4125809 - RNA, 56 nt, Human
cugugggagaggcacuugcuacuuccgggguuggacuccagcaacuucucccacag

SEQ ID NO: 4125810 - RNA, 63 nt, Human
cugugggagaggugccuggauuuagaggagcgaccacucuucauuuguagguacucucccuag

SEQ ID NO: 4125811 - RNA, 116 nt, Human
cugugggaucuaacuggccaguggugguggcugcaguguccggugcauuucaccaggagcauccugcgagcccugggagcugccuggcugacggcauucccacagcgagccuacag

SEQ ID NO: 4125812 - RNA, 81 nt, Human
cugugggguaguuacuauaaugagucccuguuuuauaaaugaagaaacgaggcucagagagggugacuugccccaugucag

SEQ ID NO: 4125813 - RNA, 72 nt, Human
cuguggggucugcauucacucugcaaauacugagugccugcucucugcagagugcugucguacgccccagag

SEQ ID NO: 4125814 - RNA, 90 nt, Human
cuguggguagauacccaguggugagauugcuggaucaaaugguaguucuacuuuuaguucauuaaggaaucuccccacuuuuuuccauag

SEQ ID NO: 4125815 - RNA, 73 nt, Human
cuguggguuaaaaugauaccuugcaagguuaauuaaauuuacugguuuaaaaugcggguaucugacuccacag

SEQ ID NO: 4125816 - RNA, 92 nt, Human
cugugguaaacaagacuaaugcuaacaucauaucacuguguguuacauaguauaugauguauaguguaugccagugguguuuauaaacauag

SEQ ID NO: 4125817 - RNA, 57 nt, Human
cuguggucaucucagaguggcccaaauaguuccuaagaaggcaggggugaaccacag

SEQ ID NO: 4125818 - RNA, 101 nt, Human
cugugguccccuuggcugaauagcacaggcgaccccuaggagcaacaggccaaggugugugagccugcuggucggcgauagugcuucagcgggggccaggg

SEQ ID NO: 4125819 - RNA, 85 nt, Human
cugugguugauaagcaucccaugacucuggaggaagcugcauuaagcuucuucccaggcuuagaauuguguuggauguaccauag

SEQ ID NO: 4125820 - RNA, 65 nt, Human
cuguguaaaugccccauucauugauaagucauaguugugcuucuuggauguaggcauguacacag

SEQ ID NO: 4125821 - RNA, 86 nt, Human
cuguguaauccuauuccuuugacuuagugggacucugaauaugaugauuagaucauuuuguauagcaaagguggagggauucacag

SEQ ID NO: 4125822 - RNA, 74 nt, Human
cuguguaaucgugguuauguggcccugugucugcuuuuguaugacaugaaccuaccauaaugauuugcccauag

SEQ ID NO: 4125823 - RNA, 115 nt, Human
cugugucaggcuccuagguaauugacguguauuaauucauguucucuucauaauaaacugaggagguaugugcuauuguuauauuauuuuuacccaugaggaagcugaggcauag

SEQ ID NO: 4125824 - RNA, 71 nt, Human
cugugucaucuguguuacauaauucuuaaagaaugcacacugcuuuaauugugcagcacagaucaugacag

SEQ ID NO: 4125825 - RNA, 78 nt, Human
cuguguccagcagccugggagcaguuaugagcugggccacagccucagcagcucuggaacucccggcugcugucauag

SEQ ID NO: 4125826 - RNA, 56 nt, Human
cuguguccuccccaucacuucuucccuaauuguaggagagagucagggaggcaggg

SEQ ID NO: 4125827 - RNA, 61 nt, Human
cuguguccugucuccuaagguggauuuuuuuucagcuccagagaaggcgagaggaacauag

SEQ ID NO: 4125828 - RNA, 98 nt, Human
cugugucucccgcccaggcuaauaacugcagcugacaucuggcugggccccgcgggggcgcagcgggcagcguugggggguugggcagggcagggcag

SEQ ID NO: 4125829 - RNA, 61 nt, Human
cugugucuccucaacucaugcucgaggucagaaauggucucgguacuugagagagacacag

SEQ ID NO: 4125830 - RNA, 78 nt, Human
cugugucucgaggagcuguuuugaagugcucggucaauuccaugugagcagcucccaguggcagcuccuuguccucag

SEQ ID NO: 4125831 - RNA, 57 nt, Human
cugugucuuccuccccaguucuguacugacucaggcagaacugggcagggagcagag

SEQ ID NO: 4125832 - RNA, 120 nt, Human
cugugucuucucucuacucuucauuuccugccuuuaaggggaccuggaaacaaacaugaauggcacagaaccuuggugguagggacacaguggagagugaguguuggggauaagacagag

SEQ ID NO: 4125833 - RNA, 72 nt, Human
cugugucuucucuugauaguucccaaacaguagaggcucagccuuugggauggggcuaacgagagagcagag

SEQ ID NO: 4125834 - RNA, 117 nt, Human
cugugucuuuuaauuggagcauuuagcccauuuacauuuaagguuaauauuguuaugugugaauuugauccugucauuaugauguuagcugguuauuuugcuuguuaguuuacgcag

SEQ ID NO: 4125835 - RNA, 61 nt, Human
cugugugccagguggguguaugaaugcaaagaaagucucugccuuguaacccgccuuacag

SEQ ID NO: 4125836 - RNA, 75 nt, Human
cugugugcugggagucaggagcaggcugggcuggcagaggacuggaagcagagcuugguuugauagagcagacag

SEQ ID NO: 4125837 - RNA, 77 nt, Human
cugugugcugugcuaggggcacuaaaagcugaaccucccagucuuagcaaaggccccuacacccaagcuugacacag

SEQ ID NO: 4125838 - RNA, 84 nt, Human
cuguguguccacacuagauuuauuuccaugcuaagguacaaauacaaccuucaaggagauuggagucuacugugggaaaaacag

SEQ ID NO: 4125839 - RNA, 114 nt, Human
cuguguguuacucucugcugugguucugccuuuagcgcugugacugguacguaauuaacaaccagcugcugauugcuaaaugcaugaauggucaccuguaccuguggcagacag

SEQ ID NO: 4125840 - RNA, 67 nt, Human
cuguguuauuggcaggaauuagauaagcuugugaauuuagggaucugcuucgcgccaauuucaucag

SEQ ID NO: 4125841 - RNA, 79 nt, Human
cuguguucaugccccagugcaggagcucagaaacauguucugucccuucuuccuguucuugggcugugaacagacacag

SEQ ID NO: 4125842 - RNA, 67 nt, Human
cuguguugggcucugcguccuggaacaucaguucccuguccucaggaacacaggggcccaugcacgg

SEQ ID NO: 4125843 - RNA, 58 nt, Human
cuguguugugaaaaauaaacagagcugucgaauaagcucugcucuguuucauagacag

SEQ ID NO: 4125844 - RNA, 76 nt, Human
cuguguuuaauaucaaaguauucuugacuguuuuucaccccuucuugagggacaaucugaacuuguauggacauag

SEQ ID NO: 4125845 - RNA, 59 nt, Human
cuguguuugcucuugcuggaaaaguugcccugagaccaggacaauucaagagccuacag

SEQ ID NO: 4125846 - RNA, 56 nt, Human
cuguguuuugccugcgaugaaggcggggcagguguucaggcagugcaaauacaugg

SEQ ID NO: 4125847 - RNA, 59 nt, Human
cuguuaaagauaguuaagcuucucaccuauaaaauggugagagcuaucuacacugacag

SEQ ID NO: 4125848 - RNA, 62 nt, Human
cuguuaagcaacaugaguaaguacaaauuccaaagaacuaacuugcugaugcuguuucgcag

SEQ ID NO: 4125849 - RNA, 55 nt, Human
cuguuaagugaaugucaugucaggcaagcuucugcagccuucauucaucuggcag

SEQ ID NO: 4125850 - RNA, 61 nt, Human
cuguuacugcuggagccauugagugagugcauuuuuucucagucuucccugucaguaauag

SEQ ID NO: 4125851 - RNA, 64 nt, Human
cugcugucaaaggaaauauuugggugacucagccaagaaagcaguuuauugguuuuggcagcag

SEQ ID NO: 4125852 - RNA, 69 nt, Human
cugcuguccagagucuccuguuguuguucuucagaucaccagacuggacccuuuggauacugacagcag

SEQ ID NO: 4125853 - RNA, 61 nt, Human
cugcugugcuauacagauuguacugcacaauucagcuaacagccauucauauagacagcag

SEQ ID NO: 4125854 - RNA, 70 nt, Human
cugcuguucugaagcaacaagcagggguagcugaaggugaccucgaaccguguguugcuugagaucacag

SEQ ID NO: 4125855 - RNA, 130 nt, Human
cugcuuaguacucccccacucccaggcuugauuuauuacccacuauauuguuccaagcacagaccuuuuuaucacugucacauaugugggccuggugaugagauaugcuugguaguggcuggaggggcag

SEQ ID NO: 4125856 - RNA, 61 nt, Human
cugcuuauggagaugaguaagagcaggugaaauguuucuauuucuauucauacaugagcag

SEQ ID NO: 4125857 - RNA, 56 nt, Human
cugcuuccauggucuggagacuggaauauguggguucugcagacaccugggggggg

SEQ ID NO: 4125858 - RNA, 78 nt, Human
cugcuugacauucuggaaaggguccucauucugucuuguucagggauaacgaacaccuuuucccagcaggugaagcag

SEQ ID NO: 4125859 - RNA, 76 nt, Human
cugcuugauacaacugaauagaacuuuacaagaauguuugcugcacacacauucuuugaguuuuguuaaagagcag

SEQ ID NO: 4125860 - RNA, 57 nt, Human
cugcuugccucucccucccuccaucccaucugccugggggaggcgagggcugagcag

SEQ ID NO: 4125861 - RNA, 61 nt, Human
cugcuugcuugccaugggcuugggcacuacaacuugggcccaaggucccauggcagcacag

SEQ ID NO: 4125862 - RNA, 104 nt, Human
cugcuuggacugaaacauccaacauagcuuuacucaaaugaccuggaccuuuucuaggguagcgggaaugguugugguugguugugccuuucuguaccaaguag

SEQ ID NO: 4125863 - RNA, 71 nt, Human
cugcuugggaaagcugcagaaauucucaggacuuggaggcuugaaaugcucagggguuuuccagaaagcag

SEQ ID NO: 4125864 - RNA, 88 nt, Human
cugcuugggcagcugcagggcgggcgcgccgcgucucuggaaggccccguccacgaagacgccguucuugccgaggcagcgcagguag

SEQ ID NO: 4125865 - RNA, 74 nt, Human
cugcuugguaaauaaugagacagcuuauuuaauuguucuuauuuagaccagcucaucuuauuaauuacaagugg

SEQ ID NO: 4125866 - RNA, 69 nt, Human
cugcuuuagauuuuacuaaguggauaucugucuaguaagagagaagcaacacuugguaagacuaaaugg

SEQ ID NO: 4125867 - RNA, 82 nt, Human
cugcuuucugccaugucugaggagcagcuggcccgcuacgaagugugucgccggucagcuuucccaaaagcacgcauugcag

SEQ ID NO: 4125868 - RNA, 78 nt, Human
cugcuuugcgugugacuuuucuaguuucagcacugaaaguccugcauccuugaagccccuaagucccaggcaaaccag

SEQ ID NO: 4125869 - RNA, 70 nt, Human
cuggaaaacaaagcuuuucaguauguucaugaacauuauuuagaagaugcugauuggcuuuugaaagcag

SEQ ID NO: 4125870 - RNA, 109 nt, Human
cuggaaaaucccugagauaucagcuucaggcgaggcuuaauccaaggcugagagucugcauuucucuauuucuuggguuugccuugcugcugcaggccuuuuuuuccag

SEQ ID NO: 4125871 - RNA, 74 nt, Human
cuggaaacugaguguaggacuuugaguuuggucuugcuaaaccacaagucuuuagauucaguucaguguuccag

SEQ ID NO: 4125872 - RNA, 61 nt, Human
cuggaaacuggugcuucugugugcagcugcuggaaacagcaccugggcuggaagaccccag

SEQ ID NO: 4125873 - RNA, 57 nt, Human
cuggaaagcagaggcuguagugagcugagauggcaccacugcacuccagccuuccag

SEQ ID NO: 4125874 - RNA, 71 nt, Human
cuggaacccagagggguuaagugcuaguccgggcagagcccauggccagauucuuucuucucaggauccag

SEQ ID NO: 4125875 - RNA, 68 nt, Human
cuggaaccugucuggucagggaagacccauuucaggccaugaggucaacacugugaccaacaggccag

SEQ ID NO: 4125876 - RNA, 88 nt, Human
cuggaagcacugccacuggaaccuggaggccaccaaccagacuggauucuauugccgccuccuggauuuuagugccauuuguuucugg

SEQ ID NO: 4125877 - RNA, 89 nt, Human
cuggaagcugguuagaaaugcagagucucaggccacaccccagcccucagggugggucccaggaaucuguguucuaacaagugguccag

SEQ ID NO: 4125878 - RNA, 121 nt, Human
caggccuugcuggauagacggugcaggaagagaacauggaggcugagggcccaugagacaaaccucaccugauuuacaacuuugucuuugacaccgucuauagaauccagcacuuggucug

SEQ ID NO: 4125879 - RNA, 85 nt, Human
caggccuuuuuaccuuuuucuucaccuuuauuccuuaucaagaagaaugcaaaauaaaucgguugguucaagguaauaagguuug

SEQ ID NO: 4125880 - RNA, 88 nt, Human
caggcgcacgcucacccuggggaucagccccgccuccugcuucagcagcuggcucagccggguggucuucuuggagagggugugugug

SEQ ID NO: 4125881 - RNA, 80 nt, Human
caggcggucgcaggggcugagcaccagcggguacaagcgggacucagauccagccccuugggcuucagcccuaccgccug

SEQ ID NO: 4125882 - RNA, 63 nt, Human
caggcuacaaauaagcauguaauacugaaaauacauucuaauuacauggcuguuuguccccug

SEQ ID NO: 4125883 - RNA, 65 nt, Human
caggcuauccccacgauauagccaaagcacccuggcuugcuuugaaagugucuggggaguuuuug

SEQ ID NO: 4125884 - RNA, 75 nt, Human
caggcuccaagcccucugauguacgccagcuuccuugguguaaaggaccucaucagggguaucugcuuggcccug

SEQ ID NO: 4125885 - RNA, 78 nt, Human
caggcucccccaauguacuccucaaucugaucgguggccaaaacaacagacacuugugaggaguguggauggagcuug

SEQ ID NO: 4125886 - RNA, 89 nt, Human
caggcucccuggucugaauguuuauauuggccaaaagggauguucagaguucuuauuguccaauaggauguuccugcagauggugccug

SEQ ID NO: 4125887 - RNA, 70 nt, Human
caggcugaaaucuaugcuugagacagauggggaagagccuggcccugcuguguagcggaggaacagccug

SEQ ID NO: 4125888 - RNA, 61 nt, Human
caggcugacugggguucauugguguccacugggggcagcucccgugccuucagcaguccug

SEQ ID NO: 4125889 - RNA, 65 nt, Human
caggcugcccagggccugcaugcgggugugggguacauccucggggaaaggcacuggacagccug

SEQ ID NO: 4125890 - RNA, 59 nt, Human
caggcuggauuucuaauaccccuacaagcaucuugaacggguguggaaauuacauccug

SEQ ID NO: 4125891 - RNA, 90 nt, Human
caggcuggggacuuggaggcuagaagugaguccuguuuccuccaugaaagccacagcacuuuacuucucagugacucaguuucccacuug

SEQ ID NO: 4125892 - RNA, 81 nt, Human
caggcugugacccucuugagggaagcacuuucuguugucugaaagaagagaaagugcuuccuuuuagaggcuuacugucug

SEQ ID NO: 4125893 - RNA, 59 nt, Human
caggcuuagagggacgaauaagcccuggccagaggccuggccaguccucuuugggccug

SEQ ID NO: 4125894 - RNA, 56 nt, Human
caggcuugaccaguuucuagacuuccuuagaugucaguguagcaggugcaagccug

SEQ ID NO: 4125895 - RNA, 65 nt, Human
cagggaaauaaguccagccccugacucccaggccaugggccaggcugcaggagcuggaugccuug

SEQ ID NO: 4125896 - RNA, 55 nt, Human
cagggaagaauaguuagcaaagccuccaauuagaguuuuguuuauacuuccacug

SEQ ID NO: 4125897 - RNA, 80 nt, Human
cagggaaggcaaguuagggcugccuauggcuagauagaacuauuccuuucucguuuaguucagcuccuugaagaaaccug

SEQ ID NO: 4125898 - RNA, 58 nt, Human
cagggaaggcugcaaauguuaaauugauuauuccuuugacaguaggugguuuucauug

SEQ ID NO: 4125899 - RNA, 76 nt, Human
cagggaauauugauggagguguuagacagauaauucuacaaacuaacaugucucauccuaaacaauaaaaucccug

SEQ ID NO: 4125900 - RNA, 61 nt, Human
cagggaauccauggucauaagguacuuuuuaucauguggaacacuuaacuuggguuuccug

SEQ ID NO: 4125901 - RNA, 99 nt, Human
cagggaaugggcaucggggcuggaagaggacacacgaaucaccuuucugauuucugccuuugcuuuuuccugagccuugguugcugcugcccagcccug

SEQ ID NO: 4125902 - RNA, 69 nt, Human
cagggacucacagcccguucucuggcacacacagccccagcacauguggcccgacguggcuggccccug

SEQ ID NO: 4125903 - RNA, 55 nt, Human
cagggacuuagguauauuaugggauagaauauuaugauuuaugcccaagucccug

SEQ ID NO: 4125904 - RNA, 82 nt, Human
cagggagcacauucagggaagagagggaggaggcaggaugucccucugccuucgcugcucccugaaacacagugcuguccug

SEQ ID NO: 4125905 - RNA, 70 nt, Human
cagggagcgguagccacugccugcauuccuuacucaggaggcaggcauggggucugccauugcuuaccug

SEQ ID NO: 4125906 - RNA, 79 nt, Human
cagggaggaaggggucuugggaguccuggcugaggaugugcucccaucagccaggacucacaacaccacuaucuaacug

SEQ ID NO: 4125907 - RNA, 65 nt, Human
cagggaggcggcugagagggcgcgccccgaguccacaggggaccagugcccugcccgcagccuug

SEQ ID NO: 4125908 - RNA, 60 nt, Human
cagggaggggaagagcugagggcagaggaaagggagcccccugaggaugucuccuuccug

SEQ ID NO: 4125909 - RNA, 68 nt, Human
cagggagugcacccucacucugcaggugagucagaaucaggcaccacagagccaggguugcaccccug

SEQ ID NO: 4125910 - RNA, 60 nt, Human
cagggagugggaggagagagcacugaaaagagugucucuuuggccucccauaugucccug

SEQ ID NO: 4125911 - RNA, 90 nt, Human
cagggaguugcuguuaauuugaagugcaaugaggauucugaauguuuagagauucaccacaucuuuaugaaguaaccuggcaacuucgug

SEQ ID NO: 4125912 - RNA, 64 nt, Human
cagggauacauagauagauaaucuggcaaaauuguggauuuaaucuuuccauguugauacccug

SEQ ID NO: 4125913 - RNA, 130 nt, Human
cagggaucuuuuaauuuugagauuaugauucaguagauguagguauaccugagagucugcauuuuuaacaagcucacagaugaugucuauguggcugaucuguagagaucaagauguagguaucucccag

SEQ ID NO: 4125914 - RNA, 76 nt, Human
cagggaugcgaggcacaaucagcaccccacacaugaauccaagacugaaugagggcugcugcugugagcgucccug

SEQ ID NO: 4125915 - RNA, 85 nt, Human
cagggauuggggcuugcccugugaugugcuguugaccaaguuagagggguauaggcaagcagcaaaguauugggcaagaucacug

SEQ ID NO: 4125916 - RNA, 80 nt, Human
cagggauuuuggaaucugggaaaacaguguguuaaauuuaugaugugcauuuuuucuccacuuuucagcauuauucuuug

SEQ ID NO: 4125917 - RNA, 58 nt, Human
cagggauuuugugcuguaaugcccauccacugcauguacaggcagcacccaguccuug

SEQ ID NO: 4125918 - RNA, 70 nt, Human
cagggcaacaugauguaauggaaagaacagauaauuaauauuuggguucuugauugcauuuguuccuuug

SEQ ID NO: 4125919 - RNA, 59 nt, Human
cagggcacugaaugccaagcuaggaggcuugggugggauucucuuggcauuagugacug

SEQ ID NO: 4125920 - RNA, 125 nt, Human
cagggcagaaguacagguucuguuuguacacucgccauuguccaagagcucauuauccggagugugugugcuugaggaguggcgcuggacuuagaguggacagaugcaugugacuugaagcccug

SEQ ID NO: 4125921 - RNA, 72 nt, Human
cagggcaggacagauacauuaccucccaguagagcugauaacugggaguagagugccuucugcccuguccug

SEQ ID NO: 4125922 - RNA, 64 nt, Human
cagggcagugaagaacacacgugaccauggccaucagcuggauaacgacugucaucgugcccug

SEQ ID NO: 4125923 - RNA, 68 nt, Human
cagggcauaagaugaggcuguagauguagguugaccauauagaguauuuuagcacauauuaugcuuug

SEQ ID NO: 4125924 - RNA, 72 nt, Human
cagggccaaguuggugccuuuuucuuccccuguucagggaggaauggcccugagugcccagccuggccccug

SEQ ID NO: 4125925 - RNA, 68 nt, Human
cagggcccagcccucugcucacugucccaccagcuacauccccggagaccgugcugggcugggcucug

SEQ ID NO: 4125926 - RNA, 61 nt, Human
cagggccugcauuguugaccaccaauuccuuggagagggaggcagcuccugcagugcccug

SEQ ID NO: 4125927 - RNA, 62 nt, Human
cagggcgacagccuguggaggcaucaaggagaugcuccuggcauugugcagggugugcccug

SEQ ID NO: 4125928 - RNA, 59 nt, Human
cagggcucugccuugagggauggccauuccaguagggccauauucuuggaggagcuuug

SEQ ID NO: 4125929 - RNA, 72 nt, Human
cagggcugguggggcagagaauaaaaaccuaacuccuuuuugucaguuuuucuauacuuuguaguugcccug

SEQ ID NO: 4125930 - RNA, 90 nt, Human
cagugagcgguccaaauggauuggggggcaugaauggcaccugacuuacagcaggagcucagcacuuuuacucucuuugccgcuucacug

SEQ ID NO: 4125931 - RNA, 55 nt, Human
cagugagugggauagcugggauucgaaccugggucucugaacuuccacugcgcug

SEQ ID NO: 4125932 - RNA, 61 nt, Human
cagugauaggacagcuagaacugaguuccgaguguuuugaagaguaucuguccuauaacug

SEQ ID NO: 4125933 - RNA, 79 nt, Human
cagugauaguuagucugguaucagugaauuugcaaguugauauucaaaucaaagugaaaagugcugaugacugucacug

SEQ ID NO: 4125934 - RNA, 64 nt, Human
cagugauauuuauccuacucacacguccauccauaggcugucugugagaagaaaaauauggcug

SEQ ID NO: 4125935 - RNA, 58 nt, Human
cagugauucagacucaucauuucugacuugaucuggaauccucaaguuuggaucacug

SEQ ID NO: 4125936 - RNA, 62 nt, Human
cagugauucaggugccuguuggaaaaacauucuguguauaauuugguauaucugaaccacug

SEQ ID NO: 4125937 - RNA, 87 nt, Human
cagugcaaaaugagacuggagaugcaaacaaggaccaaauaaugaaagaccuugcaugacaugcuaagauuauguuauuuugugcug

SEQ ID NO: 4125938 - RNA, 64 nt, Human
cagugcaauuacaagcuaauucagugcucuuuguguuggacuaauagcuucugauuugcugcug

SEQ ID NO: 4125939 - RNA, 60 nt, Human
cagugcaauuuugcuuucccaaugacagcacccuggaagcauuggggguagauugcuuug

SEQ ID NO: 4125940 - RNA, 74 nt, Human
cagugcagacccacagggcagugcugcccacucccaggacucgggagcauggcugccucccugugccaacacug

SEQ ID NO: 4125941 - RNA, 81 nt, Human
cagugcagugaagacaauggagcacagcaguuugccuuucuagugcacagcugcccuacuccaugugacuucgacgcacug

SEQ ID NO: 4125942 - RNA, 106 nt, Human
cagugcauauuuccuauuugaaaagcccaaaucuguagcaucuuaaauguagucugcaucagacuuccuuuaaguggcacuuggauuucagagaggguuugcauug

SEQ ID NO: 4125943 - RNA, 125 nt, Human
cagugcauuuuauucugucaugaaguagguaaguucucugacuuggcgcucuugucuucaagcauugguuuguuccuugcaagcaggaagcucagguccuugaaucuugucuucagcagucacug

SEQ ID NO: 4125944 - RNA, 96 nt, Human
cagugcucaacacuggucuugacaguuuaagcaccuaauauuugcuaaauaaauaaccaaaaguaguaaacuugaacugaugaguguuagagcuug

SEQ ID NO: 4125945 - RNA, 92 nt, Human
cagugcuuggagaauagcugggaggcacauucaucacauuaugauguuacugacuuaaaaugcugcccauucccagcaguuuuccauaucug

SEQ ID NO: 4125946 - RNA, 89 nt, Human
caguggaauagcaucaacauuuauauggguucaugaagcuaugcugugcuuuuuacuuucguuguauaaauaguugcccuaguucacug

SEQ ID NO: 4125947 - RNA, 64 nt, Human
caguggccagaagacugcaaugcucugauuggccagcccugagucuuguggucuucugucccug

SEQ ID NO: 4125948 - RNA, 67 nt, Human
caguggccagucccgaugcuuguucaguauguguuagcugagcugcauuuguggaguggcugagcug

SEQ ID NO: 4125949 - RNA, 79 nt, Human
caguggcccuccccacccuggcucucuggccaccgcaggugccuccugggagcagagcagggguggagaaggcagccug

SEQ ID NO: 4125950 - RNA, 87 nt, Human
caguggcuggaccacugugcuccccagcaggcuccggggcucccuuuauuucaaguccugcuuugggcagcuuuguggcccucacug

SEQ ID NO: 4125951 - RNA, 68 nt, Human
caguggcuucucagaauacucuggacagugcuaauuuccugauuuccacagugacugauaggccacug

SEQ ID NO: 4125952 - RNA, 66 nt, Human
caguggcuuuaguguucaacccagauaacuuaccaacaagucauuuucccacugaagcugucacug

SEQ ID NO: 4125953 - RNA, 57 nt, Human
caguggggucuguuuuuguuuccaagcaggugauggcuggaagaggagaugccucug

SEQ ID NO: 4125954 - RNA, 59 nt, Human
caguggucagcuguccacuguggacagagccccugguacacaguggaaauugaugucug

SEQ ID NO: 4125955 - RNA, 61 nt, Human
caguggugccauuuccuaauugaggcaccuggcccaauuaggaauaaaugaguacuugcug

SEQ ID NO: 4125956 - RNA, 60 nt, Human
cagugguggaagagauagugaugugagcucauauguaauuacucagucucccauacauug

SEQ ID NO: 4125957 - RNA, 88 nt, Human
cagugguguucuugucaguguuaaucagugguaccugaagagagguuuucuggguuucuguuucuuuaaugaggacgaaacacaccug

SEQ ID NO: 4125958 - RNA, 58 nt, Human
caguguacuuggaauguaacagcugcucaaaauguguguguugaaucugagucuacug

SEQ ID NO: 4125959 - RNA, 62 nt, Human
caguguagaauacaaucuaggugaagcugucauccauggcuucacugacugguucuaggcug

SEQ ID NO: 4125960 - RNA, 88 nt, Human
cagugucagaggaugucuuuugagcccuguaccacuuuucaccuuggagaauacaucucauguaagagauaacauuaucugauaacug

SEQ ID NO: 4125961 - RNA, 59 nt, Human
cagugucucccccagguucugugaguuaagacaacaaagcagccggcuggguggugcug

SEQ ID NO: 4125962 - RNA, 65 nt, Human
cagugugaauaguucuauggcugcagggcuccagcguggcucuuccaaauggcuguucuucacug

SEQ ID NO: 4125963 - RNA, 56 nt, Human
cagugugagcuaauagcagagccagguguagaagcugggccucuuugcucauucug

SEQ ID NO: 4125964 - RNA, 94 nt, Human
cagugugauuuguuuuuauuguucauguaugaauaaauauuaaaauguaaucaucuguuuaugccgagcaugagcugaaaugccugugacauug

SEQ ID NO: 4125965 - RNA, 98 nt, Human
caguguguugucauugauuaauuuauuuaagaaucuccaucugauucacucucagaggagcaccauggagaauucauuauuugaugaugaacguguug

SEQ ID NO: 4125966 - RNA, 70 nt, Human
caguguuagcagggguagauagaguguguuagaauagcaauggcuucucugugagcuccugcaaauguug

SEQ ID NO: 4125967 - RNA, 64 nt, Human
caguguugucugauauuuuagcaguagggacauuuucauagcaguuggagguacagagacacug

SEQ ID NO: 4125968 - RNA, 55 nt, Human
caguguuuagcacagugcuuggcacauaguaagcccuaguaaauguuaaauauug

SEQ ID NO: 4125969 - RNA, 78 nt, Human
caguguuuucaacaacuugguucaaauggguuuccccuaagauccacccacccauuuggccauucaguuguuccacug

SEQ ID NO: 4125970 - RNA, 89 nt, Human
caguguuuuuucaacaucuuagaauuucaguguuuccagguuugugaaaugccccugggugaaugauauucuaaaugccaaggacacug

SEQ ID NO: 4125971 - RNA, 58 nt, Human
caguuaaacagauugaguguuacagggcccagaaccuauaaaugcaucuguucaacug

SEQ ID NO: 4125972 - RNA, 60 nt, Human
caguuaacugagcucugugagagucccagggcugaauugucgccagugguuuaguuucug

SEQ ID NO: 4125973 - RNA, 69 nt, Human
caguuacauggggguuaggauguugaacuauaaucauaaguaaaacaguuuccugacuccuaugaguug

SEQ ID NO: 4125974 - RNA, 62 nt, Human
caguuaccagaucgcaggagguggggccagcacgucccccuccagccaagccuugguagcug

SEQ ID NO: 4125975 - RNA, 111 nt, Human
caguuaccugggggagcuuaucaaaaaacagauucugguuucucacuugcaaaagauggggcggggcgcgagacacaggauucugcauuucugauaagucccaagcugcug

SEQ ID NO: 4125976 - RNA, 63 nt, Human
caguuacuuggggguguuuuccuugguauugucuaaaugggccaaguaaacauucucagauug

SEQ ID NO: 4125977 - RNA, 55 nt, Human
caguuagaggagguggguuaagagagauuuucuaucuuaccucccuucuuuccug

SEQ ID NO: 4125978 - RNA, 69 nt, Human
caguuauaguugugguaucugcuguuucugccuugaaauuuccagcuuacagcuaagcaacaacuacug

SEQ ID NO: 4125979 - RNA, 99 nt, Human
caguuauguauuauaaucaugaaauuguauuggccucaaacccaaauuuucuuuguagucuaggauagauuuuucaugaaagcuauauaguuauaacug

SEQ ID NO: 4125980 - RNA, 55 nt, Human
caguucaugagugaccaugaaaaauguuuucaucaggcaucaugcucaagagcug

SEQ ID NO: 4125981 - RNA, 72 nt, Human
caguucauuagaagguuuuaaaggaauacaauuuuuaccaccauuguauuauuuuugcuucucaugagucug

SEQ ID NO: 4125982 - RNA, 62 nt, Human
caguuccagugcuccauagcauaguguguuggucacucuguccuggagggcauaggacgcug

SEQ ID NO: 4125983 - RNA, 71 nt, Human
caguuccuuaaugcuuugaaaaggugcauuaacacuuuggcagcacuaacuauuagguauuuaaggagcug

SEQ ID NO: 4125984 - RNA, 73 nt, Human
caguucucaauaauuuggacauuuuuggcauguaacuuuguacauguaaguauucaaaauauuucauggacug

SEQ ID NO: 4125985 - RNA, 79 nt, Human
caguucugauggcaggcagccugagggaucugggcacagcgggcggcucagguguccccggcugcccucccaguagcug

SEQ ID NO: 4125986 - RNA, 58 nt, Human
caguucuuaugcugguggcuuccaaaccucacuuugagaaauacugccuuaggagcug

SEQ ID NO: 4125987 - RNA, 64 nt, Human
caguucuuuguggggaguucucaguccaugucaaggagacguggcuccccucuacagagggcug

SEQ ID NO: 4125988 - RNA, 57 nt, Human
caguugaaggcccagccacagaaugggaaacaagccauucccacugugccuucccug

SEQ ID NO: 4125989 - RNA, 80 nt, Human
caguugaucuccagaugccuggaaaugagaaugugucaagguaacucucaccuucguugccaggcugagggauccagcug

SEQ ID NO: 4125990 - RNA, 108 nt, Human
caguugaucugaaauaggauuuuaccuaaugaagcagaauuucccacucuuuuguuuaugagagguguggguuuuguuuuguuucuuaaucuuauuuuguuuuuacug

SEQ ID NO: 4125991 - RNA, 64 nt, Human
caguugcacccaugucuccacguacagcucaugcaggcugguggguggugcaggagugugcuug

SEQ ID NO: 4125992 - RNA, 65 nt, Human
caguugcuuguuaguggugagguucuaugauccuaaguaggggacuuaguggcuacaagcagcug

SEQ ID NO: 4125993 - RNA, 61 nt, Human
caguuggaggaaugaggcuguaacaaaggaaaaauauauuucucccucuuccucucagcug

SEQ ID NO: 4125994 - RNA, 98 nt, Human
caguugggccuccagaugccaggucuuuguucugcauccucagcccgccucaggucucagcugaggagcgagaacucugcuggaaggccacacagcug

SEQ ID NO: 4125995 - RNA, 86 nt, Human
caguuggggacacauucacaaaugcugccccauuccauggaaggauagauuuggaccagagagggcaguaccgugaaugccaacug

SEQ ID NO: 4125996 - RNA, 73 nt, Human
caguuguauggcuuuaaauugaaggaguuuggcuuuuuaucuaaauugcuucauaauaaaaccacugcuuuug

SEQ ID NO: 4125997 - RNA, 65 nt, Human
caguuguauguaccacagguggugguagaacauucuauuagcuuuuaagugugcuacaugcuaug

SEQ ID NO: 4125998 - RNA, 55 nt, Human
caguuguccuuuguaccaaguucugucaacuagcuugguagcugaggacauacug

SEQ ID NO: 4125999 - RNA, 74 nt, Human
caguugucugauaaaugccaucuuuuugaaugcuuuccuugaaauucaagaaaggagucuauguaucacagcug

SEQ ID NO: 4126000 - RNA, 91 nt, Human
caguuguguuauuuccuugggguacaguucuuccagugucauuggcaucaaugaauaugugacuuugauuucaaguguaaacaaaccacug

SEQ ID NO: 4126001 - RNA, 56 nt, Human
caggaagcucuuagcagucaccuuccgauugggguugauuggguuaaggccuucug

SEQ ID NO: 4126002 - RNA, 85 nt, Human
caggaaggaggacuagaggaacaucgagcgauggacugcaagaucuauaauagauguccuuugcuucucugguccauccuuuuug

SEQ ID NO: 4126003 - RNA, 88 nt, Human
caggaagguugggggaggccugcugcccaugugccaggcccccaggggcuguuucagggcagagcguuuccugcccccacccuuccug

SEQ ID NO: 4126004 - RNA, 81 nt, Human
caggaaguggcaggcgcaggguuuggacccaggccugggugaccccagaaccucaugggauccugugaccuguugacccug

SEQ ID NO: 4126005 - RNA, 73 nt, Human
caggaaucacuaacuuagggaauuugaugaacuacuucacauaguucacauuuacugguuuguccgauuccug

SEQ ID NO: 4126006 - RNA, 78 nt, Human
caggaaucagcaggcccagaguuucauggccuugagcaauugcugggcagugggguuucugugggugcuaauugccug

SEQ ID NO: 4126007 - RNA, 79 nt, Human
caggaaucaguacaaaggugcucucaaggaacauucgaugguguaguuugggauuggcccuauggauuguaucuuccug

SEQ ID NO: 4126008 - RNA, 74 nt, Human
caggaauccagauuuagagagauaaccauguuuuucuuuaggcaaaaguauuaucucuuuaaaugugccucuug

SEQ ID NO: 4126009 - RNA, 59 nt, Human
caggaauguuugugcuccuuuagagauuuguaauuaagaagaggcagaacucguucuug

SEQ ID NO: 4126010 - RNA, 93 nt, Human
caggaauuagguuuuccuuuucagauucaaauuuuaugugaguauuugccuuuuguaacuuuagcuauuuaaucugauggagaauuuuuccug

SEQ ID NO: 4126011 - RNA, 78 nt, Human
caggaauuuagagucccuggguuuuaccgagucuccacugacuagcagugcagcugugggagaaucucuggguuucug

SEQ ID NO: 4126012 - RNA, 73 nt, Human
caggacaaaccucuuccuagucacuuggaaagaagaacuuuccgaguugaaguaggauagcgguuagugccug

SEQ ID NO: 4126013 - RNA, 59 nt, Human
caggacaaagcccuuugagaaacagucaccaaccuguguucccacugggcucuguccug

SEQ ID NO: 4126014 - RNA, 65 nt, Human
caggacaagagggaaucgauaacuaaaauaggucacgagaagcuggagaagccgucuugucgcug

SEQ ID NO: 4126015 - RNA, 77 nt, Human
caggacagaggccagcuacccaagggucagggaccuccaucucuggcccugaggggcugugccccuucugcuuccug

SEQ ID NO: 4126016 - RNA, 89 nt, Human
caggacagagugggccccuggcacaugcucccugagugguaacaaugguucuccaccaucucucgugucucaaggggccccgcugccug

SEQ ID NO: 4126017 - RNA, 72 nt, Human
caggacagggcagaaggcacucuacucccaguuaucagcucuacugggagguaauguaucuguccugcccug

SEQ ID NO: 4126018 - RNA, 60 nt, Human
caggacaguuggacagacauugugggaacccccgcacugcccuggcaccacacaugccug

SEQ ID NO: 4126019 - RNA, 68 nt, Human
caggacaucacucgccgccugucucgaaguggugagcgccaccacaucgggcggacacugggguccug

SEQ ID NO: 4126020 - RNA, 61 nt, Human
caggacauggacacuuuugggcaguuaucauuuuacccaacacagauguguuaguguuuug

SEQ ID NO: 4126021 - RNA, 63 nt, Human
caggaccaggagauuugagcuaggcuugggaccuucucuuugcugggucucucccugguccug

SEQ ID NO: 4126022 - RNA, 79 nt, Human
caggaccaggcugugccucugcucucagggaacucacauccuaggguggagagaaagaaacgugaacagauggucacug

SEQ ID NO: 4126023 - RNA, 71 nt, Human
caggaccccgaggagagguccaggcccuugggcuucugccaggcccugcugaggccucccucucuguccug

SEQ ID NO: 4126024 - RNA, 55 nt, Human
caggaccuaacucaccugucucagagccgucuguaaguaccugugagaggaccug

SEQ ID NO: 4126025 - RNA, 83 nt, Human
caggaccugggaugguucucauguguucguccccuuccacacuaagccaaagaaggagcugaaacaagggaccguccuuucug

SEQ ID NO: 4126026 - RNA, 63 nt, Human
caggaccuuccauuucuaaaccagaugugauuaccuuauuggaugaagaaaggaaggaaccug

SEQ ID NO: 4126027 - RNA, 56 nt, Human
caggacuauguucaacagauagccgcugagacaugcaugcacucuggcauauccug

SEQ ID NO: 4126028 - RNA, 69 nt, Human
caggacugcauaugauagaugccuugcaauaauuucccagcaaggaaaauaucauguuagugauuccug

SEQ ID NO: 4126029 - RNA, 62 nt, Human
caggacugggucuagggcagcagggcuugggggucgagcccucugccugggaccaaguccug

SEQ ID NO: 4126030 - RNA, 67 nt, Human
caggucccacagggaguucacgcaaugcaggccagcuuuucuggcccagagugaguccugggcccug

SEQ ID NO: 4126031 - RNA, 84 nt, Human
cagguccuucucaaggaaaagugauggcauacugauuagauguaugaugccgaugccaucacuuuuccuuuuguaggcauacug

SEQ ID NO: 4126032 - RNA, 82 nt, Human
caggucucacugcuguuggacacucccuuuucgaagcugccacugcucugagucugggcauguucacuuugccugggaccug

SEQ ID NO: 4126033 - RNA, 60 nt, Human
caggucugagucacauguucaucucagaaucagaugguacguucaauuagacucagacug

SEQ ID NO: 4126034 - RNA, 63 nt, Human
caggucugcaccauucccaaggguugcugugcacagccuuuucuaagguaugguuuauaccug

SEQ ID NO: 4126035 - RNA, 70 nt, Human
caggucugccucacucacuucugacuccauaaaagcucccauaagauggaaggagaaaggggcagagaug

SEQ ID NO: 4126036 - RNA, 75 nt, Human
caggucuuccuccagcugcuucacaaugauccucuccuccaccagcacgucauuaauccagucgaggaggaccug

SEQ ID NO: 4126037 - RNA, 76 nt, Human
caggucuuguauggaagguguguguuuaaacaaauuugaauaguauuuaaacacuggcaauuucaugcacaauuug

SEQ ID NO: 4126038 - RNA, 62 nt, Human
caggucuuuguugcagcauggacaggagccaacgucguucaaccacagccaagagggaccug

SEQ ID NO: 4126039 - RNA, 97 nt, Human
caggugaacaguuugucaaaccucaaaauuaguaacaaaggccaccacccuugaccugggacuuugagcaauucugagaugcaacaagcuucacuug

SEQ ID NO: 4126040 - RNA, 64 nt, Human
caggugaccuauggucacuacauaugaguucagaaaguucagaaaggugaccguaguucacgug

SEQ ID NO: 4126041 - RNA, 70 nt, Human
caggugaccugacucuccucaagcauaaauaggucauuaguuacugcuuucaggaaguuucccucaccug

SEQ ID NO: 4126042 - RNA, 71 nt, Human
caggugaggugggacugggcugcaagaucuggugccgcuuuucuccacugugcagccugucccuucuccug

SEQ ID NO: 4126043 - RNA, 65 nt, Human
caggugaguuuuccuccuugguugucuaauuuaacauuccaaaaugggaagaaaaccagcaucug

SEQ ID NO: 4126044 - RNA, 80 nt, Human
caggugaugagaggguguggaagucaugggcugagagagcuggucagguuccccccagccuuucacaugagcaucacuug

SEQ ID NO: 4126045 - RNA, 62 nt, Human
caggugauuagagcuagaugaggucaugagagggaggcccucaugaaaggcucaguggccug

SEQ ID NO: 4126046 - RNA, 85 nt, Human
caggugauuugaaugugcagccagguuugaggaccacuguucuacaugcaucuuuggccacuugugcugcaucuugucuacucug

SEQ ID NO: 4126047 - RNA, 58 nt, Human
caggugcaaguaauuccagcuacugaggaggcucaggcaguagaauugcuugaaccug

SEQ ID NO: 4126048 - RNA, 80 nt, Human
caggugcccgccaccaugccuggcuaauuuuuugcauuuuuaguagagaccuuguuagccaggauggucucgaucuccug

SEQ ID NO: 4126049 - RNA, 59 nt, Human
caggugcucugcugcagguaagccaguugucacauccuggcucuccuuggaggcaucug

SEQ ID NO: 4126050 - RNA, 67 nt, Human
caggugcugaagaagucuguucgcccugaaauuccuccuuggucacagcuuuuucagcagcaaccug

SEQ ID NO: 4126051 - RNA, 56 nt, Human
caggugcugacuucccacuaacuucaaagggaauugaggaggaagaaagcacacug

SEQ ID NO: 4126052 - RNA, 57 nt, Human
cagguggaugguugcuuaugguuaguaucgauucugagcagguaggcauucauacug

SEQ ID NO: 4126053 - RNA, 72 nt, Human
cagguggcaaugcaaucagaugauuauuucuguaagaaucaagaaauucagcaucaugcauuguaaccccug

SEQ ID NO: 4126054 - RNA, 64 nt, Human
cagguggcagugccugcauucugaauguccugcgcugacacagguagguuauugcugcuaccug

SEQ ID NO: 4126055 - RNA, 83 nt, Human
caggugggauucacauuguuuuaaugugaauaaggacauuuacuuauucuagauaagaaaagggcugugaaauccauaaacug

SEQ ID NO: 4126056 - RNA, 66 nt, Human
caggugggccguaaucucuggguagcuaaagcccagcagcagcccgaggaucaugugucaacccug

SEQ ID NO: 4126057 - RNA, 67 nt, Human
cagguggugccucagggacuuacaaaccagaagguuccaugccuuccccuuuaguggguauuauuug

SEQ ID NO: 4126058 - RNA, 55 nt, Human
caggugguugagagcuguaggccugacaccagaaagucugaucucaaccauucug

SEQ ID NO: 4126059 - RNA, 85 nt, Human
caggugguuuuggggucgagagcugacucccuccuccuccgucuuaacccaggcucagagggucagcucccuccccagggcucug

SEQ ID NO: 4126060 - RNA, 77 nt, Human
cagguguagagugaggcugggcagagggguguugcugaugucugcaccgccaugcucccagccacaguuuccaccug

SEQ ID NO: 4126061 - RNA, 57 nt, Human
cagguguauaaacucagugacuccaagcggcuacacugagcaauguuuacauacuug

SEQ ID NO: 4126062 - RNA, 89 nt, Human
caggugugcuggugauugucuccugagagcuggacagaggccucugcacucuaccugcacucaggaaacauuuacagaaucacacucug

SEQ ID NO: 4126063 - RNA, 65 nt, Human
cagguguuaaaugauggauuuagacaagcuggacaccaaguuuguguucuaucauucuacagcug

SEQ ID NO: 4126064 - RNA, 61 nt, Human
cagguguugcaguugaagacugguaaguuugccaaucagaucuuccaacacugacaccaug

SEQ ID NO: 4126065 - RNA, 56 nt, Human
cagguuccaguugcagggacuuuauagauugggaaagucuacaacuagggaagcug

SEQ ID NO: 4126066 - RNA, 82 nt, Human
cagguuccccaagggcauuuggcucaaccuaaguaagagaauaugaauuugagggagaaagccgaggugucuggggagugug

SEQ ID NO: 4126067 - RNA, 61 nt, Human
cagguucuauacugaauaauuuuuguugguauuuuggcuucaguaauucagauaaugccug

SEQ ID NO: 4126068 - RNA, 62 nt, Human
cauguucuuugugauucugagcuggcaggucaucauugccaccagcauuucaaagacacaug

SEQ ID NO: 4126069 - RNA, 64 nt, Human
cauguugagggagaagauucugcacacucauuugaggcccgccugacccugucucccucacaug

SEQ ID NO: 4126070 - RNA, 56 nt, Human
cauguuuauggagcagguauuaggugucuugcacuguaccaggcccuguggacaug

SEQ ID NO: 4126071 - RNA, 89 nt, Human
cauuaaaggacuugcuauugguuuacucuguaaaccaggaaccugacauaguugcugguuucugaguaaccacagcaguacaacaaaug

SEQ ID NO: 4126072 - RNA, 64 nt, Human
cauuaaaugccauuguauauucauugaucagugaaaucacaucugggucacaguggcaucuaug

SEQ ID NO: 4126073 - RNA, 85 nt, Human
cauuaaguagcuggugugaccuucaugcuaaguuggauacagcagaguuuaaacaaaugaaauagucaaucuaccagacuuacug

SEQ ID NO: 4126074 - RNA, 77 nt, Human
cauuaaguucugguauaaauggcucuuggucccuuuggaaauuucagacuaagugggacauuuacuaggacucuuug

SEQ ID NO: 4126075 - RNA, 110 nt, Human
cauuaaugaggaaaccaggugggguaaagcugguucacuaagcauaauaucuguaauauuuuuaggucugcugugauucuacuaguguuucaccuggauuuuuuuuaaug

SEQ ID NO: 4126076 - RNA, 73 nt, Human
cauuaauuagcugcagaguagggcauguaccuguucaacuuuacaauauacugccaaauugcagcaauguaug

SEQ ID NO: 4126077 - RNA, 90 nt, Human
cauuacaaucccuuguauuuggguaguauagagaauuagaaaaaaaugaacacaaaaaguucucauuuuacccaagaacuggguguuuug

SEQ ID NO: 4126078 - RNA, 56 nt, Human
cauuacuaucaaccaggucacagaugacgauugcuuggaccaggaaggugguggug

SEQ ID NO: 4126079 - RNA, 75 nt, Human
cauuacuccaccucccagagccacagcuucuuuaaaauaucuauuucaauggcuugcucugggagggaugugaug

SEQ ID NO: 4126080 - RNA, 59 nt, Human
cauuacuuacaguuacggcaaguggucuccaaagauggcugccaacauuguuagcgaug

SEQ ID NO: 4126081 - RNA, 83 nt, Human
cauuacuuaccaccucuuugauuugaggcaaguuacgaaccacuccauuuuucucuucuguaaagugguggcacugauugaug

SEQ ID NO: 4126082 - RNA, 80 nt, Human
cauuacuuaugggaaaaaucagucuucuauuuggguuggcaaaaaucagcugaagagaggugcugaguggccaggaaaug

SEQ ID NO: 4126083 - RNA, 73 nt, Human
cauuagaaucaggaaauggugauuugguugaaucuacagauaauagcuuuaccacuuccugugucagcugaug

SEQ ID NO: 4126084 - RNA, 67 nt, Human
cauuagcaaucauaaaccuuuauugaucuaaaccaauggguauugaagugguuuguaauugguaaug

SEQ ID NO: 4126085 - RNA, 60 nt, Human
cauuagcauucagugacuuguaagaguaaacuuccuucuagauaguccugugugcuuaug

SEQ ID NO: 4126086 - RNA, 129 nt, Human
cauuagcugacgauaaugaaucuucuguucugaaaagcaugguuuaguugauuuuuuuaauuuuacuucaauggagcaguaccuugucuuuuauagaacaaguuagacaaaccauuaaugacaagagug

SEQ ID NO: 4126087 - RNA, 69 nt, Human
cauuagggaugcuguggaagggauuugggaggaugcauuagguggcuuuaggguuccuucuacccuaug

SEQ ID NO: 4126088 - RNA, 76 nt, Human
cauuagguuagugcaaaaguaauuggaguuuuaauggcaaaaacugcaauuauuuuugcaauauaagaacuugaug

SEQ ID NO: 4126089 - RNA, 107 nt, Human
cauuauacagugaccagcacuaucuuuguuuccagccaaaauagauuucagaggaacuauacauaaaacauuuggguggaaacaguuagugggccauuucaaaaaug

SEQ ID NO: 4126090 - RNA, 75 nt, Human
cauuauauuacagcacuguuaaagauacugaaauauauugaaguuuuaccuugacauugcuguaguguccagaug

SEQ ID NO: 4126091 - RNA, 83 nt, Human
cauuauauuauucugaauuauuguuuaggaauguuuagacuauauuuuuuccagaggagugauucagaggguauguuuuagug

SEQ ID NO: 4126092 - RNA, 73 nt, Human
cauuauuaaccuuaaaggccgaaguaaagauuuauaggacuaaguguuugcuuuagucuuuugguacauagug

SEQ ID NO: 4126093 - RNA, 64 nt, Human
cauuauuucagcugggaaagucacuauaugaauuaauagcagauuucccagcugaaaauaaaug

SEQ ID NO: 4126094 - RNA, 61 nt, Human
cauucaagguuggcucaggaauugggcucuggcuccaggaacugauuuauaacuuuaggug

SEQ ID NO: 4126095 - RNA, 85 nt, Human
cauucaccuuuucauggcuuuguucuguuagaugaaaguguuucuagauuuggcauuuaucuaacauagcaucauagggugaaug

SEQ ID NO: 4126096 - RNA, 61 nt, Human
cauucacugaagcuuuauugaaugccuuuuauggaucagcagugugaagcuuuauugaaug

SEQ ID NO: 4126097 - RNA, 69 nt, Human
cauucagagcaucucuaaagccagaaaauaagagcaagguuagcuguugggguugggggugugcugaug

SEQ ID NO: 4126098 - RNA, 73 nt, Human
cauucagagugcuugcauauuuauugucucauugacuucucacaagggacuggaaggcaaguauuucugugug

SEQ ID NO: 4126099 - RNA, 55 nt, Human
cauucagcuggcagguucugggaaggcgggccucuucccucauccccaguuguug

SEQ ID NO: 4126100 - RNA, 55 nt, Human
cauucagguacacucagugcuaggggaccucccuccccagucugggaccugcgug

SEQ ID NO: 4126101 - RNA, 96 nt, Human
cauucagucgugugugugucccugccacauggauucagucuugugugugugugucccugccacauugauucaguccuguguguguguaugugugug

SEQ ID NO: 4126102 - RNA, 68 nt, Human
cauucauguuguaguauguaucaguacuucauuccuuuuuauggcugaauaauauuccauuaugagug

SEQ ID NO: 4126103 - RNA, 76 nt, Human
cauuccacuggacacuuguggccuuucuaguaaguuuauggaagauuuacuggaagaccacauuguuuaugguuug

SEQ ID NO: 4126104 - RNA, 101 nt, Human
cauuccaguuuuauucucagacacacaacuucugcuuagauaguucagaguucccauaauccugucuuagaaaaaggcuguggucuuagggaaguggaaug

SEQ ID NO: 4126105 - RNA, 83 nt, Human
cauucccaaggcuguucucuguaacaugcauuuuucccccuuuuucuuuaaaugcuguggcguuacggcgaacaccuuuugug

SEQ ID NO: 4126106 - RNA, 58 nt, Human
caguccuaccagguucugagcuagccagaugaguccuggcauagaauauggugggcug

SEQ ID NO: 4126107 - RNA, 59 nt, Human
caguccuguugguuccagagguggccugucaccaggcaucuggggacaucauuaggcug

SEQ ID NO: 4126108 - RNA, 75 nt, Human
caguccuugcucaaagucuacaguuagcacacuaaauaaugaauuucuuuuugugaaaaguugaguaagaaacug

SEQ ID NO: 4126109 - RNA, 68 nt, Human
caguccuuuuugacucagauuuuguggauuugaaauaaucaacgugccauucaugugagcaagaacug

SEQ ID NO: 4126110 - RNA, 80 nt, Human
cagucgacuaccuuucaucuuauugucuuugauccucucuuuagaagcuucuuggcaggagauaaaauauuaguugauug

SEQ ID NO: 4126111 - RNA, 57 nt, Human
cagucuaagacucacgccaagauuuuuauuuccuucuggggcccugucuugggucug

SEQ ID NO: 4126112 - RNA, 55 nt, Human
cagucucacccuggaggccccaguugcaauauugggugucacaaaugugagagug

SEQ ID NO: 4126113 - RNA, 58 nt, Human
cagucucugcccgcgucugccccagcacuuggcacagcgggacagacgcagagaucug

SEQ ID NO: 4126114 - RNA, 56 nt, Human
cagucugaacacugggcuacuccugcgggauuccagguaagacccaggauaggcug

SEQ ID NO: 4126115 - RNA, 58 nt, Human
cagucugggagggaugccaguguacaagcguaaaugagcaaauaaagcucucagauug

SEQ ID NO: 4126116 - RNA, 63 nt, Human
cagugaaagauaaguuauuauguaccugaugcucagguuaguggaaaauaucuuuuuaagcug

SEQ ID NO: 4126117 - RNA, 85 nt, Human
cagugaaaucagaggucagcuguaccacaggaaacacugagaagucaagacaagaucaguauggucaucugaccuuuguucucug

SEQ ID NO: 4126118 - RNA, 97 nt, Human
cagugaaauguauaggguugguacaacaguaaucaagguuuuugcccaaguaauggcaaaaaccucaauugcuuuugcaccaaccaauauuaagaug

SEQ ID NO: 4126119 - RNA, 56 nt, Human
cagugaacauuugugcuagcccugccuaugcagaaggccagcugcauaugucacug

SEQ ID NO: 4126120 - RNA, 57 nt, Human
cagugacacugguuuagguauguaucucugguacuuuccaaagcugcaguguuucug

SEQ ID NO: 4126121 - RNA, 107 nt, Human
cagugacauugcugcuucaacuaagaaauucuauauuuaaauucuaauguaugcaacauacugaaggcauucagauaacagagcacucagagggcugcaaaccacug

SEQ ID NO: 4126122 - RNA, 122 nt, Human
cagugacccucuggauagguaagcugcauggaccaggcucauugagaauguacugacacuuccaggaggcagggcugugcccgcuucucaacuguucauauauugaugcuuuugggucacug

SEQ ID NO: 4126123 - RNA, 60 nt, Human
cagugaccgaguagaauaagcucuccaucaggguagagacuuugucuauuuuguucacug

SEQ ID NO: 4126124 - RNA, 75 nt, Human
cagugagcccccagcagagcccgguccaagugcgggauggacuguggcguagaugcugggaagagguguccacug

SEQ ID NO: 4126125 - RNA, 57 nt, Human
cagugaggauuacuaguuaacagggagaaacaaucuuguacuaugucuaagucacug

SEQ ID NO: 4126126 - RNA, 57 nt, Human
cagugcagacguggagggggcacagcugggaauugccucagaugucuuaaggcacug

SEQ ID NO: 4126127 - RNA, 64 nt, Human
cagugcagaggccagggaggauugauuuuguggcacuguuccauccuggccuggauugcaacug

SEQ ID NO: 4126128 - RNA, 77 nt, Human
caggcacccaccaccaugccuggcuaauuuuuuggacgggguuucaccgaguuagccaggauggucuugaucuccug

SEQ ID NO: 4126129 - RNA, 55 nt, Human
caggcaccugccucucguguccaugcagcauuacaggaggggacagguggccgug

SEQ ID NO: 4126130 - RNA, 61 nt, Human
caggcagaggcuuuucauggcucuugugggaaaaagaguccuugcugacaaguccugccug

SEQ ID NO: 4126131 - RNA, 82 nt, Human
caggcagcacaagguaugugaagagauuaaaaaauaggggauggucugccucuuucucucuacaguacuuucauccugcuug

SEQ ID NO: 4126132 - RNA, 76 nt, Human
caggcagccagaggggccuggcacugagcuggcacggaggagaacggcccugcuggcccaggccccucgcugucug

SEQ ID NO: 4126133 - RNA, 74 nt, Human
caggcagcugcugucucacuggugugguuugccaaguagccaguuagaccuguagauagcaggagguuugcuug

SEQ ID NO: 4126134 - RNA, 71 nt, Human
caggcaggagucagccugcggcugcacgaggcuucggagaccaagcugccugcugcacucggugcugccug

SEQ ID NO: 4126135 - RNA, 62 nt, Human
caggcagggcugccuucugcuuuuucaaauucuugcuggucuuagcaguggagccaugccug

SEQ ID NO: 4126136 - RNA, 57 nt, Human
caggcaggggcccugcugaguacauacagcucacccacuuggccaggcccccaccug

SEQ ID NO: 4126137 - RNA, 81 nt, Human
caggcaggguggaaagugggcaggaggaugcacccaggcccagaaugaaccucugugcuuuguccagccuccccuagccug

SEQ ID NO: 4126138 - RNA, 58 nt, Human
caggcagugauauuuaauuuguauagugauguauuccaagugucuauaucagugcuug

SEQ ID NO: 4126139 - RNA, 86 nt, Human
caggcaguuguuuuaaaucgcggauaaugugagauugaaaagcagccuucaaauucuguuacuaaugugaugugaauaacauucug

SEQ ID NO: 4126140 - RNA, 56 nt, Human
caggcauaaguaauguuuuauguauagaaaugcuuucuuucauuacuuggugccug

SEQ ID NO: 4126141 - RNA, 59 nt, Human
caggcaugagccaccgcaccgggccuaaaauuuguugcuuuggucagugguucaguuug

SEQ ID NO: 4126142 - RNA, 59 nt, Human
caggcauggagaggcagagacucucccuuggacguaauucuuugccuauucucugccug

SEQ ID NO: 4126143 - RNA, 85 nt, Human
caggcauggauccuucauugguugagggcuacucucuggagcauauauggugcuuccagccuucccaaugcuugguuugagccug

SEQ ID NO: 4126144 - RNA, 57 nt, Human
caggcauuguucuagguucucaggauagagugucaagcaagaccuaaacgaucccug

SEQ ID NO: 4126145 - RNA, 64 nt, Human
caggccaauaaaugugauggccuuuuuuuacaaugcucuuuaugaaguccuuaccccuggccug

SEQ ID NO: 4126146 - RNA, 64 nt, Human
caggccaccagauacaugccccuuggggagucauuuacuaguagggucugaauaucuggugcug

SEQ ID NO: 4126147 - RNA, 129 nt, Human
caggccacugugggagcuguggugcugugccagugaggugaguagugagaagcccaucuugcagaccccacagacgaagggcuucugcucagccugcacgcacuggugcuccagcaggucaguggccug

SEQ ID NO: 4126148 - RNA, 66 nt, Human
caggccagaggaguugaggcuuuggguagcaccccgcaggcccagcaguagagcucauauggccug

SEQ ID NO: 4126149 - RNA, 125 nt, Human
caggccauaagaugaccuaauaagcacacaauaucuggagagcuaagcggaguuaucccucauaccuaaggcgacuucucucucuggauauuuguaugcuggauuugucucugaagcuaagcuug

SEQ ID NO: 4126150 - RNA, 104 nt, Human
caggcccagccuucucacccacccagccccacacggucuagcucugccugaaguaggugcuuggcucgugcacacagauggacggguggaugcggcugggccug

SEQ ID NO: 4126151 - RNA, 65 nt, Human
caggcccaggguuauugggaaaauaaccaaauaaauggucaacuaucuaaauagacucugaccug

SEQ ID NO: 4126152 - RNA, 108 nt, Human
caggcccauuuccauucacuaagaaaugcucuuuaagacuaaauuagaguuugguaaauuacuagacaaugaauagauuugagaagcucuucuggaaaugcagggcug

SEQ ID NO: 4126153 - RNA, 75 nt, Human
caggccccacgauguuuugggagaguguuuagcacaggaaaaugcgcagaauacacgcacgacacgggggcacug

SEQ ID NO: 4126154 - RNA, 83 nt, Human
caggcccccauauagccagugagugggaagcuacaauuccugcucuguccucuuaccacuacauuugcuaauggcaaggucug

SEQ ID NO: 4126155 - RNA, 57 nt, Human
caggcccucgcccgcagcgaccuaaccccuuccagaggcucugcuggcuggggcuug

SEQ ID NO: 4126156 - RNA, 61 nt, Human
caggccggugauucuggauguauuuugaagauagagccaauaacuccggaguuuuggccug

SEQ ID NO: 4126157 - RNA, 55 nt, Human
caggccucaccagcggagcugcgagaggucuuuccagagcuugcugagaggccug

SEQ ID NO: 4126158 - RNA, 73 nt, Human
caggccucacugcagccccaggaaguaggggcggguuggggcccauuuuccagagggugcucagggcggccug

SEQ ID NO: 4126159 - RNA, 77 nt, Human
caggccugagaggcagccagagaaaaucacauagccgcacagauuuguucauugucucugaugugccucuaugccug

SEQ ID NO: 4126160 - RNA, 70 nt, Human
caggccuguccuggguccccgcaggucagugugaaggcgugcgcugccggcggacccugggacaggggug

SEQ ID NO: 4126161 - RNA, 58 nt, Human
caggccugucugcacaugaggcugugagggcacaggccugugugcacacgaggccaug

SEQ ID NO: 4126162 - RNA, 59 nt, Human
caggccuuucuggggaagugagaggaaauacaagauucuuaugggucccaagaggccug

SEQ ID NO: 4126163 - RNA, 55 nt, Human
caggcgaugcugcuggugcuggugcacaggccccacuuugaguagcacuugaaug

SEQ ID NO: 4126164 - RNA, 76 nt, Human
caggcggggagggagcuuccgaacuacagcuucuccagcacuuggagcagcucgaggccucucaccuuaaggccug

SEQ ID NO: 4126165 - RNA, 73 nt, Human
caggcgucccacugacccaggcuggguggcggcagagaguggcauucccacugagguagcuggugacugccug

SEQ ID NO: 4126166 - RNA, 66 nt, Human
caggcuccauuaaucauccugcaccuaaguuguuccuacgauggcaggauguuugguggaaaucug

SEQ ID NO: 4126167 - RNA, 82 nt, Human
caggcuccauuugcugaugggcugugcgacucaauguucacaaauguuuagucauucagcuccuuuucaaggaauaagccug

SEQ ID NO: 4126168 - RNA, 78 nt, Human
caggcucccagaaaauucucagacaaugcuaucagaaauucuacacaacauaguuuugucugguuucuugggugugug

SEQ ID NO: 4126169 - RNA, 84 nt, Human
caggcucgggcugauguaugguccagguaaaugcagcuucugguuaauacgaugcuguaauggaaaaacauuagcaugagauug

SEQ ID NO: 4126170 - RNA, 64 nt, Human
caggcucugucaggcggagcagcaugaggucguggcuguaguccucgucugcuuggcgggugug

SEQ ID NO: 4126171 - RNA, 80 nt, Human
caggcucuguucaaugcaauggcaauggaaggaauaguaaccuuccauuuagugcacaguguaaugaaucagaauucuug

SEQ ID NO: 4126172 - RNA, 55 nt, Human
caggcugaggguuaggccuuagaacuccaccuauuugcugcaacuccucugucug

SEQ ID NO: 4126173 - RNA, 55 nt, Human
caggcugcagugcaguggcuauucagaggcauggucauagcucacugcagcccug

SEQ ID NO: 4126174 - RNA, 55 nt, Human
caggcugcauggagggguacaggacucuuucugcuucuuuuauuggcagauccug

SEQ ID NO: 4126175 - RNA, 55 nt, Human
caggcugcugacaggcuuggagaggagugaggacugggagucgucggagagucug

SEQ ID NO: 4126176 - RNA, 76 nt, Human
caggcugcugugaggaggcggccagaagaguggggacgggccuguguuguguguuuccuccucuccagagagccug

SEQ ID NO: 4126177 - RNA, 65 nt, Human
caggcuggcucaggugugagcugaagaggcaaaacugucuguuuagguugcauuggguuccccug

SEQ ID NO: 4126178 - RNA, 58 nt, Human
caggcugggaacgccacccgcuuccguaguaggaaaucaaucguggauucccagccug

SEQ ID NO: 4126179 - RNA, 55 nt, Human
caggcugggacugaccccugcugagaaguaccaggcggucuugucccucugccug

SEQ ID NO: 4126180 - RNA, 65 nt, Human
caggcugggggaggugagcugagucuggcaggccaccugccccaccagcacccucucuaucccug

SEQ ID NO: 4126181 - RNA, 103 nt, Human
caggcugucagaggggaggagguggagauggcgauguuuagugguguguucacguggcugacuuugccugucuuuagcagaacacuuccccuaaaaguaccug

SEQ ID NO: 4126182 - RNA, 69 nt, Human
caggcugugaaacugagaugcgccauggguggguggugggucugaucacaguuucuccuucccagccug

SEQ ID NO: 4126183 - RNA, 59 nt, Human
caggcugugaguuuugucucagacuuaauuuuaucucugacagauuuaacucauaaaug

SEQ ID NO: 4126184 - RNA, 69 nt, Human
cagguuuuauaaagcauguacugugugcuagacacuguucuaagcacuuuacuuguuuuaccuuacuug

SEQ ID NO: 4126185 - RNA, 59 nt, Human
caguaaauacauaucagagaagcaggaacauaugugcuucucugauacgugcuuuauug

SEQ ID NO: 4126186 - RNA, 60 nt, Human
caguaacaagugccaacguuagauuagaugagaaaauuuucaauggaggcacuauugcug

SEQ ID NO: 4126187 - RNA, 74 nt, Human
caguaagaacugggagggagagcaauagucuuuacuuugagauuugacauuauucucucagucuuugggaucug

SEQ ID NO: 4126188 - RNA, 89 nt, Human
caguaagacccagaguuaguauacaaaguaacagcuagugucaaauugagauguucacuuauguauugcaugccucgugucucuuacug

SEQ ID NO: 4126189 - RNA, 105 nt, Human
caguaauaauaccauucagaugugcacaguauuugauagauuucaaaggacuuuuuacaaaaucuuauuugauccugucagcaguguuuugagguauuaucccug

SEQ ID NO: 4126190 - RNA, 58 nt, Human
caguaauuguaauuaaaaauuagcauagaaaugugcuuuuaggagauuaaaauuauug

SEQ ID NO: 4126191 - RNA, 114 nt, Human
caguacaagcuggcaccucuucucaaagcaacauugacaaauggcaauggcuuucuauuugagcccacauuuguuaaugcugcuuuuaacaagaagugccagcaugcuauacug

SEQ ID NO: 4126192 - RNA, 83 nt, Human
caguacacucauccauaaaguaggaaacacuacacccuccagugcuguuaguagugcuuucuacuuuaugggugacugcacug

SEQ ID NO: 4126193 - RNA, 59 nt, Human
caguacugcauuaaauuuagguuauggcuguagcuaugccaaaauaauguauguaucug

SEQ ID NO: 4126194 - RNA, 60 nt, Human
caguacuuaguucucaugguuucuugaacauugugaaugagagaacuuuggaaagugcug

SEQ ID NO: 4126195 - RNA, 60 nt, Human
caguacuuugcaucauuccacugccuucuguccuaauuguuuaugaugcaaagucagcug

SEQ ID NO: 4126196 - RNA, 63 nt, Human
caguacuuuucuggcuuucuacucugguaggaaaaacagcccuacuagucagaggaguaucug

SEQ ID NO: 4126197 - RNA, 94 nt, Human
caguagaagugaauuaauauuauaugugcuacaugguaguguaguuaugauacucauaauuuuguauugccauuguagauauuuucuucuagug

SEQ ID NO: 4126198 - RNA, 77 nt, Human
caguagagccaaggccgggguugcagccaccaguuugcuuucuguacugcugaggcucccucgggucugcucugcug

SEQ ID NO: 4126199 - RNA, 69 nt, Human
caguagaggagagagcuuggguuuugaauuugauauaguaaagagccugucugccuuucuaccucacug

SEQ ID NO: 4126200 - RNA, 68 nt, Human
caguagauuuuucaucugauugauaacucugcaauuagggcuuuuugaugcaguauggaacaucucug

SEQ ID NO: 4126201 - RNA, 68 nt, Human
caguaggucugaguauggccugagaaugugcauuucuaacaaguucucaggugauacugagguugcug

SEQ ID NO: 4126202 - RNA, 63 nt, Human
caguaggugcucaacaaguacagccuaaucccucugcuugcuugacuuuguguaccuguccug

SEQ ID NO: 4126203 - RNA, 111 nt, Human
caguaguauacguugaaaugcuuaaaaacaguaugguagucaauaaaugugugguggcaacacucuaauauaguauuaccacugcaguuuugcauucuaauauugccucug

SEQ ID NO: 4126204 - RNA, 76 nt, Human
caguaugcuugggacucccuguagcagugccuggaagaugguauguuuugcugcugcaggaauucucaagggacug

SEQ ID NO: 4126205 - RNA, 76 nt, Human
caguauuccgagagcaucuccuaccuacuccuucucaucuugagagaaaggggaguuucaggagagccgagaccug

SEQ ID NO: 4126206 - RNA, 88 nt, Human
caguauuuauaaucuugcccaucuuccagagcauuuauucaacaaauauuaaugagcaucuaugugcuggguacugugguaagugcug

SEQ ID NO: 4126207 - RNA, 63 nt, Human
caguauuugagagguccaggugugacuggcuucaggcacccacauuuaacccucagguuucug

SEQ ID NO: 4126208 - RNA, 72 nt, Human
caguauuuuacugcucaaagcucuagguagcuuccuucuuuagggaaagauauuugagcuguaaaauaucug

SEQ ID NO: 4126209 - RNA, 77 nt, Human
cagucaaggucacagucuaggccuaggucaaaaucuagaucaagaucuuggacuaguccuaaauccaguggcuacug

SEQ ID NO: 4126210 - RNA, 80 nt, Human
cagucacccaaagcagcaguuccaucaccugacuugcggguacagacagggauggagagacuacuggcccaugggggcug

SEQ ID NO: 4126211 - RNA, 89 nt, Human
cagucacugccccuugguuagagcuggaacuugagaugaaacauaguuuccauugcugaccaaagucccauaaggugucuaaguggcug

SEQ ID NO: 4126212 - RNA, 69 nt, Human
cagucacuucaugguuucuuggacaggcagauccuggccauguucauguaauuccauaagguaaggcug

SEQ ID NO: 4126213 - RNA, 63 nt, Human
cagucagggaaugaugcacacaguuggguugucccuaaccuuguugguuucauucaccucuug

SEQ ID NO: 4126214 - RNA, 68 nt, Human
cagucaguugaagauggccaugcauuagucauacuucugucuguguaaauggcaucucucagcugcug

SEQ ID NO: 4126215 - RNA, 55 nt, Human
cagucaugccugcuggggacccuguugcaccaggguccagagacaggcaugggug

SEQ ID NO: 4126216 - RNA, 79 nt, Human
caguccaaaaugucaguguuacugcuauugaaaagccuugaucuauaccaguuagcacaugacauccuucuggcaacug

SEQ ID NO: 4126217 - RNA, 64 nt, Human
caguccagugauuaaaacaugacagccacaaauaaauuauuuauguggcuuuuaggucacacug

SEQ ID NO: 4126218 - RNA, 57 nt, Human
cagucccuucccauuagguccccucaauccagaagaggccaugaggggaggugacug

SEQ ID NO: 4126219 - RNA, 75 nt, Human
caguccuucauuccuccuuugaaugucauauuacaacacacacagcauucccaggacaguggaauuuagggauug

SEQ ID NO: 4126220 - RNA, 92 nt, Human
cagucuaucccauuuuaaugcauguuagagguuuuccacauguuaggcaaauuuucuagaauguuuugaaagggaaaaaauucugcagacug

SEQ ID NO: 4126221 - RNA, 105 nt, Human
cagucuaugacacagcugaaacugaauucggaaguucuaaggugcauuauucucaucaauguagguauaaugcguagaacucuuggccacagaagccauagaaug

SEQ ID NO: 4126222 - RNA, 55 nt, Human
cagucucuggcagcugcuggccugaccuuuguuuccccagccuuuccagugauug

SEQ ID NO: 4126223 - RNA, 61 nt, Human
cagucucuggugaguugacaguagcuaauagaaucuagucucuguuugcuaucaugagcug

SEQ ID NO: 4126224 - RNA, 76 nt, Human
cagucugaaauguucuggaguuucuguggcucuaaagcgggguuuucaacagcagcacuauugacauuuugggcug

SEQ ID NO: 4126225 - RNA, 57 nt, Human
cauuaugugagugauuaauucaggauaacauaaacuucuggaagucauuuacaggug

SEQ ID NO: 4126226 - RNA, 85 nt, Human
cauuauuacaaaagaagggagaagguaccauuuagccccuaagccauggaaguuaacagacucuuuccaucuuuugguaaugaug

SEQ ID NO: 4126227 - RNA, 66 nt, Human
cauuauucuacaccucucucauuuagaugagguagacauuuaaaucaguggagguuguguaaagug

SEQ ID NO: 4126228 - RNA, 63 nt, Human
cauucacaaagcugauugauggcaaagcugagauuugaaaccaaucaguuuuguuucagaaug

SEQ ID NO: 4126229 - RNA, 77 nt, Human
cauucacaacucauagaccagaacuugucaccuggcuacacccaaucucugggagccagaaaguucagcugugaaug

SEQ ID NO: 4126230 - RNA, 66 nt, Human
cauucacaucuuguuccaucacccuuuccagucacaggagagccugggaaagccaauguguggaug

SEQ ID NO: 4126231 - RNA, 63 nt, Human
cauucaggucuguuuccaucagugcuuuguucucaaauauuagcccuuguuauagaccgaaug

SEQ ID NO: 4126232 - RNA, 78 nt, Human
cauucaguaaaugucacuuuucucccugcuggcccuugucugacauuacucagcauuucagaaguggcauauacuaug

SEQ ID NO: 4126233 - RNA, 85 nt, Human
cauucaguuuguucccagagcucugacaccagcugacuuagauuaaauagcagugagcuggaaaagcauucuggguauugguaug

SEQ ID NO: 4126234 - RNA, 71 nt, Human
cauucauaucuguuguuuucucauauguuggucuccuugaugaacauauaaagaaaggaacagggacaaug

SEQ ID NO: 4126235 - RNA, 93 nt, Human
cauucaugugacagacuguguucuagaaggggauguauagcaguaaaccaaguuuauaaaacucucugucuaaaugcaguuugcauucuaaug

SEQ ID NO: 4126236 - RNA, 83 nt, Human
cauucauuuaguggguccuugguucugugagcaaaagcaaacgaaugagguuccacagguaugaggccccaccugauaaaaug

SEQ ID NO: 4126237 - RNA, 55 nt, Human
cauuccuggcccgggcgccgucguaaggggcaggccgagcccgcggcccggggug

SEQ ID NO: 4126238 - RNA, 101 nt, Human
cauuccuucaagcgucccagagcucuaaggcgaagcugcuauagaaugauuugccuagaacuuugccuuagggcaaaccucaaguacugcuuuuaggaaug

SEQ ID NO: 4126239 - RNA, 56 nt, Human
cauuccuucuuccaucuccccaacugaaacuuggggagaucuugcuugaaggcaug

SEQ ID NO: 4126240 - RNA, 81 nt, Human
cauucggcaauaagaaugcggcucaugguagaaacaguguuucuaaaugguggcugcauugugcuauuagcccacagagug

SEQ ID NO: 4126241 - RNA, 57 nt, Human
cauucguucuuccucagaacccuguggacuaagcuggguucugggaggggcugacug

SEQ ID NO: 4126242 - RNA, 72 nt, Human
cauucuagcuaucuguguccagauccaagugucugagucucagaugagcugguccuacacaugugcuaucug

SEQ ID NO: 4126243 - RNA, 71 nt, Human
cauucuauuucacuugugaaguccuuugcaauuugaauucuaaaaagagaaaucacaagagagauaaagug

SEQ ID NO: 4126244 - RNA, 80 nt, Human
cauucuauuuugagccccugacaucuauuuucuugccaaaacugcugcacaauugguuguagaggggucagagaagggag

SEQ ID NO: 4126245 - RNA, 123 nt, Human
cauucuccauacucaaucacuacagccugcuuuggguugcuucauguuauaugcuucuggaaaagucgucaucauuuuccauccauaccacuuggagacagccagguuuugcacuggagagug

SEQ ID NO: 4126246 - RNA, 68 nt, Human
cauucuccugccagaaaagagggaguucaagucuucuuuccaggacuccuguguuuuggcugagacug

SEQ ID NO: 4126247 - RNA, 101 nt, Human
cauucuccugccucagucucccgaguagcugggacuacaggugcccgccaccaugcccggcuaauuuuugguauuuuuaguagagacgggguuucaccgug

SEQ ID NO: 4126248 - RNA, 58 nt, Human
cauucucuugacaggacagcccccuugcccuaucuggcuccccaugugaggagcgaug

SEQ ID NO: 4126249 - RNA, 101 nt, Human
cauucugacuguucaaccaguagcagagauacggaaccugacuagggucaauuucaaaccucauucaggucuguacuauugucuugcuguaacuaagaaug

SEQ ID NO: 4126250 - RNA, 93 nt, Human
cauucugagagccuucugaguuguaucauacauggauaauuugcauuaugaguuuuauccacguaugauaaaacucugaaggcuuucaaaaug

SEQ ID NO: 4126251 - RNA, 76 nt, Human
cauucugcauuuggaaggggcaggguagaaagaauggaauaugacgcuugcagacacauccuuuaucagcagaaug

SEQ ID NO: 4126252 - RNA, 64 nt, Human
cauucugugcuuuggggcuucagaugggacugacuagggcugggacacccagagcugcagagug

SEQ ID NO: 4126253 - RNA, 111 nt, Human
cauucuguguuuuuaugcuucuauuaugcauaugucugaauccauacgugauugauaacauuguuuuauauguuuuaaauauguguguaaaugguauauuaaugugguuug

SEQ ID NO: 4126254 - RNA, 94 nt, Human
cauucuuauuaaaugcucuaugcuaauauuagcuucuuugacuauuuuauuucagguuuuuaaguuuuauuggcuauagcacuucuugagggug

SEQ ID NO: 4126255 - RNA, 57 nt, Human
cauucuucaguccauaaguauucagagcacccacugugugcugagggcugggcaaug

SEQ ID NO: 4126256 - RNA, 84 nt, Human
cauucuucucuggucugccaccuucauccuccacuugcagccuccuuugcagugaccauacaggugcagagcaugagcaggaug

SEQ ID NO: 4126257 - RNA, 60 nt, Human
cauucuugcaccgugauggcuuuugacaaauuaaacaaagggugcauguuugcaagagug

SEQ ID NO: 4126258 - RNA, 94 nt, Human
ccagaaaccugaacacuggcuaugagggagauggggguuggaggagaucuugugcccuccaccaugguuaagugaauugaauuuagguauuugg

SEQ ID NO: 4126259 - RNA, 74 nt, Human
ccagaaagagcuguugucugcuuacuguucccaucuuagcaggaggcaguaugacuacaaacagcuuuuccugg

SEQ ID NO: 4126260 - RNA, 80 nt, Human
ccagaaauacucagauucacugccucccuugcaagaaugaggguggggugagggagagcaggguccugagauacuucugg

SEQ ID NO: 4126261 - RNA, 70 nt, Human
ccagaaccuuucuuuccuuggucugagcucccgacccacccccugucuggacuggagagaggaagucugg

SEQ ID NO: 4126262 - RNA, 84 nt, Human
ccagaacgaggaaggagcggaguugggauuccagcccaguuggacgcugaagucccuguuuuguuuacugccuccuguucaugg

SEQ ID NO: 4126263 - RNA, 90 nt, Human
ccagaagcgaggaagaggcaaggcaggauucuucucuagagccuccagagacagcaugagccugcugaugccuuguuuucugauuucugg

SEQ ID NO: 4126264 - RNA, 61 nt, Human
ccagaagcugcagugaucugggagcacacgcagugaucugggagcacacgcagugaucugg

SEQ ID NO: 4126265 - RNA, 92 nt, Human
ccagaagcugggacaaaggcauggaacagauucuccccuagagccuucagagggagcgugacccugccaaugccuugguuuuggacuuccgg

SEQ ID NO: 4126266 - RNA, 71 nt, Human
ccagaagggcuauugcagugacuggaaaacaguaaaagcuccucucacuagcuucacuagcuucccucugg

SEQ ID NO: 4126267 - RNA, 55 nt, Human
ccagaagucaaguaagaugaagauugaaaaauguccauuggacuuggcuucaugg

SEQ ID NO: 4126268 - RNA, 66 nt, Human
ccagaagucaggaaugagucuuacagggcugaaaauaaaaguguugacaggacuaguuccuucugg

SEQ ID NO: 4126269 - RNA, 59 nt, Human
ccagaauaguuucauugugccuucuucugagcagagacaguguaauguaauuguuaugg

SEQ ID NO: 4126270 - RNA, 66 nt, Human
ccagaauccccagccagcuugcuucccaguagccucugccaaugggagacacuggugggagcuugg

SEQ ID NO: 4126271 - RNA, 88 nt, Human
ccagaaucugcuaccagacgggacuuaucacagauguagagaucugaaaaauaacagauauauauuauaagcccuuucagaauucugg

SEQ ID NO: 4126272 - RNA, 69 nt, Human
ccagaaugcagugagaagcaguuaugauuugcaguugucaaaucauauaguugucacugcuaaucaugg

SEQ ID NO: 4126273 - RNA, 61 nt, Human
ccagaaugugugaaauuugauguaguccuucuuggcuucguuuuuuccucagauguucugg

SEQ ID NO: 4126274 - RNA, 70 nt, Human
ccagacacaccccugggcugggcacacaguuccuuauuuggguuuugugguuuucccaggugguagcugg

SEQ ID NO: 4126275 - RNA, 73 nt, Human
ccagacagccggccugagccaagagucagaaucuggcuaugaaagccaggugacuggcuggggcuggagaugg

SEQ ID NO: 4126276 - RNA, 62 nt, Human
ccagacaucuugguugcagcuuguucagacccugagcagagaauccagcuaagugugccugg

SEQ ID NO: 4126277 - RNA, 75 nt, Human
ccagaccacuagucucaugacagcccaacagcgugaggcccauggcagcuggcugcuguugagacuuguguuugg

SEQ ID NO: 4126278 - RNA, 56 nt, Human
ccagacccugcaggugauguguagcgcccagucucaggcaccaauagggaucgugg

SEQ ID NO: 4126279 - RNA, 80 nt, Human
ccagaccuuguuaucuccguguccuugugauaauucagaaauggaaaugaaugaacacaggccugggguacaaguucugg

SEQ ID NO: 4126280 - RNA, 60 nt, Human
ccagagaaaaaugugucccuguguaggcaacugcccugaggaauguauuauuccuucugg

SEQ ID NO: 4126281 - RNA, 57 nt, Human
ccagagaaagugaagcaaaugugugagguugcguuuguuagcauuuauuuaaucugg

SEQ ID NO: 4126282 - RNA, 66 nt, Human
ccagagaaauaaggggaaaauggcaaauaaugauaaaggcaucuuuccccuaguuaguuuuucugg

SEQ ID NO: 4126283 - RNA, 80 nt, Human
ccagagaaggcagagauaaguagacaggaugagucagcugccuuucuuaccuacaaguuauuccauuucugccaacuugg

SEQ ID NO: 4126284 - RNA, 58 nt, Human
ccagagagaguagaaguuuccaagggcuugugugccaagcauucugcuucuuuccugg

SEQ ID NO: 4126285 - RNA, 73 nt, Human
ccagagaugugauccuuugcuguguaaguuauguuuucuaauaaaaaugauacagaugggucagauuucaugg

SEQ ID NO: 4126286 - RNA, 81 nt, Human
ccagagcauguggagucuuugaggaauuucauagucuugguaccuuugaauauguuccucacaaguucucagaaugugugg

SEQ ID NO: 4126287 - RNA, 56 nt, Human
ccagagcucuuugauccacugccaggccucgggcaauggagccaaggugugucugg

SEQ ID NO: 4126288 - RNA, 55 nt, Human
ccagagcuugaauccaacaaagacugauaugggcagucuuuagccagagcucugg

SEQ ID NO: 4126289 - RNA, 83 nt, Human
ccagaggccuaaucacuggaggucaguagacauauaaguuuccaucuuaauuaauuauuugccuguaagacaaggccuugugg

SEQ ID NO: 4126290 - RNA, 58 nt, Human
cauauauuuugaauagccucugugauuuuuugggggugacaggggcagcacaauaaug

SEQ ID NO: 4126291 - RNA, 117 nt, Human
cauaucaaaauugcuaugucaaaauggccacuuugauaaaauuuuauagcaaacuccuagagaaagcaauaguauuuauuaaaguagcuuccauggcacccuaguucuuuugguaug

SEQ ID NO: 4126292 - RNA, 59 nt, Human
cauaucagcccaagcaaugggcucugguggaacuuccaggcuggugggggcuugacaug

SEQ ID NO: 4126293 - RNA, 64 nt, Human
cauauccuggcugcaccagugacccuucuuauccagaggggaaaucuuaguggagcugguuaug

SEQ ID NO: 4126294 - RNA, 77 nt, Human
cauaucuccugugaauugcaacaauugcaacaauauuguugaauauugaagcaauuuuccaguccugcagggauaug

SEQ ID NO: 4126295 - RNA, 93 nt, Human
cauaucugauaagaaauucccugcagcagcacuuaggacuuagcuugaaagcugcccaguggaauuauaaucuguccaaacucugagaaugug

SEQ ID NO: 4126296 - RNA, 67 nt, Human
cauaugauguaugacuguguucaaacuacagugguagaguuugaauaguugcaacauaaaucauaug

SEQ ID NO: 4126297 - RNA, 55 nt, Human
cauaugccugcaaauaccaguaauuggccuuacagugugaauaagcaggcauuug

SEQ ID NO: 4126298 - RNA, 71 nt, Human
cauaugggugaaccuugaaaauauuauguugagugaaagaaaccagucauaaaaggaccaccuauuguaug

SEQ ID NO: 4126299 - RNA, 77 nt, Human
cauauguguauauauagagugugcauauuuauguguguguuuacacagauguacacucauauauaauugcacacaug

SEQ ID NO: 4126300 - RNA, 63 nt, Human
cauauguuuagauguuguuuugugguuuguuuuucacaaauuacccucaacaucuagaugaug

SEQ ID NO: 4126301 - RNA, 92 nt, Human
cauauuaaaguguagcucuagaucauaggucauuauuauagucuguaaaaauuucaaaguaguuccagaucauagagcauuauuguagucug

SEQ ID NO: 4126302 - RNA, 111 nt, Human
cauauuagaauuacauccauuuucucccccuuagcucuugucuuuuuuucagagcauaaaauggaggagaugagaggaaggggaagggaagaaacuugcuuuucuaaaaug

SEQ ID NO: 4126303 - RNA, 55 nt, Human
cauauuccgguguguggguccccagugcugacuggggacuacaauuugcagugug

SEQ ID NO: 4126304 - RNA, 55 nt, Human
cauauucuguuggucacauagagcaacccuaguaugaugugggaaagagagugug

SEQ ID NO: 4126305 - RNA, 119 nt, Human
cauauugaacaucuguucuauaccaggcauaguguuugacacugagauaaauaaaacgaaaaaucuguuuuaagaagugcagaggcuuguaaggaauaaaauauaaaaaguuuaaugug

SEQ ID NO: 4126306 - RNA, 64 nt, Human
cauauugacaauucuaugcagagcaaagcuuccaaaaaggcaugcuaugaauucugucaaugug

SEQ ID NO: 4126307 - RNA, 97 nt, Human
cauauuuggagugucugauaaaagauauuuggaaaucaaagagcugauguaauucaaucuuugauuugacaauaucuugucagaaaugcuaaguaug

SEQ ID NO: 4126308 - RNA, 130 nt, Human
caucaaagcugcuucgcaagcccccucauuagcagggcuuaucugggggagcugcucauggaguccucgcugcucaugcccacagcccucccagagugcuaugcgaguggcugccgugcaguugggggug

SEQ ID NO: 4126309 - RNA, 59 nt, Human
caucaaagcuuuuuucuguguugggcauauacccaacacacacagacucagcuuggaug

SEQ ID NO: 4126310 - RNA, 63 nt, Human
caucaaauaggaauauuuggcaaaugagucugguguuuauggaucaaauguuucuauuuguug

SEQ ID NO: 4126311 - RNA, 83 nt, Human
caucaaauauaucaguggucacaagauacauauaggcccaaaagaggcuucaugaugauguugccaucaugguguggguggug

SEQ ID NO: 4126312 - RNA, 89 nt, Human
caucaaugggccugcuuaacaaugaaauguaucuaguuucuguguuuauuaucugaaaucaugaacaagguaggugaguagcccuggug

SEQ ID NO: 4126313 - RNA, 78 nt, Human
caucaauguacugaagguggggccagaaaaauaguacuuaauuacaguacuauguuucuuccuuuucauacaucuaug

SEQ ID NO: 4126314 - RNA, 70 nt, Human
caucaccaucagcagaugcucaaugaacaccuccuauuugggugugacauccuguugugugcuugugaug

SEQ ID NO: 4126315 - RNA, 78 nt, Human
caucaccugccucccaguuuuucuccacuaaggcaaucaugguugccuuagggacuaauagacugucaccagguuuug

SEQ ID NO: 4126316 - RNA, 57 nt, Human
caucacuacaaauuuaagaaauagcuacaguuaauucaguagauauuguagugaaug

SEQ ID NO: 4126317 - RNA, 64 nt, Human
caucagaaagaguccuggacuugacaucagaaaauccacauucaaaucuaggcucuuuucagug

SEQ ID NO: 4126318 - RNA, 64 nt, Human
caucagaaucugagucucugcccuaaaauugcucagucucgugggagagauagcauauucugug

SEQ ID NO: 4126319 - RNA, 75 nt, Human
caucagagccguuucaaagcacagcucacauugcaccuucuacugcgagccuucugcuuuggauuugcuuuuuug

SEQ ID NO: 4126320 - RNA, 83 nt, Human
caucagauuaaucuuuauuuauugagcacuuaauguauaauggacacugugcuaggugcuugggauaaguggaggacauggug

SEQ ID NO: 4126321 - RNA, 60 nt, Human
caucagcuuuucuauguggugaccagcacugucaguuuaauagccaccaaaaagcugaug

SEQ ID NO: 4126322 - RNA, 55 nt, Human
caucaggaaaggacgucuagccagcuguguugucggcccacuccccuuccugaug

SEQ ID NO: 4126323 - RNA, 57 nt, Human
caucaggauaaguuccagguggguggugcuuugcucaaccuggugugugccugugug

SEQ ID NO: 4126324 - RNA, 88 nt, Human
caucagggagaauuaagccucuuauuuuuaaacuguauuugccauugcaaaagcaguuaucugggaggaauuuaaaagcuucuuggug

SEQ ID NO: 4126325 - RNA, 94 nt, Human
caucagguagaaaugggcuuagucuccacagguccagcaggauggccuggggccugccccugggccugggaggccaggucuucaccaaccuaug

SEQ ID NO: 4126326 - RNA, 55 nt, Human
caucaguguguugccuugcucagacaccugggaugggaguugucugccauuggug

SEQ ID NO: 4126327 - RNA, 68 nt, Human
caucaucucucugaaucuguugucucauucccaaaauuggcaaaagaugccuaacucagaagaugcug

SEQ ID NO: 4126328 - RNA, 59 nt, Human
caucaucucuggcccuugaaguccccaagacagagagguaauacaaggccugagaugug

SEQ ID NO: 4126329 - RNA, 60 nt, Human
caucauuaccuuguaaccaauaguucaggauccugagguagcuggcuauaguuagugaug

SEQ ID NO: 4126330 - RNA, 120 nt, Human
caucauuucauaacguaaguaaaauagagagggagugaaauggaauagagagagaauaaaacucccauuacucuguggcuauuugauucucuauguauuuuauucacauaaugaaugaug

SEQ ID NO: 4126331 - RNA, 82 nt, Human
cauccaaucaugaaauauucaccacccacuuccugugugccaagcacugaggcugggcugaggguauagagagauaaagaug

SEQ ID NO: 4126332 - RNA, 62 nt, Human
cauccacucguuuaaaaauaucauugcuaccacugggacaccaaugaaugaacgaauggaug

SEQ ID NO: 4126333 - RNA, 61 nt, Human
cauccagcaucugcacugcagcgugcuccucguccagcacacuguggugugagggcugaug

SEQ ID NO: 4126334 - RNA, 68 nt, Human
ccaaacuuuugaauaccuugucucauguuaaugggaaacugagcaagaugaaggauucaagacgaagg

SEQ ID NO: 4126335 - RNA, 66 nt, Human
ccaaagaauuuggaaaaucugauggugugagcagcagccguuaguaucaggguuucccauucuugg

SEQ ID NO: 4126336 - RNA, 77 nt, Human
ccaaagacccagccugguuuuuauaggccagacauaaaucugagaaaguguuuauaaaauagacugggucuaucugg

SEQ ID NO: 4126337 - RNA, 58 nt, Human
ccaaagagcuagaauuauaggcaugagccaccacacccagccuauaacgguuuuuugg

SEQ ID NO: 4126338 - RNA, 76 nt, Human
ccaaagauauuaguugcuguuucuaccuaguuauuuaaauaaaauggcuuuuaaaaauagcauuuaauugagaggg

SEQ ID NO: 4126339 - RNA, 71 nt, Human
ccaaagccuaugcuguuugagcaaaaugccgagaaaagggagcgucacagacucaagggcauaggaucugg

SEQ ID NO: 4126340 - RNA, 65 nt, Human
ccaaagcuguccucucauuguuuguagcuacucccauuaucaacaugaagguaggaugguuuugg

SEQ ID NO: 4126341 - RNA, 58 nt, Human
ccaaaggccaggcacugagguucuggccuguuucucugcuucuggggccuggccuugg

SEQ ID NO: 4126342 - RNA, 69 nt, Human
ccaaagucaauacagcucguuaguuuuuagugauagggucaguaaauaacucagaugcucugacucagg

SEQ ID NO: 4126343 - RNA, 59 nt, Human
ccaaaguccauaguuugcauuagggcucacucuuggccuuguauauucuguggguuugg

SEQ ID NO: 4126344 - RNA, 60 nt, Human
ccaaaguccuuucuccaccugcaaagccaaauauguggaggccgagaacagggacucugg

SEQ ID NO: 4126345 - RNA, 58 nt, Human
ccaaagugcuaggauuacaggcaugagccacugcauccagccaucccaagcauuuugg

SEQ ID NO: 4126346 - RNA, 58 nt, Human
ccaaagugcuaggauuacaggugugagucaccacgccuggccuccgcguggccuuugg

SEQ ID NO: 4126347 - RNA, 129 nt, Human
ccaaauacagcucuggcuuagcaagaguuccauucugcgauccucaagcacauaagcggcauguaaacgcuaaugacucugggccuaccucgcugucccuacucucauccggggccuacccuguguugg

SEQ ID NO: 4126348 - RNA, 116 nt, Human
ccaaaucugugggugacuagauguccuguguaagccaggacaauccugagaaaucauggucauugucaaccguggccuacacuugaaagguauggcauguccccauuuucccuugg

SEQ ID NO: 4126349 - RNA, 61 nt, Human
ccagagucugcagcuacugugguguuggggaugagcugccagcaccaaaugcaggcucugg

SEQ ID NO: 4126350 - RNA, 129 nt, Human
ccagaguuugcugguggaccucaggauucgaagugugcaacagacggagugcgcuugcuguucagggcggccccgugcaggagcaccagcucacccucaggcaucucggacuggagggccagcagaagg

SEQ ID NO: 4126351 - RNA, 91 nt, Human
ccagauacaagugaauuuaagcccacauguauugaagcugcaagcuuaguuugcaauuuaugugcaagugguuuuguauuuauugaucugg

SEQ ID NO: 4126352 - RNA, 62 nt, Human
ccagauacuccuucccagucaacucaauuaucugcaccaaugaacugggaaaaaggcacugg

SEQ ID NO: 4126353 - RNA, 86 nt, Human
ccagauccauuuucuucucuaaucucaaugaucucaucuauaaagacaaguuggucuaaggguuaggaacgacagugcaggucagg

SEQ ID NO: 4126354 - RNA, 88 nt, Human
ccagaugacaggugcuguguaaaaaugaagcaaguuuuucauguucuauaaaacaugauaacuucauuacacaauagucagaguaugg

SEQ ID NO: 4126355 - RNA, 60 nt, Human
ccagaugagaccacacugcuggaaagacuuccugcucagauaguggguggucucucacgg

SEQ ID NO: 4126356 - RNA, 63 nt, Human
ccagaugcagcaaaaugacaggcuaaagaacaugugaaggcaugccuuuaauuugcuauuugg

SEQ ID NO: 4126357 - RNA, 73 nt, Human
ccagaugccagagccccaggacagcucuaguugccccagcggcuacaguggcacugggcuuuccuggcacugg

SEQ ID NO: 4126358 - RNA, 70 nt, Human
ccagaugccaggugacaguauggcucacguguggguuuguguccaccuuggcccugucccuggagccugg

SEQ ID NO: 4126359 - RNA, 87 nt, Human
ccagauggcgucaccucaguuaccauggcuugguccaagcagugacuucuguucaugggcucuggaauugaguggccaaaaaucugg

SEQ ID NO: 4126360 - RNA, 68 nt, Human
ccagauuaagucuugugaacuguuugaucuuucauuuuucauucuguucaguuccacacuuuaucugg

SEQ ID NO: 4126361 - RNA, 94 nt, Human
ccagauuauccaggauaaucauaucugaaaaaucuccuuugucaugaaagguaacauucacagguuucaggaaugaggaccuggauauauuugg

SEQ ID NO: 4126362 - RNA, 103 nt, Human
ccagcaaaauauccggagagagaugauguuuacuaugauguaaccuauguauaugcauacauuaccuuuuggaaaauuguauauucucugcauccccuuuugg

SEQ ID NO: 4126363 - RNA, 77 nt, Human
ccagcaagcaggcaugggaggccauccuauuggggaaagaugaggaugccaucagagugucuguguacaagggcugg

SEQ ID NO: 4126364 - RNA, 65 nt, Human
ccagcaagugcaugguauggucuccauuccugggugcauugauguggccugccaugcccugcugg

SEQ ID NO: 4126365 - RNA, 58 nt, Human
ccagcaagugugcacauacaugguuacugauaaucaggagugugcacuuugauccugg

SEQ ID NO: 4126366 - RNA, 100 nt, Human
ccagcaccucaaauuauuuaggcuugcaauuaggauggaaaguggacaaaugccacauuccauccuauuuguaugccuaaauaaugugcaggggugaugg

SEQ ID NO: 4126367 - RNA, 61 nt, Human
ccagcacuccugucucaagucuacauugucuacauugguguuugagauuaggagagccugg

SEQ ID NO: 4126368 - RNA, 64 nt, Human
ccagcacugaguggagaaucaauuugagccugggaaggcccggccauccaucucccuuugcugg

SEQ ID NO: 4126369 - RNA, 71 nt, Human
ccagcacuuccuggaguaaguuaagauguuccugcuuuggcccucagggaauuggacacuccagguguugg

SEQ ID NO: 4126370 - RNA, 63 nt, Human
ccagcagcagcguccaaggagaauggcagaagcugaggugcccuguggaggcugcucagcugg

SEQ ID NO: 4126371 - RNA, 57 nt, Human
ccagcagcccacaggcgucccuugucagcaaaaagcacccuggaaauggguggcugg

SEQ ID NO: 4126372 - RNA, 57 nt, Human
ccagcagggaaaaacccaccaacagaauuagugggacgcugggggacucucugcugg

SEQ ID NO: 4126373 - RNA, 68 nt, Human
ccagcagggaaauucaguuucuguccugggaggaaacagacucucauggaaagacuuggaugagcugg

SEQ ID NO: 4126374 - RNA, 70 nt, Human
ccagcagggacauaagaggaacauggaacaccuaaaggcuaguccagcugugucauuuggguccuucugg

SEQ ID NO: 4126375 - RNA, 55 nt, Human
ccagcaggggaauauuuuuaggggaaauacuucccuaaaaacauaacaccucugg

SEQ ID NO: 4126376 - RNA, 99 nt, Human
ccagcagguggucugcagagagaccccugggccagcacagguugaaucaauugucacugagcaguagagggucucuuuaggacacuuaggucugucugg

SEQ ID NO: 4126377 - RNA, 56 nt, Human
ccagcagucagguggagggaaugagaacuacagcucucccugccuuuuacugcugg

SEQ ID NO: 4126378 - RNA, 69 nt, Human
ccagcagucggaucugagccuguacauggaagacaucacgucauucuccugcucagagucccccugcgg

SEQ ID NO: 4126379 - RNA, 70 nt, Human
ccagcaguguggguagggauguagguaggugcauaguuagcugcucuccugcucccaacugcugcacugg

SEQ ID NO: 4126380 - RNA, 62 nt, Human
ccagcauagaucugucauauccuguugucagcggcagagugggugggcagaugugugcaugg

SEQ ID NO: 4126381 - RNA, 72 nt, Human
ccagcaucuguccuuucccucacaccugagaggaugggaggagacgaggacagcucagacugcaagugcugg

SEQ ID NO: 4126382 - RNA, 57 nt, Human
ccagcaugagaaaaugaaucagacgaugaccgcuuugagaaaugggcucugugcugg

SEQ ID NO: 4126383 - RNA, 94 nt, Human
ccagcauuuaggagggucuggcagucacuuuugcuugugcccugugguucacaugucugucuggcaugagugagguggguugaccucuuucugg

SEQ ID NO: 4126384 - RNA, 63 nt, Human
ccagccaccgcuuguuugcacucacaaguaaauugaugccgacaaccuggagcggagggcugg

SEQ ID NO: 4126385 - RNA, 56 nt, Human
ccagccagaaccacuggaacggugauucuuccugugaccacucugguucugcuugg

SEQ ID NO: 4126386 - RNA, 63 nt, Human
ccagccagagaggaaggaaugcacaguuucccuuugacggugagauuuccugcuucuuguugg

SEQ ID NO: 4126387 - RNA, 80 nt, Human
ccagccccacggcuucagucucaucaucgccugggcuggaguuuauccggugagauggaugaggccaggaaggggucugg

SEQ ID NO: 4126388 - RNA, 57 nt, Human
ccagccccuugaccuccuguccgggacuccauccacugaaccaggacaaggggcugg

SEQ ID NO: 4126389 - RNA, 87 nt, Human
ccagccccuugguuuagagagugugguuaccaggcaacuguuguucucuucucagccuuugugaccucuuucugagccuacgguagg

SEQ ID NO: 4126390 - RNA, 82 nt, Human
ccagcccuggcuuggaagccaccagauacucagcccauuguugccucgugacugggcagaucuuugguggcuaggccacugg

SEQ ID NO: 4126391 - RNA, 79 nt, Human
ccagcccugguccaucagugcagacuguaaguuggaaugucauaaucauguaacacaacugcuugagguccagaguggg

SEQ ID NO: 4126392 - RNA, 127 nt, Human
ccagcccuuagggggccugaggcuugcgggaccagugcuguugggcccagagagagaaccccuuuccucugcaguguuggcgagcccacuguguccugucuggcucugugccccccagcaggcuugg

SEQ ID NO: 4126393 - RNA, 73 nt, Human
ccagccgggccuauaccuugagcagggcggcccccacgacaggacaggagcagcccugagggugccaagcugg

SEQ ID NO: 4126394 - RNA, 89 nt, Human
ccagccuucgguggggugcggcagggggccugccuccaccaggcauagcauggaggccaccugaccugcuguuuccuacaugacccugg

SEQ ID NO: 4126395 - RNA, 56 nt, Human
ccagccuugcaccgagccagcccagccagggaagaguggagaggaggcaaggcugg

SEQ ID NO: 4126396 - RNA, 56 nt, Human
ccagcgcuucccaucagggaggacugcuuauaacucccuggauggaggagcccugg

SEQ ID NO: 4126397 - RNA, 57 nt, Human
ccagcguaaaccauaaaaguagaauuuguauaaggauucacagggugguuuaugggg

SEQ ID NO: 4126398 - RNA, 60 nt, Human
ccagcucagggucacauggcacauggcucauuugaggcagagccuguggcuugauguugg

SEQ ID NO: 4126399 - RNA, 62 nt, Human
ccagcucagggugcagcacaguuccuggagcugcaggagaacggcaccccaugggcuacagg

SEQ ID NO: 4126400 - RNA, 60 nt, Human
ccagcucaucucagugaaaugcccucaguccaaugaacacauucucaggagaugccuugg

SEQ ID NO: 4126401 - RNA, 63 nt, Human
ccagcuccaggucagugcaccccuguguuccacagcaggggagccccugguccugguggcugg

SEQ ID NO: 4126402 - RNA, 63 nt, Human
ccagcuccugaaagcuuugcuucuaagagugugcaccuuugaaagcuacuuucgggucacugg

SEQ ID NO: 4126403 - RNA, 87 nt, Human
ccagcuccuggacagagguggcaaggcggggggacucaaaggucuuugagggacucccggcccugccagccacguuucaggcccugg

SEQ ID NO: 4126404 - RNA, 59 nt, Human
ccagcugcuaucaugccauuucuuggaaaaugccugaaauucuguuaugguagaguugg

SEQ ID NO: 4126405 - RNA, 78 nt, Human
ccagcuggucuagaugcgggcagggaccuugucuguuuucacucaucucugcguccccagcaucgagcacaugucugg

SEQ ID NO: 4126406 - RNA, 56 nt, Human
ccagcugugccguguggauagcguuagauuccgcagcuuuccaccugcgcugcugg

SEQ ID NO: 4126407 - RNA, 59 nt, Human
ccagcuguuucugaugcuaggcaagacacguucugccagugagcaacagaaacauaugg

SEQ ID NO: 4126408 - RNA, 83 nt, Human
ccagcuuaugugaucuugggcaagucccugcccucccuggaacgaagggccagggggcuggacuuucccacacaacuugcugg

SEQ ID NO: 4126409 - RNA, 81 nt, Human
ccagcuuggucgcugcuguguugccagugucaccuuucuggagccagguggcucucuuaagggcagcguuuggucagcugg

SEQ ID NO: 4126410 - RNA, 62 nt, Human
ccaucauuucccgagagcccaaauagaacgcagugugagugugugugggugcugggaugagg

SEQ ID NO: 4126411 - RNA, 74 nt, Human
ccauccacguccucugcuucaugcccugaugcguguuucugcaugaagggacacggggcaggggagugaggggg

SEQ ID NO: 4126412 - RNA, 79 nt, Human
ccauccaguaagugugaggacugugcuaagugccaugagaaacucaggacacacugcaagagccuggcacuuacugagg

SEQ ID NO: 4126413 - RNA, 88 nt, Human
ccaucccaaaugcuuuuuuuacaaugugauguugacauuucuccaucaagaggugggucaguguuacauuauauagaacuuggggugg

SEQ ID NO: 4126414 - RNA, 55 nt, Human
ccaucccauuagaaaaaggucacacaucuuuggccccuuuuaauuucaggggugg

SEQ ID NO: 4126415 - RNA, 62 nt, Human
ccaucccccaucugguagggcauaguguuaagcugccugccuggagacagauggaggagugg

SEQ ID NO: 4126416 - RNA, 79 nt, Human
ccaucccucugcugugucccuggucuccuggcucuccacuaucuuacugucagccccagcggucaggcagcugggaugg

SEQ ID NO: 4126417 - RNA, 89 nt, Human
ccaucccuuuccuugagagccacugucuugguguaaugugaccacacugccuagucucaggagcaggggcuaaucuggggauggggugg

SEQ ID NO: 4126418 - RNA, 94 nt, Human
ccauccuuauccuccuaucccacagauccaauacacaugucaaggguuucaaauccugugcaauguugagguuucaggagaggggcagggaugg

SEQ ID NO: 4126419 - RNA, 69 nt, Human
ccaucguggaacuauggaccuagaguuggcaauggagaaaauagcuaccuagaaauacguuuuacaugg

SEQ ID NO: 4126420 - RNA, 120 nt, Human
ccaucguuauuacaguguugggugagagaaccuguuuauguuaccugcgacauuaugagaaaugcagauguaggaaaauaaacguauuuggcuuaguuucacaaagcaaauuuaccaugg

SEQ ID NO: 4126421 - RNA, 80 nt, Human
ccaucucaacuuggucccaggcucuucaaggaagacugcaaaaagggcaggauuucucuagcuuggacaaggcagggugg

SEQ ID NO: 4126422 - RNA, 66 nt, Human
ccaucucaauccccacaccccuggcccaguggucagagcuguggucacuguuggggaaugaggagg

SEQ ID NO: 4126423 - RNA, 75 nt, Human
ccaucucguuggcuggaacauuugcuuuuggagcccaaagcugccaugcaagaaguccaaccaucccgagguugg

SEQ ID NO: 4126424 - RNA, 80 nt, Human
ccaucucuuaagucuuugcuuuaaucauugagaguugaauauauccucucagauuucaaugugagcauuagugaguaugg

SEQ ID NO: 4126425 - RNA, 58 nt, Human
ccaucugacugccacccaggccaaggaccauccuuguaaacugggggggcaucagugg

SEQ ID NO: 4126426 - RNA, 63 nt, Human
ccaucugauaugugugggcucauacagaaaacaugcuguaaugugaagacauaaaucagaugg

SEQ ID NO: 4126427 - RNA, 99 nt, Human
ccaucugcugagggugaggggccuguggugcgcuauuucagacaccugcagguagacuggggucagggaucagagagcuccauaugcucagccuccugg

SEQ ID NO: 4126428 - RNA, 59 nt, Human
ccaucuguaggugacacaugagugaucaagcaggugcucauuuacagauuuacagaagg

SEQ ID NO: 4126429 - RNA, 74 nt, Human
ccaucuucaguuccuaagcacugugcauucuuuacuguagaagaauaaauguuggacuuaggaaagaagaaagg

SEQ ID NO: 4126430 - RNA, 72 nt, Human
ccaugaccauaccugggccugaagugacaaggaaaggaagcauuguugcuggagagggcuggauggccaugg

SEQ ID NO: 4126431 - RNA, 59 nt, Human
ccaugagauccuaugaugugauaguuaauuugaugugucaucuucacugggucacaagg

SEQ ID NO: 4126432 - RNA, 69 nt, Human
ccaugauggcaccagcaccuagauggggccucaauagguagcuguugaaggugguggugcaaagugugg

SEQ ID NO: 4126433 - RNA, 61 nt, Human
ccaugcaaagaaugugggcauagguggauaacggugacuaaaucccacagaauuugugugg

SEQ ID NO: 4126434 - RNA, 57 nt, Human
ccaugcagaaacugccagugggagugauguccgagucccacuggacgucugugcugg

SEQ ID NO: 4126435 - RNA, 63 nt, Human
ccaugcagcugaagaaagagugguuagaugaauguguccagcccccuuucuugagcucuuugg

SEQ ID NO: 4126436 - RNA, 113 nt, Human
ccaugcagucauucucaaaagggacaaucuggcagcucuccucggcggacucauccugugcaugguccuccaggguggcggcugccacuucuugguugguuuucuucucgugg

SEQ ID NO: 4126437 - RNA, 82 nt, Human
ccaugccugcucugcuccgcuguggcugccuggggauacggacgucucugcaccaagcccagcuggagaaggaaggccaugg

SEQ ID NO: 4126438 - RNA, 64 nt, Human
ccaugcucccuggaccugcauguccccaucggugaccuacauggauggagguccaggaguaggg

SEQ ID NO: 4126439 - RNA, 65 nt, Human
ccaugcucugggcuuuugaaguggcugaugacaucacuaguuuguuuacucagauaaaugcaugg

SEQ ID NO: 4126440 - RNA, 59 nt, Human
ccaugcuucucuuuuccucaccuaacucaagguagaaucugccuagggcgggaagcagg

SEQ ID NO: 4126441 - RNA, 58 nt, Human
ccauggcaauggucagucuauucaaacauaagccuggcauggugcuggccucccaugg

SEQ ID NO: 4126442 - RNA, 65 nt, Human
ccauggccaggaaagccaagguaaagcuccccagggucaaggagcccagguauccuaggacaugg

SEQ ID NO: 4126443 - RNA, 124 nt, Human
ccauggcuauguuauuucucauuuuuaguggaguaaaauuauguggugguuuauuuaagaaaaaauuuuugacauuuucuucaguaacacaaaccauuaccacugugugggaaaacugaccagg

SEQ ID NO: 4126444 - RNA, 68 nt, Human
ccaugggaacguauguugggaauauuguuccagccacugcaaaagggcucccagcauugcuucccagg

SEQ ID NO: 4126445 - RNA, 63 nt, Human
caucccagaucccagccugcagaauaaagauaacuaaacucugacagguugggauauggaaug

SEQ ID NO: 4126446 - RNA, 68 nt, Human
cauccccaugugcugggauuacaggcaccuuguaaucugccaguuuguccccauggccaugugagaug

SEQ ID NO: 4126447 - RNA, 64 nt, Human
cauccccuugugggcuggcagcauuuuugcuaacacugccuuaaaugaugcuacuggcaggaug

SEQ ID NO: 4126448 - RNA, 63 nt, Human
caucccugauuccuaguacagucaaaccugcguuuuaggccaugguggguacagggagggaug

SEQ ID NO: 4126449 - RNA, 74 nt, Human
caucccugguuccuguguuuaaauucuacauuacaagacuagaugcugagaaggaagagggaaagccagggaug

SEQ ID NO: 4126450 - RNA, 74 nt, Human
cauccuaagaacauuuccgaggguuugccaagggucaaucaugauuccaggcucccuuggagguguaaggacug

SEQ ID NO: 4126451 - RNA, 72 nt, Human
cauccuacagcaguuaugugucucuugacuucgauuuauucacuaaaauaguuugcauauaauugaugggug

SEQ ID NO: 4126452 - RNA, 121 nt, Human
cauccuagucucagauugugugggcccuguauccaagucccaucuguuaaauuuucuaguaagucccucugaaaagaagaugggaauugggcugggcgccagccauauaaugauuaagaug

SEQ ID NO: 4126453 - RNA, 63 nt, Human
cauccuccaacuccaugguucucagauucugucugucagaugaaaggggaccauggugugaug

SEQ ID NO: 4126454 - RNA, 62 nt, Human
cauccugccucagcugaggccgcuccacacaggugagcaggcgcagcaggagguccaugaug

SEQ ID NO: 4126455 - RNA, 98 nt, Human
cauccuucucucaagacagcucucggggcguggauggucagugcaggccggcagcaccgccugucucccauccaccccgagccuguucauccagggug

SEQ ID NO: 4126456 - RNA, 59 nt, Human
caucgacagccaagucuucuauuucagaauauugauuuauuucgcuuuggcuuuugaug

SEQ ID NO: 4126457 - RNA, 66 nt, Human
caucgcucagcaagagaggcagccugugauccugguuucauggcauuguccugcuucugaguguug

SEQ ID NO: 4126458 - RNA, 63 nt, Human
caucuaaguuuucuggaauaacuuggagcauuuugugcuuuuguuauuacaugaaacuucuug

SEQ ID NO: 4126459 - RNA, 71 nt, Human
caucuacuuauugugagguauugagauucacucaguagugaagcaaacauauauaguaagaucccuggaug

SEQ ID NO: 4126460 - RNA, 65 nt, Human
caucuaguaagcagcagagcaggggcagauucuagaacccuggcucucaauggcuguacuauaug

SEQ ID NO: 4126461 - RNA, 72 nt, Human
caucuauguaggggaugguucccuagaaaaccgggaagaauauaaaggauuucaggguccccccuggagaug

SEQ ID NO: 4126462 - RNA, 61 nt, Human
caucucagauccaucacuggauuuucuagauuuugucuagauuuguguuugggaugagaug

SEQ ID NO: 4126463 - RNA, 89 nt, Human
caucuccuugccaggccuugugagcugucugaaggcugcuggugcugccccugcugccucugcacagcucacucaagccagggagcaug

SEQ ID NO: 4126464 - RNA, 57 nt, Human
caucuccuuucuggagccugcucagggacagauucuggaagguggaaaugggugaug

SEQ ID NO: 4126465 - RNA, 60 nt, Human
caucucucugucucauccccucugaccgccucagccagggggagagaauggagcucggug

SEQ ID NO: 4126466 - RNA, 114 nt, Human
caucugauauuuuguaguugguauacagcaaaaguuaacuaacagaguaauuacagucuuauucugugaacaugguuaaucuauuuuuuugaugccaauacaauuaaucacaug

SEQ ID NO: 4126467 - RNA, 69 nt, Human
caucugaugggaauauaagagcucugaugggaaaaggauuuggcaggucuuuuacauucagucaugaug

SEQ ID NO: 4126468 - RNA, 76 nt, Human
caucugauguuucaaagguuauacagucaaaauugaaucaaugugauuguaaugugccuuuccaaaaaagaagaug

SEQ ID NO: 4126469 - RNA, 72 nt, Human
caucugcucagugcuuaucucuaaaguuggaaggaaacuaauugguuuuuagauugauggcauuaauagaug

SEQ ID NO: 4126470 - RNA, 75 nt, Human
caucuggaacucggucuuuggccuaaaaucacaauuaugugaaaacauuuuauacuuaagacagaguuuaaggug

SEQ ID NO: 4126471 - RNA, 90 nt, Human
caucuguacaugugcaucuauaucugauaacagucuuaauuuugcccagaaagugcuuuuauuauauacaggagucaugaauguacagug

SEQ ID NO: 4126472 - RNA, 96 nt, Human
caucuguccuucuucucugugauuuucguuauggcuuggggagcauuuaugucagaaccaccaugcuaggaacucucagggaaauaaagaucagug

SEQ ID NO: 4126473 - RNA, 66 nt, Human
caucugucuucauuuaugcaauuagcaauagaaauauggugauaaacagcugaugaagaccaguug

SEQ ID NO: 4126474 - RNA, 84 nt, Human
caucuguuccuggcaccugcaggaugagccagggccuuuuacagcgaaggccuuuguuuuaaugcauugcuacaagauuggaug

SEQ ID NO: 4126475 - RNA, 70 nt, Human
caucuguuugugccaacaucucaggucccugaauguaccccuucuccugagguugaaguauaaauugaug

SEQ ID NO: 4126476 - RNA, 81 nt, Human
caucuuaauuccuagaaccucugauuauguuacuugucauggcaaaaggagcuuugcagauggauuaaggaccuugagaug

SEQ ID NO: 4126477 - RNA, 90 nt, Human
caucuuagauuugccaguguucaguaugcauuaaguguucaauaaauguguguccacuugagucugaggcuguguguuuauucucugaug

SEQ ID NO: 4126478 - RNA, 75 nt, Human
caucuucccgucuucucuuggaaaugcccucucugaucagagacggaugagguaguuuggagaagagccaggaug

SEQ ID NO: 4126479 - RNA, 87 nt, Human
caucuuccuucaauuuaaaacuuuugggugguauagcaguacagauguuaaauauuuucuguguaugacuccagaggguaggggaug

SEQ ID NO: 4126480 - RNA, 105 nt, Human
caucuucguuuuuuccgagaaucugcaucuuagucaaaaucuguuuacuugaggcagauguuuguacuaggagguaaagauggauggcugaagcaauggaagaug

SEQ ID NO: 4126481 - RNA, 70 nt, Human
caucuucugggacuucucaguuggaucaguaggaucaguugaccugaaaagaggagucuuguagaaaaug

SEQ ID NO: 4126482 - RNA, 79 nt, Human
caucuugccugcuauucuguuguucaccauacucucccccacacuuaauggugucuggugcacaguagcagugcaaaug

SEQ ID NO: 4126483 - RNA, 75 nt, Human
caucuuggcuuugaaauccagucauuaggugagaaaccccuggacuaaaaacugucuuuccuaaagcaggagaug

SEQ ID NO: 4126484 - RNA, 88 nt, Human
ccaggcuguucucaaacucuugccuugugaucugccugccuuggccucccaaagugcugggauuacaagcgugagccacugcaccugg

SEQ ID NO: 4126485 - RNA, 58 nt, Human
ccaggcuugaagcuucagaguauguaagagaggugcagcucugguuauugaagcaggg

SEQ ID NO: 4126486 - RNA, 61 nt, Human
ccaggcuuuuagcugcauggcagaguuuguccugagaaagaucuugcccagcucagccugg

SEQ ID NO: 4126487 - RNA, 57 nt, Human
ccagggaagauuagaagccacucaucugacugagacgcauccucugacuuuucuugg

SEQ ID NO: 4126488 - RNA, 126 nt, Human
ccagggaagcugugguacuuggcuacaagugagagagaaggagguagcaguugaaguaagucucugccaucaguuuuucuuugccuugaaugcuuauuccaugaguuuuagcaguuuaauccuugg

SEQ ID NO: 4126489 - RNA, 58 nt, Human
ccagggacagaucaccuguuagccaaaaacagauauguuagcuaccuugauccccugg

SEQ ID NO: 4126490 - RNA, 77 nt, Human
ccagggacaugcuaaaagagugcucagaugcaugucuucauuccaagacccugcccagccccucuggcaaucccugg

SEQ ID NO: 4126491 - RNA, 56 nt, Human
ccagggaggagcauuucauggugugugucuugacaacaugacaaugcuaguccugg

SEQ ID NO: 4126492 - RNA, 65 nt, Human
ccagggaguucuugugaccuggcuaagguugugcaacuagcuugcuccagguacagaacuccagg

SEQ ID NO: 4126493 - RNA, 128 nt, Human
ccagggauauuucucuuauuuggcauuauggaaaauuuuggaggcugagaaguaagagaccagaccaucaaaucuuauuucauugauuucuaagacuaauagugaugucuuaaaagaauauguuaugg

SEQ ID NO: 4126494 - RNA, 59 nt, Human
ccagggcccacggccagaauagguggccagcccccgcccagugcuggcccuggcucugg

SEQ ID NO: 4126495 - RNA, 81 nt, Human
ccagggcccaggcaggcaggggaugugccagugguccuugccacgggccaccagcuuugccacccugcuccagggcccugg

SEQ ID NO: 4126496 - RNA, 61 nt, Human
ccagggcccaguauaaggcccaguagguacagaagagcuauugggccucuggugccucugg

SEQ ID NO: 4126497 - RNA, 67 nt, Human
ccagggcgaggcucacuggcuucaagacgagcucaucucucaccagccaggggaucuugggcccugg

SEQ ID NO: 4126498 - RNA, 65 nt, Human
ccagggcugugucccuaggggagcugcagaaagcagugcucuucuugucugggacacuugcaugg

SEQ ID NO: 4126499 - RNA, 80 nt, Human
ccagggcuucggcuggauguucaauuucccauccucuuuuuuacuuugcggaaacuucaagauucaagccuggagccugg

SEQ ID NO: 4126500 - RNA, 57 nt, Human
ccaggggagugugugauaaugugcagauucgcaugaaugcacacauacacccuuugg

SEQ ID NO: 4126501 - RNA, 64 nt, Human
ccagggggggaccacaccucaggggguggccucccccacacuccugaggguuucccagccuugg

SEQ ID NO: 4126502 - RNA, 69 nt, Human
ccagggucgguggcuugguugccaggugaaggaagaucugcuccuggcuucuuagaccaguggccuugg

SEQ ID NO: 4126503 - RNA, 71 nt, Human
ccagggucugagggacagaguccuggcccugcuccagauagccagguaagcacuuuggcuucagguuuugg

SEQ ID NO: 4126504 - RNA, 73 nt, Human
ccagggucugccccaggagcagggucugccucccuggauggacugguggcuccuugggcaggagggucccugg

SEQ ID NO: 4126505 - RNA, 68 nt, Human
caugcacaacauacucaagaggccuaccaucccaacacuuuuagucaucuugugugugugugugugug

SEQ ID NO: 4126506 - RNA, 76 nt, Human
caugcacaagggaugaugaaaucaaaucaccugucuaugacaucuuauuuuuaauuuauuauccaguguugucaug

SEQ ID NO: 4126507 - RNA, 61 nt, Human
caugcacagaucuucuaaaggguaguuccaacuugagcucuggaguuagugaucugggcug

SEQ ID NO: 4126508 - RNA, 74 nt, Human
caugcacagcgucugccugagucccuccacagugcccccuguauuuggacaccaaguagaagugacugaacaug

SEQ ID NO: 4126509 - RNA, 79 nt, Human
caugcacaucuuacagaugcagagaucaugacuucgguggaugagacuaaucuguaugaagcuguaggauauauguaug

SEQ ID NO: 4126510 - RNA, 70 nt, Human
caugcacgugccuccuggugugagagugucucugggauacaugcuucacagaccaggaggcugugauuug

SEQ ID NO: 4126511 - RNA, 59 nt, Human
caugcagaaggucaaagcaagauguaucauccuacucuuagucaggaccuuucugagug

SEQ ID NO: 4126512 - RNA, 67 nt, Human
caugcagacaauuagugaacaugggccccacuacaggcaaacugcauuuuuacaaguucuuuguaug

SEQ ID NO: 4126513 - RNA, 58 nt, Human
caugcagucuggagccuucuguacaacguauuucacaggagcacuuugugucugcaug

SEQ ID NO: 4126514 - RNA, 65 nt, Human
caugcaguguuguuaaaagauuagaaacuaaaagcaguucuaguguacuguucagcacuugcaug

SEQ ID NO: 4126515 - RNA, 70 nt, Human
caugcaguucacauucugaaguuuugaaaagcccuguuccuggggguagagccaggguggacacuguaug

SEQ ID NO: 4126516 - RNA, 67 nt, Human
caugcauauuuucuacuauaucgaaguggaaaauauauccaugugauauagugaaaaauaucucaug

SEQ ID NO: 4126517 - RNA, 67 nt, Human
caugcauggagcucacccucccagaacuccacacuuaaugcccacugaggaaggagagaaaugcaug

SEQ ID NO: 4126518 - RNA, 100 nt, Human
caugcauguguguauagauggauucauggacuuauggaugcauggcuauauggcuacauacauggauucauggauucagugaugcauugccacaugcaug

SEQ ID NO: 4126519 - RNA, 57 nt, Human
caugcauguuuauagggugcuuccugacacccaggaggcacucaggaaaugugagug

SEQ ID NO: 4126520 - RNA, 65 nt, Human
caugcauuauggcugagucucucaguggccaaauccacugaauuagaacacucaauaaugcacug

SEQ ID NO: 4126521 - RNA, 58 nt, Human
caugcauuguaauuuuuagucugcugugaaauuagagacuugaggaagaacaauguug

SEQ ID NO: 4126522 - RNA, 99 nt, Human
caugccaaggggagaguggaaaggugcacagagguaaauugcaugugugugucacacacagguguuuguuauacucaguuaucucacacccauagcaug

SEQ ID NO: 4126523 - RNA, 92 nt, Human
caugccuuuaacuucauugaagggaggaacaaugugugucugagcuagccacugaaggcacagccucccuucacaugagaaguuggggggug

SEQ ID NO: 4126524 - RNA, 56 nt, Human
caugcggauuuugaugucucuguaaucccacagagacaaauguuaguaguuuguug

SEQ ID NO: 4126525 - RNA, 110 nt, Human
caugcuacaauggcacacuugaguagcuucaauaggaacugcauggcagagccuuaggaauugaccgucuagcccugugaggaacaauucugugcccuuguucuagugug

SEQ ID NO: 4126526 - RNA, 63 nt, Human
caugcuaucugagcugucauuuuguuaccugacugaagguaaaggaguuauugccagggcaug

SEQ ID NO: 4126527 - RNA, 57 nt, Human
caugcuauuugugagugucuucguguaugcaaguguauauauguacaagugugugug

SEQ ID NO: 4126528 - RNA, 77 nt, Human
caugcucaugcacacauuuggaggaggcuugggccugcguucccaguaguagguuucuccuuuaaagcaugggugug

SEQ ID NO: 4126529 - RNA, 72 nt, Human
caugcugagucugaaacagcucaguggccguucucugucacagauagauugagcugugugggcucacucaug

SEQ ID NO: 4126530 - RNA, 56 nt, Human
caugcuuaugauuugcuaagccauaaagaaacuggauacugcagaucagaagccug

SEQ ID NO: 4126531 - RNA, 68 nt, Human
caugcuucucuucacagggaucauccugugggcuggggagccugggaugagagcugggacagaagcug

SEQ ID NO: 4126532 - RNA, 98 nt, Human
caugcuuggcaugugugacaguaaugggcaagacaauaugucuccugcuuucauggaauauauguucuccuucccaguauugcaucuuccacagcaug

SEQ ID NO: 4126533 - RNA, 58 nt, Human
caugcuuguccgaggugaguacuuucucaguaagaaagcuucuagggugggcaagaug

SEQ ID NO: 4126534 - RNA, 60 nt, Human
cauggaaccguuugcaguuuggguuaggccauaggcguuugauacaggaaugguucuaug

SEQ ID NO: 4126535 - RNA, 115 nt, Human
cauggaagugaugaaugugaagggugcauugcgcggggcugcacagccagcuguuuugcuguuacugucuucacagucucucuuguagugcagcuaguuccaguuuucuucuaug

SEQ ID NO: 4126536 - RNA, 66 nt, Human
cauggauuuuggagcaagcuggagagaacaucuccauauugacugauucuuucuaugccuuucaug

SEQ ID NO: 4126537 - RNA, 74 nt, Human
cauggcagaagacagagucuacauucuagacccguugacugagggcuugguugugugacuugguuugagccaug

SEQ ID NO: 4126538 - RNA, 71 nt, Human
cauggcagguggcacagccugggaccuggccucucccucuagguuucaugagcacuguuccaacugccaug

SEQ ID NO: 4126539 - RNA, 64 nt, Human
cauggcauuaggaccaugagccuggucagagagauacguauguccaggucaccccugagccaug

SEQ ID NO: 4126540 - RNA, 58 nt, Human
cauggccacagcgugguccagggagacaaagagcccaugagccaggcugacggcugug

SEQ ID NO: 4126541 - RNA, 70 nt, Human
cauggcccuguuuaugguaaggcuuagccuugagaccaaucauuuucuuugccuucuuugaacauucaug

SEQ ID NO: 4126542 - RNA, 111 nt, Human
cauggcucagagcucaaggggcccagcaguguccuggggcccuaaggccagcagccgggaaguuccugggcaguggguuccccaaggcacgguccccacagcucccacaug

SEQ ID NO: 4126543 - RNA, 60 nt, Human
cauggcugcgagaagaguggguugacagaaaagaaagauuuuaguugacucgaggcugug

SEQ ID NO: 4126544 - RNA, 55 nt, Human
cauggcugggugcagugauaguaggaagugugccuaugugucucuguguagccug

SEQ ID NO: 4126545 - RNA, 82 nt, Human
cauggcuugcucacacuagccucacauuaccuugauguuguuacauuccagguuggugcaggguagcucugagauggccaug

SEQ ID NO: 4126546 - RNA, 64 nt, Human
caugggaagggaaggaaagaaccagcaguagacauccagugacacuguuggccuuccacccaug

SEQ ID NO: 4126547 - RNA, 66 nt, Human
caugggcaauauugucuaccaguaugagucugacuagagacuuacacaguauccaagguucuuaug

SEQ ID NO: 4126548 - RNA, 62 nt, Human
caugggggugcugaggggcuuggcugggacuuugcccccugcccacuuggccaccuucuaug

SEQ ID NO: 4126549 - RNA, 70 nt, Human
cauggguauaugagaaccauggaggugcuaaagaaaaauagaagcauuuucuuauuaucauauuaccaug

SEQ ID NO: 4126550 - RNA, 65 nt, Human
caugggugggauggggucaacauguaccuggagagacuagaagcauaguccccuucccaaaggug

SEQ ID NO: 4126551 - RNA, 79 nt, Human
caugguagauggugacugagcagaacaaugggagccgauaccuugguuuauucaucucugcugcauaccauuugcuaug

SEQ ID NO: 4126552 - RNA, 58 nt, Human
caugguaggugcuuagauuucugcuaacugacuagcuuaguuauaguaucuagccaug

SEQ ID NO: 4126553 - RNA, 77 nt, Human
cauggucaagguguaagcagguugguucuuucugggggaaauacccguuccaggccucucugcuuagcuuguacaug

SEQ ID NO: 4126554 - RNA, 68 nt, Human
caugguccggagaggugggggcagcaucugggcccccuugcucagucaggcuccuugccuuucccaug

SEQ ID NO: 4126555 - RNA, 56 nt, Human
caugguuaaaauauggaaaauccagcuuuuccuagggaguccaaaaauuagccaug

SEQ ID NO: 4126556 - RNA, 73 nt, Human
caugguuaggagggguggccaggcuuaggcguuuaauuugauuaaugauaagcauacauucucuccuuuccug

SEQ ID NO: 4126557 - RNA, 104 nt, Human
cauguaaccaauuccuugcauucaagucccuuugccuugaacaaucuggugguuucucuuuccugguuggauucugauuaaugcaagacugaguugugaaugug

SEQ ID NO: 4126558 - RNA, 86 nt, Human
cauguaagaaaugugacuauccugagaccaccacacuguacaaaauacaagcuauauauggagguccugcaggauggcacaucaug

SEQ ID NO: 4126559 - RNA, 106 nt, Human
cauguaccaggcaugacaguguuuuguguuaagaaaguacaguauugaaacagcagagaaacuauugucauaguuuaauacagaacuugucagggccaguacacug

SEQ ID NO: 4126560 - RNA, 66 nt, Human
cccaaauaugucagggguggaaguggagaaggaauucacuauuucagugauucugcagaaguuggg

SEQ ID NO: 4126561 - RNA, 82 nt, Human
cccaaaucucuuucaguuuuauuccaaugugcagcacaguuucauuauuuuguguaugugccacaauggaaagagguuuggg

SEQ ID NO: 4126562 - RNA, 60 nt, Human
cccaaaugcauaguuuauaagaagguucccucuugguuuuguauaaucuauggguuuggg

SEQ ID NO: 4126563 - RNA, 89 nt, Human
cccaacaaucgagccuuguuuaugaaccuacauuuauuaagugaaaguauuuggaaacugaugguacauucaagcuugguugccauggg

SEQ ID NO: 4126564 - RNA, 81 nt, Human
cccaacaccuauuuuacugaugaucuggaggggcuggcaugguagccauuuugaucucugucauguguaauagccucuggg

SEQ ID NO: 4126565 - RNA, 64 nt, Human
cccaacuccaggcagggaggccacugagccacuugaaucagccucuuguucgcugcuuggaggg

SEQ ID NO: 4126566 - RNA, 63 nt, Human
cccaacucuaggaaaacagcaaacugguuuaugcugaacacagaugauguuccaggaacuggg

SEQ ID NO: 4126567 - RNA, 59 nt, Human
cccaacugccaggcccugggcagagauaaaagaauguggaugaguggcaggcagauggg

SEQ ID NO: 4126568 - RNA, 127 nt, Human
cccaacugggggaucuuccuguaacauuuuuaucuggugcuuucauagacaccauuuguguuugccaauaacagaauuaaaguguuuguggagccauagaauuuuaucagaacguuuaacuuugagg

SEQ ID NO: 4126569 - RNA, 87 nt, Human
cccaacuuugauuaccuaucacaggaaaaucugcccacacaagacugguaagucgauggggugauauuucuugaggaaucuuugagg

SEQ ID NO: 4126570 - RNA, 63 nt, Human
ccaggguuccagcagaggaggguuuguccagaauaaggaacccauggucugguggggcccugg

SEQ ID NO: 4126571 - RNA, 84 nt, Human
ccaggguuucauauaugcaauaauaauuuggugucuuuaaauuaaauuucuggcacuguauuuuggguguauuuucuuuucugg

SEQ ID NO: 4126572 - RNA, 76 nt, Human
ccagguaggcaccucagucaguuauuaugccagucacacaugugacagggcagguggcuacuggucauugccucgg

SEQ ID NO: 4126573 - RNA, 66 nt, Human
ccaggucuggaccauguggcuuucaucuagacaauggagaagcacuacgauaggugguccuccugg

SEQ ID NO: 4126574 - RNA, 59 nt, Human
ccaggugcaaugagacagcucugggcuacccaggccuuccugucucccauuguuucugg

SEQ ID NO: 4126575 - RNA, 93 nt, Human
ccaggugcugcgcuaggcucugggaacagacgggugggcaagagagcccaagcccacugcucagagccaagcaucuacuccagcauaucuugg

SEQ ID NO: 4126576 - RNA, 63 nt, Human
ccaggugggauguguggauccugagugcugaacagguaacaguaacgagauguccuaacuugg

SEQ ID NO: 4126577 - RNA, 57 nt, Human
ccaggugucaaaauaccauuucaggaaauaacucggaaaugaauuuugaucaccagg

SEQ ID NO: 4126578 - RNA, 62 nt, Human
ccaggugugcucugcaguggauacagcuguacguucggugacaguucggcagauacgcuugg

SEQ ID NO: 4126579 - RNA, 72 nt, Human
ccaggugugguggcacucaccuguaaucccagcuacucaggaggcugaggcaggagaguugcuugaaccugg

SEQ ID NO: 4126580 - RNA, 62 nt, Human
ccagguguuggaagggcaguggguaagguucccaagccagcccccacacccuucccacuugg

SEQ ID NO: 4126581 - RNA, 75 nt, Human
ccagguuagagauauuugaggcucuuuaagcaugaaaaugccccucauuaacacaaugucauuucuuagccaugg

SEQ ID NO: 4126582 - RNA, 60 nt, Human
ccagguucaaaaguggccuguaaaaucuuguuuacaagagauucuauguuuugagcuugg

SEQ ID NO: 4126583 - RNA, 72 nt, Human
ccagguucaagccauucuccugccucagccuccggaguagcugggaguacaggaaugugccaccacaccugg

SEQ ID NO: 4126584 - RNA, 69 nt, Human
ccagguucuuauguuuugucaguggagaaggguuugagucuagccagacuggcaauagcaaaugcuugg

SEQ ID NO: 4126585 - RNA, 109 nt, Human
ccagguucuugcuucaucccagccauagugggagccagcagcuugggggagcuucuguuccaucugcuuggcucuuagcaugugguugggacaagcuuucugggccugg

SEQ ID NO: 4126586 - RNA, 72 nt, Human
ccagguugaacccccaagaccuaugccucacccccgacccaggcagcaggaacucagggaguucucaccugg

SEQ ID NO: 4126587 - RNA, 57 nt, Human
ccagguugcuggcucuuggcagcccgaagcugaacuccgagcugagaguagcacugg

SEQ ID NO: 4126588 - RNA, 67 nt, Human
ccaguacauauccuuuacguuuuguucaucaacuuugauagacagcauagaggaaauguggaacugg

SEQ ID NO: 4126589 - RNA, 76 nt, Human
ccaguaccuaguauaucuuuaguacauagucacagcucuuaucccugcuggacugugaguucgagggcaggacugg

SEQ ID NO: 4126590 - RNA, 59 nt, Human
ccaguauuugcauguuagggaccuagacuaggucacugagagcacccaagucccucugg

SEQ ID NO: 4126591 - RNA, 99 nt, Human
ccagucaaaaaggcaaauucuguauguuuccacuuauaugguaccuagaguagucaaauucauagagaccaaagugaaaugaugguugccaggggcugg

SEQ ID NO: 4126592 - RNA, 106 nt, Human
ccagucacagcaugcauuuucugaguuuauuuccccuuagagaaucucaaggaaauuuauacuuugaaagggaaauaaacuccuuggagaaaugguugauucuagg

SEQ ID NO: 4126593 - RNA, 63 nt, Human
ccagucacagguguguuuauauaaguguaucacuggugugauuaugaauaugcacuguucugg

SEQ ID NO: 4126594 - RNA, 59 nt, Human
ccagucaguuucauuugccagcucucacauaccucaagagcuguuugaagcuauauugg

SEQ ID NO: 4126595 - RNA, 110 nt, Human
ccaguccuccuggucuugccuguccgcugugcauggggagggaagcgcucaggccuguuaccugccuggaguccucaacggggagaggcggagggagccggcuggacugg

SEQ ID NO: 4126596 - RNA, 58 nt, Human
ccagugcaggugagcaccaggugcagguggcugugccaggugucagggccaugccugg

SEQ ID NO: 4126597 - RNA, 63 nt, Human
ccagugcuggacucugcugcugggccuuggugggcaggggcagcaagagagguucagcuuugg

SEQ ID NO: 4126598 - RNA, 78 nt, Human
ccagugggcccuuacccugugccugucccagugugacccagcacaaagggggacugcagagggucuccugcccacugg

SEQ ID NO: 4126599 - RNA, 75 nt, Human
ccagugugcugucauuagcaucuagagggugcaacgugaauucaaucuucaggagucaagugagagcaugacugg

SEQ ID NO: 4126600 - RNA, 84 nt, Human
ccaguguggcuggagcuuagugaggugcaagacacagugggugagguaguugaugucuuguugauuucauucuagauacacugg

SEQ ID NO: 4126601 - RNA, 61 nt, Human
ccaguguuaaauuucuaauuugugaucauugaacuaugguuaugugagauguuuacauugg

SEQ ID NO: 4126602 - RNA, 63 nt, Human
ccaguguuccagagagcugauguggaccacaggggaagccucugccuucuggaacaucccugg

SEQ ID NO: 4126603 - RNA, 68 nt, Human
ccaguguucugguguucauuucaccaaggaaacccuuauuuuaaaaaaugaauauuaacagcuucugg

SEQ ID NO: 4126604 - RNA, 127 nt, Human
ccaguuaaauuugaauuucagauaaacaacgcguaaucaucugggauaaguacgucccaugcaauauaugggauauaccuauccuagaagauuaugcguuauuuaucugaaauucaaauucaaaugg

SEQ ID NO: 4126605 - RNA, 88 nt, Human
ccaguucccaguuugacaauugggagauauaaagcucagaguagaaaaguaaaaguuuuaaggucucucaguugguauuuuguuuugg

SEQ ID NO: 4126606 - RNA, 59 nt, Human
ccaguugauguuuagacucugcauggacacucaaugacauucucucuaggcacagcugg

SEQ ID NO: 4126607 - RNA, 75 nt, Human
ccauaaggaccgaggccuccucgccgccaccgccgccgggguggggccugggccuggggccgcgagucucguugg

SEQ ID NO: 4126608 - RNA, 60 nt, Human
ccauaaggagccagacauuccagaauuugaaggaaagggcagaaaauggcauccuuaugg

SEQ ID NO: 4126609 - RNA, 87 nt, Human
ccauacacacacuaaguaaagacaugacacauuggagaguaacuacacauauaugucaguguuguaauguuagauuaggugguuagg

SEQ ID NO: 4126610 - RNA, 55 nt, Human
ccauacccccaacaccccuuucaccagaacccucugugcagcacuuggggguagg

SEQ ID NO: 4126611 - RNA, 61 nt, Human
ccauaguggucauacagacuuguauuaguucuuggaacucucacuagcucugugaccuugg

SEQ ID NO: 4126612 - RNA, 67 nt, Human
ccauaucaaacgaaguuauuuuaauuacuuuacucuuucuucuuuuaguugaaauuguuugauaugg

SEQ ID NO: 4126613 - RNA, 77 nt, Human
ccauaucacaaaugaggaaaucgagcaucagagaauuuuccuaacuuucucaaauuugcucccucauaagugguagg

SEQ ID NO: 4126614 - RNA, 57 nt, Human
ccauaucucaauuucuugucagugugguuucuauauugagcaggugcagggaagugg

SEQ ID NO: 4126615 - RNA, 60 nt, Human
ccauaugaaauugccauuuuuauggaccaaaaaugguugcauaucagaaauuucauaugg

SEQ ID NO: 4126616 - RNA, 60 nt, Human
ccauauguuaaguaugaaaggugaccuuguuauuuggacaguuuuuacucuuaacugugg

SEQ ID NO: 4126617 - RNA, 80 nt, Human
ccauauuggaaugaaaucauugggguugaauaauccauucuuugguuuguuucagaaacauguguguuugcauuucuugg

SEQ ID NO: 4126618 - RNA, 57 nt, Human
ccaucagguaauuugcaccuaguugaauucucucaauaacugcuaaauucccugugg

SEQ ID NO: 4126619 - RNA, 81 nt, Human
ccaucagucugaguagucuggaguuuuccucugagagucauaggcauuagaaagaacuuuagauaucaugugucuugaugg

SEQ ID NO: 4126620 - RNA, 72 nt, Human
ccaucauuuuacaaacauuucagaauuuuaccuuuuagaaggaaacaguucugccuguuugagaagugcugg

SEQ ID NO: 4126621 - RNA, 78 nt, Human
ccauccauuauguuucccaggcucugcauccaggcuuuaucacacagacaacuuccuaugcagacuaagcauggaugg

SEQ ID NO: 4126622 - RNA, 76 nt, Human
ccauccccugggaaguuguaccuucuguuaugaagaugaccagccuccuaaugacagucaacucccagaugggugg

SEQ ID NO: 4126623 - RNA, 72 nt, Human
ccaucuaguggccaccaugccagcucucgggggacucgagggccccgggaggguggccaagcgagagauugg

SEQ ID NO: 4126624 - RNA, 89 nt, Human
ccaucucaguuaggccuugucacaggaauacauuacuaccuucugaggaagacagacugugcucuugggcaauagcugccacugugugg

SEQ ID NO: 4126625 - RNA, 58 nt, Human
ccaucuccacugucccugucaaacucccagcaaaugugcacagggaggguggggaugg

SEQ ID NO: 4126626 - RNA, 77 nt, Human
ccaucuccagggaaggcucugccugcuuggggccaucccaaagcacgcaguuuguuuuuaacccucaggacgaucgg

SEQ ID NO: 4126627 - RNA, 67 nt, Human
ccaucuccucgcaggccagaacacgccacgucacuccaggacgguucgccaccuuugagaagagagg

SEQ ID NO: 4126628 - RNA, 57 nt, Human
ccaucugcauacacaaacaggaagacuaccauagcuggccuggaaaaaugcagaugg

SEQ ID NO: 4126629 - RNA, 73 nt, Human
ccaucuggcuugaaguuaugcaccagcucagugugagacuaaacugugcuauggcugccacucaagccaaugg

SEQ ID NO: 4126630 - RNA, 62 nt, Human
ccaucugucaagauagacucugcauuacagagaagaugguggugaggucugcugacaguugg

SEQ ID NO: 4126631 - RNA, 113 nt, Human
ccaucugugccacccgcaugggacugccugggguccagugccuggcaaggcccugcuucuagaagcccucccugaugccagcccugagcucccagcccugugggaggcagugg

SEQ ID NO: 4126632 - RNA, 126 nt, Human
ccaucuuggccucugcauccccuuuccucacaucccugccaccuccuucuuuuccacccugggaaaaucuggcugagagauggagagcacuggggcugaggagagggcuugggaggcuggaggugg

SEQ ID NO: 4126633 - RNA, 71 nt, Human
ccaugaauguuaaacagcuuuuauauucacuaggaaaauauugugguguuuaaugggcuguuuauuucagg

SEQ ID NO: 4126634 - RNA, 96 nt, Human
ccaugacguacaucuuaaggaucauaguaaacauugauguggaagccauuuguuuuguaaucugguguggcugugauccucagaucugaaauaugg

SEQ ID NO: 4126635 - RNA, 82 nt, Human
cccaaccauguaucagcuuguaauuugugguguuggaagagcgaaacuggcuaacacaguacaagcaugauacauaacaggg

SEQ ID NO: 4126636 - RNA, 83 nt, Human
ccaaagggacugcaguuugacuacaucaugguuuacauuuucaguuugugaagaauaaaugguugagacugagucccagcugg

SEQ ID NO: 4126637 - RNA, 128 nt, Human
ccaaagguaaguguuuuaugaacgucacucaaugcuggugcuuacuuuccucaaaccugccccuguauaugucacagacacauugcaggagaguaaauaaaaggauuugggggcuucauuuuauacgg

SEQ ID NO: 4126638 - RNA, 59 nt, Human
ccaaaguccauaguuuacauaaggguucacucuuaguguugugcauucuauggguuugg

SEQ ID NO: 4126639 - RNA, 59 nt, Human
ccaaaguccauaguuuacauuacagcucacucuuaggguuguacauucuauggguuugg

SEQ ID NO: 4126640 - RNA, 59 nt, Human
ccaaauagucuuucauugaauuucacauauuaguucuuguuacuauggaagacauuugg

SEQ ID NO: 4126641 - RNA, 126 nt, Human
ccaaauaucugcauguuagaggcuuauguguuuaugaguaggcaggugucuucauggaacucugguaucuuccagauguucauagguauaucuggaacgaugaguaucuggccaaguaauauaugg

SEQ ID NO: 4126642 - RNA, 80 nt, Human
ccaaauccaggaacaaagccccauccaccuucaggacuuggcacaugagguaccuguggccugggguuuguucugagugg

SEQ ID NO: 4126643 - RNA, 56 nt, Human
ccaaaugacaguucucucugaguacugugcuagguacugaauuucugucauuuagg

SEQ ID NO: 4126644 - RNA, 79 nt, Human
ccaaaugucaauaguacugccguugugaagcucuuagaaggcauucugugaagcucugaacagcagcuaaggcaucugg

SEQ ID NO: 4126645 - RNA, 57 nt, Human
ccaaauucacauauacauuauuccuuccuuggggaggaguagugagguggaaugagg

SEQ ID NO: 4126646 - RNA, 70 nt, Human
ccaacagacacugacaggguccauggaauucuucgggaaauccuccaaggacucuugucagcuguguugg

SEQ ID NO: 4126647 - RNA, 79 nt, Human
ccaacaguucuggaggcugggaagucgaagaugaagaaccagcagguucagugucugaaaggcuuuuucucacagaugg

SEQ ID NO: 4126648 - RNA, 67 nt, Human
ccaacauacauguaaaggaaauuaugacauuaagugccauucauagugagaaacauguauguguagg

SEQ ID NO: 4126649 - RNA, 66 nt, Human
ccaaccagggaauuucuugaggguagaauguguuucaugaucccuggcaaaaucccugguacaugg

SEQ ID NO: 4126650 - RNA, 105 nt, Human
ccaaccauguauucugguuuguuguuguuguuguugcugcuguucagaaaauaagauccccagagccacagcaagauuaagggcagaaaauuacauuacuggugg

SEQ ID NO: 4126651 - RNA, 58 nt, Human
ccaacccacgaccguccuggauuccucucacucagagaagcugaggucaggugggugg

SEQ ID NO: 4126652 - RNA, 61 nt, Human
ccaacuguacaauggcuauaauacccucucccuuagagggcuuuuugggacauguaaaugg

SEQ ID NO: 4126653 - RNA, 59 nt, Human
ccaacuguaccucaaacucuggaaccugauuaaggaccagaucgcugaugugcacuugg

SEQ ID NO: 4126654 - RNA, 72 nt, Human
ccaacuugcuguauucagaagcucacucugccucccuggcuucaguucuccaaucugaaugggaugaguugg

SEQ ID NO: 4126655 - RNA, 92 nt, Human
ccaagaaucuuguaguucauuagcacaaaauaaauaaagugagcauuuaugauaaucuuauuaugugcuagagaauguacuagauacaaugg

SEQ ID NO: 4126656 - RNA, 58 nt, Human
ccaagacgggcuggcucggacuuggccaaccgcuauguccagagccggccugcugagg

SEQ ID NO: 4126657 - RNA, 77 nt, Human
ccaagagacccuggagcacauggcaggaggccuucccagccaaggcuccugcagagauguuccaugguuagacuugg

SEQ ID NO: 4126658 - RNA, 91 nt, Human
ccaagauuuuaaagauguuuagguaaaaaguuuuucaagagacaagacaaggacugauuaagugccuaaaaucuuuuagaaagaaugaugg

SEQ ID NO: 4126659 - RNA, 68 nt, Human
ccaagcaaagguuggaaauguuuaccaaaguagugauuucuugggcgucuucagcuuuuuaaguuugg

SEQ ID NO: 4126660 - RNA, 56 nt, Human
ccaagcaauuaaguccaucagaacggaacaaccguuaaggaaggugaauuucuugg

SEQ ID NO: 4126661 - RNA, 105 nt, Human
ccaagcagaggaacugccucucggggcagccaagaaccacagacccaggcggcugcagcuccuacuucugaacuucuggucucccgagugacagcuucugcaugg

SEQ ID NO: 4126662 - RNA, 82 nt, Human
ccaagccaaacccuccugaacuggccacugggugacaaucaucugccuguuccagaggcccagugagagggcuguagcuugg

SEQ ID NO: 4126663 - RNA, 67 nt, Human
ccaagcucuuccugcaccuguggcugagcucccugggccucaguggcaguggcugggcagagcuggg

SEQ ID NO: 4126664 - RNA, 56 nt, Human
ccaagcuucuuuccuacuacaguaacuuauacuauuucgcagugggaagaguuugg

SEQ ID NO: 4126665 - RNA, 57 nt, Human
ccaaggaagaagcugcccgacauaccugacugacuugucuggaugcccuucucuugg

SEQ ID NO: 4126666 - RNA, 55 nt, Human
ccaaggagaaugacaccauggauacuauacuguuuccugaagugaucuuucuugg

SEQ ID NO: 4126667 - RNA, 114 nt, Human
ccaaggaguuugguuuuguuuggguuuguucuagguauggucccagggaucccagaucaaaccaggccccugggccuauccuagaaccaaccuaagcucgcgcaucauuccugg

SEQ ID NO: 4126668 - RNA, 64 nt, Human
ccaaggcacacucugcaagguugaucucagaaagaaauauaauggugucugcagagguaccugg

SEQ ID NO: 4126669 - RNA, 60 nt, Human
ccaaggcccauaguuuacauuaagauucacucuuguguuguacauucuaugggauuuugg

SEQ ID NO: 4126670 - RNA, 90 nt, Human
ccaaggcucucuugcauugcucaggcccugggccauccugaagcuggcaggauggcuuugggcuuagccucaauaguggguggguucugg

SEQ ID NO: 4126671 - RNA, 55 nt, Human
ccaaggcuggagugcaguggcgcaauccuggcucacuguagccucugccuccugg

SEQ ID NO: 4126672 - RNA, 62 nt, Human
ccaaggcugggaaacaugcaggccucagcuccacccccaugcugagcccucuuccagccugg

SEQ ID NO: 4126673 - RNA, 57 nt, Human
ccaaggcugucauucaguagcugcugaaugcacgcucugcugagucacuggccuugg

SEQ ID NO: 4126674 - RNA, 57 nt, Human
ccaaggcuguggggcugugcagggccucucaagugguacagccguaaugguccuugg

SEQ ID NO: 4126675 - RNA, 81 nt, Human
ccaagggauggcauuaaaguucuuucucuuauuugguagcucuaacuaccaaauaagccaagggcuuuggauauuccuugg

SEQ ID NO: 4126676 - RNA, 101 nt, Human
ccaagggccuguuuucuuaccguugggguacuuguaucaaagcacagauaugaccgguuugugcggaucgguguccuccaaagaucaacagcggcucuugg

SEQ ID NO: 4126677 - RNA, 84 nt, Human
ccaaggguuucugcuucuucuugcuuuugcuuuaagcagggcagcuagaaaacauagcagggguaacagaaggaaagaaaaggg

SEQ ID NO: 4126678 - RNA, 92 nt, Human
ccaagguccaggugaguaggaggcucgcuggucgcacagccugcccccaccuuugggugcuggcucaagugugcuucccaccuggcaccugg

SEQ ID NO: 4126679 - RNA, 112 nt, Human
ccaaggucugacuggugcaggaagcuaggccuucauguuuugaagauuagaauaaacagcugcaauauuaggaucucaccauagaaggaagcugggcccaggaaggagcugg

SEQ ID NO: 4126680 - RNA, 57 nt, Human
ccaaguaagggcuagcaauugugcgcauuguugcugugguuguuuuucuuauuaugg

SEQ ID NO: 4126681 - RNA, 62 nt, Human
ccaaguccucuaccauuccuggaguguauaugguuccccaggagggugcaggaaggacuugg

SEQ ID NO: 4126682 - RNA, 128 nt, Human
ccaagucugcccugaguuuaguuccuugguugugaaacguggcucugcagugucaaugauccaacuugaagcagcugcugccaagcccgugcuccuggcccucaggucuuggauucagcaggaacugg

SEQ ID NO: 4126683 - RNA, 62 nt, Human
ccaagugagguggggagggauaggcuggagcagaucaguggccuugaugccucauuccuugg

SEQ ID NO: 4126684 - RNA, 62 nt, Human
ccaagugccccucauuguguucaucaucccccaaggcugagcauuaccugaggccacugugg

SEQ ID NO: 4126685 - RNA, 60 nt, Human
ccaaguuaaggcuuugggaacuugcccuaacuggcccaauaccuaaaguuugaacccugg

SEQ ID NO: 4126686 - RNA, 70 nt, Human
ccaaguuuguggcagagcuggaacugguacucaguuacuuggcuccgaguccagagcucccucaacuagg

SEQ ID NO: 4126687 - RNA, 71 nt, Human
ccaauagcagcugccuauucagggcuuggugaguccuugugcuuagcccuuucuggccguugcuucauugg

SEQ ID NO: 4126688 - RNA, 77 nt, Human
ccaauauauuucccugaaauuugaagaggaauuggagauuccuccuaaguugccaggaauuauuuagaaaugugugg

SEQ ID NO: 4126689 - RNA, 97 nt, Human
ccaauauuaaugagaaaugagucacuuauuauuggggugcaaauagagagauaaaugacaucaguaauuaagucucaagcccucuuugguauaaugg

SEQ ID NO: 4126690 - RNA, 72 nt, Human
ccaaucaaauuagagguuuguuuugaugaguucuuuauggugaaaugaucaaugaaaccuuauuugaauugg

SEQ ID NO: 4126691 - RNA, 95 nt, Human
ccaaucaacuuugcauuugcccuggggcuggccuggcagugcugcuaucagaauucagauacuggcccagcccugcucuagggccugaaguuugg

SEQ ID NO: 4126692 - RNA, 129 nt, Human
ccaaucaggagccggccugaccccgcccccucuucucacguuauuggcugagaggcccccagaugggcggggccggccgugggguuggggagggcagggggcggggaggaggaggaaggcgcuggcggg

SEQ ID NO: 4126693 - RNA, 69 nt, Human
ccaauccccucuuugccagcaucucugccuggccuaccuagcugagcaggccagcaauggaagggaugg

SEQ ID NO: 4126694 - RNA, 111 nt, Human
ccaaugaacacauuacguccucuguaugguuuuuaucaaguaacugccccagugcucccaugacgcugggcagguccacuuguuaggccagugagggccauaguucguugg

SEQ ID NO: 4126695 - RNA, 72 nt, Human
ccaaugauaagcagcagcaggauuaaagagggugcugugaggcauuuuuuuccuaaaugcugccugcuuugg

SEQ ID NO: 4126696 - RNA, 105 nt, Human
ccaauggggucagcaucauccaacagguugagagucugaauagacugaaaaauugaaugaaaguugaauucucuuucugccuuauugcuugaacugauauauugg

SEQ ID NO: 4126697 - RNA, 70 nt, Human
ccaaugggugguguuggagaugguugcauuaaggcauccuuaauacgacucauaauuuaacauaaauugg

SEQ ID NO: 4126698 - RNA, 55 nt, Human
ccaaugugaagucaagggagcagccagccugccuggacuggaagcuucauguugg

SEQ ID NO: 4126699 - RNA, 61 nt, Human
ccaauguuugugaucuacugacucguaagcucccuaugaggaaaauggaacaaaauauugg

SEQ ID NO: 4126700 - RNA, 58 nt, Human
ccaauucaccuccuaugcacauuuuucauaucauaaauuacugcaggguggugacugg

SEQ ID NO: 4126701 - RNA, 61 nt, Human
ccaauuccucagucguuugagccaaaauacuuccuuguugcuuaaaccacuaaggguuagg

SEQ ID NO: 4126702 - RNA, 98 nt, Human
ccaauugcucacuauauugcuugaggccaggaggugucaaccuccuggaguuagguaucuggucaaccuccuggccucaagcaauccuccugccuugg

SEQ ID NO: 4126703 - RNA, 67 nt, Human
ccaauuuucugauuggagaguugaggcuagaauuucauuuacuggaacacuucaagcagaagguugg

SEQ ID NO: 4126704 - RNA, 73 nt, Human
ccacaagccucucagguugguauucaucuccacaucuuacagauugugaacugaggcccagcgaggcuucugg

SEQ ID NO: 4126705 - RNA, 87 nt, Human
caugugcguguguacuuguuaaugugguagugcauaucugcuuguuuguguaugaaugugugcccacuuggugugcagauguaugug

SEQ ID NO: 4126706 - RNA, 73 nt, Human
caugugcucaggucauucagaacuuggccccagagcgugccugggccucugguucguggugaccuacgcuaug

SEQ ID NO: 4126707 - RNA, 60 nt, Human
caugugcuguagcagagaggaacccacuacagcugggauccuggacugacacagcgagug

SEQ ID NO: 4126708 - RNA, 76 nt, Human
cauguggcauuuuuaauacagauaacugaaugacaaaguaguaaucaguuuauagauauugcugaugucaaacaug

SEQ ID NO: 4126709 - RNA, 58 nt, Human
ccagcuccauugcuuaguguaagcagcuucacugcuuaguguaaggccaugcagcugg

SEQ ID NO: 4126710 - RNA, 129 nt, Human
ccagcuccuggggucuccagauagcacaggcugggccaucaggagacuccauccccuugaccacagugauuggcucagggaaagagcuccugucugucuagcgaguccuaaucccuagacuuuuucugg

SEQ ID NO: 4126711 - RNA, 73 nt, Human
ccagcucucucuucucauagcuaguucuuccuuugccccuauauuggaggaggcucugcuuaugaaaggcugg

SEQ ID NO: 4126712 - RNA, 73 nt, Human
ccagcucucuguccuccccacaguggacugcagccacaaugcucuccccaugugagauggaaaggggagcugg

SEQ ID NO: 4126713 - RNA, 61 nt, Human
ccagcugacaguagguuuacaguuuauaaucuggccuuuguaaaagcauuugucagccugg

SEQ ID NO: 4126714 - RNA, 55 nt, Human
ccagcugcagaauguuggggaagagggugccugauucucuggcuucuguagcugg

SEQ ID NO: 4126715 - RNA, 60 nt, Human
ccagcugcccauccugggaaauguauggaugguggcaaauauacccacugggguagcugg

SEQ ID NO: 4126716 - RNA, 61 nt, Human
ccagcugcucuucuggccugucagcccauucguggcagugagaagccauuagagcaggugg

SEQ ID NO: 4126717 - RNA, 57 nt, Human
ccagcuggaagagugcagaacuaacauaaaugauguccugcuagcaucugcagcugg

SEQ ID NO: 4126718 - RNA, 62 nt, Human
ccagcuggcacuguggcugcccucccaguggggaggccuccugcagccugggccacaucugg

SEQ ID NO: 4126719 - RNA, 76 nt, Human
ccagcugggccuugccaggggugucucgugacccagucccuuagagaaacaugcagacaucucagcaaggagcugg

SEQ ID NO: 4126720 - RNA, 77 nt, Human
ccagcugguggugcagguguugaugcaggacuuuucagaagagcgcuucugugggagaaacgccugcuguccagugg

SEQ ID NO: 4126721 - RNA, 60 nt, Human
ccagcuguucauuguugccaccccucgccacugucaggagguggcaaugagggcaguugg

SEQ ID NO: 4126722 - RNA, 62 nt, Human
ccagcuguuggaguaaagcacuuagauugaacuaugucuggguuuuaaagauccaaagcugg

SEQ ID NO: 4126723 - RNA, 68 nt, Human
ccagcuucuuacgagcugguacuuuuaauaauuuacuagaguguccuugagguuccuaggaaugcugg

SEQ ID NO: 4126724 - RNA, 60 nt, Human
cccaugggcagcugcagcagugguguguaucuuucauuuguugcuuuagcugugcagagg

SEQ ID NO: 4126725 - RNA, 83 nt, Human
cccauguucugcuuuuuucacuuaacaucauaucaugagcaaguuuccuugucauuacacaguucaguggaaagagugaaggg

SEQ ID NO: 4126726 - RNA, 86 nt, Human
cccauguuggcuguuggagcuuucuuuucccucauuuguuaugagucaauaaagaagcagaagguuuggacgugcuagccaguggg

SEQ ID NO: 4126727 - RNA, 92 nt, Human
cccauuaaccugaagacaacaaugcugaacugaggaaagccagguacuuauaaagcuuuucaucacaguguaguuccuucuagcuuaagagg

SEQ ID NO: 4126728 - RNA, 121 nt, Human
cccauuaggagaggguggcagguuugcuucaguaaugguagggcugucauuaucaucaccauugcuggaauggcaccugcuauauacugagcaccugcuugggccagacucuguccuaggg

SEQ ID NO: 4126729 - RNA, 81 nt, Human
cccauugcagucaaagauuggaccaauugcaguuuccaggacaucuggcuaaaauuaaucaguccaaguuugagcacuggg

SEQ ID NO: 4126730 - RNA, 59 nt, Human
cccauuuaucccaagguuacuccauguccaccaucuuaagucugccacugggauaaggg

SEQ ID NO: 4126731 - RNA, 61 nt, Human
cccauuucuugacucugaauuuggaauacaacaagacugcuuucagaaauaaggaaugagg

SEQ ID NO: 4126732 - RNA, 77 nt, Human
ccccaaacuuuggacggcggggcggggcccgagcccaggccauccgcggcgcuguccccgcgaguccagagcugggg

SEQ ID NO: 4126733 - RNA, 62 nt, Human
ccccaaaggggaugcucagugcaggggugaacacagccugcacugagacccucuuugcuggg

SEQ ID NO: 4126734 - RNA, 75 nt, Human
ccccaaauucugaguuucauuuugccuauaguucuuugggggaccauaucgcucaaaaggaaggucuguuugggg

SEQ ID NO: 4126735 - RNA, 62 nt, Human
ccccaacacugcacgugcagccucagaguacagccugcagggugcacaguggggugccgggg

SEQ ID NO: 4126736 - RNA, 57 nt, Human
ccccaacaugagagauccuucaugagagauugggucaacaugguauucuuucagggg

SEQ ID NO: 4126737 - RNA, 110 nt, Human
ccccacaauaucuucuuucuaucuuuuggaugucugcauaugauauggcuuggaaccguguccccaccaagucuucugucaaacugugacuucuaaugcuggaggugggg

SEQ ID NO: 4126738 - RNA, 68 nt, Human
ccccacaauguagaggcugaaagcaauuaacuaucuguuauugcucacaaaucuuuaggucagcgggg

SEQ ID NO: 4126739 - RNA, 65 nt, Human
ccccacaguccgugaggagccaugagaucuugcuuggagggccucuuacauggacugcucugggg

SEQ ID NO: 4126740 - RNA, 73 nt, Human
ccccaccaggcacucacagggaagacagggaaggaucuugagaaaguuuccuuugugcaggccuugggaaggg

SEQ ID NO: 4126741 - RNA, 120 nt, Human
ccccacccugcuacucaagaccauugaggccacgggguuugcugaaacuccucaaaaacugacaaguuuccacuggagacacuguggagaacauggucucagggaaauaacucucugggg

SEQ ID NO: 4126742 - RNA, 102 nt, Human
ccccacuagcgcugcccaaguccauuaggccccugccugaucugcccacuaauaaucccggcugucaggugccucaggaugagacaagcagaggggaugggg

SEQ ID NO: 4126743 - RNA, 55 nt, Human
ccccagaacacauggacaugaaucuaccuauucugugauucucugaguuuugggg

SEQ ID NO: 4126744 - RNA, 79 nt, Human
ccccagaacaccugucagacgcccugugguucguuagcuggcuugcagagcagccacaccuguccugccagcucugggg

SEQ ID NO: 4126745 - RNA, 66 nt, Human
ccccagaauuuuugaccugggaggaaucuuugcugagauguggauccuaggguagaaacagguagg

SEQ ID NO: 4126746 - RNA, 68 nt, Human
ccccagagcccagcacacggugcucaggggccaccugcuggcagucaggggcaugugugacucugggg

SEQ ID NO: 4126747 - RNA, 77 nt, Human
ccccagcacaugcaccuguagagaagcccccagguguugcagagagccccugagggaggguauaggcugugcugggg

SEQ ID NO: 4126748 - RNA, 62 nt, Human
ccccagcagcaccuggggcagugggucuccagcuuuacaccaaugcccuaggggaugcgggg

SEQ ID NO: 4126749 - RNA, 78 nt, Human
ccccagccagucugcuggcugucccuaccuggcuggauuucggccaggcaaagcgggggucaggggaagcaggcgggg

SEQ ID NO: 4126750 - RNA, 55 nt, Human
ccccagcccccagccucacccucauagaccaggagucagaggcugccagcugggg

SEQ ID NO: 4126751 - RNA, 129 nt, Human
ccccagccuuuaucuuugugugcaauugauuugugcuaauccuggaaugaguuugcugauuggaagccuuguccucaguagucuaggauuucaccuucaacccugucaccaucuggcuggacugugugg

SEQ ID NO: 4126752 - RNA, 56 nt, Human
ccccagcucugccaucaucugccuuugccugaaggugagaaacugcggaguggggg

SEQ ID NO: 4126753 - RNA, 58 nt, Human
ccccaggccaggagcauggcauugguggugcccaccaaauaggcuuccuggguugggg

SEQ ID NO: 4126754 - RNA, 128 nt, Human
ccccagggaguguggccucccuccaccccaugacucucgcuaccagggcccgguggucacuaugccacaaacucccaagcagggugcagaggcauggagggggcaacccuaaucauccucacaugggg

SEQ ID NO: 4126755 - RNA, 67 nt, Human
ccccagguggaggcaggaguugacagcauggauagagacagguaaggccacugaccuacaucugggg

SEQ ID NO: 4126756 - RNA, 76 nt, Human
ccccagucugaaugaugagugggacucugaauuccuuugacagagguggacccauucaaucaucagugaaaugggg

SEQ ID NO: 4126757 - RNA, 67 nt, Human
ccccagugcaucuguuaagacagugaguguugcccaauuugcaaguuguccaagguaugcacugggg

SEQ ID NO: 4126758 - RNA, 97 nt, Human
ccccauagcacaggcagcaagugugaggcacagcacagagcacauguacacgaguauuugugugcgugugugcgcaugugugcgcgugugaaggggg

SEQ ID NO: 4126759 - RNA, 60 nt, Human
ccccaucacaucaaaccuacucucagaaaagaacugaugaguccucugauguguggaagg

SEQ ID NO: 4126760 - RNA, 107 nt, Human
ccccaucccuagaagcccuugcuaacccagucuccucguguaaaccuuuccccagguuuacacuccaggcuggggugggcaaacaggggcucagcuauaggaugggg

SEQ ID NO: 4126761 - RNA, 57 nt, Human
ccccauggcaacugcugggggugagaggacgggucccaaggcagggaggacaugggg

SEQ ID NO: 4126762 - RNA, 74 nt, Human
ccccauuuaacacagaguuuuccaaccucugcacuauggauauuuugggcuggauaaucuuugucuuggagggg

SEQ ID NO: 4126763 - RNA, 78 nt, Human
cccccaaagcuggcuaagcccaggcugggcccucaucagccacgcggaaucagggcugggcuuguggccagcuggggg

SEQ ID NO: 4126764 - RNA, 72 nt, Human
cccccaaccugaggccuucucugcacaugccagaacaucugcaggaaaaaagugccuggggcagguacaggg

SEQ ID NO: 4126765 - RNA, 70 nt, Human
cccccaagaggcuuauagucuuccugucacucuccuugugagcauguaaauuggaaagccuuccuggggg

SEQ ID NO: 4126766 - RNA, 105 nt, Human
cccccaagucuuuuuacugauacaaaauauuuuacauguuuauggggguacauguauuuuuuauguacauaaaauguauaaugacugagucagagccuuuggggg

SEQ ID NO: 4126767 - RNA, 55 nt, Human
cccccacagggcggagauuaucugugaaagaaaauaucugcagcuccuggggagg

SEQ ID NO: 4126768 - RNA, 59 nt, Human
cccccagccagcagugcucagcuaaccuucuggagcaagcagugggguugguguggggg

SEQ ID NO: 4126769 - RNA, 96 nt, Human
cccccccugggcucauauggggaccugggccuuggauugacacuguaugcagcaaagacagcgucaaaggguccuggauaaaggcucugggagggg

SEQ ID NO: 4126770 - RNA, 130 nt, Human
cccccgggaguagagccucuggcagugagucaccacagccuccaucgcccguggccuuggacagagaagagcucggcgggccaugugggcagaggaggcuguacugcugggcaggccgcucccagcgggg

SEQ ID NO: 4126771 - RNA, 130 nt, Human
cccccuagagccauucaucuuuuuauguaugugcucugucucuccaauuagauuauaagcucuuaagaaaaagacccuugucuugauugaagagauagaaaaaauauuuagaaauguagcuccuucaucg

SEQ ID NO: 4126772 - RNA, 115 nt, Human
ccccgaccuuuuccuaguaaaaccccuuauuucucaucagauauaaguuugccuggaagauauaugucuggaauuugagguucaguuugcaugaggaggacaauuuuacuugggg

SEQ ID NO: 4126773 - RNA, 79 nt, Human
ccccgccccacaggaagcuggagacccuugaccuguccuacaaccggcuggugcacgugccccgcuuccugccgcgggg

SEQ ID NO: 4126774 - RNA, 128 nt, Human
ccccgcuugcucccaagacucuuguuguccugcuucaccguccccacaguaaccaggcccugcugccgucaauggaggcgagggggcgggagacagcagugacgucaaagcggaagaagggggcgggg

SEQ ID NO: 4126775 - RNA, 57 nt, Human
ccccgugacugugcccaucuuguggccuguaccugggcugguggcucagucaugggg

SEQ ID NO: 4126776 - RNA, 73 nt, Human
ccccgugguucugcuucucuuauuuucagcuggaauucuucagcugaagaaaugggaagcauucaacacuagg

SEQ ID NO: 4126777 - RNA, 78 nt, Human
ccccuaaaaugcauggcagccugcccugcuugccuugccaucgcuaguugcauuagccugggcaggcugcaaaagggg

SEQ ID NO: 4126778 - RNA, 95 nt, Human
ccccuaagagcugugcagagaaacucagauagcugauggucaauggacuaaaugagcuucacuguuuuucuaaugccagcacagacucuuauggg

SEQ ID NO: 4126779 - RNA, 93 nt, Human
ccccuagaauauuaaaugauaaaccuguggccacuaaauuugcuauaaggcugauuuuuaucuaaggucuucucuauuucugugcccuggggg

SEQ ID NO: 4126780 - RNA, 95 nt, Human
ccccucacucccggaaacgacguucagucccuggauuuagaguucuuuugcucaaauuggauuuuaaacuguugguuuucuguuuguuuaagggg

SEQ ID NO: 4126781 - RNA, 63 nt, Human
ccacaggaagaucucccagaggugcaaugaagaaacaccucuggauuggguucugucccgugg

SEQ ID NO: 4126782 - RNA, 59 nt, Human
ccacaggaccagaggagaucaccaugauaugguggagaaguccaaauauggugccuugg

SEQ ID NO: 4126783 - RNA, 55 nt, Human
ccacaggacuguggaaggaucucuugaggucaggaguuugagaccagccugcugg

SEQ ID NO: 4126784 - RNA, 60 nt, Human
ccacaggcacugcuaacuugggagggguucagauaccccuccugggcacaggccugaugg

SEQ ID NO: 4126785 - RNA, 76 nt, Human
ccccggaagugacugcaccuugcgguccuguggcuggagcaauucucccaggaaugaggggcggaggcuuccaagg

SEQ ID NO: 4126786 - RNA, 98 nt, Human
ccccggcuccuguuuuccacgugguucucacugcgguuacacacagccuguaggauauuguagaauacccaucauucuggaagucaggagaccuaggg

SEQ ID NO: 4126787 - RNA, 55 nt, Human
ccccgucagccucuccuuucugagaacugaguauggagucagggucuggcugggg

SEQ ID NO: 4126788 - RNA, 109 nt, Human
ccccgugcccuccucugcagacgugacacccgcaugccacugugccaggcagggcuucuggaggacgcaggugugggguuguuuguguugcauguggcccggcucgggg

SEQ ID NO: 4126789 - RNA, 91 nt, Human
ccccuaaugcacaucaauuguaaguugacuuaaaguuguacagauccuuccuuucugugcauugagucauuucaguaugucuauggagggg

SEQ ID NO: 4126790 - RNA, 64 nt, Human
ccccucaaagguucuuugagaacucugugcacauuuaugcagaauugauggagaacuuaagggg

SEQ ID NO: 4126791 - RNA, 129 nt, Human
ccccuccccgugucauaauaaaucucacguuuucugccggcuggaggcuuggagcggugaggugacguucauuucggccgcgugaaguuuucuuucaaacugggauugguggggaggccgggggaaggg

SEQ ID NO: 4126792 - RNA, 130 nt, Human
ccccuccugugaaguguuaagguccucguuuuuauuaaaugcaagugcuccugggagggcuaauagcuuaaguugagggaggcucuugcagaggaaggaugggaacagagacaguuuucuaggagguugg

SEQ ID NO: 4126793 - RNA, 83 nt, Human
ccccugccaaccaauggugcuggugcuggguguguuucauggcccugcccagcaggccucaugcaccagcuaccaugcagggg

SEQ ID NO: 4126794 - RNA, 62 nt, Human
ccccugcccaugauccgggacuagaggagcuauaaauccagucagugcgggauggucagggg

SEQ ID NO: 4126795 - RNA, 58 nt, Human
ccccuggagaauuucaacagagugguccauagaccacuugaaucaaauucuuaggugg

SEQ ID NO: 4126796 - RNA, 75 nt, Human
ccccuggcccauucauaaguaaaugauuaccuaauugugagguugggaauggaagacauuaugauggggcagggg

SEQ ID NO: 4126797 - RNA, 58 nt, Human
ccccugggaagugguaaagaaaauguggcagcuacuuuagaccaucuuccacaguggg

SEQ ID NO: 4126798 - RNA, 59 nt, Human
ccccugggccuggcgggucggcucugcugccggagccgguuuucaaguguccaucaggg

SEQ ID NO: 4126799 - RNA, 65 nt, Human
ccccugguguccgcaacgggcagcgcgucccggucgggucccgcauggucaguggccagcagggg

SEQ ID NO: 4126800 - RNA, 71 nt, Human
ccccuuccacucuguccccugugggaccgccgaccccuggggguuccgggaggaaagggagggaucugggg

SEQ ID NO: 4126801 - RNA, 128 nt, Human
ccccuuccccgccaccaccuccgucacaggccaucugucccugcacugcccacucucagcccuuuuaauagcaugggccuuggggaggaugguguccagggugguuucauaacaggccgggggagggg

SEQ ID NO: 4126802 - RNA, 77 nt, Human
ccccuuccccuccuagggcaguugaccugguggccucaucucucagcauccagcagccugccuugggagcuuagggg

SEQ ID NO: 4126803 - RNA, 62 nt, Human
ccccuucugcuuauuugcucuugcauuauaauccucacagcaaccuugagugggagaagggg

SEQ ID NO: 4126804 - RNA, 66 nt, Human
ccccuugcuacugauugaccuuggagaggugacuuggccucucugagccucaucuguaacaugggg

SEQ ID NO: 4126805 - RNA, 77 nt, Human
ccccuuggguaggaaagggagugaagggaaggucacuccugaguuuccaugcuuuccucuuucucuccuugaggugg

SEQ ID NO: 4126806 - RNA, 74 nt, Human
ccccuuuccagguaaggucacauucugaaguacuagggguuaagauuucaacaugucuuuuuuugguagagggg

SEQ ID NO: 4126807 - RNA, 94 nt, Human
ccccuuucccucucgggacuccucuagaaguugaggcccaugugcguggcgagcaucagcuaucugacgagugggcacugggagggugaggugg

SEQ ID NO: 4126808 - RNA, 82 nt, Human
ccccuuugccuccauggguugucuuugucuccacuuccagcuuuuauggggguggugagauguagcugauggggguuggggg

SEQ ID NO: 4126809 - RNA, 83 nt, Human
ccccuuuuccacuugagggucucugggcuacaaauugacaagcugagcagccucagagccugaggcccugagaggggaagggg

SEQ ID NO: 4126810 - RNA, 58 nt, Human
cccgaaggcggagguugcagugagccaagauugugccaccauugcacaccagccuggg

SEQ ID NO: 4126811 - RNA, 73 nt, Human
cccgacuuguuccucuagucucuguauuuccugccaacaggaagcugaauccagagacaggguccgauucagg

SEQ ID NO: 4126812 - RNA, 55 nt, Human
cccgaggaaccagagguagcuccguuuuggaaagagcuuccugguugcccauggg

SEQ ID NO: 4126813 - RNA, 84 nt, Human
cccgauuugcaucagugcucugagguccagggugaaaggaaagaauccccagcagcccgggccccagggcaaguggaggugggg

SEQ ID NO: 4126814 - RNA, 83 nt, Human
cccgcauggagauagacuuggguauauauguugcuacagaccuguacagacacuucugaauauguuuaucaucucuauauggg

SEQ ID NO: 4126815 - RNA, 91 nt, Human
cccgccgccgccgcgcucacgggcugccggguggcggcugagguuggcagugccgagcugccccgaggcggcgggaagcgcgcggcgcggg

SEQ ID NO: 4126816 - RNA, 57 nt, Human
cccgccuuggcaccaccaaguggccaucagcugaggggccgagggggugucaguggg

SEQ ID NO: 4126817 - RNA, 82 nt, Human
cccgcgucggcgccuucaggcccuuuuuguuguuaauaguuuuucuguguuaauugcagggagccugggggcgucgcuuggg

SEQ ID NO: 4126818 - RNA, 85 nt, Human
cccgcuucuuccagaccaaggaaggcugggcugugggagcuugguguuccuguccaguguccucguuuguaaaaugagagguggg

SEQ ID NO: 4126819 - RNA, 95 nt, Human
cccggaacggcaaucuccucacguguaaaguggagagagugacugucagucaccuggucagucagucacacucacugagguaggccugugguggg

SEQ ID NO: 4126820 - RNA, 55 nt, Human
cccggaggcagauguugcagugagcagagauugcaccacugcacuucagccuggg

SEQ ID NO: 4126821 - RNA, 55 nt, Human
cccggaggcggagcuugcagugagcugagaucgugccacugcacuccagccuggg

SEQ ID NO: 4126822 - RNA, 129 nt, Human
cccggauaccaguucaccauuugucccuucauucugcccaaaaaacugauggcuuccucugaaucugucaguaaggcaagugauuaucuaggaauugacagaagugauuaucuaggaauggagucuggg

SEQ ID NO: 4126823 - RNA, 61 nt, Human
cccggauccucagucgugcgggagucugggaggccuggcuuccucaggggugagguuuggg

SEQ ID NO: 4126824 - RNA, 111 nt, Human
cccggcacuuugggaggcugaggcgggcggaucacgaggucaggagaucgagaccauccuggcuaacaaggugaaaccccgucucuacuacaaauacaaaaauuagccggg

SEQ ID NO: 4126825 - RNA, 56 nt, Human
cccggcccagacucugggagcccccaaaggauggcucugaggaaguugggcacggg

SEQ ID NO: 4126826 - RNA, 57 nt, Human
cccggcgaggccccgaagcucucugaaagcuggacagccagucggggccaugcuggg

SEQ ID NO: 4126827 - RNA, 59 nt, Human
cccggcucagccuccugacccaggcccuggcuaagggcugcaggagucugugagucagg

SEQ ID NO: 4126828 - RNA, 56 nt, Human
cccgggaggaggaaguugcagugagccaaguucaagccacugcaccccagccuggg

SEQ ID NO: 4126829 - RNA, 69 nt, Human
cccgggccagccuucaccugcucuggucccagcugcccuugcuugggagagcuguggggccuggcaggg

SEQ ID NO: 4126830 - RNA, 64 nt, Human
cccggguucuggcuucagcaaacugaguaaaugauagugcuguuucuugagcuaggaaccuggg

SEQ ID NO: 4126831 - RNA, 92 nt, Human
cccgucauucccucagcacuuggcugaagacuagauguuuacucucuuauugggguaaaaugucaggauucuaggcacagcugaggguaggg

SEQ ID NO: 4126832 - RNA, 58 nt, Human
cccgucccuuuugcccgcuggugcaucugccuacucagcagcagggguugggggcggg

SEQ ID NO: 4126833 - RNA, 130 nt, Human
cccguccucacccccgggcucgucccccagccuccgccggcccgccugugaaugguggauuuaaugagcguuuguguggcguuggccggcgguucugaagaugcgcugaccuggagggagggcgcgaaag

SEQ ID NO: 4126834 - RNA, 81 nt, Human
cccgugauuuaguuauuuguacuauuugcaucauggagcuuuacccauagcucauccaaggucacauaacuugucaaaggg

SEQ ID NO: 4126835 - RNA, 62 nt, Human
cccguguuccugcucagagcuggcacaaccgaccaaggcagaagcucugagaggggcauggg

SEQ ID NO: 4126836 - RNA, 67 nt, Human
cccguuuucuguggguaauaccucauaccgugaccaggcacagaggcggaggagaccccgggauggg

SEQ ID NO: 4126837 - RNA, 99 nt, Human
cccuaaaggucuugugauuucagagucagagcuccauggaguuggugaggggccaacuuuuuggggaguugagcuuuugagucaaauguugacaaaggg

SEQ ID NO: 4126838 - RNA, 59 nt, Human
cccuaaccaaagggccuaaggaaugaccguuugguauuccuugggacccuuggugaggg

SEQ ID NO: 4126839 - RNA, 55 nt, Human
cccuaagacccucaagaucuccuaaaaagagagccuuccauccuaggguuuaggg

SEQ ID NO: 4126840 - RNA, 76 nt, Human
cccuaauuuuugaacugugucugcccgugaaguccuggaguuccauggcugugccucaaggcuacucaagaaaggg

SEQ ID NO: 4126841 - RNA, 67 nt, Human
cccuaccaggaggcucccaaggggcuaggccagguuuuggcaaggcccugguguuucagauguaggg

SEQ ID NO: 4126842 - RNA, 88 nt, Human
cccuagauggcacuucaguuuucccuccugcagguagcaucagcacuaggcacuguagugggggagaaauggucugagaugcacaggg

SEQ ID NO: 4126843 - RNA, 79 nt, Human
cccuaggaauuacagguuguguauucagugaucacagaguauagugauucacugaaggaagacacugucauaccugagg

SEQ ID NO: 4126844 - RNA, 80 nt, Human
cccuaggaguuuacaugacguguauuucaggcaaaccacuuaaccuuuccuaugaaaccaaucauguuugugucuuaggg

SEQ ID NO: 4126845 - RNA, 95 nt, Human
cccuauaaaaaugcaaacgcugcugggagggaucguaaaucauuaauaccacucugugaguuuaucagaucacuccuugcuauguuguaggaggg

SEQ ID NO: 4126846 - RNA, 107 nt, Human
cccuauauaaguagacuacaucuuguaaaacugcuugguauggucuaauagcacauuagauguacagagcuguuuuaaccauuugaccuaguuuuuacugcccaggg

SEQ ID NO: 4126847 - RNA, 78 nt, Human
cccuaucacugaccucuugucggagcuccagauauauccuguugucugcuggagaucuugacauugaagucuaugggg

SEQ ID NO: 4126848 - RNA, 118 nt, Human
cccuaucuccaucuucuuucuucuaggguauaauugacuuacuagguuuguuggaaauccuucugugugacucuucaguacaauaauaucuccaagaaguaauauuuguuagguaggg

SEQ ID NO: 4126849 - RNA, 66 nt, Human
cccuaucugucuccagggcaucugggcugagggcagcccuggagggaagcacugaggcagagaggg

SEQ ID NO: 4126850 - RNA, 105 nt, Human
cccuauuuucaaauaaggccacauucugaggcucagggaguauaugaauuuugggugacacuguucaacccccuagaguuggggagaguggcuguuggucuaggg

SEQ ID NO: 4126851 - RNA, 76 nt, Human
cccucaaagacuccugccuccucuguuugcugcaguagccauccugaagggcaagcaagcagguagagcugauggg

SEQ ID NO: 4126852 - RNA, 90 nt, Human
ccacagggaagggggcuggcuuucucgugugggucagagaauaguuuccaaggacaccacagagagugucagccuuugcaggccuuuugg

SEQ ID NO: 4126853 - RNA, 59 nt, Human
ccccuguccuuggaugcucuaugcaagguccauuaaaguacaggagaucuggcagaggg

SEQ ID NO: 4126854 - RNA, 78 nt, Human
ccccuuacuggaacaccauuuccucucugcuccucucccauagggagcacaugagcugauggugggcuggugaggagg

SEQ ID NO: 4126855 - RNA, 122 nt, Human
ccccuucccugaaauauguauggauuuaaguaaaauucuguuuccuuagcuuguaaguaaguagaugcaaaauggaguuuagauaugcuuauguucauguuuuggggaaaaaaaggaagggg

SEQ ID NO: 4126856 - RNA, 61 nt, Human
ccccuucccuucugggagauccauucugcuucagggccuggguccuugggggcggaagggg

SEQ ID NO: 4126857 - RNA, 95 nt, Human
ccccuuuacuggggucucagaaugguuuaguuaagacugaguguaaacugaaacaaauuaguuuuuaaacuauggaguauuugaagaaaaggugg

SEQ ID NO: 4126858 - RNA, 56 nt, Human
ccccuuuguuuugcccuugcagcagcaaaugaugcucuggcaggaagacggauggg

SEQ ID NO: 4126859 - RNA, 99 nt, Human
ccccuuuuagagguuuagcuggcagcugguacagugggucugcuauccucucuccuggaacagauccuguaucaggcacagcccagcuuugucuagggg

SEQ ID NO: 4126860 - RNA, 70 nt, Human
cccgacuagcugggauuacaggcaccugccaccacgccuggcuaauuuuuguauucuuaguagagacggg

SEQ ID NO: 4126861 - RNA, 57 nt, Human
cccgacucugggcugagccagggcccgaggcuggccccaggcgcugcccggagcggg

SEQ ID NO: 4126862 - RNA, 80 nt, Human
cccgaggccaugcagcagcuacuugggaaggaaagagugacccucccauuccuacccaaagcuuuggaugcaucuuaggg

SEQ ID NO: 4126863 - RNA, 64 nt, Human
cccgaggucagaggccuggugugagcuugguaugcccugccagggagcccugcugaccagaggg

SEQ ID NO: 4126864 - RNA, 61 nt, Human
cccgagugcaccugcguuccugcugguccgggagcugaucagguggauucacuaauuuggg

SEQ ID NO: 4126865 - RNA, 74 nt, Human
cccgcaaugcgccugcuuggggcucccugcagccucugggggaggcagggcggcccagagcaggccugugcugg

SEQ ID NO: 4126866 - RNA, 87 nt, Human
cccgcacgccacugcuggggguagcucugcguaggacuccacaauguuccccgcauuguuuugugcugacugcgcccagcucgcggg

SEQ ID NO: 4126867 - RNA, 58 nt, Human
cccgccaggaaccccugagggugaguggucccuguucuucccuaggggcuccugaggg

SEQ ID NO: 4126868 - RNA, 63 nt, Human
cccgccgccucaagccagcaguucuggaaaaugagugaaugcagacugccugcagguguuggg

SEQ ID NO: 4126869 - RNA, 73 nt, Human
cccgccggcccccagcucccaucccugccagccuucccacggcagggagccuuccuggcugugguguuccggg

SEQ ID NO: 4126870 - RNA, 103 nt, Human
cccgcgcuguccuggggagcgguuugcuuuccuaacucaucggauguaccacccuggauacacacccuugauaggacugcggugcucggccgggcagccuggg

SEQ ID NO: 4126871 - RNA, 77 nt, Human
cccgcuagugggccuaauuugcagugacccccuuuaccuuaagucauaguaucugcaacaaggccucauuucuuggg

SEQ ID NO: 4126872 - RNA, 70 nt, Human
cccgcugccaaguaaugccugggcucccgggcuacacgcugcuuagggcuccggcuuuugcaaggagggg

SEQ ID NO: 4126873 - RNA, 77 nt, Human
cccggaacaaacacggguagauggcaccaccugguggccgcacugccacacagccaucccagccugugguuccaggg

SEQ ID NO: 4126874 - RNA, 56 nt, Human
cccggagagcaggcuggccgugucggagcugagcugggccggggagcucuccaggg

SEQ ID NO: 4126875 - RNA, 56 nt, Human
cccggagggcccugcccaugguggcugaggaagaagugcaggugggcccuucuggg

SEQ ID NO: 4126876 - RNA, 90 nt, Human
cccggcgugggaacuggcagcuguaggaugcaugggugucaacccugccugccacguucagcuguaaccagagccgcccacggagccggg

SEQ ID NO: 4126877 - RNA, 55 nt, Human
cccggcucugagggccccaugugcuuugacuugguggaaggcugcucugccaggg

SEQ ID NO: 4126878 - RNA, 59 nt, Human
cccggcugucucuggcagcucagcggucagcagcgaugagaagccaggggagcgugagg

SEQ ID NO: 4126879 - RNA, 81 nt, Human
cccgggagccaucuuuaccagacaguguuaggagcuucacaauuagaccauccaacacuguacuggaagauggacccaggg

SEQ ID NO: 4126880 - RNA, 62 nt, Human
cccgggcggguuuccaucgcuggggguggccugguacccccaaagcugaguucccgccuagg

SEQ ID NO: 4126881 - RNA, 66 nt, Human
cccggggcguggguggcggccugguucugagucgcugcgcggggcuucagccgcccagucccuggg

SEQ ID NO: 4126882 - RNA, 72 nt, Human
cccgggggccccucggacacgugcgggccagaugccggccaccgggccccgccgugucgacaggcccugggg

SEQ ID NO: 4126883 - RNA, 129 nt, Human
cccggugacuuaauaggugagggccucaggugacaccgucgucugaagucuuggagaaaccuuuacuguccaggggaggagaggacuggcggucgguggggaucgaggcccagcacacaucacugggug

SEQ ID NO: 4126884 - RNA, 73 nt, Human
cccgguguggugguggaugucuguaaucucagcuaccugggaggcugaggcaggagaaucaccggaaccuggg

SEQ ID NO: 4126885 - RNA, 60 nt, Human
cccguagcucuuugccauuucuuagcuagaaggccagcuuucaguuacaggcacuguggg

SEQ ID NO: 4126886 - RNA, 60 nt, Human
cccguagcugccuuugggcuccugcuggggucucucccacagcggcgcgguagcggcggg

SEQ ID NO: 4126887 - RNA, 120 nt, Human
cccgucuugcagaauguucccuaagugccaggcuggcgucaggggcuguacauagauuaucucugauccccucuaagauugcuguugugguaagugugaguggcccauuuugcugauggg

SEQ ID NO: 4126888 - RNA, 57 nt, Human
cccguucagagccucaccgagccgugcugaggccucuguguagccaggucuggaggg

SEQ ID NO: 4126889 - RNA, 84 nt, Human
cccuaaaguguuaugaaugaucucuuaaaagauuuuaaugacuccaucagucaugaucuaguaggaaauggcacauucaaaggg

SEQ ID NO: 4126890 - RNA, 71 nt, Human
cccuaacuuccuuguacugacuccauuaaggcaacucaacaguauagucugaguacauagucaagcugggg

SEQ ID NO: 4126891 - RNA, 60 nt, Human
cccuaagaagcuaagacuaucuggguaaguguguacccaguagccuaaccuagcuuuggg

SEQ ID NO: 4126892 - RNA, 89 nt, Human
cccuaauacccagaaaaauacuugacacuggcaaguggcagucggcacucaaugaaugucuacaccguauguuguuguuuucugaaggg

SEQ ID NO: 4126893 - RNA, 63 nt, Human
cccuaaugagguguucuaucagucaggguccccccaggaaacagaugacauacucacuuaggg

SEQ ID NO: 4126894 - RNA, 114 nt, Human
cccuaccuccaucuugcaaacagcaggugucugauaggugugugguucauggcccaguggacacauuacauuggagaaggcacacccaccucuguuuucaggaugguggacggg

SEQ ID NO: 4126895 - RNA, 91 nt, Human
cccuacuccucaauuucauugucaucuaucuuagauauguguaguuacuacaaguucccaauagauggcaggaaaguguuuugaggaaggg

SEQ ID NO: 4126896 - RNA, 93 nt, Human
cccuacuggcuguguuacaucauauggaauuuaaagucacuggaauugagguagcagugagaagcaucauaugauuuaaaauaaagcuuuggg

SEQ ID NO: 4126897 - RNA, 85 nt, Human
cccuagauagaaggcaagugucauaugccacugcauccccaacucugaggacaaagccugguggcagguggaccuucauucaggg

SEQ ID NO: 4126898 - RNA, 65 nt, Human
cccuagccccagccucuugccaccuaaguguaaguguaaacucucaccaggagauggaggcaggg

SEQ ID NO: 4126899 - RNA, 60 nt, Human
cccuaggggcaaugauggugcuggggugugauguuuucaguaugaaguugugcuuggagg

SEQ ID NO: 4126900 - RNA, 58 nt, Human
cccuagguaagggucacaguucauauuccaaauaugacugggaugauauugcacaggg

SEQ ID NO: 4126901 - RNA, 81 nt, Human
cccuagguguccucucaaggagccgagauuaccauggcuauuggugggcugaggggccuugaugacaggcagcaccaaggg

SEQ ID NO: 4126902 - RNA, 84 nt, Human
cccuaugaugaagaaauacuaggaauauucauaauggaaagccuuuuuguguaugucugugaauguccuguauuaucaauaggg

SEQ ID NO: 4126903 - RNA, 55 nt, Human
cccucacuguccuugggcccuuggccucugcugagggcgugggggacgguguugg

SEQ ID NO: 4126904 - RNA, 75 nt, Human
cccucagccucaguuuucuuuccaggaugacgucuucacagaguugugauggaggugaaaugagauuuuguaggg

SEQ ID NO: 4126905 - RNA, 82 nt, Human
cccucagggaauagcaacuuuggcuuuguucuugggauuuuggugaaaucagaguagaauugagccaggguccugguuaggg

SEQ ID NO: 4126906 - RNA, 59 nt, Human
cccucauacccugccccacugaggcugacucuucagugcuaaaagagcuggugugaagg

SEQ ID NO: 4126907 - RNA, 58 nt, Human
cccucaucuuuggcccugacacccucggauugccaggcuugucucagaagaugcuggg

SEQ ID NO: 4126908 - RNA, 68 nt, Human
cccuccaggaaagucaggcuuagauaucccuugcuguguuucugccuuaucuuugcugagacgauggg

SEQ ID NO: 4126909 - RNA, 64 nt, Human
cccuccaggcacugcccucuuccagagaaacccuccaggccacagagagggcugcuggggaggg

SEQ ID NO: 4126910 - RNA, 59 nt, Human
cccuccagggcgcugggggugucuccauguaucacaccauccugcaguuccuaggaggg

SEQ ID NO: 4126911 - RNA, 100 nt, Human
cccucccagugcugauccugccugccugccaagaaccguguugcccucgggggacaacagugguuucagguucccuccaggaagcaugccuggggagagg

SEQ ID NO: 4126912 - RNA, 76 nt, Human
cccuccccugcacucacccugauuuuuuucucccucuaauugagggagcaaagguuucaggguuguggccucuggg

SEQ ID NO: 4126913 - RNA, 86 nt, Human
cccucccucaggggcugugcauuucccagccaucucuuugaaguuaggcuuuuuggguuggaggaguaguuugccuuuuggauggg

SEQ ID NO: 4126914 - RNA, 64 nt, Human
cccucccuuugcagcagugcaucucacgguacagauuagaguuuagccugcagaaaaggcaggg

SEQ ID NO: 4126915 - RNA, 97 nt, Human
cccuccgcccccagcuccuuggccugggucacaccagggucccggucggauuuagccgggcugcuccgggucgggugaggcacugggugcguguggg

SEQ ID NO: 4126916 - RNA, 129 nt, Human
cccuccuucaauacgcccuugaaauuccccugcuucacagccuuacugagauccacuucuagcacuuuucugaaggccucuggaggacucccaguaagauguccagagggcacauuuagggacgugugg

SEQ ID NO: 4126917 - RNA, 72 nt, Human
ccagcuuggaauaugccauuguaccuucaaucucagaagugcuacaucacaauaguauaaaauucaugcugg

SEQ ID NO: 4126918 - RNA, 56 nt, Human
ccagcuuguuugaagcucgucaggauguuccuugcagaccccgcuuagccagcugg

SEQ ID NO: 4126919 - RNA, 92 nt, Human
ccagcuuuaagggggcuuagacagacagagaauuuaaauaccucuuuagguuauaguggagauauuuagcugugucuauaaggcccagcugg

SEQ ID NO: 4126920 - RNA, 59 nt, Human
ccagcuuugugcaaugcagucucuaaacacuccucuagggaugacaauucaagggcugg

SEQ ID NO: 4126921 - RNA, 62 nt, Human
ccagcuuuucagaaucugccugaaaguggccuaagaauggcacaggccuucaggauggcugg

SEQ ID NO: 4126922 - RNA, 76 nt, Human
ccaggaaaauaccaagcuuuaacccaguuggcaguuccuuguggcauacauuugguuagacuuggguuuuuccugg

SEQ ID NO: 4126923 - RNA, 56 nt, Human
ccaggaaagaggaagaacgcauauguaaaccaugccuaccguuuuccuuuuccugg

SEQ ID NO: 4126924 - RNA, 64 nt, Human
ccaggaaagcaaccaguccacauuggagcaggaaaacuccaggcuucaggagugguuuccaagg

SEQ ID NO: 4126925 - RNA, 80 nt, Human
ccaggaagccagaagcuucguggcucuucaaaugaagucucuuucagaagucugccugccggggccuuuguguuaccugg

SEQ ID NO: 4126926 - RNA, 61 nt, Human
ccaggaagccucagaugcugagcuucccacauuccugcucccagcucccugaucuuccugg

SEQ ID NO: 4126927 - RNA, 59 nt, Human
ccaggaagugauggagagaguaucugggcugcucuggguaaaucccauccuuucucugg

SEQ ID NO: 4126928 - RNA, 75 nt, Human
auggguguaagauuauuuugugcaauaaucggaaaccaccaaauauuaacaaaguaauuucuacuuugcagacau

SEQ ID NO: 4126929 - RNA, 63 nt, Human
auggguuaacacaugcaauugcacuuugcaaauucugaagugacauacaaauguguuguucau

SEQ ID NO: 4126930 - RNA, 66 nt, Human
auggguuuggacauguugagucugauaugccauugugacauucagguagcaguguccgauagacau

SEQ ID NO: 4126931 - RNA, 61 nt, Human
augguaacuuguacauuucccuguguucacagcagcacaguggaaagaaacgaauuagcau

SEQ ID NO: 4126932 - RNA, 83 nt, Human
augguaaggguauguguuuuuaaguaaacauuuguucauguguauauguguuagauuaccuuguaaaacauauuccuuauugu

SEQ ID NO: 4126933 - RNA, 73 nt, Human
augguaggccaagguauacaaugacuaugauaaugaaugauauaauagucauuguauaccuuggccuauccau

SEQ ID NO: 4126934 - RNA, 81 nt, Human
augguaucuggaugcccauaaaauagagucuaaacucuugauugugauguaaaggcucucaauaugauccaguccuaccau

SEQ ID NO: 4126935 - RNA, 102 nt, Human
augguauguaucugcuuuuccagaguuguaaguguugacaaagacaaugucauucuggauauugucaacacuuacaacuccggaaaagcagauacauaccau

SEQ ID NO: 4126936 - RNA, 121 nt, Human
auggucccacucuacucugcaauuggucagcuuauauuuuuaguguaauagucuguucuggguaucacauuuuauguagaauauagguacaccaagaaguauucagaggagggaggaccau

SEQ ID NO: 4126937 - RNA, 74 nt, Human
auggucuacaaagccauucaggaucuagcccucacuuuuuuugguagaucccuugugguuuuuaguucagccau

SEQ ID NO: 4126938 - RNA, 82 nt, Human
auggucuugaucuccucaccuugugauccucuugccuuggccucccaaagugcugggauuacaggccugagucaagauacau

SEQ ID NO: 4126939 - RNA, 79 nt, Human
auggucuugccaauauuagcuguguaacucugguuggauaaauugcuuaaccuuguugaguuuggcuaaccaagaccau

SEQ ID NO: 4126940 - RNA, 76 nt, Human
auggugaaguacuucucuccugauggcugaacuguggcucggggcugcauguagaccaggagggacauuucagcau

SEQ ID NO: 4126941 - RNA, 81 nt, Human
auggugagcuuaugauguuuacauaaaaguucuauaagcuguguauacaguuuuuuauguaaaauauuaaaagacuaugau

SEQ ID NO: 4126942 - RNA, 86 nt, Human
auggugaguccuuggaaggcaggaacccugugugcgccuguuucugcagagcacagugcaguuucugcuaacagagggccuaucau

SEQ ID NO: 4126943 - RNA, 56 nt, Human
auggugaucagcccuuguaucuuucaccaauaagaaaacagggcucuggacgccau

SEQ ID NO: 4126944 - RNA, 86 nt, Human
auggugcagagaguguggggucuucucuuggccugggcugauugccuguucucugugccuaggcagaaacccccacacccaaccau

SEQ ID NO: 4126945 - RNA, 68 nt, Human
auggugccaagugccuuuucacaaugucuuguguaauccucauaaagacccugagaaguaggcaucau

SEQ ID NO: 4126946 - RNA, 66 nt, Human
augguguguaugugugcaaauguaaauauauaccuguguauucauuuauuuacucauccacgcuau

SEQ ID NO: 4126947 - RNA, 80 nt, Human
augguuaaguguccuggaguuauaaugccugaacauaagugaccauuaaaugauuagguuuuucuuugacacuuuacuau

SEQ ID NO: 4126948 - RNA, 55 nt, Human
augguuauuucauggaaaaauuggagaauuaccauccuuucaugauauuggccau

SEQ ID NO: 4126949 - RNA, 105 nt, Human
augguucuuggguguugacacuggaugcagaagcagaacuuacacagucugaacaaacgggugguuagaaaagauuguuucaagccucuguguuccuaagaucau

SEQ ID NO: 4126950 - RNA, 64 nt, Human
augguuguuacuuggugucucuggcugcauuuuguuugucgcugcugguuccgugacuguccau

SEQ ID NO: 4126951 - RNA, 83 nt, Human
augguuguucagcuguuagucaaaucaguugagacauucaaacauugucuauuugauuucuucugacaacggagcaucaccau

SEQ ID NO: 4126952 - RNA, 94 nt, Human
augguuuagauccagucagcuccaacagauagcccucggaauuccccuaaggucuugucaguguuggcagcuuucaacugguguucauugccau

SEQ ID NO: 4126953 - RNA, 57 nt, Human
auguaacaguaagccugugagcugcagaagaacagcaguuccaaggaucuguaacau

SEQ ID NO: 4126954 - RNA, 68 nt, Human
auguaaggcaaaggggaaguuaucauucuuugaccuagauugaauuaaccagaauucccucugcucau

SEQ ID NO: 4126955 - RNA, 130 nt, Human
auguaauaaauuggugaacgucuacuuuagaaggguggcaccacauaucauagaaucauuaauuuucuguugauuauuauuguggaauugcuacuuuuuuguagggcaauauuuucacuuuagaaugcau

SEQ ID NO: 4126956 - RNA, 88 nt, Human
auguaauggggugcgucagcuggauccgaguuagauauugcuguaaauguugcuuagcuuugccaucugucacauacucuuuuugcau

SEQ ID NO: 4126957 - RNA, 100 nt, Human
auguacaauauguugcaagauuaucuucuucuuguuaggauucugaauuuaauugauucaugcaauaaaaagggaauaugguuuuguggcacucaaacau

SEQ ID NO: 4126958 - RNA, 68 nt, Human
auuuaugcagcacuuuacauuuggaaagaggucaaugaaaucuagacagauuugagugcugccuaaau

SEQ ID NO: 4126959 - RNA, 102 nt, Human
auuuauguuccgaggcucuucccaucuugcauugaucaaaguuugggcucugugggcuaaccuuuguucaauguaagaugggaacagccuaggaacauaaau

SEQ ID NO: 4126960 - RNA, 59 nt, Human
auuuauugacuucagugagucuuggguuacagauuuccaaacagagcugaguaauagau

SEQ ID NO: 4126961 - RNA, 63 nt, Human
auuuauuggaugcuuacuugggccaguauaucucccauuggcgcagguaagcaucuaauaaau

SEQ ID NO: 4126962 - RNA, 83 nt, Human
auuuauuucagcucagaggaaagggaacauagucaaaagacuauuaaaacauguaauccuuuuuuucugauaaauguauaagu

SEQ ID NO: 4126963 - RNA, 72 nt, Human
auuuauuugcuagugaggccagugacauauauuaaguuaacuuacuauauauaggaccucagugaagugaau

SEQ ID NO: 4126964 - RNA, 56 nt, Human
auuuauuuggggaauuggcucacaaacuauggaggcugagaagucccaugauaggu

SEQ ID NO: 4126965 - RNA, 80 nt, Human
auuuauuuuauaaaguguuaugagaacuaaguggguuaguaaauguaaagcacuuagaauauagcacugacaaagugaau

SEQ ID NO: 4126966 - RNA, 93 nt, Human
auuucaaaacauggcuuuuccaggcagcaaauuuucugaauguaucgcaaaagaagauaaauugcaugucuauguagaucaugucaaugaaau

SEQ ID NO: 4126967 - RNA, 80 nt, Human
auuucaaaauguuuccaaaccucaucagugaaggacauaccuacauuucuaacccagaugagguuuuugaaauguggaau

SEQ ID NO: 4126968 - RNA, 63 nt, Human
auuucaaggauguuauauaaauggaaucguacaauauauagccuuuugagauauccuugagau

SEQ ID NO: 4126969 - RNA, 66 nt, Human
auuucaccuuguaagcaaauggaaggcuuugaguaacaugaucgcaagcaggcugcagggugaaau

SEQ ID NO: 4126970 - RNA, 67 nt, Human
auuucagagugagagugcucaaggcugcaggugcaagacagcacugguaaggacucuuagcugaggu

SEQ ID NO: 4126971 - RNA, 87 nt, Human
auuucaugaaacauuccccuugagaaauaccugaguaaaauuaauucacaaucaguagaaacccagugggaauguguucaucgaaau

SEQ ID NO: 4126972 - RNA, 70 nt, Human
auuucauguuucaucuaccuaauaagcauaauucuucccuugcagaacuagugggggugaaauaugagau

SEQ ID NO: 4126973 - RNA, 66 nt, Human
auuuccaaaaccacuuauugccuuucaggcugauguaagaauaguuaugagugguuauaagggaau

SEQ ID NO: 4126974 - RNA, 58 nt, Human
auuuccaguccuaaugaucugguagcuuuucagguauuuguuauuaagauugguaaau

SEQ ID NO: 4126975 - RNA, 123 nt, Human
auuucccaguaguucccuaaauuuaguaaauauuagaaucaucuggaaaguuuguuucaauguaguuucauuggaccaauuccugauauuuuguuuacuauauauggaguggauuccugaaau

SEQ ID NO: 4126976 - RNA, 94 nt, Human
auuucccgaguuagauaauguauuugaguuaugaaagagaauauucauguuuuuuaggaaacauacacucaaguauuuagggauaaagggggau

SEQ ID NO: 4126977 - RNA, 66 nt, Human
auuucccuuugcuuuuaaucuuuguacauccuuuucaguagggugugggauuagaggaggggaggu

SEQ ID NO: 4126978 - RNA, 65 nt, Human
auuuccugacaguggaaccuuauaguucuugauuuuuaagagagagcauucuucuguuaguugau

SEQ ID NO: 4126979 - RNA, 87 nt, Human
auuuccugauuaucagcuuguuauguuuuaucaacuuuguuaguugaauccuggcuaaaguuuguuauaugauaaggaacaggaaau

SEQ ID NO: 4126980 - RNA, 115 nt, Human
auuucgcacuccacuaaagaaaaaucaaaaugcuucucuuuacaaagacuguguauucaauaccuuaaacgaacuugaaguggagcuuuugaaauuuguguccgaagugcagaau

SEQ ID NO: 4126981 - RNA, 130 nt, Human
auuucuaaauacauuugccacuugguugccagcuggagagaccgaaagaggcugagggcauggagagcugcauuuucuaaaugguuucaggccccuggcauuucagcaauagguaauacaaaacagaugu

SEQ ID NO: 4126982 - RNA, 78 nt, Human
auuucuagacuaacagucuccgcuugaaacccugaaauuuaccaauuuggguuuuaaaguagauuauuagcuagaagu

SEQ ID NO: 4126983 - RNA, 129 nt, Human
auuucucauuucauaguuacauaguguauucaguucuuaaaugacugauaagaggaagucacagugcacuucuaagagcugcugucaucauuugaaugcuguaggaccuuuggcugaaaugaaaagacu

SEQ ID NO: 4126984 - RNA, 70 nt, Human
auuucugccauuggagaauauucuauuugauagcacuauuccagauuguaaauuccucaaggacagaaau

SEQ ID NO: 4126985 - RNA, 88 nt, Human
auuucugccuugaaauuuugcuacaguugguggaaaaaaugcacucaaacccauauuuccaugcuguuguuagagagggggcaggaau

SEQ ID NO: 4126986 - RNA, 59 nt, Human
auuucugggcucuaauccaggaacauugaaucagaauaucugggggugagccuagaaau

SEQ ID NO: 4126987 - RNA, 56 nt, Human
auuucuguggcuucauucuccugugauggccgaugaaaccauggagccacagaagu

SEQ ID NO: 4126988 - RNA, 86 nt, Human
auuucuuaucuuaggauauagguucauaguguuacagcuugcagucuguaaucuuaguauuaggaucauauuugaagaucagaagu

SEQ ID NO: 4126989 - RNA, 86 nt, Human
auuucuugcaguccucucagcauauuucugaucacagucccaaaugacauugagaagcccugauaggaaaaugcuguguaagaaau

SEQ ID NO: 4126990 - RNA, 129 nt, Human
auuucuugugcagacucagaaaauagcuuacuuaucacacugugccugucagcugcauuguaggugccagccuagugcagugguaugauggguaaggccgguucugggugaugucugugcugcugagau

SEQ ID NO: 4126991 - RNA, 58 nt, Human
auuucuuuccaugagccuauguacccauuucuguuggguauauuccuaggagagaaau

SEQ ID NO: 4126992 - RNA, 95 nt, Human
auuucuuuguaccaucuuuuccucugccuccuugguuaaagugauuacuaaggagcuacaaaggagugaaaaaaaucaggugguguguaaggggu

SEQ ID NO: 4126993 - RNA, 80 nt, Human
auuugaauguuggauugacuuaguaaaagccaaugugcacaauuagaguuggcaacucuaagcaauauagccuucugagu

SEQ ID NO: 4126994 - RNA, 115 nt, Human
auuugagcauagacuauuagacgauacugaauuaauguuaauugucuuaggugugaugaugggauuauaguaaucuaagagaauuuucuuauuuuugguagauacaugcugaaau

SEQ ID NO: 4126995 - RNA, 125 nt, Human
auuugaggaaaucuuacuauagauuuuguuuacauggaauguguacuaaguuacucccuuaaaggagagcaugacuuuuguucauuuuucuguauauauucaucuauauauccaucuguucaaau

SEQ ID NO: 4126996 - RNA, 60 nt, Human
auuugagguaugguaagguaaaaucuuuuaaaaugaggaugccuuuauaaugcuacaaau

SEQ ID NO: 4126997 - RNA, 77 nt, Human
auuugauguuuuauaaugucugcagagccacacaaccucaguaggcugugggggccauagacguuuuauuuucagau

SEQ ID NO: 4126998 - RNA, 64 nt, Human
auuugcagagcucugaauuuugaccucuuugcugcaagccugugaauuuucagaacucucagau

SEQ ID NO: 4126999 - RNA, 78 nt, Human
auuugccagugcuguguuggcugccggcacaggaggcccguucuguauucugcugcuggcaccgggggauaugcaaau

SEQ ID NO: 4127000 - RNA, 58 nt, Human
auuugcugagcucaaagaaaaggcauuacaaaugcaguugaucuguggcuuaguagau

SEQ ID NO: 4127001 - RNA, 57 nt, Human
auuugcuuggucuucucuccguagauaaugggguuaagcaugggggaacaagcaagu

SEQ ID NO: 4127002 - RNA, 77 nt, Human
auuugcuuuaaagaucagacuguuuggacuaagccucuuaauaggaaggcucuggcaacagcugguguuagguagau

SEQ ID NO: 4127003 - RNA, 56 nt, Human
auuugcuuugggacagcuuaaacugaaaacuuucugucuuguggaccaaagcaagu

SEQ ID NO: 4127004 - RNA, 77 nt, Human
auuugcuuuuccuuuucucucuauucuuaaaaagcauuggagaaacuguaggagggaaaggaaggaggguggcagau

SEQ ID NO: 4127005 - RNA, 56 nt, Human
auuuggaagguuuacaaagagagauuacuacuuuucucagugcagauuguccaagu

SEQ ID NO: 4127006 - RNA, 61 nt, Human
auuuggaaguuuggagugaagggaaacaauaagcuuacuuuuacauacgcaaacuccaaau

SEQ ID NO: 4127007 - RNA, 63 nt, Human
auuuggcagacagagggaggaagaaacaagccuacaagaauucuuaccagccuccugccugau

SEQ ID NO: 4127008 - RNA, 129 nt, Human
auuugggugcaguucacuugcuaggaaggaggaagccacccagcuuugauagaccccaaacgccuagaaugagacgguuuauucaccgcaggugcuucccucuggaaccuugcucacacacaccuaagu

SEQ ID NO: 4127009 - RNA, 74 nt, Human
auuugggugggagcaggaagcaguugggaauuagagggauauggaaagauauuuucuccagcuugcacuuaaau

SEQ ID NO: 4127010 - RNA, 68 nt, Human
auuugguaucuguuccaggcacucagcuccugugugcagaaguaagagggcccagaaugaggcuaaau

SEQ ID NO: 4127011 - RNA, 70 nt, Human
auuuguaagauaguuuuauuuuauuuacauucuuaugagaacuaauugaaaugagacuggugauacaagu

SEQ ID NO: 4127012 - RNA, 60 nt, Human
auuugucccauugaccccaagguaagucacaugaccaagcccaagaucaguggggcagau

SEQ ID NO: 4127013 - RNA, 74 nt, Human
auuugucugaggcauguuugagagagcacugcuaucaaaguaguaaguaguuccauccaaacagccagaugggu

SEQ ID NO: 4127014 - RNA, 85 nt, Human
auuuguggauaaagucgaguucugauuuugccauugggaugaugguuguggcacauuaacuuuggcaagucagacuucugcaaau

SEQ ID NO: 4127015 - RNA, 113 nt, Human
auuugugugaugguauuucagguaguauucuguuuucuaaucuguguacuggaacacacuuucauaacuggcacacagauuaggaaacagaauacuaccugaaucccacaaau

SEQ ID NO: 4127016 - RNA, 62 nt, Human
auuuguguuguauuaagcugcuaagauuauaguaauuugugaugcagcaauagaagacaaau

SEQ ID NO: 4127017 - RNA, 55 nt, Human
auuuguguuuucccauacuauugagacauuucaguagcuaauggaaaccauaagu

SEQ ID NO: 4127018 - RNA, 100 nt, Human
auuuguuaaaaccugaaaugcaguaauuuagguccauguucguucauccuucugaaucagcaggcuucuaaauuuuuaacuguguccuauggaaauaaau

SEQ ID NO: 4127019 - RNA, 81 nt, Human
auuuguuugauucugaguaacauguauuggaaggccaagucuaucugcaugccuuuucagguguuauucugacagaggagu

SEQ ID NO: 4127020 - RNA, 77 nt, Human
auuuguuuguggaguuaaagggcucacaagguaaggacagcuguaagaacugucugcccugagcucccagugcaggu

SEQ ID NO: 4127021 - RNA, 88 nt, Human
auuuuaaauuugagccuuuauaguugguagcaguuuauauaaagucuccauuagcugauauaaaauuacagaggagcaguuuugaaau

SEQ ID NO: 4127022 - RNA, 97 nt, Human
auuuuaauuauauuaggucagauuugaugugguuuucuaauaaagcagauucuugcuuagagcgacuacgcauuaaaucaauuaaauaugugaaaau

SEQ ID NO: 4127023 - RNA, 75 nt, Human
auuuuacauaaucuguacguaguucuaaucuguauauagucuuggagguuaugauuugccacagauugguuggau

SEQ ID NO: 4127024 - RNA, 56 nt, Human
auuguacagguuggaggaaguggacuucaguuuguccuuagcaacacuguuauaau

SEQ ID NO: 4127025 - RNA, 60 nt, Human
auuguauuguuugcgucuguguucccagugccugugagcacagugccugacauauauggu

SEQ ID NO: 4127026 - RNA, 74 nt, Human
auugucacauuauaugugaggauagcucauuuuuuaaauauaccaaugcucuaucuucaggguggugugagaau

SEQ ID NO: 4127027 - RNA, 61 nt, Human
auugucacccauuguuucuucuucccugacaccagggagucugauuuuuuauggguguagu

SEQ ID NO: 4127028 - RNA, 74 nt, Human
auugucucuuaauugucuuagucugugcaggcugcuguaacaaaguaucacagacuggguaauuuauaaucaau

SEQ ID NO: 4127029 - RNA, 57 nt, Human
auugucuucuggucuuaucuuuucuauuggaucaggaacuauaagacagaagacaau

SEQ ID NO: 4127030 - RNA, 57 nt, Human
auugucuucugucuuauaguuccugauccaauagaaaagauaagaccagaagacaau

SEQ ID NO: 4127031 - RNA, 89 nt, Human
auugugaauaaaugaaugacugucuacuuuggggaaaauuuaauuccccaacauaauuaauguggcauaguuagucauuucuucagagu

SEQ ID NO: 4127032 - RNA, 64 nt, Human
auugugaauagugcugcaauaaacauaugugugcaugugucuuuauagcagcaugauuuacaau

SEQ ID NO: 4127033 - RNA, 64 nt, Human
auugugaauggugccacaauaaacauacauguccaugugucuuuauagcagcaugauuuauaau

SEQ ID NO: 4127034 - RNA, 79 nt, Human
auugugagcaaaucccugaguucuaauuccuaucucugcagaggagauaggagccaggacuuaacaacucuaucauaau

SEQ ID NO: 4127035 - RNA, 96 nt, Human
auugugaucagcucuacuuuauaaguauauaagucaauuugaugguuauauggagggcggauuuuacuuaucaagguagaagggaaggagaacaau

SEQ ID NO: 4127036 - RNA, 56 nt, Human
auuguguaaaaucuuccaguuuuguaaugucagcaagauguuuagauuuauacaau

SEQ ID NO: 4127037 - RNA, 66 nt, Human
auuguuaaacucucaacagagaaccacguguaggacagcguggucuugcaggugagaguagauggu

SEQ ID NO: 4127038 - RNA, 57 nt, Human
auuguugcuuuauuaucucuagguucuccuccuucccuggagucuggggguggcagu

SEQ ID NO: 4127039 - RNA, 57 nt, Human
auuguuggaugguugucuuccaaaguggcuguaccauuuuacauccccaccagcaau

SEQ ID NO: 4127040 - RNA, 59 nt, Human
auuguuuuguuucccagugacuuguugcugccacaacuccaaugaggagauaggacagu

SEQ ID NO: 4127041 - RNA, 72 nt, Human
auuuaaacauaaagcaguucauuucucaucuuuucauggagaaagggacugaucugcuccuagugugaaaau

SEQ ID NO: 4127042 - RNA, 64 nt, Human
auuuaaaugcuuaagaggguuuugcuuauuacuauuguaaguuuacccugccaggcaugugaau

SEQ ID NO: 4127043 - RNA, 104 nt, Human
auuuaacaaacuauauuuuauagaacacuuauuuuacucaauuccgaugguuaguuuauugaggaguguuuagggugagguuucaugagcaaaguuugggaaau

SEQ ID NO: 4127044 - RNA, 79 nt, Human
auuuacauaaccaguucuuugugauggaaauuuagguuguuuacagucuuuuucuauuacaaaugaugcuuuagugaau

SEQ ID NO: 4127045 - RNA, 72 nt, Human
auuuacccauuuuuuuucaugagagacagguuauacauguuugaucugugauaggaaaauaaauggcuaggu

SEQ ID NO: 4127046 - RNA, 65 nt, Human
auuuacucgugucuccagugcugucaaaacuucuuugacauuuuuggccuggugaaugagagaau

SEQ ID NO: 4127047 - RNA, 87 nt, Human
auuuagaacaagacuucuguucaaauuagaaguuccccuaaugcaugauuacugagcucuagguuuugaacccugaaguuucuaagu

SEQ ID NO: 4127048 - RNA, 56 nt, Human
auuuagacaccagcuuguaagguaccaaaacugcuuucccaggugguguuauaaau

SEQ ID NO: 4127049 - RNA, 94 nt, Human
auuuagcuucuuugauugcgucuauaacuaauuggauaccuuccugugagugugcaggaaagccaguuaguuaaaggcgcaguaugguucaaau

SEQ ID NO: 4127050 - RNA, 114 nt, Human
auuuaguuuccugcugguugauaauuaacucauuauagauauauguccaaggguauucauuguauacuuuauuuaugaaagguauagucuuuaucaaaaagaaauauacugaau

SEQ ID NO: 4127051 - RNA, 69 nt, Human
auuuauaagacauuugacaaaccauuuuuugucuccucaggaaaugaguuuccucaauguccugugagu

SEQ ID NO: 4127052 - RNA, 116 nt, Human
auuuauaguuagccucagggagaguuuaugauauuuuaugagauuaucacauuucagguagaauguauuccucaugcaagagucggccaaauucauccaggaguuugaaaaugaau

SEQ ID NO: 4127053 - RNA, 77 nt, Human
auuuauauacugccaggccacagcuaaagaggauucuuuacagaaucaaauuucuugugguuguuccguauacaagu

SEQ ID NO: 4127054 - RNA, 92 nt, Human
auuuauaugguuuccuguauucuaaagggaaagguauaugcacuugucuucuuuuuaaacuuuuccucuuaugaaucaguagcaguaugaau

SEQ ID NO: 4127055 - RNA, 94 nt, Human
auuuauuaccaugaaucucacuuucuaaaauugcuagcacuauuaaaguuucugacagugaagcaagccauuggaacauguuuguggugugaau

SEQ ID NO: 4127056 - RNA, 89 nt, Human
auuuauuauucaaagcccaguaaacauuggggaaugacaucuuaagccaaauagucuaucuugugcucacuggcuuugaaucauuaagu

SEQ ID NO: 4127057 - RNA, 91 nt, Human
auuuauuuaacuguugagcaauguuuuguugaaugaauagaccacaguuuauucauucccauagcauacuggguuauaguuuuuuuuaaau

SEQ ID NO: 4127058 - RNA, 74 nt, Human
auuucaaagugaugugggagaguauagcuaggggaauuaacuaguccauggcauggauucacacacuuuagggu

SEQ ID NO: 4127059 - RNA, 79 nt, Human
auuucaaugucauauauuuaguugugcaacagugggacaaugggguacuaugugaacagcuaacuguguggaaugagau

SEQ ID NO: 4127060 - RNA, 56 nt, Human
auuucaggauagccuaguuuugcuuuguguauuugcaugcaaguuauccuagagau

SEQ ID NO: 4127061 - RNA, 84 nt, Human
auuuccagccaaagagaauucuggugcuaacaagguauauuacuaccuguuuuuuuagagaguugucauuguuuagcuggaaau

SEQ ID NO: 4127062 - RNA, 56 nt, Human
auuucccaggacuagaaauauacucauaauugcaggcaucugguuucuaggggagu

SEQ ID NO: 4127063 - RNA, 63 nt, Human
auuucccaggguuaccucgugggcucugccuuugcccucagaaacggcugacccuggagaagu

SEQ ID NO: 4127064 - RNA, 73 nt, Human
auuucccccuccuuugggugaauuccucucuugauuagcucaggaacggaaugugauccaaucugggcaaaau

SEQ ID NO: 4127065 - RNA, 82 nt, Human
auuucccccugcuucuuuuccugcuaugaacacuuauugaaugcuuguguuuacaaagcguugagacaaguacaagggagau

SEQ ID NO: 4127066 - RNA, 77 nt, Human
auuucccuuuagcuaaauuagccuauauuggaaacugagacacuauaaaccuauagguucacuuagcugugggaaau

SEQ ID NO: 4127067 - RNA, 56 nt, Human
auuuccucccuugucauugcuucagugugcucaaaagcagguguaaaggaggaaau

SEQ ID NO: 4127068 - RNA, 58 nt, Human
auuucuagaggcagcuucuagguauacauaacaacuuggauuuauggucucaggaaau

SEQ ID NO: 4127069 - RNA, 56 nt, Human
auuucuagcaaaggcucugcuaauuaaagcagggaucugcagaaccuucuggaaau

SEQ ID NO: 4127070 - RNA, 77 nt, Human
auuucuagggaaccgggggguagagucuggggucugugacucagucuacaguucccucaggucccuacagcagaagu

SEQ ID NO: 4127071 - RNA, 85 nt, Human
auuucucagggcucuuucggguuuccagcucuaagaugcaguaaaugcaaagagaaacuuagaagccugaaaggcgguggggaau

SEQ ID NO: 4127072 - RNA, 55 nt, Human
auuucucaucuuugugaauggucccaucauccaccuacuuauuuaggugagaaau

SEQ ID NO: 4127073 - RNA, 76 nt, Human
auuucuccaccucauuugaagaacgagcuucguagcccacggagcugagguuaguauaaauguggaagggagaagu

SEQ ID NO: 4127074 - RNA, 118 nt, Human
auuucugacaucccuaauuccccguggccucucagcucugacaggaggcaucugggguaauggggggcagggacgcagagcugggagaaugcagggaguuaauuggagagacggagau

SEQ ID NO: 4127075 - RNA, 108 nt, Human
auuucuguauuaguuuucuaagguagucagaacuuugaaauuuauuguucuucaguuuauuuuacuucauuugaaaugccuaauugaagaguuaaugggcaaugaaau

SEQ ID NO: 4127076 - RNA, 69 nt, Human
auuucuguucuaguuauucacaguggagagaggaaauguccguaggcuguauuugacuugagcggaaau

SEQ ID NO: 4127077 - RNA, 71 nt, Human
auuucuuguucuccucauuuagagguuuuuauugaaaucaaugucccuucaaaaugaugaaaggaagagau

SEQ ID NO: 4127078 - RNA, 61 nt, Human
auuucuuuacuuuggauucuauuacucauucguuagaguguaagucuggaguaaaaggaau

SEQ ID NO: 4127079 - RNA, 122 nt, Human
auuugaaaauauauuaguguuuugagauaaacagauuaugaagcauugaccuugugagaaucacacaguccaaggcaggugcuuaugacuugcuccucucaccacucugaaguuauucaaau

SEQ ID NO: 4127080 - RNA, 119 nt, Human
auuugaacuaaguaauucauagaauacuacuacauuucauuugcaguauggauaaugcuaaauuauccacaucuaaagagaaauguucuugggguuucugguuuucccuuauuucaagu

SEQ ID NO: 4127081 - RNA, 112 nt, Human
auuugaagagguaaagucaguuaaagcugcaugugucagugguuaggaugacaggcuucuauucuucugauacaaugucugcuuuauaccaaaacuuucuaccucuuugaau

SEQ ID NO: 4127082 - RNA, 107 nt, Human
auuugaagauguagcacaguuuaaaugagugacugcaguggcuauuucaaucuaccaggggaggucuuugcaucuuauuuauuauggauuaucuugcaucuuuaaau

SEQ ID NO: 4127083 - RNA, 81 nt, Human
auuugaauauauaggcaaggagauuucuaagcaaaauguugaaggugcugccugguuucuucuugcuccguauaguaaaau

SEQ ID NO: 4127084 - RNA, 105 nt, Human
auuugagcccuuuaaaugugugauaaagauuaaaucaaauuggucaaagcuauucuuggaaugaucuuuuuaauuugaaucuguauuuguugaagagcuucaagu

SEQ ID NO: 4127085 - RNA, 69 nt, Human
auuugaguuagugagugaaucaagccugguuacaucacaaccaggaauauuuugcucauuuauuuugau

SEQ ID NO: 4127086 - RNA, 57 nt, Human
auuugauagaucuuuaauccagaaguuauuuaguacucuggcaguggucuuucaaau

SEQ ID NO: 4127087 - RNA, 99 nt, Human
auuugauucucguauucacaguuauuuucccagcauuuagagcugcaucaggcauuguuuaggugcuggaaaauauuuguugaaugacuauaaauaaau

SEQ ID NO: 4127088 - RNA, 75 nt, Human
auuugcagucuacuuaagaaucucaggaaugcaucgaucagccuuacauccuugaggucuguguaggcagcaagu

SEQ ID NO: 4127089 - RNA, 57 nt, Human
auuugcguuaaagaccucuuuggcaaugcauuguugaaagagguuaauauuguaagu

SEQ ID NO: 4127090 - RNA, 73 nt, Human
auuugcucuguuaugcauaagcaucaguguauaaauaaauaugacuggagaugcaguguaaacaguggcaaau

SEQ ID NO: 4127091 - RNA, 77 nt, Human
auuugcuuacugguaguggagguuacagcuguacaugaagcauguacugacuguacuuuuaaauugguuugucaagu

SEQ ID NO: 4127092 - RNA, 57 nt, Human
caccuccuugcucuuucucuuugugacccaguaacacaggaugaugggaagguggug

SEQ ID NO: 4127093 - RNA, 65 nt, Human
caccucgccucaucauccuaauuacagaaauccuaagguuagaauggagauggggcuccaaggug

SEQ ID NO: 4127094 - RNA, 59 nt, Human
caccucucauuucuacagauucccuccaguguggacucucugaugguagaugagaugug

SEQ ID NO: 4127095 - RNA, 130 nt, Human
caccucugaacacgagcgaugaaguccaggcucaggaugaaagucauggugaggaugaauguuaucacacgugagguucuauccugauuugauuuugccugggauuucagaggcuauguggaaguuuuug

SEQ ID NO: 4127096 - RNA, 117 nt, Human
caccucuggcaaguuuuaaaaguacugaugccugggcuccaccugcuccugugauuuggauucaauuggugugggaugaagccccaguguaaguaauuuuuuuaaguuauccaagug

SEQ ID NO: 4127097 - RNA, 100 nt, Human
caccucuuggcucguggagacugccagaaugugaggccugcggcuggggcucaucuugcugauuugggcuucccgucacuggcagcucccacagcaggug

SEQ ID NO: 4127098 - RNA, 56 nt, Human
caccugaacggacguccacggcaugggggaccucaucuguggcaucugucauggug

SEQ ID NO: 4127099 - RNA, 56 nt, Human
caccugagcaacccugugcgggggagaaacucaguuuugcauuggaugugcaggug

SEQ ID NO: 4127100 - RNA, 59 nt, Human
caccugcgucgugugggcagugaccuggacacucagggucaccccucgaugacagggug

SEQ ID NO: 4127101 - RNA, 72 nt, Human
caccugcuuuagagcccagcuugguggcucaccguauccaaggaggaccgccggcuuugcuccagagaagug

SEQ ID NO: 4127102 - RNA, 72 nt, Human
caccuggagaacagaccacagucaggcuccuggucaaagccaagccagcuaagucggucauuaauccaggug

SEQ ID NO: 4127103 - RNA, 86 nt, Human
caccuggcagcuuauuagaaaugcagucucaggcccugccccaaaccuacugauuaaaaucugcauuuuaacaggauccccaggug

SEQ ID NO: 4127104 - RNA, 60 nt, Human
caccuggcuauucccucaaucugggcccuggggccauggcaauguggaaugguccaggug

SEQ ID NO: 4127105 - RNA, 105 nt, Human
caccugggagaugugacaaaauacagauuccagggucuuaccccagagagucagcaauucugaaaugaggcucaagaaucugcauuuuaauaaaccucccaggug

SEQ ID NO: 4127106 - RNA, 71 nt, Human
caccugggaguguucuaggucacauuuuacuggcgaacgcaucucuugauggacggagcgcugcugaggug

SEQ ID NO: 4127107 - RNA, 57 nt, Human
caccugguaaccugccugacuaauggauuaauuguccuuugguuuguugcuuaggug

SEQ ID NO: 4127108 - RNA, 82 nt, Human
caccuguccacgcagucugccuaaauccuggccaggaaaaacguggugggagugucagaggaggacugcgugagggggagug

SEQ ID NO: 4127109 - RNA, 71 nt, Human
caccuucaaaugggcagacagggagcucacggcaccugcuguaugcuuugguuguuucucugaugugggug

SEQ ID NO: 4127110 - RNA, 77 nt, Human
caccuugggcaggaaggcccaccuguccuguggcuguggccauagcacucagugugggucuccccaaccagaaggug

SEQ ID NO: 4127111 - RNA, 123 nt, Human
caccuuguacucacucccaggucacuguccugcagccgggggucccaagcugggcugcuccucaaggcgagcacaugaaggcuggggccuggcugggggcuggcagggagcugugcggaggug

SEQ ID NO: 4127112 - RNA, 69 nt, Human
caccuuuacuaacaccauacaugcugcaaaaaaugugaguguguguauguauguauguguuagugugug

SEQ ID NO: 4127113 - RNA, 58 nt, Human
caccuuuccuauguuucauauauuccuuggagugcugggguggguggaauuaggagug

SEQ ID NO: 4127114 - RNA, 68 nt, Human
caccuuugaccuugcagcgcacucccaaacaugcaggugugcuuguccugagguuuauuuugggggug

SEQ ID NO: 4127115 - RNA, 60 nt, Human
cacgagcccuguaggaaucucucaacuguugcugucauugacuccugccugcaggccgug

SEQ ID NO: 4127116 - RNA, 121 nt, Human
cacgaggccccuggccacccaggaaccugucagucccuucucaaagugugcgggaaacagcagguccccaaacugugcggaggagggugggaggcgcugaguggacccacaggggcuagug

SEQ ID NO: 4127117 - RNA, 70 nt, Human
cacgaucacauuccucucaacaugccugccggggucuguggagccuaggggcugaugggaggguggggug

SEQ ID NO: 4127118 - RNA, 72 nt, Human
cacgaugguaaacaacacaaaucauuugacccguaugaguuuuugccucagguguaugugugugugccugug

SEQ ID NO: 4127119 - RNA, 66 nt, Human
cacgcacuguuuaauuuaggauuagguaacuaaggaaauaucuaccucuaaaguacaguuugugug

SEQ ID NO: 4127120 - RNA, 83 nt, Human
cacgcaggaggcagugcagugcagugguuaggagccaggcagcuuggguuugcauccuggcucugccacuuacugccugugug

SEQ ID NO: 4127121 - RNA, 63 nt, Human
cacgcaugugccaugugugcagauauguaucgugugugcauguacaugcaugggcacugugug

SEQ ID NO: 4127122 - RNA, 78 nt, Human
cacgcauguggaucagaugaagggacauuugcguauuuccccugcucuucaauuuguauaauccauauguaacaagug

SEQ ID NO: 4127123 - RNA, 74 nt, Human
cacgccuggcagcaggugggcccgugucagcaacagaaaugaggucacuuacuacccugccugccacccgcgug

SEQ ID NO: 4127124 - RNA, 129 nt, Human
cacggagaaagagauuacaauauagcagaggaagcucuuccagggcuccuacagggaccuuugggacaaagauucagugggcuuugggacagcuugacuucaacuagaugguauuugaauaaucugcug

SEQ ID NO: 4127125 - RNA, 91 nt, Human
cacggagcugucugagaacuucaaaugugacaaugugaauauuccaaggaaaaguucaaguuuacuuugaaguuuacuuuuaaguacuuug

SEQ ID NO: 4127126 - RNA, 74 nt, Human
cacggccacauuuacugauguauguauugucuaugacugauuuugugcuacauugguagaguucaguaguugug

SEQ ID NO: 4127127 - RNA, 56 nt, Human
cacggguggaaucagggacucccucuagacucccagauccucugguaccacccuug

SEQ ID NO: 4127128 - RNA, 59 nt, Human
cacgguguggcuaccugggccugacuccacagggacggggggcaccuuggcuaugccug

SEQ ID NO: 4127129 - RNA, 64 nt, Human
cacgucuuugcacacaucccuucccgagaugucaugcagguugggccggauugugaaggacgug

SEQ ID NO: 4127130 - RNA, 93 nt, Human
cacguuagcucauuaugguagcuagaaugcuucgugauauguuaggcaucuauucuguacuaccaggcguucuagauugcagagcuccacgug

SEQ ID NO: 4127131 - RNA, 82 nt, Human
cacguuuagccuaucuuauuaaacacugcuuaucuacuaaaggcagucagcagcauguuuaaucaaagucagggcagaugug

SEQ ID NO: 4127132 - RNA, 69 nt, Human
cacuaaccauauucacacuaugcccagugugugugcugugcugugugugugugugugugugugugugug

SEQ ID NO: 4127133 - RNA, 74 nt, Human
cacuacaaagaccugugaucacauggaaugagaugguuagaugacucaucuauggcugucagagguuuauggug

SEQ ID NO: 4127134 - RNA, 64 nt, Human
cacuaccacaccacacuccacuauaugaaguuccaagcaauguggaaucugugcuguuuuagug

SEQ ID NO: 4127135 - RNA, 125 nt, Human
cacuacucucuaaguccuuggcuuacccggcuccaguuccugaauguauauuucauuugguuauuucucaugagacaugacuucaggccuuuggagucucacugggccuuggucugaagagugug

SEQ ID NO: 4127136 - RNA, 82 nt, Human
cacuaggagaguugagcagugucuuucauauccuccaucggguuuacucaucugugcagguuuaggaagcagcuccuccgug

SEQ ID NO: 4127137 - RNA, 69 nt, Human
cacuaguccugguuucaugcuauucaaaaacuaaaugaaaaaugaagaaauugaggcucagagacggug

SEQ ID NO: 4127138 - RNA, 88 nt, Human
cacuauagauuugcaagauguuaacauagggagaaacugaguaaauguacaaaggauuucucuguauuauuucuuacaaguacauaug

SEQ ID NO: 4127139 - RNA, 97 nt, Human
cacuauaucucuccuuaugaagcauuauacucaauuguuagcucuuacuguuagagcuaacaauugaguauaaugcuucauaaggagagacauagug

SEQ ID NO: 4127140 - RNA, 63 nt, Human
cacuauaucuguucuuguuuauugauauuuccccagcaaugagccaaaguccagguguuugug

SEQ ID NO: 4127141 - RNA, 78 nt, Human
cacuauaugauuccucucacuuauauaaugaaucauagaguaauacuuaggguagacagaaagcggaaucauacagug

SEQ ID NO: 4127142 - RNA, 66 nt, Human
cacuaucucuuucucaaaauguaagcaaguuugguuuauuuguuuuaguaagagagggagagagug

SEQ ID NO: 4127143 - RNA, 70 nt, Human
cacuauguuggccaggcuggucucaaacuccugaccucaggugauccaccagccucggccucucaaagug

SEQ ID NO: 4127144 - RNA, 56 nt, Human
cacuauuccauaaugcauggcaaagauggauugucaagcaauaauugguaauagug

SEQ ID NO: 4127145 - RNA, 62 nt, Human
cacucaaacaggcagcacuaaucucugguaauagaaaucaggauagugguuaccugggggug

SEQ ID NO: 4127146 - RNA, 64 nt, Human
cacucaaucauuuccugucacaggugcagccucuaugcauuauccugccaugauugauagagug

SEQ ID NO: 4127147 - RNA, 76 nt, Human
cacucaauccugugucaauuccucauucucuuucccccaagaaaagagaaaugacaagacugaucaggagaaggug

SEQ ID NO: 4127148 - RNA, 59 nt, Human
cacucauauuggaacaagcuugggguggaagauuuaggccgugugagcaugugugagug

SEQ ID NO: 4127149 - RNA, 86 nt, Human
cacucaugguugguauugaggggugaugaggcacuggcuuugggggagccaggcagacucucuuucuucuucuccuucguggguug

SEQ ID NO: 4127150 - RNA, 105 nt, Human
cacucauugagaggcuuugcuuggagugguccguuuacaaaugaauaaugugagauaagugaauucccacuauaugccaagcauguuuuaggcccugggugugug

SEQ ID NO: 4127151 - RNA, 82 nt, Human
cacucccccacuguccccggagcuggcaaauaaacaaauccacaaacaaauuauccgugugcuccggagaggcggcggcgug

SEQ ID NO: 4127152 - RNA, 60 nt, Human
cacuccucuggugagcagacaguuaucgaauccaucucugugaaugcuuguuauggagug

SEQ ID NO: 4127153 - RNA, 62 nt, Human
cacuccuguuccacuaaaugagaccaguuuguauaaggucaugggugugaccucaggcagug

SEQ ID NO: 4127154 - RNA, 60 nt, Human
cacuccuugggaaaucacuagcacugcuagaaacagagacuagggauuuccccagggcug

SEQ ID NO: 4127155 - RNA, 60 nt, Human
cacucgugggcccccagaagccagcaaguguccuuguauuuucuggguggcugcauagug

SEQ ID NO: 4127156 - RNA, 56 nt, Human
cacucuaaccuccaucuuccaucaagaguagcaacgaugaagggugggguggggug

SEQ ID NO: 4127157 - RNA, 98 nt, Human
cacucuagcugccagggugugagggccucugcugcuccacauaugcuaauaugaggcagcacaugggauugucagacucccugauuuuugcuagucug

SEQ ID NO: 4127158 - RNA, 55 nt, Human
cacucugcaggccaaaccaaagaugucuguuggcccaaucuggcuugcagagcug

SEQ ID NO: 4127159 - RNA, 89 nt, Human
cacucuuauuuuccauaaagaguuguuccauaugugcugcuugcugagaaaaacacacauauguggcaacuguagaugaaauauacgug

SEQ ID NO: 4127160 - RNA, 61 nt, Human
cacucuuccccaaacacacaguaauuaaaauugccuuaugugucuguuuagggaggaugug

SEQ ID NO: 4127161 - RNA, 74 nt, Human
auguacagcaaauauaugcucucuaauagguauguacucauaccuggaaaaguuauaugugugugucugugugu

SEQ ID NO: 4127162 - RNA, 67 nt, Human
auguacauucuucucaccgaagggguauacuuauuuucuuaccuuuagucuuugaaguaauguacau

SEQ ID NO: 4127163 - RNA, 57 nt, Human
auguaccaguguugagaaugagagaucugguuuccucucuucuuauggcugguagau

SEQ ID NO: 4127164 - RNA, 56 nt, Human
auguacuaaguguguuggauauuuauugauguguaacaaucuacacuuaggcacau

SEQ ID NO: 4127165 - RNA, 84 nt, Human
auguagauacguuaucacauguauguguguuuagugauacaaauuguuucauagacacagaucuauauauguguaugucuauau

SEQ ID NO: 4127166 - RNA, 64 nt, Human
auguagauucuugguucccauuccugauguaccaauucugauggcagagacccagaaucuacau

SEQ ID NO: 4127167 - RNA, 86 nt, Human
auguagcucagcagugcaacagauucgagaagcaauuagauucaacugcuucaguaugauuuuugugcaucauuaagaaguuacau

SEQ ID NO: 4127168 - RNA, 78 nt, Human
auguagugggagucccuguccccauacgagcaggaggccuucaaggcauguaugccgggcaggggcuuugcuuaacau

SEQ ID NO: 4127169 - RNA, 61 nt, Human
auguauaguggugaugauuacacaacgaugugaauguauguaguaucacugaacuguacau

SEQ ID NO: 4127170 - RNA, 95 nt, Human
auguauaguguguggcccucuauuugcguucuuucccaaaccugcauauguugagggugggccugcaggaagagggaugacugacucauuuacau

SEQ ID NO: 4127171 - RNA, 95 nt, Human
auguauauauauguauguauauacuuacauguguggaaggauaugcacuuaccuacuuuuaugcauguaaguauaugcuuacaggccuaaaacau

SEQ ID NO: 4127172 - RNA, 58 nt, Human
auguaugaugcuaggcucucaguguccccggcacaaguuccauuguugcaucgugcau

SEQ ID NO: 4127173 - RNA, 56 nt, Human
auguaugggguguaugggaucaucauaucuuaagaugaucucauauugccaggcau

SEQ ID NO: 4127174 - RNA, 82 nt, Human
auguauguaaagcaauaggguaaucuacucauuaaacaaauuaauaaagugacguugauucuuuuauugcaaauauguauau

SEQ ID NO: 4127175 - RNA, 101 nt, Human
auguauuaucagcuacucuggguguagcccaguaugagguaugggggauccaguagaaucccaguuccuuuggagcuauacccaguaggaaaaauaugcau

SEQ ID NO: 4127176 - RNA, 81 nt, Human
auguauuuuaauacaggauuucaccucauauuuugguauuauuguguuaaaagaugaaauggugucuuggaagaaaugcau

SEQ ID NO: 4127177 - RNA, 75 nt, Human
auguauuuuccaggaaaacaguuggaaguuucgacuuugugguuuacuuuuggcuguguuuuauggaaaucacau

SEQ ID NO: 4127178 - RNA, 95 nt, Human
auguauuuuuuuguucuauugaugucuuuuauggagaugucauaaaaagaagauuaugacuucucauuaugaggcagauggaggagaagaugcau

SEQ ID NO: 4127179 - RNA, 99 nt, Human
augucaaggaacaugcccaagguggcauguggcuccucucccggagguugauuucucaaagggcuacugccugccuucaggacugguguuuguugaugu

SEQ ID NO: 4127180 - RNA, 55 nt, Human
augucaauuuguucucucgaagcagcugaaaaaaagugugagaauaaauggacau

SEQ ID NO: 4127181 - RNA, 55 nt, Human
augucacaggcaacaagauugccaagaaugugcaauauccugagugccuugacau

SEQ ID NO: 4127182 - RNA, 62 nt, Human
augucacaugacacaaauaucuauaugacaauguagaauaugaugagugucaugaaagauau

SEQ ID NO: 4127183 - RNA, 58 nt, Human
augucacauggucaccucuagcugcaaguaaccaguuugaggugaaacauguugacau

SEQ ID NO: 4127184 - RNA, 72 nt, Human
augucaccuguugcucugggcuaucugagaaaggagguaggugccacuuucccagccccaguauagagaugu

SEQ ID NO: 4127185 - RNA, 79 nt, Human
augucacugggcuuuugggaagucggguugagcacuuaccagagugaggcuuucugggcuucuuucagccauaguacgu

SEQ ID NO: 4127186 - RNA, 72 nt, Human
augucagaacucaaacguauauuugaguuucuguucgucagaacugaaacauauauuugaguuucuguucgu

SEQ ID NO: 4127187 - RNA, 61 nt, Human
augucauguuggcugaaauucuggagcucuuaauugcugcugguauuucaggacaagacgu

SEQ ID NO: 4127188 - RNA, 81 nt, Human
auguccaaguuaaccaauacaaauauuguuaugcuucuagauucugcgauguaugcaguauuuguuagcuuuucaggaugu

SEQ ID NO: 4127189 - RNA, 64 nt, Human
auguccaugcuuugcuccagaaacuuuucuuuaacacgagaagguuuuggcuuaggugggauau

SEQ ID NO: 4127190 - RNA, 72 nt, Human
augucccuuuaagaguuaaacuuugaccugaguuuaaagggcuggaggggucaggaaugacugggaggacau

SEQ ID NO: 4127191 - RNA, 130 nt, Human
auguccuacuucaagugaccuauuaaaauagcucucaauaguuugcuuuaauacaacugccuuuaauagcuuuuaaauuuaguguuuguuugaguagacuuuauggugauuuguaaaaugauauggauau

SEQ ID NO: 4127192 - RNA, 85 nt, Human
auguccuucauaugaguauugugcagaugacacgagaucacggcugcagcauaggccuggcacugacagggugcucaagggauau

SEQ ID NO: 4127193 - RNA, 69 nt, Human
augucuagugucuauugaccggaaagaaugacauguuuuauugcauuuuucucaguagcacuuauccau

SEQ ID NO: 4127194 - RNA, 97 nt, Human
augucuccucugaaccagaguuaauacugaguuuauuaaccagaguauauuaaccagaguuaauaacagaguaucaacucugguucagaggacacau

SEQ ID NO: 4127195 - RNA, 71 nt, Human
augucuggacauugacaaucauggcuagacauccccuuccugacugaacauaaucaccaaugacuagacau

SEQ ID NO: 4127196 - RNA, 89 nt, Human
augucugucaagcagaucuguauuguaucacagucuuaaugauuuugacuguccagaagauagaaauauagauuaaauuugauugacau

SEQ ID NO: 4127197 - RNA, 56 nt, Human
augucugucuuuguacuccacagugccuagggcagugcuggguacacagcagacau

SEQ ID NO: 4127198 - RNA, 109 nt, Human
augugaaagcacaccacuuaaauguuuucuugauagacaaggaacaagcauguaguuuuuuuuaauugaaaagaucuguuccaugacuguauagaauucauuuucacau

SEQ ID NO: 4127199 - RNA, 70 nt, Human
augugaagaucaggguccuagaguaaccuaauauuuuguacauugguuauuugacuccucauuuuuauau

SEQ ID NO: 4127200 - RNA, 116 nt, Human
augugaauaguaagaaaagaucacuuuaaggggaauuuuguuuuaucuucauuguaaguugauguuuuuuaaaugcagcaguuucuguucuaaagcugauuacuacugugccacau

SEQ ID NO: 4127201 - RNA, 86 nt, Human
augugagaaaguacauauauuuaugauucuagagaaggccaaaaaugaguauggucaugggauuaugaauauauguauguacacau

SEQ ID NO: 4127202 - RNA, 78 nt, Human
augugagccaagcccguccaucacaggcacaguggugugagugaggcccaauggcuggauggagggaugagcccacgu

SEQ ID NO: 4127203 - RNA, 67 nt, Human
augugaguucaugcaauuauauccccaagcacacagccuaggcagauguauauaugagccgucacau

SEQ ID NO: 4127204 - RNA, 69 nt, Human
augugauaugcacauacaauggaaucuuauuugacuguaaaaaugaaguuccaguauaugcaguaacau

SEQ ID NO: 4127205 - RNA, 59 nt, Human
augugauguggugagaagaguacuacuucaccuccaugguauucuucucaaauauccau

SEQ ID NO: 4127206 - RNA, 74 nt, Human
augugauguuuugauauaugcauacauuaugggaugauuacaucaagcuaauuagcauaugcaucacuucacau

SEQ ID NO: 4127207 - RNA, 65 nt, Human
augugauuuuaagagaugcaccucuuaaaauugugucuuaagagaugcaucucuuaaaauugcau

SEQ ID NO: 4127208 - RNA, 65 nt, Human
augugcaaaaugauauccugaagcaccauaggaaauauaaaugguacgcucucaugcuugcacau

SEQ ID NO: 4127209 - RNA, 58 nt, Human
augugcaauuauuaagaagagaccugccagauuggguucuauugagguauuugcacau

SEQ ID NO: 4127210 - RNA, 65 nt, Human
augugcacugaugccagggacagaaaccacugcauccaccacugucaccagcaccaaugccacau

SEQ ID NO: 4127211 - RNA, 84 nt, Human
augugcauguuauuaugcuguggaaaauacaaagacaaauuaauuuugucuccaggcuacuuauacaagauaacaaaugcacau

SEQ ID NO: 4127212 - RNA, 73 nt, Human
augugccuacgaaguaauaagccaggcuugguacaauugugaaaggcuguccucucuugcucagugggcauau

SEQ ID NO: 4127213 - RNA, 65 nt, Human
augugcucauauguguguuagugacauguaugugcacaugucuggguauaugcauaugaucacgu

SEQ ID NO: 4127214 - RNA, 68 nt, Human
augugcuuaaagacacacagccagcaagugauggaaccaugaaaccauuucuagguguguuuggccau

SEQ ID NO: 4127215 - RNA, 56 nt, Human
augugcuucaggaugucagugucuggucaugaaaacagagaccauucuagccacau

SEQ ID NO: 4127216 - RNA, 66 nt, Human
auguggcaaaguaggggucuguugggggaaaaaaaaggccucaagagccaagcuucuuucucacau

SEQ ID NO: 4127217 - RNA, 102 nt, Human
auguggguagauauuucuaagccucaauauucuguaaaaugggaaaaacaagagcauuuaccuuacagcauuguucagaggcuuaacggaaauaauccacgu

SEQ ID NO: 4127218 - RNA, 65 nt, Human
augugguacagugugacuuuggagugaagccaaagguucucaccccagcuacacuuuacaaucau

SEQ ID NO: 4127219 - RNA, 57 nt, Human
augugguuuuuaugguucuggaguuccacauggcccagucucuuuccaaaaucacau

SEQ ID NO: 4127220 - RNA, 65 nt, Human
auguguaugguuguuguagagagaacaguagaacagauuuuucuguccaggcuuacuauauauau

SEQ ID NO: 4127221 - RNA, 81 nt, Human
augugucagcuaggaaaugauagggucugcccccuguagggcaaagggaaccuguacguuguccuugaaggacugacauau

SEQ ID NO: 4127222 - RNA, 78 nt, Human
augugucauugcugcuuuuaguuggauagaaggaaaacaguuucuuucugcugaaaacagccauguaaaacuacauau

SEQ ID NO: 4127223 - RNA, 60 nt, Human
auguguccauuaucaguucugguuguuacaaugaucaaauuaacuggauaauggccacau

SEQ ID NO: 4127224 - RNA, 77 nt, Human
augugucucagaguaucccugaacuggauguccucaucucaguuuagaguucaggguuucucaggaugaugauacau

SEQ ID NO: 4127225 - RNA, 63 nt, Human
augugugaauuccaccaagugugguuuaaaauggccccagauacacugagugaauuagcacau

SEQ ID NO: 4127226 - RNA, 55 nt, Human
auguguguguuuaauccucaaagcauuccugcaguuuguagauuaugccacauau

SEQ ID NO: 4127227 - RNA, 58 nt, Human
auguguuaguuugugauuauacagacuuacaauaagugugauuauuugauuaacaugu

SEQ ID NO: 4127228 - RNA, 56 nt, Human
auguguuuauaauuacucaaucacuauuuugugguugcagugauuuugaaauaugu

SEQ ID NO: 4127229 - RNA, 123 nt, Human
auguguuuccagccacaccaaaaggugcuugggguggagggcugggggcauagaaggucaggccucaggaggccucaaguucgcauucagcuuugccacuguaccaggugggcugacgcacau

SEQ ID NO: 4127230 - RNA, 84 nt, Human
auguuaaauucagcgauccccagaaagccuggcacuaggcuucccuggccagugacuggcuuucugguguguagaagaaaauau

SEQ ID NO: 4127231 - RNA, 61 nt, Human
auuuggacauaugaaaguagccuuugcuucuucuaccugugguugcuuucuagcuucagau

SEQ ID NO: 4127232 - RNA, 127 nt, Human
auuuggacauucuaaugcuaucaaaauaacauccaagccagucucaguuccuacuuucucaaucucaaguauggagcuucacgggggacagcauuuggaaguaaauugcuguauaaggacaucaaau

SEQ ID NO: 4127233 - RNA, 78 nt, Human
auuuggaccauggaccauaguuccuauuaagcaaucauaauagaguagagauggcaaacuaugguccauggaccaaau

SEQ ID NO: 4127234 - RNA, 71 nt, Human
auuuggcaggguuccucucuagcauuugguaauaauuccauaccaaaugcuagggagaaacucucccaaau

SEQ ID NO: 4127235 - RNA, 63 nt, Human
auuugggcaaagguagaaggagagggguaaaaccuacuauuuuauucugauuuuugcacaagu

SEQ ID NO: 4127236 - RNA, 64 nt, Human
auuuggggcucugaaaaagauguaguaaaaauauauuaugaguuuguuauuuagugccccaaau

SEQ ID NO: 4127237 - RNA, 89 nt, Human
auuugguuuuggagcuguaaggauuugacagcuaugugacucacagaaauauuuaacaggaguuguaaauacaguacugaaacucagau

SEQ ID NO: 4127238 - RNA, 91 nt, Human
auuuguaaaccagucacuggcugaggaaguugccacuguuggcuuagaucagggguaggcaaacuacaguuagcugccuguuuuuauaaau

SEQ ID NO: 4127239 - RNA, 130 nt, Human
auuuguauuguuauggaaaugaauaauaugauucugggaccaauagucuuucaacaaugugacacaauguacuggcacauuccucacauuuggagaaagccugccugggacagaaucugacagggcagau

SEQ ID NO: 4127240 - RNA, 60 nt, Human
auuugucaauacacuucuuccaaguuuaaaagccagucauuggagggauuguuggcaaau

SEQ ID NO: 4127241 - RNA, 86 nt, Human
auuugucaauuuucacaaagguauucucauuuuggaagcaagugucuuguucuccaauuggcauacuuuuaagaaguaugacaaau

SEQ ID NO: 4127242 - RNA, 56 nt, Human
auuugugcuuuggguuucuguuggagcuuccuccacaugagaucacaaagauaaau

SEQ ID NO: 4127243 - RNA, 74 nt, Human
auuugugggggcgaguggccagucucuucauguguaaaaucagaacaguaacaccuacucugucccccucggau

SEQ ID NO: 4127244 - RNA, 78 nt, Human
auuuguguccacguccauguuucuguguguuguguguaugcuugauugcacacagagaggugguaugucaucauuugu

SEQ ID NO: 4127245 - RNA, 79 nt, Human
auuuguucugcgucaugccacauaaccaguucacuuuccaugaaaucaacugauuguuuggcauuggauacacacagau

SEQ ID NO: 4127246 - RNA, 60 nt, Human
auuuguuucaaagaaagaaaauauagaugguauuuguguguuccuucucugagaccugau

SEQ ID NO: 4127247 - RNA, 120 nt, Human
auuuuaacguuuggccauuuuggugauaaucugaaauagucuuaucugagcauugacucacugaucuauauugagggguuugagguaagguauuuaguacaaucaccggugacuuaagau

SEQ ID NO: 4127248 - RNA, 77 nt, Human
auuuuaagaagaaucaggcaaauuucuuuuucucucucaucuagaaaggaaaggauuggcuucucugucauuaaaau

SEQ ID NO: 4127249 - RNA, 68 nt, Human
auuuuaaucaguucuucuguuuuucagagacaauucuguuuccuggauuaauagggagcuguugagau

SEQ ID NO: 4127250 - RNA, 68 nt, Human
auuuuacaacuuggugugaauaauuuaacucuaccuagagugugagcucuucuaacuaauuguggaau

SEQ ID NO: 4127251 - RNA, 128 nt, Human
auuuuacauaggacacaaaaaauggaaugcuuuuggacuuaaaccuguuuucuuuucaacuccuucugccuagaggagaugguagccucagaagaguucuuacuuccccuuccuagaacugugcaaau

SEQ ID NO: 4127252 - RNA, 103 nt, Human
auuuuacuaauaggagcaccaaauccuucagggccaggaaagcucuauuuaaccaugaauuuccucccuugggguuucguuauguuugguuacaaaguaaaau

SEQ ID NO: 4127253 - RNA, 66 nt, Human
auuuuagaucccaacaaaggacauggccauaauaaggcaucuaggccauaaucuuaggaucaaaau

SEQ ID NO: 4127254 - RNA, 89 nt, Human
auuuuagcugucucuugaguaacguaauuuguggaagggguagggcucccucuaugccuaccuccaaaauauauacucccaguaaaaau

SEQ ID NO: 4127255 - RNA, 62 nt, Human
auuuuagucuugggacauuuagggugguggcaaauaacucugcaguguaacagcgcuugaau

SEQ ID NO: 4127256 - RNA, 124 nt, Human
auuuuauaauaaauacaaaauaguuucagaauuacguuaccucuaaaaaauuagaagccuaucauguaagugucaauauuuuuguagguuuugguuuuguuauuauuuuuuucuauuuuagaau

SEQ ID NO: 4127257 - RNA, 78 nt, Human
auuuuauaauuucaccuuuuacauuuagguaggugaucuauuuuagguuaacuuuaguguaugagguaagauaaaagu

SEQ ID NO: 4127258 - RNA, 79 nt, Human
auuuuauauggaaaaaaauuggcuagcuucagguaauuuuaaugaauuggaagaaagccuauuuuguuucaucugaaau

SEQ ID NO: 4127259 - RNA, 56 nt, Human
auuuuaucaaggucuugcugggaugcuugucaguuuccaaaaugccuugauaugau

SEQ ID NO: 4127260 - RNA, 58 nt, Human
auuuuaugcagaacugcgagcccaguucuuuccugcguucuucaguuuaauauaaaau

SEQ ID NO: 4127261 - RNA, 60 nt, Human
auuuuauguaugugguguuuaccuaauauuuuaaaggguaagaugucauccacauagagu

SEQ ID NO: 4127262 - RNA, 80 nt, Human
auuuucaauuugacugugcuuugaucuuaugaauccacuuucaaagaugaccguaugucagagccagucuuauaagagau

SEQ ID NO: 4127263 - RNA, 64 nt, Human
auuuucagguuuugccauuguauuguauguauguaagauguauauaugggggaagcuggaugau

SEQ ID NO: 4127264 - RNA, 63 nt, Human
auuuucagugaucauagcacacaaaauuaauuuuugauagccuuuugugauuuggcuggaaau

SEQ ID NO: 4127265 - RNA, 62 nt, Human
auuuucagugucaauuuuuaaauauauuuuucuuuguguauucugguggugacguuggagau

SEQ ID NO: 4127266 - RNA, 64 nt, Human
auuuucaguuauagaaugguagagaaaagugcauuuucccaucuacaucuuguggccugaaaau

SEQ ID NO: 4127267 - RNA, 106 nt, Human
auuuuccuuugcaauuuggccacuggaggugccuagaugagcucuuucuccccaaagcugcugagagucgugaggcaguuuccccaucccacugcagcuggaaaau

SEQ ID NO: 4127268 - RNA, 61 nt, Human
auuuucucagccuccuugcuggagcacugggccugggcuccagcagaaagggcgaguggau

SEQ ID NO: 4127269 - RNA, 104 nt, Human
auuuucucucacauccuccucacccacccacugcucauuggccuauauuuugugugccaagaaagaacagcagggaaguggaggaagggggguugagagauagu

SEQ ID NO: 4127270 - RNA, 69 nt, Human
auuuugaaauacuugaaggaaaaagguuaagaacguaguuucacaaaccagucuuuaaguugucagagu

SEQ ID NO: 4127271 - RNA, 68 nt, Human
auuuugagcuccuauuaugugcccaguguggcauuagacacuguggggaaauaauaggagauaaaaau

SEQ ID NO: 4127272 - RNA, 70 nt, Human
auuuugucaugguuuccucaguuguucuucagcagugaacaugaagguauuuaagguuuaccagcaaaau

SEQ ID NO: 4127273 - RNA, 72 nt, Human
auuuugugagcccagguugaggcugcagugaacuaugaucaugccacugugcucuagccugggcaacagaau

SEQ ID NO: 4127274 - RNA, 85 nt, Human
auuuugugguuuggauuuacagcuuguuuuuuaugccuuuaaauuuacugaauaaaaugacaauaaaaguccaugccuacaaagu

SEQ ID NO: 4127275 - RNA, 90 nt, Human
auuuuguuaggacacauugcaggaaaguucauuauucuaggccuucaacagaauaaucuuagcaaccuccagugugauagagaacagagu

SEQ ID NO: 4127276 - RNA, 76 nt, Human
auuuuguuaucuuuaccagaaggaccagaggcaaggaugaaacuaagaagucaccuuugcuccuucuggucaaaau

SEQ ID NO: 4127277 - RNA, 62 nt, Human
auuuuguuguuguuguuguucccaggcuagaaugagccagaauuuagaaaacaacauaaaau

SEQ ID NO: 4127278 - RNA, 65 nt, Human
auuuuguuuuguucuugggcugguguuaagaucuuuaaacauaaagucuuugauaaagacaaagu

SEQ ID NO: 4127279 - RNA, 104 nt, Human
auuuuguuuuucaucagagccucuuugauugaguuucugaugcuugccaauauguugcugugguugagauucucaacaaagaguagcaaugaugacuccaagau

SEQ ID NO: 4127280 - RNA, 97 nt, Human
auuuuuaaaauuuggguuaaaauuaucauguacaucucuaguaaauuuuguauguuucguaugagaagaacaggugacuuuggcccacagugaaaau

SEQ ID NO: 4127281 - RNA, 71 nt, Human
auuuuuccucuuugauugacuacacgccuuuuuuaugaaaaagauuuguggauuuaaggauauggaaagau

SEQ ID NO: 4127282 - RNA, 55 nt, Human
auuuuuccugggugcuuuaguuuuuccauuuguacuaaaguaccccuggaagaau

SEQ ID NO: 4127283 - RNA, 93 nt, Human
auuuuucugcaauuugauaggguuguuuuguaacuuacggucuuaaaauuucuugagaauuuuuggcagaaacaaccuucaguguauaaaagu

SEQ ID NO: 4127284 - RNA, 62 nt, Human
auuuuugaagguuaauggaacugaaaaccccacuuuauaaguuccuaauaaccugaagaaau

SEQ ID NO: 4127285 - RNA, 80 nt, Human
auuuuugcuuggugugaacuuguucuucauccagacuaaaugguggucuugaaagaaggggucuacauccaauggaaagu

SEQ ID NO: 4127286 - RNA, 55 nt, Human
auuuuuguaauacugcugugugaaguauaguucuacaaagcaguaggauaaaaau

SEQ ID NO: 4127287 - RNA, 79 nt, Human
auuuuuguauuuuuaguagagguggguuucaccauguuggccaggcuggaccccuucuccuauuaaaauaaccaaaaau

SEQ ID NO: 4127288 - RNA, 93 nt, Human
auuuuuguugucacgcagaacagauuauauaccauuguuguaagugauuaauacauacauaugaaugauuuggcucagguaagcagcagaagu

SEQ ID NO: 4127289 - RNA, 77 nt, Human
auuuuuuaaacauuguacauucuguagcugugucugcuucaaaauuauagcugcacgugguaaauguaaaggaaaau

SEQ ID NO: 4127290 - RNA, 92 nt, Human
auuuuuucuguuuuccuugaaagcccagggcauacaaccagggacagaucauuuuuccccaugcuucucagcucaaggcaaacagcaaaaau

SEQ ID NO: 4127291 - RNA, 82 nt, Human
auuuuuugccaguaaaguuuuaguuccagucccuguuggugagaggguagcaaggcugggagaugaggccugugcaagacau

SEQ ID NO: 4127292 - RNA, 88 nt, Human
auuuuuuuaacugggcaaguauuuguguaaguuuuggaaguaagaacuuuugaagaauuaugcaaaagccaaaaccauguaggaaaau

SEQ ID NO: 4127293 - RNA, 73 nt, Human
auuuuuuugauccaguugaaagugaugaagacauagcaagugaucaugaugaugagcuggguucaaacaagau

SEQ ID NO: 4127294 - RNA, 94 nt, Human
auuuuuuuuauuuguuaucaguagaauuauuauaaaacauuggcuuuuuguagauuuuuuaaaguugugguucugcguuacauaugaaggaagu

SEQ ID NO: 4127295 - RNA, 114 nt, Human
caaaaaaaugaugaaaucaaaauauagaaacaagggagaggauucugacauacuagacaaugccaguaauguuguucuuuguuuuuccauuuuuuguuuuuguuuuuguuuuug

SEQ ID NO: 4127296 - RNA, 91 nt, Human
caaaaacaaaagcuucaguucuggggcaaugagaaaauuaaucaaacaucugcuucuuugaccccgcauggauugggaguuaagugcuuug

SEQ ID NO: 4127297 - RNA, 69 nt, Human
auuuuaccuacuucaaacuuuuaccugguuauaguaaugaauuguggaggaaaagaaguugggugaaau

SEQ ID NO: 4127298 - RNA, 92 nt, Human
auuuuagcuuuaaagcacuguaaagaaguaaguaugggugugggggaugggcuguauauuuuuauucuuauaauuguugagggaguugagau

SEQ ID NO: 4127299 - RNA, 63 nt, Human
auuuuauaaccaaaaauuugugcugcuuaaguaaaaaagcaggaagaguuuagguuguagaau

SEQ ID NO: 4127300 - RNA, 83 nt, Human
auuuuccaguucaauucuucaagugcuuuggagauagguauuacuaucuuuaugcacauaaagaaacugagacuuuggagaau

SEQ ID NO: 4127301 - RNA, 85 nt, Human
auuuucuaucaccuuuuggauaggaguugggcuuuuagaguaaacauuuucaugagccucugcuuaugcaaagguaauagaagau

SEQ ID NO: 4127302 - RNA, 61 nt, Human
auuuucucuggcuucucaggacccauauuaagaaaggcacccugcagcaccagaaggagau

SEQ ID NO: 4127303 - RNA, 62 nt, Human
auuuucugugugcagauaaauaacaaagugcuuuuauaguuguuuauuuuuauagagagaau

SEQ ID NO: 4127304 - RNA, 68 nt, Human
auuuucuuucucacuugcuucccugugucugacccuggcauuugggaagagcagguggguaagaaaau

SEQ ID NO: 4127305 - RNA, 77 nt, Human
auuuugaaauauugucagaaaaauaagugggagccacauuuuggaggauauugcauuucugacagagugcucagagu

SEQ ID NO: 4127306 - RNA, 111 nt, Human
auuuugccuucgcuuucucacacuaaguuaugcuuaugcuucauggucauaucaagcucaguuugggagauggggagauaauauuucuucugugagaaaguguuuugaaau

SEQ ID NO: 4127307 - RNA, 59 nt, Human
auuuuggaauuuauacaguaaugguugguaaauaucaccuauugccuaaauaccagaau

SEQ ID NO: 4127308 - RNA, 80 nt, Human
auuuuguaguuuucuagcacauggaaaaguaaccaggcacaaaauacauuugguuuccaaauguuggacaacuguauuau

SEQ ID NO: 4127309 - RNA, 66 nt, Human
auuuuguaugugcugaaauuuugaaauacugugcacugacguguuucacaaugagcauuacagaau

SEQ ID NO: 4127310 - RNA, 81 nt, Human
auuuugucauguguagguacacuuugaaaauaaaggaauaaaagccucuguucacagaaauuguguaccucaaauuaaaau

SEQ ID NO: 4127311 - RNA, 127 nt, Human
auuuuguuaugggaaacugaagauggguaaacauacaaugauaauaguacuuuauagggcuaaaucuaaaagccuuaaagauuaauauuauguuuggauaaaugcugaauaaguuuacauaaagaau

SEQ ID NO: 4127312 - RNA, 83 nt, Human
auuuuuaaauucuguaucuauuuugaaguuccuuagucuauagaauuacaugaggauucagaauguaugcaguggaaaaaaau

SEQ ID NO: 4127313 - RNA, 99 nt, Human
auuuuuaauuguaaaaacguucacagcuauucucauguauuuuucauuaaaaaaacuugcaaaguaaguggcuauuagcuguguuuuacagauaagaau

SEQ ID NO: 4127314 - RNA, 61 nt, Human
auuuuuagcaucgaaguaaauuuagguuauauacauagucuaggcuauagguguuggagau

SEQ ID NO: 4127315 - RNA, 92 nt, Human
auuuuuagcuuggcauggcauuuagagaauuaacauaacuccgguuauaacugguaaagaauugguucucuguaaauaccugcugcuugaau

SEQ ID NO: 4127316 - RNA, 62 nt, Human
auuuuuagugucuugcuuugggaaagggugcuacuggccuuuaguguacagacacuagaaau

SEQ ID NO: 4127317 - RNA, 72 nt, Human
auuuuuauuugguuugauuuucucaauucuuguccagaucuggggucuuuugaaagauugcuaaguaaaaau

SEQ ID NO: 4127318 - RNA, 66 nt, Human
auuuuucacucaagcaucuacagggauucagcugaucuaggcugggcucuaagcuuugggaagaau

SEQ ID NO: 4127319 - RNA, 123 nt, Human
auuuuuccuuucucauguuauugucuauuuuggggugacaaggugagaauagcuccauaaaaugaguugggaaauauucuugucuuguuuucucuggaagaguugguauaagauuggaauuau

SEQ ID NO: 4127320 - RNA, 88 nt, Human
auuuuuggaaagguggaccaagguggaagauaaaaauugugaagacaagcacaugauuuuguuucuagcuugcacugucccuaaaaau

SEQ ID NO: 4127321 - RNA, 66 nt, Human
auuuuuggagaaucuuucaaggccuguuccucaauuuuagcaggcagaaaauagucauccaaaaau

SEQ ID NO: 4127322 - RNA, 56 nt, Human
auuuuuggcaauguguguugcuucuacuuccagaagauaaagcacauagcaaaagu

SEQ ID NO: 4127323 - RNA, 66 nt, Human
auuuuugggccacaagccaugggaccaucucagaaugauggucuguuggcaugugcuaauuaagau

SEQ ID NO: 4127324 - RNA, 55 nt, Human
auuuuuguauccccagcuccuggcacagggucugcuagagagaggauauuaaagu

SEQ ID NO: 4127325 - RNA, 103 nt, Human
auuuuuucuagcauuagugagacaacagagcauaaugucuagcacacagcagguguucacuagacauuauuuguacuaucaucuaagccauguugcuaaaagu

SEQ ID NO: 4127326 - RNA, 97 nt, Human
caaaaaaugggucuuaaccuggagucuaugaaccucugcaaugacaugcaaaaugucauauguuuauacuuuucuugggugaagaucccuagguuug

SEQ ID NO: 4127327 - RNA, 130 nt, Human
caaaaaauuaggagggaguauaucccauguugaacugaacauuucuucccuuuagcagaaacaagccuuguuucugagagcugaagaaauguucaguucuacaugggauauaugcccuccuaauuuuuug

SEQ ID NO: 4127328 - RNA, 130 nt, Human
caaaaaggcugaccuucccuugacugagagagaacucagcuuaccuguuuucaugcuggaacaucauuauuuucuuuggacuucagcugaaacacuggaucuuucugggucuggaauguaucagccuuug

SEQ ID NO: 4127329 - RNA, 65 nt, Human
caaaaccaaauauucuagggaauguuaggcaaggaggacuuguuugcauuaauuagaagguagug

SEQ ID NO: 4127330 - RNA, 62 nt, Human
caaaaccagcaagauuuugcuuugcaggaaagaucugucuuugcaggauuuuguuuguacug

SEQ ID NO: 4127331 - RNA, 82 nt, Human
caaaacccauaagcagugguuauugcauugugaaaaaccaugucuuacacagagaaugaugagucacuguggugguguuuug

SEQ ID NO: 4127332 - RNA, 68 nt, Human
caaaaccuucaaauggauucagugagaguugcucccaugggggccuugcugcuuccagaaggugcuug

SEQ ID NO: 4127333 - RNA, 63 nt, Human
caaaacuagauuaccacugcuagaauuucagucuggucugugucugagcuagucuuaguuuug

SEQ ID NO: 4127334 - RNA, 104 nt, Human
caaaagaauacuuugcucugagcuuuagcugggauuuucuucucucacauuauuuuggcuuuuucaggauuucaguuugaaguuuaaguagagucauucuuuug

SEQ ID NO: 4127335 - RNA, 66 nt, Human
caaaagaguggcagagcuggcugcggaugagaaaaugucauuggcaaaaagcucugcaaugguuug

SEQ ID NO: 4127336 - RNA, 59 nt, Human
caaaaggcaggggaaagagugccauuaaaaauacguacaaaccuuuuuccuuccuuuug

SEQ ID NO: 4127337 - RNA, 70 nt, Human
caaaaguaaggaaccagcuaauauuguuaguccugacuggaaaacaagaauaagugguuucuggaaguug

SEQ ID NO: 4127338 - RNA, 85 nt, Human
caaaagugccuuugugggagcuuugggauucaggcaggaaguuacuaaaacuuguugcuacccaagaccuaggaagguugauuug

SEQ ID NO: 4127339 - RNA, 68 nt, Human
caaaaugaagcugaagaaacaggcugugaucagauuaugacaggccuugaguuuugggcuuuauuuug

SEQ ID NO: 4127340 - RNA, 129 nt, Human
caaacagccagacagaauuucaggguauugaaggaacuugccacagaaaagaaguucauuugugaauuaugaucuuucauguaguagauccuuuguacucccucaucacgaacauucuuggcauccaag

SEQ ID NO: 4127341 - RNA, 84 nt, Human
caaacagcuguuuucaauaaugcagguaaauucuagucauaggaaaaucucuauuacugccugagcuauuggaaaaguuuugug

SEQ ID NO: 4127342 - RNA, 86 nt, Human
caaacaggagccaccaugaggucagggggagccgguauugaaagccccgagugccaggccucugcuacgcucaguccuucuguuug

SEQ ID NO: 4127343 - RNA, 68 nt, Human
caaacauagcccuuucuuguuuaacugcauuuuguucaauguuuuaagcucuagaaggggaaucuuug

SEQ ID NO: 4127344 - RNA, 86 nt, Human
caaaccaugugagguauacguugguucagucuggaaaggugagccugccucucuggaccaaaccaguguauaccucacauguauug

SEQ ID NO: 4127345 - RNA, 63 nt, Human
caaacugguagggccccacauccuuagaauuuaaguucuaagacaugagacucagccaguuug

SEQ ID NO: 4127346 - RNA, 97 nt, Human
caaagaaccacucacuaaagcuuucuaguugacagcaugccagguaucaaagaguucacagugccugccuuuaacuuaaagcaugacagguuuucug

SEQ ID NO: 4127347 - RNA, 71 nt, Human
caaagaaccuucgagacagggcagguucauggcugccucguccacaaaagcccuguuuucuggguuccuug

SEQ ID NO: 4127348 - RNA, 87 nt, Human
caaagagaaaaaggcgguaucuuguuaucaggaaaacaguagcuuuuacagaggagcuucccgguagacaacugccuguucucauug

SEQ ID NO: 4127349 - RNA, 76 nt, Human
caaagagaacuaucagccacugggguuaaaacucaauaaggaggcauuccagugugcaugguacacaauuccuuug

SEQ ID NO: 4127350 - RNA, 82 nt, Human
caaagaugaauaaagcaggguccuugcacuagaggaaaccuugaggauucagaagugaaggcacucauuuuaucuaucuuug

SEQ ID NO: 4127351 - RNA, 80 nt, Human
caaagcagcaucuccugugcagagggacuguuuggaagauauagugaggagugcucagcgucacaggggagugcucuuug

SEQ ID NO: 4127352 - RNA, 61 nt, Human
caaagcauaguucaucuguccaugugacaugaaguauucauggaaggugaagcuagaagug

SEQ ID NO: 4127353 - RNA, 63 nt, Human
caaagcccuggaaucucuccaugggaaaguggauguacaaucucagaggauuccugggccuug

SEQ ID NO: 4127354 - RNA, 67 nt, Human
caaagcugaggccagaguuccccgagucauggcaccucaucugggggacucuuugccucuggacaug

SEQ ID NO: 4127355 - RNA, 104 nt, Human
caaagggagccacucagagggggccuuuggagaauccagucaugguccgaggcuacccugaacggacuccaggggcugcuaacuggacugugugagcucuguug

SEQ ID NO: 4127356 - RNA, 71 nt, Human
caaagguuauggcaauauaaucaucugcucuugcucugcaagggaaacucaauauugccuuaauuacuuug

SEQ ID NO: 4127357 - RNA, 71 nt, Human
caaaguaauuaaggcaauauugaguuucccuugcagagcaagagcagaugauuauauugccauaaccuuug

SEQ ID NO: 4127358 - RNA, 69 nt, Human
caaaguacagugcuuccugggaaauggaguuuuucaugugcucauagucucagaaugggcuguacuuug

SEQ ID NO: 4127359 - RNA, 58 nt, Human
caaaguccauaguuuacaauagagcucacucuuguuguuauacauucuauggauuuug

SEQ ID NO: 4127360 - RNA, 59 nt, Human
caaagugcuggaauuacaggugugagccaccgugccuggcaaggagccagauacucuug

SEQ ID NO: 4127361 - RNA, 55 nt, Human
caaagugcugguauuacaggugugagccacugcacccaaccugagccacauuuug

SEQ ID NO: 4127362 - RNA, 126 nt, Human
caaaguuguuuguucuuuuuguuuguuauuccuucgaguuuauuuuuaaugguuguugauuauaagaacaaugaauuugaaagcauauuaggacugaauuaggauacaaacacauacacaacugug

SEQ ID NO: 4127363 - RNA, 129 nt, Human
caaauaacauccuuucucauccuuuuuuugaaugcagaacucuucauuuuggaacuguaaauuuggcacuuguaugucauuuaucuucagaauuucuguuaauggaagcaaaugaggaggagauuaugg

SEQ ID NO: 4127364 - RNA, 78 nt, Human
auguuaaccauuuucuaugcauuacuuaggagcauccucacagaagcccugugauguagcuagaguagggaccaacau

SEQ ID NO: 4127365 - RNA, 69 nt, Human
auguuaaccuuccugaggaaagucuaagauauggucaucacacuuauuuggaucuuaugaagguggcau

SEQ ID NO: 4127366 - RNA, 62 nt, Human
auguuacagagaaaguggaagcuaucagaaaugaaguuuccucaauccuuucucucuggcau

SEQ ID NO: 4127367 - RNA, 79 nt, Human
auguuagaagaucuaguuucugguucuugcucuggugcuaaccagccagaucacucaaccagagcucuuuauccaacau

SEQ ID NO: 4127368 - RNA, 72 nt, Human
auguucacugauuuagucauuuauaucugacugugcaaugcaguggcaugguugacugcaguaaaagaacau

SEQ ID NO: 4127369 - RNA, 129 nt, Human
auguucagaaaaauggucagguccucagggaauaguuaaaacugugcaggacuagacuacuuagguuuauaucccugccucagugcuugacagcucugggaccuugggcaccucaguuuucucaucuau

SEQ ID NO: 4127370 - RNA, 90 nt, Human
auguucaguugcagguggggaaguaugaacggaaggccugggaaucucuuccauuagaccacuggggugccccuuccuguagcucaacau

SEQ ID NO: 4127371 - RNA, 55 nt, Human
auguucauauccccauucugaucagucacugaugcaggaaacagggaaugggcgu

SEQ ID NO: 4127372 - RNA, 61 nt, Human
auguuccuaccucuggcccagacgcccaccugcugagggagccaaggaggcuagagaacau

SEQ ID NO: 4127373 - RNA, 72 nt, Human
auguucucugugacacauaaaauuauauguauguauauguauccguguguguacagaauaugcuaugaacau

SEQ ID NO: 4127374 - RNA, 88 nt, Human
auguugaacugugaacuuuggaaaugagaagccaccuuucgccgcuucugaaggugacucacaaagccaguuucacuugguuccacau

SEQ ID NO: 4127375 - RNA, 84 nt, Human
auguuggcagucccuccaacacaguauuagaauacuucugucucuauucuacauuauguuuauugggacuggggaggcuaacau

SEQ ID NO: 4127376 - RNA, 77 nt, Human
auguuggguacaauguagaguaaaauauguuaggauacucaaauucuuagcaaucaccaccucuauauuuacugcau

SEQ ID NO: 4127377 - RNA, 66 nt, Human
auguuggguuuguuucccuuuucugccaacugcuuucuggcuggagagagaaaaagccuuaaacau

SEQ ID NO: 4127378 - RNA, 103 nt, Human
auguuguaucaaaauguagauauaguauauaguggcgcuguaugcuguauucagcauaugguauuaguggugcuaugugcuauuugcaguauguauacaauau

SEQ ID NO: 4127379 - RNA, 59 nt, Human
auguuguugaacucuuugcauguuauuuaguaugaugugcagaaaacacuuaagaacgu

SEQ ID NO: 4127380 - RNA, 55 nt, Human
auguuuacuuguucugcugaauucugacccccauuaggauggcaagcaagugcau

SEQ ID NO: 4127381 - RNA, 63 nt, Human
auguuucaccagcaaauuaccucgaugaguccuuccuggggauuuguaauuuguuugauacgu

SEQ ID NO: 4127382 - RNA, 82 nt, Human
auguuuccuaagggggagccaugcaauauguugaucuauuaacagauauuaugguuucuccuuaggcuucugaugcaaacau

SEQ ID NO: 4127383 - RNA, 62 nt, Human
auguuugcuuuagguauagaauccaucugagcuaucuuugaaggaaucagccaaaguagcau

SEQ ID NO: 4127384 - RNA, 81 nt, Human
auguuugcuuuuuauagugucuuucuucacaggcacuaaagguguugugagaaaaggcauuaaagucagagcuauuaacau

SEQ ID NO: 4127385 - RNA, 62 nt, Human
auguuuggaauuugcauacugggaaaguugggguguuuugcagaaugcaaauuuuauaauau

SEQ ID NO: 4127386 - RNA, 77 nt, Human
auguuuuaugccaaggaucaauauguauauuuaauagaaauugggauauuuaacuauucuuuggcgaucugaaauau

SEQ ID NO: 4127387 - RNA, 64 nt, Human
auguuuuuaauacuucauuacuuagguagggucaauuuguauugugagguauuaggaccuacau

SEQ ID NO: 4127388 - RNA, 59 nt, Human
auuaaaauagaauuggaagcagaguuaggaaauuucuaaucugucaguuuuguguuaau

SEQ ID NO: 4127389 - RNA, 97 nt, Human
auuaaacuaagagaucugugacaguacagacauauauaaauauaguaaaugucuugauauuuuacuguuuggaaaacacagagcauauuaguuugau

SEQ ID NO: 4127390 - RNA, 69 nt, Human
auuaaauucucugugguaugucauagcaaguggcaauuguauuuguuagauacuacagcaggaucagau

SEQ ID NO: 4127391 - RNA, 129 nt, Human
auuaacagaguuuauuuucuagcagaaugcaauccuaucuuaguucuagagucuaaucuauuuagaaauuucuucuugcagggcugaugggaagugcaguaguuggagacuaaaguaagaaaugaagau

SEQ ID NO: 4127392 - RNA, 129 nt, Human
auuaaccuuauaguucacaauuaugaaauauaugcaaacuaaguuguuuccuuuuucccucuaaauauucugggacaaugaggaacaacuagugauugacagaucauaauuugauaaauaauggcuaau

SEQ ID NO: 4127393 - RNA, 78 nt, Human
auuaagaauuucuagccuaaaacguuuaaguuugaacgacucaacggggaguccuugaauguuuugaaaucauauaau

SEQ ID NO: 4127394 - RNA, 64 nt, Human
auuaaggagguaaacuaugguugcaaaauccuuucuauaccgcaaaguaguuuucagccuuggu

SEQ ID NO: 4127395 - RNA, 81 nt, Human
auuaaguaggugcaaaaguaaugcagguuaugccauuauuuucaauggcaaaaacugcaauuacuuuugcaucaaccuaau

SEQ ID NO: 4127396 - RNA, 81 nt, Human
auuaauaguuuaugaaugugucagacauaggacccaguuucuauccuaugaggucugaaucacauuuauuaaaauuuuaau

SEQ ID NO: 4127397 - RNA, 72 nt, Human
auuaaugaggcaggaaaggcguaucugggaaauaaaaucaucaucuaagcauggcuuuucuucuuuguuaau

SEQ ID NO: 4127398 - RNA, 125 nt, Human
auuaauggugcgaaauuaauuugaaguuacagcaauuuugugcacaagugcuuuuaauucuaagcucaaauuugaagauuguuguguugccucugaccucaguuuuuaaucugugcaccauuaau

SEQ ID NO: 4127399 - RNA, 75 nt, Human
auuaauucugcucugaagccaggauucuggggagucuuuacuccagauaguaaccuuucuagagcgagaagggau

SEQ ID NO: 4127400 - RNA, 72 nt, Human
auuaauuuacacauccauguuuugacuuuggcguccuuaaggaaauagaggcaacauguauguguauauaau

SEQ ID NO: 4127401 - RNA, 55 nt, Human
auuacaagaugggaaagggaagugugaccgggacacucugagagccacuuguagu

SEQ ID NO: 4127402 - RNA, 76 nt, Human
auuacaaucaaauuaguauugcgauucauuagcaguacuacuguuaaauaguaguaguaguaguugagguaguagu

SEQ ID NO: 4127403 - RNA, 74 nt, Human
auuacaaucauucaggucacuuggaagguuugcaaaaaucacauguuucaaguguccugauuaauggaaguaau

SEQ ID NO: 4127404 - RNA, 68 nt, Human
auuacagaaacagcgugguuagaacuccagaaaucuggguuuuuccaauucugauucuauuauguaau

SEQ ID NO: 4127405 - RNA, 101 nt, Human
auuacauguagagauguuuuuagucugacuauuaccuccaagaauucuuauggagugugaaaagugguauucauuaaagacagaauuuaugggcaugcaau

SEQ ID NO: 4127406 - RNA, 85 nt, Human
auuacguuggugcaaaaguaauugcggguuuuuuggccaguggaaguaauggcaggaacugcaauuacuuuugcaccaauuuaau

SEQ ID NO: 4127407 - RNA, 130 nt, Human
auuacucccaauaucaacaguggguguacacuccuccugugauauuguuuguuauaucuaagaaagaagaggaugauauuacugucaauaucacagaagguguacagccccuugugauguuguuucuaau

SEQ ID NO: 4127408 - RNA, 97 nt, Human
auuacuccgaaaggaccuuuugaagauaagcuauuuugaugggguuagaauucacaugaguauuauuuuccaaaguaauuguaacuuucugagugau

SEQ ID NO: 4127409 - RNA, 66 nt, Human
auuacucugcauuugugaagaugcaccuccuccaaugaucagauguauuacagaugcaucagugau

SEQ ID NO: 4127410 - RNA, 84 nt, Human
auuacuuugcagaaauaaagauauuaucaggcaagaaaagcuacauuaugcugcagugacaaaaucuuauugacuuaaaguaau

SEQ ID NO: 4127411 - RNA, 130 nt, Human
auuagaacaccugggagagcuguuaaacaauauauaagucugggccuccuucccagaggugguaauucaguuggucugugauggggcguaggcaugaauauuuuuagaaaaaucccccagugcuucuaau

SEQ ID NO: 4127412 - RNA, 98 nt, Human
auuagagaaaaaguagaaaaccaccgcuguuguauguuuuuuaauugcuuacuauaauuauuaugacaacaauugcuggguggauuuccaucucugau

SEQ ID NO: 4127413 - RNA, 66 nt, Human
auuagagaauaaacgagauuuggcauguuuauuuguguucauguugaacuuguuuuguuuucuaau

SEQ ID NO: 4127414 - RNA, 72 nt, Human
auuagaguaguuugaagcacaugaauggcaaggugaaugcccuuagcuaacauuaaaucaggcaacucugau

SEQ ID NO: 4127415 - RNA, 95 nt, Human
auuagagugugguuuuacucuauaaauuuacuaaaaaugaguggauuguauacuuacaacuggugaauuuuaugguaugcaaauuacacuucaau

SEQ ID NO: 4127416 - RNA, 130 nt, Human
auuagauuuuugaguaucuuucugcucagguaaguuaugcuuuuaagucuugcuucuuucccuaaauaucacagcuuugcuugcaagauagguuacuuaaauagcagauuucuguucuuuugauuguagu

SEQ ID NO: 4127417 - RNA, 129 nt, Human
auuagcaagcaagccacacuagacuuuaaaauugaacugagggcccugcugaagcacagcuucuauuguucuguaaugaguguuuugcagaguccuuucaaaaguaaacuguauuguucccuugcuagu

SEQ ID NO: 4127418 - RNA, 81 nt, Human
auuagcaugaccuuggagagggcuuggaucacacuguacucagcgguugugugguucccuuuuuuauguuuccaugcuggu

SEQ ID NO: 4127419 - RNA, 91 nt, Human
auuagcgaagaaauuuccuuuucugagagggccaagauuacguuuuguguaaucuugcuuuccauagaagugaccacuuucaaguacuaau

SEQ ID NO: 4127420 - RNA, 64 nt, Human
auuagcgguugaagggaggaagaguuuugauaucccuggcuugauccuccaaccagcugcuaau

SEQ ID NO: 4127421 - RNA, 61 nt, Human
auuagcuaauguggacucuaucaaaguuaaguuucugauuuugauaaucauguuagagaau

SEQ ID NO: 4127422 - RNA, 55 nt, Human
auuagcuccaccauuuggcccugaaauucccccaagggccagagguacuacugau

SEQ ID NO: 4127423 - RNA, 62 nt, Human
auuagcuugguaugccauaaagugguaguacuauuuuccauacugugggauauggagcuggu

SEQ ID NO: 4127424 - RNA, 69 nt, Human
auuagcuuuguccucacugcaaguuuauuguucguugagguaagcaagugguagaaggacaacguuaau

SEQ ID NO: 4127425 - RNA, 58 nt, Human
auuaggaaucaaauuccgaaagggcuagaucauugcucuccgggagcugauaucuaau

SEQ ID NO: 4127426 - RNA, 81 nt, Human
auuaggaguaacaggauccaaagaauguauugaacuucauuguuuuaguuggcaucuuugcgagccuuuuaaugaucugau

SEQ ID NO: 4127427 - RNA, 56 nt, Human
auuaggauuugguauggucauaaggauagagcccuuaugaaaggacuaaugcugau

SEQ ID NO: 4127428 - RNA, 83 nt, Human
auuaggcuggaccauaggaaauugcuauuuuuuguacgucagagaugguuaaugauuggcaguuggcugugguucaaccuaau

SEQ ID NO: 4127429 - RNA, 62 nt, Human
auuagguuaggggucucaagaugagaucauccuggauuauccugguggccccuaaauccaau

SEQ ID NO: 4127430 - RNA, 59 nt, Human
cacugaacuggucuuaggaggugaauguuagagaaacaugucuuuugucuagcucagug

SEQ ID NO: 4127431 - RNA, 76 nt, Human
cacugaagauacggugacaaaauggagacgugcaaaauuauauucuucuauugacauucacuguaacucuucagug

SEQ ID NO: 4127432 - RNA, 59 nt, Human
cacugaagcuuucauucucuugucuuccacagacuuugagagaaaaaugagcuucauug

SEQ ID NO: 4127433 - RNA, 85 nt, Human
cacugacaaaaagccuggggcuggaacguucugugcugccugcauggcauguacaggaccgcggcccccuggagcugguggagug

SEQ ID NO: 4127434 - RNA, 76 nt, Human
cacugagaaggcaggagaggagaaauucagagggaggaguccuccagcagccugacuucccucuugacucucagug

SEQ ID NO: 4127435 - RNA, 63 nt, Human
cacugagcuaggaguuaggaagcuggacugccuguccaggcuuucugacuuuagacucugaug

SEQ ID NO: 4127436 - RNA, 63 nt, Human
cacugagcugauagaauuccaguuagaaagcaaagaaacuuggcauuuuaguuagcuucagug

SEQ ID NO: 4127437 - RNA, 101 nt, Human
cacugaggugaggagggcaccagggcugaagggucuccaaggcaggcgugugauaucagacugucauguaaccuuucugagccuugguuccccaacuugug

SEQ ID NO: 4127438 - RNA, 87 nt, Human
cacugaguauauauguuuguuuagaugguaaaucaguauugagauauacuggacuuaaugaugaauuguauauacaaauauucagug

SEQ ID NO: 4127439 - RNA, 82 nt, Human
cacugaguaugaaagaagauaaaagcuguguguuauuaaaauauucugcauugacuuuuauuuccuguagauguaaucagug

SEQ ID NO: 4127440 - RNA, 62 nt, Human
cacugauuggcuaagauuuggucaccugacugggaugccaucaaaugauuggccauucagug

SEQ ID NO: 4127441 - RNA, 59 nt, Human
cacugcacuccagcgugggcgacagagcaaaacuccaucuaaucaggcugggugcagug

SEQ ID NO: 4127442 - RNA, 61 nt, Human
cacugcagaucagaggcugagaggguaauaacggaauaucccgagcagcuuuaugucagug

SEQ ID NO: 4127443 - RNA, 66 nt, Human
cacugcagggcagagggagaaucucuggaaaacucacuagaggugaaagaauuuggcucugaagug

SEQ ID NO: 4127444 - RNA, 55 nt, Human
cacugcaguggucagagcagagguggugagagcuugggcuagagacuuagcagug

SEQ ID NO: 4127445 - RNA, 81 nt, Human
cacugccuaggcagguucguuccacaauggaccugagugcaaagggcucccagggggaugaacacugccuggagaugcgug

SEQ ID NO: 4127446 - RNA, 111 nt, Human
cacugccuggauguuugguagacuugaauagcauguuuagugcauaugaguuuaucuuucagauuuucauguauaugcaugcauucaaaggcuauaaaaauuccuccagug

SEQ ID NO: 4127447 - RNA, 59 nt, Human
cacugcuaguguguuccugauaaaaugguacacauuguucauuguacaccuaguaugug

SEQ ID NO: 4127448 - RNA, 93 nt, Human
cacugcucuucagcauuaaucauugguggaugacugaaauaaacagaauuuaaaguauucugaggucauuguugcauuaauugaagggcugug

SEQ ID NO: 4127449 - RNA, 61 nt, Human
cacugcugcuguuuuucaauucauuuugguugacuaacauugaauuuaaaauacaguggug

SEQ ID NO: 4127450 - RNA, 65 nt, Human
cacugcuucuuuccuuggugacuucacuuucacuguugcaguccuuaggagaggaaguaucugug

SEQ ID NO: 4127451 - RNA, 56 nt, Human
cacuggaaccaagacccagggccuagacugcagaguccagggucagaaguucagug

SEQ ID NO: 4127452 - RNA, 57 nt, Human
cacuggaauauggcguugaaccugucuucuugcugucauggccuuuguauucuagug

SEQ ID NO: 4127453 - RNA, 56 nt, Human
cacuggacuccccaagggccaggugugcaguucguucaccucagggagauccagug

SEQ ID NO: 4127454 - RNA, 82 nt, Human
cacuggaggucuaaugaaagauguaggaacuuuaugccugauaugugugugguuuuuguuucuuugguugcuucuuuuugug

SEQ ID NO: 4127455 - RNA, 70 nt, Human
cacuggcagauuuucucuggaggaguugauuucacgcuccaaaauacagaaggaucugacucuuccagug

SEQ ID NO: 4127456 - RNA, 79 nt, Human
cacuggccagguagaggggaccuagcggggagcuccaacaguguggaugcuacaggauucuccuuaucuguguucagug

SEQ ID NO: 4127457 - RNA, 66 nt, Human
cacuggcuggcagaugcucuugcuuaagucacaugacuauguagaacaggaaguacugcagcagug

SEQ ID NO: 4127458 - RNA, 70 nt, Human
cacugggagaugaacaacuagaaauguaaauucaaacaguuuuacauucacaguuguucaucucccauug

SEQ ID NO: 4127459 - RNA, 64 nt, Human
cacugguggaaagcaucugauagccgucuuauuucucuucggacccagugcuguucauucagug

SEQ ID NO: 4127460 - RNA, 68 nt, Human
cacuguacuggguugaaggacgucccccccaaaaauauguguccuguauacaaacccugguaccagug

SEQ ID NO: 4127461 - RNA, 70 nt, Human
cacuguauguagaauagcugacaacugugaaguugggauaacaaugaauuugucaugcauucuuacagug

SEQ ID NO: 4127462 - RNA, 76 nt, Human
cacugucacugaggaugcacgguccucuccuugcccuggaagcagagaacgggaaugugcagccacagugagugug

SEQ ID NO: 4127463 - RNA, 64 nt, Human
cacugucuguguguccuuggggcaaauuccuucacuucucauccuucggauugcauauacagug

SEQ ID NO: 4127464 - RNA, 58 nt, Human
cacuguggugccaaaccuggaguucucaaaucuccaagguuccaagaaaucaucagug

SEQ ID NO: 4127465 - RNA, 80 nt, Human
cacugugucaaauaucuuugcaguucugauuaaauagccaacauuaucuguucuucaguaagcugcaagugaagucagug

SEQ ID NO: 4127466 - RNA, 107 nt, Human
cacuuaaaauuaaucucuucucaggaaaacuguauuugaauaacuuggggcaacuacuaauguuuucugggugaauggguuuucagagcugcuggauugugugugug

SEQ ID NO: 4127467 - RNA, 82 nt, Human
cacuuaauuaauuaguuaagcauguaaacacugagauaaauuccuguauuauuaaauaugcuugaauaaugugaugugagug

SEQ ID NO: 4127468 - RNA, 92 nt, Human
cacuuacaucucccaauauauuucuuguuauucucguugaguacugcauucagacagagguugccaauaaaguuuauuguaggagcuaagug

SEQ ID NO: 4127469 - RNA, 104 nt, Human
cacuuacuuauccaugagcccaggucuucacaucugugaaaugggguuaauauuguuugacagaguugugaggauuuaaugaauggcucauuguuagucaagug

SEQ ID NO: 4127470 - RNA, 69 nt, Human
cacuuagaaggucagccuuggauuugguagcaguaugugaaaugcucagagauaaaacugaucagagug

SEQ ID NO: 4127471 - RNA, 58 nt, Human
cacuuauaaaauguggaaagucaucaaaacauaggaugauggucaacaauuuugagug

SEQ ID NO: 4127472 - RNA, 80 nt, Human
cacuuauccgaaguggccacuagaagcucagcuggucaggggggugcugaaggcagagggcaguggucaggagugaagug

SEQ ID NO: 4127473 - RNA, 61 nt, Human
cacuuaucugcagaccgguuucuuccuucuguguggcaagaagcauggcuguagauuccug

SEQ ID NO: 4127474 - RNA, 59 nt, Human
cacuucaagagcaagggugccacaaauuuaguguauucuaacacaugcucuaagaagug

SEQ ID NO: 4127475 - RNA, 68 nt, Human
cacuucaauacaccucaggcagcaaagucucagcuuuugagccguggucucugaggguguuggaugug

SEQ ID NO: 4127476 - RNA, 65 nt, Human
cacuucaauugcguuaggaggucuuugcuggucuccucccuaaagcugccuucgcaguuggucug

SEQ ID NO: 4127477 - RNA, 69 nt, Human
cacuucaugccuuggguuugucuucugucaguauccucagcacccagaacagagccgggcacaaagcug

SEQ ID NO: 4127478 - RNA, 67 nt, Human
cacuugaacuguuugaaugagaaagguguucauuaaaagacauuguuuauucaaauacuuugggaug

SEQ ID NO: 4127479 - RNA, 71 nt, Human
cacuugacacagaauuuggcuaucacauuucaguggauuguggggcuguggaguaauuguguguguaugug

SEQ ID NO: 4127480 - RNA, 70 nt, Human
cacuugaccccugggacacagauuccagcauaagaaugugccugugccagccugucccaggaggcaggug

SEQ ID NO: 4127481 - RNA, 59 nt, Human
cacuugaguucuuaauagucagucaccccaaaaggaggaauggcuauaggaacaaagug

SEQ ID NO: 4127482 - RNA, 57 nt, Human
cacuugauggaagagcagaagagaacuaacccacucccucaagcucuucuauaagug

SEQ ID NO: 4127483 - RNA, 70 nt, Human
cacuuggaaaugcaaauauauugaaucugauuuuauuuuagaaguucaaagugcauguuccucagaagug

SEQ ID NO: 4127484 - RNA, 57 nt, Human
cacuuggaguuuuuacuuguauuuaaaauuuaaagcagcaagugaaaacuaugggug

SEQ ID NO: 4127485 - RNA, 124 nt, Human
cacuuggauauggagaaugcuggacagagagaaauuaguugguuugcucaagauuacccaauuaauaauuggcaggauugguuucuuguaccugguucgggguucucuguauuccaucauagug

SEQ ID NO: 4127486 - RNA, 59 nt, Human
cacuuggcccugagguuaucaucuaggauccugcaaugagaggcagcagggcucuggug

SEQ ID NO: 4127487 - RNA, 68 nt, Human
cacuugggauaagguaugugaaguacuuagccaagggcuugguacauggcccuccuugucagcaugug

SEQ ID NO: 4127488 - RNA, 59 nt, Human
cacuuguagaggcauuauuccaaaggaguucacagguuccuauguaaacccugcaggug

SEQ ID NO: 4127489 - RNA, 78 nt, Human
cacuugucauuggauuuaggggccuccuggauaauccacaaugaucucgucuggagguccuuaacauagugauaucug

SEQ ID NO: 4127490 - RNA, 65 nt, Human
cacuuguguggcaagcuguaugcuagacccaaggguuggcgagcaaaauaguuucuaccccugug

SEQ ID NO: 4127491 - RNA, 61 nt, Human
cacuuuacaaacuccucacuguugguuggcaacuaaacacagcaagagggagugugaugug

SEQ ID NO: 4127492 - RNA, 66 nt, Human
cacuuuggaauguugggauuuaaguguaugacuuaagugcauugccaucauaagcauucaggagug

SEQ ID NO: 4127493 - RNA, 70 nt, Human
cacuuugggaggcugaggcggauggaucacuugagguaaggaguucgagaccagccuggccaacauggug

SEQ ID NO: 4127494 - RNA, 65 nt, Human
cacuuuucaaaguacuacucaguucagcaguuccuuucugcugcuguuugaagacuuuguaagug

SEQ ID NO: 4127495 - RNA, 55 nt, Human
cacuuuugauuuuuucccagaagaaaauauuucauccaggaaaguuuuaagagug

SEQ ID NO: 4127496 - RNA, 60 nt, Human
cacuuuuucagacuaauagggcauaauuuacuuuauuguuuucuauuaccugagauugug

SEQ ID NO: 4127497 - RNA, 106 nt, Human
cagaaaacacacacagacacacauauacacacaugcuccggccuuccugggaaaucaagucugcaggucagggcagcggugcuuguguuauggguguuuguuucug

SEQ ID NO: 4127498 - RNA, 77 nt, Human
cagaaagaaggguggcugaguagauggaagagcauaguauggccuuucccucugugccagcuucuccgucccugcug

SEQ ID NO: 4127499 - RNA, 56 nt, Human
cagaaauaaacuucucacaucguuaguuccugagauugugugaguguuuguuucug

SEQ ID NO: 4127500 - RNA, 78 nt, Human
cagaaauauaaagauagaaugcuuuccuguguguugaaugagucgauuuauggaagucauucuuuuuuaucuaauaug

SEQ ID NO: 4127501 - RNA, 73 nt, Human
cagaaaucagcauaggauguggagccaggauugaaauccagaucugugacucuccaguccgugcuuuuuuuug

SEQ ID NO: 4127502 - RNA, 113 nt, Human
caaaacagaugacuaauaggugcuugaagcucugauagaaaugcuugcaaacuagaacauuuacaaguaggugccaacaguauuucugccaaagcaagcgcuguacuguuuug

SEQ ID NO: 4127503 - RNA, 68 nt, Human
caaaacauucagagagcucacuugacccaaccgaggguuuuacuuggugagccuuucuaguagucuug

SEQ ID NO: 4127504 - RNA, 130 nt, Human
caaaaccugauauguggcaaaauacugaaagaaugcagaagacugaaaagcugaaguccucuucuuccccagagcugcuucuguccuuugaaaaacauucuguacauauucaaggcauauuaaucucuug

SEQ ID NO: 4127505 - RNA, 64 nt, Human
caaaacugccuuauaauaugucaacagaauuacuuccuguugcuaaacauagaggggcaucuug

SEQ ID NO: 4127506 - RNA, 76 nt, Human
caaaagaagcugcuuuuggagacaucuuaggauauagaacccuauaaacuauauguuagccagagggcuuuuuuug

SEQ ID NO: 4127507 - RNA, 81 nt, Human
caaaaggguggagggagguuagauucaagcuccgugucugacugcuugagcuaggacaucaaucuucuucugccuucagug

SEQ ID NO: 4127508 - RNA, 71 nt, Human
caaaaguaccuugugugcuuuguaaccuuucuggguaacuccuuaaaugaacauacaagggugcuuguuug

SEQ ID NO: 4127509 - RNA, 74 nt, Human
caaaaguauauucccaugaagagguagagaguucuuuucuagaggucucugggaaauggagaauuuuauuucug

SEQ ID NO: 4127510 - RNA, 56 nt, Human
cacaagguuggcucuuucuuugugccugaagagcacacaugaguucucaucuugug

SEQ ID NO: 4127511 - RNA, 75 nt, Human
cacaaucagaaagacccaaugguauuuggcaaugaaaaguuuuauacaggaacuguuggcucccuuuugucugug

SEQ ID NO: 4127512 - RNA, 61 nt, Human
cacaauucacacuggucuccagucaguagaccauguugcugagugggauuccugugcugug

SEQ ID NO: 4127513 - RNA, 72 nt, Human
cacaauugucagugcuguuuaaauuguauccucucucucucuuaauugaacuuuugucacugacauguugug

SEQ ID NO: 4127514 - RNA, 68 nt, Human
cacaauuguucuaggucauccuuauuacucccauguuagagaugagaaggcucaggcuuagagaggug

SEQ ID NO: 4127515 - RNA, 93 nt, Human
cacaauuuauuuaagcagucgccuauugaucaacauuuggguuguuucuaauccugugcuguuaauagugauacugcaaugaauaaccuugug

SEQ ID NO: 4127516 - RNA, 70 nt, Human
cacacaaauauaauaauccuuacugaaugagaaaaaugccuuuuuucuugaaggaaggguucuuugugug

SEQ ID NO: 4127517 - RNA, 70 nt, Human
cacacaccccucuguagagcccucugcucuaaauaagaucuacggaagcguucucagcaggggcaaugug

SEQ ID NO: 4127518 - RNA, 69 nt, Human
cacacaccuuucagguccagacagucgaggcggugcccgaggucugugaauuccugagaaaguagagug

SEQ ID NO: 4127519 - RNA, 90 nt, Human
cacacagauuucugucuacauguacuauucacugucaucugaacuucccacucaaugcagcugauaauuacauguucuggaagcugugug

SEQ ID NO: 4127520 - RNA, 96 nt, Human
cacacagccccagauuaaaugugggaaccagcagagugggguuuagagucaggcagcccagauucaaucccagcucugcuacuuccuggcugugug

SEQ ID NO: 4127521 - RNA, 85 nt, Human
cacacauaaagauuaggcugaggagggauguugcuuauuucuuuaggaaaauaugauccuuagugagacugaucucaaauguaug

SEQ ID NO: 4127522 - RNA, 58 nt, Human
cacacauuucagaugcuacaaugccguaaacaggcacagugaucauagugggugugug

SEQ ID NO: 4127523 - RNA, 89 nt, Human
cacacccagcacuggcucacgaggguccuggggagagcuagaacagacuggcacugccuggcagggccccacgggagccacugacugug

SEQ ID NO: 4127524 - RNA, 81 nt, Human
cacacccccuguaccccaguggcuuuugcccagguuggagucauuuuauccgcaguggccccuggggcuucauggucagug

SEQ ID NO: 4127525 - RNA, 79 nt, Human
cacacgcauucugucuucgaggcuaauaguggcuccaugugugcagcugccugugcccuggaaggagagagugucugug

SEQ ID NO: 4127526 - RNA, 67 nt, Human
cacacuuguugcuaacauaugcuucucccaguggucauuaagagaagcuauuuagcugcacuuugug

SEQ ID NO: 4127527 - RNA, 61 nt, Human
cagagugcauggugcuguucauuugagcuuaaaguugccugugugcauggccaugugucug

SEQ ID NO: 4127528 - RNA, 77 nt, Human
cagagugggagcucuagaaagauuguugaccaaucaucuuauugacuagaccaucuuucuagaguauaacuauuuug

SEQ ID NO: 4127529 - RNA, 68 nt, Human
cagaguucacacucagugcacccgguauauacaggaagcacucagggugugagcacaucaugcaucug

SEQ ID NO: 4127530 - RNA, 64 nt, Human
cagaguucuuuugagcauggauuaccuguaucuuacagauaaaaguuguuuaaaauuuauucug

SEQ ID NO: 4127531 - RNA, 90 nt, Human
cagaguugcaggcggccccuugggauggagaaugggggaagcuuuaucccaagcuucagcccagccuccgccuccacugccccaucucug

SEQ ID NO: 4127532 - RNA, 67 nt, Human
cagaguuuaauucacagugcuuggcaccugguagggguucaauaaacagcuggugaauuaaagacug

SEQ ID NO: 4127533 - RNA, 77 nt, Human
cagaguuuacucaugcagauguucugagucacagcacaguuguccugugucuucacauuugugugcuauuaacugug

SEQ ID NO: 4127534 - RNA, 72 nt, Human
cagauaaaguuuauuggcaccaccauguccuccuucccugggcugugaguggacgugaccaauaaacugcug

SEQ ID NO: 4127535 - RNA, 58 nt, Human
cagauacgcagacccgggugugaguucaggcucugcugcucccuggcugugugaccug

SEQ ID NO: 4127536 - RNA, 55 nt, Human
cagauagcaaauggguaagcuaggacuaacaccuaguggucuuauugcugaucug

SEQ ID NO: 4127537 - RNA, 77 nt, Human
cagauaggaggcaaugggcuauagcauugcaccagggagugacuguguccgggagcaaagcguccugccuccauuug

SEQ ID NO: 4127538 - RNA, 73 nt, Human
cagauaguugagaucuuuucuuugugaggugaccuaaaucuuuauuucugcagugaaugacucaauaguucug

SEQ ID NO: 4127539 - RNA, 65 nt, Human
cagauauaccaggaggccgaaacugcuccuggaggcuggggcaggagagggccaccuggaaucug

SEQ ID NO: 4127540 - RNA, 61 nt, Human
cagauaugguugucaugaaggcuaaauaagguaauaugaaguccuuagaacacuguaucug

SEQ ID NO: 4127541 - RNA, 85 nt, Human
cagauauuaucacaucaauguuuuaaaaugcaugguucagucagguaauccgaacaaauuuuaagagauugaaaugguaaauuug

SEQ ID NO: 4127542 - RNA, 78 nt, Human
cagaucagaaacccauacuacacuaugcauggauguaggccaaauucacacuacucuguguugugugguucugugcug

SEQ ID NO: 4127543 - RNA, 128 nt, Human
cagaucccgugguggagguggucagugccaugcaggacuuggccguggaggaggguggcucggcugagcuccucugccaguauucacggcccgugcaggccacguggaagauggacgagcgggaggug

SEQ ID NO: 4127544 - RNA, 60 nt, Human
cagauccuuaggacaaccauccacagugugcagggcaaggaggauguccccgagggccug

SEQ ID NO: 4127545 - RNA, 66 nt, Human
cagaucucuguguaguucagucuucuugcuccuuucugaggacauuuucauuccacagggaaucug

SEQ ID NO: 4127546 - RNA, 77 nt, Human
cagaugagccagaaauguagaauugcuuaacugaaacaaacauucagaccuggaacucuacauuccuguaagcacug

SEQ ID NO: 4127547 - RNA, 98 nt, Human
cagaugaggaaacugaggcucagguagguuaacucacuauaucaggucauacgaguugacauguggcuuugacccaggauuuggacucagcccuccug

SEQ ID NO: 4127548 - RNA, 85 nt, Human
cagaugcaaaaauagacacagaugaucagguguggacgucaguaaaaaauguugugccacuucuuucauuucuccuuuguuucug

SEQ ID NO: 4127549 - RNA, 67 nt, Human
cagaugcuauagugcugccauaaacauucuuguucagguuuuugggggacauauauauggcuuucug

SEQ ID NO: 4127550 - RNA, 64 nt, Human
cagaugcucagagaaguuaaggaauuuacucaaggacccaaguaaaugcagucucugagaucug

SEQ ID NO: 4127551 - RNA, 68 nt, Human
cagaugcugagagaucaaggcaggauuuuggccucuaauaauaaggaugcuuuguuuccagcacacug

SEQ ID NO: 4127552 - RNA, 58 nt, Human
cagaugcugguaugggggaggugaugugaagcagcuaaacccucauagauaguguaug

SEQ ID NO: 4127553 - RNA, 112 nt, Human
cagaugcuguccucauucuggagauuaaguucucagccacaaaguagauuagaguauuuauccacugucuugguagugggaacuucucccugagcugagacgagaguguuug

SEQ ID NO: 4127554 - RNA, 77 nt, Human
cagauggaacaagggcuggcccugggaagaguucagacaggauguccacugguuccuggccaccucuuccaccacug

SEQ ID NO: 4127555 - RNA, 63 nt, Human
cagauggcaacagcucugugacugccguaucacaccgcaaccucauaucugcuuugcugucug

SEQ ID NO: 4127556 - RNA, 61 nt, Human
cagauggcagggcagcucugcagguaacuucuggcgccgucugcugcugccuccgccucug

SEQ ID NO: 4127557 - RNA, 76 nt, Human
cagaugguacauguggaaauggguuggauggaguauuuuaauacccacacaucucuaauucaguucuacacgucug

SEQ ID NO: 4127558 - RNA, 70 nt, Human
cagauggugcuggcugcauuggcaagucaauuauccaucaguaacacauguuuguguagucaguuaucug

SEQ ID NO: 4127559 - RNA, 65 nt, Human
cagauguaaaagucauagucgggaaagacaucgcuuuagugguguuuucaaaugaccuuuaaaug

SEQ ID NO: 4127560 - RNA, 67 nt, Human
cagauguaauccauauugaucagccuacugagacacagagcagggugcagugugagguccacaucug

SEQ ID NO: 4127561 - RNA, 63 nt, Human
cagauguacaugaagggcaaugagaagcgcgugcaaaaauacauucuccuucaaugugcaaug

SEQ ID NO: 4127562 - RNA, 55 nt, Human
cagaugucauuucccaugcagccuaugaacuugguugauggugggugaugcucug

SEQ ID NO: 4127563 - RNA, 67 nt, Human
cagauguccacaguuugugcugaagaagguggcgccucaguccaagucagagagugugagacaacug

SEQ ID NO: 4127564 - RNA, 91 nt, Human
cagauguccccugacauuucauggccagaacuguaucacauggguugcccccaguuaaacgggccaugugaguguguaguggggcacacug

SEQ ID NO: 4127565 - RNA, 85 nt, Human
cagauguuuaaauguuacuguuuccugaagcagaugcaauacaucauuuacuguucuauuucaguaagcaggcaacaucaucaug

SEQ ID NO: 4127566 - RNA, 56 nt, Human
cagauguuuucuggaaaaugaaugacaugagccugucacauuaaggaaaacaacug

SEQ ID NO: 4127567 - RNA, 93 nt, Human
cagauuaagaaaguuugcuaagagauguuacuaaauguuguauguaacuaaacaugugucuugcauuucuugguagauacaauuuuuaagaug

SEQ ID NO: 4127568 - RNA, 63 nt, Human
cagauuagugcuucuacccuaggcagggcuuucuuggucuaaugguaauaagcaccgacacug

SEQ ID NO: 4127569 - RNA, 88 nt, Human
cagauuauucugguaccauaacguaaugaacuugauucucauccggaguacauuuuuuauuagucugugggaucagaggcaaaauuug

SEQ ID NO: 4127570 - RNA, 65 nt, Human
cagauugcugggccucuucccuggauauucugauugaauuguuuggaguggggccagugaauuug

SEQ ID NO: 4127571 - RNA, 59 nt, Human
cagauuggaacccuaggcaggcagauuugugaggucaaagccagcaggggucuguacug

SEQ ID NO: 4127572 - RNA, 66 nt, Human
cagauugggugagaugauuucauccucagcuccaagggugauucuuaauuagcuuaagucaaucag

SEQ ID NO: 4127573 - RNA, 67 nt, Human
cagauugguuaugucuguucuuaaacuucauauaaauggaaccauacaguacauaauccugagucug

SEQ ID NO: 4127574 - RNA, 60 nt, Human
cagauuuacucccugcugcugcccaguggcaauaauuggguacugcagagggugggucug

SEQ ID NO: 4127575 - RNA, 65 nt, Human
cagauuuagggccagauaggcuucuugauuuuugucggaugucuacaagccuggccuguagugug

SEQ ID NO: 4127576 - RNA, 55 nt, Human
cagauuucaaggaggcacuccacaacuuuaagagugagugccccuuuaaauccug

SEQ ID NO: 4127577 - RNA, 67 nt, Human
cagauuucuuuagcaagcuaaggagagggaaaaaaaaucacuuugagcauugcaaaaagaaagccug

SEQ ID NO: 4127578 - RNA, 129 nt, Human
cagcaaaagaguuuauuuuaucaauggcuagcagauagggggcacacuuuugguagauauccaaagcaggcaggcucuaaguggauaaaagucugcuuauuugggcuaugauuagaacaauuagaugug

SEQ ID NO: 4127579 - RNA, 67 nt, Human
cagcaaaaucugucguguugauaguucuaaaucagccaggcuaggaauguuuacacgacagaaacug

SEQ ID NO: 4127580 - RNA, 112 nt, Human
cagcaaagagcagcagagccagccugcagcuccggauuucuggggcccugacccugguccuugucaccccagucucuggagcuccagcccugcuucuuguggcuuucggcug

SEQ ID NO: 4127581 - RNA, 60 nt, Human
cagcaaagcuuaauuuauaucugagggaacugagacucagagagaugaacugacuugcug

SEQ ID NO: 4127582 - RNA, 63 nt, Human
cagcaacaacaggacugugaauuguuuaaccucugugguuaaagcuacagcuugaguugacug

SEQ ID NO: 4127583 - RNA, 71 nt, Human
cagcaagacaggauucccgugggcccagugucccuguccucgcugggauuuucucucuugagauuucacug

SEQ ID NO: 4127584 - RNA, 66 nt, Human
cagcaagcauuuugaagaggcaauuuucuaaauaaccuuuauuucaaaguguauuguuuauugcug

SEQ ID NO: 4127585 - RNA, 63 nt, Human
cagcaaguaaaagucauguaaugauaugauugaacuuuaagaauauucuaacaugacuugcug

SEQ ID NO: 4127586 - RNA, 58 nt, Human
cagcaagucauccaggaugaugucggauauggugcugaucuucuuggccagcuugcug

SEQ ID NO: 4127587 - RNA, 112 nt, Human
cagcaaugguuaaguguuggaacaaaguaauacagcuuuacauuaacaugguuuauucacuagaauuaaugaccuagagcaguaauugcauuuucaaaacuucagcuugcug

SEQ ID NO: 4127588 - RNA, 81 nt, Human
cagcacaaaccaagggcgcugggugucgagacucagaggggucagcugugucccucggcaucagcgucuaccaaggugcug

SEQ ID NO: 4127589 - RNA, 126 nt, Human
cagcacacugaaguccugagcccuccgccacccgcaaggccuuccucggagacagggaccuauccagagaugucucugucacugucaggaugcgcugcaaguggacaaaggguuuccuucguguug

SEQ ID NO: 4127590 - RNA, 93 nt, Human
cagcacagcugaggagcagccaacucuguaccauggggccugcaggaaagccucugagcugcuguggcagauuggauucuccuaagcuggcug

SEQ ID NO: 4127591 - RNA, 125 nt, Human
cagcacagugcuuggcacaagauggaccuacccucaguccacaccugcugcccauccaggccaggccuggagcaggugccagguguguggugggggcuuggccacuauggccgucaugaaugcug

SEQ ID NO: 4127592 - RNA, 57 nt, Human
cagcacaguuucccccaugagcucuuggggagcuggaggagggagauagcugugcug

SEQ ID NO: 4127593 - RNA, 67 nt, Human
cagcaccuaucucuggagucuacagaguuuccaucugucuggucuuugcuucagaaccugggugcug

SEQ ID NO: 4127594 - RNA, 79 nt, Human
cagcacuccacucgacaucauuguccguugucaugacaccaaguuacagcauuugaucaaugguuccugugccauguug

SEQ ID NO: 4127595 - RNA, 65 nt, Human
cagcacuucucugugaaaggaaagaacugacaccauguguguuagguguccuuacagggauacug

SEQ ID NO: 4127596 - RNA, 77 nt, Human
cagcacuuugagggcucuuaauccucacccugggcuaaagauuuggccgaccauuaaguagccauccgaagaugcug

SEQ ID NO: 4127597 - RNA, 56 nt, Human
auucucuggcuaaaaccugaagguuauacauggcauguagggaauagcuagaggau

SEQ ID NO: 4127598 - RNA, 63 nt, Human
auucucuucaaaaacugcaccuugcuggcagaguugcuacagaauguggauuuugaaaagaau

SEQ ID NO: 4127599 - RNA, 88 nt, Human
auucugaauuugaguucuuaguugugcuugugugugugcacauaguaaacacacacacagguuaaaauaauugggagaucauuagaau

SEQ ID NO: 4127600 - RNA, 57 nt, Human
auucugauugggauuuuaugaaauaaaacacuuguccauuugaucccucaucaggau

SEQ ID NO: 4127601 - RNA, 73 nt, Human
auucugccacacaauuacugcugcuaugugcucuucaguugcacuuuauuagcuguaguaauuguaguugagu

SEQ ID NO: 4127602 - RNA, 84 nt, Human
auucugggaucucaagauuccagaauugggagccuugaggaugauucuacaagucucaguuuuggauucaaaggauccugugau

SEQ ID NO: 4127603 - RNA, 56 nt, Human
auucugucucccauggccgaaggcuuauuccacaaagccgucauggagaguggggu

SEQ ID NO: 4127604 - RNA, 55 nt, Human
auucuguggcaauuuguuauagcagccugagcuaacuaagacagauuccuagagu

SEQ ID NO: 4127605 - RNA, 67 nt, Human
auucugugggcauugcccaugaaaugaaaucaaaacaauauuucucuucuguucagugcccaagaau

SEQ ID NO: 4127606 - RNA, 82 nt, Human
auucuguguacuuuagaaugugacuguauuugaagguaaggccuuuaaagagguaguuagguuuaaaugaggucauaaggau

SEQ ID NO: 4127607 - RNA, 70 nt, Human
auucuguguugcaucccuaagccaggaacaaaguccagcccaggccuggcuccaggggacacgcaguagu

SEQ ID NO: 4127608 - RNA, 55 nt, Human
auucuguucccuccuucccuccuucuauauuuacagaagaaggagggaagagaau

SEQ ID NO: 4127609 - RNA, 80 nt, Human
auucuguuuccuguugguccuggucuaggcagaguguacuucacuuucaagcccucuagagacaggacagguaacuuaau

SEQ ID NO: 4127610 - RNA, 70 nt, Human
auucuuaaggcucucugauggcagcaguugaggucucucugagccugcagccucagagaauuuugaaagu

SEQ ID NO: 4127611 - RNA, 70 nt, Human
auucuucacuaagugccgaguuuaguuccuuccccuggaacugugaugcuuaugccuuagccuaaagaau

SEQ ID NO: 4127612 - RNA, 115 nt, Human
auucuucagcaccaguucaauguguuaccuacaacauagucuucuacagauaaucacugagcauauacugaugaggguuuuguguguguucacuauugcaacuacagugagggau

SEQ ID NO: 4127613 - RNA, 78 nt, Human
auucuuccaucuggcuaucccuuagucaauucaaauaaauauuuauggggcacuuuggguaagccaggugcuaagaau

SEQ ID NO: 4127614 - RNA, 66 nt, Human
auucuucucauagagacaugauuauagaaaaauaaucaaucugugaugaugaucucugagcugaau

SEQ ID NO: 4127615 - RNA, 85 nt, Human
auucuugcacauguuuacuucaucgaguacuuccaacagcccagcugucgauagaauuuuucagaugaggugaaugaggcagagu

SEQ ID NO: 4127616 - RNA, 87 nt, Human
auucuuggacucagucagcccagcuacaugaacaacaaggucccaaacagccauuucaguauaauugcuggcacugacucccagaau

SEQ ID NO: 4127617 - RNA, 61 nt, Human
auucuuucaagaagcuggaagucugugugagggaacaggcuucaagguucuuggcaggaau

SEQ ID NO: 4127618 - RNA, 106 nt, Human
auucuuuccaggcaauguuaguuuuaaaaaguugcuagaguauuguuaaguauagaucacuuaaucuaugucacucuuuggaaagaaugcagugcauaaaaagaau

SEQ ID NO: 4127619 - RNA, 64 nt, Human
auucuuugcauuuuugagcacgaaguugagugguaauuuuguaauuuugaaaguagccaaggau

SEQ ID NO: 4127620 - RNA, 68 nt, Human
auugaaaggcaaaguaggaagcaauuugguuuuuuccuccccucugucaccugcuucugucugccagu

SEQ ID NO: 4127621 - RNA, 59 nt, Human
auugaagaaacccaaauaaugguugcaguugugcugccauuguuuuuguuauuauuaau

SEQ ID NO: 4127622 - RNA, 64 nt, Human
auugaagaacauaauagcuacuuguaguauauugacauaagugauucugauguguuucuuuaau

SEQ ID NO: 4127623 - RNA, 75 nt, Human
auugaagacggaaugagucuugaaaagugcuguacagccuaaccccacuuuuucacugguucucaccucuuuaau

SEQ ID NO: 4127624 - RNA, 129 nt, Human
auugaaguaaugaaaaaaaaucaagaaugcucuguauagggcugcugcagaugacaggaagcuuaugcugccuagugcagauggcugcgucccuugcugaggucuugauuuuguuugcauuuaagaaau

SEQ ID NO: 4127625 - RNA, 84 nt, Human
auugaauucuuuuugauugccuugucagauuucuuuuguauuuuauauaaauaagauaugacaguggcaaauuaguuuuucagu

SEQ ID NO: 4127626 - RNA, 69 nt, Human
auugaauuuuugggucucuccgggcaucucaucuggucccagagcccuagggggaaccgaggacucaau

SEQ ID NO: 4127627 - RNA, 66 nt, Human
auugagaagaaaaucuaauauaugauaaagcagcuguuugaaaccguaugugauuuucucaucaau

SEQ ID NO: 4127628 - RNA, 73 nt, Human
auugagaagucuagaaaucauguacugugaucugggcuagacuaggucaugaggauuuacuagacuagguaau

SEQ ID NO: 4127629 - RNA, 65 nt, Human
auugagaaugccauaagagcuauucauccccacucaagugauuauuuuuauauggcuuucuugau

SEQ ID NO: 4127630 - RNA, 98 nt, Human
auugaggacuuuuguagcaguacuuggucaaggaagcaggaaaguucacuaaaauauuauuguucuugccaagacaugaagcacugagaguuuacagu

SEQ ID NO: 4127631 - RNA, 67 nt, Human
auugaguacuuagugucauauacuaggaauuuccuuugguauuuucaugugcacuaugucauuuaau

SEQ ID NO: 4127632 - RNA, 130 nt, Human
auugauauaaagggcuaauagcaaagccauuggcauuucuguuagacucucauugacuugcauuuaauauacucugcugccagugggagcugaagggccaauuugcuuuggugcuuuuuugugcauuagu

SEQ ID NO: 4127633 - RNA, 70 nt, Human
auugauaucuaccgccauugauaucuaucuuucauuggauauacauccucaguguuggucaagaaucagu

SEQ ID NO: 4127634 - RNA, 82 nt, Human
auugauccugguggugagguggugauaaaucauugcagguggggggaaauugauuuuuauaccaccucucacuuauuucaau

SEQ ID NO: 4127635 - RNA, 129 nt, Human
auugaucuucaaagguggaguucuguggaaugucaggaggcuccuagggcucugucagagucaucuuugagcacugcuugguagcuuucucagucugaaacaucacuccauccuuacggagcaaaauau

SEQ ID NO: 4127636 - RNA, 64 nt, Human
auugaugccacuggaguuguuuacuaaccugaagaucacaauaaauaaaacaguuggugucaau

SEQ ID NO: 4127637 - RNA, 59 nt, Human
auugcaaaauuguccuguggaaacauucguaucaaugguaucuaugggcuuuuuguagu

SEQ ID NO: 4127638 - RNA, 58 nt, Human
auugcaaagcauugugagcgcaguaaaagcuacugaauuguacacaguacuuuacaau

SEQ ID NO: 4127639 - RNA, 62 nt, Human
auugcagagcuaggcagcggcaagcccacuuucacacagcgccagcugccuggcucugggau

SEQ ID NO: 4127640 - RNA, 95 nt, Human
auugcagccaccuguuuuucucauuuccaggagaaaggauuuuauguaugcaaugaagcaacuuuuuuuuggagaaagaaaauuugcucugcagu

SEQ ID NO: 4127641 - RNA, 81 nt, Human
auugcccaggcaggagugugguggcuauucacaggugcaaacaaaguacgcuacagccucaagcucuuggccugaagcagu

SEQ ID NO: 4127642 - RNA, 70 nt, Human
auugccuugacuccacucuuuccccgguggguggagacacagcugggcuaagaguagaggccaagccaau

SEQ ID NO: 4127643 - RNA, 67 nt, Human
auugcuagucuuucauuuggagcauuuuuuuaucaagaagcucuuuccuugaaaggcauacugcaau

SEQ ID NO: 4127644 - RNA, 129 nt, Human
auugcucucauuuuuaauaugacaaggauagauuaguuuugugguuguauuguuuuuaaaggaaauagauacuuauaacaauugugauauccuugcugaaacguuuuucauaaaaaaaagacaaguaau

SEQ ID NO: 4127645 - RNA, 129 nt, Human
auugcugcagggcgucgugugaggacugaguugcuaggggcacaguucucagaagcagggugggcagugagcaugcccugcaggagcugcuguccugcucaucuucucugccacacaguugcccugcau

SEQ ID NO: 4127646 - RNA, 60 nt, Human
auugcugcguggcuuuuagaaggucuguaggaaggaauaucuucugauuuauggagcaau

SEQ ID NO: 4127647 - RNA, 55 nt, Human
auuggacauguugagucugagaugacacuuagucaucuaauuaaaauugucuagu

SEQ ID NO: 4127648 - RNA, 64 nt, Human
auuggaggaugcuuagcagcaucccuggucucuaccaaucagaugcaguuaguauacuuccagu

SEQ ID NO: 4127649 - RNA, 62 nt, Human
auuggaguucuucucucuuaguaaauggcuuugugccauacaaguauggaaugauucucagu

SEQ ID NO: 4127650 - RNA, 64 nt, Human
auuggcauucauuaacgaaagucuuugcaguggaauugcagaaacagucauuaauguagcuaau

SEQ ID NO: 4127651 - RNA, 78 nt, Human
auuggcuuauuacccagggacuauuaguuguguauuaacaucaaguuaaacacuguaucagucuucaauaagcucaau

SEQ ID NO: 4127652 - RNA, 65 nt, Human
auuggcuuuuguaacgugugcaugucuuuuggaggaaaacucugagaacauuuaggagagucaau

SEQ ID NO: 4127653 - RNA, 62 nt, Human
auugggauucagugaugugguaugaguuuuguugacuggaguagaucugacugaguccugau

SEQ ID NO: 4127654 - RNA, 57 nt, Human
auugguaccuauugacuggcugcagugccauguaggccaggaaaaaggguggccaau

SEQ ID NO: 4127655 - RNA, 127 nt, Human
auuggugcuuccuggggucaccucuuguuuaaacuugggcauuuaaacuuggauauuaaacagauucugagacagagaugugugugcaagagguuuauugaggagugaucucaggaaugacauuagu

SEQ ID NO: 4127656 - RNA, 65 nt, Human
auuggugguugccuagggccagggagaguguagggauuggcaagaaaugggauuugacugccaau

SEQ ID NO: 4127657 - RNA, 104 nt, Human
auuguaaaagguggugugcauguguaugugugcaugcacaucugugauauguguguauguaagcaugugcauauguacagguauauguuucuauguuuuauagu

SEQ ID NO: 4127658 - RNA, 78 nt, Human
cacaugcacauaaauucugaucaaguuccuucugagcaaucagacaacucaggacacacagagaaacaugugcauuug

SEQ ID NO: 4127659 - RNA, 87 nt, Human
cacaugcacugugggguguggaugugucucugagauguccaugaaugagccucugggcacacaccaugcccacagauugaugcagug

SEQ ID NO: 4127660 - RNA, 57 nt, Human
cacacuuugugcuaaucuauuugcacucagcacauuaggcccugcacuaaaguugug

SEQ ID NO: 4127661 - RNA, 60 nt, Human
cacagaaauauugugucccuuguuaugaggcacugagaaggacacaacaucauuucugug

SEQ ID NO: 4127662 - RNA, 70 nt, Human
cacagacauucauauccucgguauucauucauuugcuaaaacagagucacccaggauauugaagucagug

SEQ ID NO: 4127663 - RNA, 62 nt, Human
cacagacccagaagggaugaaggucggauaugagaacgaacuucugccucugaugguuugug

SEQ ID NO: 4127664 - RNA, 68 nt, Human
cacagacucugaugacaguguuacagcuccauuaaaguggaagaguaauauuuauuagacacacugug

SEQ ID NO: 4127665 - RNA, 77 nt, Human
cacagagaaaacacauuucuaaauuuuuaccggaacuggcaguucuggcaaggauuuuaaaauguaagucuuuugug

SEQ ID NO: 4127666 - RNA, 66 nt, Human
cacagagacaugaugucauugcucugcccggauuuccuuggggacucaauuucaucauuuccugug

SEQ ID NO: 4127667 - RNA, 58 nt, Human
cacagagagcuacgugcagcgucguagcugagcaucugugucgucugcguucucugug

SEQ ID NO: 4127668 - RNA, 61 nt, Human
cacagagauuagaauuagacuaaauuaaaucaaagucuccuauuugaucugauucucugug

SEQ ID NO: 4127669 - RNA, 67 nt, Human
cacagagcccuugggaagugcagggacucuggcuucaagccaccuguuucgcuugcccagcuuugug

SEQ ID NO: 4127670 - RNA, 64 nt, Human
cacagagcuagacagcaagggccugccucaugcagacagcagcccuaaccugucauagugugug

SEQ ID NO: 4127671 - RNA, 57 nt, Human
cacagaggcaaccuucugggguuacagcauccuaaccuaauuugaauggucucugug

SEQ ID NO: 4127672 - RNA, 75 nt, Human
cacagaggcaugugauuguggggauggaguggggcuccucccucccuuccccaguagucaagaccguccucccug

SEQ ID NO: 4127673 - RNA, 59 nt, Human
cacagaguguuagcgcugguugggagcaguuagguuuccaaugagcaaaaauaucugug

SEQ ID NO: 4127674 - RNA, 130 nt, Human
cacagauaaagccuaagugcaauuagaguuugagaauuaccgugucaaguuucugaacuaguaaguaucagaauuuaaaauguguagauucucuaagacaguaauuccacuucuaggaaucugucuuuug

SEQ ID NO: 4127675 - RNA, 77 nt, Human
cacagauaccuagugaaacauauaaauuaucugaaaugacccaagaggaggcagauauguuuacacugacuacugug

SEQ ID NO: 4127676 - RNA, 88 nt, Human
cacagaucaaaggcgcagcccaggaggcgggagccccugcacacuuuccaccucugcugggcuuagccucuuggcugguuggucugug

SEQ ID NO: 4127677 - RNA, 71 nt, Human
cacagaugacaaaagauaucugguugguaauauaacacugcuauuuccagugaaccagguguuuuucagug

SEQ ID NO: 4127678 - RNA, 78 nt, Human
cacagcacaaaggcccagaagcaaaacagacaguuuuugggagcugauuucuuugcuucuaggcuagcccccacugug

SEQ ID NO: 4127679 - RNA, 70 nt, Human
cacagcaccaggaagccugagaaugcuuagggcucuagcccaggcuuuguaccaggcuuucuggugugug

SEQ ID NO: 4127680 - RNA, 129 nt, Human
cacagcacccaccuucacgucgaucacgcucccucuggguugccgauuucuacccucaaggcuguagccucgagggaccagggguagcugagauauuaagugcggaugaguguuugaggcgggugugug

SEQ ID NO: 4127681 - RNA, 70 nt, Human
cacagcagaggaaaagucugauacuugccuuaauuuugguuucaucauaucgcuuuuuucccuuugcuug

SEQ ID NO: 4127682 - RNA, 67 nt, Human
cacagccaaagaggugcucugcagccuggacagcuccuucaguuuggcagcagagugcgucucugug

SEQ ID NO: 4127683 - RNA, 55 nt, Human
cacagcccugcagcaccugcccuucccauggugagggguggaguugcggucugug

SEQ ID NO: 4127684 - RNA, 127 nt, Human
cacagccuuccuuucccauagacuccugccuucgacgccuccugguugcaaugaaaugguucuuacgaccgcuuggguuguuagggguuuugguagugcagguguuuuuugcaaggggagggcugug

SEQ ID NO: 4127685 - RNA, 78 nt, Human
cacagcuacaggagagcugggaugauccaguacccuguucagaaggaccuugacccagcuuuccccacaauggcugug

SEQ ID NO: 4127686 - RNA, 59 nt, Human
cacagcuuaugccacugauuggacauccuaauguggucccaugucagaugugggcugug

SEQ ID NO: 4127687 - RNA, 66 nt, Human
cacagcuucuuccauuccacucacaguuuccccugagagcugaacaucauggaaaggcuagcagug

SEQ ID NO: 4127688 - RNA, 68 nt, Human
cacagcuugaucucuuggaccugugugguaagaaccucaguuuacaguguuuaaaaaucagaucugug

SEQ ID NO: 4127689 - RNA, 65 nt, Human
cacagcuuugagaggcucucagaucagccacauuccaaucggacuggagucagaucagagcugug

SEQ ID NO: 4127690 - RNA, 57 nt, Human
cacaggaaucagcauuaauggcuccaaugccacguguuuuuaaucuuguuccuagug

SEQ ID NO: 4127691 - RNA, 57 nt, Human
cacaggagagcugggaggugccaaggauaagcuuuacucacuucucaguuuuucgug

SEQ ID NO: 4127692 - RNA, 115 nt, Human
cacaggagggagguugagcagacagagaggcugagcaguacauccaaggucaugcuaaaagugaaugguugaauauguguuucucauccuuuccuuuugauucagcacuccugug

SEQ ID NO: 4127693 - RNA, 66 nt, Human
cacaggaugcaccugcccuccucuccuccauggggugagcccaaggagccaggugcagcccuugug

SEQ ID NO: 4127694 - RNA, 66 nt, Human
cacaggcaccccugacugcucaauagcuagaaaugaauuuacagcggggagaggcagcgguuugug

SEQ ID NO: 4127695 - RNA, 68 nt, Human
cacaggcuaguggaggagcaugagcuugggcccuugucccugacucagcuccuauacuuuguccugug

SEQ ID NO: 4127696 - RNA, 69 nt, Human
cacaggcucuucucacuugauucccgguuuucuuuggagaugccauuagucacagagggaagagccuug

SEQ ID NO: 4127697 - RNA, 130 nt, Human
cacaggcuugccauggaaagaucugggggaaauggugcuuuguuaagucugaaauuggauggguuuuaauuuaagagcauagcuccaacccucaccucucucucuaagcagaaaaauaguuauguuugug

SEQ ID NO: 4127698 - RNA, 61 nt, Human
cacagggaaggauuuagugggaagaauauguuaguuuuccacugugucauucccuacagug

SEQ ID NO: 4127699 - RNA, 62 nt, Human
cacagggccugugaauucucccugcucugucccugggcaguuugaaauuguagucucuagug

SEQ ID NO: 4127700 - RNA, 95 nt, Human
cacaggucaggagagacccaguuaaucucaggaaggcugagagccccccacugcucuucaaggccuuccagguugaaggggucucaaguccugug

SEQ ID NO: 4127701 - RNA, 84 nt, Human
cacaggugcccgccaccaugccuggcuaauuuuuguauuuuuuguagagacauauauauugcccaggcugguuucuaacuugug

SEQ ID NO: 4127702 - RNA, 119 nt, Human
cacaggugccggccggaggggagccgcgagggugcucugagcccuuuuguauccgcccucugcugccagcuucaaaagggcucagagcacagccacgccccuuguccagcccagcagug

SEQ ID NO: 4127703 - RNA, 72 nt, Human
cacagguuggccaggugccugucacaccaaccccaaguguugcaggggucgugcagaccuguccagccugug

SEQ ID NO: 4127704 - RNA, 62 nt, Human
cacaguaagaaaugaagagguaauugauagugggcagacuccauccucugcauuuugcugug

SEQ ID NO: 4127705 - RNA, 96 nt, Human
cacaguagcauaagagcacuggaguagaaaucaaaauaaguaauuaguuaguuuggcuuugugaauuauuacucacaugaucuugggaacucugug

SEQ ID NO: 4127706 - RNA, 61 nt, Human
cacaguaguauuuuagaaaaccaugaauucuacaagauagauuuuauagacugcuacugug

SEQ ID NO: 4127707 - RNA, 62 nt, Human
cacaguaucccucuuucuccccucaccccaccagagauggcagaaaccucagggaugcagug

SEQ ID NO: 4127708 - RNA, 130 nt, Human
cacagugaaacauuuugcuuuucugaaagaacauuauauucauuuugcccuugcuagaucacugguaucauuacuuaugcuagucucuaggaggggaaaagagggauuuuauugaagugauuuacuugug

SEQ ID NO: 4127709 - RNA, 61 nt, Human
cacagugcucggguuuuaugucucuuguuuuauccugaauuauuuauccugagcaucugug

SEQ ID NO: 4127710 - RNA, 56 nt, Human
cacaguggcaaaggggcuugggcccugcauuggggaugaucagcccuggcgcugug

SEQ ID NO: 4127711 - RNA, 99 nt, Human
cacaguguccagcgauguguuuuuggucuuucccaugucuuuuugcagucugcuaagaugaauggugaagucugauaaggaaaaugcagguguggagug

SEQ ID NO: 4127712 - RNA, 69 nt, Human
cacaguucuggaggcugguuucugcugaggccucucuccuggcuugcggaccguuaccuucucacugug

SEQ ID NO: 4127713 - RNA, 60 nt, Human
cacaguuugguauagaagugauuguagcaacuucaugauuagaucacucuuaccauugug

SEQ ID NO: 4127714 - RNA, 76 nt, Human
cacauaaucucaggggauucacuggcacccauucaugggccccagucacgaacucuugaacuaaaaggauaaugug

SEQ ID NO: 4127715 - RNA, 59 nt, Human
cacauacauucauguuacucuacaacuuauuuuauaaagggugugugugugugugugug

SEQ ID NO: 4127716 - RNA, 102 nt, Human
cacauacucaugugugaguauguauauucacacauacucaugugugaguauguauauucacacauacucaugugugaguauguauauucacacauacaugug

SEQ ID NO: 4127717 - RNA, 77 nt, Human
cacauacugaucuuaaguaacauuauuuuauagaacuguuuaaauggguuuaaaugguguucuuuagaugaaaugug

SEQ ID NO: 4127718 - RNA, 82 nt, Human
cacauaguaauucuacuuuuaaacuguugaaggugacauaacuuuaccuuucuccuuccagucaaguaagaauaucugucug

SEQ ID NO: 4127719 - RNA, 67 nt, Human
cacauaucacacauaacuaagcugcacauaacucaauguugucacuagguagugugucagaucugug

SEQ ID NO: 4127720 - RNA, 98 nt, Human
cacaucauauuuuuucaaucuagucuacuauuaacaggcaauuagguuuauuccaugucuuuguuauuguggacaggggugaaaugaacaugcaugug

SEQ ID NO: 4127721 - RNA, 129 nt, Human
cacaucuaccacuggucauauaucaguaugauauauaauauuugcauuacugugauaauaaacaaagaggauagagucaagaaaaguaaauauuaauguuuaauguguuuccaaauauguaaaaaugug

SEQ ID NO: 4127722 - RNA, 63 nt, Human
cacaugaugguggaagccauagaaaugcaagaugaucuguguugcuggcaaagccaaugugug

SEQ ID NO: 4127723 - RNA, 58 nt, Human
cacaugcacacacgugcauguacgcaugcaugugcgcacgugugugugugugugugug

SEQ ID NO: 4127724 - RNA, 65 nt, Human
cacaugcuggcugccuuggauggcagcuaggaccguuccauuuauuccagggcaacuagagugug

SEQ ID NO: 4127725 - RNA, 57 nt, Human
cacauggccacacuuggguacucaggaaauguacuuuauauuguggcuggccaugug

SEQ ID NO: 4127726 - RNA, 57 nt, Human
cacauggccagccacaauauaaaguacauuuccugaguacccaaguguggccaugug

SEQ ID NO: 4127727 - RNA, 59 nt, Human
cacauggggagcaaggaaggcagaaugaacauuuuucuuccuccaggcacacccaugug

SEQ ID NO: 4127728 - RNA, 82 nt, Human
cacaugggggauggucagcuccagcacagcggggugguucgccccagagcccccucccuagugacuggaauuuccuccagug

SEQ ID NO: 4127729 - RNA, 63 nt, Human
auugucacuuugagguucuguuaacauuuuguaagacaacaaauaagacccucuaagggcagu

SEQ ID NO: 4127730 - RNA, 60 nt, Human
auugucagaguuugagaaaguaaaaccauuuguguucaaguguuuccuaaacucuacaau

SEQ ID NO: 4127731 - RNA, 60 nt, Human
auugucauuggcuucuaugucuauggcuuccuaagagugauaaauaaagccaugcacaau

SEQ ID NO: 4127732 - RNA, 72 nt, Human
cacauuaggccuugccuggcuucacacuuucaggcauuucagaggugaggccuguacaaagcugcagaugug

SEQ ID NO: 4127733 - RNA, 56 nt, Human
cacauuccccagagcuggggcuggccugagcccuaggcgcagaguggggaggugug

SEQ ID NO: 4127734 - RNA, 59 nt, Human
cacauucuauagcaagcugaucucaacgagcccuacuugggagagcugcuuggagugug

SEQ ID NO: 4127735 - RNA, 58 nt, Human
cacauucuuuuaacggcuuuaccugauucauaacuggacccagcugccagggagugug

SEQ ID NO: 4127736 - RNA, 68 nt, Human
cacauuguuaaucacaaagauaagccuguuugagagggcacugggcuuuguaguuagcaucaucugug

SEQ ID NO: 4127737 - RNA, 118 nt, Human
cacauuuaucacaaauacuuuccuguucuguuggcuuuuuaaaguuguguuuuauuguauuuaauaguaauaaaguuuaaaagucaauaguauaaaggauaaauuauagacaaaugug

SEQ ID NO: 4127738 - RNA, 77 nt, Human
cacauuucauaaaguaacauggaccuuaaaaauuauauugaagaauuugagguauugauauuuuaugacugaaugug

SEQ ID NO: 4127739 - RNA, 62 nt, Human
cacauuuccuuccuggggagggaaguauaaguuuuccccauccauccauggauggaaaugug

SEQ ID NO: 4127740 - RNA, 104 nt, Human
cacauuuuaccugguguucccagcauuccagaagcucgacugagucuuacauucuaguacaugcucagugguauucggaaacuggaagcaauucucugaaagug

SEQ ID NO: 4127741 - RNA, 84 nt, Human
cacauuuuauaauucaaaggaaaauaaguaguuccauuucugauuuacaggcaugguuauuugcacuuugaaggguaggcagug

SEQ ID NO: 4127742 - RNA, 109 nt, Human
cacauuuuccucucagaaauagcaaggaguagauagauucuaagcacuaaauaugauuuuggugucauguugggguuuauuuaccucccgugagauuaaggaauuugug

SEQ ID NO: 4127743 - RNA, 130 nt, Human
cacauuuucuuuauccaguucaccauuauuggacaccuagguugauucuauguuguugucucagugaauaaugcugugauaaacauaugagugcauguguccuuuugguaggauuauuuguuuuccuugg

SEQ ID NO: 4127744 - RNA, 129 nt, Human
caccaaaaaaauuagauguuauuacugauuacugaaagacugaauauuuaggauauauuuuauuuugauaguuuuaucaguagauaggacucaguagaaauagcaagucccuauauuuuuccugguuag

SEQ ID NO: 4127745 - RNA, 57 nt, Human
caccaaggcuaaaauaacauguucccuagaauuaggaacauuuggcuggcuuuugug

SEQ ID NO: 4127746 - RNA, 69 nt, Human
caccacacccagccauguucaguucucuagaguauauaccuagaaauggaauugcugggucauauggug

SEQ ID NO: 4127747 - RNA, 68 nt, Human
caccacauugcagcuucuuuuggcuuguccacagugcgaggcgaagcuaauggagagcugagugugug

SEQ ID NO: 4127748 - RNA, 111 nt, Human
caccaccacacacuugauggccugcaucguguccggagccuggagagugucgguggugacagcucagggccaggcgcguuucugcgggcgcaagggguguggaggcuggug

SEQ ID NO: 4127749 - RNA, 88 nt, Human
caccaccagcccaggagcagcuuccuguuugcaggcaugggcgcccguugccauggugacugcaggaggugcucccuccagguggcug

SEQ ID NO: 4127750 - RNA, 83 nt, Human
caccacuaagucuuguugacucuuaauuugcuuuugcagcugaagcaauaaauguaaagguuaagaaagaaagcuuuagggug

SEQ ID NO: 4127751 - RNA, 76 nt, Human
caccacucuuuucucuuacaagcucccgauauaaauagagaaaucaauuguauggcccuugaagagaaagugugug

SEQ ID NO: 4127752 - RNA, 55 nt, Human
caccagacagguguaugcauauaucaugugugaauauguguauguguguguggug

SEQ ID NO: 4127753 - RNA, 63 nt, Human
caccagaccagcucucugaagaaagaguuaaugaacucacuguuccuuggggaguuggaggug

SEQ ID NO: 4127754 - RNA, 58 nt, Human
caccagccccaccgggacugcagaguuaccgugcucuguccuuggucuuggcugagug

SEQ ID NO: 4127755 - RNA, 56 nt, Human
caccagcuacucggguuuccuggugauucccacauuugccccagggguggcaggug

SEQ ID NO: 4127756 - RNA, 61 nt, Human
caccagcuucccaucgcgggucucgaucuucuucacaaccggggcccugguggagcuggug

SEQ ID NO: 4127757 - RNA, 61 nt, Human
caccaggaagcugcaauuugaggaguggcaacacuggauucaagauacgguuuccaggcug

SEQ ID NO: 4127758 - RNA, 68 nt, Human
caccaggcuggauggagagggcccuguagcugggucuucccaguguggacucucuccuuuggcuugug

SEQ ID NO: 4127759 - RNA, 55 nt, Human
caccagggccccaggcugugccagucuccggcugaacuggccggcggcccaggug

SEQ ID NO: 4127760 - RNA, 62 nt, Human
caccaguauucgaucuggccaguucuacaaaggauccuuugguugacugggguuggcuggug

SEQ ID NO: 4127761 - RNA, 57 nt, Human
caccauccaggugagggagaccugccggcuucucuguaggcuccuccaggaugugug

SEQ ID NO: 4127762 - RNA, 67 nt, Human
caccaugacugguugagagaggcaggaagaaaggaggaaguguucuguuuuagcacuuguuauggug

SEQ ID NO: 4127763 - RNA, 64 nt, Human
cacccaagauagcaccuuuguggaaugucuguaaggcauacaacacagaggcgcuguauggcug

SEQ ID NO: 4127764 - RNA, 63 nt, Human
cacccagagucccaggacuuccaguuggaggacaaauaccaaagcuguguccaagggagggug

SEQ ID NO: 4127765 - RNA, 68 nt, Human
cacccagcaggucucaaucugagcaggcucuacucaugggaccugcucgucuuggacccaguugaaug

SEQ ID NO: 4127766 - RNA, 57 nt, Human
cacccaggcagguggcugagaaugggcaauuggccuacacgcaccccugucgggcug

SEQ ID NO: 4127767 - RNA, 59 nt, Human
cacccaggcauggguugagaugcuugggugcccaucccaucucugccagugacugggug

SEQ ID NO: 4127768 - RNA, 60 nt, Human
cacccaggccaggugcucuagaaucagacaaucucuguuugggugcuuccuggcccagug

SEQ ID NO: 4127769 - RNA, 87 nt, Human
cacccagguugugguacugcauuacagccuccuuaggaaacuuacacacaucuuccugggcuccuguuuaugcuaccacagaaggug

SEQ ID NO: 4127770 - RNA, 55 nt, Human
cacccauuaaccaaagagugaaugcugaaucuacucugguugguugaugcuugug

SEQ ID NO: 4127771 - RNA, 71 nt, Human
caccccaaggagagcgcuuccugcgugccuguuguugcaaaaacauaacagggcuuuggaagucuccggug

SEQ ID NO: 4127772 - RNA, 68 nt, Human
caccccagcuucucaggauagaauugggagccccaaaucccugcccugguuuguagaagccuggggug

SEQ ID NO: 4127773 - RNA, 93 nt, Human
caccccaggccccgcaggcugcagccaagaagagccacucaccccaggagggccucugggaagggcugagcacugccaagggucauugaggug

SEQ ID NO: 4127774 - RNA, 124 nt, Human
cacccccucuggccaccucccagggugagggcugaagauuguggccccucagagccugcccacuccaggcacuuggggcccagcucaguccuugcucucgacagggacuggcagguggugggug

SEQ ID NO: 4127775 - RNA, 65 nt, Human
caccccuaccugagucaggaguggagauuagcccaaauuaaagcucuggugacucaggagaggug

SEQ ID NO: 4127776 - RNA, 72 nt, Human
caccccugaccaagaggcuucacauguccaccugccuggccccuugcagcauguguaauuucugguugggug

SEQ ID NO: 4127777 - RNA, 84 nt, Human
cacccuaaucuuaacacuuuuguggcuccauggcuuccucagugauuuuaggaggaaaaaggccacagcaaguguguuggugug

SEQ ID NO: 4127778 - RNA, 59 nt, Human
cacccugacuggcccugcaggagaggguggcucuuuccccuggagacaaagacagggug

SEQ ID NO: 4127779 - RNA, 73 nt, Human
cacccugagaaugccuuggagagccuagaggcccugagccuugggccugggaaucggugcguugagggaggug

SEQ ID NO: 4127780 - RNA, 78 nt, Human
cacccugcuaucaagggcugaacacagguuucaggcccaacucugccuguuuccaaagcccaugcucuuguaguggug

SEQ ID NO: 4127781 - RNA, 58 nt, Human
cacccuggucuuugcaaagccaauccagcauggauugcauaugcagcacaucaggcug

SEQ ID NO: 4127782 - RNA, 58 nt, Human
cacccuugaagugaacuugagggcccagccccaauuucaggcugcaucuguaagggug

SEQ ID NO: 4127783 - RNA, 130 nt, Human
cacccuuguauaauccccuccuuuucaauguaguuagaaccuguuaccauaguacauaauacauuuuaccugagugaauaguuauguuauauggcacaguugaccucaagauagggagauuaucagggug

SEQ ID NO: 4127784 - RNA, 89 nt, Human
cacccuuucucuccuugcacaaccacauguugcuuuuggcuaagcccucugguacaguuacuguuauaugugcugcagagaagagggug

SEQ ID NO: 4127785 - RNA, 62 nt, Human
caccgggcccucuccggcgucugcuuuccacaaugcagcccccgcccaggagggcccaugug

SEQ ID NO: 4127786 - RNA, 63 nt, Human
caccguaggugcuuaauaaauguaucagagaacagggaagauuuuuauugagcacguacugug

SEQ ID NO: 4127787 - RNA, 80 nt, Human
caccuacucugcccagccccuaucccugggauuuaacuguacucacucccagagucagagguggggccugagaggaggug

SEQ ID NO: 4127788 - RNA, 64 nt, Human
caccuagacagaggcaagcgcauuacuucaucuugugagcugcauuacagccucuguuuucgug

SEQ ID NO: 4127789 - RNA, 106 nt, Human
caccuauuucuucaaacauaggaagaaacaucuuaucugcaugaucccuccuggggagcuaucuuacggucuuaugugauaaggugaccucuccuuugggugagug

SEQ ID NO: 4127790 - RNA, 56 nt, Human
caccucagcgccugcuuacuaccaugaaacccaucagaaaggcauggucuggggug

SEQ ID NO: 4127791 - RNA, 75 nt, Human
caccucccagagcagugcuggagaggugcagagagauggccuccuauuucuuguucccuccaaguucugggucug

SEQ ID NO: 4127792 - RNA, 73 nt, Human
caccucccauuuccuucuagcccaaguauugggcaaacuauggucauccucuuaggcuagaggacagggcgug

SEQ ID NO: 4127793 - RNA, 60 nt, Human
caccucccggcacggugcucagcugugacgccgaaauaaguuagggcuggccgggcggug

SEQ ID NO: 4127794 - RNA, 77 nt, Human
auuugguaggcauugcuucgcacaaucccaugaugccagcuugcuagcauggauaugcccagggcacccuaccagau

SEQ ID NO: 4127795 - RNA, 78 nt, Human
auuugguucccugcaggguucggggaagacauuuuggagcaggugauuuuuuuuccucugagcuuugaauaauuaagu

SEQ ID NO: 4127796 - RNA, 84 nt, Human
auuuguacauuuacaauaaaucuuuaggaagcucaaacucuccaugaggauuucuaauagagaauuuaauugugagaaacaagu

SEQ ID NO: 4127797 - RNA, 78 nt, Human
auuuguagagauaguagagacuguuuuuaagugcuguuuuguaauuugagaacuacuuuauuauucuuuuuacugaau

SEQ ID NO: 4127798 - RNA, 95 nt, Human
auuugucugcuuuuagucuuuuaggaauuuaucacagacuggauuuauuuuauuuauuuuugguacaaauuccaugggacuuuuggaagggaagu

SEQ ID NO: 4127799 - RNA, 86 nt, Human
auuuguggguggaagugaagcagcagucaugccuaugcucugacugucaggagaagggcuagugggcacuguugcagcucacaggu

SEQ ID NO: 4127800 - RNA, 76 nt, Human
auuugugugaacucuucaaguaugagcgcuggaaacccacuacagccaguuuaagcaggagggguaauuugcagau

SEQ ID NO: 4127801 - RNA, 83 nt, Human
auuuguuauaauuguuccuuggaagaacuugagguacugugcuaagaaccuucauguuuuccaaggaaaguguuguaaaaaau

SEQ ID NO: 4127802 - RNA, 62 nt, Human
auuuguucagcauugaauuuggauuuuugauuucugaauucuacgccugaugcugaacgaau

SEQ ID NO: 4127803 - RNA, 115 nt, Human
auuuguugccuuuugaugugccaaagaagagugggaauguucuaagaauucuuuuuggcuuaaucuuuguugaauugaaaauauguauaacucuucugcugaaaguguagcaagu

SEQ ID NO: 4127804 - RNA, 60 nt, Human
auuuuagaaauaacgaaacacucagugccacugguacugaauuuuggcauauucugaaau

SEQ ID NO: 4127805 - RNA, 81 nt, Human
auuuuagcugggcauauugaugucuggaacaaaagucuguauuuuccuaccucuuuugugcauggguauggccaaugagau

SEQ ID NO: 4127806 - RNA, 85 nt, Human
cagcugcaguuuuguuacauggauauauuguacaguagcgaaguuugguauuuuauuguauccaucacccgaauaauguacguug

SEQ ID NO: 4127807 - RNA, 57 nt, Human
cagcugcccaggccaccuggagcaaagguaagaagcugucccaggggcugggggcug

SEQ ID NO: 4127808 - RNA, 108 nt, Human
cagcugcugccccuggccuccauggucauggcagccacgcugucgggggcuguacccagaggcugcuuucauggccgccccauuuuggaggugaggggccugcggcug

SEQ ID NO: 4127809 - RNA, 55 nt, Human
cagcugcuuccacacaagcaaagcucaagaccagggccugcaugcuggaagucug

SEQ ID NO: 4127810 - RNA, 55 nt, Human
cagcugcuuuaguuuuccaucccucauuaauagaaucuggagccuacaguagcug

SEQ ID NO: 4127811 - RNA, 55 nt, Human
cagcuggacugggauguagcgacgguccaucagcucucugccuuccagccagaug

SEQ ID NO: 4127812 - RNA, 61 nt, Human
cagcuggcaauguaagucccuggaaagagaacaucacacccagggcacucuugccacucug

SEQ ID NO: 4127813 - RNA, 55 nt, Human
cagcugggccuccugagcccugggcaggacaggguuagugggccaggcccaggug

SEQ ID NO: 4127814 - RNA, 78 nt, Human
cagcuggucugcauugcugguacugguugcaucauccucauccucagagcuggcuucacaggcaguguggaagagcug

SEQ ID NO: 4127815 - RNA, 56 nt, Human
cagcugguggcugaugaccgucugcuuggggcugcagauguucacguuaccaguug

SEQ ID NO: 4127816 - RNA, 85 nt, Human
cagcuguccaggggucaccugccuggguggucaccugccuggguggucaggcugucucaccucaggagggcccccggaccagcug

SEQ ID NO: 4127817 - RNA, 68 nt, Human
cagaaauguacugacaugcaguucacaaacuggcacugguuuaaaauaagcacuguuguauguuucug

SEQ ID NO: 4127818 - RNA, 61 nt, Human
cagaaauguacuucuuuagucaauauguaguuugcuuuauauuaaaugaagagguaaucug

SEQ ID NO: 4127819 - RNA, 58 nt, Human
cagaaaugugauguacacacacccacauuacuuggagguuauauuacauuacauucug

SEQ ID NO: 4127820 - RNA, 63 nt, Human
cagaaauuaucaugggggagaaacaugauuuauuuacauguucccagacucccaagaugacug

SEQ ID NO: 4127821 - RNA, 120 nt, Human
cagaaauucuuugcauuauauguauauguggucauuuacauguggccagaaauuugagagaaacccuuucagcauuucuugagcucauggagaaaugauauacauggcagcagaaaucug

SEQ ID NO: 4127822 - RNA, 86 nt, Human
cagaaauuggcgaagaugcuuacugcaauauuuuuacaagggcuaucuuacaaaauugaggccaguaugccaucuuccaguuugug

SEQ ID NO: 4127823 - RNA, 59 nt, Human
cagaacacacgccuccuccauggggagaucuugcuucuuguggauaaccgugugcucug

SEQ ID NO: 4127824 - RNA, 82 nt, Human
cagaacacuuucaucacacuuuguugaaguuuucaugagccucguucaggaaacuuuuuaaagugagauucuuuugauuuug

SEQ ID NO: 4127825 - RNA, 119 nt, Human
cagaacagagcuagugauucgaaugcucuucagguuucugcucuggaaaacugacacccgcuguuccugacucuagguaaagcuugaagagcugugccucagcccccugcuuacauuug

SEQ ID NO: 4127826 - RNA, 94 nt, Human
cagaacagcaagagaggcagggcaaauagauggagaacaaccacaggcacaucaaguuuucccugaagccucuccccacagcauuuuuguucug

SEQ ID NO: 4127827 - RNA, 58 nt, Human
cagaacaggucaugcuugcugugcuagaauauagaacggcaggcccuaagccugugug

SEQ ID NO: 4127828 - RNA, 68 nt, Human
cagaacauucuugccaguacauucuuggguguaagauacuauucccuguuuguuuggcugauguuuug

SEQ ID NO: 4127829 - RNA, 63 nt, Human
cagaaccagccugggcuauaggccuccuauggaaacaggcaggcucaggcccaugcuuaucug

SEQ ID NO: 4127830 - RNA, 65 nt, Human
cagaacgcauugacaguauagcuuuaccuaugaauaucauuucaauagugcugcucaauguucug

SEQ ID NO: 4127831 - RNA, 89 nt, Human
cagaagaacagugccugccucagagcaucgcgcagagagccuagggcagcugggcugugcuugauguucucaguaguuguuagcuucug

SEQ ID NO: 4127832 - RNA, 58 nt, Human
cagaagagcauuuagucccucucaugacguccaucugagggcucaaaugugcuugcug

SEQ ID NO: 4127833 - RNA, 56 nt, Human
cagaagcagcugaucucgcgagcccgcccccugcucggcgagaacagagcuuacug

SEQ ID NO: 4127834 - RNA, 56 nt, Human
cagaagcagucagcagcaccuuuguggaccgugcagugggcuucuaacugcuccug

SEQ ID NO: 4127835 - RNA, 70 nt, Human
cagaagccagugaagagcuguugcagagauuuaaguaaagggaucccugaaucagccuugcauguaguug

SEQ ID NO: 4127836 - RNA, 68 nt, Human
cagaagccggcgccacaccauggcugcuagguucaccaucccagcguggauguggggcgcggcugcug

SEQ ID NO: 4127837 - RNA, 77 nt, Human
cagaagccuggccagccagggcugggguggaugcaccuuucccucccucccacccacucaccugccuggccugccug

SEQ ID NO: 4127838 - RNA, 60 nt, Human
cagaagcugugcugggggaucuguugggugaccugcaggacucccugggcccagcuccug

SEQ ID NO: 4127839 - RNA, 92 nt, Human
cagaaggacugccguguacguuucuguaaggacuuaaugcaaauuaggauuuguacuuuggggaaauguugaaggauaauggcguccuugug

SEQ ID NO: 4127840 - RNA, 71 nt, Human
cagaaggcagcagaggaaaggugcuuagugcaagccuaaggaucuuguaagccuuuguagcccggacucug

SEQ ID NO: 4127841 - RNA, 101 nt, Human
cagaagggcaguaggguggagggcugauguugccaccucaaguuuccaauuugauuuaggggucguuccugugagcuagccacucccuuccugccucucug

SEQ ID NO: 4127842 - RNA, 78 nt, Human
cagaaggugucaaggaggaagugagagaugacuauuuuaacaaagauguucuauuuucacuuuugcaaugagauacug

SEQ ID NO: 4127843 - RNA, 103 nt, Human
cagaaguaacgugcuugcuaaagagaaauggcuuugacaacuugccuuaaauaaucuggcaagugaaucuccuuucuuuauucauuagggauauuugcaccug

SEQ ID NO: 4127844 - RNA, 93 nt, Human
cagaaguacagacuugcugagcugagccaaaucugucuauccaauuacuggguaagagagcugacuguagcuuuaggcaaaaccuguaaucug

SEQ ID NO: 4127845 - RNA, 81 nt, Human
cagaaguccaaucugccccaagaaggcccucgcuucucucuggaguucaagagaaccuucuggguauuccagauaccucug

SEQ ID NO: 4127846 - RNA, 117 nt, Human
cagaagucugugggggaaauucauuucuuaguuuaccaaaauagacuuugaggccaagaauguugaagccuucuaacuaauuggaaauggaaccuggauucaaaccuaagacuucug

SEQ ID NO: 4127847 - RNA, 76 nt, Human
cagaagugaagagguacaaguccucagauaacauucuguaaauugugucugaacaaacucugccuccugccaucug

SEQ ID NO: 4127848 - RNA, 81 nt, Human
cagaagugagaacucuucuuccuuuaaaaugauuaacagaggauaauaucauuuacaaggaucaagggaucucuaccuuug

SEQ ID NO: 4127849 - RNA, 130 nt, Human
cagaagugccugagaggugcagggcccgagucugguuaggugacagcgggucaagaggaggacauuguccucucucuuguguugcugcagaugccacaaaacugggccacggcacgaucaggcaguucug

SEQ ID NO: 4127850 - RNA, 63 nt, Human
cagaauaaaagucccaaggcaucauauccugacccugggguuaccauauugggacuuuuacug

SEQ ID NO: 4127851 - RNA, 98 nt, Human
cagaauacagugaauauaccagugagguagacagcuuuuucucucucaugagaaagagaaagcuuagguaucucaacuuuuaguagucaaaacuuuug

SEQ ID NO: 4127852 - RNA, 62 nt, Human
cagaauaccagaaucauuuuauguugguguuacaugaaacauuugaugaucuuuggacucug

SEQ ID NO: 4127853 - RNA, 106 nt, Human
cagaaucaccuggaagucuuguucaaacagagcucugcucucagauucaaaacgucuguguggagccugggaauuuagaguucggacaaguucccagguguuacug

SEQ ID NO: 4127854 - RNA, 127 nt, Human
cagaaucaccugggaaagugaauuuaaaaucuagauuucugggcuccaaccccagugaacucugaugcaguaguucugggguggagcuugggaaucuguaauucagcauguucuccagaggggccug

SEQ ID NO: 4127855 - RNA, 60 nt, Human
cagaauccuguuuuacuucaucaaccucaagguuaugacuuuuuggcaaaagggauucug

SEQ ID NO: 4127856 - RNA, 63 nt, Human
cagaaugacaggaaagguuacauuuuucauucuaaauggaguguuuuucucugucgucuucug

SEQ ID NO: 4127857 - RNA, 70 nt, Human
cagaaugcacccagugucuggacuauaacacugaugucaugggccauaccaacuugggcugccuuuucug

SEQ ID NO: 4127858 - RNA, 71 nt, Human
cagaauggccagcuuauaggggcucagggaucacccaguccccacugcugcuuuuaucagcgaggccacug

SEQ ID NO: 4127859 - RNA, 58 nt, Human
cagaauggggagacuagcagcacuucugggcagcccaugaagcagccucuucccucug

SEQ ID NO: 4127860 - RNA, 82 nt, Human
cagaaugguucauguuuguguauugcucauuuagcuuucgacguccuuuggaaaguugaggaauaaacagguggacaauuug

SEQ ID NO: 4127861 - RNA, 61 nt, Human
cagaauguugucauccugggaugggaaggccugacaccugcuucucugcuugacaguucug

SEQ ID NO: 4127862 - RNA, 112 nt, Human
cagaauguuuacuagauucucauggcucauuauuggacacuucuucugcacacauucuacagcaucuuguguggaagauucuucaaucuguagaaauuaggaaacagcacug

SEQ ID NO: 4127863 - RNA, 73 nt, Human
cagaauucacuaauucaguguuugcagcaacuuuauaaaacauaaugauugcaaacauugagaacugacucug

SEQ ID NO: 4127864 - RNA, 72 nt, Human
cagaauucgaaugagcagaaucaggaagucuggauauuucuggauguuuucugcucauucaaauaaauuuug

SEQ ID NO: 4127865 - RNA, 70 nt, Human
cagaauugauuucuuacucuuccaaggucuguacauuaugacagcaugggaauuacaggaaucauuucug

SEQ ID NO: 4127866 - RNA, 88 nt, Human
cagaauuggacauguugaauuuuagauggcuaugggauaugcaggagcagguauccugggggcagcuggaaacaugggucuggagcug

SEQ ID NO: 4127867 - RNA, 61 nt, Human
cagaauuggagagcaacagaauuugaguggccccuucagagaauguccuucuucauuuuug

SEQ ID NO: 4127868 - RNA, 59 nt, Human
cagaauugggaguguccugauaucccgauaucuugagaacagaagcauuccuaauuuug

SEQ ID NO: 4127869 - RNA, 68 nt, Human
cagacaaaaaugcuuggacuuaauaaaucuaggagagagguuuguuuaucaaggucuagcauuguuug

SEQ ID NO: 4127870 - RNA, 62 nt, Human
cagacaauaggagcacauucugcaguugccgcuacugcuacuacagauacuccugcuguuug

SEQ ID NO: 4127871 - RNA, 66 nt, Human
cagacacaggauccaggguugagggguuagucaguuuguccuucagcuggggcccccucuguccug

SEQ ID NO: 4127872 - RNA, 73 nt, Human
cagacacguggagaugguugacaaauguugcccgaaaauuugggaucuuggcaaucaauucugacgucuucug

SEQ ID NO: 4127873 - RNA, 91 nt, Human
cagacacuagaaguuaaagggggcuacagugugggguugggcucagaaagagcaacacacagguaagccucuuucaaaacauuagucuuug

SEQ ID NO: 4127874 - RNA, 55 nt, Human
cagacacuaggugacagagugccacagggcagacaacucgcuacgccugggucug

SEQ ID NO: 4127875 - RNA, 55 nt, Human
cagacagaccugcaagggcacagacccugaggagggagugugcuugguuaguuug

SEQ ID NO: 4127876 - RNA, 76 nt, Human
cagacagagguuugacacugaucaaauacauaucgaaugaaugaauaaaugaaugagugaguucagaccucgccug

SEQ ID NO: 4127877 - RNA, 58 nt, Human
cagacagccaacuggggagggcaugccaggggaugcagccuccucucuuggcuuaaug

SEQ ID NO: 4127878 - RNA, 88 nt, Human
cagacagccugggcuccggaaggcagccuugcauugucacaaagucggcccugcagugcuuggcaaccuucugaccagccugcuucug

SEQ ID NO: 4127879 - RNA, 57 nt, Human
cagacagggagggagcgcggcugggccagaaggcugaucaccgccugcccccugcug

SEQ ID NO: 4127880 - RNA, 63 nt, Human
cacaaggccugaacaugaggagaugggaaucuuagaaucugucuaacauaccaggucuaugug

SEQ ID NO: 4127881 - RNA, 71 nt, Human
cacaagguuaucuguagguuagaugugagcacccaaacaaaauauuuagccaacuauaugacuaguuugug

SEQ ID NO: 4127882 - RNA, 67 nt, Human
cacaagugcaggucucagcuacucucuggcccaguuucuuaagagggugcaggccugaugcacagug

SEQ ID NO: 4127883 - RNA, 93 nt, Human
cacaauagucuuucucuucaucucaguaaaugugugaucugggcaaauauuccaagauagggacaaagcuagagaagagaauugaagauugug

SEQ ID NO: 4127884 - RNA, 67 nt, Human
cacaaugcagggagugggguuuagauagcaaaggaguugagagugacucacagucccuguaggagug

SEQ ID NO: 4127885 - RNA, 57 nt, Human
cacaauggcaccuguagggcguugcucuggggcaucccugcagagagugcuuuugug

SEQ ID NO: 4127886 - RNA, 57 nt, Human
cacaauuagcagcucuuuauuugcaguuuucauacauauauggaggugcuguuugug

SEQ ID NO: 4127887 - RNA, 63 nt, Human
cacaauuccauggcauucuuugucaguaccugucaaaauauaccuaagccguuaggaguugug

SEQ ID NO: 4127888 - RNA, 56 nt, Human
cacaauuccuaacccuagaggugauaucaguauagcucuggaggcaagggagagug

SEQ ID NO: 4127889 - RNA, 71 nt, Human
cacacacguauguguuagccaacuguuuaucauauguacauguuauacauauguguuaacaaaugugugug

SEQ ID NO: 4127890 - RNA, 74 nt, Human
cacacagaguccuuacugagguagaccagcugacagaauaaacgccauagggaugcuuguaagaacucagugug

SEQ ID NO: 4127891 - RNA, 98 nt, Human
cacacaguacaaaagcagaguggggcuuuaaaggcucagauucugcacuuagacaggccugagcugcaguccuggcucugccauuuuccagcugugug

SEQ ID NO: 4127892 - RNA, 67 nt, Human
cacacauaugccauuacagcaaaaaugcauugagauguauguguuuguuuguaugugugugugugug

SEQ ID NO: 4127893 - RNA, 68 nt, Human
cacacauauugucccuaguguggcacuucuuucucccauacuccaccacuaaugagacaguuugugug

SEQ ID NO: 4127894 - RNA, 57 nt, Human
cacacauggcugccagggaggucagcgaauauaauguuuacucugggugccugugug

SEQ ID NO: 4127895 - RNA, 61 nt, Human
cacacaugugccaucacagaccacguaaaucagaaugccuuggcauggagguagcagugug

SEQ ID NO: 4127896 - RNA, 57 nt, Human
cacaccauaugauuccauuuagaaauccuagacaaggcgaaacuaaucuauggugug

SEQ ID NO: 4127897 - RNA, 82 nt, Human
cacaccauuuauuucaauaaauacauugauagcuugaauuggugccauucuuuuccauuaaggugucaauguauuuggugug

SEQ ID NO: 4127898 - RNA, 71 nt, Human
cacacccugacaugacacugcacaccaggaaaacaaggugugcagcucugaacagucaugaagguggugug

SEQ ID NO: 4127899 - RNA, 67 nt, Human
cacaccgugggucucgcugugaggacgggccuaagcucacagguagccucagagacagauacgggug

SEQ ID NO: 4127900 - RNA, 100 nt, Human
cacaccuccuauggcugaggugcuauggaggauacguagcaccuuauguccuccacauagcaccuguauucuccacagcaccuuagcccugggaggugug

SEQ ID NO: 4127901 - RNA, 89 nt, Human
cacaccuccuuuuuuaagguagcuccuccucagcugcccuccagugcucugugggaggagggacccuagcagagaggaaaccaggugug

SEQ ID NO: 4127902 - RNA, 68 nt, Human
cacaccucuguguacgcaggcgugcgcgugcgcgugcgugugugcgcgcgugugugugugugugugug

SEQ ID NO: 4127903 - RNA, 71 nt, Human
cacacggcuguugacagaaccggaugcuguugcccaugggcccgaaggucugaguuuguuguuggcuggug

SEQ ID NO: 4127904 - RNA, 80 nt, Human
cacacucuccuggauggaccuucucuuauuucuccaauccaaaauccaguaagccagaucaaaguguccaggggggugug

SEQ ID NO: 4127905 - RNA, 68 nt, Human
cacacugccuuucuaaguggauaauuguaaucaauguuugaucauccauacuauugagaggcauauug

SEQ ID NO: 4127906 - RNA, 55 nt, Human
cacacuguguuuugaugaagccauaccacuaggcuucucccaaguaugcaguuug

SEQ ID NO: 4127907 - RNA, 71 nt, Human
cacacuguuguggcaaauguguccugggucccuucuaguccaggguuuuauacuuugcuaguaucagugug

SEQ ID NO: 4127908 - RNA, 70 nt, Human
cacacuugcuucagagucaaguuuuaaugggaaucuuucaaguuagugaacuuuggggccaaaaagugug

SEQ ID NO: 4127909 - RNA, 58 nt, Human
cacacuugugaccgauauaaugagccacuggauggcacuguggguccaugcaaaugug

SEQ ID NO: 4127910 - RNA, 64 nt, Human
cacagaaaggcucaaaucccaaggaaacuccucccugggaugugaaaagucucaauuuucugug

SEQ ID NO: 4127911 - RNA, 60 nt, Human
cacagaaaugauguuguguccuucucagugccucauaacaagggacacaauauuucugug

SEQ ID NO: 4127912 - RNA, 75 nt, Human
cacagaagcauuuuaguaaugaacuugagaaaaacuaaaaauuuucaggaacgugcuggaaugucaggcacugug

SEQ ID NO: 4127913 - RNA, 82 nt, Human
cacagaagucaaagucuggauuuuuaagguggaucucugagugaucaauauugcugaggauugaggcuugaauuucauagug

SEQ ID NO: 4127914 - RNA, 71 nt, Human
cacagacaggcucugaggcagauuuucguuuuagcuuuaggaugaucacucuggcucaagggaugugugug

SEQ ID NO: 4127915 - RNA, 101 nt, Human
cacagacucucucgggucugggaaaguuaauguaucucauguaacuaacugacauucaccaaacguaagaacagauaaaguuucccccgacagacccugug

SEQ ID NO: 4127916 - RNA, 61 nt, Human
cacagaggcugcgcuugggaacggaaugaacaaccaggagcugugggaggcaggcuuugug

SEQ ID NO: 4127917 - RNA, 58 nt, Human
cacagaugaguagaugggugcagcguugacaauaacugcagucauauuguucaucuug

SEQ ID NO: 4127918 - RNA, 73 nt, Human
cacagaugcaggugauucacaguuuaggcugggcugauaacagcccccgccagcugagaauggggccuuugug

SEQ ID NO: 4127919 - RNA, 122 nt, Human
cacagauggugcucugcagaccucucugcuguggcacuucccucccugaauggcuuccugcaagaggugcuaauugcaaguaagggauggagugcggcccggaccgcagagcuuauuucgug

SEQ ID NO: 4127920 - RNA, 67 nt, Human
cacagcauagcugggaaggguuugccaugcuuccauggcugcaucauccugguugagaauugcuuug

SEQ ID NO: 4127921 - RNA, 87 nt, Human
cacagcccagauuaaggagucaggaguuaugcuccaccucugugaguugcccuaagaggugggcauccugaguuuauuaugguuaug

SEQ ID NO: 4127922 - RNA, 72 nt, Human
cacagcccugagaaugucccgaaugguuuccucucaccuggagagauuggggaugaaucuuucuuggcugug

SEQ ID NO: 4127923 - RNA, 60 nt, Human
cacagcccugcgccccaguuugggggugaaacuagacucagaaccaggggcaggucugug

SEQ ID NO: 4127924 - RNA, 55 nt, Human
cacagccuaaacucagaacuccaagggcaguuggaggucaggggagaggcugaug

SEQ ID NO: 4127925 - RNA, 56 nt, Human
cacagccuuuaggguacacacagauacauuugggcuggacacccuaaagugcucug

SEQ ID NO: 4127926 - RNA, 60 nt, Human
cacagcucugacacaguacaaaauucaguggcucucugaaguaugcugcccagagcuuug

SEQ ID NO: 4127927 - RNA, 62 nt, Human
cacagcugcccuaacuguacucaacucucucuuuuuugucuacaucaaaguacgcagcugug

SEQ ID NO: 4127928 - RNA, 72 nt, Human
cacagcuggugacagagcccagacuucccccagguuucuggcggguccgggggucucuccuccccagcugug

SEQ ID NO: 4127929 - RNA, 58 nt, Human
cacagcuguauucaaguugcaaggcuugucaacuuugcuauuuuucugugcagcucug

SEQ ID NO: 4127930 - RNA, 98 nt, Human
cacagcuucuuuauaucuggcugggguccauccucuaauauacacccucuaauggugaguugcagugagcggagccucagugcugugaacuggcugug

SEQ ID NO: 4127931 - RNA, 70 nt, Human
cacaggaaaugauucugcagcagagcaucgccuugaauucucucugcugcuuugugauuuuuuccugcug

SEQ ID NO: 4127932 - RNA, 121 nt, Human
cacaggacagaugcuacaaguaaaguagaaaacagaagcaaucuaugaaugguucauauguguaaaugcauuuguuuaagcuauuuggaaaacuugguuaguauuuucacuuaguucugug

SEQ ID NO: 4127933 - RNA, 64 nt, Human
cacaggagcccugaggccucccucugucuggggccucccucucuggggggcuucagggccugug

SEQ ID NO: 4127934 - RNA, 59 nt, Human
cacaggaggcaaugguaagauuggaauucuguauuuugaacugcccuguccuucaugug

SEQ ID NO: 4127935 - RNA, 81 nt, Human
cacaggcaccacucuaacuuuuuugauaugugccccuuguuucgcaggcauucuucgaaguaaguaguguugugucgugug

SEQ ID NO: 4127936 - RNA, 59 nt, Human
cacaggcagggaccucuugaguucccaagcaacagggaaugugcaagacuugucugaug

SEQ ID NO: 4127937 - RNA, 97 nt, Human
cacaggccaaagaaacaggccccagauggagucccguggaguucugccaucucuuuggcugagcugaauugcugccauuugccugcaucugucagug

SEQ ID NO: 4127938 - RNA, 91 nt, Human
cacaggccacacuuugagcagccagugguugaagaugcagucuccucauaggaucucuccucugccucugagcaggcagguguggcuaaug

SEQ ID NO: 4127939 - RNA, 81 nt, Human
cacaggccgugugcuccuuuugguuuguggugugucuggaaaacaaaaggaacacaggagaaaggggaagcucggccugug

SEQ ID NO: 4127940 - RNA, 64 nt, Human
cacaggcuuggggcucagacagaucuggguuuauaucucacuucugcugcugaccaacacugug

SEQ ID NO: 4127941 - RNA, 63 nt, Human
cacagggaacaacuagaacaaaggccuugagauguggcaguuuguggcaaauuguuuauugug

SEQ ID NO: 4127942 - RNA, 61 nt, Human
cacagggcagagaccugggugcagaggggacccugcccucuuccucaggccuuucccugug

SEQ ID NO: 4127943 - RNA, 59 nt, Human
cacagggcagguacucucagagcauccauacuuccgcucugcccuucacccgcuuugug

SEQ ID NO: 4127944 - RNA, 96 nt, Human
cacagggcccagcuucagugaauguugaguaaggcuucagugauuguuagcgcuucaucuuguucuauguuugaaaccagaaguugcgcaccugug

SEQ ID NO: 4127945 - RNA, 60 nt, Human
cacaggggacaggaagaugguaguggauggcuuccuucccacccuccacuguucacugug

SEQ ID NO: 4127946 - RNA, 72 nt, Human
cacagguagcuuuugauauuagggcuggcuggaaugucugaugucaucccuggaguccggagcucaccucug

SEQ ID NO: 4127947 - RNA, 73 nt, Human
cacagguuggcagggucucugcucuacauggcuuuucagcgagccaggcuagcagagacuccacugucuugug

SEQ ID NO: 4127948 - RNA, 80 nt, Human
cacagguuguuggggaaggugggagaauguaaguguggucugcagacgucaacauggucacucuuccuuguguaccugug

SEQ ID NO: 4127949 - RNA, 76 nt, Human
cacaguaaauacccggggcugugauuuuugugacuuuggucaaugggacgacaggcucugugguagacuggcugug

SEQ ID NO: 4127950 - RNA, 71 nt, Human
cacaguaacacagacagccacuaguaauuguucccuaaaaauucugugugggaaugucugagauguuugug

SEQ ID NO: 4127951 - RNA, 92 nt, Human
cacaguaccagggcaucuggaucaggauggcuucugcaucaaacuacauagugugcacaggaagcuauucucucuaaucauccuguccugug

SEQ ID NO: 4127952 - RNA, 61 nt, Human
cagcugucucugccuuaugguccagggcaaguuucccccuguaauauacacagacagacug

SEQ ID NO: 4127953 - RNA, 109 nt, Human
cagcugugcccacauaugucugacaggguguguuagaaugauuauguguggguguggcuacaugcaucucugggacacauguuugcauauguguggcacacgaaggcug

SEQ ID NO: 4127954 - RNA, 97 nt, Human
cagcugugugggaggaggaggacuccuacccuggucgaaguugaguuucuuagcuggaggaguuucuccuagcccuucaauauccaccacgucacug

SEQ ID NO: 4127955 - RNA, 57 nt, Human
cagcuguuguuaugucugcaggggaaucacagucuuuggcagccccuuacacagcug

SEQ ID NO: 4127956 - RNA, 64 nt, Human
cagaaagaugugaguucaaaccucagugaauggacugagguguccggcugcauaaucuuggaug

SEQ ID NO: 4127957 - RNA, 66 nt, Human
cagaaagcagagcugagccuuucacaauuuaggaguccaaguucagcgcugcuucuaacacaucug

SEQ ID NO: 4127958 - RNA, 56 nt, Human
cagaaagccgacuuacaauggaauaucauucagcuguaaaaacgacggacuuucug

SEQ ID NO: 4127959 - RNA, 88 nt, Human
cagaaagggugcggccuggcugacagcuuaauuccagcuuuacgaaacccugaguagagaauucagcuaaggugagcccagauuucug

SEQ ID NO: 4127960 - RNA, 127 nt, Human
cagaaaucacuaacaucuuauggaaaagcuuugaaagccauggcugcaucagccugccucucccacuuagagacgggaaaguuuaugugagccagggucgaggcuguuugggacugugugaucucug

SEQ ID NO: 4127961 - RNA, 55 nt, Human
cagaacagaaucguguggugaggccuucugcuucugccaauuuuguuuuguuuug

SEQ ID NO: 4127962 - RNA, 70 nt, Human
cagaacagagucaaaaguaugugcaaugucauuauuaauuauuguaaacauaaauuggauucucguuuug

SEQ ID NO: 4127963 - RNA, 77 nt, Human
cagaacucuuaaaagcaauauuuaaagguuugcaacucucuguuggaaucaauucauguugcaaauagugagaucug

SEQ ID NO: 4127964 - RNA, 64 nt, Human
cagaacugugagggcggcccaugcugcaggcuguggcugucagcaggcugcuucuccacagcug

SEQ ID NO: 4127965 - RNA, 109 nt, Human
cagaagcaggaugccgaucccggggaggugccagggggcucaaaggagagugccaggcaggugggcgagccucuggaguccucuggagccuccuuggcugcugcuucug

SEQ ID NO: 4127966 - RNA, 85 nt, Human
cagaagccugggagucuggguuucaugggcacuggcucucugccauaucagccggucccaucuuaauccaagcauccagggacug

SEQ ID NO: 4127967 - RNA, 58 nt, Human
cagaaggagcgcuaaggucccaggugugauaggaugagggcacccuuagccuccucug

SEQ ID NO: 4127968 - RNA, 72 nt, Human
cagaaggcuuauuuugauaucugaguauggccugaaggcuaugcugagugagugaaacccagagcacuucug

SEQ ID NO: 4127969 - RNA, 78 nt, Human
cagaaggguaaguaagcgcugugggcgugcgaggaggcagcucugccucuuccuagugugcagcguggccaccuucug

SEQ ID NO: 4127970 - RNA, 128 nt, Human
cagaagguccugggucccaaaguuccuguuacucacugcugauugggcacagaugagagugccuaguuuucauucagcagccuguuguggguacaggguuauggcugcaaugaagcagggccuuucug

SEQ ID NO: 4127971 - RNA, 80 nt, Human
cagaaguacaauggaacuuguaauuauguccucuuugauaacaugaauuuggauaugacgaguuuggugauuggcuccug

SEQ ID NO: 4127972 - RNA, 69 nt, Human
cagaaguauuuagucuucauuccuguguuugaagcagaaaaaaagguauugagggcuaaccagacucug

SEQ ID NO: 4127973 - RNA, 60 nt, Human
cagaagucuuucuguuucaccuuuaauuugagguuaagaacaguauauggaaagcuucug

SEQ ID NO: 4127974 - RNA, 70 nt, Human
cagaaucaguagagagcccuagggcucaaguguguguggcuucuaugagccugggcuuucucuggagaug

SEQ ID NO: 4127975 - RNA, 79 nt, Human
cagaauccuucuggguaguuacugugacgauccuucaccuuggcaguggaggaaguucuaugauuacauccugguucug

SEQ ID NO: 4127976 - RNA, 59 nt, Human
cagaaucuucucuauuuucccucagauauuaguucucugcaggaaaccacaggguucug

SEQ ID NO: 4127977 - RNA, 91 nt, Human
cagaaucuugcucugucacccaggcuggagugcaguggcacgaucucggcucacugcaaacucugccucccggguucaagcaauucuucug

SEQ ID NO: 4127978 - RNA, 88 nt, Human
cagaaugaugcuggcauuguucacagaauuugcgaagaucugagcccucagguccuccauggucuugaaguaaugcccccaaucucug

SEQ ID NO: 4127979 - RNA, 75 nt, Human
cagaauuuggaucauaggguuuuugagcuacaagggauaugaguugucauugaguucaaauccuucauuuuucug

SEQ ID NO: 4127980 - RNA, 58 nt, Human
cagacacacacccuggccuagcgcuaagauggugcuaagaccccuggguguugaucug

SEQ ID NO: 4127981 - RNA, 80 nt, Human
cagacacagcugcaggagguggguaccugucuucgcugaaagcuagacuuggcucguccuaguucuuguuuagugugcug

SEQ ID NO: 4127982 - RNA, 58 nt, Human
cagacaccagccccucuguguccccagcacucggggagcagagcgggcggggguccug

SEQ ID NO: 4127983 - RNA, 67 nt, Human
cagacacuaugcuaagguacuaauaggaauuauauauuccucacaaugaccuuaagcaauagugcug

SEQ ID NO: 4127984 - RNA, 81 nt, Human
cagacacugagagaacaucuccucccacgugcaaucugugcaugugcucaguucugcacaaggagaauucauuagugccug

SEQ ID NO: 4127985 - RNA, 72 nt, Human
cagacacuguguacacauacuauucaaagagauggagcuagucauugcuguugaaaagugugugugugucug

SEQ ID NO: 4127986 - RNA, 100 nt, Human
cagacagcagggagaugcucuccaugaggauccaggugacaggcccaguggggaucugggagccucauggagacgagacaucccagcccugcccccucug

SEQ ID NO: 4127987 - RNA, 59 nt, Human
cagacaggaauucuggcguggucuacguuucuccagcgccccgcuggaaaucuuuuuug

SEQ ID NO: 4127988 - RNA, 78 nt, Human
cagacaggccagacaaauugggacauuguguuacaacuccucuugagaacaccaugccuccaaagucugguucuucug

SEQ ID NO: 4127989 - RNA, 88 nt, Human
cagacagggaggaggucacauggggagagggagaaggccaugccucuuccacugggccccaucccugguugccauuccuccuuggcug

SEQ ID NO: 4127990 - RNA, 57 nt, Human
cagacagggguaaccuuccucauuucucuguguuguauguaggaaggacccugucug

SEQ ID NO: 4127991 - RNA, 57 nt, Human
cagacaggguggguuucugggccucgggcugauaagaagacccauccugauccucug

SEQ ID NO: 4127992 - RNA, 67 nt, Human
cagacagguagggacagaacaugaguggcagcaagccagacuuggucuuagugcucuaaccugucug

SEQ ID NO: 4127993 - RNA, 55 nt, Human
cagacaucuguacccagccugugguuuugccuggcugguaggguacagaagucug

SEQ ID NO: 4127994 - RNA, 62 nt, Human
cagacauggcgccaagugcuagaccaguaucauaaugguccaggcacuucccaucaugccug

SEQ ID NO: 4127995 - RNA, 75 nt, Human
cagaccacuauuucuauugcaugugauagaggcaggagauaacuccuguaaaggugacaggcaaagaaugggaug

SEQ ID NO: 4127996 - RNA, 119 nt, Human
cagacccaucugcuggguuuguugcaguacagauugccgggccucgagagaaucugauuuggcaggucuacaguggggucugaguaucugcauuucuaacaaguuucccggagaugcug

SEQ ID NO: 4127997 - RNA, 127 nt, Human
cagaccccaagagacuggcaguaccaacccaagcgugcccuggcauguccuccuggcaugcccgcugugucccuuccaggauggccggggugugggcuggucugcagaggcucugcagcuggggcug

SEQ ID NO: 4127998 - RNA, 86 nt, Human
cagaccccagcccauuucucaggacuccaugggcgcgcacaggacgugcucucgucccugccagggaaguggcuccuggcggucug

SEQ ID NO: 4127999 - RNA, 63 nt, Human
cagaccccagcggccagcaggcuucaccaccucugccuucccugggcuggcuugcuggguuug

SEQ ID NO: 4128000 - RNA, 56 nt, Human
cagaccgguuaacuugcccaagaucuauagcuugcugcagugaucucaucggucug

SEQ ID NO: 4128001 - RNA, 58 nt, Human
cagaccugagguugaguaccagucuugacucuuacuaacugcuuggacuucaguucug

SEQ ID NO: 4128002 - RNA, 67 nt, Human
cagaccuggagggacccuggcccugucgcuguccaugugacacuggcccaggcucuccuccuuucug

SEQ ID NO: 4128003 - RNA, 72 nt, Human
cagaccugggcauguguccugcugugucacacaggugcucugugaccuugagcaagacacugguccucucug

SEQ ID NO: 4128004 - RNA, 61 nt, Human
cagaccuggguaaggggcugacaaagauucuuugcuugaccaaacuuuacucaggcuccug

SEQ ID NO: 4128005 - RNA, 95 nt, Human
cagacggagucgcacucuaucacccaggcuggagugcagugacacgaucucuguucacugcaaccuccgccucccggguucaagcgauuccccug

SEQ ID NO: 4128006 - RNA, 80 nt, Human
cagacggggucagggaggccccaccauggcuugucgagggcacgggcaccugcauggcggcgcucucccugccuccccug

SEQ ID NO: 4128007 - RNA, 57 nt, Human
cagacuccaccuccagaaagucuugugcauuaagucuacaagaggaauggaggucug

SEQ ID NO: 4128008 - RNA, 64 nt, Human
cagacuccagagaguucucuuguccucuuuuggccaugugaggauacaagaagauggcagucug

SEQ ID NO: 4128009 - RNA, 71 nt, Human
cagacucuuggcuuggaugagguaugcaugcacaggcaaaagcuaagcagaaguaccucguucuaguucug

SEQ ID NO: 4128010 - RNA, 79 nt, Human
cagacugaaaccugagccaugagccugcgcccagcucccugcgagguuggaaagcgaggaguuggcauuuuucagccug

SEQ ID NO: 4128011 - RNA, 57 nt, Human
cagacuggguggcuuaagcaacaaauauuucucacuguucuggaggcuacaagucug

SEQ ID NO: 4128012 - RNA, 55 nt, Human
cagacuuccugaaagcugguuuuuggucccugggaagccagcccacagugguuug

SEQ ID NO: 4128013 - RNA, 60 nt, Human
cagagaaaguugagaaguucccuuuggaaaaauccaaaccacacuuagcaguuucgucug

SEQ ID NO: 4128014 - RNA, 77 nt, Human
cagagaaaugcagcagcugaccagugaguccugcaaguaagaggcagaauugcaacucacucucauugcucucucug

SEQ ID NO: 4128015 - RNA, 91 nt, Human
cagagaagagccuccuggaggagagccugcacuuugaccaugcuguccggaugggugcagugcucuuuucugcaaaguguucacuucucug

SEQ ID NO: 4128016 - RNA, 89 nt, Human
cagagaaggaaagggaauccaugauuugagagcagccggcuucacugaacugguacuguucugcggaucagaagcuaagccuguaucug

SEQ ID NO: 4128017 - RNA, 55 nt, Human
cacaguacccagcacuacugagcaaacagauacucaguguguuccucuuacugug

SEQ ID NO: 4128018 - RNA, 81 nt, Human
cacaguaggagaaucuggcucaugucgucgcaaguauaugguucuugcugagauaagcuaugaccagggaauuccuauuug

SEQ ID NO: 4128019 - RNA, 90 nt, Human
cacagucauauuucccuuugucuuuguggugagccugcgugaaauaaaugaaugcaucagcacacacuggagcaaggagaugggacucug

SEQ ID NO: 4128020 - RNA, 129 nt, Human
cacagucaucuuccuucaagcuuggagaaaggacagucuucccuuauuccacucagagguguccauguguaggagaaaggggagggugggccucagcucucagcuccucugaucaaucuacgcugcuug

SEQ ID NO: 4128021 - RNA, 68 nt, Human
cacagugggcuggugucugauucuccccugagaaaucucaaggaugaaagauuggccauguagcugug

SEQ ID NO: 4128022 - RNA, 75 nt, Human
cacagugucaggcagcugaggacuuugcuaacauguccuguccucguucacagaguccuuggcuccgucauugug

SEQ ID NO: 4128023 - RNA, 88 nt, Human
cacaguguuuaagcuucagcuucaauaauggcugauggugauacauuugaguaauucuauuaccaguugaaugagggaagcugcugug

SEQ ID NO: 4128024 - RNA, 72 nt, Human
cacaguguuugguaaguacccaccuggguccagcacuguacuggacauuaggugaagcuuaucuucauagug

SEQ ID NO: 4128025 - RNA, 74 nt, Human
cacauaauaaggaaguugcagaaguggaauugaaucccagccuuccucacuuuguagccauccuuucacaugug

SEQ ID NO: 4128026 - RNA, 63 nt, Human
cacauauaaauuaccccauuugugugcacagacagggcacacacugggcaugguuuaugcuug

SEQ ID NO: 4128027 - RNA, 77 nt, Human
cacauaucagccagcuguccucccuuuccugggagcugguccagagacgaggggcagggcgucugguuuucauugug

SEQ ID NO: 4128028 - RNA, 72 nt, Human
cacauaucugaagggauauucugaggaaaguagaauaccucauaauguaaggcucccuacaguguauaugug

SEQ ID NO: 4128029 - RNA, 82 nt, Human
cacauauguuuaauaaggucuggauuuuaucuacuguauucaucagaaguauuacaaaguagaaauucaguaaauauuugug

SEQ ID NO: 4128030 - RNA, 107 nt, Human
cagagcggcauuccuggcauccucauucagcccgaaggugcgccguucaccuucggcguuauuucccugaggguugcaggugguuggugagcgaggaggcgucucug

SEQ ID NO: 4128031 - RNA, 69 nt, Human
cagagcgggugcuguucuggcugccaccacccuggaggggcuggaagagggaggggcacaaaggcucug

SEQ ID NO: 4128032 - RNA, 98 nt, Human
cagagcucccacacccccucugcagcuccugccucucugguugggccucccagguucagaaaagacucaggggcugagguggucuguauggaucgaug

SEQ ID NO: 4128033 - RNA, 84 nt, Human
cagagcucggguaacacuggcaccgucucacacuguuuucaaugauuucccuguguugcugcugugugucuaccuugggcuuug

SEQ ID NO: 4128034 - RNA, 69 nt, Human
cagagcucugaccuggccgcccugcugugcaguaacuagugcgagugggcaaaacagcucagagcuaug

SEQ ID NO: 4128035 - RNA, 58 nt, Human
cagagcugagaauguugaugcugaggcuuucuuguuuccuuuccauuuucugagccug

SEQ ID NO: 4128036 - RNA, 72 nt, Human
cagagcugcuguuuucuaggguuguuggcccagggcugaacacccagggccuuccagggaagacagggccug

SEQ ID NO: 4128037 - RNA, 60 nt, Human
cagaggaaaugggaaggagauaagccauacugauuuccuuguaagaccuauuuuugucug

SEQ ID NO: 4128038 - RNA, 65 nt, Human
cagaggaccugcucgaccguggccccacacacgcuuuggaacuggccagggaggagaggccccug

SEQ ID NO: 4128039 - RNA, 62 nt, Human
cagaggcacaagaaagcaaggcaugcauggagcagcgcaguuguuugguuugaggccaucug

SEQ ID NO: 4128040 - RNA, 130 nt, Human
cagaggcuagagaaaugugaagauauggucagcacugguggaaaaugugacuauucuaaaguuguaguucauuaucacuuuagaaguauguguucuaguugugcagaucuaauuucugcuugagcccuug

SEQ ID NO: 4128041 - RNA, 60 nt, Human
cagaggcuucuuucugauuugcguaugugugccauagugccugaucuacaaggggcccug

SEQ ID NO: 4128042 - RNA, 64 nt, Human
cagaggcuuggcauuaucaugcagagcaaaaagaagcuccucacaugaagaaucaagacccuug

SEQ ID NO: 4128043 - RNA, 71 nt, Human
cagagggaaaauuacccagagugcaccacccaacaauaccaguguuaacauuucaacgaauuuuccuucug

SEQ ID NO: 4128044 - RNA, 66 nt, Human
cagagggaauuugcagguuguuuugagaaagauuucuuaaagcaauuugagcaaguucuaucuuug

SEQ ID NO: 4128045 - RNA, 60 nt, Human
cagagggagaguucuggcagaauuuggaccugaguucugguugcccaugacaucccgcug

SEQ ID NO: 4128046 - RNA, 62 nt, Human
cagagggagcccuccaggagcagggaagucauauccguggaccauuuguagguuucccucug

SEQ ID NO: 4128047 - RNA, 55 nt, Human
cagagggcacucggagugacauuuucuggggaagauccuccuggugacuuuucug

SEQ ID NO: 4128048 - RNA, 59 nt, Human
cagagggccauaggugcauaguugagaacugaguuuagaauuugaacuauggucaucug

SEQ ID NO: 4128049 - RNA, 79 nt, Human
cagaggggagcucugauaugaaugucuagcucuuccucgcagaggaacaugugaaaucucauaguuagucucucuucug

SEQ ID NO: 4128050 - RNA, 75 nt, Human
cagaggguacccagguggcucugacggggguuccaguggaaaugucugugggguucaugugccucuugccuucug

SEQ ID NO: 4128051 - RNA, 65 nt, Human
cagagguauauauucuccauauugggguuucuccaaccauaauguggguguuaauagugccucug

SEQ ID NO: 4128052 - RNA, 107 nt, Human
cagaggugaaguaauuugcucaaagugacauaguaguggggccaggguuugaacucaggaaguuuaacuccagagcccauacucuuagcuuagcuauacuaccucug

SEQ ID NO: 4128053 - RNA, 60 nt, Human
cagagguggagcucuuggcaucauggcagacuaaguugauguugacaguucccauugcug

SEQ ID NO: 4128054 - RNA, 81 nt, Human
cagaguaagacugaaaagugucuguugaguuaaugaaaaagugaauuaacuaguugauguuacuuuucuagguuuacucug

SEQ ID NO: 4128055 - RNA, 98 nt, Human
cagaguagaagucugacugaccuggaaugaauauacauucauuccauauuuauuccacuggaauacauucauuccaggucagucagaguucuauccug

SEQ ID NO: 4128056 - RNA, 105 nt, Human
cagaguaugucacguggagauggggcaagggcucacggucugcugggacugggauaccaccaccuagacacugugugagucuuugccucugccaccugugcucug

SEQ ID NO: 4128057 - RNA, 59 nt, Human
cagagucaaucuuaucaguuaauaaagucaaguuguugauucagagaagauuggcccug

SEQ ID NO: 4128058 - RNA, 83 nt, Human
cagagucagcgugcggggccagcgcaggcugauaaccgcacggaacuucccaggcacccuguguggccgcacugcucccucug

SEQ ID NO: 4128059 - RNA, 58 nt, Human
cagagucaggauuacccaaucuguacaagcuuuguguaaaggaaggaaccugagucug

SEQ ID NO: 4128060 - RNA, 55 nt, Human
cagagucaguaacauauaugguacaaacauucuuauacaugugucacugauucug

SEQ ID NO: 4128061 - RNA, 92 nt, Human
cagagucaguucauggucagcuagugguugcaucugaguauuaagagaaugaauguccagccaaccacuggauugagaaagaggagaaguug

SEQ ID NO: 4128062 - RNA, 57 nt, Human
cagagucauaucagagaauaugaacugucaguguuuccaauguuucucuuggcucug

SEQ ID NO: 4128063 - RNA, 77 nt, Human
cagaguccucucuuggcuauccaaguuauccauaauuuuuucuggauuuucuuucugaauagcuucaaagaggccug

SEQ ID NO: 4128064 - RNA, 99 nt, Human
cagagucuagaccuuuaaccacuguguuaugcuuuccauggguaaagcaaccuaaaaaagccccuggaaucaguuacaugugguuggagacuaacucug

SEQ ID NO: 4128065 - RNA, 76 nt, Human
cagagucugauuuugacaacugugcaguuuguauugaaggguacaagcccaaugacguuguccggauccugcccug

SEQ ID NO: 4128066 - RNA, 80 nt, Human
cagagucuggagaggagcaccauggccaugaacacugacucuggaaagaaccagauggccugggcucgauuccaacucug

SEQ ID NO: 4128067 - RNA, 130 nt, Human
cagagugaaggguuccaugauucucuugguccuucccucagaguugccuggugcuuuuugcagauucagccaugucuucacaccgggcagcaggaaggagaaagagaaggggagucgcacuuaccaccug

SEQ ID NO: 4128068 - RNA, 68 nt, Human
cagagugaccuacuuagaacucaaguuaauagauaaagguaagaugagcuuuuguaguagucacugug

SEQ ID NO: 4128069 - RNA, 61 nt, Human
cagagugagggccugcaccugccccggguccucuguccggaaaugguuuaauccuuaccug

SEQ ID NO: 4128070 - RNA, 77 nt, Human
cagagugcagggugugcagcggcaugcagaggacagucgucaccauguccucagcugcugcacagcuuuucaaucug

SEQ ID NO: 4128071 - RNA, 62 nt, Human
cagagugcucucucucauccucuuuccaccauaugaggauacaacuagaagauggcagucug

SEQ ID NO: 4128072 - RNA, 91 nt, Human
cagaguguggagugaaguggagaaguaaauaucuguuuauagcacuagaagagugauacacagauuuacaucaaucaagcuacauagucug

SEQ ID NO: 4128073 - RNA, 92 nt, Human
cagaguguguauuccuacuacauuaauaaaacauucaguacccacugaaaguuugagaauaguggaggaauagaauagaauguuauagucug

SEQ ID NO: 4128074 - RNA, 63 nt, Human
cagaguguuucuuugggugggugaagaaagaaucaacaccucauauaaugagagaugcuucug

SEQ ID NO: 4128075 - RNA, 80 nt, Human
cagaguuccagccuuucaaagucguuuucaauccuguuuuuucaggucauguauuugcgagguuaggaaaaccuacucug

SEQ ID NO: 4128076 - RNA, 123 nt, Human
cagaguuggaugcuaggaaagauugauuuuguaucuuacggggacuaauugaaagaggacccugcuaucacuuuucauuaugguucacgugauguagauagucuuugauggguuucagcuuug

SEQ ID NO: 4128077 - RNA, 78 nt, Human
cagaguuuccaguauucaggcuucgagaaacagugagaaugugauguuccugaagccugagugaugacuaugauucug

SEQ ID NO: 4128078 - RNA, 55 nt, Human
cagaguuugcuggaggcgggaaaguaggccgcgguuuccaccccagccagcucug

SEQ ID NO: 4128079 - RNA, 94 nt, Human
cagaguuuuguuugcuuaauagcuugacuauucuaugauguuggaguuacuaaccauagagaauguuaaguaccaaaaugaauacuaaacucug

SEQ ID NO: 4128080 - RNA, 67 nt, Human
cagaccacaaaugagcuggcaggggcucagggacugccaagucacccagccuuggcggguuugucug

SEQ ID NO: 4128081 - RNA, 69 nt, Human
cagacccaucugcagggcuuuuugaaacaugguccacuggacuucacuuucagagucucaguaagucug

SEQ ID NO: 4128082 - RNA, 61 nt, Human
cagacccccugaagagaggaagcuggaccacuuugugcucuaaggucagggcgaaggucug

SEQ ID NO: 4128083 - RNA, 72 nt, Human
cagacccucauguauagguccauagugaauguuaucuaacaugauuuugguuuauuacauccaugggugcug

SEQ ID NO: 4128084 - RNA, 112 nt, Human
cagacccuggcuggagccccuauggcuugggguggggagugggaguacccaccccaggcccuccccuuccuuccucagacagccuccuugagggcucaagccauuucuucug

SEQ ID NO: 4128085 - RNA, 69 nt, Human
cagaccgcuggcaaugcguacaucugcaugcuguacaggccagaagcugcagcucauugcuggggucug

SEQ ID NO: 4128086 - RNA, 58 nt, Human
cagaccucaaagcugcagugcuggacaguggggcugaaagcaaagccuuuagaguuug

SEQ ID NO: 4128087 - RNA, 59 nt, Human
cagacuaaaaaucguguccuggaaggaaacuacagguacuaccagggauuuucagucug

SEQ ID NO: 4128088 - RNA, 70 nt, Human
cagacuauuuauguccaaguguuuuaaccaaggaguuaaaugguuagauuucucauucauagauuguuug

SEQ ID NO: 4128089 - RNA, 65 nt, Human
cagacucuuggucuccagcacagaaucucugauucagggagucuggaguggggcccaagaaucug

SEQ ID NO: 4128090 - RNA, 60 nt, Human
cagacugccuggggcacaauauggcucuggcugggccacaugcucucucuccagguucug

SEQ ID NO: 4128091 - RNA, 57 nt, Human
cagacuggcugaaggccgaguggaguggguuaaagcuuggccccgaagccuagucug

SEQ ID NO: 4128092 - RNA, 63 nt, Human
cagacugggugcugugggcucagagguggcaaacaugucuggaugucuggagcaucgugucug

SEQ ID NO: 4128093 - RNA, 74 nt, Human
cagacugugggaagacagccagguggcacgacuccggcagccacuugccgcccggccaucucggcucccaucug

SEQ ID NO: 4128094 - RNA, 56 nt, Human
cagacuugacggcagcugcuuucaugggugauacccggguucuagcccucaaucug

SEQ ID NO: 4128095 - RNA, 64 nt, Human
cagacuuugugugcauuucugugcauacacaugaagauucaaauguguacaggagugcagucug

SEQ ID NO: 4128096 - RNA, 123 nt, Human
cagagaaaagaagaguuaggaaggaaaaacauucuauuuugcuaaaacagcuuccucagaacuucucaugcaauguuuucaaagugagugugcauaaagucuaccaaugacuucuuauuucug

SEQ ID NO: 4128097 - RNA, 89 nt, Human
cagagacacaugccugaacaccgugugugugugcgcgugugugugugcacacacacacgugcucaacacgcuccaugcagaauacuuug

SEQ ID NO: 4128098 - RNA, 64 nt, Human
cagagacuguacaaugccgagacuaacuccugcucuaaugagcggaggggcauuugcagcucug

SEQ ID NO: 4128099 - RNA, 87 nt, Human
cagagagaagaguuugcggggacucagccuuugucagccccagcugacagugaggcuggcaaggcugguauuugaaauauuccucug

SEQ ID NO: 4128100 - RNA, 88 nt, Human
cagagagacaguauguugaaauagaagggacaugugacuaagaucuuagugaccccacauguguccuagcuauucuccuauuucccug

SEQ ID NO: 4128101 - RNA, 86 nt, Human
cagagagaggccucacagcacagguguccucacagggggugccucacagggcuucccuaacacaccugcugguagcuucugcucug

SEQ ID NO: 4128102 - RNA, 82 nt, Human
cagagagauguuaauggcuuugcucaaguuuagccagcugguaaguggcaaagcuggggugugagccauucauauuauugug

SEQ ID NO: 4128103 - RNA, 87 nt, Human
cagagaggagcaaggacuauaagacaaaagcuuugagaaaaaccacuggcugugcuugguguccuuggaugauuuuuucacucuuug

SEQ ID NO: 4128104 - RNA, 82 nt, Human
cagaaacuuuaguuaggggagcaacuagguauauauuuguuuuuaaccaaguucuaccucaguuucccacuuaugguuucug

SEQ ID NO: 4128105 - RNA, 90 nt, Human
cagaaagccuguaccccucagugaccuauugcauucaggcuagcuuuguguggaacacaagucauugaggggccgcauaaaagcuuauug

SEQ ID NO: 4128106 - RNA, 85 nt, Human
cagaaaggaccaccuuugcaacucccauguguugaugcuguaugguaacgcaguaauaagcuggaggguguggaggugcugacug

SEQ ID NO: 4128107 - RNA, 75 nt, Human
cagaaaggcacagugauuucugcaagggcucugaguuuguaaaugacagagcugggauucaucuaugucuuucug

SEQ ID NO: 4128108 - RNA, 78 nt, Human
cagaaagggacuugugucuguguuuuuguuaacuaugcacaucgauuugacugagagacauagcacaguuuuucgcug

SEQ ID NO: 4128109 - RNA, 78 nt, Human
cagaaaguagaacuuccauauucuugguauuuucuaggggaagcuggccccuggaagggaauggugguuguaugguug

SEQ ID NO: 4128110 - RNA, 57 nt, Human
cagaaauguuuaugcuuuugaagaguggcauugagcccuuuagaaguugaaacucug

SEQ ID NO: 4128111 - RNA, 55 nt, Human
cagaacagaggccuuauguuucagaaacuaaugggaauuauggucacuguuccug

SEQ ID NO: 4128112 - RNA, 65 nt, Human
cagaacagucgccugcauggaucugcuuaccuuaccguccaagguguguaugcagguggcuucug

SEQ ID NO: 4128113 - RNA, 65 nt, Human
cagaaccacauugaagagagagaguggcugcucucagcacguuguuuucauugugguuaaaccug

SEQ ID NO: 4128114 - RNA, 65 nt, Human
cagaacucugcccugcauuucuguuucuugcuucugaaugcaguuaugugagggcaugauuucug

SEQ ID NO: 4128115 - RNA, 118 nt, Human
cagaacucuuggcugccugcagggcucugggcagaggacagcccccuugucugggaggcuguaauuccgaggccagggcugccuucccaaucaccucaggcaagcaaaugaggcaaug

SEQ ID NO: 4128116 - RNA, 55 nt, Human
cagaacugaacuguaaaauugaaaccagaagguugcaaauuucaguuaguucaug

SEQ ID NO: 4128117 - RNA, 57 nt, Human
cagaacugaccucugauucuaggacugaccucugacccuggaacugauucaguucug

SEQ ID NO: 4128118 - RNA, 92 nt, Human
cagaagaaaggugaccguuucaugagucagagaccucauggagagagacagcaugaggucucugacuuagagauggaugcuuggauuaucug

SEQ ID NO: 4128119 - RNA, 61 nt, Human
cagaagaaaguggggagacaagaggcugcucuuguuacuugauuucuuugcuuuauuucug

SEQ ID NO: 4128120 - RNA, 68 nt, Human
cagaagaccguccccaggaugugggcacuucucgccagaggguccugagccuggggcgcacucuucug

SEQ ID NO: 4128121 - RNA, 120 nt, Human
cagaagagcacaggaaggcuaccuuuucagaaaaguauuuugagcacuuuaugauauuagcuuccuuguaggguaaggugccaagguaauuucagucuccccugugauauaaagcuucug

SEQ ID NO: 4128122 - RNA, 61 nt, Human
cagaagagguuuuuaagggaagguuugcauaucacaccuuucccugguuaaccauuuucug

SEQ ID NO: 4128123 - RNA, 57 nt, Human
cagaagaucucuuaguggaggguaagguccaacccucagcucccaugagaucugcug

SEQ ID NO: 4128124 - RNA, 77 nt, Human
cagaagaucugagauuuucagcaucacuucagcaaaaauuguuaugguaauaauaugaaggucuuuaaaucuugcug

SEQ ID NO: 4128125 - RNA, 98 nt, Human
cagaagcauauaagguaacuuccuggccauugccauggcaaguugacauggcauuuauaaacugucauggcacugguaggagugucuuuaugcuaaug

SEQ ID NO: 4128126 - RNA, 98 nt, Human
cagaagccagagcuucucucucacugaugguggaaagccuuucuacaacccaagaggaggccauucucucaguagcagcagaggcucagguguuuaug

SEQ ID NO: 4128127 - RNA, 82 nt, Human
cagaagcucccaguguggguaaaguacauguagaacuuccaacagacccucuucuauuuugucuucugcucaucaccuucug

SEQ ID NO: 4128128 - RNA, 61 nt, Human
cagaagcugaggagugaggcaauuauuugaagaauucaaccccacuucaggcagcugucug

SEQ ID NO: 4128129 - RNA, 63 nt, Human
cagaagcugggaaaaaaugggcaguucaagaaaauaaaaugacugcaaauaccuaguuaucug

SEQ ID NO: 4128130 - RNA, 89 nt, Human
cagaagcuuuuugauagccuuuggcuacaagcgcugcaauccuaaccuaccuggguuaaagugucagaagccaaaauuaaaaucucaug

SEQ ID NO: 4128131 - RNA, 82 nt, Human
cagaaggaaagagcugagagggcgaucagaggaagaaaagaacuuuuuccacugcuacaaccucccagaaucccuuccucug

SEQ ID NO: 4128132 - RNA, 62 nt, Human
cagaaggauagagcugggaguuuccccuaucacugggugaggcuacucagcuguccgaacug

SEQ ID NO: 4128133 - RNA, 59 nt, Human
cagaaggcauagaccggauuaugcaaucacugagaaguagcuucuggauguguuuucug

SEQ ID NO: 4128134 - RNA, 65 nt, Human
cagaaguagaaucucagguaggcuauggguaaacuugguaggcuagcuggcauucuacauugcug

SEQ ID NO: 4128135 - RNA, 84 nt, Human
cagaauacccaacucagacuggauuaaauaaaaggggauuuucuugcuuauuuaacucuagauucagugguaaauggguuucug

SEQ ID NO: 4128136 - RNA, 84 nt, Human
cagaauaccuaauucagacuggcuacauuuucauggugcucaauagcuauauggagcuaauggccacuggauuggauagcacug

SEQ ID NO: 4128137 - RNA, 108 nt, Human
cagaauaccuucuuccuugcgauuuauguggacagacauaauccuaauuucucaggcaaguaaauugauauuagauuugucucagugauaccaagaugauaauuucug

SEQ ID NO: 4128138 - RNA, 130 nt, Human
cagaauaguauuuaugaaaaucuucagcuuccuucuuagauuuguagaaaccagcaccaguaggcuugguagcuuauuucagcuaaaauucuuaauuaaagggaagccucagauuuguuguacuauauug

SEQ ID NO: 4128139 - RNA, 90 nt, Human
cagaaugaaauggagauggcuauuuuagagaucaaggagguaacuucuugacuggcugaaauaccauauuuaguuccuuucaauauucug

SEQ ID NO: 4128140 - RNA, 58 nt, Human
cagaaugauuuguuaccgcauuuucuucuuggaaagaaaugcaugagaaaguauucug

SEQ ID NO: 4128141 - RNA, 68 nt, Human
cagaaugugagguuguaugugaaaaugacaaguugaauuguugcuuucacaaugcaauccuacuucug

SEQ ID NO: 4128142 - RNA, 60 nt, Human
cagaauucuuaaaacuuauggacagguugaaauaacuuuccauuuguauuaggaguucug

SEQ ID NO: 4128143 - RNA, 60 nt, Human
cagaauugagagaggcuguucucugggcacacuugcuuuauguggucuuuucaauugcug

SEQ ID NO: 4128144 - RNA, 121 nt, Human
cagaauuguuuggagagcuuguuaaaacacaggaugacaggcuucauccucagaguucuuaauucaguagcucugcaguagggccugaguuuguauugcuaccaaguuccaaaugauacug

SEQ ID NO: 4128145 - RNA, 80 nt, Human
cagaauuuaaacccaggagccagagucugcaguguaagagcuuuacccugaaauuaggcuccucucuguaguagaugcug

SEQ ID NO: 4128146 - RNA, 68 nt, Human
cagaauuuucauuagaaugacugagaaauuaugcaugaaguuucuuacuugcuuugaugaacauucug

SEQ ID NO: 4128147 - RNA, 91 nt, Human
cagacaaaauaaaaugcccaguguuuaggaauaaaauguaacugugcauaucccuggauuaacugaagcuauuuugauuugaaaaaaucug

SEQ ID NO: 4128148 - RNA, 79 nt, Human
cagacaaagugauuuugaauaaguguuuuuaagccaaauuauaagagagcacagauggauguauucauuauuuugucug

SEQ ID NO: 4128149 - RNA, 86 nt, Human
cagacaaguaacaguugcuauaauaucuucauuuuucauagaauaaacaaaaauguagaccuauagggaccucagugauugucaug

SEQ ID NO: 4128150 - RNA, 74 nt, Human
cagacaaugaagaagccaauugguaggcugaguuaaacuguggcaguuugucugauggcuguuucaauggucug

SEQ ID NO: 4128151 - RNA, 71 nt, Human
cagacaaugguuggacaguuauuuguuagcuaaaauccuacugaaauuauuguuuaaucaaacuuguccug

SEQ ID NO: 4128152 - RNA, 64 nt, Human
cagacaccaagacuguagaacaguguuguccaacagaacuuucugcaguguuggaaaugaucug

SEQ ID NO: 4128153 - RNA, 62 nt, Human
cagacaggacccaucagccaggcacugugagagcacagagcagggagguuggguccugccug

SEQ ID NO: 4128154 - RNA, 55 nt, Human
cagacagggcccugugaugguacccaacaaugaacuacaaacuaggcccuuucug

SEQ ID NO: 4128155 - RNA, 71 nt, Human
cagacagucuuucaaagaaaagaucacuucauuuuugaagugauaagcuacuuucugugaggacuguacug

SEQ ID NO: 4128156 - RNA, 63 nt, Human
cagacauacaucagucaggaaaggucuuaugacuaaggcauuucugaugagggaugugguaug

SEQ ID NO: 4128157 - RNA, 114 nt, Human
cagacauagaauguucgcugccuuucuaaugacauucacagaguuauuuuuaugcuuaaucaaaugagucucagacagcuuuugaauauggaaaggaugauacacaaauguuug

SEQ ID NO: 4128158 - RNA, 62 nt, Human
cagacauaucccugcucccuuagauuuuauggucucaugguggaauacagggaaguguguug

SEQ ID NO: 4128159 - RNA, 72 nt, Human
cagacauugugaaaguugccacaccaguugcaaggugcuggucagagcaacugcucacaaauuucuuguuug

SEQ ID NO: 4128160 - RNA, 114 nt, Human
cagaccaccucucaacugcuacucaaccugugucucuccuuacaagacuggucacgguuccugcuagucuguacuuauggcagagaugaugugagggcauaugagauguggcug

SEQ ID NO: 4128161 - RNA, 56 nt, Human
cagaccagacacucgcaucgacauuaccugcuuggcuucugcgaugucuguguuug

SEQ ID NO: 4128162 - RNA, 61 nt, Human
cagaccagcucuaugaacccaauccucuuugcgucccagguguuguggucaagcugggcug

SEQ ID NO: 4128163 - RNA, 102 nt, Human
cagacccuaucucccgugcucuuuuacaguggcuauuucauuuaguacuagggggcuuuuugccuguauuuuauaaaugagcaaagaggacuggagggucug

SEQ ID NO: 4128164 - RNA, 68 nt, Human
cagacccuguugguggaucagauugggcuugagaugaggugcccagcccuguccagcagagggugcug

SEQ ID NO: 4128165 - RNA, 55 nt, Human
cagaccucgugauccgcccgcuuuggccucccaaagugcugggauuacaggcaug

SEQ ID NO: 4128166 - RNA, 56 nt, Human
cagaccuggggccugggagcccgcccugggcaggugaguucuggggccucaggcug

SEQ ID NO: 4128167 - RNA, 66 nt, Human
cagacgagacacaggugguuccugucaggaacagcauuuccugguaugggaagccuguucucucug

SEQ ID NO: 4128168 - RNA, 64 nt, Human
cagacgucugggcucgcggugucacagaguggcccuuccuccggcucuggagcacagacgucug

SEQ ID NO: 4128169 - RNA, 75 nt, Human
cagacuagggagcugcuguugggggagaagcaugguuucugagagccacugaacagcaacacagcucucuuacug

SEQ ID NO: 4128170 - RNA, 113 nt, Human
cagacuaugaauuauuuugaacgauugauaauuuugguuccagguuggcccaguaauaauuuauuaauucaacuugacaacccaaauuacugguaucacuuauuuuauuuuug

SEQ ID NO: 4128171 - RNA, 62 nt, Human
cagacuccuccacagaccuacugaaugagaaucugcauuugaacaggacugcuggggguaug

SEQ ID NO: 4128172 - RNA, 71 nt, Human
cagacuccucucugucacaccaguggccccuagcauuuuaaagggggccauggggacagagggugaaucug

SEQ ID NO: 4128173 - RNA, 68 nt, Human
cagccuggcuccgugucacgugcccucugcuguucccuaggcacugggacgcugcacugaccagucug

SEQ ID NO: 4128174 - RNA, 72 nt, Human
cagccugggugggacugaagucugaggggucuguuucugacccuucccuccucucacccauucucucggcug

SEQ ID NO: 4128175 - RNA, 89 nt, Human
cagccugguaguccucuguggaccaggguauaaggaaugaaugugcuuccuucuaaagccuugcacagagugaugguuuuucgggacug

SEQ ID NO: 4128176 - RNA, 56 nt, Human
cagccugguccccggcucacccggccgcauccagcaccucguagccguggccgcug

SEQ ID NO: 4128177 - RNA, 67 nt, Human
cagccugugacucugugaaaccauguucagacuccauccucucaugucacuuguggucacuaggcug

SEQ ID NO: 4128178 - RNA, 58 nt, Human
cagccaauuaauuaggguaggagguggaagccccccauuucuuuggcuaaauugggug

SEQ ID NO: 4128179 - RNA, 64 nt, Human
cagccacagggaggcguuuucagggcccaucugggguuggaagacauugcuuuccuuuguccug

SEQ ID NO: 4128180 - RNA, 63 nt, Human
cagccacaugguggaagagcaucagaaagugcaagugcucaggaugcaauuccaucaaggcug

SEQ ID NO: 4128181 - RNA, 73 nt, Human
cagccaccugagauaagagagcucacaccggucagagguaugaugcgucuccucuuucagguauuuaggguug

SEQ ID NO: 4128182 - RNA, 102 nt, Human
cagccacugaacugggccuggggaggcaaaggcaagucugucuucauuacuagagaggcuguguaaagugcuuuccccuucccacccagcaucaugugguug

SEQ ID NO: 4128183 - RNA, 98 nt, Human
cagccagaaccagauaaaacuacuuugggccauuuguuuacugacauuaaaguggauuuauggagaccgaaagucuuucuauugucccuucugggcug

SEQ ID NO: 4128184 - RNA, 61 nt, Human
cagccaggaaugcaugcucugcuguaaauagagacagcagggggcugaguagucuugguug

SEQ ID NO: 4128185 - RNA, 64 nt, Human
cagccauaaaauuaauauguacuauguauauauauuuauauggguaaauaauaauuuuaggcug

SEQ ID NO: 4128186 - RNA, 85 nt, Human
cagccaucccugacucaucuccucaacucagagcuugagcccaucacccucagcucagagcucgggaggauggggcuggaggcug

SEQ ID NO: 4128187 - RNA, 82 nt, Human
cagccaugcuuuucucuacauuuuaauaagcugcuuacaaaauuggugauugaugaguaagaaugaggaggaugcagggcug

SEQ ID NO: 4128188 - RNA, 57 nt, Human
cagcccacagcccagcacuuguggagaaccauguuaguguguuuaggcugcggguug

SEQ ID NO: 4128189 - RNA, 59 nt, Human
cagcccaccuggcacguguguuauccccgauagccacggcccuucaagguggcuugcug

SEQ ID NO: 4128190 - RNA, 55 nt, Human
cagccccaguucccuggaagucugugaauagcaagaaauggggcaggcugggcug

SEQ ID NO: 4128191 - RNA, 107 nt, Human
cagccccuccuccuugcucggccugccuuugccugucgccugguccucucuggaagcugcucugccucuggaccagccgaggggguaggaugagcuggguggggcug

SEQ ID NO: 4128192 - RNA, 83 nt, Human
cagccccuuucacaggaccuucuucagaggccagccucugguggggaauagaggcacccuggaggagacugugccagcugcug

SEQ ID NO: 4128193 - RNA, 97 nt, Human
cagcccuagggucauccuuggugcucuguuacccagcaaccccagcagugacagcccugcuucuggaguaacagggugacugugguccuggggacug

SEQ ID NO: 4128194 - RNA, 85 nt, Human
cagcccucagauggucugugagcugugagaccuguugggaaucagagccagcaggggcucuaaagaucauggaagcugagagcug

SEQ ID NO: 4128195 - RNA, 58 nt, Human
cagcccucaucucagcuucuuuggcaaaccucuagcaggguugcugaaacagggacug

SEQ ID NO: 4128196 - RNA, 82 nt, Human
cagcccuccccauccuggcgccacacggcucuacuuccccuuccagauuggggcuguuucagugccaggcuugggaacgcug

SEQ ID NO: 4128197 - RNA, 77 nt, Human
cagcccucuaauuucacagcuggucuaugggaaagacacaugcauccuuggcccauaugauucuggaagugcugcug

SEQ ID NO: 4128198 - RNA, 60 nt, Human
cagcccugccauggagccuccugaagacuccacucuuugcaggucugaaugucagggcug

SEQ ID NO: 4128199 - RNA, 71 nt, Human
cagcccugcggcuccuggaccuccgcuggaucgaggauguuaaagacucccagcuccgggaguugcugcug

SEQ ID NO: 4128200 - RNA, 60 nt, Human
cagcccugcucuuagugucuccaacuccaggguggggugacaaaaaacgagggcaggcug

SEQ ID NO: 4128201 - RNA, 62 nt, Human
cagcccugguagccugcugccauugugcugugccagaugcugugcuggcuaaccaugggcug

SEQ ID NO: 4128202 - RNA, 55 nt, Human
cagcccuuaaauagauauacaguguaucugugguauuaagucuauauaaggggug

SEQ ID NO: 4128203 - RNA, 64 nt, Human
cagccgcagagccucccuugccauuugccucaagcccagggcagugccaggagggcucuggcug

SEQ ID NO: 4128204 - RNA, 101 nt, Human
cagccggggcucagggagaccucuggacacugcauccuuccagggcauagagagugagguagggauagguguccagagaccuuagagcugaggccuugcug

SEQ ID NO: 4128205 - RNA, 84 nt, Human
cagccgugcacccuggaaacgaagcuuaacuuuucugagcuacugccccagauaaagaaaguuucgggucgcggacgccggcug

SEQ ID NO: 4128206 - RNA, 58 nt, Human
cagccgugccccuaccaugcugggcuuguggacaggcaagagugggugucacaggcug

SEQ ID NO: 4128207 - RNA, 56 nt, Human
cagccuacugugccuaccgaggcuccacgugggucucagcaggcaccagaaggcug

SEQ ID NO: 4128208 - RNA, 92 nt, Human
cagccucaccacggcagugccugggacccggcuguguguaucccaccuggccaggcuccaaguacuguucagaugacuguggcaugaggcug

SEQ ID NO: 4128209 - RNA, 84 nt, Human
cagccucacccagugacccuugacagggccaagaauggaccuccggcucugggguccaguccugcucaccacuuggugcugcug

SEQ ID NO: 4128210 - RNA, 90 nt, Human
cagccucauuucccuaacaaucagcagggaggcucugugcccugcggguggguggggcuaucggggccuugucugcagaggagggggcug

SEQ ID NO: 4128211 - RNA, 129 nt, Human
cagccucccaaagugcugggauuucaggugugagccaccgcguccggccucauaaagaguucauuuuaaaaguccuuauuggccgggcgcgguggcucacgccuguaaucccagcacuuugggaggccg

SEQ ID NO: 4128212 - RNA, 59 nt, Human
cagccuccccucaaaagugagauuuuccuggaaugucacuagucgcggggggagguaug

SEQ ID NO: 4128213 - RNA, 65 nt, Human
cagccucccgaguagcugggauuacaggcaccugccacaaugcccagcugauucgguggugguug

SEQ ID NO: 4128214 - RNA, 62 nt, Human
cagccucccugggcgcucuugugccccacacggccggugccugagagcuggggaugaggcug

SEQ ID NO: 4128215 - RNA, 87 nt, Human
cagccucuccuuuccaaagaucccaaagagcacaccucugcaaaccagugucuccagggagcuuggaaagacccgggaggaagacug

SEQ ID NO: 4128216 - RNA, 57 nt, Human
cagccucugagccuuggcagaugcuauuacuccccauagcacaggcucagggagcug

SEQ ID NO: 4128217 - RNA, 72 nt, Human
cagccucuggaagguuggcucccaguuccaucuccugucuagaagaacugggugccugccugcugugggcug

SEQ ID NO: 4128218 - RNA, 56 nt, Human
cagccugcagcucaucccgcuuaccacugccuuuggagggagacagcucugggcug

SEQ ID NO: 4128219 - RNA, 80 nt, Human
cagccugcagugcacaggacacucggccuccuggucagcaaacuguuaggcagcccaagaugucagcggcaccacgguug

SEQ ID NO: 4128220 - RNA, 55 nt, Human
cagccugcuagggcaaugccuuugccuuccauagccccuuugucuuagcaagcug

SEQ ID NO: 4128221 - RNA, 55 nt, Human
cagccuggccauauucugcucaaaaaaagcaaagaggcagaaagagcccaggcug

SEQ ID NO: 4128222 - RNA, 67 nt, Human
cagccuguacaacccaugagucuacauuucaguaguuuucuacaucaaauacuacauggguuggcug

SEQ ID NO: 4128223 - RNA, 108 nt, Human
cagccuguucuauaugccagagggcacuggguuucaaugucaguauuuauguucuuuugauagcuuguuagaauuuaguugcucguggauuucuguagaacucugcug

SEQ ID NO: 4128224 - RNA, 81 nt, Human
cagccuuagcaaucugggugacccugggcaaggccuauccccucucugggccuuuguuucuccaccugugcaaugaggcug

SEQ ID NO: 4128225 - RNA, 68 nt, Human
cagccuucaaccuagcuagagcaguucauccugaacaaugcugggacccgcuggguuuugaaaagcug

SEQ ID NO: 4128226 - RNA, 58 nt, Human
cagccuucagccuuagagaauguggcugagaggcuauggaagauaaggcugaaaguug

SEQ ID NO: 4128227 - RNA, 85 nt, Human
cagccuuggugaccuugagcacguugaagcgcacugucuugcucagaggccggcacucgcccacugugacgaugucaccgaucug

SEQ ID NO: 4128228 - RNA, 123 nt, Human
cagccuuuuccccuccccucugaaaucugccugcccacagagagggugcauucugaguuucucucucucucagcuaugcucuaagcuuagugaggcagagucuacccuuguaggaaugagcug

SEQ ID NO: 4128229 - RNA, 93 nt, Human
cagcgacaaggauuccggcagugggcgccaggucuccgcuaggucaaagccggggugaucuaguccacgguugaacucuuacccuguuugcug

SEQ ID NO: 4128230 - RNA, 77 nt, Human
cagcgacuaguuagacaggaggcagcagcuucucaagaaauuccuucacagcugccaucuccugaggacaggagcug

SEQ ID NO: 4128231 - RNA, 117 nt, Human
cagcgagaaaauaaaauaaauggaaaaguggauuaugaucgugaaagauuggcuuauacagcauuugauaggaacaguuucaggauguuuuccccccuucaauuuguauuuuuccug

SEQ ID NO: 4128232 - RNA, 78 nt, Human
cagcgaucuaaaagagcauggaaaguucaggaaacaacaaauacuuuuucauaacuuuuacaugcuugggagguucug

SEQ ID NO: 4128233 - RNA, 84 nt, Human
cagcgcaguuugagggggcucagcucauuguggauccggucugcgucauguagaaucuucuggagcucccccuggcucguguug

SEQ ID NO: 4128234 - RNA, 67 nt, Human
cagcgcgggcacuggcucugggcagaucccagcgcggagcugacucccugggcccgugccagcggug

SEQ ID NO: 4128235 - RNA, 68 nt, Human
cagcgcuuucaucaucaacuggcagguaaguuaccacaacuuacacagaaugccaaugaaugagccug

SEQ ID NO: 4128236 - RNA, 71 nt, Human
cagcggcauauuuccaaauucuucucagcauuuuuaaacaguaacugggagugaagcaaauaaugcuggug

SEQ ID NO: 4128237 - RNA, 79 nt, Human
caguggucuguucucauuguuuucauccagaaagacacugauaauaagauuuccugagugccaugagagcaccccucug

SEQ ID NO: 4128238 - RNA, 64 nt, Human
caguguaaaauuuaagaagugugugcgugucuacugacagcaagacaguuuccuaagugcucug

SEQ ID NO: 4128239 - RNA, 76 nt, Human
caguguagaaaucggagcuuggaagcuuccucuuaaccgggagaaagccauagcccagcuuuacgauuucccauug

SEQ ID NO: 4128240 - RNA, 71 nt, Human
caguguagcaagaggaauuucuggaaggaggccaaauuuggcuucggaucauuucucuucaacacacacug

SEQ ID NO: 4128241 - RNA, 68 nt, Human
caguguauacacauguguaugugcaugcaaauauggauguguagccgcauguguacucuuauaggcug

SEQ ID NO: 4128242 - RNA, 127 nt, Human
caguguauggggaagacuuuuguguccucacuucuugacuucugggugcccucugggggaacacagcccggggaaggggugcccagagaggcaaggccuaggcccagaugauuuccccuccuagcug

SEQ ID NO: 4128243 - RNA, 72 nt, Human
caguguauuaguuguccagcaguuggauuugaucaccgaaaaugcuaaaauugugagauuacuaucacacug

SEQ ID NO: 4128244 - RNA, 103 nt, Human
caguguccuggggagccgcuggugcuggcaacagaguagggagccccuucagccccauggugugcucagcacugcaugaacacuuuccccaggggacucacug

SEQ ID NO: 4128245 - RNA, 55 nt, Human
cagugucucaguuucacuugaagauuugcccagcauuuagaaacuguugacacug

SEQ ID NO: 4128246 - RNA, 103 nt, Human
cagugucuccccuaaagugagcuccauacacauuuauuuggccucuuugugauuacaucgggauaaaugaguguuaugcagguuccaguauaguuuuccacug

SEQ ID NO: 4128247 - RNA, 64 nt, Human
cagugucuccggcuuuuccaugcugaucugaugccuauuuuagauccaugugggcuggaaacug

SEQ ID NO: 4128248 - RNA, 65 nt, Human
cagugucugccuuucuguuuggcuucaguccuuaaagcugucaacagaccagagaggcggagcug

SEQ ID NO: 4128249 - RNA, 58 nt, Human
cagugugcuacacuuuaugugucggugaccaggagucacagaugggaugagcacacug

SEQ ID NO: 4128250 - RNA, 60 nt, Human
caguguguuacaagguucccaauucuuauuuauaagacauggaaucaggguaauguacug

SEQ ID NO: 4128251 - RNA, 66 nt, Human
caguguuaaaggaucuuugucauuaauauauuugugugaauuaaugauucagcucuuuucuagcug

SEQ ID NO: 4128252 - RNA, 58 nt, Human
cagcucugugggagcguauguguguauauguguguguguuugcucuccaugguuguug

SEQ ID NO: 4128253 - RNA, 69 nt, Human
cagcucuuagagggagacagaccuagacucuucuugaacuggaaauuagugugucugucagagaagcug

SEQ ID NO: 4128254 - RNA, 56 nt, Human
cagcugaaacuauguucucauaaaacuuauuugucucuguggccaugguucagcug

SEQ ID NO: 4128255 - RNA, 84 nt, Human
cagcugaaccugacucgccaccaaucaaugcagcaaaauggugaacauuuguccauuuuauuggauggugggcaaggaagacug

SEQ ID NO: 4128256 - RNA, 64 nt, Human
cagcugaacgacauccucucauuuauucauggggcgugagaggagugauuguaaaauucagaug

SEQ ID NO: 4128257 - RNA, 105 nt, Human
cagcugacagccagucgcucccucauauacccagcgagagcucccacucagcuuucagugggcauaggagggaacccagccaagaccagaagaacugcccagcug

SEQ ID NO: 4128258 - RNA, 61 nt, Human
cagcugagcaggcauuuuccccaaagccucucuugaccgggcuccagucucugcucaguug

SEQ ID NO: 4128259 - RNA, 56 nt, Human
cagcugccccgcuggcugaccacaaacuuaugagcaagcccagcugaggucagcug

SEQ ID NO: 4128260 - RNA, 71 nt, Human
cagcugccccugcugacugcccuucucuccucccucucaucccagagaaacaggucagcugggagcuucug

SEQ ID NO: 4128261 - RNA, 103 nt, Human
cagcugccucaacccaguccuguacuuucuuucaaggggggcaaaaauagagucaggcuccuccagaaacugaggcagaacaaguugggugagcauccagcug

SEQ ID NO: 4128262 - RNA, 89 nt, Human
cagcugccugguggacagcagccagcagccuggcagcguggggcuggugagcugcugcugcuaucuacccaggcaacuccauuuugcug

SEQ ID NO: 4128263 - RNA, 104 nt, Human
cagcugcucaucauaggcuucauggacaaaagccucacuacuuauuagaguaucuucuucugggucuuuuuauuuauggcaggucuaauuucuugaugcugcug

SEQ ID NO: 4128264 - RNA, 63 nt, Human
cagcugcuggcauggagacucugggucccgaagcuccugggcccugccuccaucccagcucug

SEQ ID NO: 4128265 - RNA, 59 nt, Human
cagcugcuguucaguuuuguuuccuucuuuucauuggccuccaaaacugacggcaucug

SEQ ID NO: 4128266 - RNA, 112 nt, Human
cagcuggagccgcugggcaacagcccaaugggccuggagagagcuggcuucccaccgggccugggaucggaccugcagggcugugcugggccuguggcgucagcggcugcug

SEQ ID NO: 4128267 - RNA, 76 nt, Human
cagcuggaggccuuuguggagcucauggcagggucagcuuuaaucaucagccaggcugcuccagggaggccagcug

SEQ ID NO: 4128268 - RNA, 55 nt, Human
cagcuggcaaguggagcagggugggggcucaaccuccucaccgcuugaucagcug

SEQ ID NO: 4128269 - RNA, 57 nt, Human
cagcuggccugaucccuguggcgccaggcggguccugcagggcgggcagggcagcug

SEQ ID NO: 4128270 - RNA, 79 nt, Human
cagcugucaacaccucugggccucugguccauucucccuguuaagaaagagaaaauggcaagagccacagaggcggcug

SEQ ID NO: 4128271 - RNA, 84 nt, Human
cagcuguccagagaagaaaucugagcugugaguugcuuaggaugaggguuuguucagucuauccagcucagauccuugcagcug

SEQ ID NO: 4128272 - RNA, 82 nt, Human
cagcugugucucuccaggauacugcucucugcugcuggaaauucccuugcacaaaaguaugucaucuuuuagaaagcagcug

SEQ ID NO: 4128273 - RNA, 60 nt, Human
cagcuguuacugaaguaaaaugccacuguuugggugaagaaguguugcugggugacacug

SEQ ID NO: 4128274 - RNA, 58 nt, Human
cagcuguuccuggaaggagacccaguugaaagggguuguuauggaccaggaacagcug

SEQ ID NO: 4128275 - RNA, 64 nt, Human
cagcuguugaucucuuaagccuugccuuaagaugcuagaaagcuucagagcaucacuucagcug

SEQ ID NO: 4128276 - RNA, 59 nt, Human
cagcuguuucaguagcguuacuggguugaaagcccaaugacagugagcugagggaguug

SEQ ID NO: 4128277 - RNA, 93 nt, Human
cagcuuacaagggcagagaguugcugguuugaaccacagaccccugguuuaacaucuguaaucuagucaaccccuccucuuucuugaaggcug

SEQ ID NO: 4128278 - RNA, 80 nt, Human
cagcuuccguguugcugagcacagacuugggggaaacgaagaucccagagccaaugauggugcccacgaugauggagaug

SEQ ID NO: 4128279 - RNA, 61 nt, Human
cagcuuccugccuugauccagagcuugcacccguggcagggcucccuugcaaggagggcug

SEQ ID NO: 4128280 - RNA, 61 nt, Human
cagcuucuccagaugacccucagggcagaggugaccuggcagugucuugcuggggcagcug

SEQ ID NO: 4128281 - RNA, 60 nt, Human
cagcuucuuccugaacucuugcaacaucacugcugauucugcacuuugggggacaggcug

SEQ ID NO: 4128282 - RNA, 58 nt, Human
cagcuugcuucacagcucagcuuauagguguccgagcugagauuugaagcaaguucug

SEQ ID NO: 4128283 - RNA, 116 nt, Human
cagcuuggacuauagaauaugacagaaaugaucauguaauuucagaagcugggucauaaaagaagaugugacuucuguccuguuggaugaaucauucauguuugcagcccgagcug

SEQ ID NO: 4128284 - RNA, 61 nt, Human
cagcuugggcuggaaaguuucucagcauauaaacuguuuguaaagcuacagcccaggucug

SEQ ID NO: 4128285 - RNA, 73 nt, Human
cagcuuguaaguggugggguuaagguuagaacuagaggcuagucugaagauucuuuccacuauucuucagcug

SEQ ID NO: 4128286 - RNA, 57 nt, Human
cagcuugugcaaagguccugggguaggaauguguccaaggaacagcaaugcaggcug

SEQ ID NO: 4128287 - RNA, 65 nt, Human
cagcuuguuuuauuuggggaccagcaagugggugauauuuugagaacuucaggugauacaagcug

SEQ ID NO: 4128288 - RNA, 63 nt, Human
cagcuuucugucucaugacugacacccuuccuugguuccugucaucuguagccagguaugcug

SEQ ID NO: 4128289 - RNA, 63 nt, Human
caggaaaaagugaccuugguagcuagucuccaaagauggccaccaccaauacuugccuuccug

SEQ ID NO: 4128290 - RNA, 70 nt, Human
caggaaaacaauaaacguuuaaguaucguccaugcauuacuugggacauacugaaacuguuguuuaucug

SEQ ID NO: 4128291 - RNA, 58 nt, Human
caggaaacaaagccuugcucauuaugugcuagaacaauggguaaacuuugcuuucuug

SEQ ID NO: 4128292 - RNA, 69 nt, Human
caggaaacgggaaggcagaauauuguauggggauaccuaggcacugauucuguuuuccauguguagaug

SEQ ID NO: 4128293 - RNA, 112 nt, Human
caggaaagaaaggucuguuggguccagagcaugcagaucaucaagauauagaccaugugcuguggccuuggugaucugguguacucuguucccaauaggccugugccuccug

SEQ ID NO: 4128294 - RNA, 56 nt, Human
caggaaagguagucacaauguagcaauaaucguaacaauguuggauugcauuccug

SEQ ID NO: 4128295 - RNA, 57 nt, Human
caggaaauucaagagaggcugccuucuuaaaucagauagccauuccaagauuuccug

SEQ ID NO: 4128296 - RNA, 101 nt, Human
caggaaauuuccaucuuuaacuauacucuguaaaugugcuguccaauacacagauagcuacugagcacuggaauauagcuagucugaauggagauguucug

SEQ ID NO: 4128297 - RNA, 125 nt, Human
caggaacaacuggaagcuuguuaaaacugcaaauuucugggcccuaaaccagcucuauuaaaucaaucucuguggagguggggcucaggaaucuguauuuuaauaagcuucaucaguuguuucug

SEQ ID NO: 4128298 - RNA, 57 nt, Human
caggaacagaguggcauugucuggccagcuggguuccuggagaaugccucuguacug

SEQ ID NO: 4128299 - RNA, 99 nt, Human
caggaacaggccauuuucacuucuuuugugauucuucaguuacuucaggccaucuggauguauacgugcaggucacaggggauaugauggcuuagcuug

SEQ ID NO: 4128300 - RNA, 88 nt, Human
caggaacaguuuucuaugguagaagcaugaguucauuugcaauuuugugccauguuuuccauugccauggaaacucacaauuuuccug

SEQ ID NO: 4128301 - RNA, 68 nt, Human
cagacuccuucagaaacuucuggugucaaauaacucuuauuuucagcaaguuuuucuuaaggugucug

SEQ ID NO: 4128302 - RNA, 70 nt, Human
cagacucucaugcucuucucuuaugacuauggaaggcacucaugucugaguagagugugauuuucuucug

SEQ ID NO: 4128303 - RNA, 81 nt, Human
cagacucuuauuuagugauagaagcaaggacugaauuaaugguuauagcuccuugguucauuauaaaugaaauggaguaug

SEQ ID NO: 4128304 - RNA, 62 nt, Human
cagacucuuucccugugacagagucuugaugaaauucugcgggcuucucuagggaaggucug

SEQ ID NO: 4128305 - RNA, 81 nt, Human
cagacugagcugggacauggggagagccucuguccccagguuguuuucugcugggcaacuccccuccagaguucaguucug

SEQ ID NO: 4128306 - RNA, 58 nt, Human
cagacugcaccaucuggagcaccuccccucagggcagcaguuacaaaugugcagacug

SEQ ID NO: 4128307 - RNA, 75 nt, Human
cagacuuaugaagucagacauaauucuaacauuguuauauaaucagauuuaucugucuggcaguggcagaguuug

SEQ ID NO: 4128308 - RNA, 58 nt, Human
cagacuucaacucuaaacaacgggcuauucuggcaucgauguuggaggcuggggucug

SEQ ID NO: 4128309 - RNA, 71 nt, Human
cagagaacgaauagauguauuaggaauacauuauccuugcauuccugagacuuaucuguuucccccaucug

SEQ ID NO: 4128310 - RNA, 68 nt, Human
cagagaacggggaggaaggaggcucacuacccaaggaggugagcugauggcaucccuguuucuuccug

SEQ ID NO: 4128311 - RNA, 90 nt, Human
cagagaagaaaugcauuaugcugcgguuuuauauuucagucggaagauggcuggagaacuaguuaaacacgugccuaggaauguucucug

SEQ ID NO: 4128312 - RNA, 69 nt, Human
cagagaaggaggcaagaggaggguccuggaaaacugugaccuggggcuucuuucugccaccgaccuuug

SEQ ID NO: 4128313 - RNA, 106 nt, Human
cagagaaggaugcagucaguucaagcuguuuuugacugauguuucagauuguggucuaguaaacaggucugaaaauagcuacuuuuuuaaagacuguaaauuccug

SEQ ID NO: 4128314 - RNA, 60 nt, Human
cagagacauuaagugccaugauuaaaucuucauaguugaucuuugcacuagauguuucug

SEQ ID NO: 4128315 - RNA, 73 nt, Human
cagagacccaccuugccuuacagugucuugauaguggagccacaccaagcuacucaggcaagaugugucacug

SEQ ID NO: 4128316 - RNA, 74 nt, Human
cagagacuacgucuguuuuugaggcuaucuucucucuccuugggcaggaagaaaguagaaaaccgugguuucug

SEQ ID NO: 4128317 - RNA, 95 nt, Human
cagagacuugggacaggagaugacuuggccaaaggauuguugcuacaauaggcuuuguguuuuguuauccuuuguaacuaccccaacacuuucug

SEQ ID NO: 4128318 - RNA, 57 nt, Human
cagagagauagguugguguccuaaguucuagggcagaugcugagauuuauuucugug

SEQ ID NO: 4128319 - RNA, 73 nt, Human
cagagagauguauucugagaggcagagcuugugagugaauacuuauaugcauuucuaagaaaacauacgacug

SEQ ID NO: 4128320 - RNA, 59 nt, Human
cagagagcaggaggcagcgggacguggcagggccucuguccccucccucuugccuccag

SEQ ID NO: 4128321 - RNA, 57 nt, Human
cagagagcucaggaaaaugggagaaggacacacccccaggagccugaguccucucug

SEQ ID NO: 4128322 - RNA, 77 nt, Human
cagagaguuccacccauguguccaaggccacaauagcuaauccaugauggagcuggaauuggacccagggcucucug

SEQ ID NO: 4128323 - RNA, 77 nt, Human
cagagaguuccacccguguguccaaggccacaauagcuaauccaugauggagcuggaauuggacccagggcucucug

SEQ ID NO: 4128324 - RNA, 85 nt, Human
cagagaugaaaagcccuggccagacaccaguucauuaguggaaauaaaagcuuccuaaauugcagggaacuggcugggcuuucug

SEQ ID NO: 4128325 - RNA, 72 nt, Human
cagagaugaggcagaguggagagaaacaacucuggcugagccagagucuccagccacuacuucuuauuccug

SEQ ID NO: 4128326 - RNA, 79 nt, Human
cagagaugauuucagaagcaagaggagguggccaggagcaccagccaaaccaccagcuuccuuugggagcucaucucug

SEQ ID NO: 4128327 - RNA, 67 nt, Human
caggagaaagaugguuaguuuucuuguuaacauucauuaaucuugaaaucuagucauuuuuagucug

SEQ ID NO: 4128328 - RNA, 57 nt, Human
caggagagaagauuuggagcaagccaggguccccuggugauccagccuccucugcug

SEQ ID NO: 4128329 - RNA, 109 nt, Human
caggagagauagagaacggacggaggcagagacuccaccuucaggccaaagagccucuggugggggucaucuugcccuuuuccauauuccaacuuuuaucugcuuucug

SEQ ID NO: 4128330 - RNA, 79 nt, Human
caggagagggagauauaguaagagguugucgggaacaaacaaagacaucccugacaauagcgauuuaucuugcuaccug

SEQ ID NO: 4128331 - RNA, 70 nt, Human
caggagauugugccagugccuuggguauuaggagucugguuccaaucgcacuggcucauuuagaguccug

SEQ ID NO: 4128332 - RNA, 82 nt, Human
caggagccaggguguccugggagccauuuuagaggcugccuauugcagugugucucuuggcuuccucaucuacagggcccug

SEQ ID NO: 4128333 - RNA, 57 nt, Human
caggagcccagggacagggcggaugucgaugcuuugacaagcccugcucuggucgug

SEQ ID NO: 4128334 - RNA, 60 nt, Human
caggagccgccaggcacguuggcagggccgaacucacccuucccggcggcggcggccuug

SEQ ID NO: 4128335 - RNA, 79 nt, Human
caggagcucagaggauucuggggaggacauugggaaggacccuguggaggacucuugggagugcucuggagaagacuug

SEQ ID NO: 4128336 - RNA, 63 nt, Human
caggagcugagaagcagcgcuugauuuccugggggaaaucaagaaaagugcuuucggcuccug

SEQ ID NO: 4128337 - RNA, 61 nt, Human
caggaggagacauacuauaggaauauaguuauuaaauuacccuucagacuugucuucccug

SEQ ID NO: 4128338 - RNA, 60 nt, Human
caggaggagagagaugcuaugggauuaucuccuccaccccaacacauuccuuuucuucug

SEQ ID NO: 4128339 - RNA, 57 nt, Human
caggaggcccggccacagcccaggugcugcuccugaggaagcggcugacgucuccug

SEQ ID NO: 4128340 - RNA, 127 nt, Human
caggaggcugagcccgaggacaggucagugaguucccuuacuuucugguuuccagcuggccucagccuauggcagcccagcagagucuaggaaggagggaacgauggguccagggcuuuguucccug

SEQ ID NO: 4128341 - RNA, 56 nt, Human
caggagggaggccugugggacuuucugcuguggcuguuuacaaggcuuugcuccug

SEQ ID NO: 4128342 - RNA, 61 nt, Human
caggagucuguuccucauuuguauucuaaaccaggucaugguggggagucaggcauucuug

SEQ ID NO: 4128343 - RNA, 61 nt, Human
caggagucuugaaggacaggcagaguuagggcgcuaacucugaggaauguacaggacccug

SEQ ID NO: 4128344 - RNA, 100 nt, Human
caggaguugcagcuuuuuaugcucaugagguagccuguucugguaacgggcacugcuuccugagccugaguuccauuuuugcuugcacaacuuagucuug

SEQ ID NO: 4128345 - RNA, 62 nt, Human
caggauaugaugguuguccuaggugcaucccuguggaccagcuaggguagcacaucucccug

SEQ ID NO: 4128346 - RNA, 116 nt, Human
caggaugcauuugaguucccagggcaucuuguuaaagugcagauuuugauucaguaggucagggauaggccugagaaucugcauuucuaacaagcucccauauacugcugcuccug

SEQ ID NO: 4128347 - RNA, 79 nt, Human
caggaugcucaacaaacacugaagaccuaucugguaccagcuuuggugaccaagaaagaaaaucagugagguacuccug

SEQ ID NO: 4128348 - RNA, 65 nt, Human
caggaugggugucggccagcaccucaaacaccuccuaauuugcauuaccacugacacccuucuug

SEQ ID NO: 4128349 - RNA, 85 nt, Human
caggaugugcagggcccaagggugcccagcagaggagcaaggccucuucucuucucacuuugcccuguaccuuggguugcaccug

SEQ ID NO: 4128350 - RNA, 65 nt, Human
caggauguucuguuuuugcuuauuuugcuuugaugagggaaaaggcagugcaagagaggguccug

SEQ ID NO: 4128351 - RNA, 79 nt, Human
caggauuacuccagcugcuggucugagacugacaggaaggaagcaaagucagcugagagggagugggguauuggaccug

SEQ ID NO: 4128352 - RNA, 92 nt, Human
caggcaacaagguuuuuagaaagcaaacggaguggcuggacuuuguaauaaauuaagagucugguugauuccuuugcacuacucccggcuug

SEQ ID NO: 4128353 - RNA, 57 nt, Human
caggcaaggagcuggcucaaguaggacagggccuacugggccagcuacuuagcacug

SEQ ID NO: 4128354 - RNA, 72 nt, Human
caggcaagggacguggccuuggaguuggacagauguggcucugaauucugcuccaccacuuccagcagcgug

SEQ ID NO: 4128355 - RNA, 85 nt, Human
caggcaagucugcuggcaagaaauauauaucuuagguuuguuucauuugaggaugucuguauuuugccuucguucuuuaagugug

SEQ ID NO: 4128356 - RNA, 69 nt, Human
caggcaaguggcuaggccagugaccuccugugaagagcauaaaaaugaagucucuggcuugucugccug

SEQ ID NO: 4128357 - RNA, 78 nt, Human
caggcacagugaugagccggcugaggcugugggaucguuuauuggggcucuguccagccaggcugcagcacccgccug

SEQ ID NO: 4128358 - RNA, 81 nt, Human
caggcacccaccaccaugccuggcuaauuuuuuguagagaugggguuuugaaauguuggccaggcuggucuugaacuccug

SEQ ID NO: 4128359 - RNA, 76 nt, Human
caggcacugugcugagcucugcaccuuuaagaggcagcaagucgugacugguucagagcuggcucagagcugccug

SEQ ID NO: 4128360 - RNA, 70 nt, Human
caggcagaaaguauucuguguaauguuuuguuagauacacauugauagggaacaaauacugcucugccug

SEQ ID NO: 4128361 - RNA, 69 nt, Human
caggcagaaugagauuacuucaagguuucucuuaauuguuuucuuccuuuaaguaaagagcacugccug

SEQ ID NO: 4128362 - RNA, 88 nt, Human
caggcagcagggagcaaagcaggagagccugggugagcgcacgaagggugagucucccaucccggggucuccuccgccucugugccug

SEQ ID NO: 4128363 - RNA, 60 nt, Human
caggcagcccugcaccaagugugggauugcccagcaccacugguuuugcagaggcgcccg

SEQ ID NO: 4128364 - RNA, 87 nt, Human
caggcagccuuaucugucauccuagaacuccaggacagucccacauuguguugggaguggccacgacugggagauggaucugcucug

SEQ ID NO: 4128365 - RNA, 69 nt, Human
caggcagcugggucaccgucccgugggucuuguugucacgcugcgaucuuaaagugaccacgcugcuug

SEQ ID NO: 4128366 - RNA, 65 nt, Human
caguuuuggcucuggugcgggcuccugcgcuuucagccgcaccugcuccaucagggccaugauug

SEQ ID NO: 4128367 - RNA, 69 nt, Human
caguuuuucaagacaaccugcaugugauaaagucuggcauggggacuacaggagguugcuuggcagcug

SEQ ID NO: 4128368 - RNA, 59 nt, Human
cauaaaaguaggaccaacuuacauuaccaccaauaguguaugugagccuuauuuuuaug

SEQ ID NO: 4128369 - RNA, 60 nt, Human
cauaaauagcuuuuugcuuuccaauuucuaaaagaugcuugaaggcagaaguuggauaug

SEQ ID NO: 4128370 - RNA, 61 nt, Human
cauaacuugguguuggaaacugaccuaagccaauuugcuuauacacagcauccaaguuaug

SEQ ID NO: 4128371 - RNA, 80 nt, Human
cauaagaaccaguaacagugaucaccugugggaauuagaugggagauucucacaaaugaccaugguuacuaguuucaaug

SEQ ID NO: 4128372 - RNA, 76 nt, Human
cauaagacccauuuuccugauaggcgcccugcccguagaagaagagcugcagcuuuggcccagucgggaggguaug

SEQ ID NO: 4128373 - RNA, 78 nt, Human
cauaagauauaaugcuguacaucacaauuugcuguaaaacauuuuauaguauuuguaugagcagguaauuguuuuaug

SEQ ID NO: 4128374 - RNA, 74 nt, Human
cauaaggaacuugguaaauugugucagauaccaugaaaaugcaucuuuucauaguuaaccacagauuguuuaug

SEQ ID NO: 4128375 - RNA, 72 nt, Human
cauaaguuucagcuguugucaucaucacuauuauuguugcuauugugaaagaggacagcuuagggcuuccug

SEQ ID NO: 4128376 - RNA, 73 nt, Human
cauaaucucucugagcaaagcagccugcucauccuggacaagauuuggggugaaggguugcuuugagauuaug

SEQ ID NO: 4128377 - RNA, 72 nt, Human
cauaaucuuaggcaccauuugccaagugacuccucuguguuacugaugguggagcugguauuugagccuaug

SEQ ID NO: 4128378 - RNA, 60 nt, Human
cauacaaauguguccaggcucucaacugaggccucgaagaauaggagacaucuuuguaug

SEQ ID NO: 4128379 - RNA, 83 nt, Human
cauacaacaaagugaguuaaaguaccuuuguauguguuaacuacacauaccucuggguagcuuucaacuucuuuaguugcuug

SEQ ID NO: 4128380 - RNA, 113 nt, Human
cauacauaaauuaugauauauccaugcaguagacaaguucucagaaauaaaaaugaaugaaccauugauacaugcaacaauguggaugaaucucaacauaauuauguucaaug

SEQ ID NO: 4128381 - RNA, 97 nt, Human
cauacauaacaacagguaguucucagcuguucccuuggugccagacauacauuuuaucuaaagagacagcagacagaacuaccugcugcuuccugug

SEQ ID NO: 4128382 - RNA, 79 nt, Human
cauacauacauaugcauguguguauauauagcacauguuuccaugauggccucucuguacacacacguguguaucuaug

SEQ ID NO: 4128383 - RNA, 130 nt, Human
cauacaucagaauccccugggagcuuauuuaaaaugcagauuucugggcuucaccaccucugaccaggagguccaagguagggcccagacauggacguuucugucaagaucccagggaaugcugaugcug

SEQ ID NO: 4128384 - RNA, 69 nt, Human
cauacaugcaugauacaaaguugcccuacggagauagaagggggcugauuuugucacauagcaaggaug

SEQ ID NO: 4128385 - RNA, 61 nt, Human
cauacauugaauuugcacguguaaaaggauuuucuaucacagcacugaaauucaauguuug

SEQ ID NO: 4128386 - RNA, 57 nt, Human
cauacauuuauacacaucuauguauauaaauguacguguguguggaguauguguaug

SEQ ID NO: 4128387 - RNA, 129 nt, Human
cauaccaaucccagggugggucuaguaggcaggacagagauaagcuuugacucagugaaccgagagcugggagaggaggcagaaguuuaccucugccuugcuuaccagacccacccugggauugguaug

SEQ ID NO: 4128388 - RNA, 57 nt, Human
cauacucucuagaagagauagaucugcgggaaagagggauucuguccagggagugug

SEQ ID NO: 4128389 - RNA, 81 nt, Human
cauagaaauauagauuuacucaagagaaagggaacugaacccaauccugccuucucccaaugguaagucaugugaccugug

SEQ ID NO: 4128390 - RNA, 112 nt, Human
cauagaaucuauuuaagucaccuuagagagucuucuuuaggccauuuauagaaaacaugaaugaagcccaggggagagucucugcagugaaaaaugcugaagugggcucuug

SEQ ID NO: 4128391 - RNA, 66 nt, Human
cauagaauuguuucaaaugucuagauacuguagccucacaguacucuuauuugaaauaugcagaug

SEQ ID NO: 4128392 - RNA, 69 nt, Human
cauagauucuuauuuccaucuuaguucuaucaaaucaaauuaucugagaauggguccugagaaacuaug

SEQ ID NO: 4128393 - RNA, 56 nt, Human
cauagcaaggugcuuuccacaucucucaucugagaaguggaaaaaccuugcauaug

SEQ ID NO: 4128394 - RNA, 105 nt, Human
cauagcaggagucaguuuggaggguaauucaggcucaagaccgagacaugaaaaaguggcucaguuugggggauugaagagaugcacuuuuuuguaaacugcuug

SEQ ID NO: 4128395 - RNA, 79 nt, Human
cauagcauuccacuauguagacauggcguaauuuguccaaccauaccgcaaugauugcuauuuacauaaaaaugcugug

SEQ ID NO: 4128396 - RNA, 58 nt, Human
cauagccagccauugcucccaauuguuauucacaacaauggagagccucuggacugug

SEQ ID NO: 4128397 - RNA, 56 nt, Human
cauagcccggggggcggcugcugggggaacagcagcaggauuuucguugggaugug

SEQ ID NO: 4128398 - RNA, 83 nt, Human
cauagcuagaagguagaaggaccagaauuuaucuuugauguuauaauuuaagcaauagauggaaggucauguuuucuacugug

SEQ ID NO: 4128399 - RNA, 84 nt, Human
cauagcuccaagacaaguuacacuuuacaauuuuuuugacggccugaaauaguagaaaucuuugaaguguaauguguaguugug

SEQ ID NO: 4128400 - RNA, 60 nt, Human
cauaggaagccaucucagucaccuacuuguaaaggcaacuaugguccuugcuucccuaug

SEQ ID NO: 4128401 - RNA, 57 nt, Human
agaccugcuuuuccaaagaccauuacagggaacuccuguccuuaaaaaagcaguucu

SEQ ID NO: 4128402 - RNA, 68 nt, Human
agaccuggaagaacugaggccuuguggcuuguacauaaggggauacucuugguucuugcccaagguuu

SEQ ID NO: 4128403 - RNA, 67 nt, Human
agaccuggccugcacagcccuuacugcagacacucacaaacuggucaggacuccuguaggccaggcu

SEQ ID NO: 4128404 - RNA, 113 nt, Human
agaccugggcaagucauuuagccucuugguaacuguuuccugagcuguaaaaugaggaugccaugccgcaagguuguuguaugacuuaaaugaggaaguaauuguaaaggucu

SEQ ID NO: 4128405 - RNA, 129 nt, Human
agacgaggacuuaacacuauagaguuggggucaaaagccagguuuuugucaucuauuucuggugauauuucuaucaucagaaaccuugaggaaacugcuuaauuuuucuaaguauuagugccuugaucu

SEQ ID NO: 4128406 - RNA, 91 nt, Human
agacgauuaggaaggggccacucccaucuuguuucuugugcucugagugguggucacagagaacugugggagugugcacuucaugucuucu

SEQ ID NO: 4128407 - RNA, 70 nt, Human
agacgcugacaucugaagacgcuuucuaauauuccaugaauaugugaaauucaaaaugucaguauagucu

SEQ ID NO: 4128408 - RNA, 63 nt, Human
agacgggcacgcucacgcagaacaucuugaccuucaacaagugcugcaucagcggccgcgucu

SEQ ID NO: 4128409 - RNA, 67 nt, Human
agacuaaagaagcuagcaaucuauauugccccaaccaagguauuauguuaagagacuucuuugcucu

SEQ ID NO: 4128410 - RNA, 72 nt, Human
agacuacauccagggagauacuggcugccaagcuuucuucagccuccuaauuuccugugaauuacacagucu

SEQ ID NO: 4128411 - RNA, 65 nt, Human
agacuaccucacucaucugguaagugucagcgaugauuuguuacacaggugugugguuagaguuu

SEQ ID NO: 4128412 - RNA, 64 nt, Human
agacuaggggugauguggcccacaggcagacaguucccacccugggccacucuucccugggucu

SEQ ID NO: 4128413 - RNA, 130 nt, Human
agacucacaggugggguuaagcggagugacgggaagguuaauucuggaugcacagggaaucugaagauggaauugugaaacauucauggauuugccccaguauuccagccacccaugccugugugggucu

SEQ ID NO: 4128414 - RNA, 125 nt, Human
agacucagcugaggaacauuugaaaauauuagugcucuggguccacuccagaccaauucuaucagaaucucugggguggggcccaggcaucaauguauuuuuuuuuuaauuccccaggugagucu

SEQ ID NO: 4128415 - RNA, 59 nt, Human
agacucaguuuucauuucaugagcagguauacaaucuguuuuaauggagacugauguuu

SEQ ID NO: 4128416 - RNA, 118 nt, Human
agacucauaaacugguuugaacuagcuccagcucaccacugcuagagucuauuauaauacuuugcuuuuaguagacacggaauggugguaaggaugcuaauaaaaagaacaugauucu

SEQ ID NO: 4128417 - RNA, 56 nt, Human
agacucugguccucuugaauuuuauuuucuagaaaaaucaccaggcuccugagucu

SEQ ID NO: 4128418 - RNA, 55 nt, Human
agacugaaggucucagcaugugaaagguaccaccccucacaaggccucuuagucu

SEQ ID NO: 4128419 - RNA, 66 nt, Human
agacuguaauuuguggccuccuuaucagaugccaugcaaaauguuuucugugggucacaacaguuu

SEQ ID NO: 4128420 - RNA, 69 nt, Human
agacuguguuggcuuuucucuuguacuuuuacaggaaaaugggaaucuacaaaagaaggcuuacagacu

SEQ ID NO: 4128421 - RNA, 75 nt, Human
agacuuagacaugcguaggaauaaagaaucucaacuucuacagaagcacugagagauucuccuguugucaagucu

SEQ ID NO: 4128422 - RNA, 75 nt, Human
agacuuagauuucagagaggcuucaaaucuugcuaaccguagaggagaucauggcuucugcugauaaauaugucu

SEQ ID NO: 4128423 - RNA, 105 nt, Human
agacuugucgcauggaaguacucaugguccagagcccccuuuccagcuuugaggcugggcucuggaaaugggagcuccuauuaucuccccauugcaguuaagucu

SEQ ID NO: 4128424 - RNA, 57 nt, Human
agacuuguuccacugccaaagaagucacucucugauuucaacaaagggaauaaguuu

SEQ ID NO: 4128425 - RNA, 102 nt, Human
agacuuuuaaaagguaugagcaugauagguauuuaauuaaauaaaaagauguaggcaucauuuaaaaugaguaccucucguuguuuauuauuuauaaaaucu

SEQ ID NO: 4128426 - RNA, 122 nt, Human
agagaaaacuaggugccaauaggcucaugcaguuacugucuuauauggcuagagcuuuuguucuuugaacuaagcucuuuucauaagagcaaacguauguaaagcagguauuuguuuucuuu

SEQ ID NO: 4128427 - RNA, 89 nt, Human
agagaaauuauaccuaagccacuagucuguuaugaaggugcuaccuuauucauauuugacaugacuuauggcugauuuaagauuucucu

SEQ ID NO: 4128428 - RNA, 129 nt, Human
agagaaauuccucuguccucugacuucuucacuuaguacgcugcgaccuucccauguuguucaacauccucaacucggagcgucacuggcuggagguggucuauaaauggaauuggcuuaacuaucucu

SEQ ID NO: 4128429 - RNA, 74 nt, Human
agagaagaauguacaauuucugagagaacuaccuuggagacuaaaccacucagaacauugacauucuuauuucu

SEQ ID NO: 4128430 - RNA, 62 nt, Human
agagaagcagggagucaucugugaugcucuucuaauuucccagaacaacaccccuauucucu

SEQ ID NO: 4128431 - RNA, 99 nt, Human
agagaagggaucauagugcagcucccuuucacaguucccagaaacagaguauuuauggaaucagaugaggggcagagcuaaagcuaaggucucuuuucu

SEQ ID NO: 4128432 - RNA, 80 nt, Human
agagaagucaucagagaacauuuugccuuaccucucacuguccuauagauaaggugaagcucccgaugagaacuaucuuu

SEQ ID NO: 4128433 - RNA, 63 nt, Human
agagaagugagugugacucagcagauggaauguuccaaugcuggugaguaaauucaguuuccu

SEQ ID NO: 4128434 - RNA, 62 nt, Human
agagaaguguugcuguguuguuauuuuuaaaauuaaggagcagcugaaaggcaaacuucucu

SEQ ID NO: 4128435 - RNA, 77 nt, Human
agagaaguuugaaauuaggagaaaucuggaaaaaucugugucacaaaaauuuguccugagucaaacauguuuucucu

SEQ ID NO: 4128436 - RNA, 81 nt, Human
agagaaguuugaggcaugaugcuggaagccacagggcaugcuguauuuuggccaugugccuuucaucaugcuuuugucucu

SEQ ID NO: 4128437 - RNA, 59 nt, Human
agagaaugauuaauguaagcccuucuguaacuagccagaggcuuaaggaauucuuuucu

SEQ ID NO: 4128438 - RNA, 74 nt, Human
agagaaugcucugucucugacagugguugggaucucaucacuggagauauccacacagggacuguauuacuacu

SEQ ID NO: 4128439 - RNA, 124 nt, Human
agagaauuccuuaaaacuaauguaguuucaguaacuuaccauuguagcaucaucaaugauggaguaauuugccuggugcagauagugguguaguauauuacauaguaaacaugaaggauuuucu

SEQ ID NO: 4128440 - RNA, 82 nt, Human
agagaauuuucuauggagcuguuucuguguuagaugagucuuaggaaaggcuagagaagcaugaaucaguucugaauuguuu

SEQ ID NO: 4128441 - RNA, 56 nt, Human
agagacaagaaauaccugggacagagacucacuguucauggguagcugcuugcuuu

SEQ ID NO: 4128442 - RNA, 79 nt, Human
agagacacauuagaugacucuuucuuucuguucaucacuaacacuaagcuagaggggaagaacaauuuaauuuguuucu

SEQ ID NO: 4128443 - RNA, 80 nt, Human
agagacaggugaccacaggcauugguucggccacucaaugagguuagaacuggaauuuugugguuuucuugccuuucucu

SEQ ID NO: 4128444 - RNA, 59 nt, Human
agagaccugcccagagccccuuucacucugaguuauggaguauuuggucuggcagcucu

SEQ ID NO: 4128445 - RNA, 80 nt, Human
agagacuagcuuuggguaggggacguggaagaaaagaauagcuuuuuuuaauuucuucuacucuuaaaaagcuuuuuucu

SEQ ID NO: 4128446 - RNA, 69 nt, Human
agagacuggcucagaaucugucauguucuauugauaaugaugaaaauaugauucugaggcccuguuacu

SEQ ID NO: 4128447 - RNA, 57 nt, Human
agagacuggcuucuaaaauggcaagaaauccauuuagucauaaaagaaacaguuucu

SEQ ID NO: 4128448 - RNA, 58 nt, Human
agagacuguccuuuccucauuaugucuucuuggcaaguaugugaaagaucaguugucu

SEQ ID NO: 4128449 - RNA, 65 nt, Human
agagagaagcaagaugcuauuuccuggauccaaauuucccaggacaaaacuucuugcauuucucu

SEQ ID NO: 4128450 - RNA, 61 nt, Human
agagagagagagagaaauuugauggugaaguauuuccuauagaaacaaccucucuuucuuu

SEQ ID NO: 4128451 - RNA, 85 nt, Human
agagagagaguuguacauuugcuuauguacaaggcgauuucuucagaugucgccccagaugcaagacaaagaacagucucucucu

SEQ ID NO: 4128452 - RNA, 55 nt, Human
agccauuauugagugccugcugcgugcauagguuuguaguaggcacugugggguu

SEQ ID NO: 4128453 - RNA, 117 nt, Human
agccauucuccugcaacuuguccaugauaggugcuaggcccaugagguuugcuggaccuacaagagccccaggcagccaugugggaccuugagcaagaggaccacgcaggagaagcu

SEQ ID NO: 4128454 - RNA, 62 nt, Human
agccauuuucguguuuggcaucuucaugcaggcgucaggaagcugaauuacaaaaaggagcu

SEQ ID NO: 4128455 - RNA, 76 nt, Human
agcccagaaaccagccuagaaugugggggaggacaucggcacuccauccccucauuacaggcggggagcugaggcu

SEQ ID NO: 4128456 - RNA, 57 nt, Human
agcccaggaguccuuaaggacccagguggguggaguaaaaccaggagggccugggcu

SEQ ID NO: 4128457 - RNA, 55 nt, Human
agcccaugcagaccuucccagagcugcucacugugucuguggggacugcuggguu

SEQ ID NO: 4128458 - RNA, 93 nt, Human
agccccauccaggguguggagagagcucuugaccacagguggaggugcccuuccccacaccugaugagcucuguccacacuuggagaccagcu

SEQ ID NO: 4128459 - RNA, 99 nt, Human
agccccgggagccucacacagcuggggagaggccaaggaucucgcagucacuagccaggcucaggaucaggggccuuuccuuggcugggcacuggggcu

SEQ ID NO: 4128460 - RNA, 129 nt, Human
agccccugagaacacagcuccucaccauggacuguaccugggggauccgcuucuugguggcagcugccacagguaaggggcucccaaguaccagugaugaggaggggauugaguucagucaagggggcu

SEQ ID NO: 4128461 - RNA, 81 nt, Human
agccccuggaggcugcagagaagucugagacuggagaaaggaggcucggacagaauucugcuucugugugucccagggucu

SEQ ID NO: 4128462 - RNA, 61 nt, Human
agccccuguauuugcaaaucaagagaccaguugucugcuugaggacaauuuacaugguguu

SEQ ID NO: 4128463 - RNA, 55 nt, Human
agccccuguccucucugaugaccaccuguccagguugucccaggacugagggguu

SEQ ID NO: 4128464 - RNA, 66 nt, Human
agcccgaaguccugggggcagcuguguccagcagacgcugcacccagcagucuuggggguugggcu

SEQ ID NO: 4128465 - RNA, 105 nt, Human
agcccgauauguuuccuccauauaaguacagcugcacugucacauugguaaguaugcagcuagguggugguggguugacauggagguuguuuugauuuugugguu

SEQ ID NO: 4128466 - RNA, 71 nt, Human
agcccgcaccaggagugagaaugaagggggcauccugggcauuaccccccuuccuugugacugguggggcu

SEQ ID NO: 4128467 - RNA, 59 nt, Human
agcccuaacucccaguaucuuggaaugugacauuauucagaaauuggguuguuacaguu

SEQ ID NO: 4128468 - RNA, 55 nt, Human
agcccucucccuuucuucuuagggcucaaauucaggaucugaaauggagggggcu

SEQ ID NO: 4128469 - RNA, 65 nt, Human
agcccugaagcuggccaugucccggucugcggggugggaagagacagguggcgggcugcagggcu

SEQ ID NO: 4128470 - RNA, 86 nt, Human
agcccugcccugcuucucuugggacagagacgaacuugaagauucuuaaggauucaguugucacuagugaagaaucaggcugggcu

SEQ ID NO: 4128471 - RNA, 61 nt, Human
agcccugcugugucccuggcuuucucuccuggcuggggggauggaagggacaggcaggacu

SEQ ID NO: 4128472 - RNA, 85 nt, Human
agcccugggcaaauuauguuacucaugguuucugaguuuccccacauggaugaaggggugaguaguauacuuauugcauaggguu

SEQ ID NO: 4128473 - RNA, 64 nt, Human
agcuauugccuaguauuugcagagaaauauaaaugauucugaauggcaagcauuaggcaagguu

SEQ ID NO: 4128474 - RNA, 99 nt, Human
agcucaaguagauaauaaauuugaguaauuugggcuaccaaaauaacccacauauuccuggcagcauuaauuauucagguuaauguuuuacuuugagcu

SEQ ID NO: 4128475 - RNA, 117 nt, Human
agcucaauucaguucaguugugcuauauguacaugcacauguaucuauauacaaauuguguauaauuugggcuauggauacauuguaguacauucaauugaaagugaagugggagcu

SEQ ID NO: 4128476 - RNA, 56 nt, Human
agcucaccagcugcguuggagggcucugucuuccacccccagacagcuggugaccu

SEQ ID NO: 4128477 - RNA, 77 nt, Human
agcucacuuuucuguaauugcagggugcaauucucuguuuuucuucccucagugcaaaaaggcagacuggugaugcu

SEQ ID NO: 4128478 - RNA, 63 nt, Human
agcucagacuuaaaagaauuguuuaaggcaaaaagcuacuguucauuuuauugucugauugcu

SEQ ID NO: 4128479 - RNA, 82 nt, Human
agcucagagauauaauaauuuacaaguguacagagcgcugcaguuuacaaagcauuuuugaguguauuaucucauuuggguu

SEQ ID NO: 4128480 - RNA, 76 nt, Human
agcucagccuccagcugcuccaacccagcgggcuucagucagagaagccagcuguucuggggcagcaacuugagcu

SEQ ID NO: 4128481 - RNA, 58 nt, Human
agcucagggcaaagacucaaauccaagcuggcuggcuuuagaguuguagcucucagcu

SEQ ID NO: 4128482 - RNA, 57 nt, Human
agcucagugagauauugacuccacuuuuccagugaggaaauugaggcucacagagcu

SEQ ID NO: 4128483 - RNA, 59 nt, Human
agcucagugaggguuacaggaagcauggcaagcuuugcugcuugggggcuucaggagcu

SEQ ID NO: 4128484 - RNA, 62 nt, Human
agcucaguucugcugcugccuagggugccaugcuggccccgguuccaaugcagagccuggcu

SEQ ID NO: 4128485 - RNA, 56 nt, Human
agcucaguuuuuuuaagagccaugcuaauuaaacaguauggucuuaagagacugcu

SEQ ID NO: 4128486 - RNA, 108 nt, Human
agcucaugaguuaaugugucagcaauuuaggcuggguucagcugggugauucuucuggucuccucugggcccacuuaaaucuggcaguuaucugacuuaucaucagcu

SEQ ID NO: 4128487 - RNA, 109 nt, Human
agcuccagagucccuguucuuaacuagccuaggcuacuucuaauaucauguuaugcuaagaaguucccuggaugagcuaaaaauugagacgauguuagugcuuugggcu

SEQ ID NO: 4128488 - RNA, 66 nt, Human
agcuccaggcagcauaguggaugugguaacuaaagccauggucccuagcacagcuguccuagagcu

SEQ ID NO: 4128489 - RNA, 126 nt, Human
agcuccagggccuugcccccuuuucuuucuuacaaagaaaacgguggcuugacucagcaaaaacuaagaaggguagcuguuucuccaggucaggaaggauacgggggucagcacuuccuggcaguu

SEQ ID NO: 4128490 - RNA, 85 nt, Human
agcucccagcauuaugguauagucccauaguccugacuggucagaagccauguggagacuauagccauaacaagcuguaggugcu

SEQ ID NO: 4128491 - RNA, 61 nt, Human
agcucccagcuccuuugagagagaaaagccuaaaguguuugcagggagcugagauggagcu

SEQ ID NO: 4128492 - RNA, 98 nt, Human
agcucccuggaaagccagccauggccagucugcagccccuggggacucugugagagucuggaugcagacaggccaggggcugccaccucaggaaagcu

SEQ ID NO: 4128493 - RNA, 72 nt, Human
agcuccuaggcaugcaaauaaaugugcacacuggaaauugaguucugcaauuuuuccaugaccuagaaagcu

SEQ ID NO: 4128494 - RNA, 58 nt, Human
agcuccuuuucugacauagggaauucuguguuuguuuuucuuauugucuugaggaguu

SEQ ID NO: 4128495 - RNA, 64 nt, Human
agcucuaggcccuggggaauacaacaguggcccaaacagacaugggcucugcccuccuggagcu

SEQ ID NO: 4128496 - RNA, 73 nt, Human
agcucuccaggaggaugaggggcauagaaaguuugagaaccacugcucuauaguauguuauccauccucagcu

SEQ ID NO: 4128497 - RNA, 61 nt, Human
agcucucuuccaguggcuuugauuucucagagagagagcaaagggacauggaagaggaguu

SEQ ID NO: 4128498 - RNA, 57 nt, Human
agcucugacugaagagaugcaagauuuucucagaugauuugugugucagucagaguu

SEQ ID NO: 4128499 - RNA, 69 nt, Human
agcucugaggcuuguucuauguaugaucugauuaaggaagauuucauauuggaaccaguuaacagagcu

SEQ ID NO: 4128500 - RNA, 71 nt, Human
agcucugcaccaucguaugcuuaauuaaaauaucuaauacgguuuaauuaaguaugcaauggugcagugcu

SEQ ID NO: 4128501 - RNA, 62 nt, Human
agcucugcagaacaauuccugcuguuaacagacuuaacagucuacugaauaucugcguggcu

SEQ ID NO: 4128502 - RNA, 70 nt, Human
agcucugcauuaaaaugugccucucuuuaagucaagugcuuuaaguucaggucuuuucagugcaacugcu

SEQ ID NO: 4128503 - RNA, 55 nt, Human
agcucuggaccugacaucuggugcucggugucucauugauguuaggccaugaguu

SEQ ID NO: 4128504 - RNA, 58 nt, Human
agcucugggauucucaggccaccggcaguuaugacccacuggcuauaauuccagagcu

SEQ ID NO: 4128505 - RNA, 68 nt, Human
agcucuguaggucuuaucuuaggaggaucuuugacuccuuaaauacacaucagauaagcuucagagcu

SEQ ID NO: 4128506 - RNA, 57 nt, Human
agcucugugccacaugcaguguuauguuaagcauauagcagccauuucacagagacu

SEQ ID NO: 4128507 - RNA, 56 nt, Human
agcucuuggcaagacucucccaauuuauggggcuuugggagacacagccuugagcu

SEQ ID NO: 4128508 - RNA, 67 nt, Human
agcucuuggcagucuucaucaguucugggggcaacauauuuagaacuuaagaauacugucuugaccu

SEQ ID NO: 4128509 - RNA, 64 nt, Human
agcucuuucugugugucucagcaagcuguguccccaggguccagcucagcacauaggagguacu

SEQ ID NO: 4128510 - RNA, 72 nt, Human
agcugaaccuuagucuggagugacccuaccaagguccaucacacccagggagauccaggcugagagucagcu

SEQ ID NO: 4128511 - RNA, 56 nt, Human
agcugaaguuuagaauugugaaaaacucaugguugcuucacaacuugaacucaguu

SEQ ID NO: 4128512 - RNA, 62 nt, Human
agcugacauucuguacugugagcagugagcugcucccaugucuggcagcugcaguuguagcu

SEQ ID NO: 4128513 - RNA, 59 nt, Human
agcugacauuggagaagugccuggagugugcugggcacuuuauugaccccaggucaguu

SEQ ID NO: 4128514 - RNA, 76 nt, Human
agcugacuucugugucuuucacaaagguugacuucaguucagaaguuacuuuauguagaagaaaucauggucaguu

SEQ ID NO: 4128515 - RNA, 87 nt, Human
agcugacuucuguucagaucuaauuggauuauuauuguuucuccucauaauguggcugaucgcagagcucuuacuagaaagucaguu

SEQ ID NO: 4128516 - RNA, 107 nt, Human
agcugagagguggguuugugcuuguggcauuuagcuuggcaggauagaauguaaauuacaccucuuguccuaagagcuggauucuagcacagucuccaucauuagcu

SEQ ID NO: 4128517 - RNA, 58 nt, Human
agcugagcagccuaagcaaauuuccaaaacagaaaggaaagaauaggugugccaugcu

SEQ ID NO: 4128518 - RNA, 61 nt, Human
agauuuuauagauaauuucccaggcugcuucuuccaaagccuaacggaagcuguaaaaucu

SEQ ID NO: 4128519 - RNA, 98 nt, Human
agauuuugacacuugccuccauuccauguccccuaggauagagcuggagagcguuuaggguccauauggaugaauggcaggaugaaggucaagcaucu

SEQ ID NO: 4128520 - RNA, 77 nt, Human
agauuuugugcuugcugagauaaaugcugucuucaugguggcuggagauuaguuuuauuuaucuuuguaaaaaguuu

SEQ ID NO: 4128521 - RNA, 80 nt, Human
agauuuuguugguuguguuggggauuaguacacagacauuucaguuugugugcaauucuuaacauacauacugaaaaucu

SEQ ID NO: 4128522 - RNA, 112 nt, Human
agcaaaaaagacaagagagaggaaaggaggaucuuugaauuucucuaugcucuaauuaucauguugggaaaucagggguguugcuuucuuguuuucuuuguuuguuuuagcu

SEQ ID NO: 4128523 - RNA, 82 nt, Human
agcaaaaugcaagagguuggauuuuaagagccuaagcuaaguuucuuaacacucuuaauaauuauaaucaguugcuacagcu

SEQ ID NO: 4128524 - RNA, 67 nt, Human
agcaaacccaugcauugauugacaggaaaguaaaaucaauuuacauugaaaucaauggaugugugcu

SEQ ID NO: 4128525 - RNA, 61 nt, Human
agcaaagacagggacgaccaagguaagucucacuaggagaucugcucucucuguauuugcu

SEQ ID NO: 4128526 - RNA, 65 nt, Human
agcaaaggacagcccauccugggauuuugcugaagcaguuaaagaggaggcugucucuuucagcu

SEQ ID NO: 4128527 - RNA, 78 nt, Human
agcaaagggcuaagacaauucuucagucacaauacaucuauuuccuguguugccuaaaucuuguuuuacacuuuggcu

SEQ ID NO: 4128528 - RNA, 82 nt, Human
agcaaauaaaugacagagccagaacuagaccuuguauuuuuuaaccuacagucuaaucuuguguuuuguaugcuuguuuguu

SEQ ID NO: 4128529 - RNA, 64 nt, Human
agcaacaccaucuucuguggcuuaugagcuuuugacuugucagcaacagugggugaguguugcu

SEQ ID NO: 4128530 - RNA, 62 nt, Human
agcaacaggaccauggagcccaucauuauguguuuuggcuuuggaacauggucuguguagcu

SEQ ID NO: 4128531 - RNA, 60 nt, Human
agcaacaguguauaucauaggcccucaacaaacaaugccugcuguuucuuuacuguugcu

SEQ ID NO: 4128532 - RNA, 77 nt, Human
agcaacauccuugggcaugcauccaugcacugaguacagguauuucugcaggauggaugcucagaagucuaauugcu

SEQ ID NO: 4128533 - RNA, 65 nt, Human
agcaacugauauuaacaggcaagugagugcugguaaagccucuggcucuguugagauuuguagcu

SEQ ID NO: 4128534 - RNA, 57 nt, Human
agcaagaaggcuucagagcccaggagcuucaaguuccuggucuaguacuuccuugcu

SEQ ID NO: 4128535 - RNA, 67 nt, Human
agcaaggaaauuuugaaucagugucucucauuaacugugugagagagauuauaacauuuaccuuguu

SEQ ID NO: 4128536 - RNA, 58 nt, Human
agcaaguugaaauacuguuuuaucugucaaauuagaaaaacaguuuuugcuaacugcu

SEQ ID NO: 4128537 - RNA, 101 nt, Human
agcaaguuuuuguuuguuuguuuguucguuuguuuuaagucaagcuaucccaacuagcuguuauuggccaaacagaguucaacagacaucaugaaugugcu

SEQ ID NO: 4128538 - RNA, 87 nt, Human
agcaauguuuuguuucuuguuaguacaugaaaaaucauuggagauugucaguuacccuacuaacaaugagaacaagccagauaagcu

SEQ ID NO: 4128539 - RNA, 60 nt, Human
agcaauucauucuucucugcacagaagucccccacucugacccagagcaguaugaauguu

SEQ ID NO: 4128540 - RNA, 82 nt, Human
agcaauugauggcagcaguuuggagucuuuggugaauucagucaagaaagaaauccccagcugucuaccauugcaguuagcu

SEQ ID NO: 4128541 - RNA, 56 nt, Human
agcaauuuccagucucuaaggguggggacaugaauuuaccucagaggcaaauuguu

SEQ ID NO: 4128542 - RNA, 95 nt, Human
agcacaaaaacuuauaaccaaagagagaccuuucuucucagugcucaagucauucuuugagaaagaagcucuuuuugaucaugaggcuuuaggcu

SEQ ID NO: 4128543 - RNA, 81 nt, Human
agcacaaagagauggaggaaggcugaacucacucucugccugcauuuugagcucagacaccauucuucugccuuuuguacu

SEQ ID NO: 4128544 - RNA, 82 nt, Human
agcacaacuguuauuucugaaugccauccacguggcucagccacugagaugaagcaccauucagaagaagcaaaugugugcu

SEQ ID NO: 4128545 - RNA, 87 nt, Human
agcacacaggccuaacagccuucgacaguuggaguaguguuccauuuauuuuaguccccuaucgaugggauuuagguuguuuguguu

SEQ ID NO: 4128546 - RNA, 56 nt, Human
agcacagaauggcuuggaagccccuaaacaugguccuccaagucagaguuuaugcu

SEQ ID NO: 4128547 - RNA, 128 nt, Human
agcacagaccccacaaacccuccacuuucuuuauuucaggccuggcguaaaggagaugggacucacacccaagaggaugcauuuccauacacccauuucugaaauaugaagagguguccagucuguuu

SEQ ID NO: 4128548 - RNA, 89 nt, Human
agcaugggcugaaggcaaacagagacaaugaaugcuauggauguguaguguucauucaaucuauuugcuucagccucuugaaacaugcu

SEQ ID NO: 4128549 - RNA, 86 nt, Human
agcauggggcauuauuagagguguugacgccaagguagacacauccauguauaucuuugcaaauaucucuaaguguuucuugugcu

SEQ ID NO: 4128550 - RNA, 75 nt, Human
agcaugggguucuguuugaccuguuuggcuaauguuucuaggugccuuaacauuuaggaaggaccuccucaggcu

SEQ ID NO: 4128551 - RNA, 63 nt, Human
agcaugugagguccuuggugugcuuagcucaugccuggcaggugguaaggauuucauaaagcu

SEQ ID NO: 4128552 - RNA, 59 nt, Human
agcauguggcuaucuuugggggccuuauuuugccuaccauauucauuuagccacaagcu

SEQ ID NO: 4128553 - RNA, 76 nt, Human
agcauguuaaaaaauaaugcaggcacuugacugacugggcucaggacagugauuugcaguauuuacuaauagaguu

SEQ ID NO: 4128554 - RNA, 69 nt, Human
agcauuacaacacagcuuuccucaaguuuauuuuauaucuuaaauaaggauacuguguguguuauagcu

SEQ ID NO: 4128555 - RNA, 80 nt, Human
agcauucauuuuggggagcugagaaacaacauucuaacccuagauuguucuugccucuguucauugccauaaugaauucu

SEQ ID NO: 4128556 - RNA, 84 nt, Human
agcauuccacaauagcugcuucagucuaggucucagaauacauuuagaugaaggagaccagaaugaagacaaagccuggagucu

SEQ ID NO: 4128557 - RNA, 59 nt, Human
agcauucggagaguucaugaagacccggguucccaucuugauccugcuacucacgagcu

SEQ ID NO: 4128558 - RNA, 68 nt, Human
agcauuuagagcaggguguggcacaucucaacucuaaaugaauguuaccugcuccugcugcuacugcu

SEQ ID NO: 4128559 - RNA, 71 nt, Human
agcauuucugggagaauucuaaguuugguuaccaucuugacagauaauacagaggcuuccaguaaaauguu

SEQ ID NO: 4128560 - RNA, 60 nt, Human
agcauuucuuggcccauuguaggugcucaguaaacacuuacgggaugaaggagauaagcu

SEQ ID NO: 4128561 - RNA, 55 nt, Human
agcauuugcuuaccucagggcccuugcagucguuauucccugaggcuagcaugcu

SEQ ID NO: 4128562 - RNA, 56 nt, Human
agcauuugugaauuaagcaugucaacauuacuguguugcuuguuaggcacacugcu

SEQ ID NO: 4128563 - RNA, 65 nt, Human
agccaaagucacuaagugaaccacugggugacaaguugcccaggcccaguuggugauuuauggcu

SEQ ID NO: 4128564 - RNA, 60 nt, Human
agccaaagugguauauagggaacuucuguggacccagaaucucuacacuuucacuaggcu

SEQ ID NO: 4128565 - RNA, 75 nt, Human
agccaacacucacagguagaauaacaacaucacaguacagagaugugaguggcaucugccuuugaguaagggacu

SEQ ID NO: 4128566 - RNA, 71 nt, Human
agccaacuucucugguugagguccaauuucuguggcaccugagauuccccuggcuagagaagcugugugcu

SEQ ID NO: 4128567 - RNA, 66 nt, Human
agccaagaaucggguaggccaaugcaugucuaagugcuacaggcucagauaucuguguuccuggcu

SEQ ID NO: 4128568 - RNA, 59 nt, Human
agccaaggagaggggccucaggccagcacaagagcacagggcaggcaccucuuccugcu

SEQ ID NO: 4128569 - RNA, 58 nt, Human
agccacagcuccuugguggagacucuuaccucuggacaaacaggaccugugaaaagcu

SEQ ID NO: 4128570 - RNA, 56 nt, Human
agccacauacuguaacuucuggggcguccugguucagaagccuggggaauguggcu

SEQ ID NO: 4128571 - RNA, 61 nt, Human
agccacauauuccuggggacauagaucugaguuagaucuuuaccaccaaagaaugcuggcu

SEQ ID NO: 4128572 - RNA, 81 nt, Human
agccaccuuuguuucgcagccucucucuggcaccuccauccacugcauuguguggagggaggcugaaggagcugaggggcu

SEQ ID NO: 4128573 - RNA, 88 nt, Human
agccacugacaacucggugggcuauuaggaccaggccaucuuuucccaaugugguacucuucuaaugggcacgcugggcucgggagcu

SEQ ID NO: 4128574 - RNA, 61 nt, Human
agccacugucugaacuucuguggaggucuggugcaggggaggugugaacagauaggaggcu

SEQ ID NO: 4128575 - RNA, 66 nt, Human
agccacuuccuucugucagcucaaagaagcuccugcaggguucagggcagacagaagagaugggcu

SEQ ID NO: 4128576 - RNA, 56 nt, Human
agccacuuucgagauggcucaguuacauggcuggagcuggcaaguugaagguggcu

SEQ ID NO: 4128577 - RNA, 59 nt, Human
agccagaauuugaacccacaaaugucugauugcagcauggcaggugcagauucugugcu

SEQ ID NO: 4128578 - RNA, 57 nt, Human
agccagagacugugucuguaauguucagaaaaugucugagggacacagcucauggcu

SEQ ID NO: 4128579 - RNA, 130 nt, Human
agaggguuagaugauacggguuaaguuucaauugcacagcugaauauuuuggggcuuauccaaccugagccuuucaagacucauugaguauugguguaaguugacccuguggcuugaucgucuuccuucu

SEQ ID NO: 4128580 - RNA, 56 nt, Human
agaggguuguaugaauucucauggaacaucaaguccaauaguuuauuuagccuucu

SEQ ID NO: 4128581 - RNA, 129 nt, Human
agagguaagcaaaguccuguauuaccugcaagauggaaauggaaaugaguacaugauaauugauguauauauuucuuucauucuagagcugcagaaaaucuagagggauuuuuaacagaugcugcuucu

SEQ ID NO: 4128582 - RNA, 58 nt, Human
agagguagugcaagugugaagcauguggucauuuuggcauacucaguguauaacuucu

SEQ ID NO: 4128583 - RNA, 129 nt, Human
agaggugaaagcugauauuucuaguuugugaaagcuauuuuuuucuguacaacucucaucuaaagauauaggacagucaggaaaaauugauaauuuuguuaaaguggcagauaaacagcuuguaaaucu

SEQ ID NO: 4128584 - RNA, 68 nt, Human
agagguggagcccugagaaccggaggaaaacauccaucaccuccagccccuccagggcuuccuccucu

SEQ ID NO: 4128585 - RNA, 130 nt, Human
agagguggagggguggagagagggggcuuuugaacaucagccauuugaccuugggggccagaguucaaaucccccagaggucugaaaagguugaaaagauaucauuaucccuucucccucccccgcgucu

SEQ ID NO: 4128586 - RNA, 61 nt, Human
agaggugucuguuaggaauaggcagccaguguucaaaggauggccuccucucagaugcucu

SEQ ID NO: 4128587 - RNA, 68 nt, Human
agaggugugagagucaguacaacacuuugccaucggcagaggucuuugggcuggcucucgaugccucu

SEQ ID NO: 4128588 - RNA, 55 nt, Human
agaguacauucagagcuaccuacgaaauaggugugaaauaugcuugaagugcuuu

SEQ ID NO: 4128589 - RNA, 66 nt, Human
agaguaccauuacucacuuauuuuuuggggccaaugugcagaauuuacaguugcugaugguacucu

SEQ ID NO: 4128590 - RNA, 57 nt, Human
agagucagucacuggcacuuugucuguuuggugacaucauguuucccugacuguucu

SEQ ID NO: 4128591 - RNA, 62 nt, Human
agaguccaugaagacagcugagagucucucauaucagugaucuucagcuuccuuuuggcucu

SEQ ID NO: 4128592 - RNA, 82 nt, Human
agagucucugucacccaggcuggagugcagugggacgaucuuggcucaccacaaccuccgccucccggguucaagugauucu

SEQ ID NO: 4128593 - RNA, 80 nt, Human
agagucugucgcccagccuggagggcaguggugggaucuuggcucacugcaaucucugccuuccaggcucaagcaauucu

SEQ ID NO: 4128594 - RNA, 79 nt, Human
agagucuguguuguucgaacuggucaguuuagcccacuguacaaugcucaugacaguacugauauuaacagacaacucu

SEQ ID NO: 4128595 - RNA, 77 nt, Human
agagugaaguuuuugaaagugacaaguguuccagaggcaaaaaggagaggaaaguugacuuucaaaaauggcauuuu

SEQ ID NO: 4128596 - RNA, 70 nt, Human
agagugaauguaagugauuugcuaagucauguaacuagugagugauuguucuggauauuuacauugcucu

SEQ ID NO: 4128597 - RNA, 78 nt, Human
agagugacaaugucuccauuauuauaagccugagacucaaagacauccuggagugugauauuugaguauugucaaucu

SEQ ID NO: 4128598 - RNA, 59 nt, Human
agagugacagccacugcaguaaccacaagaccguggaugacuuagucccugcucucucu

SEQ ID NO: 4128599 - RNA, 68 nt, Human
agagugaccaagugcucuguguauuaggauguccaccagguauccuaaauuggcagggcagguacucu

SEQ ID NO: 4128600 - RNA, 80 nt, Human
agagugcagggcucagagcaaaagggcacaguggccccuucccagucucagugccccuccccucugcccuuugucacucu

SEQ ID NO: 4128601 - RNA, 76 nt, Human
agagugcuauuaugauggcucccauucaacuauaggcuuccuucagacagucuuaauggauaggagcucgcacucu

SEQ ID NO: 4128602 - RNA, 98 nt, Human
agaguggagauuuaaguaagauuagguaauuugcucaaggcaguuaguagcagagccagauucaaacuuacguagucuuacuacaaaauccacacucu

SEQ ID NO: 4128603 - RNA, 56 nt, Human
agagugggaauuuucucccagggaccccauuucucuuuggcuggaauucccgaucu

SEQ ID NO: 4128604 - RNA, 65 nt, Human
agaguuaaccuuagagccucgacuagugcuuuacauauaggcacuagucuaggugcuaagauucu

SEQ ID NO: 4128605 - RNA, 56 nt, Human
agaguucauauucagagaucgcuaauacauguuaaugaugucagaagaugaagucu

SEQ ID NO: 4128606 - RNA, 92 nt, Human
agaguuccuugccucagagaccugacaguacagagggaccagcacaagccgaucaucugaacauguugcagcucugggcaaugauggcgucu

SEQ ID NO: 4128607 - RNA, 55 nt, Human
agaguugaggcuggagagguaugcaaaaaaucagaucuuaaaaggucuuaacuuu

SEQ ID NO: 4128608 - RNA, 76 nt, Human
agaguugcccaggccgccuggggagaggcccugucaagguccagcagggccucuggggggaggcuugggaggcucu

SEQ ID NO: 4128609 - RNA, 90 nt, Human
agaguugcucugucacccaggcuggagugcaguggcgcgaucucgaucucagcucacugcaaacuccaccucccagguugaagcgacucu

SEQ ID NO: 4128610 - RNA, 76 nt, Human
agaguuuggaaaugauugcgcucauucagauucucuucugauguuugaauugcugccaucauauuucuagugcucu

SEQ ID NO: 4128611 - RNA, 130 nt, Human
agaguuuuucuuuguagagucuuugcaaggcuuagugcacuuuuccacauccauagcagauaacgauuuugcucugggcuugguuagggcuguugaaggcucacuguuugacgauacggugacagacuuu

SEQ ID NO: 4128612 - RNA, 127 nt, Human
agauaaaaacuaauuggcuaucauuguugugauaaucuuacucaugucuucacccauucuaaaaauaguuuggggugugugaaauuaugucauuuggcaaugaugccuuauuucaguaaauuuauuu

SEQ ID NO: 4128613 - RNA, 85 nt, Human
agauaaaauucaugggcaggccucucauuucuguaaauaaaguuuuacuggaacauggccaugcccauuccuuuauguuuugucu

SEQ ID NO: 4128614 - RNA, 62 nt, Human
agauaaauuauuuaggauauuuggguuugugguauaaaaagaauauccaaaugauuagaucu

SEQ ID NO: 4128615 - RNA, 75 nt, Human
agauaacaugauuugcuauuuagauaucagagauagaaaugcguaggcugggaucaaaguggaaaucaauuaucu

SEQ ID NO: 4128616 - RNA, 123 nt, Human
agauaacauguguaaaaacacuucgcacaaucucuggcacauagucagcacucaagaaauuuggacuuauuguuuguguauguauuuguguguguguguguguguguguguguguaugugucu

SEQ ID NO: 4128617 - RNA, 62 nt, Human
agauaagucaggcuguuccuguccaaaauuccuguaaggggaauuuauagccugacuuguuu

SEQ ID NO: 4128618 - RNA, 63 nt, Human
agauaagugucuaccacuuuaagagaggcacacauuuuagccuuuucuguaaggcauuaaucu

SEQ ID NO: 4128619 - RNA, 79 nt, Human
agauacuguuucagguacugggaaugcagaagugaacagaacagucaaacaucccugcccucaugccuauaauauaucu

SEQ ID NO: 4128620 - RNA, 63 nt, Human
agauagaaggauuggagugaccacugugcugcccucugcauggaguugauguccuucugugcu

SEQ ID NO: 4128621 - RNA, 69 nt, Human
agauagagacuauaaugcucuuugugccgguaaggaaaacaagcucgaggagauuaaagucuguuguuu

SEQ ID NO: 4128622 - RNA, 87 nt, Human
agauagauuggaggucuuagaagaaaaaucaugucaguugugcaaguggacaaaacaaugauuucuucaagguccucauuuuuuucu

SEQ ID NO: 4128623 - RNA, 101 nt, Human
agagcugcuagagaccauccugcccauccgaguucugagauugggacugugauguugggaccugaggacuggaugguagaauacuggggucccccagcucu

SEQ ID NO: 4128624 - RNA, 62 nt, Human
agagcugcugcuguacugggauccaauuucacuuuaggaauuugcucaggcagagaagcuuu

SEQ ID NO: 4128625 - RNA, 59 nt, Human
agagcuggccagggaucacucuguccaccauccuauaccagcuguuccugaccagcucu

SEQ ID NO: 4128626 - RNA, 62 nt, Human
agagcugggacuuggacucaauucugauucagaaggaaaugcugauccacucucauugcucu

SEQ ID NO: 4128627 - RNA, 64 nt, Human
agagcuguuuccagaaucaaagcaaaagggucugccuccuucauccuggccuggagacaacucu

SEQ ID NO: 4128628 - RNA, 76 nt, Human
agagcuuuaaaaauaggaaaauauuuaacaagauaauacuuauuuuuagucugugaaaucauuuccuguaagcucu

SEQ ID NO: 4128629 - RNA, 73 nt, Human
agagcuuuaguacuugugaguaaaacauaguaguuacaaauuauuauugacuauucagaaugugcugcacucu

SEQ ID NO: 4128630 - RNA, 83 nt, Human
agagcuuugccuuagaucaguaguugguaagggucauaggauguaaucccaggccaacuggcugaucucaaagccugugcucu

SEQ ID NO: 4128631 - RNA, 64 nt, Human
agaggaaaaacagaaaaauucauggcagcucauaaucugcugauauauucuaguuuucuccucu

SEQ ID NO: 4128632 - RNA, 78 nt, Human
agaggaaauucugcucuuaacauaauguagcuuaaaagaaaaugcugcauuuugucaaagagucagcgaugagccucu

SEQ ID NO: 4128633 - RNA, 103 nt, Human
agaggaagaggcuggagcgcaggagguagcuggugcugggcuccuagucuuggcagaggagcccaaagcacuuggcugcccugcgugucacucaucucccuuu

SEQ ID NO: 4128634 - RNA, 64 nt, Human
agaggaagcaguggaaaaagcccuguggacucucuggguccccagggaagccauuucugacuuu

SEQ ID NO: 4128635 - RNA, 130 nt, Human
agaggaaggcacugcaaaaucucgacuuacuucugacaacaucuuugugcuuuuguggaguuucuagcuuaaguuuucaaaaaacacagaugucuguguaguauuuguaucuuuuuuuaaggucuuucuu

SEQ ID NO: 4128636 - RNA, 63 nt, Human
agaggaauaugggugcacuagaaccaggagggucccaaaucccuuaugcacucauauuuuucu

SEQ ID NO: 4128637 - RNA, 75 nt, Human
agaggaccagcaagaaaucauugaauuauuugcuaauugugagcaaaauuuguauugauuuuucucugucucucu

SEQ ID NO: 4128638 - RNA, 76 nt, Human
agaggagaaggcaaagaguuuuaccagcuauuuuggucuuuagcaaaauaauguuaggccuuugcucucuaaaucu

SEQ ID NO: 4128639 - RNA, 69 nt, Human
agaggagagggagagauggaaaagggagaacucaccuuuguuaacauacugcuuucuaauaacucuuuu

SEQ ID NO: 4128640 - RNA, 56 nt, Human
agaggaucuaagugaguccucaccuuaacugugugaaguagauaucacuguccucu

SEQ ID NO: 4128641 - RNA, 63 nt, Human
agaggcaaguaguccaaagcuggcaugaugaggccacccaucauuguuagggacucuaacucu

SEQ ID NO: 4128642 - RNA, 122 nt, Human
agaugaaauaaaaugaauucguuacaagacauuguggagauguugcuaagcccuuuaauuuuuggaaacucaguauaauuuucaucaguucuugugaaacuugauuuaugcucguaucaucu

SEQ ID NO: 4128643 - RNA, 73 nt, Human
agaugaauuugacaaauacccauuagaccagccaacggcuugcucagugacuccuauuugcuugaauuuauuu

SEQ ID NO: 4128644 - RNA, 130 nt, Human
agaugacaugcugauaggaugccauguuguuccaaaugcuguaccacacuuuuuauucugacucauaguguggucccuaggaaagcaguguuggaaaaucagcucaagauggcagaagcaacuaauucau

SEQ ID NO: 4128645 - RNA, 69 nt, Human
agaugacuaugauguauuuugcaucuagcuauagcgguuguauagcauuuguuuaucauucauucaucu

SEQ ID NO: 4128646 - RNA, 62 nt, Human
agaugagggcaagcuauagaauauaaggggaguccauagcaucccaggaguuugcucuuacu

SEQ ID NO: 4128647 - RNA, 62 nt, Human
agaugagggggaugugggguagcaaacccuaaaaacgagcuacugaccacuucugccugucu

SEQ ID NO: 4128648 - RNA, 119 nt, Human
agaugaugcauaugacauuaaagcuugagaugcacugcacuagaaugcaggggcgucauuuugcuugcugcuguauccuuagugucagaacaguacuuagcacaucauaagcacucacu

SEQ ID NO: 4128649 - RNA, 77 nt, Human
agaugauguccuucuuagaagagauucauguuuuuaauuguauguuuuauuucuccaagagggagcuuauauugucu

SEQ ID NO: 4128650 - RNA, 114 nt, Human
agaugcauuuguucaggaugcauuuauucaaguugcauuuguucaggugcauuuguuaaggauguauuuauucaggauguaacuguuugggaugcaucuguuccagaugcaucu

SEQ ID NO: 4128651 - RNA, 75 nt, Human
agaugcccaaacugacauuggcaguucuaaccucuuuccugagcuccaggcugccugauguccagcaggacaucu

SEQ ID NO: 4128652 - RNA, 78 nt, Human
agaugcuagacucaccaagaacaaggcacuggauaaaucucuaaaccauucuaagucacugugaaaggugaagcauuu

SEQ ID NO: 4128653 - RNA, 64 nt, Human
agaugcugaggcaggaauggggaaaaguggaggagacacugaacucacuuugcuuuagaaaucu

SEQ ID NO: 4128654 - RNA, 75 nt, Human
agaugcugagguuguggagugcauugaauaguuuuaaauaagauaaaggcagugcgacuccaaauuuagccaucu

SEQ ID NO: 4128655 - RNA, 55 nt, Human
agaugcuguaacugguauaaaugcacagaauuuauacacugcagaaccagcauuu

SEQ ID NO: 4128656 - RNA, 63 nt, Human
agauggaauaugcucuuugggagaccagguugagugcccuucccucaggccuuaucuccaucu

SEQ ID NO: 4128657 - RNA, 67 nt, Human
agauggcagcagaacaaacaggaaagucaugaucauuaauguggucuguucuuuuagcugaucauuu

SEQ ID NO: 4128658 - RNA, 78 nt, Human
agauggcuuauucacaugccuggcaaguuacagcugacucuuggcaggaguccuuuguuccuugccacauggacaucu

SEQ ID NO: 4128659 - RNA, 56 nt, Human
agauggcuuccuucucacuguguccucacauggcagaagagacaaggcagcucucu

SEQ ID NO: 4128660 - RNA, 130 nt, Human
agaugggaaaaagcaggacugaggaccgagucugcagcaaggggcccugauaggcaccauaggccucaugagugggucuacaccucuggcuagucugggucuuuccagcucuugcugagcccacaauucu

SEQ ID NO: 4128661 - RNA, 87 nt, Human
agaugggagaagcagugggacaguagccccagaacaugcaccguucauagauaggagugcuagucucacuccugcucuuucucaucu

SEQ ID NO: 4128662 - RNA, 75 nt, Human
agaugggauuugucuuaauaugugcauucuguuugccaaggcauacauagcauguuuggacacauggucucauuu

SEQ ID NO: 4128663 - RNA, 63 nt, Human
agaugggccuucgagcaugcccccacuucuugggcugucauaacuccccuugaagaguccucu

SEQ ID NO: 4128664 - RNA, 66 nt, Human
agauggggcuguuggggaaacacaugcuuauuucccugcuggugaccacugcagcaguucccaucu

SEQ ID NO: 4128665 - RNA, 62 nt, Human
agaugggguccaugaggguagucagaggauucugagauucccauacccucagggccucauuu

SEQ ID NO: 4128666 - RNA, 55 nt, Human
agaugggugccuucuuucuuuaaccucuuguggugaagagagaaaucaucuuucu

SEQ ID NO: 4128667 - RNA, 88 nt, Human
agaugguguuuucuacagcugggcuaaaaauaaauaaauaaauaaaaagucugugcuuuguaaaagcccaagcuguaggggcccuucu

SEQ ID NO: 4128668 - RNA, 60 nt, Human
agaugguucgaguguuuuuguuccccucuagauguugaacuccugaaucgugagccaucu

SEQ ID NO: 4128669 - RNA, 75 nt, Human
agauguaaguuguggcaguuugcauuuuauagugauagccuguaagauuuuuaaaauguccucagaaauacgucu

SEQ ID NO: 4128670 - RNA, 83 nt, Human
agauguagaccucaaacuuagguuaucaauccuggggacaguaaucugcucagaauuuagggcucugagguuggucugcgucu

SEQ ID NO: 4128671 - RNA, 60 nt, Human
agaugucccugguggaggcuggcagccucauccugcagccagugucuuccaggggaggcu

SEQ ID NO: 4128672 - RNA, 96 nt, Human
agaugugaguguuguacauggaaaucuuccaggagggcauuucuuuuguucucauagaggcuugucuccuucuggggccauacaacucugacauuu

SEQ ID NO: 4128673 - RNA, 87 nt, Human
agaugugcaacaaugugaaggugcuuaaugccacugaacuguauacuaaaagugguuaaaaugguaaauuuuauguuauguauauuu

SEQ ID NO: 4128674 - RNA, 77 nt, Human
agaugugugcauuuuagugucucagacuaaauucgagaaucauuaguuuaaguuucagaagcuaagaagugccaucu

SEQ ID NO: 4128675 - RNA, 108 nt, Human
agauguuuaaagcacuuauaauaaugucuagguaauaguauagcuuaauaaauguuagauauuuuuauuuauugauauauuauuucuaacugguagguugcaacauuu

SEQ ID NO: 4128676 - RNA, 85 nt, Human
agauuaauuuuguugauuucuauugaguuccuguaauauuugaucaaaagcuagcaaaagcacaguagaaaaggaaaauuguucu

SEQ ID NO: 4128677 - RNA, 71 nt, Human
agauuacagcaugggaaugggauuuaggcucgucacauuugguugacugagcaauucuuaugcucugauuu

SEQ ID NO: 4128678 - RNA, 112 nt, Human
agauuagauucaccugugaagccuucgaaaguccugcugcuuaggccauauuucagaacaauuaaguuagaaucucuggggguaggacucaggccuuaguguuuuuauagcu

SEQ ID NO: 4128679 - RNA, 57 nt, Human
agauuaugcuggcugcuacaaguaaacagaauaugggaagugggaguuaguuagucu

SEQ ID NO: 4128680 - RNA, 75 nt, Human
agauucagggcaagucucagaagguucuggagcacuuuaaauccauaaaauauaaugagugcuuacucuguuucu

SEQ ID NO: 4128681 - RNA, 83 nt, Human
agauucaucaauggaucaaggauuccuaacccagauaauacuucuuguuccuauguuuagacuccuuggucuucugugagccu

SEQ ID NO: 4128682 - RNA, 92 nt, Human
agauucaucugcauuuuacaaaaugcuuuucaugggauuuuuuaauuuauuuacuuuaagucuuaggaaauagcaaagaugaagaugaauuu

SEQ ID NO: 4128683 - RNA, 61 nt, Human
agauuccuaguguuauuucuguccuuuggaauauuauccagcagagggaauuuuaggaucu

SEQ ID NO: 4128684 - RNA, 77 nt, Human
agauucuaaugguaucauggcugagauucaaucauggcaaaaucucggauuucucagucacaugaaccaaugaauuu

SEQ ID NO: 4128685 - RNA, 88 nt, Human
agauucuuccacugauucuuucuccaccaauucaugauaguuacauauauguugaagagguacaagaagaggauaugucagagagucu

SEQ ID NO: 4128686 - RNA, 93 nt, Human
agauugaaauucauagaucuccagcucacagauagcgugggauauuuccaaauuccccaaguuaauuuguagcugaaaauggaauuucagucu

SEQ ID NO: 4128687 - RNA, 72 nt, Human
agauugagaaaucggaugguugccaugucuguguagaaagaaguagacaugggagacuuuucauuuuguucu

SEQ ID NO: 4128688 - RNA, 72 nt, Human
agauugagaaaucggaugguugccaugucuguguagaaagagguagacaugggagacuuuucauuuuguucu

SEQ ID NO: 4128689 - RNA, 72 nt, Human
agauugagaaaucggaugguugccgugucuguguggaaagaaguagacaugggagacuuuucauuuuguucu

SEQ ID NO: 4128690 - RNA, 79 nt, Human
agauugauuccuacagagggcuaugagggagacucuguuccacuuuucucuucuagcuucuugugguuugcugcaaucu

SEQ ID NO: 4128691 - RNA, 87 nt, Human
agauugauuucaggagcugucgcuguguuuaugacaagaagcauauagagucauuuauagaagugggcaguaauucuccuguuaacu

SEQ ID NO: 4128692 - RNA, 65 nt, Human
agauugccaggaaauagugcugugaucuuacaaauuugagaguguaucuacuuucuggacagucu

SEQ ID NO: 4128693 - RNA, 130 nt, Human
agauuggguuaauagcacugccaccugguuuucuaguuugcaaugguaguuguugcuccaugacuauggagcaauaucuccauuacuuuugcagcuccaaccucaguuuuauaaguguuagcagcaaucu

SEQ ID NO: 4128694 - RNA, 59 nt, Human
agauugugcaguaaaguccuuuucauuuucccuggguaggacagugucuagcacagccu

SEQ ID NO: 4128695 - RNA, 56 nt, Human
agcaagucauccaggaugaugucggauauggugcugaucuucuuggccagcuugcu

SEQ ID NO: 4128696 - RNA, 57 nt, Human
agcaaucagcuucuuuguguuugaccaaugacggaugagcacaugguuuuguuugcu

SEQ ID NO: 4128697 - RNA, 57 nt, Human
agcaaucuccagaguaaccuuggagcaguaaucugaucucagauuguucugggagcu

SEQ ID NO: 4128698 - RNA, 77 nt, Human
agcaaugccauucacugaauuucaugauuauucccauucaaaaggaauaguuuuaaaaccucaggaagcaugugacu

SEQ ID NO: 4128699 - RNA, 79 nt, Human
agcaauuacugguccacagaaauucuaaaaccuagcuggguacauagcguuaguuucuggauuagggcucaggauugcu

SEQ ID NO: 4128700 - RNA, 100 nt, Human
agcaauuuggugugcaggacugcuggaauaaaugugaauuagagcuuugcgaugugaguaacacugugucuuuuuacauuuauccccgccaucaugugcu

SEQ ID NO: 4128701 - RNA, 67 nt, Human
agcacaaaagugguuucccaguucaguaguaacaacagcuaauauuuaugagcucccacuaugugcu

SEQ ID NO: 4128702 - RNA, 129 nt, Human
agcacaauuugcuaccaagacuaaugacuagacuucaguguugguucauuacgauuuuccugucaaaucaguguaugcaugaauauaauacagaugauccaguuuaacuugcauccaaauuccauugcu

SEQ ID NO: 4128703 - RNA, 56 nt, Human
agcacacagaauugauucacuguuaucaaaauugaaggacagugguuugaugugcu

SEQ ID NO: 4128704 - RNA, 121 nt, Human
agcacaggccacaccugcgucugcucacagcaaggcccugcaaccugacuugggucuuuuccccaagugauaguuggugcagccuaauugugaucagaugggggguuucacaggucuggcu

SEQ ID NO: 4128705 - RNA, 81 nt, Human
agcacagugauuggcagauagcaagugaaggaggggcaaggcugccaccacuucuggcuucuggugaaauuuuacuggacu

SEQ ID NO: 4128706 - RNA, 76 nt, Human
agcacaguguagacuaauaauagauaacuaguaauugaauaguacucuuucuguuaaugugucugagacuguugcu

SEQ ID NO: 4128707 - RNA, 64 nt, Human
agcacauucugccuugcuuugcauguaaaaguauagaauccaaaccuagggcaguaauggugcu

SEQ ID NO: 4128708 - RNA, 89 nt, Human
agcaccauuugaugguuugaggauucaugucagaauucaaauacaucucugaauucaaaugaauucuuaaauauaugccauuauguguu

SEQ ID NO: 4128709 - RNA, 129 nt, Human
agcacccgcagggccucgucuuccuccuggucggcacccuucuccagcagcaaagcugccggcuucagcagcuucuccugguacagaacugggccgcucaugaacuggaagggaggacauugggcaguu

SEQ ID NO: 4128710 - RNA, 92 nt, Human
agcacccucaggggcccuuuuucaccagcagugugcaucucacgagucugcucuugaaaaaguauuucaggcuccugcugggaagaugugcu

SEQ ID NO: 4128711 - RNA, 64 nt, Human
agcacgcaugguaaauccacugacuuugcuuuugaaagucaagugccaccaccauguaucugcu

SEQ ID NO: 4128712 - RNA, 59 nt, Human
agcacggggcgccggucaucccugagcugaugucagggcagccuaaggcaccucaggcu

SEQ ID NO: 4128713 - RNA, 55 nt, Human
agcacuagagccaaaauuugggcacauuucugucugucuccgaagccuacgugcu

SEQ ID NO: 4128714 - RNA, 85 nt, Human
agcacuagagcgugacagggucuggcuggucauccuuuaguagaugaccaguuaagucauccugucuacuuaguucuucagugcu

SEQ ID NO: 4128715 - RNA, 56 nt, Human
agcacugggaacgcauggggccggggggcuccccacagcucagcagacccagugcu

SEQ ID NO: 4128716 - RNA, 69 nt, Human
agcacugggcuggggcucauucuccaucacucacuguaaacguuggguccagagccucagcccagagcu

SEQ ID NO: 4128717 - RNA, 65 nt, Human
agcacuggggcagugggcagugguucccggcgugcaccggggcaguggcugcugccuccagcucu

SEQ ID NO: 4128718 - RNA, 61 nt, Human
agcacuguaguuauagcuaacauaaauaggcaacaaugaccggaaagcauggcacagugcu

SEQ ID NO: 4128719 - RNA, 129 nt, Human
agcacuguuccugucgauagcggcuggagggguauugaucccacucauaagcacacaggagcccacucgggcccagagucacaugggguguucaauaccccuucccgcuaaugagcagcagcuucaccu

SEQ ID NO: 4128720 - RNA, 87 nt, Human
agcacuuauagaagacugaacucuuguaguccauguuuuucacuuuacaugugaggaaacugggccucagguuaguuauuugguguu

SEQ ID NO: 4128721 - RNA, 66 nt, Human
agcacuuggauuugaacccagguaguugauaauucagauuucuugauaauucaaaucccauaugcu

SEQ ID NO: 4128722 - RNA, 57 nt, Human
agcacuuugggagauaaagcugauaauuaguaaagagcuucaaacccacuaagugcu

SEQ ID NO: 4128723 - RNA, 83 nt, Human
agcacuuuugucauugagaaaauaaguauggauaaauauugauuguuuuucuggaaaaugcuuucuuauuucaaaagucagcu

SEQ ID NO: 4128724 - RNA, 58 nt, Human
agcagaaauuaaguaaguaagggguaaauuuuuccuaaauuauauacuugguuucucu

SEQ ID NO: 4128725 - RNA, 87 nt, Human
agcagaaccacagcacuguugaggaacacccccuucagagcaacaaacagaacagaaaggcagucaguaacgggcucguguuuugcu

SEQ ID NO: 4128726 - RNA, 67 nt, Human
agcugagauuaugcucuucucaugguguaccaugcccaaugacugagcaagggccuaauaaguagcu

SEQ ID NO: 4128727 - RNA, 96 nt, Human
agcugagcaguacuucccugggcuggguuuacccucuucccaggccccagagauggaggaguccgacccuggcccaggaaguuccuggcuccugcu

SEQ ID NO: 4128728 - RNA, 56 nt, Human
agcugagcucaggcugauguaaucaugcaucccgggaaucagcccagagcccaguu

SEQ ID NO: 4128729 - RNA, 76 nt, Human
agcugagguggaggcagcucuggauaggaauuugggagaucugaaaacuggacucagugcugccauucccuuggcu

SEQ ID NO: 4128730 - RNA, 62 nt, Human
agcugaguauucugauauacaugacaagauaaugauuuugcagagagguuaggaacucaguu

SEQ ID NO: 4128731 - RNA, 108 nt, Human
agcugagugcuggccgcauugcucuggccucccugggauuucacauuugaucgcuuuucaguguggcugcaaaggaaggcugcaggagccauuuggugggcacuggcu

SEQ ID NO: 4128732 - RNA, 60 nt, Human
agcugcaagauuucuuuuguaugucugcaucugagauacaaugauuauuuugucuuagcu

SEQ ID NO: 4128733 - RNA, 57 nt, Human
agcugcaggguuucgccaguugugcaauacagccagccauaauacgaacccagcacu

SEQ ID NO: 4128734 - RNA, 58 nt, Human
agcugcccaauccugcagggcgagaacugaggaccuucaucucugcuaaugggcagcu

SEQ ID NO: 4128735 - RNA, 58 nt, Human
agcugcccagucuccucacucuggaaaguuacugaugaaugagaggcuuaaggcagcu

SEQ ID NO: 4128736 - RNA, 61 nt, Human
agcugccucagcaacacagaccagguaccaaguccugguacuuccaacacugaggcaggcu

SEQ ID NO: 4128737 - RNA, 62 nt, Human
agcugccuggagucauuuccugcaggaauuccaugucuucccauugaaguguuucagcagcu

SEQ ID NO: 4128738 - RNA, 56 nt, Human
agcugccuguguagaaccaucugcagcucuucagaaugggaaccacacaggcaguu

SEQ ID NO: 4128739 - RNA, 63 nt, Human
agcugccuucccucucauuaggguaugacuuauaggaaggagugacugauagggguggcagcu

SEQ ID NO: 4128740 - RNA, 87 nt, Human
agcugcucaucagaggaguccugugucuuccaggaaaagggcugacuuaguauuccugaugcacacagucauuuacagugagcaguu

SEQ ID NO: 4128741 - RNA, 65 nt, Human
agcugcucuucauuuccccccagcaaaacaagaggaaauggaugguggagaugguggagacagcu

SEQ ID NO: 4128742 - RNA, 97 nt, Human
agcugcugagccccucccuccagcuggcuggucugagcagucgcagcccagcugugggcucuaauggcagcagacagcaggcaggggcccagcugcu

SEQ ID NO: 4128743 - RNA, 64 nt, Human
agcugcuggauucagcccuuuucugugucccucagagagcuaugagaacugaaccagagcagcu

SEQ ID NO: 4128744 - RNA, 69 nt, Human
agcugcuggcacuggagugagcccauguaggacccuucugcccaggccaccuuccaguugccugcaguu

SEQ ID NO: 4128745 - RNA, 79 nt, Human
agcugcuggcagccaggaagcaguuagauggguuuucucagaaagaacuaagacagcauuccuggugaugauuguagcu

SEQ ID NO: 4128746 - RNA, 73 nt, Human
agcugcuuuggcaaaacuugcucuucuccugcaagauccaaaaagagaaccucaaguccuuugccaaagugcu

SEQ ID NO: 4128747 - RNA, 82 nt, Human
agcuggaagucugaauucaaagccgcuugggaaucagagugugaugagauaccggguugaguggcuuggacccagaguagcu

SEQ ID NO: 4128748 - RNA, 104 nt, Human
agcuggaggaccuugaugcaguuuugaaggcuguucuaggagagugggaauggaggguuccaucuuaucucuuagagcuccucugcccauucuucaaucuggcu

SEQ ID NO: 4128749 - RNA, 68 nt, Human
agcuggauggucuuggcagcauacaguuggauuggcagaaguaaucccaagggcugcuggcuucaguu

SEQ ID NO: 4128750 - RNA, 62 nt, Human
agcuggcaguaugacuggugacuggugaaucuaggaugaucucacucacaugccuggcaguu

SEQ ID NO: 4128751 - RNA, 63 nt, Human
agcuggccauugugaguggccuuccagcaagugcccauaguaaccacucggaaugugcuagcu

SEQ ID NO: 4128752 - RNA, 70 nt, Human
agcuggcuuuaugguuggcuaagggauucuucccgagucucacugcagccugccgaccaggaggccaccu

SEQ ID NO: 4128753 - RNA, 73 nt, Human
agcugggcagcggggaagccucagugacuggccccuaccuagacugggccauuuccccagcugccagccagcu

SEQ ID NO: 4128754 - RNA, 89 nt, Human
agcuggguauggcugagacaucauaguaugcugagaaaucuuccaaaugcaugugcuauagaugugaauuaaauuuuagccuucuaguu

SEQ ID NO: 4128755 - RNA, 69 nt, Human
agcugguguuuuauaaacgguguuugguggucuaagaaaccagucaccauagaauaaaacauauauguu

SEQ ID NO: 4128756 - RNA, 59 nt, Human
agcuguaagcaacagaaacauucuaauaagugauuuauuagaaaggcuauugcauagcu

SEQ ID NO: 4128757 - RNA, 78 nt, Human
agcuguagauuaggaguugggaggugaaaccaauaagcgguuuugugguucugggccaaucucuuaaucucugcagcu

SEQ ID NO: 4128758 - RNA, 78 nt, Human
agcuguauggcugcagagaccugaagaaggaaagcuuaaguccccuuuuugaucuuguuucuggggcuaugauaugcu

SEQ ID NO: 4128759 - RNA, 63 nt, Human
agcugucaaguucacaugcauccuugcuacccccaggugagcaaugccaagugaacuccugcu

SEQ ID NO: 4128760 - RNA, 58 nt, Human
agcugucaggcagaacugagcuucuuggcuucaaucugcucaguguggccugaguguu

SEQ ID NO: 4128761 - RNA, 95 nt, Human
agcugucuuccaucucauagggauagggcucugacucauuucuauuucugcagcucuuuggucaggagcucuucccuggugugacuagaauagcu

SEQ ID NO: 4128762 - RNA, 76 nt, Human
agcugugauguggagggugcugagacgggcuuugguaucaagugaggccauuaaucgucccuccugcuucacugcu

SEQ ID NO: 4128763 - RNA, 76 nt, Human
agcuguggacaaucaguuuuuauuaauguagcucgugauuacauuagcucuuuugguagacauuucuccugcaguu

SEQ ID NO: 4128764 - RNA, 102 nt, Human
agcugugguuucuucuuuacagauuuagagagagugaagaaccccuaauacaaaacuaaagaaugcauuauggaauaaccuuucugaaauuguaucauagcu

SEQ ID NO: 4128765 - RNA, 100 nt, Human
agcuguguaaguggaggguguaccacuguauaagcaaaaugaaauauaagaauguucucaaguauguacguggcacaaacguaacuucauaugcacaacu

SEQ ID NO: 4128766 - RNA, 77 nt, Human
agcugugugaccuuguucagauugaccccuguuuuugagauauuucaucuggaacaagguaauaauagaacauagcu

SEQ ID NO: 4128767 - RNA, 75 nt, Human
agcugugugucaggaggguauuuuuggccuuuaguaugucgucuaaguugcuagugcuuuucugagauuguaguu

SEQ ID NO: 4128768 - RNA, 59 nt, Human
agcuguguuuuguuaacuuuguacauaggaucuucuuuagcaacuagggagacacagcu

SEQ ID NO: 4128769 - RNA, 78 nt, Human
agcucuucguuuucuuugugggaaccgugugggacaagaaagcccacaaguccuaauuuuaggaggagaggggagacu

SEQ ID NO: 4128770 - RNA, 72 nt, Human
agcucuucuagcauaaacucuucugugcaauuuagcugcaccgaggaaacgggaguuuuucuggaagggacu

SEQ ID NO: 4128771 - RNA, 62 nt, Human
agcucuucuagccagcacauacuucuaucauccuacaagucuggggucugguagaacgagcu

SEQ ID NO: 4128772 - RNA, 56 nt, Human
agcugaaucuugacuaggaagaacuuauuccuuucuuucuguccuuuccaucagcu

SEQ ID NO: 4128773 - RNA, 68 nt, Human
agcugagccagcagcaacaggacagacuauaauuaugacaaguuacauccuguuguccuggcucaguu

SEQ ID NO: 4128774 - RNA, 63 nt, Human
agcugagcuaguaguuccagugccuagcacuacacccaaaggcgcaaaccacucgcucuaguu

SEQ ID NO: 4128775 - RNA, 70 nt, Human
agcugaggccagugaggucaagucaucucccuaagccaggcuggagcuggcucugcacccaggccucgcu

SEQ ID NO: 4128776 - RNA, 55 nt, Human
agcugaggccugauuucgccguggcugggggcuggggccggaguugggcccggcu

SEQ ID NO: 4128777 - RNA, 76 nt, Human
agcugaggcgguuggaucaccugaggucaggaguucaagaccagccugaccaacguggugaaacccugucucuucu

SEQ ID NO: 4128778 - RNA, 77 nt, Human
agcugaggcguauggaucaccugaggucagcaguucaagaccagccuggccaacauggugaaacccccgucucuacu

SEQ ID NO: 4128779 - RNA, 67 nt, Human
agcugagggaaaacauuuggagcacagauugcaaagcaccugaauuugaaauguuuauuucuuggcu

SEQ ID NO: 4128780 - RNA, 87 nt, Human
agcugagggccucagaggggaugcuuggagaagcugaaaaauccacaagcuguucucugaaauuuccuccccuggggcagccucacu

SEQ ID NO: 4128781 - RNA, 69 nt, Human
agcugauaaucaugcauggcuauuaugaggcagaaggugggaccuucuguccuuugcuaucaaugagcu

SEQ ID NO: 4128782 - RNA, 84 nt, Human
agcuuucuccagagacuugcaugugcuuggauuaacaaacuugcgauccagggaugcuaagcaggugccuucugugaccaagcu

SEQ ID NO: 4128783 - RNA, 68 nt, Human
agcuuucuuuuuacagucauggucacucauagcuacaaucuaugagaggauauuuugggaggauugcu

SEQ ID NO: 4128784 - RNA, 75 nt, Human
agcuuugagaagcucaugucuuacuuggauaaugaucaucugagcagguucccagagauagagcuguacgaggcu

SEQ ID NO: 4128785 - RNA, 61 nt, Human
agcuuugaucuagggaggaaggccauaggaagaugugcagucauaaacuaguaucaaaguu

SEQ ID NO: 4128786 - RNA, 63 nt, Human
agcuuuggagcugggugaaagagcuggucuuaaccauggaaucuggagcccgucucuuaagcu

SEQ ID NO: 4128787 - RNA, 57 nt, Human
agcuuuggauuucuuauagcccaccgaagugugugugguuauaagcuggccagugcu

SEQ ID NO: 4128788 - RNA, 100 nt, Human
agcuuuggguguuuucuaagcacagagggacauuccuacuagagcugcacaagucucagcccaagcaggaguguccccuggcuguuagaaagccagagcu

SEQ ID NO: 4128789 - RNA, 93 nt, Human
agcuuuguuuaacgaaguaacauuuugagcaguaggcuuuaucaauaauuuguuaggccuaagauaaagugauacucuguauuaggcagggcu

SEQ ID NO: 4128790 - RNA, 75 nt, Human
agcuuuguuucucuuuaaggugauuucugcuacuaauaagccauaguauggaaauaucuuggaagucaagaggcu

SEQ ID NO: 4128791 - RNA, 80 nt, Human
agcuuuucagcaucccucuguugcagugauuuuagauaaacgucaauccuauucauacaaggaggguguucaaagaagcu

SEQ ID NO: 4128792 - RNA, 64 nt, Human
agcuuuuccaaaugagcagaacaagcauauugggcuauuguagguauuuguauuugggaaaguu

SEQ ID NO: 4128793 - RNA, 81 nt, Human
agcuuuuccuaugaaagucaauccccaaguguccccuaaaacaugaggacaggggaauuuacugucauuaagcagagagcu

SEQ ID NO: 4128794 - RNA, 58 nt, Human
agcuuuucuauguauuauauccaggaaauauuucuggaaggguacauaggaaacugcu

SEQ ID NO: 4128795 - RNA, 58 nt, Human
aggaaaacaauauugagagcagccugugaccuuucuggcagcuuucaauuucuuuccu

SEQ ID NO: 4128796 - RNA, 67 nt, Human
aggaaaagggguucccaacuccuccugcagaaauaauuuucaugggaccuggggacuccuuguuccu

SEQ ID NO: 4128797 - RNA, 77 nt, Human
aggaaaagucauuuguauauacccuuuauuaaaaaauuagacaauaaaaguauguguguaugaauggaucugauccu

SEQ ID NO: 4128798 - RNA, 59 nt, Human
aggaaacaggagggcuagagagauagcgcucaaguuuucuuucacagucccuguuuccu

SEQ ID NO: 4128799 - RNA, 55 nt, Human
aggaaacaugaaucugccuugaagggauguguccccaaugcauuucauguuuccu

SEQ ID NO: 4128800 - RNA, 123 nt, Human
aggaaacugagguuccaaaagcuaagugaauggaugaacaagugguagggucaggauuagaauccauguccaccugaauccaaaaccagugcauuuuccacuaggcauguggcucauuuuccu

SEQ ID NO: 4128801 - RNA, 70 nt, Human
aggaaagaagaguucugcaugacuaugggucacacuuaacucuaucaaacacuuggaacucauuuuucuu

SEQ ID NO: 4128802 - RNA, 101 nt, Human
aggaaagacuggagcuaaggcaagauggaauggcucccugccccaggcugcccugggcuaaggggcagugccaguccucccugcagggcuccagagagccu

SEQ ID NO: 4128803 - RNA, 76 nt, Human
aggaaaggaacaagauaguccccugaguugccauguaaucucuauuuaggcuucuggaauacuaaguuccuuuccu

SEQ ID NO: 4128804 - RNA, 76 nt, Human
aggaaagguuuggcuuuucaguagaugaugaccaauaauuuaccaucucugcugagauaaaggcaaauuuugcacu

SEQ ID NO: 4128805 - RNA, 61 nt, Human
aggaaagucuuguguagaugucucuucaaagaaugagaagacuucuccaacaagcuuggcu

SEQ ID NO: 4128806 - RNA, 76 nt, Human
aggaaaguguggcuaguuggcagagaacagggugaacucaguuggcucccaaaauggcuacugaauuaauuuucuu

SEQ ID NO: 4128807 - RNA, 93 nt, Human
aggaaaguucugggcauguuacauucugucuuuuacauucuguaacuacaaauagcaguaauagugcaugcuaagaaaauaaaugacuuuccu

SEQ ID NO: 4128808 - RNA, 114 nt, Human
aggaaauaacuuggaggauacuggugggggcuauacguuuggugaaauccaucagugauauucaagccaagcaaauaaucacccacuaauuuguguuuuccacuuaaaauucuu

SEQ ID NO: 4128809 - RNA, 79 nt, Human
aggaaauaguugaucaauuuucuuuggcuuucauaaucuuaaauuuagaucaagucagagaaaugacaauauauagccu

SEQ ID NO: 4128810 - RNA, 64 nt, Human
aggaaauauuucacaugugggaaacauaagugaaagcauuauguguuucacugugcaguaaccu

SEQ ID NO: 4128811 - RNA, 55 nt, Human
aggaaaugccgcggcucucuuuaggccuaggguuggcuacaauguggcauuuccu

SEQ ID NO: 4128812 - RNA, 64 nt, Human
aggaaauuaacccaggcagcaggagcuaaaggacaccaaaccagcugccaagccuggguuuccu

SEQ ID NO: 4128813 - RNA, 104 nt, Human
aggaacaaauaagauagauaguacuccaaaacuugucaugcagaaucuuuauguuccuucuugagacucucugguauuggcaaguuuuauacuauuaauuuccu

SEQ ID NO: 4128814 - RNA, 83 nt, Human
aggaacacaggguaggaaguguuagagaauccugagucuaaacaggccuaagagaucucuagcacuuccuguacuggugucuu

SEQ ID NO: 4128815 - RNA, 65 nt, Human
aggaacagacuccauuaccuggcuuuauaaaaaggucaagaguaaauuuggguacaccugucucu

SEQ ID NO: 4128816 - RNA, 83 nt, Human
aggaacaggaggcaggaaaggaagagaauccuucucagacaauggugcugcagggccccuuuuucccugagcuccugaauccu

SEQ ID NO: 4128817 - RNA, 60 nt, Human
aggaacaguaguggucaauaugccaggguccacacuguaaaucagccagcuacugucucu

SEQ ID NO: 4128818 - RNA, 59 nt, Human
aggaacaucucagucaaacccagcacugugagguguuggcaggaaaugagaauguuccu

SEQ ID NO: 4128819 - RNA, 59 nt, Human
aggaacauucucauuuccugccaacaccucacagugcuggguuugacugagauguuccu

SEQ ID NO: 4128820 - RNA, 60 nt, Human
aggaacccggucugucacugugccuugugcuuaggaggugcucagugacucuggcuucuu

SEQ ID NO: 4128821 - RNA, 57 nt, Human
aggaaccuagaaauuaccuaaccuauuucccaaauagggcuguaccaucagguuccu

SEQ ID NO: 4128822 - RNA, 64 nt, Human
aggaacucugucuccagaguugaauguugaauuccuauucucaaagccagagucaacguguccu

SEQ ID NO: 4128823 - RNA, 62 nt, Human
aggaacugucauuggggacaucagccaggaggcuauugauaauagaccaagugaaaguuuuu

SEQ ID NO: 4128824 - RNA, 64 nt, Human
aggaagaagccugcuguuagugugaacucuauuugaacuaggugugacagcagguuucauucuu

SEQ ID NO: 4128825 - RNA, 56 nt, Human
aggaagagaaaggcaaggaguuuugugaaugccaaaauaauggccuuucucugcuu

SEQ ID NO: 4128826 - RNA, 84 nt, Human
aggaagagaagacauguggauucuaguuuccucauuuccauacuugauuaugaggccaaauugaguauuuaugacuugccuccu

SEQ ID NO: 4128827 - RNA, 78 nt, Human
aggaagagcaucaggucauguuuuuugagaacuaacuaccugcagaggcagcaauaaacauguuugaugcgcuugccu

SEQ ID NO: 4128828 - RNA, 76 nt, Human
aggaagagcuuaaaguuguaaauuagagaaaguuuggcuuuugcuaucucugaguuauuucuuuguccucugcucu

SEQ ID NO: 4128829 - RNA, 65 nt, Human
aggaagaggguaggaucuagcaugcaggccauagcuugcugaacccugcccucuaauaaauuccu

SEQ ID NO: 4128830 - RNA, 79 nt, Human
aggaagaggguuggaguaggcuaggaauaggagcacaaauuaaagcuccuguucacuuugacuucuccaucccucuccu

SEQ ID NO: 4128831 - RNA, 105 nt, Human
aggaagaguuuuuuuggccucucuggaaagauuuacacggggaaagaauguucucuuccucauuuuguuaauuuuacaucagcaaccagaaugaaucucuccccu

SEQ ID NO: 4128832 - RNA, 113 nt, Human
aggaagauaaugcuauuauguugaaccauaugaaauugucauauuuuauaggucagaaaugguugaaucuuggcaguuucaugugauucaacugaauacuauugcauuuugcu

SEQ ID NO: 4128833 - RNA, 59 nt, Human
aggaagcaauguugaagaauuuguuugaaaaccagcacaggcucuuaaucagugcuccu

SEQ ID NO: 4128834 - RNA, 66 nt, Human
aggaagccaggcccuuggguggugccaucacgagccuucacuggugcugcaccagccuggcugccu

SEQ ID NO: 4128835 - RNA, 85 nt, Human
aggaagccgagguggccuugagugggggugaggggucacugcuggccccagcccuggaccuuagcccccacgccugguggcuccu

SEQ ID NO: 4128836 - RNA, 84 nt, Human
aggaagcgguaucugaauggcugagagagagacuggagcaaggacaaaguggcauuucucugccucagcuucugccgcagaccu

SEQ ID NO: 4128837 - RNA, 78 nt, Human
aggaagcuccagaggaugcaggugagggccaggcccagggcagagacccucuugccugucuccugguuugaugcuccu

SEQ ID NO: 4128838 - RNA, 76 nt, Human
aggaagcugaucucacuucuuaggagacugaaaaaaauacaucugugucauucuccucuggaaaaggcagucuccu

SEQ ID NO: 4128839 - RNA, 81 nt, Human
aggaagcuuauuuuauaggagaacucuuaaaguugcugaauguguuuacaaugcuugguuuuucuagaaacuugucuuccu

SEQ ID NO: 4128840 - RNA, 67 nt, Human
aggaagcuugcuccuaccucauagcaggcuuaucagaggcuguuuauagcagagcaagccucuuccu

SEQ ID NO: 4128841 - RNA, 94 nt, Human
aggaaggaacaaagucuccaggcuuaaucucagcuucucagaauucugagaagccgcaguucugggccuggguuucugcuuucccauccauccu

SEQ ID NO: 4128842 - RNA, 123 nt, Human
aggaaggacagaguguuuccagacuccauacuaucagccacuugugaugcuggggaaguuccucuacacaaguuccccuggugccacgaucugcuucacgagucugggcauguccugacuccu

SEQ ID NO: 4128843 - RNA, 85 nt, Human
aggaaggaggauguaauguuugcuuugcagaaguaacucuuacagagauuugcagccuagacauucuggucaucauuaccuuccu

SEQ ID NO: 4128844 - RNA, 83 nt, Human
aggugucagauagugacuguggggaauuuuugagggagcuaacuggagaugaaucauuccauggucaugauuucugcauaucu

SEQ ID NO: 4128845 - RNA, 61 nt, Human
aggugugucuuuggcgaugucuggacagcucuguccauuagagaugcuaaaggacaucccu

SEQ ID NO: 4128846 - RNA, 89 nt, Human
agguuaaagggugggauggcacagguaauggaggauagugguucuggauagugcuucuggcuuaucucgugccuucccaucuguuuccu

SEQ ID NO: 4128847 - RNA, 76 nt, Human
agguuacaggcuagcugguucuucugcucggugucucaccaggcugaaaucuagggaccagcuagggcugugaccu

SEQ ID NO: 4128848 - RNA, 81 nt, Human
agguuaugauaaguaucaaaugguagcauauguauaaagcaguacauaaauguaagauacuauuuugauauuuuauaagcu

SEQ ID NO: 4128849 - RNA, 70 nt, Human
agguucaaguguaagagggguuaaauuuagccuuuuagagcugaaaccccagauuaccacaaaugggccu

SEQ ID NO: 4128850 - RNA, 78 nt, Human
agguucaauaacauccuuugguuccaaaacaaggucucuugagccucccuuuguugcaagggaaaagucacugaaccu

SEQ ID NO: 4128851 - RNA, 67 nt, Human
agguucagaggucagcagcuugcccaaagugcucaacuaguggguagcagggcugagcugugagccu

SEQ ID NO: 4128852 - RNA, 66 nt, Human
agguucaugcuauguaaucaugagaaguaaaguuuaugaagacaaugauagcaugaaaaaaugccu

SEQ ID NO: 4128853 - RNA, 55 nt, Human
agguucccaguuuucuuaggggagaaauccuggcagagguauauugggaggaccu

SEQ ID NO: 4128854 - RNA, 77 nt, Human
agguucguuugcaaaagcaauugcaguuuuugcaauuacuuuaauggcaaaaacugcaauuacuuuugcaucaaccu

SEQ ID NO: 4128855 - RNA, 93 nt, Human
agguucugguugguuaagaguuuugugucaaguucuuuuaguugcaaacaauggaaacuuaucugacacgaaccuaaacacaaaagagaauuu

SEQ ID NO: 4128856 - RNA, 72 nt, Human
agguucuugggguuccacaaugggaacugcuuguuugguuuuucgcuuccucggcugggccccaggcuuccu

SEQ ID NO: 4128857 - RNA, 102 nt, Human
agguugaugggagaaauguguauaauaaugugagcuaaaguacauuagaaacuauagcgugccauuauauacauuugcucauuugauuucucccaauggccu

SEQ ID NO: 4128858 - RNA, 64 nt, Human
agguugcccugagaagacuucauaacacagggcugucacucauaagcucuucucagggucaccu

SEQ ID NO: 4128859 - RNA, 64 nt, Human
agguugcgcauucuaguuuugcacaccuuucccucuccucgcauguccuggagcuguguaaccu

SEQ ID NO: 4128860 - RNA, 59 nt, Human
agguugcugugcugcuaggcagaggaguugugaagugaaacagagcacagcaugcaccu

SEQ ID NO: 4128861 - RNA, 101 nt, Human
agguugcuguugaaauguuuggagucuccuucaggauaugugauaucugaaaucuuucagguuuugugucaugagguuugagucucauuugucuguaagcu

SEQ ID NO: 4128862 - RNA, 62 nt, Human
agguuggaaaaauucagacugugcuccaucuugaggccaggaagcuggguuuccauacaccu

SEQ ID NO: 4128863 - RNA, 76 nt, Human
agguuggccaugaacucgggcauggagacgguguccaucagcacgaagucugccuugccgaauuccaggcucuccu

SEQ ID NO: 4128864 - RNA, 76 nt, Human
agguuggugccaaaguaauuacgguuuuggccauuauguucaaugacaacaaccacaauuacuuuugcaccaaccu

SEQ ID NO: 4128865 - RNA, 71 nt, Human
agguuucugcaauguguguacacuggagccauuagaacgaagacccagacacacgaugcgugcagaagcuu

SEQ ID NO: 4128866 - RNA, 74 nt, Human
agguuugggcuucuguuccuuucacuugcagucagacauggaguuagugguagaaggaacagaagggguaaccu

SEQ ID NO: 4128867 - RNA, 81 nt, Human
agguuuguauugcuugagaaguuaguggagggagaauauucagggcucuuuaucaucuuguuuuuaaagcuaaauaaaccu

SEQ ID NO: 4128868 - RNA, 76 nt, Human
agguuuucccacauucauugcauucguaggguuuuuccccugugugaguccauugauggauagugaggaaugacuu

SEQ ID NO: 4128869 - RNA, 113 nt, Human
agcuaagccugcaaucggcagaaccuacaauacagauugcuauacuuacaagucugauuugugacaacuguggcaucugauuguguuuucuagauuuagcagcuucucuagcu

SEQ ID NO: 4128870 - RNA, 102 nt, Human
agcuaauaaucuaugagccauaauuucccaagagauugaaaguauguaugaaguuaaaacaaguacuuuuaaaguggcaaauuagguaguagaguuauuacu

SEQ ID NO: 4128871 - RNA, 64 nt, Human
agcuaaugaugagauacagauaguauaugcaccaugaaaauguuugugucuuauccaugagacu

SEQ ID NO: 4128872 - RNA, 57 nt, Human
agcuaauugagugcuuagugacuuguucuccaaggucauaaagauacuaagugaguu

SEQ ID NO: 4128873 - RNA, 80 nt, Human
agcuacagaacuaugagaaaauaaauaucuguuguuuuagccacagcaucugugauauuuuguuauggcaaccuguagcu

SEQ ID NO: 4128874 - RNA, 87 nt, Human
agcuaccacugugcaguugguucugucaaagucucauguuacagcugauuaacuggcugcuucugacagggccaaacaugacaagcu

SEQ ID NO: 4128875 - RNA, 125 nt, Human
agcuaccuuggcaaugcaggaugucacauuuucacgguauucacgaacauggaaugggagccuccaauuucuguaaucaagauauuugagaguugaugugcccaagguccucucuuuaaucagcu

SEQ ID NO: 4128876 - RNA, 79 nt, Human
agcuacgcauuucucuuccaguaagagucuuuaaaucaucaauauuuggaauucuuucucgaaguugguguggguggcu

SEQ ID NO: 4128877 - RNA, 56 nt, Human
agcuacuggagaacacaaaaccuugucugguuugguucaguguauccucaguggcu

SEQ ID NO: 4128878 - RNA, 79 nt, Human
agcuacuguugucuuaucaagggaggaaaaugagcaaacucaccgguuuauacuucuuugaaaaaggcagucaguugcu

SEQ ID NO: 4128879 - RNA, 68 nt, Human
agcuacuuauuuuuagaaagugaauucugagauuaagcuuagcauuuauuucuuagaaauugcuugcu

SEQ ID NO: 4128880 - RNA, 91 nt, Human
agcuaguguaucauagacuuuccacucuaagaacacaaaggcccagagcagcagcucuggcuuagaguguaguggugauuucccgcuggcu

SEQ ID NO: 4128881 - RNA, 56 nt, Human
agcuaguguuuucuaauauguuuauuaauuuguuuguaucagaucaaauacuggcu

SEQ ID NO: 4128882 - RNA, 78 nt, Human
agcuaugagccgagagcuuuccugacgguugagugguccuuugcaaucagcaguguuuucacccacagcucacuggcu

SEQ ID NO: 4128883 - RNA, 69 nt, Human
agcuauucucucugugucucauguuccuauuucguaaaauaggugcaucagcacagggucaaaauaccu

SEQ ID NO: 4128884 - RNA, 63 nt, Human
agcuauugcugaauguuggcauuucaugcaaucuggaaauaucaguauuuuaagcagugaguu

SEQ ID NO: 4128885 - RNA, 71 nt, Human
agcuauuggacacaauguugccuuagggcccacaggcagggccuguguguggagcauugugucuucaugcu

SEQ ID NO: 4128886 - RNA, 72 nt, Human
agcuauuuucaggacucucagaggcugaacucugcacaaaagggguagcagcacagaaagccuggagauacu

SEQ ID NO: 4128887 - RNA, 84 nt, Human
agcucaaagcacaucauguuguucagaccucagcuguuucuccuugacagaaggaagucuguccaggugaaugcuucaggagcu

SEQ ID NO: 4128888 - RNA, 74 nt, Human
agcucaauugacuacguccaugcaaagacuaaagaaauuuaguuuaacuuuguaaacgugaggcuugguuagcu

SEQ ID NO: 4128889 - RNA, 69 nt, Human
agcucacuaguugugagagaaaauguguauauggguauucaugugugcacaugcucuuaccuagaugcu

SEQ ID NO: 4128890 - RNA, 99 nt, Human
agcucagcgugggccccuuauaugcacugggugaggaaggagaaguuucuucuaaacgcagccauuucucucuuucuuucucugugcaccagcaaagcu

SEQ ID NO: 4128891 - RNA, 84 nt, Human
agcucaggaagggaggggagacagggaaaucaguuagaggcugacuaggauuuugcuuugucuuccgucuggauugcaggagcu

SEQ ID NO: 4128892 - RNA, 61 nt, Human
agcucaggcagauuugcugcccuccaucaaugcugguggaggaaaccaagucggcccugcu

SEQ ID NO: 4128893 - RNA, 114 nt, Human
agcucaggguggggagaaaucaggguucccccagugccaucuaaucaguggugaugcaccagcugcccucgcuggggccagaucccuggcuucuuccugcaugaucccuaggcu

SEQ ID NO: 4128894 - RNA, 55 nt, Human
agcucaugguucgcugcagaggcgucgucccagaccagcucugcagugcauggcu

SEQ ID NO: 4128895 - RNA, 67 nt, Human
agcucauucauaaaaauuaguuggcagcuaaucuuugcaugcuguucucugaacuugagugaaagcu

SEQ ID NO: 4128896 - RNA, 72 nt, Human
agcucauucgcacuggucuagacccguccagugagcugggggcaggucuugaaggugugauuugcaugagcu

SEQ ID NO: 4128897 - RNA, 80 nt, Human
agcuccaacaacaagcugaggcuuagcuaaaaauuuucucuaaagcuuuuuggagaguuucauucuuguuuuuacuggcu

SEQ ID NO: 4128898 - RNA, 78 nt, Human
agcuccagauuaacacggagcuuaacaugagagagaaaugaacuacguaucuuauuugagccauuguuauuuugggcu

SEQ ID NO: 4128899 - RNA, 71 nt, Human
agcuccagggaaagaguggaucaguaguucaaauauacuuauuccuuucugucuuuacucuggacauagcu

SEQ ID NO: 4128900 - RNA, 130 nt, Human
agcuccagugggaggcgggagauuucgcgcccagcuccauccugucuguggccucaggcuugcuuagucucugccaccaugagaugggcaguggucuggguggcccccuuccucucuccuccuggcugcu

SEQ ID NO: 4128901 - RNA, 56 nt, Human
agcuccaguuacuuaccuagagucaccugugauguaaguuagugaguaauugagcu

SEQ ID NO: 4128902 - RNA, 64 nt, Human
agcuccaugagugucaucucagcagcuccgaccuuggcggacugcaugugaccacuguggugcu

SEQ ID NO: 4128903 - RNA, 70 nt, Human
agcucccaggguagaugaccaagccucucaaaaggacacaggacuuuucaucagcuauccugucacagcu

SEQ ID NO: 4128904 - RNA, 76 nt, Human
agcuccguccaugcggcucuuuccaaaccggggccguuuuugccuggcuucucugguguggacuccgcgcggagcu

SEQ ID NO: 4128905 - RNA, 65 nt, Human
agcuccucuuucagcuaauuagauauuguucuacaaauugggcuguugucucugaaagaugagcu

SEQ ID NO: 4128906 - RNA, 62 nt, Human
agcuccuggggguuccaagcaggagcucccucuccuguguccuuucuaaugcccagagagcu

SEQ ID NO: 4128907 - RNA, 58 nt, Human
agcuccuggugccucagccgaacucccuugcagaagagcugcuguggcacccggagcu

SEQ ID NO: 4128908 - RNA, 71 nt, Human
agcucuaaauggaauuuugccuggaccugggagucuucaaaggaauaggaggaaaaauuguggauagaguu

SEQ ID NO: 4128909 - RNA, 58 nt, Human
agcucuaucaccugucaguugccauugcuaauaaaaauagcaucugcaugaugggguu

SEQ ID NO: 4128910 - RNA, 72 nt, Human
agcucuauccaaaguaccccgggcauagacaggguccucgggagcugaaguccucgcggugcuaaggaugcu

SEQ ID NO: 4128911 - RNA, 55 nt, Human
agcucuccaucuaucugugaugacagacucauuaaagaauaagauggaguuggcu

SEQ ID NO: 4128912 - RNA, 69 nt, Human
agcucucuagauacacacacagucaugugugcacaaacaugcauguguauguguauuuguaaggaggcu

SEQ ID NO: 4128913 - RNA, 59 nt, Human
agcucugaaaguuaugucgccggcuuugaccagcccagcccagcaccucucucaggguu

SEQ ID NO: 4128914 - RNA, 65 nt, Human
agcucugggggaaagucugcuccaaguuguuucauacuguuggcagaauuuaguuccuugagacu

SEQ ID NO: 4128915 - RNA, 83 nt, Human
agcucugucaagcaauaauuaccuagagcugcugagcguuugacccaagggccaagcagucugcuaggaguuuaagaagagcu

SEQ ID NO: 4128916 - RNA, 94 nt, Human
agcucuucucuacaccuucacaaaagguuuauugcuaugguuguuuacugagacccaaggcagagcagggccaguggagucaaagagaugggcu

SEQ ID NO: 4128917 - RNA, 80 nt, Human
agcucuugauccagaacagaccugccugaccuggggccacuguaccccacuuggagccaugguguguucaucaggaagcu

SEQ ID NO: 4128918 - RNA, 61 nt, Human
aggcuacugucucuuucuucccaaaauauucuguuuugguaauuaaguagauauuuggccu

SEQ ID NO: 4128919 - RNA, 77 nt, Human
aggcuagaguaguggcgugaucucggcucacugcaagcuccgccuccugagcucacgccauucuccuuccucagccu

SEQ ID NO: 4128920 - RNA, 62 nt, Human
aggcuagauagagggucaucuuaguauuaauuuuaaaaaaagauaccugcauauuuaugccu

SEQ ID NO: 4128921 - RNA, 80 nt, Human
aguauuuacuggauauggcagacaaaauauuguauguucauaaaauguuuccagguucuuccuauguccauaggaauacu

SEQ ID NO: 4128922 - RNA, 67 nt, Human
aguauuucauaauagaagccgcuggguuguugaacucagaaagcccuguuaacuguuuugaagugcu

SEQ ID NO: 4128923 - RNA, 122 nt, Human
aguauuuuaaaagugggaaaauggucaaagaaacauuugaaauaguucauucuuguaauuuuuugucccaagacugugcuauuuuaaaaaguaucugcugucaucuucaccuuuugaaaacu

SEQ ID NO: 4128924 - RNA, 104 nt, Human
agucaaaacaguaaggcacuagaauuagcugggcagauuccugaagcagauucagguggauaagaguuuaguuaauguauaguauugccucuguuuaagaggcu

SEQ ID NO: 4128925 - RNA, 60 nt, Human
agucaaaacgaagacacuuuugaauacuuaguguauuuaucugugggaguuguuuggauu

SEQ ID NO: 4128926 - RNA, 61 nt, Human
agucaaauaucuuaaaaggcuaaagugaaauugucaucucguuuguuucugauauuugacu

SEQ ID NO: 4128927 - RNA, 76 nt, Human
agucaacagcaaauucuagcaugaucuugauguucauggucaagauaugugccaauuguuauaauaugcuguugcu

SEQ ID NO: 4128928 - RNA, 64 nt, Human
agucaacauuuucauuagcuauuguuaauguuguuguuaacaauggaguuuugagaaaggggcu

SEQ ID NO: 4128929 - RNA, 80 nt, Human
agucaaguaugacaccauugcuagaagcuuucuauaacccaauguaagagaugcaggguacauggaaucaugauuugacu

SEQ ID NO: 4128930 - RNA, 60 nt, Human
agucaauuucagaucaaaauuccuucuaccuacaagggucugagguuucugaagugggcu

SEQ ID NO: 4128931 - RNA, 74 nt, Human
agucaauuuuauuuuguucuggagagcguguauuuuaaaacccguuugcuuuuccuuaacuguuaagauugucu

SEQ ID NO: 4128932 - RNA, 63 nt, Human
agucacaauaccgugugucaguauguguuucuccacagcuaugauaauuucgguauuugcacu

SEQ ID NO: 4128933 - RNA, 65 nt, Human
agucacacagacauaaaucaccaaaccauugcuguggcuacagugcuuuaugaucugcugucccu

SEQ ID NO: 4128934 - RNA, 61 nt, Human
agucacacagggccuccaaaucagaaggguacugccucugguuuaauacucugcuguggcu

SEQ ID NO: 4128935 - RNA, 77 nt, Human
agucacaggggacuguacgucauugaaggccauuuguaacaaccuggcaagguggcguauggaaauacccugcgauu

SEQ ID NO: 4128936 - RNA, 55 nt, Human
agucacauagaaguggguuuaaaugucaguugaguaacucacuugcugugugacu

SEQ ID NO: 4128937 - RNA, 68 nt, Human
agucacaugcaguuuuccagcagucuguuauugcauaaauccagacaggcugcugaagugugugugcu

SEQ ID NO: 4128938 - RNA, 65 nt, Human
agucaccagguuuuagagaccugcuaaaaggauggcaauguggucuaucugcaaucugaguuauu

SEQ ID NO: 4128939 - RNA, 59 nt, Human
agucacuuccagacaccugccuggugcccaggugugcacugaggcaggcuggagugacu

SEQ ID NO: 4128940 - RNA, 61 nt, Human
agucagaaguugcuuccaggcugauucuaaauaaaucuaccagggaaaaucaacuucuacu

SEQ ID NO: 4128941 - RNA, 60 nt, Human
agucagaauucgaucccaggucuaccagacaucaaaaccugggcgcuugaccucugcacu

SEQ ID NO: 4128942 - RNA, 65 nt, Human
agucagacagaaggaaggccaacaucugacugagugcagaugcuggcugcuucuuucucuccacu

SEQ ID NO: 4128943 - RNA, 65 nt, Human
agucagacugacugcaguguggucauuuuucuaacccauaacugcucacacugcagcagucugcu

SEQ ID NO: 4128944 - RNA, 111 nt, Human
agucagaggauucaaagucccauuauuucuggcuuugagggugaugggaauuagccuagauuuaucgccucucagagccaguagugaaaugaaggccuuaauccuaugacu

SEQ ID NO: 4128945 - RNA, 91 nt, Human
agucagcguauauuuuaaguguuuaaauuauuugcagggauuuuugacagucuaaaauugcaucuugagcacuugugauaaucgcugugcu

SEQ ID NO: 4128946 - RNA, 56 nt, Human
agucaggagauauuuugauauguuuauuucaaaucaaaauccuugucucccugacu

SEQ ID NO: 4128947 - RNA, 85 nt, Human
agucaggcaguagggagaugcuucugcguagauugcccugcaguuccuuucaagaucuacacagaggcagcugucugcucuggcu

SEQ ID NO: 4128948 - RNA, 58 nt, Human
agucagguaggcaucccaggguucaucugucacuagauauggaccugugcccauggcu

SEQ ID NO: 4128949 - RNA, 71 nt, Human
agucaguauagcuaaaaguuugucaauauuuucuaauccuuucagaggacaaauuuuugguuuuauuuauu

SEQ ID NO: 4128950 - RNA, 56 nt, Human
agucagucugcuagccuguggagggaccuucauccagggcaugcucagacucagcu

SEQ ID NO: 4128951 - RNA, 122 nt, Human
agucagugucuguuaugaauucauuggaaauagcaaugugaaaagaggaaugaauauuguagauuucuuucauugucauauuuguaaauuacugggugggauuuauaaacaaauuauugacu

SEQ ID NO: 4128952 - RNA, 62 nt, Human
agucaguuagcguaaucacugggggccuugccgggccuacagcagagcuacacuaacuuucu

SEQ ID NO: 4128953 - RNA, 59 nt, Human
agucauaacuguccugggugagaaaaaauggacccccacucggcuggacacugugcacu

SEQ ID NO: 4128954 - RNA, 80 nt, Human
agucauagcacccaccucgugggguuucagugaaaaaaaagccuggccagcagugaagccugaugcuggugggugugacu

SEQ ID NO: 4128955 - RNA, 73 nt, Human
agucaucugaagcccugucuuauggaagacuaguagcuuguucugcaugacuucaggguguccuaaaaugacu

SEQ ID NO: 4128956 - RNA, 60 nt, Human
agucaucugaccucuucucagaguucaggguuuuaccuucuccaggagguuaguguggcu

SEQ ID NO: 4128957 - RNA, 62 nt, Human
agucaugacaacugcaaaacaugggguaacaauauuuaccuugaaagcugguuguuaggauu

SEQ ID NO: 4128958 - RNA, 79 nt, Human
agucaugagccuuucauucuccagggugacugaguucuugcuuagaaccucauaagaaucgaaaguuauauuuaagacu

SEQ ID NO: 4128959 - RNA, 73 nt, Human
agucauggaauucucuaugcucuguuccaaauaaaggcaguuuccugaggaaaagauauagagcuccuugucu

SEQ ID NO: 4128960 - RNA, 78 nt, Human
agucauuaguuucuucuccuugaaaagcugcaucuuuucagauggcucuuugaaggggaauuuuuuggaauuaacgcu

SEQ ID NO: 4128961 - RNA, 73 nt, Human
agucauugugcuuuuuuucccuggugaauucgagaagaauuuauguucauuuaggaaaggaagaguauugacu

SEQ ID NO: 4128962 - RNA, 111 nt, Human
agucauuuaaccuucuagcauguaugcacauuguagccacacaauuacaagagcuaaagcaacauaacugugaggcuauaucauggcaaagcaacuaaaagcucagugacu

SEQ ID NO: 4128963 - RNA, 69 nt, Human
agucauuucccauucuucauauggcacauggcgcuuucuuuaaugacacaugugggcugggaaaugucu

SEQ ID NO: 4128964 - RNA, 92 nt, Human
agucauuuuauucagugaucuuugguaguacgauaaucaauggaauuuauggugucguagaaaaccaaaaauccauguugaauauagugacu

SEQ ID NO: 4128965 - RNA, 66 nt, Human
aguccacugccccagcuccucgugugucuuuugaacacauuaguauugugcugugcagaaaggacu

SEQ ID NO: 4128966 - RNA, 61 nt, Human
aguccacugcuuauaguagccuaggcuuuugauaagcuauaguugcuucaggcugugugcu

SEQ ID NO: 4128967 - RNA, 82 nt, Human
aguccagacuuuucucuugagcuccuguauucuguuucuuacuugacagcucuaccuggacaucagagagacacauuguacu

SEQ ID NO: 4128968 - RNA, 60 nt, Human
aguccagauguauaaucucaucccugaacauuucugauggugugauuaugacaugugacu

SEQ ID NO: 4128969 - RNA, 56 nt, Human
aguccagggcuuagucagcggggcccggaguggcuucccuggcuggcaucuggacu

SEQ ID NO: 4128970 - RNA, 61 nt, Human
aguccauuaugguggucucauggagugagucuuguuugguccaaguccauuaugguggucu

SEQ ID NO: 4128971 - RNA, 69 nt, Human
agucccucugugugugcaugcaugcgccugugugcaaacauccgcauguguagguacauauagauaacu

SEQ ID NO: 4128972 - RNA, 72 nt, Human
agucccuuccucauuccacuuuagagucuccuucuagcuucauauccucuggggccaagugaggaagggucu

SEQ ID NO: 4128973 - RNA, 68 nt, Human
aguccgcuuugauggaagcagccucaucuggagagccagcugcugugugccucccauuaggguguauu

SEQ ID NO: 4128974 - RNA, 63 nt, Human
aguccguggcaucgucugaggugggguccugcucagguuacuccauaacugaugcccugcccu

SEQ ID NO: 4128975 - RNA, 68 nt, Human
aguccuaauggagccucuguuuaucuggauccugagagucuauguggagcagaggcugccuggugacu

SEQ ID NO: 4128976 - RNA, 58 nt, Human
aguccugugaggggugcagcuuugcaacugcaggccaaagagcaaaccaaacaggccu

SEQ ID NO: 4128977 - RNA, 64 nt, Human
aguccuucaaaggcacgcaguuacaaaaacaccauuuuucuaauuugccuccuuugugagggcu

SEQ ID NO: 4128978 - RNA, 71 nt, Human
aguccuucauuuccugaucucuaaguuccuuuucuacccuacuauuuuaugaguacaaggaaggauggacu

SEQ ID NO: 4128979 - RNA, 62 nt, Human
agucgagaguagagccgugguuuuuggggcagugggaguagugagccuggcuuugcucugcu

SEQ ID NO: 4128980 - RNA, 75 nt, Human
agucgggggaggugugaagcugggcagguggccacguucuuauugucagccagcucgcacucuugccccuagacu

SEQ ID NO: 4128981 - RNA, 71 nt, Human
agucgguguuguuuucagccauuaaauuugcgguaauuuguuacagcagcaguaggaaauaacacaggauu

SEQ ID NO: 4128982 - RNA, 61 nt, Human
agucguacguugaggcaaagaggcugguccuuugaacccucuugccaaucagcuacagauu

SEQ ID NO: 4128983 - RNA, 65 nt, Human
agucgugaagguccuaagguugugaggauucucgugucuucagaaaauuaucacuuguacagacu

SEQ ID NO: 4128984 - RNA, 57 nt, Human
agucguggguacacgggacagcagacguaaaccugagcugucccuggucaccagacu

SEQ ID NO: 4128985 - RNA, 84 nt, Human
agucucacucugucaccgaggcuggagugcaguggcccagucuuggcucacugcagccuccgccucccagguuuaagugauucu

SEQ ID NO: 4128986 - RNA, 63 nt, Human
agucucagcaagcauggcuaguccuuuucuguaaaacguuucuaagccaguugguaagaggcu

SEQ ID NO: 4128987 - RNA, 88 nt, Human
agucuccaaaauccucuccuuugaguugcuuuuauugacuuguauuuuaaugucucaccguaaauguaacuuuagggcaagggagccu

SEQ ID NO: 4128988 - RNA, 57 nt, Human
agucuccagaaauauagcagugaaugaagcagucaaaaauccuugcugucuggagcu

SEQ ID NO: 4128989 - RNA, 63 nt, Human
agucucccuagaguuuucugguuaauuuagcacuuaauugaaaauauaauucuaggagaaacu

SEQ ID NO: 4128990 - RNA, 76 nt, Human
agucucgugcuccauugucuagaacuggcuuacuugcguaccagcaaaccagucacuggaaaaugggaaugggauu

SEQ ID NO: 4128991 - RNA, 72 nt, Human
agucucugccucucagaguggcugugggaauuaaauucagaaaugccagccugccugugaggcuuugagacu

SEQ ID NO: 4128992 - RNA, 59 nt, Human
agucucuuccuucaaggcugguggguaaaauucucccuugugccuuugaaugagggauu

SEQ ID NO: 4128993 - RNA, 101 nt, Human
agcugcuaaaagcuuugauuuuugagaggcuguagauacaaguaguuuuauaauaauaugugaagaucuacaggauuuuacagaguugaagucuuacagcu

SEQ ID NO: 4128994 - RNA, 58 nt, Human
agcugcuagaaaauuagaguauaucaguauaugagauugcuguagguuucguggcacu

SEQ ID NO: 4128995 - RNA, 59 nt, Human
aggggccuggugagagggucacaccagaagggccugguggagccacaucacaggcuccu

SEQ ID NO: 4128996 - RNA, 76 nt, Human
aggggcgccuccagacagcugggugcucuucuggcucaggcugugagucagggauccacugcucuucugugccccu

SEQ ID NO: 4128997 - RNA, 75 nt, Human
aggggcguccugagugaggcugggcagucccuugggccacguccucccagagcccgcccagcuucaccagccccu

SEQ ID NO: 4128998 - RNA, 94 nt, Human
aggggcuuagaacaacagaauauuuuauuuagaucacaauuuuguggauugucuugugauagaugggauauuugugauguuugugauggcucuu

SEQ ID NO: 4128999 - RNA, 84 nt, Human
agggggagcugcccaaguugccuggcuuguagaugggggccucaguccaccagccaggcccaggcugcccuacagcugcccccu

SEQ ID NO: 4129000 - RNA, 81 nt, Human
agggggcaggagagggaguuguuuucauguaacuuuugcuuuuauacagacugaagauauuuccccccauuugugucucuu

SEQ ID NO: 4129001 - RNA, 56 nt, Human
agggggcaggugggcgggaguggugggcucgcccugaccuggccgcugugcccccu

SEQ ID NO: 4129002 - RNA, 86 nt, Human
aggggguagagacaaagucagcucucugaggggucugggaccacccuuugcuccugucccaagcagggcuggccaugacuccccuu

SEQ ID NO: 4129003 - RNA, 71 nt, Human
agggguauugaucugaaggucuugaggcaggaguaaggacucacuguccaugggcgucaggcaggaaaccu

SEQ ID NO: 4129004 - RNA, 82 nt, Human
aggggugaucuggucaggauugaagcccaugaauaccuuccuuccaagguauuucugagaaccaacuuacccagaucccucu

SEQ ID NO: 4129005 - RNA, 67 nt, Human
aggguacagggccugcucuccccagcuucuccccuacaggcccaggacacaggccuugucugcgccu

SEQ ID NO: 4129006 - RNA, 77 nt, Human
aggguaccaggagguguuugcucaagugaggacaugcagggcucacuugagcaaagcucccucaugagucagacccu

SEQ ID NO: 4129007 - RNA, 70 nt, Human
aggguaguauuugucuguccuacucuggggccuuuugcagagucuggugcaugauaagcacuuggucccu

SEQ ID NO: 4129008 - RNA, 100 nt, Human
aggguaugcugcaaaguucagguauuuacuguuuuuucuuacacuuuggcaacaauuuguugagcuucaaaauaugugaauccugcuuuaagauugccuu

SEQ ID NO: 4129009 - RNA, 62 nt, Human
agggucaagucacugguucacgaucacacaucugauaaguguugaagcugggauuugaaccu

SEQ ID NO: 4129010 - RNA, 84 nt, Human
agggucauggaaauggagucugaggggguaagagaacugccugaccccagagcuucugacccucagaucauguccauagaaacu

SEQ ID NO: 4129011 - RNA, 75 nt, Human
agggcuuuccccuagaaauucugauucaguaggucuaaauuagguccuaggaaucuguuuuuuaaaaagagcucu

SEQ ID NO: 4129012 - RNA, 75 nt, Human
aggggacaaagugugcggagcccagggagggccguucgcaugaggcccagucuuggaugcggcacuuggucgucu

SEQ ID NO: 4129013 - RNA, 59 nt, Human
aggggaccagaggcugugcacaauuauggcuugauugucccuaacauuucuguuccucu

SEQ ID NO: 4129014 - RNA, 81 nt, Human
aggggaccagaugccugggccagagaguaagaaaggucauugguauggccaggcugaguaacuccugcccaguggaccccu

SEQ ID NO: 4129015 - RNA, 64 nt, Human
aggggaccuuuuuucugaucugcuguuguaaaaccacagcagcuguggggacaaggguaacucu

SEQ ID NO: 4129016 - RNA, 60 nt, Human
aggggagcaaggccgugguguaauaaucucuuugagauuuaccagaagucuuggucucuu

SEQ ID NO: 4129017 - RNA, 58 nt, Human
aggggagcaccggucgguaggacucuugguugaaucaguccagcuccguguucuuccu

SEQ ID NO: 4129018 - RNA, 60 nt, Human
aggggagcgcuccuguaugugugugugucuugcaucugugcacaugcuguguguuucucu

SEQ ID NO: 4129019 - RNA, 66 nt, Human
aggggaggagcugggggcucacaccucggaucuaacuccagaauugauguccucagccacugcccu

SEQ ID NO: 4129020 - RNA, 94 nt, Human
aggggaggauacagacuugggagggcagagacucagaaacagaauguucgcauuagggacaugguguugcggggagcugccucccccagccccu

SEQ ID NO: 4129021 - RNA, 76 nt, Human
aggggauggacacagugcucuagacggagacuucuuuauucaaaagagaauucucuggcgcgcugugcuaugcccu

SEQ ID NO: 4129022 - RNA, 61 nt, Human
aggggauggagcuggaaggcaguugagggucaccugaugaggccuuuuggugcagugccuu

SEQ ID NO: 4129023 - RNA, 59 nt, Human
aggggaugggagagcauuuagagauagcucuuaucucuuacuucucuucucccuccccu

SEQ ID NO: 4129024 - RNA, 56 nt, Human
aggggauuuuuugugcagguguauuagcuaucuauuauugcauaacaaauuacccu

SEQ ID NO: 4129025 - RNA, 85 nt, Human
aggggcaacuuauuggagaauuggagaaucagaauugcaaguucuuuuugucauugacuuugugccauuuuuauaaaaugccucu

SEQ ID NO: 4129026 - RNA, 57 nt, Human
aggggcaggcugggagucaucagaggccagauggggcucuauccccagcuucccccu

SEQ ID NO: 4129027 - RNA, 82 nt, Human
aggggcauagcacauugauaauuaaggccucccucugugacaaccuacaugcuggagguguaauuacguguaaauagcccuu

SEQ ID NO: 4129028 - RNA, 57 nt, Human
aggggcgagccuggguuuugaaguucaaacuagaguuuaaaucacaacucugccccu

SEQ ID NO: 4129029 - RNA, 129 nt, Human
aggggcuaguggccucuggagaggguauagguggcaggaggucagagaaaauuuuugagaggcugaaucugcagcaaacguuuguccggccccugcucuguaccuuccugggugcuggaacuagucccu

SEQ ID NO: 4129030 - RNA, 62 nt, Human
agggggcuuggagauugucauggacagaaguccauuuagacucucaccuccaccuguccccu

SEQ ID NO: 4129031 - RNA, 84 nt, Human
aggggggcagcugaggauggugagcaggacccaguggacugaccccacugcugucccagccuccucacauacaguuggucucuu

SEQ ID NO: 4129032 - RNA, 103 nt, Human
agggguaccaugguggucccgcagagaacacgggcacaagcaggcuggugguauacguaacuuugcugccuuuguacucugauggaauaaauuaugcucccuu

SEQ ID NO: 4129033 - RNA, 93 nt, Human
agggguauccuggucucagcugccugacuuguccaaggacuguccuaguuuguuaguccaggaaaauaagcuaggucagcuaucauauccccu

SEQ ID NO: 4129034 - RNA, 90 nt, Human
agggguccgggggggcuugucaggggcugagggggcucucccgaagcuccccacacuuucacuccuggcuggcccugggaccuggcccuu

SEQ ID NO: 4129035 - RNA, 84 nt, Human
agggguccguggcugggcuccgagcggcuugcugcucccuccucagccugaggccgccggagcccaggcuagacgcgcuccccu

SEQ ID NO: 4129036 - RNA, 98 nt, Human
aggggugccuugggugguggcaggaagaggagggugaacuucagugacucuccccugagcaguucccuucuuuuccagcugcccuuagcuggccccuu

SEQ ID NO: 4129037 - RNA, 72 nt, Human
aggggugcuggagccggaccagggacgguggcuggauagggucaccagcuggucagggcuuuucuaauuccu

SEQ ID NO: 4129038 - RNA, 90 nt, Human
agggguggggcuucaccagcagcuuucaccuccccgccuggaagcuucucucuacugcguggggagcugugacuacaggcucccaccucu

SEQ ID NO: 4129039 - RNA, 62 nt, Human
agggguuugugcuucaagacuugaucacuggguuuugugguuguuuuaaggcacaggccuuu

SEQ ID NO: 4129040 - RNA, 68 nt, Human
aggguaagacauagauuucucaugacccugucaagggcugcccuuaggagaagcuauguaacagcuuu

SEQ ID NO: 4129041 - RNA, 74 nt, Human
aggguaauuaaggguuccuuuugauagagcucagaaugcugaacuuauauucaaacagcucaagaaguuacucu

SEQ ID NO: 4129042 - RNA, 85 nt, Human
aggguacaaguagcucagguuuucuggcauuucugaaagaaucuugguuaugauguaauaggaggcuuaaagcugcucagacccu

SEQ ID NO: 4129043 - RNA, 62 nt, Human
aggguacagucaaugagugagugaaugaaugaauuauacgcuauugcaaauggcuggucccu

SEQ ID NO: 4129044 - RNA, 74 nt, Human
aggguagauauugcauagaaaucaucaggacugugguuuauguuuaauuugaagucuucaugauuucucucccu

SEQ ID NO: 4129045 - RNA, 58 nt, Human
aggguagguguaagauagcccuguagaaccaaaaguggguuucuugcuucugaucccu

SEQ ID NO: 4129046 - RNA, 63 nt, Human
aggguaucaguagauaaacggauugcauaaaacuaugugcaauuauagcucuucugauauuuu

SEQ ID NO: 4129047 - RNA, 89 nt, Human
aggguaugacauguuuugcuuucuggauaagcagggucucucuuaaauaugaagauggcuccaguguccagagggagacuaaaaucucu

SEQ ID NO: 4129048 - RNA, 79 nt, Human
aggguauguguccuuauaagaagaagagacaccagagaucucugucugccuugugagggcacagcaaaaacucaacccu

SEQ ID NO: 4129049 - RNA, 76 nt, Human
agggucagggagugaguauuuagugagccugcucggugcaccaacccacuuaauaugcuucaucuccugggacccu

SEQ ID NO: 4129050 - RNA, 115 nt, Human
agggucagggggaggccagagcaauuagccuggcugaggccucugcuaacucagaaacguaagugggggauugguccaggccucacuccagggcucuggccucgagccugacccu

SEQ ID NO: 4129051 - RNA, 78 nt, Human
agggucuacaggcuggggacccugcgggcuggaugaggacccccucacuggucuuuggcuucucaggcuggggacccu

SEQ ID NO: 4129052 - RNA, 82 nt, Human
agggucucugucacccaggcuggagugcaguggugugauggugcaaucacagcucacuguagccucgaccucaagugauccu

SEQ ID NO: 4129053 - RNA, 61 nt, Human
agggucugguguagaaguucuccacauucccuugcaacaugacucaucuacuccagacccu

SEQ ID NO: 4129054 - RNA, 86 nt, Human
agggucuugcucuaucacccaggcugaagugcaguagugugaucccaccucacugcugccucagcuuccugggcucaagugauccu

SEQ ID NO: 4129055 - RNA, 130 nt, Human
agggugaggcaaacgaggugccuggggucagcguugaagggcguacucacucucagguuccggcaugugguccccugagagugagugccuccuuaaauuuugugcccuaggugccuccuagcuucacacu

SEQ ID NO: 4129056 - RNA, 63 nt, Human
agggugaguccaguggucugaucuccaucuggagacaccuucagaaugcacugaauuuacccu

SEQ ID NO: 4129057 - RNA, 73 nt, Human
agggugauaaaguuuaaaaggguguuugcaucaagagugguuauuucaauuugcccuguuaaauuuucaccuu

SEQ ID NO: 4129058 - RNA, 73 nt, Human
agggugauuuguucauggccccaucuugguguccagucuggccuugaaagggggucuuggaacagguggcccu

SEQ ID NO: 4129059 - RNA, 80 nt, Human
aggguggaagaggaaaagcuucauuucaacucaggggucuuagaaggcuuuuaggaggaaagaagauuugaccuggcccu

SEQ ID NO: 4129060 - RNA, 56 nt, Human
aggguggggaggacgggugaccaagcgcagacgugggugacacguggccccgcucu

SEQ ID NO: 4129061 - RNA, 78 nt, Human
agggugguagggacacuaugcagaaaggcuuggguuaaugagcacuuucuggauugagugucucuccugauuaacccu

SEQ ID NO: 4129062 - RNA, 87 nt, Human
aggguggucuggagcagcuuggaggaggaucuaagagucucuggauuggugaaaucauagguccuccucaggcgaagccuucacuuu

SEQ ID NO: 4129063 - RNA, 116 nt, Human
aggguguuucucagccccaagcaggccugugccuuaacccuuuaggccccucaccaaggccucagggggagaggccagcucacccugcugcccucaggggcccccagaaggauccu

SEQ ID NO: 4129064 - RNA, 62 nt, Human
aggguuauguagaaaagcaguuuuucaaugcugauuagacuggcuugcuuuacaaggacucu

SEQ ID NO: 4129065 - RNA, 63 nt, Human
aggguucuuagagggugggcacgugauggaucacaaaagaaccaccauucucuccucuucccu

SEQ ID NO: 4129066 - RNA, 62 nt, Human
aggguuguauccucagggccuagcauaguggcugguacauaauagguccucaggaugacccu

SEQ ID NO: 4129067 - RNA, 72 nt, Human
aggguuguggaaagaggugaaaguuauucauuuaugcuuuuauauuugaaaccuuguacccucccacacucu

SEQ ID NO: 4129068 - RNA, 128 nt, Human
auaaaccugucuugacacaucauuauugcccagaguccauaguuuaccuuaggguucacucuugauauuguacauucuguggacuuggacaaaaguauaaugacauguauucaccauuacaguauugu

SEQ ID NO: 4129069 - RNA, 87 nt, Human
auaaacucucucuugcugucaaagcaggguagggaugaagagagaauauucccugcuucccugaaggcacaggagaugugaguuugu

SEQ ID NO: 4129070 - RNA, 57 nt, Human
auaaagcuuugaaauggagauaacucccaccauaccugucuccuauuauagcuuugu

SEQ ID NO: 4129071 - RNA, 67 nt, Human
auaaaguagccacuggaaagcugccuaauaaugugacacagacaaugauuugcagugguuccuuugu

SEQ ID NO: 4129072 - RNA, 58 nt, Human
auaaaguccucuuucacaaacagcuuggcaaacugugcaagucaaagaugggcuuugu

SEQ ID NO: 4129073 - RNA, 67 nt, Human
auaaagucucauggguaaaugucuagaaaacaauccuuauugcagcaauguuuacccaggauuuugu

SEQ ID NO: 4129074 - RNA, 87 nt, Human
aggcaaacuguuuaaagucuucucaccauagcaaaggucagugccuccauaaagugggagaagacguacuuuagacauuuuauuccu

SEQ ID NO: 4129075 - RNA, 67 nt, Human
aggcaaagaaaagcuguuguauggcccuuggcauaucuguuagccaaggccacaaacagccuggccu

SEQ ID NO: 4129076 - RNA, 56 nt, Human
aggcaaaucugagacauuuaaacauauuucuuaauuugaauuacuuagguuugcuu

SEQ ID NO: 4129077 - RNA, 121 nt, Human
aggcaagaaggagaugagggccagcaccccagagccagguuuuaguuuaaauugggcuucugaauccaauacuaaauugcaaccaggucucugucuuuguuguuguuuauuuucucugccu

SEQ ID NO: 4129078 - RNA, 68 nt, Human
aggcaaucagaaaauucaguggaauuuuaaagagggaaucucacucaaagaauucucuaaaauugccu

SEQ ID NO: 4129079 - RNA, 58 nt, Human
aggcacaaagacagaaaagcacugcccuuuugcggggcuuuacuaggucguugugucu

SEQ ID NO: 4129080 - RNA, 55 nt, Human
aggcacaguggcccuguuugggugaucucaccuggaaugcagucacacugggcuu

SEQ ID NO: 4129081 - RNA, 65 nt, Human
aggcaccucagcugagccuggguauaacaggcaaacccagccauucagugacugaggaacugucu

SEQ ID NO: 4129082 - RNA, 58 nt, Human
aggcaccucuuaggcugcuacugagcucuugaggaaacaacagcggccagaggagcuu

SEQ ID NO: 4129083 - RNA, 59 nt, Human
aggcaccuggccaguugucuugcuuuugucuucucuagcaaccagcugcuggguugucu

SEQ ID NO: 4129084 - RNA, 76 nt, Human
aggcacuaccuggaauuauauaaagaaugacaaagaugcgguuauccauuuauuuucuaggcaaguuaguuagccu

SEQ ID NO: 4129085 - RNA, 63 nt, Human
aggcacuaguuuauuacaguuccacuguguuacagcaguguuaucagaugacuaguaagaccu

SEQ ID NO: 4129086 - RNA, 82 nt, Human
aggcacugaaauguugagguuucgagguauaguaaguauacaaugcacuucacuuggaugccuuuucauuuuuaggcagccu

SEQ ID NO: 4129087 - RNA, 63 nt, Human
aggcacuucucaaauucaugccuagacauucaaagaguauggcaggaaggagagaggcagccu

SEQ ID NO: 4129088 - RNA, 101 nt, Human
aggcacuucugcauugggcugggucugucucaggauuguccagacaaaggauaugggcauauuuccaggagaccagauguaggcccaaugugagauagccu

SEQ ID NO: 4129089 - RNA, 58 nt, Human
aggcagaaaacaauaaccauuucaaggaucacuuaaggaauccugguguuuucugccu

SEQ ID NO: 4129090 - RNA, 56 nt, Human
aggcagagaacaugcugggcagaggagacaaggucaggucagccuguugucugccu

SEQ ID NO: 4129091 - RNA, 78 nt, Human
aggcagagccuggcucugguucccucagcucacugagguaugaguuuacaggggacagaggccauguuagcuuugucu

SEQ ID NO: 4129092 - RNA, 56 nt, Human
aggcagcaaagaaaugaugcuguccacagaacaaacagcagccucuccugcugccu

SEQ ID NO: 4129093 - RNA, 55 nt, Human
aggcagccaaucagaggcugacucacuccacugaguccucuucuaaggcugaccu

SEQ ID NO: 4129094 - RNA, 60 nt, Human
aggcagcuuacaccccccaagauucuggaccuccuccaggacugcauguggaaguugcuu

SEQ ID NO: 4129095 - RNA, 73 nt, Human
aggcagcuucuagaagcugaaaagggggaaggaaacagcuucuucccugaagccucuggaagggaguuagccu

SEQ ID NO: 4129096 - RNA, 97 nt, Human
aggcaggaagaucacuucagcccaggagguugaggcugcagugagcuaggaucacaucacugcacucaagccugggugacagagugagacccuguuu

SEQ ID NO: 4129097 - RNA, 97 nt, Human
aggcaggagaaucacuugaaccugggagguggagguugcauugaucugagauuaugccacugcucuccauccuaggugacagagugagacccugucu

SEQ ID NO: 4129098 - RNA, 98 nt, Human
aggcaggagaauugcucgaacccggaagguggagguugcagugagcugagauccggccacugcacuccagccugggggacaacagcaagacucugucu

SEQ ID NO: 4129099 - RNA, 130 nt, Human
aggcagggacacaaccucucugggccucuaugcuguucucucucgaaugagagcgcugcacuacacaagcugcagugacacggagagacagcauggcagagcuaagacgcagcaggcguguggcccuccu

SEQ ID NO: 4129100 - RNA, 62 nt, Human
aggcagggaccaguuguuuucuuuaagaauggugaaaacaugaucauggcuaguccuugcuu

SEQ ID NO: 4129101 - RNA, 66 nt, Human
aggcaggggccaggcugucugcugucagaggacgaagccugcagccuacugcccggaccccggccu

SEQ ID NO: 4129102 - RNA, 67 nt, Human
aggcaggguccacaccugggaaagauuaaggugccaucugucccagacauaaguggacauaccuccu

SEQ ID NO: 4129103 - RNA, 66 nt, Human
aggcagggucuugcuauguugcccagauuggacgugaacuccugggcucaagcaauccuccugccu

SEQ ID NO: 4129104 - RNA, 56 nt, Human
aggcagggugaugauaaugauuugcguaaguauucauuggcaggucauguugaccu

SEQ ID NO: 4129105 - RNA, 66 nt, Human
aggcaggugaaucacuugaguccaggaguuugaggccagccugggcaacauggugaaucccuaucu

SEQ ID NO: 4129106 - RNA, 60 nt, Human
aggcagguuucgggaagggggguggccaggggagggccaaaccccuuguguaacuagccu

SEQ ID NO: 4129107 - RNA, 116 nt, Human
aggcagucagucugaugccagagaccacauucuuaauugccaugcuguauuaacuccuaaaauuaaaccuagggcaugaggaugguugcugcauccaguacaaaugcugagggccu

SEQ ID NO: 4129108 - RNA, 55 nt, Human
aggcagugaugagucaugaauauuuccauucauguuaacaagcuucucauuguuu

SEQ ID NO: 4129109 - RNA, 69 nt, Human
aggcaguuuauccccagagccuggacaccuaaacacuauuugucauguugcucugggugguaaaugacu

SEQ ID NO: 4129110 - RNA, 63 nt, Human
aggcauaaccuuuuaucuggaucucccacucuuccuagccgauucagauuaaauguucugucu

SEQ ID NO: 4129111 - RNA, 74 nt, Human
aggcauccagcuacaaugaccaaaauguuuccagcuugcaaguguaucugaaucauggucauuaguuuaugcuu

SEQ ID NO: 4129112 - RNA, 89 nt, Human
aggcauccuucaacuuagaagucagcuccagagggaacaccaggacauuugcucuaguuuuagcuugaguugcagaagagaaggauccu

SEQ ID NO: 4129113 - RNA, 83 nt, Human
aggcaucuuguuccgguagagacauguugguuggggacacuccuagcccacuguuuucauuucucuguggagcaccccugccu

SEQ ID NO: 4129114 - RNA, 82 nt, Human
aggcaugaacuuccacauucucuguuacagauaaaguuuguccccuuuggcagagaugcuggagcucuuucuucuuaugccu

SEQ ID NO: 4129115 - RNA, 55 nt, Human
aggcaugauacgugcucugugagcucaaacuucacaguugggcuguagcaugcuu

SEQ ID NO: 4129116 - RNA, 58 nt, Human
aggcauggaacauggaauuaaauaugagcuacuagcauuauacauauguucucugccu

SEQ ID NO: 4129117 - RNA, 72 nt, Human
aggcauucucuuacaggaguaucccaaggccagggauuuucccacauguuuuugggccuguggcagaagucu

SEQ ID NO: 4129118 - RNA, 106 nt, Human
aggcauucuucuuuuuguuguauauaauugacacauaguaaucguacauguuugcaggauacauugugauguuucaauacauguauacacugaauaaugauaaacu

SEQ ID NO: 4129119 - RNA, 61 nt, Human
aggccaaaaggaacuuuuugaaggucacaggguuccaucugcaaccuucauuccuuugccu

SEQ ID NO: 4129120 - RNA, 61 nt, Human
aggccaaaccggauggaaaaggaggaaauuccaaagaaggagccuuucuguuuuguggccu

SEQ ID NO: 4129121 - RNA, 61 nt, Human
aggccaagugagcacuaaagcuuccugucauaaugaggaggcagugggggccacuuugcuu

SEQ ID NO: 4129122 - RNA, 64 nt, Human
aggccaauuuaauuagugugggcucuaagguaccuuaaguuagcccuauuaaauuaaaccgccu

SEQ ID NO: 4129123 - RNA, 92 nt, Human
aggccacaaagcuuguuaaauugaagaauuaggacgugaguacagaucuucuggugccaagucaguguucuuuaugacaucugagguggucu

SEQ ID NO: 4129124 - RNA, 72 nt, Human
aggccacaccauuagugauuaaaggcagaauguucauccccagagccccuuucuuuugaucacugugugccu

SEQ ID NO: 4129125 - RNA, 55 nt, Human
aggccacagauacugugaaguaacuuugaguaacuuugugugugugugugugucu

SEQ ID NO: 4129126 - RNA, 55 nt, Human
aggccaccacccuaucuccuggaauaagaaccuccacagagauauuggugagccu

SEQ ID NO: 4129127 - RNA, 82 nt, Human
aggccagaaauuuggaguauguggcuucuccaccucacacaauuugcccuaacuuuaauauauacucagaaauuacuggcuu

SEQ ID NO: 4129128 - RNA, 79 nt, Human
aggccagacgagcugcauuugaauuaccuugugcauaauuaaugaauuaauuaauuacaaauguagacucucauguccu

SEQ ID NO: 4129129 - RNA, 81 nt, Human
aggccagauuuucagaagggaccuugcuuuuggaauuugcagucccagagccuguacuuuucugugaaucuaauacugccu

SEQ ID NO: 4129130 - RNA, 61 nt, Human
aggccagccugcccaaagcugcccuuuaacugaggguugaucuuuaacuggaaggcugcuu

SEQ ID NO: 4129131 - RNA, 79 nt, Human
aggccagcugucacucagaaaggcccaggagcaagucaaggagucuaccaauggccauuucuggugacagcuauugcuu

SEQ ID NO: 4129132 - RNA, 64 nt, Human
aggccaggcugguuccuugaccuucagagcuggggcauccuuuaggugagaccagucauggccu

SEQ ID NO: 4129133 - RNA, 86 nt, Human
aggccagucacuccugccugaugcaucccuguugcacuguucauaaaaccuguaucauauggggaagcuucaaggcuggcaggcuu

SEQ ID NO: 4129134 - RNA, 77 nt, Human
aggccaucuguaauucacuagggucagcgaaggagaccguccccaucuuaugcucucuaugaauucacagcugcccu

SEQ ID NO: 4129135 - RNA, 57 nt, Human
aggccauguccuucucauuguuccguguuugcuacaaagaugauuggaacauggcuu

SEQ ID NO: 4129136 - RNA, 60 nt, Human
aggccauguggccccagagucugugguuuccccacuauacuuuguaggggcccaugguuu

SEQ ID NO: 4129137 - RNA, 86 nt, Human
aggccauuuucacgucuuuugugauucuucaguuacuucaggccaucuggauguauacgugcaggucacaggugauaugauggcuu

SEQ ID NO: 4129138 - RNA, 57 nt, Human
aggcccacaguggcucccgcggccugucugccggcuggccgacugccuugugagccu

SEQ ID NO: 4129139 - RNA, 88 nt, Human
aggcccaggguggcaagggccagaggccauccuccugcugcccugcucuggggcagacaugggcuccucggccugcguaccugggcuu

SEQ ID NO: 4129140 - RNA, 55 nt, Human
aggcccauaguagcucugggcaggaagagucccuuuggagcauaaacuauggccu

SEQ ID NO: 4129141 - RNA, 75 nt, Human
aggccccagcaauagauugcgagucuagauucaacaaacucuugccaguuuccucugacucacagccuggggccu

SEQ ID NO: 4129142 - RNA, 68 nt, Human
aggccccugcugugaccggggagcaggcccggguggggugucucucccuguuuuacgguugagggccu

SEQ ID NO: 4129143 - RNA, 67 nt, Human
aggccccuggcagugaccgguucuagagcuuuucccuggagccucuggagugucuggccaggguucu

SEQ ID NO: 4129144 - RNA, 97 nt, Human
auaacauucuuucauaucugaaaugaggcuucuguucacucacgcuggaccccugcccagcaguguuuuagccauuucugugugaaauguauguugu

SEQ ID NO: 4129145 - RNA, 56 nt, Human
auaacauuuucuuugcugugugcguuacacacugcacagugaauuucaaguguugu

SEQ ID NO: 4129146 - RNA, 60 nt, Human
auaacauuuugacaacuggugauccaggcacaguggaggauuucauugucagaaucuuau

SEQ ID NO: 4129147 - RNA, 75 nt, Human
auaaccgaauucugucacuuaggaggucauaaaaucagacacagacaugugacacugaauggcagaacuaguuau

SEQ ID NO: 4129148 - RNA, 100 nt, Human
auaacgggauaugucuguuacuucuugaaaauagccauguacauauguacaauauauguauuacuggguuuucaaguuacgaaccugacuuuuacguuau

SEQ ID NO: 4129149 - RNA, 57 nt, Human
auaacucuguucuuccuucucucgagcauucaugagaaggugggccugcugaguuau

SEQ ID NO: 4129150 - RNA, 87 nt, Human
auaacuuuucuuucugcuuuaggcaguuccugcagauccauuuauuaaagauagaaucuggcucaccuggguaaauaguugaguuau

SEQ ID NO: 4129151 - RNA, 63 nt, Human
auaagaagguaguuuccaagucacuggucugugaacacugcuugugauuaauuacccuuuuau

SEQ ID NO: 4129152 - RNA, 66 nt, Human
auaagacaaggucauaguggauuaguaaacauagccauguuuauccaacaugacuuauguccuuau

SEQ ID NO: 4129153 - RNA, 74 nt, Human
auaagauuucagggagggacaauugucaccuuugaagaaucaaagugaccaaugggcuucccucaguauuuugu

SEQ ID NO: 4129154 - RNA, 62 nt, Human
auaagcuguguaaguugcuugguucuagcuauagacgagugauuccacacuugcacgcuuau

SEQ ID NO: 4129155 - RNA, 64 nt, Human
auaagcuuccaaagggcucuagacucagcagugaaauugucgccugccuugcccugaaguuuau

SEQ ID NO: 4129156 - RNA, 86 nt, Human
auaagggacuugagcaucugaggauuuuccucugggagaaggagguauccuggaggcaauccccugaggauacuuuucuacuuugu

SEQ ID NO: 4129157 - RNA, 78 nt, Human
auaaguagaaguuaggaaauaggaauauuuacuugguguaaaacaguauucauguuguccuuugcguuucugucuugu

SEQ ID NO: 4129158 - RNA, 80 nt, Human
auaagugauguuagaaucucugaauguggucuugggaaucuguaucuuaaacccugcagaugaaucuaauguacauuuau

SEQ ID NO: 4129159 - RNA, 74 nt, Human
auaagugauugcuggcauuuuuaagauguguuuaagaugcuuucauaucucuauaauuccagcaugauauuuau

SEQ ID NO: 4129160 - RNA, 78 nt, Human
auaagugcucaugaggcuuaauuaucagugaaaugucuugcuuuagauuucacagcuuaauaaggcucagaggcuuau

SEQ ID NO: 4129161 - RNA, 129 nt, Human
auaaguuuucuuuaagugcaccccuuccaaaaaucagauaacugaaauaucauaccauccaaggaaggaauugugcuuuuaguuuagaaguuuaaguuuugguuggaggucuacugguaaugaacuuuu

SEQ ID NO: 4129162 - RNA, 81 nt, Human
auaaguuuucuuucuuuacaguacuugcuuuuaaugugucuucugcuuagagcugguauuucugaaggaaagaaaguuuau

SEQ ID NO: 4129163 - RNA, 68 nt, Human
auaauaauaaccuuggcuaguauugugccuugauggaaaggcacaauaacagccaagguuauuauuau

SEQ ID NO: 4129164 - RNA, 80 nt, Human
auaauaauauucuauauuggaagugagaaauucugccaagaagucucaugcugccaauagccuacaaagaaugaaauuau

SEQ ID NO: 4129165 - RNA, 81 nt, Human
auaauaauccuccgcauucugagucacucuuuagcacacagcagaugugugcuuacucagaguuuggauggucuugguuau

SEQ ID NO: 4129166 - RNA, 91 nt, Human
auaauacaaaugcaggacauaagcaucgacacaagcgacuucauuugccauuggugucucugugcauuugugcuucuugucuuuguaauau

SEQ ID NO: 4129167 - RNA, 62 nt, Human
auaauaugauuaguugaggcagacuuacagucuuaaguuagcuucagaaauaucaucauuau

SEQ ID NO: 4129168 - RNA, 55 nt, Human
auaaucaaaguccuaugacaucccagagacagggugaucuuuagguugugguugu

SEQ ID NO: 4129169 - RNA, 64 nt, Human
auaaucucaggguaaugaaagacgaaucuacucuggaauugccuucauauacaccugauauuau

SEQ ID NO: 4129170 - RNA, 66 nt, Human
auaaucugguuuggggauccuugugacuguuucaagugucuacauuuauucucuaaaucaguuuau

SEQ ID NO: 4129171 - RNA, 103 nt, Human
auaaugaugaugauaauaaccagccuucaguaagggcuuagcagguggccgggaacugugcuaagugaacccuaugagguugguacuauugucuucccauuau

SEQ ID NO: 4129172 - RNA, 65 nt, Human
auaauguagguauguguauuuauauguuaaccuauuaugcuauauaugcauguaucauacauugu

SEQ ID NO: 4129173 - RNA, 74 nt, Human
auaauguauauuagauguaacuuuggaugagugugaguacccuccacuuaagcaguuaauuuaucuuacauuau

SEQ ID NO: 4129174 - RNA, 78 nt, Human
auaauuaaucagagacaaugauuucuuuauggugagccccacuaucucacuggguauuaucuuugucucuguaguugu

SEQ ID NO: 4129175 - RNA, 111 nt, Human
auaauuauaagcacacacuuuuuucuacaaguuuguguuaaauguuaaauucauaugaauguggaugauguauaacuaaggggaauaaaaaagugagcugcugaugaguau

SEQ ID NO: 4129176 - RNA, 67 nt, Human
auaauucaugggccuuucaccuuggugaaauuuccacaaguucacugauguaggccuauugagcuau

SEQ ID NO: 4129177 - RNA, 73 nt, Human
auaauucucauucuaaggaagagccaguaggugaauugaaucucaccagcugccuuuucuuaguagggauugu

SEQ ID NO: 4129178 - RNA, 68 nt, Human
auacaaauccucugggaugguaaacacucuucaguauuuccaggcuauccuagggugaagauuugugu

SEQ ID NO: 4129179 - RNA, 63 nt, Human
auacaagacaguaggaaacugaacaacuaaauuagagggauuuuuuucacugcuguuuugugu

SEQ ID NO: 4129180 - RNA, 115 nt, Human
auacaaugcaugugauacaugucuguaagugagauuauauguacgggauaguauguucuauauguacucuaagucuuauauacagaugccuuuaucuacagaugccuaauuguau

SEQ ID NO: 4129181 - RNA, 66 nt, Human
auacacacaaguucuaaagauugcgcauaagcuaaugugcaaguccagaaagaacucuguuuguau

SEQ ID NO: 4129182 - RNA, 90 nt, Human
auacacagcacuguaccauaaugacccuagaccaucaagugcucuagaccaucaggugcucuagggucauuaugguacaguguuguguau

SEQ ID NO: 4129183 - RNA, 82 nt, Human
auacacaugcaaaaauauauuuaugauuaucuuucuaaauuaggaaaguaagcuauucauauuaugguguuugugugugugu

SEQ ID NO: 4129184 - RNA, 66 nt, Human
auacagccaagauauauguaugauuccauuuguauaaaaagagcauauauguauguuuguaugugu

SEQ ID NO: 4129185 - RNA, 78 nt, Human
auacagcuagucaccagcuacaggacagcuggagccagggggcuauugcuggucacagucgcuggugugugugugugu

SEQ ID NO: 4129186 - RNA, 62 nt, Human
auacaguauaacuaauaaacccugaaauagcauuaguuuugggggggaguaugugcaugugu

SEQ ID NO: 4129187 - RNA, 81 nt, Human
auacaguauuuugauuucucauagaugcuauagacagcagacucgucucuucuggccaucuuugagauuucaauucugugu

SEQ ID NO: 4129188 - RNA, 60 nt, Human
auacaguuagaaaaaaagccuuuucucuagguagguaguuauguuuuuuucugacugugu

SEQ ID NO: 4129189 - RNA, 99 nt, Human
auacauauuuucugaagcaccauguuaggaguuggggaguuacugauuaguaaaugcagcaauggucccugcccucuuggaauuucagguccagugugu

SEQ ID NO: 4129190 - RNA, 91 nt, Human
auacaucaugauuccauuauacuucugauucaaaaucaggauuacaguuuucugugucuuugcuucacaaguaugguucugacuguuguau

SEQ ID NO: 4129191 - RNA, 65 nt, Human
auacaucuaaagugucauaaguagcuuuauucuagggcugcagucuagucacuuuaaaaaugugu

SEQ ID NO: 4129192 - RNA, 67 nt, Human
auacaugaauauacauccugauggcaauaugaaaugaaauacaggccucuuguguguaugcaugugu

SEQ ID NO: 4129193 - RNA, 55 nt, Human
auacauggaagaugcuuagcacaugccuggugcagaguacacucuuacuaugugu

SEQ ID NO: 4129194 - RNA, 56 nt, Human
auacauguguauguguuuguguguauauuugcaccugcauccauauaugcaugugu

SEQ ID NO: 4129195 - RNA, 84 nt, Human
auacauuugcuucacucuuccuuuccuuccagcccuuaaggagguuauugucuaggaggagguaagaaaagcauaaaaaugugu

SEQ ID NO: 4129196 - RNA, 72 nt, Human
auacauuugcuuguaaauguaugccuuauuacaaugacuuauaguguaaggugcuuaaacaagcaaacauau

SEQ ID NO: 4129197 - RNA, 59 nt, Human
auaccacagcaaaugaggccaacucaaccccugagaugacacuaagcauguugugguau

SEQ ID NO: 4129198 - RNA, 65 nt, Human
auaccaucacuagaggaagcugcuuccuucagagcacagugcuuuuguuccucuccuggugguau

SEQ ID NO: 4129199 - RNA, 69 nt, Human
auaccaugaugggguucagggaaucucuacaucuaucaacuugugagcaguugugagccccaaaggugu

SEQ ID NO: 4129200 - RNA, 81 nt, Human
auaccauuuuuauugauucuaagaugcauuuugcccaacauuuaaaaaucucugaaauuggggugugucugacaaugguau

SEQ ID NO: 4129201 - RNA, 83 nt, Human
auacccuguguugcugcuagugagaugcaacugauauuacuuaauuguauaauauucugccucacuacaguugaauaugguau

SEQ ID NO: 4129202 - RNA, 61 nt, Human
auaccuccccuccagcaaaaacauaauuuguugcauagucaaaaugcuggaggcgggguau

SEQ ID NO: 4129203 - RNA, 75 nt, Human
auacgugggcucauggagacuuggcuccaccuugaugacagcuaggaugguaccauuucccaggagugugagugu

SEQ ID NO: 4129204 - RNA, 63 nt, Human
auacgugggcuguggcaucccuccacaguaguggcacugacgcuggagucugagcccagguau

SEQ ID NO: 4129205 - RNA, 79 nt, Human
auacuaagcuuuuucucaaacuaacaaugauuauauuccucugagggcuaugaauauguagaguuugaagguuuuaugu

SEQ ID NO: 4129206 - RNA, 69 nt, Human
auacuacugauugcuuugccaaaaguauacucaccacccauacuauuuguaaagagcaaacgguugugu

SEQ ID NO: 4129207 - RNA, 84 nt, Human
auacuaucugguuugugcucuucauucucccaaauaggaaauuuuccugagcaaggagagucaagaggauggccucagauguau

SEQ ID NO: 4129208 - RNA, 78 nt, Human
auacuaucuuuauacauuuguagcuauuuacuguauguacauuuguccgucgugcggccuaagcauagauguaaguau

SEQ ID NO: 4129209 - RNA, 129 nt, Human
auacucacaaaaagacugaagauguaacagauggugccuugggauggguggauguuauggaugcagaacugucaacacaccuaucucaauuccauuuuaacuuucacauuaugucucccuguggacugu

SEQ ID NO: 4129210 - RNA, 91 nt, Human
auacucguuuaugauaucucuguucucuaugugcaauuucaauuuacacagagaaggucucauucgcauggagaaggaguugcguggguau

SEQ ID NO: 4129211 - RNA, 64 nt, Human
auacugugugugcucaaggaaugaauggggcuucauaaacaucuauuccaagagcuaucaguau

SEQ ID NO: 4129212 - RNA, 129 nt, Human
auacuucagugagauuggaaacuccgaagggauagggacuuuuauuccucucuggccccacauuaucuaggaggaaagaaccccagucaauaccuguucccaucauggucaauuucaaaccaucaucgu

SEQ ID NO: 4129213 - RNA, 71 nt, Human
auacuuuagcuuuauaggaguuuuuaguaugcauaugucuaacuguguauuccuauauaguaauauagugu

SEQ ID NO: 4129214 - RNA, 107 nt, Human
auacuuuguguuuucacgucuucaauugcauuugaugggaccagacaugagcaccaaaccaaagcuuaccaaucagaugcagaugagaaacuggaacugagaaguau

SEQ ID NO: 4129215 - RNA, 79 nt, Human
auagaaauccaacuguguucuccaacuguagauuuugcaugguagagguucaguaaggaauacugaguaggauuuauau

SEQ ID NO: 4129216 - RNA, 70 nt, Human
auagaagauugggaaugacacacagcuuauauaauuguguguacugcuguaaauauucuucaucauuuau

SEQ ID NO: 4129217 - RNA, 56 nt, Human
gaaggaggucugauacaauauggucauguaagaugaccucugaucaguccuuuuuc

SEQ ID NO: 4129218 - RNA, 73 nt, Human
gaaggauccucucucguggcuucacuuguuuucucuggaagcagacaaggcgugacggagagaggaacucuuc

SEQ ID NO: 4129219 - RNA, 58 nt, Human
gaaggauggauaaaacauuaaugggcaaagaucuauuuggaaaguuuaucuaucuauc

SEQ ID NO: 4129220 - RNA, 57 nt, Human
gaaggauggccacagcgcugguuccugucccucugggucucaggcugggccuccuuc

SEQ ID NO: 4129221 - RNA, 56 nt, Human
gaaggcaagugagccaagagaaugcuuuuccacauuccuuacauucauauggcuuc

SEQ ID NO: 4129222 - RNA, 59 nt, Human
gaaggcacagauggcaguccacagcaccuggcugaaacacagauuggccucuugucuuc

SEQ ID NO: 4129223 - RNA, 79 nt, Human
gaaggcagaaaaggcuaauccagagcaacucuugaaagcagccccaaggagucuuccagaaaagccuuggucugccuuc

SEQ ID NO: 4129224 - RNA, 69 nt, Human
gaaggcagcccagagauguuaucuaguaucagaaauuacaguuaaauauuucuacuggguguuucuuuc

SEQ ID NO: 4129225 - RNA, 73 nt, Human
gaaggcaguguccagcuuccuggagucccuuugucuucugcaucucccuggcuccagcagcuggccugcuuuc

SEQ ID NO: 4129226 - RNA, 96 nt, Human
gaaggcaugggguaaugaaaacauauuggcuuagcucugugacuaacaagaaaaguggucacugguuaaguuaaugucuuugggcucuguguucuc

SEQ ID NO: 4129227 - RNA, 60 nt, Human
gaaggccggagagugacagcuuccagaccagagacucugcugcccacucuuccagcccuc

SEQ ID NO: 4129228 - RNA, 62 nt, Human
gaaggccuguguguauacauaaaaauauuaacauuaaauaaaauuuguaugcauaugcuuuu

SEQ ID NO: 4129229 - RNA, 65 nt, Human
gaaggccuuggccuagcccuccagggucccauacuguggaguuuggaggggcaggucuggccuuu

SEQ ID NO: 4129230 - RNA, 86 nt, Human
gaaggccuugguuaaaacauuucagcaccugauuccuggacagcaccagagccauggaacaggcucagagaugcugccuggccuuc

SEQ ID NO: 4129231 - RNA, 88 nt, Human
gaaggccuuuggaaguaaaagauuuuauaggaacaaggaaucaagaaggaugacagaauuuguuucuugagaucuuccccuggccuuc

SEQ ID NO: 4129232 - RNA, 71 nt, Human
gaaggcuaguuuguuucuuggucaagccugaucuuaacagaugagaccauggccauccuaggaaagccuuc

SEQ ID NO: 4129233 - RNA, 62 nt, Human
gaaggcucacggaggucagcgugguggccagagcgaugaguuaccuuacuucugugaucuuc

SEQ ID NO: 4129234 - RNA, 86 nt, Human
gaaggcucugagauuuuagucuauugggaagcuaacagguuagccugccacaguuucauggauucugguaaauuauaugagcuuuc

SEQ ID NO: 4129235 - RNA, 101 nt, Human
gaaggcucuucuuuuggggaaaccugaggaagggcgagaagcucucccugucuccuggaucugcuugcccucuuaggacccuuccccuuuggguuuccuuc

SEQ ID NO: 4129236 - RNA, 55 nt, Human
gaaggcugcgaggggagugccgggugcaguuucacgugccuuccccucagccuuc

SEQ ID NO: 4129237 - RNA, 84 nt, Human
gaaggcugugagaaggggcauugugucuggguuccuccuuaaagcagaucugaggaaaaccuaagccaguagcucccacccuuu

SEQ ID NO: 4129238 - RNA, 58 nt, Human
gaaggcuuagaaacaagggagcugggagaucuguccgggcuuuuggaggaagcucuuc

SEQ ID NO: 4129239 - RNA, 73 nt, Human
gaaggcuuuccuccuggcuugcagacagaugcuuucuugcuguguccucacaugguggggagagagagcuguc

SEQ ID NO: 4129240 - RNA, 58 nt, Human
gaagggaaugaggcuauauaaacaaagugauguugauuuguaaauggcuuuuuccuuc

SEQ ID NO: 4129241 - RNA, 66 nt, Human
gaagggaauuuggaggguuucaccacauagcugcugccuugauggaggcucccucacacuucuuuc

SEQ ID NO: 4129242 - RNA, 80 nt, Human
gaagggagcuugcaggugggaacccagcagggcccuggguguccuugggcacugacagggucccaacugugagcaccauc

SEQ ID NO: 4129243 - RNA, 67 nt, Human
gaagggcaugguaucuauucaggaaugcuccagugagcuuccugaauauaaagacacuagcuccuuc

SEQ ID NO: 4129244 - RNA, 112 nt, Human
gaaggggagggaaggaagagauugaguauuaguguuauguuaucugcuaggagcuaugcuagccagaugcugucacacacacuguuacugaaucccaacuucucuucuguuc

SEQ ID NO: 4129245 - RNA, 130 nt, Human
gaaggggaguaaacacaaccugagguuuauugugaucugauguugucagagccugggcugaagcuaagggcugggcuuauguuugucaagcaaucaggaaaaccucugucuucuucuuucacuacacauc

SEQ ID NO: 4129246 - RNA, 107 nt, Human
gaaggggaguugagauacuugcugucaugauguugauaaauuacuuuaaaauucuucagaauaaaguggaauaugaauguauauagcaaugcuuuuuacuucucuuu

SEQ ID NO: 4129247 - RNA, 86 nt, Human
gaagggguucauuggaggccucagguguuucuggagaaguaaucacucaugauuauuuccuagggaauuugccucccuuucccuuc

SEQ ID NO: 4129248 - RNA, 77 nt, Human
cugugguauuuuaucugacugugguauauuuaacaaauaauguaugcaaacaguucaggugacacauaauaucagag

SEQ ID NO: 4129249 - RNA, 56 nt, Human
cuguggugacaauaguuuuuaaaucuaaucaugauagaagaacuaugugauuacag

SEQ ID NO: 4129250 - RNA, 76 nt, Human
cugugguggcagugagaaggagagguguaggcucuucuuucgugcuuuucuuccucccuccuuucugucucugugg

SEQ ID NO: 4129251 - RNA, 94 nt, Human
cugugguuauuggguugggugauuuugauucuguucaacaacuggaugcuuugaguaaugaacuucagugcauaauuauccagcgaaaucauag

SEQ ID NO: 4129252 - RNA, 55 nt, Human
cuguguaacuucuuuucuuucaucuguugcccagaagaacuauugagguacacag

SEQ ID NO: 4129253 - RNA, 107 nt, Human
cuguguacuucagauguuucaugcuagcauguguguguguguguguguguguguguguguguguguacuguauauauguuccagugugugaaaugucugguggacag

SEQ ID NO: 4129254 - RNA, 56 nt, Human
cuguguagccucaugugggcuuuaauaaauuuugguuaaauaaaugagguugacag

SEQ ID NO: 4129255 - RNA, 59 nt, Human
cugugucaucuaaaaagagagauauuuuccaaggaaguucuaaauuuuggaagaugcag

SEQ ID NO: 4129256 - RNA, 70 nt, Human
cugugucccaguaccuuggguaacugccaucuucaugguuacaucacuauccagggugacugugaagcag

SEQ ID NO: 4129257 - RNA, 73 nt, Human
cuguguccuugugugagaccugauaaccagagccacacuggcucagggccaguucucgcagcaguaagcaugg

SEQ ID NO: 4129258 - RNA, 61 nt, Human
cugugucucuaccuccccaucccuggcuuuuucccugaggaugugguggugagccauuuag

SEQ ID NO: 4129259 - RNA, 60 nt, Human
cugugucugucacagcugagcaaauuuauauuagcagcuaaacugacagaccccacgcag

SEQ ID NO: 4129260 - RNA, 73 nt, Human
cugugucuuuagcaucucaaccuccugaaaguaagaagcuggggaguuggggguagcuagagggagagaccag

SEQ ID NO: 4129261 - RNA, 56 nt, Human
cugugugacccccagugaagccuugcgguaucggggagccauggguggucauggag

SEQ ID NO: 4129262 - RNA, 85 nt, Human
cugugugccagaggcuuucacaagguuaguuccagacuaccgcccacaguugggagcaauuucuugagauaagccuggcuaauag

SEQ ID NO: 4129263 - RNA, 129 nt, Human
cugugugcuccuucucaucuggauucucccuuccugaccacacugccuucugcuccaagucuggccaagcugauuugcauguuuguuugagagggauggaaaaucauuagaguuuagagugguauuuug

SEQ ID NO: 4129264 - RNA, 58 nt, Human
cuguguguagcauauagcaagagcauauaugguaugcaagagcaauaugguaugcaag

SEQ ID NO: 4129265 - RNA, 56 nt, Human
cugugugugcacgugcggggaaauaccauuucauugcuuaucuaguucacauacag

SEQ ID NO: 4129266 - RNA, 62 nt, Human
cugugugugucugcagcauacuauauaaaauaaaggaguuuucagggcugcuggccauacgg

SEQ ID NO: 4129267 - RNA, 58 nt, Human
cuguguuagucucucaagcuacuguaaauuaccagaaacuugaugagauaaacagcag

SEQ ID NO: 4129268 - RNA, 83 nt, Human
cuguguucaauuaagaggcuaaguuacucucucugugggagccuuugaagaucccagguaauggcuucuauaauucuacucag

SEQ ID NO: 4129269 - RNA, 57 nt, Human
cuguguucugaaggagaagagugucaugagauggcccauuugcucacaggacagcag

SEQ ID NO: 4129270 - RNA, 65 nt, Human
cuguguuuccaguucagaaagcaaggaucaucauuuuuccauugcucacuugcuaggaaaugugg

SEQ ID NO: 4129271 - RNA, 64 nt, Human
cuguguuuuaaauggaaauuugacucuguguuugcuguugucaaucuguuccauuagaacauag

SEQ ID NO: 4129272 - RNA, 98 nt, Human
cuguguuuuaguaauucgcagggagacaggcucucucuuuuccuauuauacuuggacagaagagccuuuuaccuugugaaaugaaauuguaacuacag

SEQ ID NO: 4129273 - RNA, 55 nt, Human
cuguguuuuggggaagauggcaagauaaugucuggcuuccacacaagaagcacag

SEQ ID NO: 4129274 - RNA, 57 nt, Human
cuguuaaaagaacaacucggagguaauuggauuugccccugaaacugcuuuugccag

SEQ ID NO: 4129275 - RNA, 85 nt, Human
cuguuaaaagcacugccauccugggugaauauggacuuaaacauuucaaacuuaaaaaggaucaggacagauguuuuacaagcag

SEQ ID NO: 4129276 - RNA, 100 nt, Human
cuguuaaggggcccccucuacuuuaacauggaggcacuugcugugacaugacaaaaauaagugcuuccauguuugaguguggugguuccuaccuaaucag

SEQ ID NO: 4129277 - RNA, 58 nt, Human
cuguuaaguguagauaauguggaaauuaaacauauaauauaucuggugcacuuagcag

SEQ ID NO: 4129278 - RNA, 69 nt, Human
cuguuaaucugcuugcaugaugaauaaaugaauaaacauguaugugaaaucaugguaagcaauagacag

SEQ ID NO: 4129279 - RNA, 112 nt, Human
cuguuaauugaugucaaagcugugucugcugggucuggcacucaugcgguaaagugaaauuuccaaacaaguccagaccccggcagcugguccugaguuuacaaggugauag

SEQ ID NO: 4129280 - RNA, 77 nt, Human
cuguuacaaaggaguagagaaggcuuuucuucuucagucuuaguacagaggcuuuuaaucuuagucucuugugauag

SEQ ID NO: 4129281 - RNA, 78 nt, Human
cuguuacaagaggaagcauugacauaaucuccauuagagcucuauauaggggcuuguuucauugcaaucucuuagcag

SEQ ID NO: 4129282 - RNA, 87 nt, Human
cuguuagcauucccagugccagcucuccccacaucugugcagcuuuuguccuguggcaggggaggauuuggaauggucugcuggcag

SEQ ID NO: 4129283 - RNA, 86 nt, Human
cuguuagcuucaaacauuuaggaggagggagggggaacgcccaauaaaguaauucucuccuauuucagaguguucaaauaugacag

SEQ ID NO: 4129284 - RNA, 55 nt, Human
cuguuaggacaugcauuaggcccuaacccaggggcucugggacauuucuuagcag

SEQ ID NO: 4129285 - RNA, 78 nt, Human
cuguuaucugguaaaagagccacuuaugaccucaggugcuacuuaaccuggggggcaauuguuucuuaggccuagcag

SEQ ID NO: 4129286 - RNA, 67 nt, Human
cuguuauugguaguaaguggaacacacuggguaaauacgucccaaguuauuccuuuacacuauacag

SEQ ID NO: 4129287 - RNA, 129 nt, Human
cuguucauagcaaaacagcugauguucuuuaaaauuagucauuuuuuagugguuuagucauuuauagugguuccacaugacuauaauuacuuaaauauguggcaguauagacagcucuccuaucugcag

SEQ ID NO: 4129288 - RNA, 60 nt, Human
cuguucaugagaugcuccuuguaccuggucaaguaugugucagacugcacucaaggacag

SEQ ID NO: 4129289 - RNA, 67 nt, Human
cuguucaugcugauucuguaugugaucuucgauuaauuugacaguugcauauaaguuagcauagcag

SEQ ID NO: 4129290 - RNA, 80 nt, Human
cuguucauuucugcaggccugaagggagguggggcuaguaagucucagccccuucucugcaagccugcucuaaacagcag

SEQ ID NO: 4129291 - RNA, 63 nt, Human
cuguuccaccucagcaugcucacagagcucggcccugccugcuggcucaguugcugggcacag

SEQ ID NO: 4129292 - RNA, 58 nt, Human
gaaacucucgcauccugggaaccccuucaguucugggcagaccaggagcgugggucuc

SEQ ID NO: 4129293 - RNA, 88 nt, Human
gaaacugggaaauuucccuuaucuugucaagcucaugggacucccaucauuuccuaaccccaaagccaggggagggauucccaauauc

SEQ ID NO: 4129294 - RNA, 59 nt, Human
gaaacuguuucuggcuuuggugcuuuguguacucacuacagccauuuuaccauaguuuc

SEQ ID NO: 4129295 - RNA, 59 nt, Human
gacaguuuagguucaaaucucauaucugucacuuggugacuguuuggccuagaacuguc

SEQ ID NO: 4129296 - RNA, 91 nt, Human
gacaguuucaccagaggccccggggcagagggucuucuccagcucuuccagggcggggcucaucuguuccugggccagagguggaccuguc

SEQ ID NO: 4129297 - RNA, 67 nt, Human
gacauaacagugaaccaugcggacccuuggccuucggggagcuuccugcaggucacugugcccuguc

SEQ ID NO: 4129298 - RNA, 101 nt, Human
gacauaagcuuguacuuuguggaaagagcagagacuuuggaaucagccuagguuugaauucuggcucuucuguuuaucaccuguguaaucuuggauauguc

SEQ ID NO: 4129299 - RNA, 74 nt, Human
gacauagaacagaaacagaugcacaguuccauagacccagaugauuucuguagcuuucugauuuuucucugguc

SEQ ID NO: 4129300 - RNA, 73 nt, Human
gacauagaacuucccagugagcagggucagcuggugcugugccuaauuaacaugcagcagaagucucuguguc

SEQ ID NO: 4129301 - RNA, 60 nt, Human
gacauagagagaguaguagcaucucaccugugguagaggcuucuacugcucacuuauguc

SEQ ID NO: 4129302 - RNA, 58 nt, Human
gacauagucucugucuucauggaguuuuugaucuaauaauggagauugagaugugauc

SEQ ID NO: 4129303 - RNA, 81 nt, Human
gacauauuugggcaugucuguguuaucuguagaauguuuugaaaaugauauucugaguacaacaagauguuuccuuauguc

SEQ ID NO: 4129304 - RNA, 67 nt, Human
gacaucacugauaccuuuauuuucauggauuugaguaugugcaugagaauauuguuuuagugagguu

SEQ ID NO: 4129305 - RNA, 88 nt, Human
gacaucagguagcaguaaugaggagaauagaauuuaguuuaauauugcuauuuuuaaauuccagccucauaauagcucucuuuguguc

SEQ ID NO: 4129306 - RNA, 79 nt, Human
gacaucuaaggaacucuagagccuugaacuugcuuugacaauauggcuucugguucuaauuuggggcuccuuagagauc

SEQ ID NO: 4129307 - RNA, 90 nt, Human
gacaucuucucagcacaggaauaugguggacaagagcaauauggacuccguccuuguggcacuuacauccuaguuugggagugugauguu

SEQ ID NO: 4129308 - RNA, 78 nt, Human
gacaugaaaauaaagcaaucuguuuuugaaacuuuguauuucaaauacuagggggucuauagcaggaauuuguguguc

SEQ ID NO: 4129309 - RNA, 64 nt, Human
gacaugaagggaaaagggcuguguucguguucucuagaggacucuaaccuuucucuuucaucuc

SEQ ID NO: 4129310 - RNA, 63 nt, Human
gacaugaaugaagacuuuacaaugcaaggaugcucaugugcuauugucaaguucauuuauuuc

SEQ ID NO: 4129311 - RNA, 56 nt, Human
gacaugaguaucagaguccuuccauaugagugagaggaaggcuucuuggcucaguc

SEQ ID NO: 4129312 - RNA, 74 nt, Human
gacaugcauggagggaaaaugucagugcauaauguacaacauuucauuuaggauguuuucccucuaugcaucuc

SEQ ID NO: 4129313 - RNA, 72 nt, Human
gacauggaaaacuaacugcuuuuuuaaaggauguuuucacagauaccuguugaaaucagauagauucauguc

SEQ ID NO: 4129314 - RNA, 80 nt, Human
gacaugggagggacaggaggugggacaaagagaagcaggacuuacuggaccaaagccuucugauaucucuuggcauaguc

SEQ ID NO: 4129315 - RNA, 60 nt, Human
gacaugucuauaaaauaauuucaguaaaaaccauuacaugggauuguucugugacauguc

SEQ ID NO: 4129316 - RNA, 56 nt, Human
gacaugucugugcuucuagcugcuaugcauuugagcugcaucucauagaacauguc

SEQ ID NO: 4129317 - RNA, 57 nt, Human
gacaugugucugcaaguugaucuauagagcaagaucaauuauugcaucauagauguu

SEQ ID NO: 4129318 - RNA, 76 nt, Human
gacauguguucugaggcagaugacugcgggacccacgggcuugauugguucucccuguucucaaggacaacauguu

SEQ ID NO: 4129319 - RNA, 66 nt, Human
gacauguugaagaauauuuggaaagaaaacaguuugacuuuguauccaaauguuuuaugacauguu

SEQ ID NO: 4129320 - RNA, 78 nt, Human
gacauuacaguuuaguccaagccagaagguaauugggucaaccacaccuggacucugaggauuuuaaauucuaguguc

SEQ ID NO: 4129321 - RNA, 73 nt, Human
gacauucccagguacaucauuagccaacugggacucaauaaggaucccuuggaaggugagucccuggguuguu

SEQ ID NO: 4129322 - RNA, 60 nt, Human
gacauuccugaagaagguauguugcccagcaucgaugggaauagaagaauuuaggaaguc

SEQ ID NO: 4129323 - RNA, 60 nt, Human
gacauuccuggcacagggcuuggucgcucauucaggcugauggccgcccuuugcccuguc

SEQ ID NO: 4129324 - RNA, 75 nt, Human
gacauugaaacauucagucaacaguguuugccacucaguaaguaaauacucauauauguuguauguuaaaauguu

SEQ ID NO: 4129325 - RNA, 67 nt, Human
gacauugacaguccuccuuauaaauggccuuuucugggcuuaagaugacagggcacugccaucuguc

SEQ ID NO: 4129326 - RNA, 69 nt, Human
gacauuguaaucaugcaucaguuaguuuuuggcucuuuaauuuugaaagcagauguuugauugcuuguu

SEQ ID NO: 4129327 - RNA, 67 nt, Human
gacauuucucagggaguuuugcuuaaagaagauuagaguaauugagcaggaaaccgagggugauguu

SEQ ID NO: 4129328 - RNA, 129 nt, Human
gacauuuucuuugguuaaauugagguugugcauuuuugguaagaauauaauggaagugauauuguuuccugaucagugcauucuaccaaaaggcacaugauauugauuuguccuguugcugguaauguu

SEQ ID NO: 4129329 - RNA, 60 nt, Human
gacauuuugcccuuccuuaagaaaauaaauaaauuaaucauaggugaggggcaccauguc

SEQ ID NO: 4129330 - RNA, 115 nt, Human
gacauuuuuauaaacaaucugugagaggaagacaucuccauauuugaagaauaaauuuugcuuuuccaaguacugagcugucaaacugguuggggauaaacugccuaaaaauguc

SEQ ID NO: 4129331 - RNA, 57 nt, Human
gacauuuuuguucauuucucuucagagugaauugaagugaauaugcagcaagaaguu

SEQ ID NO: 4129332 - RNA, 94 nt, Human
gacauuuuuuaagcgaauuuauaauaaauagggcuuuuucaauuauacaguaauguagguuccaaagugcuauuuuguggguuuucuguguguu

SEQ ID NO: 4129333 - RNA, 88 nt, Human
gaccaacuccacuaaacccuguccucucuugcucaucccguaccccucaagaaauagaggaaagguuugacuucugugaaggaugguc

SEQ ID NO: 4129334 - RNA, 61 nt, Human
gaccaacucgucugccccugugagcaauguuuauuauucaacagggcaugaugagacgguu

SEQ ID NO: 4129335 - RNA, 85 nt, Human
gaccaacugauaacugcacagcagagccuggaucugcucccauacugcuuccaauggggccucucugucagauagucaguuaguu

SEQ ID NO: 4129336 - RNA, 62 nt, Human
gaccacacgucccagagagcccagcuccaugaugggagagcagggccaggcugacugugguc

SEQ ID NO: 4129337 - RNA, 63 nt, Human
gaccacaucauccuauugugccccagguugucagaauaaccagguuuuuuagaugguggaguc

SEQ ID NO: 4129338 - RNA, 68 nt, Human
gaccacugugagacugguucugaacccagugaccuccaucucugggagcaguugcaucuccagugguc

SEQ ID NO: 4129339 - RNA, 63 nt, Human
gaccacuucaugcuuugauuuucacuguggggaaggauuucucaaagagguaggaagugaguc

SEQ ID NO: 4129340 - RNA, 58 nt, Human
gaccagaacuucuagucuaaguucuucauuguuaggaauuuaacuggccuucuggcuc

SEQ ID NO: 4129341 - RNA, 57 nt, Human
gaccagaauguuuagucaguuaguugugaauaucaauugcagaagaacguucugguu

SEQ ID NO: 4129342 - RNA, 60 nt, Human
gaccagcuaagaaggaacucagaggcuuugggaaaauuacucuucugggcuucagugguc

SEQ ID NO: 4129343 - RNA, 72 nt, Human
gaccaggaucaagacuguggggcuguuccauggaaacaugaaaacauacugcagcucccagcuugaaagguc

SEQ ID NO: 4129344 - RNA, 56 nt, Human
gaccaggcuuccccagaccucaggccacacucuucuggguugagucaagccugguc

SEQ ID NO: 4129345 - RNA, 102 nt, Human
gaccaggguuucucagccucggcacuauugacauuuggggcuaauuauucuuuugugggggcuguucaguggauuguagaaggcuuaguagcaucccugguc

SEQ ID NO: 4129346 - RNA, 59 nt, Human
gacccacagaccuggaaguauuugacuauuugaauaacugguacagguuuacugguguc

SEQ ID NO: 4129347 - RNA, 82 nt, Human
gacccacaucuaauuuuaggcuacugugacuuuccugagucccacuacagcugagcaucacuagucugguacagcauggguc

SEQ ID NO: 4129348 - RNA, 77 nt, Human
gacccagaagcccucucagaguuccaagguuggcuccugugggacgcucacugccauucucuagauguuucuggcuc

SEQ ID NO: 4129349 - RNA, 58 nt, Human
gacccagaggccugacagugugguuguguaaaauugucggugucggugucuugggcuc

SEQ ID NO: 4129350 - RNA, 87 nt, Human
gacccauauagcaaacuggagcuugcuuuacucauuaauucuaugguguguaugaguguuuccagguauuugcuuucuucucagguc

SEQ ID NO: 4129351 - RNA, 76 nt, Human
gacccauuacaauaagguuuauuuguagcauacauaguugcaaaguauguauuuaaauguugcuguguccaggguc

SEQ ID NO: 4129352 - RNA, 97 nt, Human
gaccccagggccgcaccuucccucccagugccggggccggcuaggggcucugugggcagcgcggccgccuggcgccggggugcgcccacguggaguc

SEQ ID NO: 4129353 - RNA, 68 nt, Human
gaccccaugugaucuaacccaggcaguccaaugaccgugccaggaggccugggcugggcuacaggguc

SEQ ID NO: 4129354 - RNA, 78 nt, Human
gacccccucuguuugauuguuaucccugcugccugaaagcccuggguggugauggccagucgcacuggaggaggcguc

SEQ ID NO: 4129355 - RNA, 56 nt, Human
gacccgaagccaagacagaugaacuugaguccccaaauucacacuuccuuuggguc

SEQ ID NO: 4129356 - RNA, 76 nt, Human
gacccuauaggcaccaugggggcauguguuacccauauuaugggucccuucagcucucauggagacccacgggguu

SEQ ID NO: 4129357 - RNA, 61 nt, Human
gacccugagccaaaccaguuagaugucauccauacagcauuccuuucuggagcucaagguc

SEQ ID NO: 4129358 - RNA, 63 nt, Human
gacccugggguuccaaugaugagcaagagaugcauggucucugccaucuuggagcucaagguc

SEQ ID NO: 4129359 - RNA, 56 nt, Human
gacccuuggcugcagcaucacauuuaacccuccuuggaaugcuacaggcagguguc

SEQ ID NO: 4129360 - RNA, 72 nt, Human
gaccgacguccuccccuuuuggaaguccagggagcagagaucccuggcucuggccaccgggagggcaagguc

SEQ ID NO: 4129361 - RNA, 84 nt, Human
gaccgagcagccugagcucaagaaggugaccagacggaggcagagcccuacacagugaucgccuucuuccucgggaucuugguc

SEQ ID NO: 4129362 - RNA, 92 nt, Human
gaccgcugggguggccuugcugggcuggcaggggaucgcccucucccugagcagaugaccagccccagcagggcccaggcucacggacgguc

SEQ ID NO: 4129363 - RNA, 61 nt, Human
gaccggcccagagcaggcuucaugccagcacugcagcccugccugcugccuguggccgguc

SEQ ID NO: 4129364 - RNA, 90 nt, Human
gaccggucauuuuuuaagcugguaguguuuauaaggguauuauucauauaauaauuuacuaagcucuaccuuuuuuuguguggccguguc

SEQ ID NO: 4129365 - RNA, 72 nt, Human
gaccuaaaggagaacaagacccaagucuucccauaccagggugacauucugucaauguugacuccguagguu

SEQ ID NO: 4129366 - RNA, 76 nt, Human
cuugugccucccgggaccaugcacugacuaaaggaggagaagggguccugccagggcagguguuggaaggcagagg

SEQ ID NO: 4129367 - RNA, 74 nt, Human
cuugugcgagugcugggaugcugucucuacuuccuuuuggguugccagaggcagcauuuagagcacaguguggg

SEQ ID NO: 4129368 - RNA, 79 nt, Human
gaaguuauucagugguuugagaacuuagaauuggaaaaucucuccuuuuuauuucccucaggacccaacuuguaacuuc

SEQ ID NO: 4129369 - RNA, 64 nt, Human
gaaguucaaugucagcaucuaugucuuaaccauuuuuguguuaauuguugauauugaaaacuuu

SEQ ID NO: 4129370 - RNA, 77 nt, Human
gaaguucagggucuuauaaggccaauuuuucucuuuaagauaagauggcauuagagcacccaauaccaaugaaauuc

SEQ ID NO: 4129371 - RNA, 92 nt, Human
gaaguucauuugcaagccuggugaccucucacuaugucacuggggcaacaugacaaagugaggucuucaguauugcacagaugugaaauguc

SEQ ID NO: 4129372 - RNA, 67 nt, Human
gaaguuccugggguuggggguuaguaguguaugcaaacacagaggcaugacccugcccuugagcauc

SEQ ID NO: 4129373 - RNA, 63 nt, Human
gaaguuggcagucugcaaccuggacgagggccaccagcacccucaucucggacuucuagcuuc

SEQ ID NO: 4129374 - RNA, 55 nt, Human
gaaguugggaggagaaaagguuuugaguaucuccccuagccucuuacccagcuuu

SEQ ID NO: 4129375 - RNA, 61 nt, Human
gaaguuuacacuaagcaggugugaggauaaaguaacuucacaucaguuuaggucagauuuu

SEQ ID NO: 4129376 - RNA, 58 nt, Human
gaaguuuagaguuuggaguccuuaauucaaaucuuagcucuaccaaauucuggauguc

SEQ ID NO: 4129377 - RNA, 66 nt, Human
gaaguuucuaguuucauuugcaggcaggaaaguucaacuuccuguuucaaaauaacaagaggguuc

SEQ ID NO: 4129378 - RNA, 65 nt, Human
gaaguuuguagucauauauuugcuccuaaaaucaaguuagucagauauaugacuuacgugauguc

SEQ ID NO: 4129379 - RNA, 59 nt, Human
gaaguuuuaugcacaaauauguuaagcccaaaaauguauuuguaguagcauagaauuuu

SEQ ID NO: 4129380 - RNA, 55 nt, Human
gaaguuuucugaggcuguagcuuuaugcaaauaugcuacucaagaagaaggcuuu

SEQ ID NO: 4129381 - RNA, 97 nt, Human
gaauaaacaguacuuuuauucuuaaugagauugcuuucuauaucuguaaagcccuuaucuuugguuuuauaagaagcaaugucugaguuguggauuc

SEQ ID NO: 4129382 - RNA, 63 nt, Human
gaauaagaauguggugccgcuggagaguuuagaggacuugacucucuaacgacauucccauuc

SEQ ID NO: 4129383 - RNA, 81 nt, Human
gaauaagugcacuucauuagagcagauaauauguguguucaguucauccugucaagcgcaccugcucuaaaguggcuauuc

SEQ ID NO: 4129384 - RNA, 76 nt, Human
gaauaaucccugcucagcucaccuggcagcucuucucucagguuaugaguuucaggugggcugggcgcggugguuc

SEQ ID NO: 4129385 - RNA, 103 nt, Human
gaauaauugcauuaguaacuugauaaguauucucugcauucucagugugguccugggacagccagcaugauaaucacuugagguuacucauuacaaauuauuc

SEQ ID NO: 4129386 - RNA, 102 nt, Human
gaauaauuuugcaaaugugucugaucuaucuaucuuuugaacucucuuggauaugguguccuaaggucuagauuuauagacagcauguuaguaagucuguuu

SEQ ID NO: 4129387 - RNA, 77 nt, Human
gaauaccaagugaaugaugugaaguguaaaccaaccauuguuguguuucauguuacugucauacacuuguuuccuuc

SEQ ID NO: 4129388 - RNA, 91 nt, Human
gaauacccagaagccuucuuuucugugucccuuauucuagcuuuugcgcugcuguacaaauuccacaagagaagaugcucuuuggauauuc

SEQ ID NO: 4129389 - RNA, 61 nt, Human
gaauacuugugugcaguugugcucaggucugacucugugcaugcaaagaauauagguguuc

SEQ ID NO: 4129390 - RNA, 69 nt, Human
gaauagaacuggcagauauuugcagacaugcagcuuuuggguaugccagcauuaucuccagucaaauuc

SEQ ID NO: 4129391 - RNA, 67 nt, Human
gaauagauacucagaaaugcuuucaccaucaagcugggguaugaaggcuccaucugaguaggaguuc

SEQ ID NO: 4129392 - RNA, 55 nt, Human
gaauagcuuagauuccuuagugccugagucagggccuaauaaauaauagcuacuc

SEQ ID NO: 4129393 - RNA, 73 nt, Human
gaauaggaaggagagaaaaccagagccacaggaagaggaacuugauauugguguacaucuccccuucauguuu

SEQ ID NO: 4129394 - RNA, 115 nt, Human
gaauaggaguguuucaaacuugauuaaugugcugaggguugauuuauguuuuaaaagccugugagcaggucgaaaaugaagagucaauuaaagcuaauccggucuccuccuacuc

SEQ ID NO: 4129395 - RNA, 73 nt, Human
gaauaguccccugaaguugagaaaaccacaugaccuuacagugugaaaucuacccuauucaggguggcuauuc

SEQ ID NO: 4129396 - RNA, 74 nt, Human
gaauauaaaagaugaugcagacuuugauguuccugccuucaagaagcucacagucuggcauagucuccauauuc

SEQ ID NO: 4129397 - RNA, 55 nt, Human
gaauauauaucuccacuguuacacuucuuuguguugcagugauuugucuauguuu

SEQ ID NO: 4129398 - RNA, 64 nt, Human
gaauaucaguauauuguaucagugagugauagagcuacaaaacugauuaacaugugugauauuc

SEQ ID NO: 4129399 - RNA, 73 nt, Human
gaauaucuuaggagugugauucugggauaucuuaaugcgauccaagauguuuuagaguuugacuugauauauc

SEQ ID NO: 4129400 - RNA, 82 nt, Human
gaauaugauugaccaggauacugcagggauggaacauuugauaaacugucuccuguagcuucuuggaaggcagagcauguuc

SEQ ID NO: 4129401 - RNA, 78 nt, Human
gaauauuccugaggugugggugguugguuuccuuacaagguaggguuugcaagcuccuuacauccacaggggcuguuu

SEQ ID NO: 4129402 - RNA, 67 nt, Human
gaauauugaaacggaugugagacgugcauuuuggguuacaguaacauguuuuaaguccucucuauuc

SEQ ID NO: 4129403 - RNA, 80 nt, Human
gaauauuggcuguuuguuuguguuuguugccucauggcugcaaaauugcugcuguggugucaagcaucucaaccauauuc

SEQ ID NO: 4129404 - RNA, 61 nt, Human
gaauauuuaaaacgaggccacuggacugcuuuucugcaguucacauaucuguuuuauuuuc

SEQ ID NO: 4129405 - RNA, 89 nt, Human
gaauauuuagaguggcgagugguauuuuaaaaucuaguuucaaaggagaacugaggguuuuaugguucacuugcaaugucauuguguuc

SEQ ID NO: 4129406 - RNA, 69 nt, Human
gaaucaacauaugcaugggaaagucuccuuuugaaauggcugauuauccaagggauguauguggaauuc

SEQ ID NO: 4129407 - RNA, 67 nt, Human
gaaucaacccuggugggaauauuugcaccuuggaaaucugcaaaugguacaaaucagggcuugauuu

SEQ ID NO: 4129408 - RNA, 100 nt, Human
gaaucacagggccagaauaauuuuuaguuuuauuuacuuggucuagauuuugucaucacaaaucugagaauggagcuaaaaaucacagccuguaggauuc

SEQ ID NO: 4129409 - RNA, 60 nt, Human
gaaucagguucugccgcugcucucugccugcuugccaacagugcagugcagagcccuuuc

SEQ ID NO: 4129410 - RNA, 120 nt, Human
gaaucauuaauuuggcuuuugaaaaccauuugcuuugcuagugacuggauuugggaacuccaacauccagaucucagcauggcuuuugagguuuacaagguaaugcucaugaugugauuc

SEQ ID NO: 4129411 - RNA, 60 nt, Human
gaauccucauggguagcucuggaaccucagagucagcgguucuagaaccgugggcgguuc

SEQ ID NO: 4129412 - RNA, 121 nt, Human
gaauccucuugaggguuuuuuaaagauaccagugcuuggcuccuuccccagauauucugauuuaauuggucuggaauggguuucaggcacugguuuccuuuaaaagcuccuuaggggauuu

SEQ ID NO: 4129413 - RNA, 79 nt, Human
gaauccugacuaauacacgagucuuuuagagauauuaccggauucucuuugaacucuguguauuaacuuuacaggguuu

SEQ ID NO: 4129414 - RNA, 58 nt, Human
gaaucgcgcgcucgcggaggcugggccacggccucggggccuuggcgggggccgaauu

SEQ ID NO: 4129415 - RNA, 61 nt, Human
gaaucuagccuuucaagggguagagucuguuuucccuccucuugaaccuaggcaagacuuc

SEQ ID NO: 4129416 - RNA, 78 nt, Human
gaaucugucacccaggcuggagugcaguggcaugaucucagcucacuguaggcucuaccucauggguuccagugauuc

SEQ ID NO: 4129417 - RNA, 84 nt, Human
gaaucuuauaagaaauuguuaguaugugugcuuacaucugcuaugauuauagcauuagauuaaaaauuuagauuugugauauuc

SEQ ID NO: 4129418 - RNA, 56 nt, Human
gaaucuuaugugguguuuucuaaauuguuuucuggaaaaugccacucccaggauuu

SEQ ID NO: 4129419 - RNA, 77 nt, Human
gaaucuucucuccucuucucacugcgccaccucugaucuccagcgcagcagcguggggacaggagcucagaugauuc

SEQ ID NO: 4129420 - RNA, 109 nt, Human
gaaucuuuuuccucuuuucuuauucuuuucugucaaaacuuagcuaagugacugcauucuuuuagacacuuuugaagaagaugggaauuuagaggaagcuaguugauuc

SEQ ID NO: 4129421 - RNA, 64 nt, Human
gaaugaaagugccauauguuauugcuauugucaguaguagcaacagcaauagugguauugguuc

SEQ ID NO: 4129422 - RNA, 116 nt, Human
gaaugaacaaaauacuuaagaauagaaagaacagauguguggugcauuuuuauuucaaaaucaccauugaaaaacagguuugauuuuugcuuguuugaaaguugguuggcuuauuc

SEQ ID NO: 4129423 - RNA, 56 nt, Human
gaaugaacuggaucaggguuucucuaacaauguuggagaggaagucagguuuauuu

SEQ ID NO: 4129424 - RNA, 55 nt, Human
gaaugaagcaggucacacaguuccuuuaaaagguauuugugaagcugcuuuuuuc

SEQ ID NO: 4129425 - RNA, 62 nt, Human
gaaugacagugagggaggcauuugaaauggaagccaguagaaugauccuacacauggaauuc

SEQ ID NO: 4129426 - RNA, 94 nt, Human
gaaugagcuuugagacucacugccuuagaaaaucauggaauauuaaaaguuuaguauuggauauaaucuaggaagagugcucuuaaucuuguuu

SEQ ID NO: 4129427 - RNA, 80 nt, Human
gaaugaguagaguauaaacaaaguucucccaauacaguaagagaugggcuuaaaauuuguuuguguuucuuuauuaguuc

SEQ ID NO: 4129428 - RNA, 65 nt, Human
gaaugauaccgccaauauuaccauauuacuuauggugauaugcauggcaguauaaucauacauuc

SEQ ID NO: 4129429 - RNA, 73 nt, Human
gaaugauauuuuguccugguuuuuaaguuuuauguuuuuaauuuaaggcuuauauacuuagacauugucauuu

SEQ ID NO: 4129430 - RNA, 81 nt, Human
gaaugaucaccugauggaaucucuaugccaauugaaauauaaagucacaugguagcacauugcauuaggagauacucguuc

SEQ ID NO: 4129431 - RNA, 79 nt, Human
gaaugcaaggaacucaacacaguauuugguauaguaacaggcccuguaugcucgagcuacaguguugaucauuacauuc

SEQ ID NO: 4129432 - RNA, 70 nt, Human
gaaugcagaugaaauucagaauugaggggucagugagaucuuuuggagaugaaaauuugaucuguuauuc

SEQ ID NO: 4129433 - RNA, 72 nt, Human
gaaugcaugaaugggucauuauuugaucaauuuccagcuuugauuagaccuuggaccaguuugagagcauuu

SEQ ID NO: 4129434 - RNA, 62 nt, Human
gaaugcauguuuucuaggcuuucacaaccaucuggaguugugggggugagaaaacugcauuu

SEQ ID NO: 4129435 - RNA, 76 nt, Human
gagcuacuccuuguuuucaggccuguaauuugcuaaaggauugagcacaacagagaaacuaaggaguuuggagcuu

SEQ ID NO: 4129436 - RNA, 67 nt, Human
gagcuacuguuuauuuugguuaucauuuuaguauggcuguuaagaaaggccgaaauaauaguggcuu

SEQ ID NO: 4129437 - RNA, 81 nt, Human
gagcuagauggugauagagcugggauuggcauauggauauuguuccaaaucccauguuguauauacaguaacauaaggcuc

SEQ ID NO: 4129438 - RNA, 78 nt, Human
gagcuaucaccuuaauaaacugagcugcuuauuuaaauaaauucaugcaagccacugagaguugggguugaugugcuc

SEQ ID NO: 4129439 - RNA, 63 nt, Human
gagcuauuucugccuaaugaccuguauguaaaagcaacagaaauauagaagguaggaauaauc

SEQ ID NO: 4129440 - RNA, 58 nt, Human
gagcuauuucuucgggauucaagcuaguaugcaacuggcuaaacaguggagaaagcuu

SEQ ID NO: 4129441 - RNA, 58 nt, Human
gagcucaaggccauguaggaggcaugcggcguugcagcagucagucaggccuggguuc

SEQ ID NO: 4129442 - RNA, 69 nt, Human
gagcucacaccauugaagcaggcuguugaggaucagucacuauuccugcugccauuucaagugcugcuu

SEQ ID NO: 4129443 - RNA, 99 nt, Human
gaggcaggagaauugcuugaaccugggaggcggagguugcagugagucgagaucgcgccacugcacuccagccuuggcaacagagcgagacucugucuc

SEQ ID NO: 4129444 - RNA, 98 nt, Human
gaggcaggagauugcuugaacccaggcgggagaaguugcagugagccgagaugguaccacugcacuccagccugggcaacagagggagacucagucuc

SEQ ID NO: 4129445 - RNA, 99 nt, Human
gaggcaggaggaucacuugagcccaggagguggaggcugcagugagcaaugaucacaucacugcacuccagccugggcgacggagugggacccugucuc

SEQ ID NO: 4129446 - RNA, 99 nt, Human
gaggcaggaggaucgcuugaacccaggaggcagagguugcacugagcccagaucgcgccauugcacuccagccugggcaacagagugagacuccgucuc

SEQ ID NO: 4129447 - RNA, 61 nt, Human
gaggcaggauccuggccucauagagcccccaaucugaggggagaggcaggauccuggccuc

SEQ ID NO: 4129448 - RNA, 57 nt, Human
gaggcaggcggccccugcucugcuucccugcugguguccuacagggccgcaggccuc

SEQ ID NO: 4129449 - RNA, 60 nt, Human
gaggcaguugcaguaauccaggcaagacuuguugagggccuggauuaaggcagugacuuc

SEQ ID NO: 4129450 - RNA, 56 nt, Human
gaggcauaaaucacaguguucagauuaaaguucugccugucauuuggaaaugccuc

SEQ ID NO: 4129451 - RNA, 56 nt, Human
gaggcaugaaugcaguguccuuuuccaggaaauguguggugcugacaucaugcuuu

SEQ ID NO: 4129452 - RNA, 99 nt, Human
gaggcaugagaauugcuuaaaccucggaggcggaggcugcagugagcugagauggcgccacugcacuccagccugggugacagagcaagacuuugucuc

SEQ ID NO: 4129453 - RNA, 66 nt, Human
gaggcaugcagagcuggagcagucaguguaaacuguucugggaagccagacucugcaacuguucuc

SEQ ID NO: 4129454 - RNA, 73 nt, Human
gaggcauucuagaaguagaaguagaaguagaaguagaauauuugugaauaaugcucuacauuagcaguguuuc

SEQ ID NO: 4129455 - RNA, 60 nt, Human
gaggccaaagcucugcuccugcuccuuagggugggagacauauuccagagcuggggcuuc

SEQ ID NO: 4129456 - RNA, 84 nt, Human
gaggccaaagggguccagaaggaggucaaguuggcugagcaggccuuuccagcucuggcuucuugcuggguccccuaacaacuu

SEQ ID NO: 4129457 - RNA, 65 nt, Human
gaggccagaagugccucgggcugagggggacccagacccucagcucaggcaacucugggccccuc

SEQ ID NO: 4129458 - RNA, 67 nt, Human
gaggccaggaccacacgacaggagaguccugcaaagggacccuccacagcugugugucuccuuccuc

SEQ ID NO: 4129459 - RNA, 56 nt, Human
gaggccauaagaaguucuuggguucuguuuuccauaauuaacuaauuaugugccuc

SEQ ID NO: 4129460 - RNA, 72 nt, Human
gaggcccagaugcugccaggccccucaguuuaccuugcgaaguuacuuacggaucagcagcauuuggucuuc

SEQ ID NO: 4129461 - RNA, 65 nt, Human
gaggcccaggcucuguuccccgaggagccaggucagccugcccuggggagccgagucugucuuuc

SEQ ID NO: 4129462 - RNA, 57 nt, Human
gaggcccuucuugguggcucaggacuggugggcaccgucucugggaggaagggccuc

SEQ ID NO: 4129463 - RNA, 99 nt, Human
gaggcccuuugcggacuggcuggccgcgcucuucgcacggggcgcuuuugcguggggucgcgcaggagccgcggagggccggaucgcugagggagcguc

SEQ ID NO: 4129464 - RNA, 70 nt, Human
gaggccuacccuggaggcuggcccugcugggcacugucugccaggcugccagaagccuucaggaggcuuc

SEQ ID NO: 4129465 - RNA, 76 nt, Human
gaggccuauaauuuuccaguaauuagacuuucaggcacauaugucuuguggcucgaauaugauucuguuauaccuc

SEQ ID NO: 4129466 - RNA, 65 nt, Human
gaggccuccucugagacaucugagccccucucuuauccuacugucaguguccaaauccaggccuu

SEQ ID NO: 4129467 - RNA, 67 nt, Human
gaggccucugagcuccagaguuagacacccggggccagucuggcucugucuggggcugaggggccuu

SEQ ID NO: 4129468 - RNA, 57 nt, Human
gaggccucugggccugcggguuuuaccucacuuggaaacguucaaggcagaggccuc

SEQ ID NO: 4129469 - RNA, 80 nt, Human
gaggccugcucuaggugcacaccggccccucugcaaauccccggcuggccgaacggugcccuggcagacaaauggcucuc

SEQ ID NO: 4129470 - RNA, 100 nt, Human
gaggccuggaucuuguccacacuaagcgauggcuuuacugcggggagauaauccuucuggaaaccucagguagagucugcauggggaaugagauggcuuc

SEQ ID NO: 4129471 - RNA, 58 nt, Human
gaggccugucgcuaggccucugcugccugggggacaaaaggggccuggaacaggccuu

SEQ ID NO: 4129472 - RNA, 74 nt, Human
gaggccuuggauuucucaguuugugugauauugucuuacuuuguuaagaucacugaauugaaaguaaugguguu

SEQ ID NO: 4129473 - RNA, 76 nt, Human
gaggcgcaacgcuuacccucguggaccaacaaucgaauuaacaugcugauacacacauggggugagugacgcccuc

SEQ ID NO: 4129474 - RNA, 68 nt, Human
gaggcgcucaggccuugaaggccugcgggaggucgaaaugguccuggggaggucgaggcugaggucuc

SEQ ID NO: 4129475 - RNA, 91 nt, Human
gaggcgcuccaccucugcacggccagggcugugggugcggcccccgcugcugcacugcgccuggggcccuggcugucucugggccagccuc

SEQ ID NO: 4129476 - RNA, 73 nt, Human
gaggcggagguugcagugagccgagguugggccacugcacuccagccugggcaacagagcaaaacucuuucuc

SEQ ID NO: 4129477 - RNA, 60 nt, Human
gaggcggcugaagucggagggaguggagcaaagggacucccuggccgcaauggccgccuu

SEQ ID NO: 4129478 - RNA, 65 nt, Human
gaggcgggcagaucaccugaggucagaaguucaaguccagccuggccauggugaaaccccgucuc

SEQ ID NO: 4129479 - RNA, 61 nt, Human
gaggcgggcagaucaccugaggucaggaccagcuuggccaacaauggugaaagcccgucuc

SEQ ID NO: 4129480 - RNA, 68 nt, Human
gaggcggguggaucaccugaggcugggaguuagagaccagccuggccaacauggugaaaccccgucuc

SEQ ID NO: 4129481 - RNA, 68 nt, Human
gaggcggguggaucaccugaggucaggaguucgagacgagccuggccaacguggugaaaccccgucuc

SEQ ID NO: 4129482 - RNA, 66 nt, Human
gaggcggguggaucaugaggucaggaguucgagaccagccuggccaauaugguaacacccugucuc

SEQ ID NO: 4129483 - RNA, 55 nt, Human
gaggcguguuuccugccuaugacaaccucauggaugugggcagcacagcagccuc

SEQ ID NO: 4129484 - RNA, 90 nt, Human
gaggcuagaaguugaagacuaagguguuggcaggauugguuucaucucgaggcaucucuccuuggcaugccgucuucucccuuuuacuuc

SEQ ID NO: 4129485 - RNA, 78 nt, Human
gaggcuaggcucaauuguguaccugugguccauuucaauucaggugggcagcucugcuaauugagccuggacucccuc

SEQ ID NO: 4129486 - RNA, 65 nt, Human
gaggcucacuuucauccucuucgauguaguucacuaugggccuggagcuggugaaaguguguuuu

SEQ ID NO: 4129487 - RNA, 106 nt, Human
gaggcucccaguguucccagcugagaacaaaguugaaaguuugccuggagcuccaugccacuccccgccugggccacugcuuuguuuucuucuaauguuuuuccuc

SEQ ID NO: 4129488 - RNA, 78 nt, Human
gaggcucuauuugggguagaagauggauaaaaccugcaaguaagcagaaauccuuugaacuacuccauccagagccuc

SEQ ID NO: 4129489 - RNA, 70 nt, Human
gaggcucuggggaaaacuaaaaagccuuggcucuagcaacuagcugccugccuaguuccacaguguccuc

SEQ ID NO: 4129490 - RNA, 69 nt, Human
gaggcucuuucccaaggaaaugaagcugauguuggugauagccuggagcauuucuuucauuccagccuc

SEQ ID NO: 4129491 - RNA, 129 nt, Human
gaggcugaggcaggagaaucgcuugaaccugaaggcagagcuugcagugagcugagaucucaccauuguacuccagccugggugacacaaguggaacucugucucaaaaaaaaaaaaaaaauggcaauu

SEQ ID NO: 4129492 - RNA, 67 nt, Human
gaggaaagaggagacaguauggcuuguagcuacacuuagugguugcuauauuuuuuccuauugucuc

SEQ ID NO: 4129493 - RNA, 77 nt, Human
gaggaaagauucuuaauucuuuugaugugccacguacaaauguguauucacaugagacaauuaaagacuuuuuuuuc

SEQ ID NO: 4129494 - RNA, 75 nt, Human
gaggaaaggagacauuugcagagcacccacuaugugcuagaucuggugcaagcagaugucuuccaaauaauccuu

SEQ ID NO: 4129495 - RNA, 81 nt, Human
gaggaaaggcucagggcgcgagggacguggcgggcaccgacaggaagugcaaucucauuucucuucgcugagcuucucuuu

SEQ ID NO: 4129496 - RNA, 77 nt, Human
gaggaaaguaguauuagcagcaguucaauccagugcacgaaauauuuguugccuguugggaugcaauacuacaacuc

SEQ ID NO: 4129497 - RNA, 74 nt, Human
gaggaaaucauuccagaaaaggaaaggccacaaacucacaaaggugucugcuguuuucuggaguaugucuccuc

SEQ ID NO: 4129498 - RNA, 60 nt, Human
gaggaacagcagccacauguccacucacagacucucucuggcacuuggcugcugcuucuc

SEQ ID NO: 4129499 - RNA, 61 nt, Human
gaggaacaguugguauuugugaacuggugaccuagaacauucaaaugaagcuguuggccuc

SEQ ID NO: 4129500 - RNA, 130 nt, Human
gaggaacauuuggaagaaauuccauagaaucagugcuguuaguacaaguagaaugcuacaagauugcaaaauuaguaguaggucugcugugauacaaauagauugguagcugggugcuuccccaugccuu

SEQ ID NO: 4129501 - RNA, 62 nt, Human
gaggaagaaccuggccaaggcucaauccaacauccaaagccagaggccauauuucuucacuc

SEQ ID NO: 4129502 - RNA, 88 nt, Human
gaggaagcacaguuaacgaugggggcaguguuacauugcuugaagccuuccuucucaaugggcuggccuuuugguauugugguuccuu

SEQ ID NO: 4129503 - RNA, 57 nt, Human
gaggaagggacuuuauuaucuggaauaucuccaaggaagaagagggucccuaucuuc

SEQ ID NO: 4129504 - RNA, 55 nt, Human
gaggaagguguacugggacccucaaaaugaggccuagacagugaggccuuuccuc

SEQ ID NO: 4129505 - RNA, 80 nt, Human
gaggaaguuugagaaacugcuguaguaacuagguuaaguuaaacaaauacacccaaguuuugcauaguucuguauuccuc

SEQ ID NO: 4129506 - RNA, 71 nt, Human
gaggaaugagaccuugccuuaggaggcauuuaguugucuucuguguagaaagguagcccuucacuuuccuc

SEQ ID NO: 4129507 - RNA, 60 nt, Human
gaggaauggaucacagugccgugggugggguugcaaaccucucccugucaucccuuccuc

SEQ ID NO: 4129508 - RNA, 66 nt, Human
gaggaaugugaaacagguggcugggacccagaaacccucuuacccugcaccucugucauacuucuc

SEQ ID NO: 4129509 - RNA, 68 nt, Human
gaggaauuaccuguauuuggcucugaaaauagccauacuauuagccauuuuauacaaguguauucuuc

SEQ ID NO: 4129510 - RNA, 58 nt, Human
gaggacaauaauuuuuacaggugcuaaaaaaugcaaacaugugaaagcuaguguucuu

SEQ ID NO: 4129511 - RNA, 61 nt, Human
gaggacaccucacagccucacaccugcugcagcuggaacggcaggaagguggggagucuuu

SEQ ID NO: 4129512 - RNA, 96 nt, Human
gaggacacuagagcugggcugucuggcuucaagucccagcucuguaacuuacuagcagugaggcugugggcaagccacuccccuucucugugccuc

SEQ ID NO: 4129513 - RNA, 66 nt, Human
gaggacagggguggaguggggacaugugcccgagccaccggggcagcugccacuccgcuugcccuc

SEQ ID NO: 4129514 - RNA, 66 nt, Human
gaggacagggguggaguggggauaugugcccgagccaccggggcagcugccacuccgcuugcccuc

SEQ ID NO: 4129515 - RNA, 68 nt, Human
gaggacaucugaggcccucagagccaccgaaucucaugcagagggccugcuggggccucagacaccuu

SEQ ID NO: 4129516 - RNA, 72 nt, Human
gaggacaugaaaucagacuugaauuuucaucuuauuuugcugagguugaaguuugguuugguugcuguuguu

SEQ ID NO: 4129517 - RNA, 71 nt, Human
gaggaccccccuuggugaucuugcuccgccccuuuuugaagcuugggguccucucacuuggagggguccuc

SEQ ID NO: 4129518 - RNA, 59 nt, Human
gaggaccuggacacagagcggagaacuggaccccacuagacacuccuuugucuguccuu

SEQ ID NO: 4129519 - RNA, 57 nt, Human
gaggcacaauacaugucucaaguuuuggaguacaaucuccccauagguauuggccuc

SEQ ID NO: 4129520 - RNA, 58 nt, Human
gaggcacaccagggagucuuguaagcaacuggugacaaagucaggcuucccuggccuc

SEQ ID NO: 4129521 - RNA, 82 nt, Human
gaggcacagagagggaagguaacuugcucaacaucacacagcagguaaaugucagagccuuuaaccacucuguuacugcuuc

SEQ ID NO: 4129522 - RNA, 73 nt, Human
gaggcacaggccauacuucugcuggagccaaguggugcagagccugggccacugcuccaaguagcugggccuc

SEQ ID NO: 4129523 - RNA, 68 nt, Human
gaggcacagggcauuacuucagguccuuccccugguccagugagggaguccugaguggugaccuccuu

SEQ ID NO: 4129524 - RNA, 79 nt, Human
gaggcacagguccaacccauccagugucccugcuagucacacacagcacucaggguacaauggagggcuucugugcuuu

SEQ ID NO: 4129525 - RNA, 63 nt, Human
gaggcacaugacucaccaauggaauauuuucucauuuugaauauugggucauauauuugccuc

SEQ ID NO: 4129526 - RNA, 99 nt, Human
gaggcacgagaaucacuugaacccagcaggcagagguugcagugcgccgagaucgcgccacugcacuccagccugggcaacagagugaaacucagucuc

SEQ ID NO: 4129527 - RNA, 86 nt, Human
gaggcacugcaaagucgaaacugcaguuuaggcuguaauuaaaucauccaggagacuaggcuucagguuugcuuugcagaaaucuc

SEQ ID NO: 4129528 - RNA, 99 nt, Human
gaggcagaagaaucgcuugaacccgggaggugaagguugcagugagccgagauugcgucacugcacuccagccugggcggcauagcgagacucagucuc

SEQ ID NO: 4129529 - RNA, 68 nt, Human
gaggcagacggauuaccugaggucaggaguucgagaccaaccuggccgacauggugaaacgcugucuc

SEQ ID NO: 4129530 - RNA, 73 nt, Human
gaggcagaggacuuauggcaguagcuagaggagucugcagucucuaaacuacucucccaugauucucugucuc

SEQ ID NO: 4129531 - RNA, 104 nt, Human
gaggcagaggcagagauuugcuugaacccaggagguggaggcugcagugauccgagaucacaccacugcacuccagccugggggacagaucaagacuccgucuc

SEQ ID NO: 4129532 - RNA, 63 nt, Human
gaggcagcaucuauggugggaaaacacacaugaucagccagucucaccaguugauucugccuu

SEQ ID NO: 4129533 - RNA, 80 nt, Human
gaggcagccagcuccuuauccagcauggcccugaagcaaaggcacaggguggcaguuacuggagcaaguccuggggucuc

SEQ ID NO: 4129534 - RNA, 85 nt, Human
gaggcagcuauucuguucuuggcugugccucuggcagcacaugcaaaaugggcaguaacaguggcagucacagguaaguagccuu

SEQ ID NO: 4129535 - RNA, 63 nt, Human
gaggcagcuggcccugacacgcagacuuccugaagggucucuuguuuaugccaagcuuuccuc

SEQ ID NO: 4129536 - RNA, 98 nt, Human
gaggcaggaaaaugacuugaacccgggaggcggagguugcagugagccgagaucgcgccacuguacuccagccugguggcagagcaagacucugucuc

SEQ ID NO: 4129537 - RNA, 96 nt, Human
gaggcaggaaaucgcuugaacccaggguggagguugcagugagccgagaccgugccauugcacuccagccugggugacaaagcaagaguccaucuc

SEQ ID NO: 4129538 - RNA, 73 nt, Human
gaggcaggaagccuagcacuaaggugagauacuuuuccaugaagucuucagugauauaggcuucuccuggcuc

SEQ ID NO: 4129539 - RNA, 83 nt, Human
gaggcaggagaaucacuugaacccaagaaguggaggucacuccacugcauuccagucugggcaacagagugagacuccgccuc

SEQ ID NO: 4129540 - RNA, 99 nt, Human
gaggcaggagaaucacuugaacccagaggguggagguugcagugagccgagaucgcgccauugcacuccagccugggcaacagagugaaacuccuucuc

SEQ ID NO: 4129541 - RNA, 96 nt, Human
gaggcaggagaaucacuugaaccugggaggcggagguugcagugagccaagaucgggccacugcauuccagccuggugacagcgagacucugucuu

SEQ ID NO: 4129542 - RNA, 97 nt, Human
gaggcaggagaaucgccugaauucaggaugcagagguuguagugagccaagauuaugccacugcacuccagccuggacgacagagcgagacugucuc

SEQ ID NO: 4129543 - RNA, 91 nt, Human
gaggcaggagaaucgccugagcugaggaagcugcacugagcuaugauuaugccacugcacuccaggcugggugacagagugagccugucuc

SEQ ID NO: 4129544 - RNA, 99 nt, Human
gaggcaggagaaucgcuugaacccaggaggcggagguugcagugagccgagaucacgccauugcacuccagcccugcugacagugugagacucugucuc

SEQ ID NO: 4129545 - RNA, 99 nt, Human
gaggcaggagaaucgcuugaacccaggaggcggagguugcagugagcugagaucaugccacugcacuccagccuaggugacugagugaaacuccaucuc

SEQ ID NO: 4129546 - RNA, 100 nt, Human
gaggcaggagaaucgcuugaauccgggaggcagagguugcagugagccaagaucaggccacugcacuccagccucggggucaagagcgaaacucugucuc

SEQ ID NO: 4129547 - RNA, 100 nt, Human
gaggcaggagaaucguuugaaccugggaugcggagguugcggugaguggauauugcgccauugcacugcagcccgggcaacaagagcgaaacuccgucuc

SEQ ID NO: 4129548 - RNA, 99 nt, Human
gaggcaggagaaugacuugaaccuggaaguuggagguugcagugagucgagcucucaccacugcacucccgcccgggugacagugcaagacuccgucuc

SEQ ID NO: 4129549 - RNA, 97 nt, Human
gaggcaggagaauugcuugaacccggcgguggagguuguggugagccgagauugcgccacugcacuccagcugggugacagagugagacuccgucuc

SEQ ID NO: 4129550 - RNA, 100 nt, Human
gaggcaggagaauugcuugaacccuggaggcggaggguugcggugagccgagauugcaucacugcacuccagccugggugacagagcgagacuccgucuc

SEQ ID NO: 4129551 - RNA, 99 nt, Human
gaggcaggagaauugcuugaaccuuggagguggaaguugcagugagccaagauggugucacugcacuccagccugggugacagagugagacuccgucuc

SEQ ID NO: 4129552 - RNA, 99 nt, Human
gaggcaggagaauugcuugaacgcaggaggcggagguugcagugagcugagacagcgccacugcacuccagccugggcaacagagugagacuccgucuc

SEQ ID NO: 4129553 - RNA, 99 nt, Human
gaggcaggagagucgcuggaaccugagaggcggagcuugcagugagccgagaucgcgccacugcacuccagccugggcaacacagcgagacuccgucuc

SEQ ID NO: 4129554 - RNA, 77 nt, Human
gaggcaggagcgcugugggugggagggcugcuuccugggcucugaguacagcacggugcauuuacuacucuugucuc

SEQ ID NO: 4129555 - RNA, 100 nt, Human
gaggcaggaggauugcuugagcccaggagguugaggcugcagugagcccuguucacaucacugcacuccauccugggcaacacagcgauacucuugucuc

SEQ ID NO: 4129556 - RNA, 63 nt, Human
gaggcaggcagagcaacugguccagagugaguucacugggguccagagguuuuggcugacauc

SEQ ID NO: 4129557 - RNA, 83 nt, Human
gaggcagguggugccauuagcccugcuguugggacugacagaucaguacugaaguggcaucaggguaggaagguaucagcuuc

SEQ ID NO: 4129558 - RNA, 57 nt, Human
gaggcaguauagucauuaaguagcuucagauagaccucagugacaggugcugaccuc

SEQ ID NO: 4129559 - RNA, 55 nt, Human
gaggcaguggaacagcucugggcuaaacugguugggucagcucuauccacgccuu

SEQ ID NO: 4129560 - RNA, 78 nt, Human
gaggcaguggcaguggagacccgagccugggugaggccagggaucuggggccuucucuaaacgcugcuuaaauggcuc

SEQ ID NO: 4129561 - RNA, 99 nt, Human
gaggcaugagaaucacuugaaccagggagguggauguugcagugagcugagaucaugccacuucauuccagccucggguacagagugagacucugucuc

SEQ ID NO: 4129562 - RNA, 69 nt, Human
gaggccaagggagaagaucucucuaaauauuuucccacaugggaucaaagauguuucccccuuggcuuc

SEQ ID NO: 4129563 - RNA, 58 nt, Human
gaggccacagucaguguucaucuauuuugugaagugcaucagcacuaccuguggcuuu

SEQ ID NO: 4129564 - RNA, 104 nt, Human
gaggccacugacggcugcagauaaggacauuucugacuaaugcagccaagcccuccauccugcauuccucaaaaugucuuggccugugauucucaaugagccuc

SEQ ID NO: 4129565 - RNA, 56 nt, Human
gaggccagaggcagcaggccuuuggagagaucuggaagggccugcucugugguguc

SEQ ID NO: 4129566 - RNA, 59 nt, Human
gaggccagccccucuugaaggcaguccuugaacucugccccaggugggaugguugccuc

SEQ ID NO: 4129567 - RNA, 55 nt, Human
gaggccaggagugcuguaaguuccauacaaugcuuaggacagccccccugcccuc

SEQ ID NO: 4129568 - RNA, 72 nt, Human
gaggccauauuuggaauucagauggcuuagggauauuaugccuaaguuuaucauaguuuuacauguuaccuc

SEQ ID NO: 4129569 - RNA, 55 nt, Human
gaggccauuucugcuuggacaccugcagcccuugguggcccagagaugcugccuu

SEQ ID NO: 4129570 - RNA, 76 nt, Human
gaggccccaggucgggguggggacaggcagagcccacugcucccaccaccucugucucuucccacucagaccccuc

SEQ ID NO: 4129571 - RNA, 88 nt, Human
gaggccucacugccuggcugcagaucauucagaauaaugaucuaccacacauuuaucugggauuuugcagucugcaaugcaaugucuc

SEQ ID NO: 4129572 - RNA, 79 nt, Human
gaggccucccaagcugugcugaacugugagccaauuaaacuucuuuccuuuauaaauuacccagucuugggcaguucuu

SEQ ID NO: 4129573 - RNA, 55 nt, Human
gaggccugggagccuguccuccacugcuggcuggaagggcagguuggagggccuc

SEQ ID NO: 4129574 - RNA, 78 nt, Human
gaggccuuuuagggcugcguggaauacggucauaaucgcuaacauuuguacagugccaugcaguuugcgaagugcuuu

SEQ ID NO: 4129575 - RNA, 68 nt, Human
gaggcggagcuugcagugagccgagauugugccacugcagccugggcgacagagcgagacucugucuc

SEQ ID NO: 4129576 - RNA, 59 nt, Human
gaggcggccccaccguggagcuucccccgugcaaggacgagguccacugaggcugccuc

SEQ ID NO: 4129577 - RNA, 65 nt, Human
gaggcggcggaucacgaggucaggaguucgagaccagccugaccaacguggugaaacccugucuc

SEQ ID NO: 4129578 - RNA, 67 nt, Human
gaggcggcggaucacuugaggucaggaguuggagaccagccuggccaacguggugaaacccugucuc

SEQ ID NO: 4129579 - RNA, 79 nt, Human
gagaucuugagcuggacacacacuggagguaaauggggugugcaggaaacacugaugccccggccccacccugagacuc

SEQ ID NO: 4129580 - RNA, 106 nt, Human
gagaucuuggugcugccuuccaugggucugggggcuccaggucauuccucuccucucuggggugcccugaccuguguuugacugaagauuggcuccagcuagacuc

SEQ ID NO: 4129581 - RNA, 60 nt, Human
gagaucuuuuuugucuuggucacugcugcguagccagugucugguucauaaaaggggcuc

SEQ ID NO: 4129582 - RNA, 55 nt, Human
gagaugagaagagagauggcagcaccaauucuccuccuucuucucuuccagucuu

SEQ ID NO: 4129583 - RNA, 62 nt, Human
gagaugaguuuggaugcuuuccuggaguuaucaggaagcuccagggauuaaugaagucaguc

SEQ ID NO: 4129584 - RNA, 59 nt, Human
gagaugcaguuuuaggggaaggguuggauauuagggguucagcuuuggacuugcauuuc

SEQ ID NO: 4129585 - RNA, 77 nt, Human
gagaugccaaaaguggauugaauguaucuugaaaguagaaccaacaggauuugcagguggauucaaugugggauguc

SEQ ID NO: 4129586 - RNA, 70 nt, Human
gagaugcucuugucagaugauucucaggagacggcaguagcuguuucuuagacauaugccaugacauuuu

SEQ ID NO: 4129587 - RNA, 82 nt, Human
gagauggaacaaggaauaacucuaaagguacaggaggucaggucaugccuacugucuuuggggcuguaccuguuuccaucuu

SEQ ID NO: 4129588 - RNA, 103 nt, Human
gagauggagcucagguuuuuuccuaagggaugcggcucaagggacugugacuucuaaaaauuccucuucaguguuaaucuugggagaagaaauccuucaucuc

SEQ ID NO: 4129589 - RNA, 99 nt, Human
gagauggagucucacccugucauccaggcuggaguacaguggcaugaucucggcucacggcaaccuccuacuccuggguucaagcgauucuccugucuc

SEQ ID NO: 4129590 - RNA, 72 nt, Human
gaguuccagccacuuuauacugcuaaagucuggaaacaggcugaagguagcaguguaaaguggcuagaacuu

SEQ ID NO: 4129591 - RNA, 69 nt, Human
gaguuccgguguccucggauucagggcagacuugggcagugccuguccugcaguugggggcaggaacuc

SEQ ID NO: 4129592 - RNA, 67 nt, Human
gaguuccuggauuugggguugcaagagauuucaacucugcaggaagacuucccaagccagaggaguc

SEQ ID NO: 4129593 - RNA, 68 nt, Human
gaguugaacagauuugugaagcuacucagcacagccaaaguugaauagcuuccagauuguuaauauuc

SEQ ID NO: 4129594 - RNA, 128 nt, Human
gaguugaauucugcuuacguuccuuaguugccaaugaguucugguucauuuuaugcuguuuuaaggaaaacucacaugaaauuaugaacuuuggauucaggcuuggauuuucaaauggaaagcaauuc

SEQ ID NO: 4129595 - RNA, 66 nt, Human
gaguugacauuuuaugaauauuuuaguuccauuauaaauuacucacuuguucagauaugucagcuu

SEQ ID NO: 4129596 - RNA, 63 nt, Human
gaguugaguauaugcaauauaucuugauugcagaaaagcaguugauauagcauuauucaauuu

SEQ ID NO: 4129597 - RNA, 80 nt, Human
gaguugauauuugacuauacuuuuuauugcccuuggaguguucaguccaagaguccaaaugugcaguuauguaagaauuc

SEQ ID NO: 4129598 - RNA, 64 nt, Human
gaguugaucccuacagaguuuguucugggcccacccuagaacuuccaauucagggcugcagcuc

SEQ ID NO: 4129599 - RNA, 118 nt, Human
gaguugccucagccaguggucuugccauaucuaccuagcuuaggcugaguguuauaggagaaagugcacuagcccgggcaccagauggaucagguaagacucuagcuuagguaagcuu

SEQ ID NO: 4129600 - RNA, 104 nt, Human
gaguugcugugaccuaauuguggaaacugauaaaauaaguacauuuuuaaaauguagucuugauuuuuguuauuguacuauacaauaagcuauuacaacaauuc

SEQ ID NO: 4129601 - RNA, 57 nt, Human
gaguugcuuggauuauuccuuugggcucuguuggguauccaguauaaccagcaacuc

SEQ ID NO: 4129602 - RNA, 90 nt, Human
gaguuggaaccuaaaggcagacacaaaaacauaagguaugauucaugcccaucaaaucuaugaauuguuucugaaauuagguuuucauuu

SEQ ID NO: 4129603 - RNA, 82 nt, Human
gaguuggcaaaaauuaauaauaaugagcccauuuugaguacacugaaaugaacugauuaucauugcaagcuguugcuaauuu

SEQ ID NO: 4129604 - RNA, 63 nt, Human
gaguuggcuguucgaagguagcuugacaucuggcuaccuaccauuuguggacagcucaaacuc

SEQ ID NO: 4129605 - RNA, 103 nt, Human
gaguugguaugaaugcgcguuuggguagaaacaaggcuggacuggguaagaaccuucacaggcaguucucauuuuacccagaggcuguuuuuuuccuuugcuc

SEQ ID NO: 4129606 - RNA, 74 nt, Human
gaguuguugauuuauuaguuuguucauucuuuuuacucguuguuagaauggcauggcuacuggaauggcgacuu

SEQ ID NO: 4129607 - RNA, 63 nt, Human
gaguuuaacagcccucccuccauccugggcaccuuaauuccaggaagagacaggucuguacuc

SEQ ID NO: 4129608 - RNA, 69 nt, Human
gaguuuagugcugggcaaaaugcauuuccugccuuuuaaaggaauauggauuugcucagcugaggacuc

SEQ ID NO: 4129609 - RNA, 72 nt, Human
gaguuuaugcauccuccugaguuauguuuaaauguguucacauagaacauucuuuggaggauuauucacauc

SEQ ID NO: 4129610 - RNA, 80 nt, Human
gaguuuauuaagacauccuggauguucaaaagaauuugaggcuuuccccuuuugauagaaccaggauaucuggauaucuc

SEQ ID NO: 4129611 - RNA, 60 nt, Human
gaguuuccagugcauggcaaaugcuuaauaagcugugauuauccacuggaauguaagcuc

SEQ ID NO: 4129612 - RNA, 87 nt, Human
gaguuucgcucuugaccccgaggcuggagugcaguggccugaucuuggcucacugcaaccucugccucccggauucaagcgauucuc

SEQ ID NO: 4129613 - RNA, 79 nt, Human
gaguuugaaaaagucauguuuuuguuuagcauaaauccaaauauuuauauguuauguaaaauacuuggcauuuaaacuc

SEQ ID NO: 4129614 - RNA, 70 nt, Human
gaguuugaacccuuggcuucuauggguuuucuccccaaacuggaguaaaaagaugucaaggguuugacuc

SEQ ID NO: 4129615 - RNA, 65 nt, Human
gaguuugagcccugacacugagggaguugguugucaccaaucagaugucagcuggcuuuccacuc

SEQ ID NO: 4129616 - RNA, 99 nt, Human
gaguuugaggaaggaacagcaggucuuucuucagagcuuggacucaaagaacuucaguuuaagcccugaagaaagagcugcugcuccuuccucaaacuc

SEQ ID NO: 4129617 - RNA, 92 nt, Human
gaguuugggucagaguaguguguuaaugaggacaaguuuugagggugaaucucauaaacauuauucauuauucauuauucuuauccacaguc

SEQ ID NO: 4129618 - RNA, 59 nt, Human
gaguuuguccuuugggaaugugucucaggaaagucacagugagauccaagggcaggcuu

SEQ ID NO: 4129619 - RNA, 68 nt, Human
gaguuuuaccaguuucauucggcagcucauaaggugauuuuaugugcaacugaaaaaauguaaaacuc

SEQ ID NO: 4129620 - RNA, 87 nt, Human
gaguuuuacucuugucaccgaggcuggagugcaguggcacgaucucagcucacugcaaccucugccucccagguucaagugauucuc

SEQ ID NO: 4129621 - RNA, 74 nt, Human
gaguuuugcucuccuugucaguaaaaugacugcaaccccaguuauucaauggcuuauaaggauuccaugagcuc

SEQ ID NO: 4129622 - RNA, 100 nt, Human
gaguuuuuaggauauuuuaaugguuuauggggaccgcaaacagauauuugaaauuaguuuugucuccaaaaaccugagauaaaaacuuauuuggaaacuc

SEQ ID NO: 4129623 - RNA, 65 nt, Human
gaguuuuugagaugagaggucaaugguaaauaaaaccagauugaaaugaucuauuucaguagcuu

SEQ ID NO: 4129624 - RNA, 64 nt, Human
gauaaaaguagaauuuggauggggaauaacuuccaauguugagaucccaaaauucuacuuuauc

SEQ ID NO: 4129625 - RNA, 77 nt, Human
gauaaaaguuaguguuuauugaaugcuaaguauauggcaaagugcuuagcuuuucacuugcauuaucucauuuuguc

SEQ ID NO: 4129626 - RNA, 90 nt, Human
gauaaagauacugaguucagagaguuacacaaauuguucagucauaucacuaguaaaugacagaacugaccuuugcacccaugucucauc

SEQ ID NO: 4129627 - RNA, 108 nt, Human
gauaaaggauuggagaccugaguuuaccaaauguaaucauucuaaucguuuguaaggauuagagaaugaauuuauguuugucugugaccaacauuuccaccuuuuguc

SEQ ID NO: 4129628 - RNA, 66 nt, Human
gauaaauguuugcuuaauuggagaaauucuaaaauaucuagaauugacuucaagguagacuuuguu

SEQ ID NO: 4129629 - RNA, 83 nt, Human
gauaaauuucugggcacagaauugcugggauaaaauauaugcauguuuuuaagccuuugguaauucuguguagagguuguauc

SEQ ID NO: 4129630 - RNA, 55 nt, Human
gauaaauuuugacuuuuuugugaacuucaaauucccagaaaucucgagauuuguu

SEQ ID NO: 4129631 - RNA, 58 nt, Human
gauaacauuuugaagugcuaguaacaaguacuuggaaaaugguguucaaauuguuguu

SEQ ID NO: 4129632 - RNA, 71 nt, Human
gauaaccauuagcaaaacaacuuuucuauugacaacagagcaaagaaagguguguuugcagaugaauuauc

SEQ ID NO: 4129633 - RNA, 71 nt, Human
gauaacccuucacuguggagguaggagcaggacagcuaucugacucugccacacuccuccauaggguuuuc

SEQ ID NO: 4129634 - RNA, 82 nt, Human
gauaacuaacuucaagugacaucaugucagcaaaguaucuggcauaguaccugucaugucaauguucaguugaacagauauc

SEQ ID NO: 4129635 - RNA, 97 nt, Human
gauaacucuuuugaaauugucaugcuuauguuacauacuccuaaauuuuaaaugcuggaguuauaaaaggagcacugauucugaaaguguauuuauc

SEQ ID NO: 4129636 - RNA, 81 nt, Human
gauaacugcuugugaacucuuugaacagugaggcuaacaaguuuguccuagaccucaagaaggaagacaagucaguugcuc

SEQ ID NO: 4129637 - RNA, 61 nt, Human
gagcagccacagagaguggaugggcaaggacucuccucuggccucucauguccugggcuuc

SEQ ID NO: 4129638 - RNA, 109 nt, Human
gagcagccugauugguaguaugauugcuuccagagagccccgccuggcccuggcaucccaccaggcagggagcuguuuggccucagcucugcgacgucggggccuguuc

SEQ ID NO: 4129639 - RNA, 56 nt, Human
gagcagcucaggcacuuagccaccaacucuggucccuuuuguguagagggcugcuc

SEQ ID NO: 4129640 - RNA, 78 nt, Human
gagcagcugcagccauguuucugcuuucaugucuuggggaucucgugcauguguggaggagaugugcuggagaagcuc

SEQ ID NO: 4129641 - RNA, 61 nt, Human
gagcagcuugcgcugucuucaccaugugauugcuuuuaucuggccagugcaggagcugcuc

SEQ ID NO: 4129642 - RNA, 93 nt, Human
gagcaggagaaagggcgccaccucuaccuggccggccuucccggcagaagccgccgagcuaagcccuggagaggucggcgccuggacuacauc

SEQ ID NO: 4129643 - RNA, 64 nt, Human
gagcaggauuacagaggaaggacuccuaagacugaguccccaagucacuaguaaccaucugcuu

SEQ ID NO: 4129644 - RNA, 74 nt, Human
gagcaggcuccccuuguuuccauggugacagcagcuggcucacaugugugguugcuuuggaaacgagucugguu

SEQ ID NO: 4129645 - RNA, 79 nt, Human
gagcagggagaagaguuuagacuaguuggaagugaccaaggaauggccaguucacugcuuaagccuuugaccaaugcuc

SEQ ID NO: 4129646 - RNA, 83 nt, Human
gagcagggcacagcucuuccuacccuaguuggggccagcugccaagaugccucuugggguugggaaaaggagcugagcugcuu

SEQ ID NO: 4129647 - RNA, 63 nt, Human
gagcagggcuguggccucacaaguacuaaggcagcuagaggcuacuagaggcaccugaagcuc

SEQ ID NO: 4129648 - RNA, 55 nt, Human
gagcaggguuugcuaguuguuggacaggcauuugacuuaacaguaagcccuguuu

SEQ ID NO: 4129649 - RNA, 59 nt, Human
gagcagugaaaucacaacuuuaguuuugaugcccaugauucguguguauuucacuccuc

SEQ ID NO: 4129650 - RNA, 79 nt, Human
gagcagugaagacagaaguacaaacaaacaauccccuccccaaaauacagauaguggccaguacuuuguuuuuauucuc

SEQ ID NO: 4129651 - RNA, 57 nt, Human
gagcaguggcuaagcucgcaugcauguguuuaugcgucauggaaguaguuacugguc

SEQ ID NO: 4129652 - RNA, 69 nt, Human
gagcaguguggguucuuugcaaauguuauuaucuugucgauuucucacgggauuuugcaaauacugcuu

SEQ ID NO: 4129653 - RNA, 74 nt, Human
gagcaguguugcuagggcuucuaaugacccccaggagugcugagguacaagaaaggcaccugcaaggacugcuc

SEQ ID NO: 4129654 - RNA, 75 nt, Human
gagcaucaucagaguguaaguucuuuccuaucuuugaagugaacagggacaaaugagcacuuugacacagugcuu

SEQ ID NO: 4129655 - RNA, 72 nt, Human
gagcaucuuuuuugcucuuugauguuaauaugcaauuaaugcacauuaguuucucagaucauuuaagugcuc

SEQ ID NO: 4129656 - RNA, 58 nt, Human
gagcaugcgguauuugugugggugucgagcauccucgaucacaggaaugauguugguc

SEQ ID NO: 4129657 - RNA, 79 nt, Human
gagcauuaaaccgagcacagggcccugugcguaggucacagaccccagaggccagcccuguuuuccagcuuuauugcuc

SEQ ID NO: 4129658 - RNA, 75 nt, Human
gagcauuccaauccuggaucagucacuguugcuggcuuuaugcucucagaaugguuacugaauccuuugaagcuu

SEQ ID NO: 4129659 - RNA, 56 nt, Human
gagcauugagguggguuucucuuauguaacuccaagagcaauaagaccucaugcuc

SEQ ID NO: 4129660 - RNA, 77 nt, Human
gagcauuuccaggcucgcuugcguacagugaaaagugaugacaguaagugaugucuugguuaaugaagaaaggucuc

SEQ ID NO: 4129661 - RNA, 90 nt, Human
gagccaaauuuggcaauucaccaaggcucgcuggaggccgacuucuccuccguuuguuggcugcuuggcgaguugcuuuuguuuugguuu

SEQ ID NO: 4129662 - RNA, 84 nt, Human
gagccaacagcugcaaaugccgugagagcaggcacucuuggagaucugauuucuuacagcauuuuggcaccucugguucggcuc

SEQ ID NO: 4129663 - RNA, 55 nt, Human
gagccaagcaccacauuaaguucugggaaugcagagauggauggggcauggucuc

SEQ ID NO: 4129664 - RNA, 78 nt, Human
gauguagaguugaauacuugagaaauccauacuucaguguguauuuccccuuagguauucauuuuuguuuauuucauc

SEQ ID NO: 4129665 - RNA, 62 nt, Human
gauguagcuguguaccuuuuucacuguuagcaccucuguaacaguuacauuccagcaacauc

SEQ ID NO: 4129666 - RNA, 66 nt, Human
gauguagggagaugcaagggacggaguaucaggagaacaguaccuguucugggcucuccgcuaauc

SEQ ID NO: 4129667 - RNA, 106 nt, Human
gauguagguuuuggcaguagauguagguuggcauaaaacucuucaaaauuuccuuaaauaacacugauuaaagguuuauaugccaaccucugcucuugacugcauc

SEQ ID NO: 4129668 - RNA, 67 nt, Human
gauguauuuuggaacacagacauuagaacuucaugaaguuuuagcuguugauuguuccccaagcauc

SEQ ID NO: 4129669 - RNA, 59 nt, Human
gaugucagcaugcucugaguuuggccuaucugagccaugccccagagucugucugcauc

SEQ ID NO: 4129670 - RNA, 67 nt, Human
gaugucccuguucuguggcucucaaagggaagaucccugagcacacaucagaaucacccaggacauu

SEQ ID NO: 4129671 - RNA, 62 nt, Human
gaugucucugucugguccaggaagaugucagccccacacugccccucccagauaaagagauc

SEQ ID NO: 4129672 - RNA, 130 nt, Human
gaugucugauguuuggcuaauuauucgcugcauucuaggcaaugucugguggcaagggcuagggccagauagaaaagaaggcaggaaaaaauauaauuuaagccccaaggcaagaaucagauaaagaauu

SEQ ID NO: 4129673 - RNA, 68 nt, Human
gaugucuggcuucugaaaugcugcuguuaucauuuuaucugcauuacuucuuucauaggucaggccuc

SEQ ID NO: 4129674 - RNA, 79 nt, Human
gaugucuucuguaauuaaugcagcaaggagugagaucuuuuguuccucaacucuuauaguauugguuauuaggagcauu

SEQ ID NO: 4129675 - RNA, 65 nt, Human
gaugugaauguugucuaacggcuugcuacucaaaguguaauccacggaccggcagcauuggcauc

SEQ ID NO: 4129676 - RNA, 89 nt, Human
gaugugcaauaacucuagucccaggcaugaaaaguaacuucagugaaaauauccauucaaugcuuauauggacuaauauugugccuauc

SEQ ID NO: 4129677 - RNA, 93 nt, Human
gaugugcacggaggccccucccugcccugggcagaagugggcgcagguguucacaacugccuccggggcacugauuggccccccuguaccauc

SEQ ID NO: 4129678 - RNA, 62 nt, Human
gaugugcaggcucucguucuugacaucugaaccuaagugcaagguuuaagugccugggcauu

SEQ ID NO: 4129679 - RNA, 125 nt, Human
gauguggaaacuuuaauggagaucacaaaacuuugugggagaugugguuugcacacacacagguacacacccccuacagcccugcgucagauuuugcacgagguuuugugauuuucuccugcauc

SEQ ID NO: 4129680 - RNA, 79 nt, Human
gauguggacacagugacuggcacauaguaagcgcuuaauaaguguuagauuggcggugucaaucauuuuuaggcacauc

SEQ ID NO: 4129681 - RNA, 70 nt, Human
gauguggggugggcugaguuaggccugaaauaugggccuccaggcugaguccugcccucuccaccacauc

SEQ ID NO: 4129682 - RNA, 129 nt, Human
gauguguaaagagguucgacuuccaaguaaagccucguccacaauccuugcacacauaagguuucuccccugaguguguccucugaugugugaucagguuugacuuccacguaaagccucgcccacauu

SEQ ID NO: 4129683 - RNA, 56 nt, Human
gauguguccuaguacgggugggucugaaggcauucccauguggcauaaggaucauc

SEQ ID NO: 4129684 - RNA, 59 nt, Human
gauguguccuuuucuccauccauaucuaacuccuauguggaggagagucaaggucacuc

SEQ ID NO: 4129685 - RNA, 67 nt, Human
gauguguguguguguguguguauauauauauaguuuguauauguauauguauacacacacauauauu

SEQ ID NO: 4129686 - RNA, 130 nt, Human
gauguguucucuguggguuauuuugaggguuggguaagugucugauggagcgaaauggucagagccuagcucuucuuucauauuucuccuuucugagcacaugaacccacaauaccgcuggagaacacuc

SEQ ID NO: 4129687 - RNA, 71 nt, Human
gauguuacuggaacaccuugcuccagaaagcaaagaugcuuucaagaauaggagagguguaccuaaauguu

SEQ ID NO: 4129688 - RNA, 63 nt, Human
gauguuagauguuagauggcuuacagauagcuuuauuucugauugcugucugaugcugagguc

SEQ ID NO: 4129689 - RNA, 62 nt, Human
gauguuaggcaaauaacuguggagcaucuaugugaacugcccgcuguuccuugcuugagcuc

SEQ ID NO: 4129690 - RNA, 69 nt, Human
gauguucuugcaauagacuugguucuucuguauauucucugcacagggcaacaggucuguuagauuuuc

SEQ ID NO: 4129691 - RNA, 96 nt, Human
gauguuggaagcaagguaguagcaaaagacauuagaaucagccuguucugagaucagcuggaacaagugucugaacuccucugaacuuccauauuc

SEQ ID NO: 4129692 - RNA, 106 nt, Human
gauguugguggagaagcucuaaguacacuugucuugaacagccuaaagauugauuuucagguuguggcagucaaggcuccaggguuuugugacaaagaaccagcuc

SEQ ID NO: 4129693 - RNA, 60 nt, Human
gauguuguauaggcaggccaaccacauacuguaauguugcccucugucuguacaaguauc

SEQ ID NO: 4129694 - RNA, 75 nt, Human
gauguuguugaugcugcuaguacaggcuuuguguagagcaagacucaaacuguaaugcaggaucaagaaaguauc

SEQ ID NO: 4129695 - RNA, 87 nt, Human
gauguuucuccuuauguauaaaugugugugcacguguacauauaugagcauauguauacuaacacaugcaguugugcaagaaauguc

SEQ ID NO: 4129696 - RNA, 91 nt, Human
gauguuugcagugugaagccagucuaguaacaguuuaaauguaauaauaaaucacaguggguacuagauugaguuuauuccacuagagguc

SEQ ID NO: 4129697 - RNA, 80 nt, Human
gauguuuggucuguauguuaguuuguggugucagugaaaauuguguacaauuacaacuacauaaucucagaagcaauauu

SEQ ID NO: 4129698 - RNA, 60 nt, Human
gauguuuguuaggcucugaauagauauuuauuuccucuucucaugaagccuacaaacauc

SEQ ID NO: 4129699 - RNA, 124 nt, Human
gauguuuucugugucggaaguaguaucuauguuuuuauuuguaaacaugcauucuuuugguuggauuuauggaagacuaacagaaacauggguuuuagcauugcggucuggcugccugugcauc

SEQ ID NO: 4129700 - RNA, 121 nt, Human
gauuaaaacuauauaagccucaaugucuucaucauaaaauugagauaacugugccaacuuaacgggguucuuaguucccuuaaauuuguucugaaauaaggcuuauugcaaguaaauaauc

SEQ ID NO: 4129701 - RNA, 130 nt, Human
gauuaaacagacaugaaagagaaacagcugccaaucuguucuccaggaagcucugcuccacgggccuucauuuaagaauccuggagcuucaguuuccuuucgucagcuuuuuuucuuaauggccaaacuc

SEQ ID NO: 4129702 - RNA, 100 nt, Human
gauuaaauacguggaguaagucuuuacaguuucuguugcccagguaauaagcaucugcuuuaacaguauugaagauaaacuaacuaaucauguacuaauc

SEQ ID NO: 4129703 - RNA, 77 nt, Human
gauuaagauuuauuagaugcuuaccugcgccaaugggagauauacuggcccaaguaagcauccaauaaauguugauu

SEQ ID NO: 4129704 - RNA, 129 nt, Human
gauuaagccuucuuugaaagcacaguuuaggacaauucaggagggucucuauuuuccuccaguuggcuggcagcuccuguggcagcucuucuggguucuguguguaggaauuggcggaggcuaugauac

SEQ ID NO: 4129705 - RNA, 87 nt, Human
gauuaagguuuuuaggcaaugcucauuucagugaucaagaaggucagccauuccuuucaagugagcguagcugaaugggccauaguc

SEQ ID NO: 4129706 - RNA, 64 nt, Human
gauuaauaguuccuucuacuaccuccugagagucuguuucaggaagugguaaaggauguugguu

SEQ ID NO: 4129707 - RNA, 69 nt, Human
gauuaaugcuugccuagguuacagugaagguacucauguuucacugugcucucuagauaggcauuaauc

SEQ ID NO: 4129708 - RNA, 59 nt, Human
gauuacaaugagaaaugguuggcaaugauauuucagcugucauuuaucuuauaguaauc

SEQ ID NO: 4129709 - RNA, 69 nt, Human
gauuacacguuuuuaaucacauaaguuccaugacugaugcaauggaaucucgguugauaacuugugauu

SEQ ID NO: 4129710 - RNA, 68 nt, Human
gauuacagcagcucaaacaaagggcauuucuucugugauuaagugcuuuuucuugagcugcugugauc

SEQ ID NO: 4129711 - RNA, 73 nt, Human
gauuacaguaaacauaauuuaccuguaggggaaauaucugcuauacugguguaauugcuuguuugucguauuc

SEQ ID NO: 4129712 - RNA, 107 nt, Human
gauuaccuggguuuggcacaccugguuagggcucugagugggaaagaggguccugaaaccaggcugagcccccagccagagccagagccaaugcuggagccgguguc

SEQ ID NO: 4129713 - RNA, 77 nt, Human
gauuacucuacccaggcuggagugcaguagugugaucccggcucacugcagccuccgacuucuggguucaagugauu

SEQ ID NO: 4129714 - RNA, 58 nt, Human
gauuaggcuuaaucacagaaagcagaagagcuuucaggugggccuuuugagcauaauu

SEQ ID NO: 4129715 - RNA, 57 nt, Human
gauuaguaagaguuuaccuauugucaugaggcaaaccuggguucaacuccuacaguc

SEQ ID NO: 4129716 - RNA, 64 nt, Human
gaguccggagccguggacggggcccuaggcgacaccagggcgcccugacugcggccucccacuc

SEQ ID NO: 4129717 - RNA, 63 nt, Human
gaguccggagcucagaagugagugaguuccaggcuggagcucacaggcuuugacucucgcauc

SEQ ID NO: 4129718 - RNA, 69 nt, Human
gaguccuccacccaaacucccuucucaagguacaagggcugaucccguaccagggauggguagggacuc

SEQ ID NO: 4129719 - RNA, 55 nt, Human
gaguccugaauccuguggcaacgugaaaagaugauguaaugcagggcagggacuu

SEQ ID NO: 4129720 - RNA, 89 nt, Human
gaguccuguuagcaaaagucuuuccuuagaauaauucuuuuauagaauagugaaagagaaggaaguggaagaaaaugcugauggcucuc

SEQ ID NO: 4129721 - RNA, 90 nt, Human
gaguccuuugugaaagcagcauguucauuacauuauucaguaucaaauuauuagacaaaaugaaauauguugccuucugccauagggcuc

SEQ ID NO: 4129722 - RNA, 86 nt, Human
gagucucacucuguugccuaggcuggagugcagugacaugaacucugcucacugcgaccuccgccucccagguucaagugauucuc

SEQ ID NO: 4129723 - RNA, 77 nt, Human
gagucucagagucgaggacugguggaagggccuuuccccucagaccaaggcccuggccccagcuucuucucagaguc

SEQ ID NO: 4129724 - RNA, 108 nt, Human
gagucucaguugguucaggguccuggagcuugcaguuuucuguuggguuucaaacgccaacuuuaaagaggaggcuuggguuccacucuuaaugcuaauaaaagacuc

SEQ ID NO: 4129725 - RNA, 86 nt, Human
gagucucgcuccgucgcccaggcuggagagcaguggcaugaucucagcucacugcaaacuccgccucccggguucaagugauucuc

SEQ ID NO: 4129726 - RNA, 64 nt, Human
gagucucuauaaugcaugucaccugaucucaggugauccugaggcagccugcauuaaagagcuc

SEQ ID NO: 4129727 - RNA, 60 nt, Human
gagucucugcuauguuuucucugguuauacuuagagauccuuuccaaccuagugagacuc

SEQ ID NO: 4129728 - RNA, 60 nt, Human
gagucucugggagggaaagaagcuguccuuccuccaugcuucucuuugguucagagauuu

SEQ ID NO: 4129729 - RNA, 64 nt, Human
gagucugagucuaauggccccaggauuaacgagaagcuacauccuauccccauaucucaggcuc

SEQ ID NO: 4129730 - RNA, 98 nt, Human
gagucugcaaaguuaguuaaagaaagucauccuuaggcauugggaaaauucaauuuucaucacagguccugaugacauuuccuuuaaacgccagauuc

SEQ ID NO: 4129731 - RNA, 72 nt, Human
gagucuggguggagggcgaggggcccagagggacuucccaggcucccugccuguccucagucaccccugcuc

SEQ ID NO: 4129732 - RNA, 56 nt, Human
gagucuguuuggaaucuguagggaaugaacucaaccuaaggaaagccaaagaggcc

SEQ ID NO: 4129733 - RNA, 63 nt, Human
gagucuucauuuaguugauccagaauguugcugcauacucaaucaaggucaugaaauagacuc

SEQ ID NO: 4129734 - RNA, 64 nt, Human
gagucuucuacgcucacacaaagccuuagugucagcuaggagugugugaauagcuggaggauuc

SEQ ID NO: 4129735 - RNA, 64 nt, Human
gauucuggcuugcaucaacgcucuucaaggacagcuccuuggaacauugauccaaacuggaguc

SEQ ID NO: 4129736 - RNA, 61 nt, Human
gauucugggccucacccucagaguaucuaauuuagaaagucugggagggagccucagaauc

SEQ ID NO: 4129737 - RNA, 62 nt, Human
gauucuggggagucaaagagaccugagcucaaauucagacuuugccauuuacucuccguguc

SEQ ID NO: 4129738 - RNA, 85 nt, Human
gauucuguagcagaugcugcucaccugauuaugaccuuaguauuuuggcugaaauagucagugaagacacacccuguccagaauc

SEQ ID NO: 4129739 - RNA, 68 nt, Human
gauucuuucucugcacauguaguaaauauuaaacauugaucagacaguuaugugcaugagaaaauauc

SEQ ID NO: 4129740 - RNA, 56 nt, Human
gauucuuuguuugcuucuuucccucagaacucuggagacuuugcuugcagagaguc

SEQ ID NO: 4129741 - RNA, 82 nt, Human
gauucuuuuaggccaccaggguuccauuuagagaauuacaauugccaugugcuaacugguacucugguagccugaaugaguu

SEQ ID NO: 4129742 - RNA, 63 nt, Human
gauugaaagacuguuugggagaugguuuuucacucucugucucucuccauauagucuuuaauu

SEQ ID NO: 4129743 - RNA, 61 nt, Human
gauugaaaggaaaaccagagugauguuaugacucagaaagugacucuuuuccuuuugaauc

SEQ ID NO: 4129744 - RNA, 120 nt, Human
gauugagacagguguauguauucagucuguaucauguuuauguguaggauauguuugcuucaaaauauuuccuugcaacuuaggcauguuuauucauuguuuauucuuacugcaucaauc

SEQ ID NO: 4129745 - RNA, 72 nt, Human
gauugcaaagauauuuauguuguuuguggcuuagcaagauaauuaaaggauauaaauuaaucaagugcaauu

SEQ ID NO: 4129746 - RNA, 73 nt, Human
gauugcucaaauaaaccuauucugaaauguauuugucaugcguugacauuucugcuagaauaggugaccaauu

SEQ ID NO: 4129747 - RNA, 61 nt, Human
gauugcugggucccacucccagggucucugauucaguauaugugggguggggcccaagaac

SEQ ID NO: 4129748 - RNA, 103 nt, Human
gauuggcauuuaagagaccuugauucaagaccuagcucagccauuaauuagcccuguagucguuggcuaagagcuugauauccaaggcucucaauuuccaauc

SEQ ID NO: 4129749 - RNA, 76 nt, Human
gauugguaucgccugguugcuauuugcuuaagaacaaauauuauacagaugagaucaggcauaauuuuaaaagauc

SEQ ID NO: 4129750 - RNA, 68 nt, Human
gauuguagacauauuagacugccauaguccaaaucaaugcugaucacauuuuaaugugugcugcaauc

SEQ ID NO: 4129751 - RNA, 57 nt, Human
gauuguaucuugaacuuguuuauuuuuaccuuaguaauuaagguucagguuacauuc

SEQ ID NO: 4129752 - RNA, 66 nt, Human
gauuguccaguuucagggucugcgcuuuuaaccaugaagccaaggcccuggaauugaaaggcuuuc

SEQ ID NO: 4129753 - RNA, 102 nt, Human
gauugugaugaugguuucacagguguacauagauguacauacauauguaaaaacuuaaauauguacaauuuguuguaugucuauaaagccguaaaaaugauc

SEQ ID NO: 4129754 - RNA, 74 nt, Human
gauugugcccugaaggauguguggugggaguggguaagcugggcucccaccuuaaccuucacaugagcauuuuc

SEQ ID NO: 4129755 - RNA, 61 nt, Human
gauuguggagguuuaaguaaugggaaacgagugucucuggugaaacuauacuucuaugguc

SEQ ID NO: 4129756 - RNA, 73 nt, Human
gauuguguguggagugugugucugccugugcgcccugugauguuuuugguucuuuuauauuucacacauauuc

SEQ ID NO: 4129757 - RNA, 118 nt, Human
gauuguugauuaaaaaccaugucacauucauugugcuuguaagguuucucuccacuaugaauuacaaggugugaauuuugaccuuuuaauuacaaggugugaauuuugaccaacgguc

SEQ ID NO: 4129758 - RNA, 85 nt, Human
gauuguuucaggaaucaaugguagauuaaguaaauuagauccuuucaggaugcguugcuuuuaguauuauuucuaagagacaguc

SEQ ID NO: 4129759 - RNA, 91 nt, Human
gauuuaaaaaauauggagacaugaaaaauaacaaaacacgguuuuaucguaugaccauguguuugcauuguuaauucagucccguaaaauc

SEQ ID NO: 4129760 - RNA, 77 nt, Human
gauuuacagcaaccuaaauccacuaacuagcucgcauuucaguugccuauuggugcauguaggugaugcuuuauuuc

SEQ ID NO: 4129761 - RNA, 63 nt, Human
gauuuacagguuagguccuguaaaagggcacuuguaugacccucuaggccugcgcuguauauc

SEQ ID NO: 4129762 - RNA, 68 nt, Human
gauuuacauuuuauuuggggauuuauugaccuuuggaaagguugaaaucccagauaguaauguauuuc

SEQ ID NO: 4129763 - RNA, 58 nt, Human
gauuuaccucugagggugugguugcacugagcgugaucacacuucaaaggguuagauc

SEQ ID NO: 4129764 - RNA, 61 nt, Human
gauuuaggaucagagacuuugaagguuagaagagaccuaagagaucuucugguccagaguc

SEQ ID NO: 4129765 - RNA, 79 nt, Human
gauuuaguaaucauucugauggucaaugcuagcaagucaagcuagcuauaugcauuugaaugcucauaauuacuaaauu

SEQ ID NO: 4129766 - RNA, 97 nt, Human
gauuuaguacgauugcuaauaagaacaacuaagguuuauugagcacuuaccauguggcagauaaauucauuuguuuguauuaauuuguauuguaauc

SEQ ID NO: 4129767 - RNA, 122 nt, Human
gauuuauaucuugaaugcaaauaggaauauauguuuaaauagcucuuguagaagaaauucaagaagugguuucuucuuggcuuuuugucauauuuuucugaaugcaaucuggguaauauauc

SEQ ID NO: 4129768 - RNA, 71 nt, Human
gauuuaucaucuguuauuuaugccugagucugaauaaaagauuugagagcagauuuugauagaagaaaauc

SEQ ID NO: 4129769 - RNA, 62 nt, Human
gauuuaugaccuucggcaguuagacauuuucuacugugcugcccuucgucaucuauaaaauc

SEQ ID NO: 4129770 - RNA, 60 nt, Human
gauuuaugcucuucucuaaaacacagauguggguguguguuugggggagaugcauuuguc

SEQ ID NO: 4129771 - RNA, 92 nt, Human
gauuuauuaggcugguacaaaaguaguugcgguuuuugccguuacuuucaauggcaagaaccgcaauuacuuuugcaccaaccuaaugauuc

SEQ ID NO: 4129772 - RNA, 78 nt, Human
gauuuauuggcucaucuaucagaaaguccagauauagugagggcuucagcauuguuggaugacaucguucaauacauc

SEQ ID NO: 4129773 - RNA, 77 nt, Human
gauuucagcagccucuccuagggcccuaccugacccucaaguuucaggguacauggagcaaaugggacucugaaguc

SEQ ID NO: 4129774 - RNA, 66 nt, Human
gauuucagucuaagauagaacucugaggcuaccauucuugggucuuggauucuauuugcugcuuuc

SEQ ID NO: 4129775 - RNA, 55 nt, Human
gagcccagucugcuccugcgcccaccgggcagggcugagggccgcagcugggcuc

SEQ ID NO: 4129776 - RNA, 56 nt, Human
gagcccucauugaaucugcauuuuauagcauguacugugcaaauuucggggguauc

SEQ ID NO: 4129777 - RNA, 65 nt, Human
gagcccugcaguuuccugccugcucuguaugccuuuugcaggccagcacgacagccgcaggccuc

SEQ ID NO: 4129778 - RNA, 80 nt, Human
gagcccugcucaaauuucagacucaugaacaaaauaaauaaauaauuguuguuucaagccucugaguuuugaggugguuu

SEQ ID NO: 4129779 - RNA, 87 nt, Human
gagccgcaugcaggggaguggcaggcccggacccagugcccagaccuggcucacgugacucugcuuuuuccacugugucugcggcuc

SEQ ID NO: 4129780 - RNA, 74 nt, Human
gagccgcccgcgccagccucuccaucucgcaaguuuuaauuaacgcugagggagaggcggcugacgggcggguc

SEQ ID NO: 4129781 - RNA, 68 nt, Human
gagccggagccggcgaaggagcggaaggagcagcuccagcuccagcuccagcuccggcuccgaagcuu

SEQ ID NO: 4129782 - RNA, 56 nt, Human
gagccgggacucucucugccuggccagacuuccagcaaagggagagaccgcggguc

SEQ ID NO: 4129783 - RNA, 100 nt, Human
gagccgugcacucgcuggauagacauuuaucuccauguggaggacugggauggucccuccacagggagauaaauguuuauccagcaggugcacgugucuc

SEQ ID NO: 4129784 - RNA, 62 nt, Human
gagccgugucugcaaauauuuuauucagcuuuagagguucagaaagugcacagauacagcuc

SEQ ID NO: 4129785 - RNA, 72 nt, Human
gagccgugucugggauagcagaaguaucuccgucucucccgugucaguacuucuguuucucaagcaugucuc

SEQ ID NO: 4129786 - RNA, 73 nt, Human
gagccuagggaggucuggcugcccugagcccccuaccccugggcuuugggcaguaaacgguaccuagagacuc

SEQ ID NO: 4129787 - RNA, 99 nt, Human
gagccuaucagccacaccagcuguucuccgaugaccccgugugccuggugccacgcugggcugguggagcagcgguuaagagugggcuucacagugcuc

SEQ ID NO: 4129788 - RNA, 73 nt, Human
gagccucaaaguagggguaagccaggcuccggaaggcccgggaggucagguuacgcaccucuuuguccgcauc

SEQ ID NO: 4129789 - RNA, 64 nt, Human
gagccucagggacggaggcuugcggauuccagggcugagucuggguuccaggucucugaggcuc

SEQ ID NO: 4129790 - RNA, 65 nt, Human
gagccucaguuuuaaauuucccaugagauaguaucccaugagaccugguuuaaggcaccugguuu

SEQ ID NO: 4129791 - RNA, 68 nt, Human
gagccucaugugauuacacuaagaagguggcauuugauugccaagucauggaaguaucauggagguuu

SEQ ID NO: 4129792 - RNA, 58 nt, Human
gagccugauacacaaguggaaggagacgggcaaaggccugcuccucucguguaagcuu

SEQ ID NO: 4129793 - RNA, 77 nt, Human
gagccugaucccuagcuguuucuccuacauacuaugugaugacaggcauugugaaggagcaugcagaggggugguuc

SEQ ID NO: 4129794 - RNA, 72 nt, Human
gagccuucaggaauccuggaaagccuaggacucaagcagacuuugagcaccuggaccagauucuggauguuu

SEQ ID NO: 4129795 - RNA, 130 nt, Human
gagccuugcagacuuucauuuggaguuugaaccuguuuugguugcauuucauuuuuggggaacuucauuaaugugagauuggcaaugcaaaugcaggugcaguuuucuguuaauguuaauucuguuguuu

SEQ ID NO: 4129796 - RNA, 58 nt, Human
gagcgcaccagccacaucucaauacauagcacugaaaaaaugggcuauggugcuguuu

SEQ ID NO: 4129797 - RNA, 63 nt, Human
gagcgccucagccuagagccggacgcuuuggcuucuucgccaucuggcccuagguugggccuc

SEQ ID NO: 4129798 - RNA, 55 nt, Human
gagcgcugggcugagaaguuaagcaaauguuguuuugugcugccagcugggcuuc

SEQ ID NO: 4129799 - RNA, 59 nt, Human
gagcgcuucccuccaaacgcccucagcccucaucucggccuggagaggaaaugcugcuc

SEQ ID NO: 4129800 - RNA, 61 nt, Human
gagcggccgccgggccacgugaccgguuuguuuacaaacacugccgggcccgcggccgcuc

SEQ ID NO: 4129801 - RNA, 116 nt, Human
gagcgugcuguggcccuucccugcgcugccucagggugccucccgcucgccgggacugaguuccgcgccggcguggccugcuggguuccaagcgccaggagucggcgcagccgcuc

SEQ ID NO: 4129802 - RNA, 56 nt, Human
gagcuaagaccugagggcaaguccaaggauucgcagcccccugccaggaucagcuc

SEQ ID NO: 4129803 - RNA, 55 nt, Human
gagcuaagagagcccagugucaauuagacauugacaagacaauggcucuuagcuc

SEQ ID NO: 4129804 - RNA, 59 nt, Human
gagcuaccuguggaagggaccucagcgaaaaccagugauugcccacacagcaguagcuc

SEQ ID NO: 4129805 - RNA, 72 nt, Human
gagcuagaauuaggccaauuucauaacacccaacagguguuauaaauguaauagauugccuaacuucugcuu

SEQ ID NO: 4129806 - RNA, 57 nt, Human
gagcuagacugggcucugauguaggugccaagcuauagguuggguccagaucugcuc

SEQ ID NO: 4129807 - RNA, 85 nt, Human
gagcuagccagcagaucaauguagaauauucugaauuuuuaauuuuaagugcuucuaaguugaaucaugcugaauauaaaugcuc

SEQ ID NO: 4129808 - RNA, 61 nt, Human
gagcuaggauaucaugaggguaucuccaguccucaggagaaauaucuuuauguucuugcuu

SEQ ID NO: 4129809 - RNA, 92 nt, Human
gagcuaguaucuugcagaauuaauuccagcggccaccauucacaaaaauuaugugaaaauaaugccucuggaguugcuuguaaaugaugcuc

SEQ ID NO: 4129810 - RNA, 86 nt, Human
gcaaacauggagagcugaagcauggacagggcguggcagggaggauccccgcugcccuccugcauguggucagcacuccugcuugc

SEQ ID NO: 4129811 - RNA, 77 nt, Human
gcaaacugacagauugauuaggcagggaaauugaagaaaauuaauauuccagaugaaaucauucagguuaguacugc

SEQ ID NO: 4129812 - RNA, 78 nt, Human
gcaaacugccucaucuguggucaaaauagaaacuucucaguugccuugauugaccuagaaauguuuuauguaauuugc

SEQ ID NO: 4129813 - RNA, 114 nt, Human
gcaaacugguccaagaacuugagguaggccugacgcuggggugcagcugcuggaaugaaguggccaccagagugggugagggugauggcuccgggaaauuggcuggccaguugc

SEQ ID NO: 4129814 - RNA, 59 nt, Human
gcaaagaacagccugagaguggagcuggcugcagccuggcuccuaaggacuggcuuugc

SEQ ID NO: 4129815 - RNA, 102 nt, Human
gcaaagaaggaaugcauggaguggcaggcggccaugaucuggcaggcgcuguucaggcccuguuugugagagggcuguucaccuagguggugccuucuaugc

SEQ ID NO: 4129816 - RNA, 84 nt, Human
gcaaagacagugcaugcuggcuuggaaggaaagcgcagcuggagcucuccauggugcuuccccaagccacagccuguucugugc

SEQ ID NO: 4129817 - RNA, 65 nt, Human
gcaaagacccaggugucuauccacuugcuagaaaccaucaugagaguuagauaccaguuuucugc

SEQ ID NO: 4129818 - RNA, 102 nt, Human
gcaaagauuuaaauguuggauugagcaguauuuuuuuccuguggaaugucuccagggaaucucugaguguguuccaaauucaagccauuguaaucuccuugc

SEQ ID NO: 4129819 - RNA, 61 nt, Human
gcaaagcaaggaagacacagaauuagauuuaaaucuagguaaugcaacuacuuugcuaugu

SEQ ID NO: 4129820 - RNA, 70 nt, Human
gcaaagcacacuggagaugucgauugaaaacucuccuuaaaaucugucaacaguuucccauggcuuuugc

SEQ ID NO: 4129821 - RNA, 82 nt, Human
gcaaagccaggccugggcaguccugggcgcuacagccccgugcacgggagccagcuccgcaggauggcgcgccuggcugagc

SEQ ID NO: 4129822 - RNA, 62 nt, Human
gcaaagccuucccuggcaccccuaguagaugccauugguuuuucucuaugccaggggccugc

SEQ ID NO: 4129823 - RNA, 61 nt, Human
gcaaaggaaaagauucaugaauucaggccauagccuggggccugagaacuuuuacuuaugc

SEQ ID NO: 4129824 - RNA, 81 nt, Human
gcaaaggaguguguuuucucuccagcaggcaguggggaccuuagacauuuguaagcaagagagaggcacauucagauuugu

SEQ ID NO: 4129825 - RNA, 64 nt, Human
gcaaaggaucuuucuuuuuaccauuuuaauagccugugcaaugggauuaagaaagaucuugggu

SEQ ID NO: 4129826 - RNA, 56 nt, Human
gcaaagguggcuaccagcugcuccaggauuguagcuuucuaguuuagccaucuugc

SEQ ID NO: 4129827 - RNA, 80 nt, Human
gcaaaguaugugacauaucucaguuugaagauuucuuaccucuucaggcuuccguaauauguuauucucaucauauuugu

SEQ ID NO: 4129828 - RNA, 64 nt, Human
gcaaagugauuaacauggagcuuuugcuaauuaaaucagcagaagauuuagguugacgcuaugc

SEQ ID NO: 4129829 - RNA, 84 nt, Human
gcaaauacagaagcagcaacauuacaugguccaggauauauauuaauaugugguaggagugugugugugugugugugugugugu

SEQ ID NO: 4129830 - RNA, 56 nt, Human
gcaaauacauguugagcaccuacuguaugccaggcucugugcucaguugcauuugc

SEQ ID NO: 4129831 - RNA, 96 nt, Human
gcaaauacugaguuucacaagugcugggcuugggagagcucuguccccuccauggggggagguccuguguccaggggccugugagucuggaguugc

SEQ ID NO: 4129832 - RNA, 74 nt, Human
gcaaauagaaauaaaaggauuugucauuuguagaaaucaaauaccuaaaaugacuaauaaguuuuacuguuugc

SEQ ID NO: 4129833 - RNA, 64 nt, Human
gcaaauaguucuagcucagaagcucuccugagguugcaguugagcuucagcugggacugcaggc

SEQ ID NO: 4129834 - RNA, 74 nt, Human
gcaaauauugauucugucccaaguugauguuuuccccuuaacauuauuauaaugagggauaaaaaucaaauugc

SEQ ID NO: 4129835 - RNA, 55 nt, Human
gagcuuccugaugccgaccaguaaauagauaauuguaccuccauucaggaaguuc

SEQ ID NO: 4129836 - RNA, 65 nt, Human
gagcuucgcagauggaaagugcuugagggggugcugaaugccuagguaauggucuauuucgucuc

SEQ ID NO: 4129837 - RNA, 57 nt, Human
gagcuucuaggcagcagaacugggacacgaacccagguauuucugacccuagagcuc

SEQ ID NO: 4129838 - RNA, 76 nt, Human
gagcuucucaagauuuguauugggccucuguagaaucugacuucuguaguggcucaauacaaaucuguggauacuc

SEQ ID NO: 4129839 - RNA, 70 nt, Human
gagcuucugccuucuuucugggugguucugagaacaugagaguugcuggguccagagaguggcaaagcuc

SEQ ID NO: 4129840 - RNA, 83 nt, Human
gagcuugguauuugcugugggguagaucuuucucaggaaugucacuuucugugaauaagauucucccacugaacuccauucuc

SEQ ID NO: 4129841 - RNA, 84 nt, Human
gagcuuguaaugccagagacacuuggagguagaagaaugaaguucaagacccgguucuaccacuaagugugcuuugaucagcuc

SEQ ID NO: 4129842 - RNA, 59 nt, Human
gagcuuuaagggcacuggucuuacagagccuguggggcuagaccgugugcucucaguuc

SEQ ID NO: 4129843 - RNA, 75 nt, Human
gagcuuucucagggcgcagugaggcagucaagguaacaucccuguagcugcgaucacagcuccugcugcaggcuc

SEQ ID NO: 4129844 - RNA, 63 nt, Human
gagcuuucuucuccuuugccauguguuuucauuucugccagacacuggcacuggggaagccuc

SEQ ID NO: 4129845 - RNA, 60 nt, Human
gagcuuuguuccgugguggcacacaaaucuuggcuugcuguaccaucauuggcaaaccuc

SEQ ID NO: 4129846 - RNA, 77 nt, Human
gaggaaaaaaaagguggaaagaagggcuagggacugagaugacacucugguuuuucuuccauuaagacauguuccuu

SEQ ID NO: 4129847 - RNA, 88 nt, Human
gaggaaaaaacacccagcacagugauuaugaguacuaauuaggaagaaaaacaguggcuuugaugaaucugugcuugguuuguuccuu

SEQ ID NO: 4129848 - RNA, 112 nt, Human
gaggaaaaagugcuuauugucagaggcuggaauauuagaaauguuuucaaaaaucccaugaagcauucuaaugaccaccucauauagaaagcuuagaaaagauuuuuuuuuc

SEQ ID NO: 4129849 - RNA, 62 nt, Human
gaggaaaacuguaagugguuggaagaaggcuuuguuuucuacaagacuuuuaguuauuccuc

SEQ ID NO: 4129850 - RNA, 67 nt, Human
gaggaaaauaacaacuaagggcuuccaaaggaaauguuugccuuuuguucuuuuuguuauuuuucuc

SEQ ID NO: 4129851 - RNA, 102 nt, Human
gaggaaacaggcaauauugcuucagguucuaguuguuuuuccaauaaauagaaaucaacagagcaaagccugaacaacauuguaacacaugccuguguucuu

SEQ ID NO: 4129852 - RNA, 94 nt, Human
gaggaaaccaugccaggaagcuggugugaggaugaaccgcaauccacaccuguuuucuccucagcacagcugucuccuaaggcauggacaccuc

SEQ ID NO: 4129853 - RNA, 78 nt, Human
gaggaaagagcauggaucuggggcucugcugcucaccaguuaggugaccugggcaauccccaggccucucuaagccuc

SEQ ID NO: 4129854 - RNA, 73 nt, Human
gaggaaagaugagugagagcaucaacuucucugacaaccuaggccaguaaguagugcuugugcucaucuccuu

SEQ ID NO: 4129855 - RNA, 86 nt, Human
gaggaaauagaugagagguaacacuguucagugggcacuuuuguacuagguccaguguuggagguuuuaccaucauuauuucacuu

SEQ ID NO: 4129856 - RNA, 72 nt, Human
gaggaacacaggcaagagugcaggucugagcugcuuagaaggcucagagaugugugucuguguuugacccuc

SEQ ID NO: 4129857 - RNA, 102 nt, Human
gaggaacccgaagcacuagggcaucuggcuucugggccagggcagacaaaguuguggcuguggacucagauggcuccucgccuugugugugcagaggcccuc

SEQ ID NO: 4129858 - RNA, 83 nt, Human
gaggaacgugcccccacagccagcucccuccccugcagggccugagggcucagugcgggauggggcugcagggcuaucuccuc

SEQ ID NO: 4129859 - RNA, 62 nt, Human
gaggaacuggcaguguuguguugugggugagccacuuacaauggguauacuuccauuuccuc

SEQ ID NO: 4129860 - RNA, 77 nt, Human
gaggaagaagggaagccggccauguggucuugugcugcugagucagcacuuucugcugccuggugcccugucuccuc

SEQ ID NO: 4129861 - RNA, 69 nt, Human
gaggaagagacccgcccugggagcccgcgagggaagguucccggcuggcuggcgggugcguccucccuc

SEQ ID NO: 4129862 - RNA, 77 nt, Human
gaggaagcagcuggugagauggagcaaaagauggggcagguuuuagccucgcugccugguuucucagcugcauacuc

SEQ ID NO: 4129863 - RNA, 56 nt, Human
gaggaagcagggcuuggcugagaugcaggcugugggcggcugagcugggcuuccuc

SEQ ID NO: 4129864 - RNA, 55 nt, Human
gaggaaggaagucgaggagccaggcaggccaggucuuaccucagcuucuuuccuc

SEQ ID NO: 4129865 - RNA, 92 nt, Human
gaggaaggaucucuugaacccaggcuuuugaggcuguagugagcugugaucgcaccaugguacuccagccugggugacagagaccuugucuc

SEQ ID NO: 4129866 - RNA, 120 nt, Human
gaggaagugcugagcccuagggcgagggagggugggucauucuuacaucagugaauguugaagagaaggcccugacccaccccguucugccugccagcucugggguguggcucugaacuc

SEQ ID NO: 4129867 - RNA, 88 nt, Human
gaggaauaccuuagaaagugacaaacgaaagacaugcuacagucuucuaagcccauucuguccuuuuugacguaucuuaacuucccuc

SEQ ID NO: 4129868 - RNA, 79 nt, Human
gaggaauaugcuuuuucuuacaaguacuuuauauauuguuugaguguacauucuguuugagguaggcaauuuuuuccuc

SEQ ID NO: 4129869 - RNA, 63 nt, Human
gaggaaugaaaugggaaagagacuagaugcugugcucaucauccuucgucccguuuucaccuc

SEQ ID NO: 4129870 - RNA, 88 nt, Human
gaggaaugaaguuucaccgugaaccgauuccucaccaaagaaacaaaaacugguggcaucgagacgcacgggaggacuucaaguccuc

SEQ ID NO: 4129871 - RNA, 73 nt, Human
gaggaaugggugucucgugauuagcugaaagucuacaucaccacacaguccccgcacagugcagccauuucuc

SEQ ID NO: 4129872 - RNA, 91 nt, Human
gaggaauguguacaggugaggugacaggcauggggucaugcagcugggaguggcagagcuggcacugaccccaggccugugucuguuccuc

SEQ ID NO: 4129873 - RNA, 60 nt, Human
gaggacaccauggucccagccuccaccucucaucucccuggccccagcccauggguucuc

SEQ ID NO: 4129874 - RNA, 102 nt, Human
gaggacacuaugaaguaagugauaggauuauucccauuuccaagauaagaaaauugaggcuuggagagguugaauaacuugucgaaggucacauggcuccuu

SEQ ID NO: 4129875 - RNA, 88 nt, Human
gaggacacugcacgcccccugaggcuggagugcaguggugcaaucauagcucacugcaaccucagucuccugggcucaagcaauccuc

SEQ ID NO: 4129876 - RNA, 61 nt, Human
gaggacagagccgccuggcaagcccaaaacauucccaacuggccuguuagacggaguucuc

SEQ ID NO: 4129877 - RNA, 94 nt, Human
gaggacagccugugcuuaacagugaccccugguggccaugagaccugauggcuuuaguguagguuucuguuguuuggaaauaggacugauccuc

SEQ ID NO: 4129878 - RNA, 111 nt, Human
gaggacagugagauuugauaggcucuggaauguuggauuacccacccuugccaacuuuucuguuuaagccauacauuucagacucugguuuccuuucuuaccucguuccuc

SEQ ID NO: 4129879 - RNA, 59 nt, Human
gaggacaguuguggcuuauauuauaggcucaggcagcccuaagcacaugaacaguccuc

SEQ ID NO: 4129880 - RNA, 60 nt, Human
gaggaccucagaggccagggaucuaggggccagugcuccgugugccucacccucugccuc

SEQ ID NO: 4129881 - RNA, 106 nt, Human
gaggacgaagcagagaagaaaauauggcaacacaggggguuacaaauuguucauuuacugaagguuucgaauucuuguguuugcuuuuacuuuaaugcugccccuu

SEQ ID NO: 4129882 - RNA, 99 nt, Human
gaggacugguuuauauguguuuggugaguaagauagagaaaaaguguuuaaucuuacaauuacaagacacucuagagaugaauauaaucuaguggcuuu

SEQ ID NO: 4129883 - RNA, 109 nt, Human
gaugggaaaaugcagcuuuauaggaaacacucauguguuacucuccaucagagaauucauaauggacagaaaccauaugaguguaagcaaugucagaaguccuuuaguc

SEQ ID NO: 4129884 - RNA, 58 nt, Human
gaugggaauccuguaaucuacccaugacugcggccgcuguacuuugcaggcucccauu

SEQ ID NO: 4129885 - RNA, 88 nt, Human
gaugggagaaaauucuucugaccuuggagugaaugggggcagguguccaguuauacuucuuuccccaaacucuaaaaucgucugccuc

SEQ ID NO: 4129886 - RNA, 64 nt, Human
gaugggagagcagagcagucuggagauccagcaauagcugggguuucagguggucugcaccauc

SEQ ID NO: 4129887 - RNA, 70 nt, Human
gaugggauaauaucaaauuuccuaugguuuagcaaacauugacaaauaggggaaauuaggauugcucauc

SEQ ID NO: 4129888 - RNA, 67 nt, Human
gaugggauuuuuuauguguucagggguaagcucuaccuacaggaaaaauuauauagagaaacccauu

SEQ ID NO: 4129889 - RNA, 78 nt, Human
gaugggcaggggcccugcuuccguuuaaccacagcccugugacaugccccaaaagggaagcagcagccgccuguccuc

SEQ ID NO: 4129890 - RNA, 92 nt, Human
gaugggccugggaggcagcagagcuuuguccuggcuccauuccuugcuggcuugcaguggacaaggcccuuagcucucuucaagcuuugguc

SEQ ID NO: 4129891 - RNA, 75 nt, Human
gaugggcucccuggcggcuugagaagcagagaaagggaaauagcacauucauugacaucugccuggagucccauc

SEQ ID NO: 4129892 - RNA, 69 nt, Human
gaugggcucuuuugaauauuuaugucaggacacaucuguucugggcuugaaaguuuaauaaagcuuuuc

SEQ ID NO: 4129893 - RNA, 81 nt, Human
gaugggcuggaaaacaggaguggagaggugccucuguguugccuacagccaucugggguccauuucuucucucugccuauc

SEQ ID NO: 4129894 - RNA, 62 nt, Human
gauggggcaggcagcagguaguguguugacuccugaauucuacaaagcuguauagccugguc

SEQ ID NO: 4129895 - RNA, 60 nt, Human
gaugggggccagggccugcuuuggcaacucccugccaguucuugggucugggcuuccguu

SEQ ID NO: 4129896 - RNA, 77 nt, Human
gauggguagcagugugcuucguuucaugagcuuuaaagaguugagaaggucaagcaaguugcauauugcuauucguc

SEQ ID NO: 4129897 - RNA, 66 nt, Human
gaugggucucuaaacucccagguacccucucaaacccagcuaaccuggcagguucaaaggccuauc

SEQ ID NO: 4129898 - RNA, 83 nt, Human
gaugguauuuaauauaauccauguaauuuuaaggauuuuaggaauaagguuauuguagauuauaggcaguuuaaaaggccauu

SEQ ID NO: 4129899 - RNA, 69 nt, Human
gauggucacuguguccccagcaguugagacccauuugacagagucucaggcagcugcaccgugaccauc

SEQ ID NO: 4129900 - RNA, 69 nt, Human
gauggucuuuccuggggacuccacuggugguugggaagaagguguguggcagugcccagggagaugauc

SEQ ID NO: 4129901 - RNA, 79 nt, Human
gauggugcauguagccaucaagauagcguccauccauuccucauguuugugucuuugugguacaagagcugcacugguc

SEQ ID NO: 4129902 - RNA, 61 nt, Human
gaugguguccguucuccauucugaccugcauacauguccccacuguggagacagaugccuc

SEQ ID NO: 4129903 - RNA, 63 nt, Human
gaugguuuacuucauccaaucuagauaauuauuuuaugucuauucugggaaagguaugcuauc

SEQ ID NO: 4129904 - RNA, 56 nt, Human
gaugguuuggaaugaaguagcuauucauggcagaaucuaccaucucccaaaccguc

SEQ ID NO: 4129905 - RNA, 64 nt, Human
gauguaacucuuuggaaaacauuuugguaguuccacaaaaagugaaacauagaguuaccauguc

SEQ ID NO: 4129906 - RNA, 121 nt, Human
gauguacaaccauguauuuguguaggcaggaugcaacagcuuguaguggacaaaaaaauagucuaacacuaacuugcugagugaccaugccaacucacuuacuuugggucuguuucacauc

SEQ ID NO: 4129907 - RNA, 66 nt, Human
gauguacaaucuuggucccuuuauuauggacggcaauaaaauucacaguaaccaaggcaguacauu

SEQ ID NO: 4129908 - RNA, 57 nt, Human
gauguagaaaucuggaaaucagauccuaaguuaccucugagccagucaagcuacauu

SEQ ID NO: 4129909 - RNA, 75 nt, Human
gauguaguggacagcgaaagugccugggaaguauauuauuauuacauuuuauuuauugagugcuguccuggcauu

SEQ ID NO: 4129910 - RNA, 69 nt, Human
gauguauagaguugugauuuggaaaggugcuuugcaugcaaaguucagccugguuuuaaugcuaacauc

SEQ ID NO: 4129911 - RNA, 65 nt, Human
gauguauuuucuguuuuguugaaaaguugugucgaagcaacaaaacagcaaaaugaaaauggauu

SEQ ID NO: 4129912 - RNA, 65 nt, Human
gauguccuaugaggugggacuguuggcagaaaguuuucccacauucaccacacuuauagggcuuc

SEQ ID NO: 4129913 - RNA, 82 nt, Human
gaugucuaugcaguuuuacaauuuaaaguagucauuuaaucaaacauaacuuucauuugugaagacuguauuccagaacauu

SEQ ID NO: 4129914 - RNA, 73 nt, Human
gaugucugaaaguagggcugaucuagagaaauuggaaacauuagagcagguuucaacuuuuucaugagauauu

SEQ ID NO: 4129915 - RNA, 87 nt, Human
gaugucugccaguucacaguguuuucuuugcauugcucaaggguaaagugaaagauaacaacacuguuuugaacauguuuagauguc

SEQ ID NO: 4129916 - RNA, 59 nt, Human
gaugucugucugagccgcuggacuccgaaugccuagagggcaggggcuuugacaggauc

SEQ ID NO: 4129917 - RNA, 60 nt, Human
gaugucuuacuaacuagccuuugcuuuauuauuagaaauggggaagugaguauagacauu

SEQ ID NO: 4129918 - RNA, 75 nt, Human
gaugucuugcaaaaauugcuggaaucuuuacaggagaaccacuuccaagaagaugagcaguuucugggagccguu

SEQ ID NO: 4129919 - RNA, 76 nt, Human
gaugugaacuacagaagaaacuaucacuauguuucucagacauaggaaugggaguuucuuuguguuuuuuugcauu

SEQ ID NO: 4129920 - RNA, 60 nt, Human
gaugugaacugaggcugaguguugguggaagaaauacaggcucaggcucagguucagguu

SEQ ID NO: 4129921 - RNA, 83 nt, Human
gaugugacuuugacuugaggauugucuccugugaugugcuccuaguggggcuacaggggucaguccuuugcuuugagcaccuc

SEQ ID NO: 4129922 - RNA, 72 nt, Human
gaugugagugguagcugggauucagcucucaaggaauggagaauaggaagcacuuagcuauccacccacauu

SEQ ID NO: 4129923 - RNA, 61 nt, Human
gaugugaugugagcaaaugcuugaaauguacuugcuuaguuaggcuugugcuuugucacuc

SEQ ID NO: 4129924 - RNA, 60 nt, Human
gaugugauuuauugaaaagagcuuggaaguugcuaagcucccugacaaauaaaccauguc

SEQ ID NO: 4129925 - RNA, 75 nt, Human
gauguggagauggggcaugcaaacaggaagaaauuaguaaacccauuccugcagcaaguaaccaucuuccuguuc

SEQ ID NO: 4129926 - RNA, 71 nt, Human
gauguggcuuuggcuucugucauuucuguuaaauccucuccagccagcucugacccuugccgagcuacauu

SEQ ID NO: 4129927 - RNA, 86 nt, Human
gaugugucgcuagucccauuuauccccaacaacccugugguuucuauuauccaguguugcauaggauggggauuuuuagacgcauu

SEQ ID NO: 4129928 - RNA, 58 nt, Human
gcacaggcaucaggcuuuuucugaauuagaaagacaaaaggcagcuugguaccugugu

SEQ ID NO: 4129929 - RNA, 79 nt, Human
gcacagggaaaaugcauguauguaauaugcuugucggcuucagcaacaacucauguauacauacacauuuacuauaugu

SEQ ID NO: 4129930 - RNA, 69 nt, Human
gcacaggguuucucaaccucaacacuauuuggaccagauaauucuuuguugugggaggcuguccugugc

SEQ ID NO: 4129931 - RNA, 84 nt, Human
gcacagguggccaccauggcaugauagucagucuaaagcucugccaccaaauagcugcaugaccaugagucagguugcuugugu

SEQ ID NO: 4129932 - RNA, 70 nt, Human
gcacagugaaaauucuauugauuucuguugacuuucaaaagucuagugaaagacaaugugauuauugugc

SEQ ID NO: 4129933 - RNA, 62 nt, Human
gcacagugauugauuuuuacuuucucuaguauaaaaagaaaguagacacauguuauuguugc

SEQ ID NO: 4129934 - RNA, 69 nt, Human
gcacaguggaguguguccagggaauguggauguuauugauucuguguauaauuagaccauuuacugugc

SEQ ID NO: 4129935 - RNA, 62 nt, Human
gcacaguuuagcuagguucucugcuuuagggugcaagccccaauucagauauuggcuugugc

SEQ ID NO: 4129936 - RNA, 63 nt, Human
gcacauaaauucaguucugccucuugguaaauacagcaccaagagcagggaauauuuauuugc

SEQ ID NO: 4129937 - RNA, 70 nt, Human
gcacauaagaauucucuagugcaaauuguuugauucuaacaauaggucaugccuaggagauuuuuuuugc

SEQ ID NO: 4129938 - RNA, 73 nt, Human
gcacauaucccgacuacuaacuacuguagaaagguuaacccaccuuucuacacuucgugguguuuuuaugugc

SEQ ID NO: 4129939 - RNA, 61 nt, Human
gcacauauuguaguucaccaggaugacuuugaaguuuuucugaaauagaacaauaugaugu

SEQ ID NO: 4129940 - RNA, 64 nt, Human
gcacaucgggcagcacguuucaggaggauuguuagacacucucaaccuccaucgugugucuugc

SEQ ID NO: 4129941 - RNA, 93 nt, Human
gcacaucuguaaacccuuuugagucuuuucugauguccgugugaguccaugaaaagccugacaucaugagagacuuaaauugagcaugauugc

SEQ ID NO: 4129942 - RNA, 60 nt, Human
gcacaugagcugcugggaugggcuugccccuguccugggcccuuacccagcuccgugugu

SEQ ID NO: 4129943 - RNA, 57 nt, Human
gcacauuccacacaguaauacucaauagagguuuauugagugcuuaaguggaauugc

SEQ ID NO: 4129944 - RNA, 100 nt, Human
gcacauugcuucaccugggcugcaugauggcauuucuuacauggaagaaaacugucacuaguugcccagaaaacagacucacauuugaagcauaaugugc

SEQ ID NO: 4129945 - RNA, 55 nt, Human
gcacauuuaacugagcucaggacgcugcaaugugauccuucaccgugaaaugugc

SEQ ID NO: 4129946 - RNA, 65 nt, Human
gcacauuucuuccacaugcugcuguccaccauacaggcggcuuuuaugaaaugggggaaaaaagc

SEQ ID NO: 4129947 - RNA, 63 nt, Human
gcaccaauuuacauauuuaccuuuguguaugagacuacauggaagguuuauauuuagaggugu

SEQ ID NO: 4129948 - RNA, 118 nt, Human
gcaccacaacgagauucucuuaccucugcgacugcacagaaccuuagaauaucuauaaagaauauaaaugugauuggaaauuuuguguaagauggugaagcuucuagauaugaggggc

SEQ ID NO: 4129949 - RNA, 82 nt, Human
gcaccacacgguguaaauacuaccuauaugcuuucaaucagaccgauaauaauauagaaggugcuauuuacaugguuugugc

SEQ ID NO: 4129950 - RNA, 100 nt, Human
gcaccacagugaucccuaggaaugcagacgugaagaagacagggaugcugccugcaaagggcucccugcaggugucucugucuagcguuccucugggugu

SEQ ID NO: 4129951 - RNA, 69 nt, Human
gcaccacgaagcaaaggcaggagcuugugagcuugugagcugaccccucuggccuuggccucuuagugu

SEQ ID NO: 4129952 - RNA, 70 nt, Human
gcaccagagaauaaaagggcauuccuuaggguugcugaggauuuucuuugauuguauucugcuaaugugu

SEQ ID NO: 4129953 - RNA, 92 nt, Human
gcacccaaucuuuaagggguccuuugcaacuguauucuggcugaaaaauagaguuucucucagaacugcagcugcagcuccuugacuggggc

SEQ ID NO: 4129954 - RNA, 64 nt, Human
gcacccagauauugccuugaccugucacccugguggcuacuggcaucaagguuuguucaggugu

SEQ ID NO: 4129955 - RNA, 59 nt, Human
gcacccagcaggaaagugacguuugaggguccccuucucaaccgcauugcugcuggggc

SEQ ID NO: 4129956 - RNA, 107 nt, Human
gcacccaggccucuggcugagcuuguccagagccaggcugucggccuuacgcuggggagagccacggccacccgcucaugggcacucacucaggguucccugguugc

SEQ ID NO: 4129957 - RNA, 109 nt, Human
gcacccauuaguaagguuccuuccucaccuccagcucuaggcugaagccugcagacagccuuuuguucuacagcuggggaaagaggccagaccugagcacaaugagugu

SEQ ID NO: 4129958 - RNA, 85 nt, Human
gcaccccccagaggcuguucaguguccagcuuguuuaacccugagcagggucuggaaguuagggaccuacaggcuaugguggugu

SEQ ID NO: 4129959 - RNA, 56 nt, Human
gcaccccugucuguacccccuaguucccaguauauggacuggcacacaggggcugc

SEQ ID NO: 4129960 - RNA, 84 nt, Human
gcaccccugucugugcaguccagcccuggacaccacgugguggugccaggguccugagggccuugcgcauaggucacggggugc

SEQ ID NO: 4129961 - RNA, 62 nt, Human
gcacccggaagcacaggcuugaggacgaugagcagcagagcaucuccagcgugcuccagggc

SEQ ID NO: 4129962 - RNA, 76 nt, Human
gcacccuccaggcggguucagggcugccauggcaacaaggacaugccgugagcaaaauggacacucccugaggggc

SEQ ID NO: 4129963 - RNA, 88 nt, Human
gcacccuccuccccacaucccuuguuagugacccccaagguauucagggaucugcagcauccuagggucugugaggaaggcaggaugc

SEQ ID NO: 4129964 - RNA, 80 nt, Human
gcacccuuaggccagaguccuugcgacugggacgggaggccccuguggcacaugcagggauucacugggcuggcuggugc

SEQ ID NO: 4129965 - RNA, 68 nt, Human
gcacccuuggcuggcauccagggaaauccagccagagaggucaaugcccuuuccuggaagccagcugc

SEQ ID NO: 4129966 - RNA, 60 nt, Human
gcaccgccuuggaccgcccgcugcgccagcagaccacggggaagcgguucuggcgguagc

SEQ ID NO: 4129967 - RNA, 69 nt, Human
gcaccuaugagaacgggggcgugugggacagcccagggccccgcacgacgcuuucguucucgccggugc

SEQ ID NO: 4129968 - RNA, 63 nt, Human
gcaccucagccuucugaagguggucccauugguccuuguggccugagcuucagaguugggugu

SEQ ID NO: 4129969 - RNA, 87 nt, Human
gcaccucugccgugggaguugcggccagguucuggcaggcaggggcucugccugcacugccuggcuccagguuccauucucaggugc

SEQ ID NO: 4129970 - RNA, 57 nt, Human
gcaccucuuggagccuuguuggccagcaaaacacuuacuggaggcuccaagagcugu

SEQ ID NO: 4129971 - RNA, 73 nt, Human
gcaccugaacuugacuccaguuucuacugaggauuuaaucacaaaauccugaguggggagcuaagugaggugu

SEQ ID NO: 4129972 - RNA, 92 nt, Human
gcaccugcaagguaguaucugaucucacuaaaaaaaguuagaggauuuuucuuaaaaaugguuuuuagugagaucgauaaaugcaugcgugc

SEQ ID NO: 4129973 - RNA, 65 nt, Human
gcaccugcuggaccacagggcagcccccagagaacaggacaagcucccugugcuccaggagaugc

SEQ ID NO: 4129974 - RNA, 59 nt, Human
gcaccuggcuggcaauuuauaauuuuuaaaaggugauucugauuaccagccaggcuugc

SEQ ID NO: 4129975 - RNA, 68 nt, Human
gcaccuguguuuucccucaguuucauuucuauucucucuggaugaaauaaagaaaggauauagugugu

SEQ ID NO: 4129976 - RNA, 79 nt, Human
gcaccuugaucuuggacuucuaaccugcagaacugggagaaaaucagcuucugcuguugaagccaccagucuguggugc

SEQ ID NO: 4129977 - RNA, 67 nt, Human
gcaccuuuggaaugaaaaguugcaagagguaccuccaaaauaaaguguaacuuucccauaagagugc

SEQ ID NO: 4129978 - RNA, 103 nt, Human
gcacgaaugcgguguuuaccucccuggggaagggcaagcaagcugcuggcgugguucagcaugcaccuuccccugggagcccggagagcacauuagcagaggc

SEQ ID NO: 4129979 - RNA, 57 nt, Human
gcacgagugcacgcugaaucauggccccuguucauggagaauguguuuacuucgugu

SEQ ID NO: 4129980 - RNA, 83 nt, Human
gcacgauguaguuauuuaugaaauuuauauugacucaaacccaauagagagucauccagagcuucauaaguaaagauguuugc

SEQ ID NO: 4129981 - RNA, 86 nt, Human
gcacgcccuccacggcuuggcccgcgcgcugcuguucccggccuacugggcccugcaccagcugcaggguggcugaggagggcggc

SEQ ID NO: 4129982 - RNA, 82 nt, Human
gcacggugaaauuccuuguggaaagugguaauuagacuggcuaugaggcuauuuucucauguuagggaucucaccgacuagc

SEQ ID NO: 4129983 - RNA, 70 nt, Human
gcacggugucuucuaguggggacaugugacaguaauuucuuuuccacauuaucugccauugacaccaugu

SEQ ID NO: 4129984 - RNA, 78 nt, Human
gcacguggggcggcagcggcugcagggaagagaggcuuguuaccuugggggugccagcugcuugucccccacaacugc

SEQ ID NO: 4129985 - RNA, 57 nt, Human
gcacguguguguguaugugugugggugggugagugugcacacauguguguuaugugc

SEQ ID NO: 4129986 - RNA, 60 nt, Human
gcacguguguuuccaaccaagcaagcacaauucucagaagugcuuugauggaaauacagc

SEQ ID NO: 4129987 - RNA, 73 nt, Human
gcacuacauucuuccuuuccugcaaaagcaucuguuuaaauacuuuuggccucaaaggaaagaacguuagugc

SEQ ID NO: 4129988 - RNA, 69 nt, Human
gcacuaguuuuagucccauuuuacagacaggacauggaaaccuaucuguaaagaucacagagcuggugc

SEQ ID NO: 4129989 - RNA, 58 nt, Human
gcacuauauuuaaaccuguggaugggaauauuccccauucuugguuacgcuguagugc

SEQ ID NO: 4129990 - RNA, 119 nt, Human
gcacuaugagagacccugaggcagaguauucacuuaaaccaugcccaaauucuggaccaacagaaacugagguaauaaguguuuguuuuucaaagucuuggguuauuaauucauugugc

SEQ ID NO: 4129991 - RNA, 59 nt, Human
gcacucaauuuagaacuccuuuaacaaguggucuugguucuaguuccuuaaauuggugu

SEQ ID NO: 4129992 - RNA, 80 nt, Human
gcacucaauuuucugccuagcaaaaacugugcgguuaugccaguucucauacaguuuuaguuaaaauagaagauuauugc

SEQ ID NO: 4129993 - RNA, 55 nt, Human
gcacucacuuauuucuaacagaagcuaaaaagcugucugagcgagaaaguagugu

SEQ ID NO: 4129994 - RNA, 60 nt, Human
gcacucccuucaggagccuaggacugcauuugucguccauggguggugagggggcagugc

SEQ ID NO: 4129995 - RNA, 117 nt, Human
gcacucugcaccucggggacguuauugcgcguggaacggcugcuuuuggaagacuuuugcccagaagaaaagauguuugguuuucacacgccaaagauguaccgaaguauagagggc

SEQ ID NO: 4129996 - RNA, 60 nt, Human
gcacucugcgcugggcgccagcgcccucagccggucgcucacguccacgcagcagggcgc

SEQ ID NO: 4129997 - RNA, 62 nt, Human
gcacugaagcaauauacugauaugauuauauuuugguaaccauugucaauauugcuggaggc

SEQ ID NO: 4129998 - RNA, 72 nt, Human
gagucacgggauuuugcagagagauauggcaagaggauuguuuaucuuggacucuuugcagugccauggcuc

SEQ ID NO: 4129999 - RNA, 70 nt, Human
gagucacuagucaguaugaaauugcucaaggaacucuaaccuugaugauuucuuuuugauucauuuauuc

SEQ ID NO: 4130000 - RNA, 77 nt, Human
gagucacuuccauaauaaccugagagaaaguggcaauuuuucauuuuuuaucucguauugcuuauggagcugagauu

SEQ ID NO: 4130001 - RNA, 60 nt, Human
gagucagacagggucacccagaaaggaagaggugcaucuucugaccgugucacaugauuu

SEQ ID NO: 4130002 - RNA, 81 nt, Human
gagucagcugagucagaugaacuaggcugcacuuggcugagcaacugcgcuucaaguccuaggucugauugaacuuggcuc

SEQ ID NO: 4130003 - RNA, 55 nt, Human
gagucagcugugaagaugguggcuguaacggacagcuucuuccaggcagugacuc

SEQ ID NO: 4130004 - RNA, 59 nt, Human
gagucaggucaggcuuguagauucgaguucuguugcgaguuugauugccccucugacuu

SEQ ID NO: 4130005 - RNA, 55 nt, Human
gagucagguccguggacaguuaagaagagcuuggcuaauuccaucagcuuggcuc

SEQ ID NO: 4130006 - RNA, 101 nt, Human
gagucagugucauaacagcaaugacugccauuaguacagguaguuuauagcucaaauuuuuaccuuuguauuuaccuagucucacuguuuugcgcugucuc

SEQ ID NO: 4130007 - RNA, 74 nt, Human
gagucaguugcaaacaucaggcacgcagccugcacuugaugcuggauaacuugcugauguuguauuccugacuu

SEQ ID NO: 4130008 - RNA, 78 nt, Human
gagucaucugcaauugauuucauaaggguuucuagacuuugcaacaaggcuaaaagacaucuuuauggguagagacuu

SEQ ID NO: 4130009 - RNA, 107 nt, Human
gagucauuaaaaauuaaaccauuaugaguacauugggaucaaagaacuaugaaguauuuaguagaagucugaaggauuuuguacucaaauuguaaauuuugguacuc

SEQ ID NO: 4130010 - RNA, 104 nt, Human
gagucauuaagaaacaugccacaguggccacaguucaacucuacacagucuuuccagagccugcacagugaccacugagcaagugcuauucuccacugugacuu

SEQ ID NO: 4130011 - RNA, 96 nt, Human
gagucauugugauguauuccuuugacuuuguuguuguuguuagugauuuccagugccagcaggaaacuuaaagguaauccaaauccaaaaacacuc

SEQ ID NO: 4130012 - RNA, 69 nt, Human
gagucauuuuucacugcauauagagucacuugagauauaaaaagucuuuuuguaguaaugaaagaacuc

SEQ ID NO: 4130013 - RNA, 74 nt, Human
gaguccaaagaaaugagucaaaacagcauauagaguucugcaauucaagagcugugaccucauucacaggauuc

SEQ ID NO: 4130014 - RNA, 119 nt, Human
gaguccaaauacgaaaauccacagagcuggggcucaaaucuggccucauugcuuauaaacccagcauguuuucugcaggaauccagagugagccuccauguggcagcacgaaugaucuc

SEQ ID NO: 4130015 - RNA, 118 nt, Human
gaguccaaguuggaggcugguucgcccagagaucuuguccuuuccagcccugggcaccccagcaguagaaaaguggaaagggagguaucucuagggaaacuuuccuugaguugaccuu

SEQ ID NO: 4130016 - RNA, 129 nt, Human
gaguccagaaccagagcucaggagcagagggcagggcgguuccuuggauucauugugggagggaggcaccuguuuccugagccccccgaguccaggguugcccucugagugugagcuagggcaggacuc

SEQ ID NO: 4130017 - RNA, 58 nt, Human
gaguccagacaccauaccugaugcaucccauucuauucagauuauggaugucugauuc

SEQ ID NO: 4130018 - RNA, 59 nt, Human
gaguccagagcugagggucaguagauucuagucacuagaccaccaggucugacuggcuc

SEQ ID NO: 4130019 - RNA, 56 nt, Human
gaguccagcagaaugagccaagcagugugaaauguguggaaacauguuguuggcuc

SEQ ID NO: 4130020 - RNA, 58 nt, Human
gagucccaccuccagagauggccuucccuaccacauccauccaugagagucuggauuc

SEQ ID NO: 4130021 - RNA, 58 nt, Human
gagucccaggaaugagcauagugggaagagagagaagccauugcucaccauggggcuu

SEQ ID NO: 4130022 - RNA, 80 nt, Human
gaguccuaugauuugucuuggaugaggauuaacagguuguagucuauuugaauaauauguucaggaggaaugaaggacuu

SEQ ID NO: 4130023 - RNA, 62 nt, Human
gaguccuggguccagcagguccucaggggagccccucuuugaagcccguagagccaggacuc

SEQ ID NO: 4130024 - RNA, 72 nt, Human
gaguccuguaacuuucuuccuaauugucaauucuagccaugaaagaaugugggaaaagaggugaaaggauuc

SEQ ID NO: 4130025 - RNA, 76 nt, Human
gaguccugucacuuauuauccuugugccuugcuuuugcuucacugguaaagugaaggucauaaugauucaggauuu

SEQ ID NO: 4130026 - RNA, 72 nt, Human
gaguccuuacuguuccugggacuggccaugaggaagaaacucccaucaggaacccaggagcccaagagaguc

SEQ ID NO: 4130027 - RNA, 69 nt, Human
gagucuauuauaguuccaguucaagggaaaauaaaauaccuugauuacuugauuauuguugauagauuc

SEQ ID NO: 4130028 - RNA, 78 nt, Human
gagucucacucuguggcccaggcaguggcacaaucauugcucacugcaaccuccaccuccuggguccaagugauucuc

SEQ ID NO: 4130029 - RNA, 86 nt, Human
gagucucacucuguugccuaggcuggaaugcaguggcacgaugucggcucacugcaaucuccgucucccagguucgagugauucuc

SEQ ID NO: 4130030 - RNA, 57 nt, Human
gagucucaucucuggcugucagagaguagaaaaagcugagggucaggacaaggacuu

SEQ ID NO: 4130031 - RNA, 85 nt, Human
gagucucgcucucucaccaggcuggagugcaguggcgcgaucucugcucacugcaaccucugucuucuggguucaagugauucuc

SEQ ID NO: 4130032 - RNA, 85 nt, Human
gagucucgcucugucaccaggcuggagugcagaggugcaaucucagcucacugcaaccucugacucccugguccaagcgauucuc

SEQ ID NO: 4130033 - RNA, 86 nt, Human
gagucucgcuuugucuccuaggcuggagugcaguggcacgaucucggcucacugcaaccuccgccucccggguucaagugauuuuc

SEQ ID NO: 4130034 - RNA, 60 nt, Human
gagucucuggaggggucagaccugggcauuaguaggugucucaagcuccccaggugauuc

SEQ ID NO: 4130035 - RNA, 108 nt, Human
gagucucuggcuggguggcaguggugggugggggagcgggcacacacauccuucacgcuugugugugugucuuugccuccucucaggccacagcaugaucagagauuc

SEQ ID NO: 4130036 - RNA, 76 nt, Human
gagucucuguugccuaggcuggagugcaguggugugaucuugguucacugcaacaccuccuggguucaagugauuc

SEQ ID NO: 4130037 - RNA, 80 nt, Human
gagucugcaguuuaucucuuuugaccaagauugguaugaagacuaaucuggacacuuaaagaggaaauauucuuugacuu

SEQ ID NO: 4130038 - RNA, 78 nt, Human
gagucuggaauguagagacagcuuaggagcucagaaucugaacauugucacuguagccugcucuccaguuucaaauuc

SEQ ID NO: 4130039 - RNA, 73 nt, Human
gagucuggcugcuuuagaauugaaacagauggacuugaggguuucuguaucuaauuuuacaguagcauaucuc

SEQ ID NO: 4130040 - RNA, 83 nt, Human
gagucuuacucuaucacccaggcuggagugcaauggcgcuaucucagcucauugcaaccuccuccuggguucaugugauucuc

SEQ ID NO: 4130041 - RNA, 85 nt, Human
gagucuugcucaucacccaggcuggagugcaguggggugaucucggcucacugcagcuucugucucccggguucaagcaauucuc

SEQ ID NO: 4130042 - RNA, 78 nt, Human
gagugaagggagcagggcuccuuuggguagcuuggucuugguagcucaccugcugggaagccuacguuucucucauuu

SEQ ID NO: 4130043 - RNA, 76 nt, Human
gagugaaguaucucuuuauugacaauaaaacuuuccagggaaguuuuauugucaaugaagacagagaagaccacuc

SEQ ID NO: 4130044 - RNA, 56 nt, Human
gagugaccugguuuaccaguucucugcacuuagacugguguuuauuacaggugcuc

SEQ ID NO: 4130045 - RNA, 60 nt, Human
gagugacugcccuacccccgggaugccuauccaugcccguggccuggggcagcuucucuc

SEQ ID NO: 4130046 - RNA, 68 nt, Human
gagugagacaguauacugagcaggaaaugaauuugcccuuugcugugauaggucauacugucucuuuc

SEQ ID NO: 4130047 - RNA, 65 nt, Human
gagugagagcugggggugaggggacagcugggaauucccccugcacugccugcuggcugucacuu

SEQ ID NO: 4130048 - RNA, 79 nt, Human
gagugaguucgcaauuaauucgggccacagugugccaaggcacauuuccaaacugggccuggauuggcgugucauccuc

SEQ ID NO: 4130049 - RNA, 70 nt, Human
gagugaguuuugguaguuucugucuuuagauaauugaucuauauuaucuaagauuuugcuaagaucauuc

SEQ ID NO: 4130050 - RNA, 68 nt, Human
gagugauuguaguucauugaaugaguaauugaauauccauacucaagguuaaugauugaaugucaguc

SEQ ID NO: 4130051 - RNA, 118 nt, Human
gagugauuuaguuuauuuaccuggcaacuucauuuauaaugucauuauguaaguauuaaaucauugaugaguaaauaagguugaguugauuugacuagggaaaaagacaaaauuauuu

SEQ ID NO: 4130052 - RNA, 62 nt, Human
gagugcaggccugagcaccaucugcaacaaugacaagcucuuacuugcucaggucuucauuc

SEQ ID NO: 4130053 - RNA, 58 nt, Human
gagugcaguaugagaggcugcugccugaguucuaaaugcaaccucucuuuugacauuc

SEQ ID NO: 4130054 - RNA, 55 nt, Human
gagugcuaaugcaugucaaguacuuuguacagaacguggcagguagugagcaguc

SEQ ID NO: 4130055 - RNA, 87 nt, Human
gagugcuaguuacagccaggccagcugucuugaguuugccaguagaaucagggccccuggccuaaggcaguuuuucuuuaugcacuu

SEQ ID NO: 4130056 - RNA, 61 nt, Human
gagugcugcuaaugcaagggugcuucugacuuagcacagugccaucacauggcgagcguuc

SEQ ID NO: 4130057 - RNA, 108 nt, Human
gagugcuggcuucuggacccagaggcugauucggggaacagcaaucuucuagcagaagagucugccuggucacuuggcugucugcaucugggucaauauucagcacuc

SEQ ID NO: 4130058 - RNA, 57 nt, Human
gagugcugucauacugagacagacagauuauuguucuggcucuaugugacagcucuc

SEQ ID NO: 4130059 - RNA, 76 nt, Human
gagugcuuauacaguuugccugaaauccauacauuaacagccuuuggauuuccaaacucauaguaugguguaucuc

SEQ ID NO: 4130060 - RNA, 57 nt, Human
gagugcuugguaauugcacugagccaaagacacucacuucgcaauuauugggcauuu

SEQ ID NO: 4130061 - RNA, 77 nt, Human
gaguggaaauuccuuggagucaaacagggagaaaauacgucucaguguuaaagacuuuccagagacuucuuccauuc

SEQ ID NO: 4130062 - RNA, 82 nt, Human
gaguggaaggagggcugggagaggcagcuuucggaucggcggucgcuuucuaugaagucuuccuuuccucccugcuucccuc

SEQ ID NO: 4130063 - RNA, 58 nt, Human
gaguggaaggugcuggccacagaggccucuacacagguuggggugagaccucccacuc

SEQ ID NO: 4130064 - RNA, 63 nt, Human
gaguggacuaacaggucagccuccugucccuucugacuccugcugccuggcuuuaguccacuu

SEQ ID NO: 4130065 - RNA, 62 nt, Human
gaguggagugaguggcagaaggagaucaacggucuucugaaugaaaaacccugacucuaguu

SEQ ID NO: 4130066 - RNA, 105 nt, Human
gaguggagugccgcgacgguguggccgcagccuggcugugccuucacgacgcagcugcaaucagaggagcugugggacgcugucccacguggacacagcccacuc

SEQ ID NO: 4130067 - RNA, 61 nt, Human
gaggaggcggcaagcuggugucuggggcagugaggauuucagaugcagcuccugccuccuu

SEQ ID NO: 4130068 - RNA, 56 nt, Human
gaggaggcucccuuuagguccagaucaguggaauuuggucccagggaguccuacuc

SEQ ID NO: 4130069 - RNA, 62 nt, Human
gaggagggaugggucuaacccagaaccacagauggcucugagccgggggccuguccacccuc

SEQ ID NO: 4130070 - RNA, 65 nt, Human
gaggagggccuggugucccuucguccuuggcucucuuuggccccgggccacaccaggucaucuuc

SEQ ID NO: 4130071 - RNA, 78 nt, Human
gaggaggggagagucuuagugugguuggggacugaguauggcagggacuccccagcauugagggucucucucuuccuc

SEQ ID NO: 4130072 - RNA, 55 nt, Human
gaggaggucaccuggugagcaaccaaguaagucuucauccagguccugcuucuuc

SEQ ID NO: 4130073 - RNA, 56 nt, Human
gaggagucucagaaaagaagcauggaagacucuucccaauuaacugagcauuccuc

SEQ ID NO: 4130074 - RNA, 66 nt, Human
gaggaguggcuauuugugcugguuuucugaacuuacagccuucaaaccuucuaaauggcucuucuc

SEQ ID NO: 4130075 - RNA, 55 nt, Human
gaggaguuccugcauauucuugcaccaucccgggugcuguugcuggggcucucuu

SEQ ID NO: 4130076 - RNA, 74 nt, Human
gaggauaagaagccaccauuguugugggcuuaaagugauccacuuucacuagggcucagagaaguggggcccuc

SEQ ID NO: 4130077 - RNA, 60 nt, Human
gaggauaagugcuuuuaaagcaaacaaaccugaggcguguuguuaaaggacacuugcuuu

SEQ ID NO: 4130078 - RNA, 87 nt, Human
gaggauauuuuauuuaagcuguuuugcaaaguuugauuagccuacugaauaguacaguuuaaauauuaauauaaggaaaggagccuc

SEQ ID NO: 4130079 - RNA, 84 nt, Human
gaggaucaaugggaauagaaaauguauucuauauuuuccuuguuacauagaguuagagcgcauauuuuauuaauguucauccuu

SEQ ID NO: 4130080 - RNA, 59 nt, Human
gaggaucgcuugaggccaggaguuugagaccagccugggcaacaacacagcgagaccuc

SEQ ID NO: 4130081 - RNA, 89 nt, Human
gaggaucuagcaaagaccaaagcuaguugaauguuugaaaauauguuuaggaaacaacugauuuggaaaguuuguuaucaagggaccuc

SEQ ID NO: 4130082 - RNA, 68 nt, Human
gaggaugcccaaaggguuguggcuacuuuuuguuucuguuaagugcuguaacaacuuauuugguccuc

SEQ ID NO: 4130083 - RNA, 60 nt, Human
gaggaugcuagccagcucuguggagucuguuucugagcagccagagcugcuggccucguc

SEQ ID NO: 4130084 - RNA, 76 nt, Human
gaggauggacgugacucccuggcccugcccuucucaguugcauauaggcagggcuucugggcaccacucccuccuu

SEQ ID NO: 4130085 - RNA, 123 nt, Human
gaggaugggaacaagaaaggaagaaacuggcaaauuggcagcugaagaggaacuuugggagauaaaugccuucugaggauuuugauuaguuguuugcuguuugauguuaaccguuuccuccuc

SEQ ID NO: 4130086 - RNA, 59 nt, Human
gaggaugguaugaggcaagcaaaugcaguuuagaguguuauuuaucucaggcuaucuuu

SEQ ID NO: 4130087 - RNA, 73 nt, Human
gaggauggucaguaaaguucuuucuugcugauuacacaguaaccaguugaaaagauuuuauucugaaagacuc

SEQ ID NO: 4130088 - RNA, 77 nt, Human
gaggauguugggguuuauugcugugaacagggucugcaagguccucacacagugguaaaacccugaacacaaaccuc

SEQ ID NO: 4130089 - RNA, 69 nt, Human
gaggcaaaacagucgaugccucccaguuucaagcugguuuggucaucaugggagagcguugcuguccuc

SEQ ID NO: 4130090 - RNA, 57 nt, Human
gaggcaaaugauccugcuccuugaugugaggaaaugucaaggguuugcauuggcuuu

SEQ ID NO: 4130091 - RNA, 66 nt, Human
gaggcacagucccgaggcaaggaaaacggacacagugauuccccgaguuucuggacauggauccuc

SEQ ID NO: 4130092 - RNA, 68 nt, Human
gaggcaccagcauuuggugaucaucuuaauccaguuaccuggauugauaugguucaaagcugggcuuc

SEQ ID NO: 4130093 - RNA, 100 nt, Human
gaggcaccuagggaaggaaaaugcaggaggcgcucaucuucagguggcaccgcaggacccugagcaucagcgccuccuuacauuuugcccugggcaucuc

SEQ ID NO: 4130094 - RNA, 72 nt, Human
gaggcaccucgcgggaggaggcggggugaggugucagugacacgacgaaaccucuucuugacgaugguccuc

SEQ ID NO: 4130095 - RNA, 63 nt, Human
gaggcagaaggcggcuccucuggcgccucuucuuaggguuccugaucguugucucucuaccuc

SEQ ID NO: 4130096 - RNA, 61 nt, Human
gaggcagaaggcugaggagugacuuccugagaucaccaccucaucaagcuggauuguccuc

SEQ ID NO: 4130097 - RNA, 59 nt, Human
gaggcagaggcagacccugagaaugcgugugucauuuucaagggagaggccucugaauc

SEQ ID NO: 4130098 - RNA, 80 nt, Human
gaggcagagucccaggggcagagagagccuggaaaggcaggcuggucuuguggcucucaugcccucugggcuuggcacuu

SEQ ID NO: 4130099 - RNA, 125 nt, Human
gaggcagaugaacagcgguuuggguuuugcaaugggagugcaccugggacacgaggaugguaugacuugagccuucccugugggcgcuccugaggcagaggacccacgccgugccuggucgccuc

SEQ ID NO: 4130100 - RNA, 60 nt, Human
gaggcagccagagguucucauuuggaaagcugaauggugauugcuucugagcagagccuc

SEQ ID NO: 4130101 - RNA, 118 nt, Human
gaggcagcccccggacacccuggcacuggcugggcgauggcagcggggccuggcugggcugcagcuggcugaguucugucgucugcagaggagcaggaccugggacgggggcucccuc

SEQ ID NO: 4130102 - RNA, 74 nt, Human
gaggcagcuauggauggaaagggccaagcuaauggagcaggucucugcaggcuggucuuucuuccauaugcuuc

SEQ ID NO: 4130103 - RNA, 70 nt, Human
gaggcagcuccagggacccaagagaaaagacuugccuaugguuuccucucucaguccuggcagcagcuuc

SEQ ID NO: 4130104 - RNA, 58 nt, Human
gaggcagcuggguccggucgggagcuuucccguuaccuucgccaugacccagccgucc

SEQ ID NO: 4130105 - RNA, 78 nt, Human
gaggcagcuuugcucuucaccacaccuuggacggaccaccuucuuucuguuccauggccugaaggagugcaucuccuc

SEQ ID NO: 4130106 - RNA, 99 nt, Human
gaggcaggaaaagcgcuugaacccaggaggcggagguugccaugagccgagaucgugccauugcacuccagccuuggcaacaagagugaacucugucuc

SEQ ID NO: 4130107 - RNA, 98 nt, Human
gaggcaggagaaucacaugaaccuggcaggcggagguugcagugagccgagauugugccacugcacuccagccuggccacagagcgagacuccgucuc

SEQ ID NO: 4130108 - RNA, 100 nt, Human
gaggcaggagaaucacuugaacccagaagguggagguugcagugagcugagaccaugccauugcacuccagccugagcagcagagugaaacucuugucuc

SEQ ID NO: 4130109 - RNA, 99 nt, Human
gaggcaggagaaucacuugaaccugggaggcggagguugcagugagccgagaucgcaccacuguacuccagccucggugacagagugagauucugucuc

SEQ ID NO: 4130110 - RNA, 103 nt, Human
gaggcaggagaaucacuugagccuugugggacggagguugcgguggugagccgagagcgcaccacugcacuccagucugggccacagagugagacccugucuc

SEQ ID NO: 4130111 - RNA, 87 nt, Human
gaggcaggagaauccagguggagguugcagugagcugagaucacgccauugcacucuagccugggugacagagcaaaacacugucuc

SEQ ID NO: 4130112 - RNA, 99 nt, Human
gaggcaggagaaucgcuugaacccaggaggcggagguugcagcgagcugagaucgugccacugcacuccagucugggugacagagcaagacucugucuc

SEQ ID NO: 4130113 - RNA, 100 nt, Human
gaggcaggagaaucgcuugaacccaggagguggagguuguggugagccaagaucgugccauugcacuccagccugggcaacaagagugaaacucugucuc

SEQ ID NO: 4130114 - RNA, 98 nt, Human
gaggcaggagaaucgcuugaacccgcaaggcagagguugcagugagccgagaucgugccacugcacuccagccuggugacagagcgugacucugucuc

SEQ ID NO: 4130115 - RNA, 99 nt, Human
gaggcaggagaaucgcuugaaccgggaggccgagguugcagugagccgagaucgugccacugcacuccagccugggcggcagagcgagacucccgucuc

SEQ ID NO: 4130116 - RNA, 99 nt, Human
gaggcaggagaaucgcuugaaccuggaaggcggagguuguagugagccgagaucgugccacugcacuccagccugggcgacagagcgaugcuccgucuc

SEQ ID NO: 4130117 - RNA, 100 nt, Human
gaggcaggagaaucgcuugaaccugggaggcagagguugcagugagcugagacugagccauugcacuccugccugggcaacaagagcgaaauucugucuc

SEQ ID NO: 4130118 - RNA, 96 nt, Human
gaggcaggagaaucgcuugaacucgggagucagagggugcagugagccaagaucgccacugcacugcagccuggagacagagcgagacuccgucuc

SEQ ID NO: 4130119 - RNA, 100 nt, Human
gaggcaggagaaucgcuugaauccagguggcggagguuguggugagccaagauugcaccauugcacuccagccugggcaacaagaucgaaacuccaucuc

SEQ ID NO: 4130120 - RNA, 97 nt, Human
gaggcaggagaaucgcuugauccugggaggcggaaguugcagugagccgagaucgugccacuguacuccagccugcgacagggcaagacuccgucuc

SEQ ID NO: 4130121 - RNA, 99 nt, Human
gaggcaggagaaugaugugaaccuggguggcagagccugcagugagcugagauggcgccacugcacuccagccugcgcgacacagcaagacuccgucuc

SEQ ID NO: 4130122 - RNA, 99 nt, Human
gaggcaggagaauggcaugaacccgggaggcggagcuugcagugagccgagauuacgccacuguacuccagccucggugacagaacgagacuccgucuc

SEQ ID NO: 4130123 - RNA, 96 nt, Human
gaggcaggagaauggcgugaaucugggagcggagguugcagugagccgagaucgcgccacugcacuccagccugggagacacagcgagacugccuc

SEQ ID NO: 4130124 - RNA, 104 nt, Human
gaggcaggagaauugcuugaacucaggaggcggaggucgcagugagcggagaucgcaccacugcacuccagccuggccuggguaacagagcaagacuccgucuc

SEQ ID NO: 4130125 - RNA, 98 nt, Human
gaggcaggaggaucaccugagcccaggaaguugaggcuugcagugagcugugauugcaaaugcucuccagccugggugacagugugagacuccguuuc

SEQ ID NO: 4130126 - RNA, 99 nt, Human
gaggcaggaggaucacuugagccugggagguugaggcugcagugagcaaagaugcugccacugcacuucagccugggugacaaagugacaugcugucuc

SEQ ID NO: 4130127 - RNA, 97 nt, Human
gaggcaggaggauugcuguagcccagggguucaaggcugcagugagcuauaaucaccuaacuguacuccagccugggaaacacagcaagacugucuc

SEQ ID NO: 4130128 - RNA, 66 nt, Human
gaggcaggaggauugcuugaggccagauguucaagaacagccugggcacuucaauacucuugucuc

SEQ ID NO: 4130129 - RNA, 68 nt, Human
gaggcaggagucucucuugagcccaggaguuugaggccagccugggcaacagagcgagacccuaucuc

SEQ ID NO: 4130130 - RNA, 67 nt, Human
gaggcaggcagauugcuugaggccaggaguucgagacuagcuugggcaacaugcgagagcccgucuc

SEQ ID NO: 4130131 - RNA, 71 nt, Human
gaggcaggcuggguagcaggugauccaggagcagugguacaccuggacccuggacugcccuggccugcuuc

SEQ ID NO: 4130132 - RNA, 98 nt, Human
gaggcaggggaauugcuugaaccugggaggcggagguugcagugagucaagauugcgccacugcacuccagccuggugacagagcaagacuuuaucuc

SEQ ID NO: 4130133 - RNA, 79 nt, Human
gaguggcacugggcugcaccuuuguaaaucucuuaaacauggcuuaauagaagacagcugcaucccaucacugccucuc

SEQ ID NO: 4130134 - RNA, 70 nt, Human
gaguggcaggaaaguggaagagaaaagcacugagcagcauccucuuauccaccuucucccaugcucucuc

SEQ ID NO: 4130135 - RNA, 66 nt, Human
gaguggccagugcugcucuggggcugcuuccugcaccccacaagcugcagaacugcaaagccucuc

SEQ ID NO: 4130136 - RNA, 77 nt, Human
gaguggccuugggcacaucccugguauuuuccuauaaaauaaagauggugggcauuaaauggccauaagaguugcuc

SEQ ID NO: 4130137 - RNA, 67 nt, Human
gaguggggcuuaggaccuuguggcgcuucugucagaagccucuguggucugucuaaugcaccugcuc

SEQ ID NO: 4130138 - RNA, 55 nt, Human
gaguggggugcagugacagggagucuggugggagcucugaggcugagcucuacuu

SEQ ID NO: 4130139 - RNA, 58 nt, Human
gagugggguucaggaggccugggaaguguccugaagcugccuccuggugccccaucuc

SEQ ID NO: 4130140 - RNA, 70 nt, Human
gaguggucaagagauugaauaauaacugaguagcaauaauacucagauggguuaugucuuuugacuauuu

SEQ ID NO: 4130141 - RNA, 91 nt, Human
gaguggugaacguuuguugcugauuuccccuugaguguucacuugagcuccgugcgcacacaagaugcggagacaugugaugcugcuauuc

SEQ ID NO: 4130142 - RNA, 76 nt, Human
gaguggugggguguggggcagaguggugugguaugguugguguuuuaagcagaugauucugucaucccagcuacuu

SEQ ID NO: 4130143 - RNA, 56 nt, Human
gagugguguucauuuucagaauggucucccagaagaucuucugugauacaucaguc

SEQ ID NO: 4130144 - RNA, 73 nt, Human
gaguguaaugguuugaggcaaauucaacauauuucuuaaaaacuuguugagucugcccaaauuaagaacacuu

SEQ ID NO: 4130145 - RNA, 57 nt, Human
gaguguccugcacagcaccuugcagaccucccauggcugccugcucuguagggccuc

SEQ ID NO: 4130146 - RNA, 100 nt, Human
gagugucgagauagguccccuuugucagucacugucuggaugugagucaccuauaauugugggugacuggcauccaggccugagccccaucucccagcuc

SEQ ID NO: 4130147 - RNA, 56 nt, Human
gagugucuaaucacguuucacaaggcaaauugguaagacaauguuguuggacacuc

SEQ ID NO: 4130148 - RNA, 64 nt, Human
gagugucugcauccaauaaguacucaauaaauacaaguuaauugacaaauggauguugacauuu

SEQ ID NO: 4130149 - RNA, 79 nt, Human
gagugugagaaaucugugagaaauucgacauauauuuauuuuucuuggaaauuagagaauaucuucacaguguacacuc

SEQ ID NO: 4130150 - RNA, 72 nt, Human
gagugugauaaggacuuugaaggauacauauuugauucugugggacuauguacccaaagaucugaucuacuc

SEQ ID NO: 4130151 - RNA, 62 nt, Human
gagugugcagcaggccucaucuccugggccuuagccaaggucucugaguacugcuggaccuu

SEQ ID NO: 4130152 - RNA, 112 nt, Human
gagugugguggcaugugucuguggugccagcuacucuguaggcugaagugggaggaucacaugagccuggcagguagaggcugccaugaauugugauugugccacugcacuc

SEQ ID NO: 4130153 - RNA, 79 nt, Human
gaguguguuuaaccugaaauucugaauucugagccuuucacuggaguaagaguguuugaaauucuagauaaacauacuu

SEQ ID NO: 4130154 - RNA, 70 nt, Human
gaguguguuuguguggcuaguucccugaagagcccaucaacuuaguaagcacucacacauucccacacuu

SEQ ID NO: 4130155 - RNA, 73 nt, Human
gaguuaaacauguaaguucagaucaccaucaugaaacagagcugaaggugcuucuuuuauugcaguauaauuu

SEQ ID NO: 4130156 - RNA, 70 nt, Human
gaguuaaauaguagucgccuuuuguaagcaacucuaacagagguuuacauuugggauuaauaguaaacuc

SEQ ID NO: 4130157 - RNA, 104 nt, Human
gaguuaaauguaaaaugugaaaguggaaucuaagaguuaacaucaagaacagugcuaguucaacuguucuaacuuucaagguccuuucacuuauugcaaaacuu

SEQ ID NO: 4130158 - RNA, 60 nt, Human
gaguuacaguggguuuggggcccaggcaaaaucugccucugguucuuucuccuguguguc

SEQ ID NO: 4130159 - RNA, 59 nt, Human
gaguuacuugguucaacuagaaugugaaaaaugugcauauucuauggaccaguauauuu

SEQ ID NO: 4130160 - RNA, 61 nt, Human
gaguuauauccugagucauauucuaucuuguaaaguccucccaauggcucaggaauggcuu

SEQ ID NO: 4130161 - RNA, 59 nt, Human
gaguuaucuucugugcuguuaaagcuuucuucuguuguaacauccacauuagaugauuc

SEQ ID NO: 4130162 - RNA, 63 nt, Human
gaguuauuggguggaaagguagcuuucucuuccuuguacagcuuuuuguuccucucauuagcc

SEQ ID NO: 4130163 - RNA, 90 nt, Human
gaguucaaucugcauguggauuaguuggcuuuauuuuggaaacaagcugaccaaacuucagccagcuuucacaaaugaagauuuuggcuc

SEQ ID NO: 4130164 - RNA, 87 nt, Human
gaguucaggauagugugcuuguugacagggguuuugguacccugucugucacagagcaacuauuucuugaucaaguugauaauacuc

SEQ ID NO: 4130165 - RNA, 73 nt, Human
gaguucauggccaugaaaauugguugggucuugauguccucugaucugucuuuuauucaugagcuaugcauuc

SEQ ID NO: 4130166 - RNA, 71 nt, Human
gaguucaugucuuauuuugucuugcuuggcacacugcugaguguagaguaggcauuuaauaaacaugaguc

SEQ ID NO: 4130167 - RNA, 100 nt, Human
gaguuccaagccucagggcaaguugucucuggcuggcaccccagggagugcacgcucucuggagggcuccaggcgggcacuguggccuuuggggacacuc

SEQ ID NO: 4130168 - RNA, 59 nt, Human
gaguuccucuuuuccucauuuacccuccugaaacacagaagggggagcagacugaacuc

SEQ ID NO: 4130169 - RNA, 65 nt, Human
gaguucucaccauaaaucaaaggacuaaaauucugguacauauguccuuauuagagugagagcuu

SEQ ID NO: 4130170 - RNA, 64 nt, Human
gaguucuggagaauagaagucuuaaaucaagguguggauaggcuuggcuuauucuugggggcuc

SEQ ID NO: 4130171 - RNA, 57 nt, Human
gaguucugugagccauccuagcaaauuaucaaaccuuaggaggggucaugggaacuc

SEQ ID NO: 4130172 - RNA, 83 nt, Human
gaguugacaggcuccaagaagucaucuaaacugucccuccugacaggaagccacagugaacaggugacuuggaugguuuacuu

SEQ ID NO: 4130173 - RNA, 88 nt, Human
gaguugaggguuguuuaugugagacuaaguccuguucacaaaugagaaaucuuuucuuauguggacguaccuguguacaguucagcuc

SEQ ID NO: 4130174 - RNA, 91 nt, Human
gaguugcucauggugagugaggauaggagcccagacugggucagacagaagugucuucaaacccuggcucuuccucuagccuugggaacuu

SEQ ID NO: 4130175 - RNA, 67 nt, Human
gaguugcuuaaccuauuuuucucauugaucuccauuuuaaugaugaaaacugaagguuaggaaacuc

SEQ ID NO: 4130176 - RNA, 63 nt, Human
gaguuguagcaccguggcuucaaggcugucuugaccagcagaggccuggcccugccacaucuc

SEQ ID NO: 4130177 - RNA, 80 nt, Human
gaguugugcagcuagugcugugagugcuguuucuguaucagggcacagauuucccacuccauguauuggcuccuaagcuu

SEQ ID NO: 4130178 - RNA, 58 nt, Human
gaguuguuauaauguauguaaggcauuuaguacagugccuuguacaugauaaagauuu

SEQ ID NO: 4130179 - RNA, 72 nt, Human
gauucucaugauacaucuucaugucaguguuacucuaguauuuuacugaaauggcagauauauaaaagaguc

SEQ ID NO: 4130180 - RNA, 55 nt, Human
gauucugcugucccuaagugccggcaagggcugggggaugaucuugaguaggguc

SEQ ID NO: 4130181 - RNA, 81 nt, Human
gauucugcugugcaucugaauuugaaaaucuugagcuuugaaauaaaagcagacucugaaaucuaggugcaaggcaugguu

SEQ ID NO: 4130182 - RNA, 85 nt, Human
gauucugcuuugcugguacccaagcauguccagugugcccacggggugcugggcacugucucuggggaagcagcaaaccagacuc

SEQ ID NO: 4130183 - RNA, 63 nt, Human
gauucuguaaccuuaauuuccucagguuuuuucagccuguggguacaacagggucacagaauc

SEQ ID NO: 4130184 - RNA, 57 nt, Human
gauucuguugcccuuagaguuguuaccccuacaguuuucacugggcuugcagaaauc

SEQ ID NO: 4130185 - RNA, 61 nt, Human
gauucuuaagcccagcuguggaccuacuaauuacaaugucugggggugaggccuaggaauc

SEQ ID NO: 4130186 - RNA, 75 nt, Human
gauucuuccucugccucccgugcucacucucuccccaaccauggugggcuuaggggugcugaggccgauuugguc

SEQ ID NO: 4130187 - RNA, 130 nt, Human
gauucuucuaggcucagacaaacauuaaaugggggagcagaagagggaguguggacauaagccaugcuggcagugggcaggugccagcucccugucucaguucccuugucuguaaaauagaaauugaauc

SEQ ID NO: 4130188 - RNA, 80 nt, Human
gauugaaacuagagggaggaugcugggugcuucugcuaugagcuccuugagcacccuccaacuucccuguagucuuuguc

SEQ ID NO: 4130189 - RNA, 98 nt, Human
gauugaaauguaggauugagugauagaggugguugcuguuucucaguaaagaugguugccuuuacucauuaaauccuggcuauuaaaacacuucacuc

SEQ ID NO: 4130190 - RNA, 60 nt, Human
gauugaaucauaugaaauuguggauguuuaacuguuuuugaccuacaaugugauucaauc

SEQ ID NO: 4130191 - RNA, 96 nt, Human
gauugacgagcuuaaucagcgaaucaggaggaagccuugggcaucaaucauugucagugugccuucuuccuaacuucugauuugcugcuuccaguu

SEQ ID NO: 4130192 - RNA, 55 nt, Human
gauugagucugaggaugcugcagauuucauuuggcgguaccaucacuuuucaguu

SEQ ID NO: 4130193 - RNA, 91 nt, Human
gauugcagaacaaggcaacagaagauaacugggaccagaacuaaaauauggggucuggauuauuugucuugcuguugcuguugcuguuguu

SEQ ID NO: 4130194 - RNA, 66 nt, Human
gauugcagagggaagcagauuccuuuacuucauuucuaaagaguaggggaaaaaucuucugcaauu

SEQ ID NO: 4130195 - RNA, 95 nt, Human
gauugcagggcauagcuaaaggaauuuaagacucuggaauucauacagccugacucuuuuaugcauuccuucagaaacuaguuagcccuguuauc

SEQ ID NO: 4130196 - RNA, 109 nt, Human
gauugcauaugcucagaggccugucccagaggcuuuggccacagugguuuauguccugaacgccacugugcccaggccccuggggauguuccccccugagguugucauc

SEQ ID NO: 4130197 - RNA, 71 nt, Human
gauugcaucuucugguugagccccugggaguggcaaccauagcagccauggggcugaaccuggaggugguc

SEQ ID NO: 4130198 - RNA, 65 nt, Human
gauugccaacuguagucaagagcuuugagagaguaaaaaggucuaaagcuacugaguugccaauu

SEQ ID NO: 4130199 - RNA, 116 nt, Human
gauuggcugauacaggauuagagaggaagagaaggggguaaacuggcuaacagcuucuguucuauguggcauuugcucccuuguguucaggucuucucuuuuguuucauaaccauc

SEQ ID NO: 4130200 - RNA, 61 nt, Human
gauugggacuagaaugacucuaaagucccuuucagcucuagaauucaaucuguuccacauc

SEQ ID NO: 4130201 - RNA, 68 nt, Human
gauugggaggcaaaguucucugucugccccaguuucuuucuacagagagagaagggacucuuccaguc

SEQ ID NO: 4130202 - RNA, 98 nt, Human
gauugguccuuaaugcauuuuuaaaaagcaacguauauggguaaggauaucaauaucuuaguaugcuguauucuguauguuagcucauuuuggcuuuc

SEQ ID NO: 4130203 - RNA, 68 nt, Human
gauuguaauucuacuuuccgcugacauuaaaauuucuagagauguuuguagcagagaggacuacaguc

SEQ ID NO: 4130204 - RNA, 115 nt, Human
gauugucuggucacuuaggcaggucagugcuguuauuugcucaugucaugagggcuggguguucuugaauagauggugacaguaugaccauaauuccuaacguguccagucaauu

SEQ ID NO: 4130205 - RNA, 62 nt, Human
gauugugcagauaguaauuaggaaagcugguauuaaaacuagguccuaucugucccacaguu

SEQ ID NO: 4130206 - RNA, 79 nt, Human
gauuguuauuugaucuuuucagguuucucuagucauguaguuagcacauuggaagcaagaaaagauaaacaguacaguc

SEQ ID NO: 4130207 - RNA, 72 nt, Human
gauuuaaagaacuauuaacgaggaagcugggacuguucccugcuuucuguagguaguuacuguuguuaaauc

SEQ ID NO: 4130208 - RNA, 77 nt, Human
gauuuaaguagacuauuucaaucuccuuuggugcuuuccuaccugagcacagagugggugagauguggauuuguguu

SEQ ID NO: 4130209 - RNA, 79 nt, Human
gauuuaagugguucuugcaagugcucuguaucugaauucaggaagcagugaaucuggcaagaauuuacaaacuuaaguc

SEQ ID NO: 4130210 - RNA, 106 nt, Human
gauuuaauuuacuuauauucuacuuucauccacaaagcuguugacuaugaguaacucacagucaacagcauuauggaugaaagcagaguaucaguaaauaggaauc

SEQ ID NO: 4130211 - RNA, 56 nt, Human
gauuuacagcuauacccaaugguauaacuguuaacuauuggguauaacuguaaauc

SEQ ID NO: 4130212 - RNA, 82 nt, Human
gauuuaguaggggcaccaggaagcuguuauagcaaacacccaggugauacugcuacauacauucuguugcgccugccaaguc

SEQ ID NO: 4130213 - RNA, 79 nt, Human
gauuuauccuugggaagggucaguuucuucauuaggacaaugaagaaaaauccagcugucccuuccaaggggagguauc

SEQ ID NO: 4130214 - RNA, 84 nt, Human
gauuuauuguaaaguacuuagcacagcacuagguacacauuagguguacugauaaugucugcuaaauuacuauuacacugcuuc

SEQ ID NO: 4130215 - RNA, 85 nt, Human
gauuucaagagaaagauuagaccauaaagaguucaauggagaaagcaguaucuccagcuuuggcucuagcuacacuuuugaaauu

SEQ ID NO: 4130216 - RNA, 60 nt, Human
gauuucacuaucaacaucauugcucuagaauucugaauggcuuuggugugaugggggauc

SEQ ID NO: 4130217 - RNA, 60 nt, Human
gauuucaggcccaccuuuccacagcuucaccacaaccugaacagaaagguccuagaaauc

SEQ ID NO: 4130218 - RNA, 57 nt, Human
gauuucaguggcugucucaaaugucaaaaugauggagaggacagagagacugaaauc

SEQ ID NO: 4130219 - RNA, 72 nt, Human
gauuuccuuuucucuuucaaucugcaguacuuuuuaugaagacuggucuuuugugauggaugaagagagguc

SEQ ID NO: 4130220 - RNA, 61 nt, Human
gauuucugggcccaacccuagagugugugacucaguaguucugggauggagcccaagaauu

SEQ ID NO: 4130221 - RNA, 58 nt, Human
gauuucugggcuuuauuucagaguuucuaaugcugaguggggaugaaguugggaaguu

SEQ ID NO: 4130222 - RNA, 69 nt, Human
gauuucuugauaaguagugugauauucccagguauagccuucauggggagagcucuuggcaaugaaauu

SEQ ID NO: 4130223 - RNA, 74 nt, Human
gauuugccaaaacacaggguuuucuggaagauuauccacacucgcaauaggaagcucuuuguuuugugaaaguc

SEQ ID NO: 4130224 - RNA, 107 nt, Human
gauuugccaaaggagcuguccuccuggugcaaagggccuagagagugguaucagucacaguuugaacuauguucucugcucuaggaugucacagcuuaccccaaauc

SEQ ID NO: 4130225 - RNA, 71 nt, Human
gauuuggacuucuggagugugguuaauuuaaguguucucaucaggccuugauauuucagauuuccguaauc

SEQ ID NO: 4130226 - RNA, 100 nt, Human
gauuugggguggagaguucgguagaugucuauuaggucugcuuggugcagagcugaguucaauuccuggauauccuuguuaacuuucugugucguugauc

SEQ ID NO: 4130227 - RNA, 100 nt, Human
gauuugggguggagaguucuguagaugucuauuagguccgcuuggugcagaccugaguucaauuccuggauauccuuguuaacuuucugucucguugauc

SEQ ID NO: 4130228 - RNA, 64 nt, Human
gauuuggguggaagguggcauuuuggcuggcuaaaauaaaugcagacagcuucacacaccauuc

SEQ ID NO: 4130229 - RNA, 80 nt, Human
gauuuguaguuuuaugugucagcuaacauaauagguacguucuuagauuggaaggugaauagauuuuuaacauauaaguc

SEQ ID NO: 4130230 - RNA, 56 nt, Human
gauuuguggugugaggaagagcgaugcccuaagaugcagacucacgccuucagauu

SEQ ID NO: 4130231 - RNA, 65 nt, Human
gauuuuagaaggaaugcuauggugaugauaauaaaauaacaccaucuagcauuuauuuggaaauu

SEQ ID NO: 4130232 - RNA, 81 nt, Human
gauuuuaugauacauacuuuuucuugcaagcaauuuugcagcaaguucuguugccuguaaagaaagguugaucauuuaguu

SEQ ID NO: 4130233 - RNA, 86 nt, Human
gauuuuauuuucuguauuuucuucuggaagcuuauggggcuuuuucuuuaucugaacuuucacaagaauaugcuuugauauggguc

SEQ ID NO: 4130234 - RNA, 58 nt, Human
gauuuucagaucuugcaguccccuccauggcagcugucacacaugggaucucagaguc

SEQ ID NO: 4130235 - RNA, 76 nt, Human
gauuuugaaggcaacggaaugauuugcaguuagggauaggacagaccucuuaacuguaucauacuguuucaauauc

SEQ ID NO: 4130236 - RNA, 77 nt, Human
gauuuugggucuauaccacccauccagagccagguguauuacaugagcuggaagucuguggucagaguccuaagauc

SEQ ID NO: 4130237 - RNA, 68 nt, Human
gauuuugucaugauccuucuguuaggugcaucucuuauuccagcccuaacagauugggugacaauauc

SEQ ID NO: 4130238 - RNA, 87 nt, Human
gauuuuuaggauauaauccauucagaaauugggaauuguguguccacuagcauguuauuccuauugagugauuucauuuaaagaguc

SEQ ID NO: 4130239 - RNA, 55 nt, Human
gauuuuuccacaauaaacauaggaugaggucuguguauagaaaguaggaaagguc

SEQ ID NO: 4130240 - RNA, 58 nt, Human
gauuuuucuacucuccuuaucucuuuagggagauaggacaggagaaguagcagaaauu

SEQ ID NO: 4130241 - RNA, 105 nt, Human
gcaaaacaaaaauaaaauuccacuggcucuccacuauggaugagaaguugcacaaaggccuagcuguuucguugguggagagcuacauggcugcccaaguuuugc

SEQ ID NO: 4130242 - RNA, 74 nt, Human
gcaaaacaaacacacagcaacaagaauagccaaagaaaccauuuggcuugcuucuucugcugucgucuucuugc

SEQ ID NO: 4130243 - RNA, 79 nt, Human
gcaaaagaagauucaguuaagcacuauacccuaaggcauccauugcauuguauguagugacuuaauuucucucuuaugu

SEQ ID NO: 4130244 - RNA, 77 nt, Human
gcaaaagagugcuuaaauugugugauccagugcuuaaagugggacagagcauuuaauuacaguuuaauuaucuuugc

SEQ ID NO: 4130245 - RNA, 83 nt, Human
gcaaaagucugaucuugaguugucaaagucuacaucuguuaacagagcuaggaaugaccacucucccuuggacagacucaugc

SEQ ID NO: 4130246 - RNA, 125 nt, Human
gcaaaaguuauuuuuggaaauaaaaauccuauauaggcugcuucuaccaaaauguaugaaagacacauccuuuauccauugguuagaaaaucaggcuuaguaugauuucucuuuuuaauuuuugc

SEQ ID NO: 4130247 - RNA, 83 nt, Human
gcaaaauaggcauggaugcagaaagagaauguaauguuauaggcagacauacuucuuuuuguaccuuuucauuugccuuuugu

SEQ ID NO: 4130248 - RNA, 95 nt, Human
gcaaaauccaggccaggaugcacuaggaaccagggucagaagugagugagaggcucagcccccugagucgccuguugaauuugccaugguguugc

SEQ ID NO: 4130249 - RNA, 62 nt, Human
gcaaaaugcaggaguucgaggcuguaugagcuaugaucaugccucugcacuccagcaugggu

SEQ ID NO: 4130250 - RNA, 82 nt, Human
gcaaaauguuagguggcacucauuaucaggugcugacaugcacuugcguggccuugagagugagugccaccuuaaguuuugu

SEQ ID NO: 4130251 - RNA, 74 nt, Human
gcagagcugucuaagucacuuccuuuuacaccuucagucucccaucugcaaaagugcucaguggacagcauugc

SEQ ID NO: 4130252 - RNA, 67 nt, Human
gcagagcuucagggaauaagaaugugcuuuucugcaagacccauuuccaccccugaaugcuccaugc

SEQ ID NO: 4130253 - RNA, 59 nt, Human
gcagagcuucuguccuucaggaguccaugaugugggaggaaggagaaagcaagugcugc

SEQ ID NO: 4130254 - RNA, 60 nt, Human
gcagaggacacaggagggcaaguugagcucccucaucccuaaauccuucagugccucugc

SEQ ID NO: 4130255 - RNA, 62 nt, Human
gcagaggauuauggagauggucucagcaacaagacugccuggauuuccauccuaguuccugc

SEQ ID NO: 4130256 - RNA, 60 nt, Human
gcagaggccaggccaccagcaagggccaaacugacacccuccuggaaaccucuucucugc

SEQ ID NO: 4130257 - RNA, 74 nt, Human
gcagaggcuggagguccuuggggucuacugggagguggcagucacaggcccuuggguccucuccacagccuugc

SEQ ID NO: 4130258 - RNA, 59 nt, Human
gcagaggggccauuguucugcccgcuccccaaaggaccgucagccgaguggccacucgc

SEQ ID NO: 4130259 - RNA, 57 nt, Human
gcagagggucagguagugaagucgaggaaacuaaaccagcugcccugaacuuugugc

SEQ ID NO: 4130260 - RNA, 84 nt, Human
gcagagggugacaguuuccauuuucauaguacaagguucuccuaaaagacucugggagaggacaaacaaaauguuacucucugu

SEQ ID NO: 4130261 - RNA, 111 nt, Human
gcagagguagcaauugguuagauggugagucaggaggccauacaggccucaccucucagagggcugcagcuuggccucugcaauggauucaccugauaaguuugccuuugu

SEQ ID NO: 4130262 - RNA, 95 nt, Human
gauaauugugaaaggugggugacaggcacaugggagcucaucaugcuuuugaauuugugugaaauuaaauguguuugcaaaauuuuuuacaaguc

SEQ ID NO: 4130263 - RNA, 73 nt, Human
gauaauuuggggcaaggaaaccagcagggauaucacccagaugagcaagcuggugaccuugccccaggucauc

SEQ ID NO: 4130264 - RNA, 75 nt, Human
gauacaaaagaggcaguggugaugaaugguuguuagugacccaauauccauacacacccuuugucuguuauuauc

SEQ ID NO: 4130265 - RNA, 67 nt, Human
gauacacagggcuaagauggauuuuaaaucauuuuaauuuucuauuauuuuggccacuguagucauc

SEQ ID NO: 4130266 - RNA, 79 nt, Human
gauacauacacccuucauuguuggguuacaugaggugauaccuuaacaagugauauauaauggaaggaaaaaguguguc

SEQ ID NO: 4130267 - RNA, 56 nt, Human
gauacauuccgggagggcuaccugguugaggugacaugagcccagcggagugaauc

SEQ ID NO: 4130268 - RNA, 109 nt, Human
gauacauuuauguuguauuuucauuucagcuugcuuagucuccuucucauucaggucugagagugacuugcugguugaauucaaugaaguuacuuaauauaucuguguu

SEQ ID NO: 4130269 - RNA, 63 nt, Human
gauacauuuuaucuccuaacaggcucaaauucaaugaacuacgaggagaauuagaaugauauu

SEQ ID NO: 4130270 - RNA, 81 nt, Human
gauacccauggagguggaagaaugaguuagaagacaaaaauaugcauauacucuaacucagaaaauucauuucuggguauu

SEQ ID NO: 4130271 - RNA, 78 nt, Human
gauaccuaucuuuagaggaagagaaucuucaaggcuauucgauuuacuucagagauuucucccucuaacagauguguc

SEQ ID NO: 4130272 - RNA, 87 nt, Human
gauaccugaauaauccaugucuagaguaaagcuaugucaaguaaaaaggaugacucuuuuuauuaaggaugugggacuucagguauu

SEQ ID NO: 4130273 - RNA, 123 nt, Human
gauacggcacaaguuuuggagauguaaucgccugaaagcauccaacuuugauuagagagucugagcucucauaguaacacagauugguagugcuucucaauucauuuucugaaacuguuuauc

SEQ ID NO: 4130274 - RNA, 70 nt, Human
gauacguuugcaugucucaguacacuccgauguugagguauucugaacaucaguauuaggcauguguauc

SEQ ID NO: 4130275 - RNA, 86 nt, Human
gauacuauaaaugacuggcaucucaaacaggcagauuuaaaagcaggggagucuggcuuuuugaugagcuuuauuuuaucaguauu

SEQ ID NO: 4130276 - RNA, 96 nt, Human
gauacuccagugccuuugcaaugggaaacaaacagcauuuaaagguguagggaagaaaauuuaaaucacuguucauuccacacaggcaaugagauc

SEQ ID NO: 4130277 - RNA, 56 nt, Human
gauacuguaggugaaaguguuuuuaaaaacugugaagggccauaacuugcaguguu

SEQ ID NO: 4130278 - RNA, 89 nt, Human
gauacuuucucuccuuagaagaaaguuacuuuuucgggccauuuuccuaaaaugugaaacuaucuucaaggcaagccagaguaauuguc

SEQ ID NO: 4130279 - RNA, 77 nt, Human
gauagaauuaacacaaggugugcuuugagcuucuggcuaugcccaguauuuuuaagcugcuuuguaacauuuuuuuc

SEQ ID NO: 4130280 - RNA, 90 nt, Human
gauagcccuggguagugcuaguuaaugcuaauuaacaaaugcuaguuaguauuguuaaacugaagcauuacuaaauaccaagauauuauc

SEQ ID NO: 4130281 - RNA, 65 nt, Human
gauagcugcuacugagauuguccuuaguaccuaucccacuggacucugacuuaguuauagcuauu

SEQ ID NO: 4130282 - RNA, 65 nt, Human
gauaggacacacuucugaggucuuucaugucaaaguaucuaacaugagacccugugugccuuguc

SEQ ID NO: 4130283 - RNA, 70 nt, Human
gauaggagaagucaccuugugguuuauaguuuaauaugcucagugaacucuaauggugcuuuucucuuuc

SEQ ID NO: 4130284 - RNA, 76 nt, Human
gauaggcaguaacagagguagaauucaaggucaggcucugccccugagcuuguuugcauuuuguuugguguuuguu

SEQ ID NO: 4130285 - RNA, 77 nt, Human
gauaggcugagccuugaugucccuuguccuggaggcuccuccaugcugaacaagcagcaucaagagccugcccuguc

SEQ ID NO: 4130286 - RNA, 81 nt, Human
gauaggggaugccucauccucagggggccaacccagccucuuccuagagccaggguccggcuucuggggagcaucuccuuc

SEQ ID NO: 4130287 - RNA, 75 nt, Human
gauaggugcccugucuuccugcuuaugacucugaaacccuguuuauuuguaucaaggacgguugguacuuuaauc

SEQ ID NO: 4130288 - RNA, 66 nt, Human
gauaguaacucuacacacgacacuagcaggccacaaugaaguacugaaguguuugggaguacuguu

SEQ ID NO: 4130289 - RNA, 55 nt, Human
gauagugcaaggcuuuucagaagaagcugauauuuucugagaagcaaacaauguu

SEQ ID NO: 4130290 - RNA, 63 nt, Human
gauaguggcacagccaagccucacucguuuugacuaaugagagccucaaagcuuugcuauuuc

SEQ ID NO: 4130291 - RNA, 72 nt, Human
gauaguguuaccauuccugggaccugcaccccaucugagggcaaacaggaccuggaaugcuugugaaauauu

SEQ ID NO: 4130292 - RNA, 107 nt, Human
gauaguuauuugcauuauggucaguacuucaccugucaaguucuuagcgaauaugucuuaauauacagugaaaaguagcuaacacaacagugcuuauuuaaacuauc

SEQ ID NO: 4130293 - RNA, 64 nt, Human
gauaguugccugggauuuggaaugcaccucuaccaucagugggauacagauccaggcagcuauu

SEQ ID NO: 4130294 - RNA, 80 nt, Human
gauaguuuggcaauuuguagaguaaauuagauuuaauuuggccugaaugccacugauuucucauauuguucaaaacaauc

SEQ ID NO: 4130295 - RNA, 82 nt, Human
gauauacuauuuaacugugcauauauuuuagaguuugguuuuaaaugacuagaauauuuguaugcacauggauaaguauguu

SEQ ID NO: 4130296 - RNA, 83 nt, Human
gauauauuuugguugcuagaguugcacuggacuuacagaaaaucaaagucacaaauccccucagcaacugccuaaaaaauguc

SEQ ID NO: 4130297 - RNA, 83 nt, Human
gauauauuuuuggaagggaaccaaaacaugggaauccuagagcauuuuggguggauauuugguucuucuucuguguauauguc

SEQ ID NO: 4130298 - RNA, 71 nt, Human
gauaucauaguagacugacuggucuuucccuccgagggacaacgugaucaguuaguuacugcuaagaucuc

SEQ ID NO: 4130299 - RNA, 80 nt, Human
gauaucgcuaacacuuguacuuacagaugaccuggacugauucuauggcaguauuucaguacagaguuuuugcugauguc

SEQ ID NO: 4130300 - RNA, 84 nt, Human
gauaugaaagggaauugagaagaagcgggaaaaggagcaugagaaauauucccuggguuuaugaauugcauucccuuuauuguu

SEQ ID NO: 4130301 - RNA, 59 nt, Human
gauaugacucauguugacccauuggggucaauauucucagggacaugaugugucauauc

SEQ ID NO: 4130302 - RNA, 101 nt, Human
gauaugcugaccccuguuucuuucugugcucugacuuucuccuggugccacccauuggccaaaccagaagcuggagcacaaggaggcugguugaguagcuc

SEQ ID NO: 4130303 - RNA, 74 nt, Human
gauauggaaagauaagcaggcuaugggcaugaggauuaugaggagcucugucuaaacuuguuuuaucucauauu

SEQ ID NO: 4130304 - RNA, 91 nt, Human
gauauggugucuguguguuuauuuuuaacgcuaugaccuuguuucaagaaagauuugaaggcagcuuuaaaaaagaugcauguacuauauc

SEQ ID NO: 4130305 - RNA, 64 nt, Human
gauauguaaucuaaggagccugcaucucauuguggcuuuacugucauucuuaugguuauauauc

SEQ ID NO: 4130306 - RNA, 76 nt, Human
gauaugugcucacaguaugaggacuagaacaagaaggcaguguaguuugguucagucucagcuggaaacauguguc

SEQ ID NO: 4130307 - RNA, 130 nt, Human
gauauguggcaguucuuaaucauaauagcuuagguuauaaccuccagcagguguuuaaaagaauuuucuuucugcuuaaauagcuggaggcuacaaucuaagguguuauuauuaagaacugccacauauc

SEQ ID NO: 4130308 - RNA, 77 nt, Human
gauauuaaaucuagaguucccagcauaaauaagauacguguucuauuucauggcuguggaacaucagauaaauuguc

SEQ ID NO: 4130309 - RNA, 60 nt, Human
gauauuagucuguaaauugaugcuugagacauacuuccuagcucacucuagacugguauc

SEQ ID NO: 4130310 - RNA, 73 nt, Human
gauauucgaugauuguuuccuauguacaccugguccuagauuagguauaugaagaugaaauaacacaaauauu

SEQ ID NO: 4130311 - RNA, 98 nt, Human
gauauucuaugccuugugcuucagaacaggcagucgaaagggaggaaaguugguuuuccuugagaugacugucuuguucccucauugguuugggauuc

SEQ ID NO: 4130312 - RNA, 71 nt, Human
gauauucuuugaugcuucugaaggugugagauuguuauuucacauaccaccauaaagucaaauaaaauguc

SEQ ID NO: 4130313 - RNA, 98 nt, Human
gauauugaugcugcugguccaggaaacccucuuugaguagcaaauggcuggaacaucucuccaggagggcuuccugugaugauggaaugcucuguauc

SEQ ID NO: 4130314 - RNA, 56 nt, Human
gauauuggauuaguuuccuaggguuccuaaaaucaggcccacucuaauccacuguc

SEQ ID NO: 4130315 - RNA, 72 nt, Human
gauauuggguaaaggauuaaucagguuuacuuccacuuuaaugaaaguggcugaauauauuuuacuaauguc

SEQ ID NO: 4130316 - RNA, 108 nt, Human
gauauuggucuguuuuauacuugcaucuaagguggauaacuuccagccauucuccccuaaggggagaaguuauccaccuuagaugcaaguauaaaacaaaccaguauc

SEQ ID NO: 4130317 - RNA, 80 nt, Human
gauauuguguaagguuaaacuuauuugugcccucaaauguuagacauuuuauggagcaccaaaguaacuagcacaaaguc

SEQ ID NO: 4130318 - RNA, 77 nt, Human
gauauuuaauucuccucuaaaaugucucaacaauuggucacccagguucuguuggcauuagaggguuauuguuuguc

SEQ ID NO: 4130319 - RNA, 93 nt, Human
gauauuuauccagccuggauuuggaaacaugagugauaaaauuaccuugugagauaaggcacuccugauuucaaauuaauguugaggcauauc

SEQ ID NO: 4130320 - RNA, 67 nt, Human
gauauuugcauuugcauaugaagaaguaaggggaaaaaccccuuaagucucugaaagugcauguauu

SEQ ID NO: 4130321 - RNA, 63 nt, Human
gauauuugcucgcacucucauugaucaaagacaaauaagugaagaaagaggcuggcagauguc

SEQ ID NO: 4130322 - RNA, 97 nt, Human
gauauuuuucucagguuuacaguauuucucagugaaaugacaggccuauuguguagcucaguuuaacaugcagaaauacagaacuagauaaaaauuc

SEQ ID NO: 4130323 - RNA, 64 nt, Human
gaucaaaccuuucauuaaagucuguaguucuucaugggaacucuaaggccucugagaguugauu

SEQ ID NO: 4130324 - RNA, 77 nt, Human
gagguugucucccaacagugcugucccucaaagaaaagacugguuauguggaaacagcacguuuggagagauuauuc

SEQ ID NO: 4130325 - RNA, 75 nt, Human
gagguugugucagagcgcucauuuucuacugcugcguaaaaaauugccacaaauguaguagcuuaaaacaacuuc

SEQ ID NO: 4130326 - RNA, 86 nt, Human
gagguuuaagaaguacaguaaagcugcuaugaauucccagcuaugggaauuuuccucaaagcuucauugucuaaacucugaaccuc

SEQ ID NO: 4130327 - RNA, 80 nt, Human
gagguuuagacaggauguucaagggaccuaugacuucauguccgugugucccucuggacauauaaucugccugugaccuc

SEQ ID NO: 4130328 - RNA, 78 nt, Human
gagguuuagaguaggaaaugcaguuuccuaaauuugaaauauaccaggccuaauuagcauugcuacucucaagaccuu

SEQ ID NO: 4130329 - RNA, 67 nt, Human
gagguuucucuagggcugaccaguucugauuuuccaucagacacuguaaaacugcuuuggaaacuuc

SEQ ID NO: 4130330 - RNA, 78 nt, Human
gagguuuggagucagcucuggcuuuggggagcuuccaggcugaggaggcucagcaggcagcagcucccucccacccuc

SEQ ID NO: 4130331 - RNA, 82 nt, Human
gaguaaaaggaucugggcugcaguccagucugagagaugccagcaaaggcuuccuaggcuaauucaguccaguaaaucccuc

SEQ ID NO: 4130332 - RNA, 75 nt, Human
gaguaacuagggagcagcccugccacuccucaugcgaugcaccaggagccagggaagcugcuuccuaggggauuc

SEQ ID NO: 4130333 - RNA, 75 nt, Human
gaguaagaugcuggaguucauauuggacauaagcaguggacauuguuuuccuucugauacuccauuuaucugauc

SEQ ID NO: 4130334 - RNA, 61 nt, Human
gaguaaggcugcugauggagugucuggauucucaucuccuuuucacuucgcugucuuucuc

SEQ ID NO: 4130335 - RNA, 79 nt, Human
gaguaaugcgagaguggaaaggaagccuuucuaaagugagagaaacuguaaucuagguuucuuuugcaccuugcagcuc

SEQ ID NO: 4130336 - RNA, 87 nt, Human
gaguaauggagggcuaaggggggauacaaaauggagagugccuuucugggucauucaaacuguaucacuugguaucuuccacugcuc

SEQ ID NO: 4130337 - RNA, 61 nt, Human
gaguaauuagagcaaugacuuuuagagacuucauuucagaaaaguucaugcuuuaauauuc

SEQ ID NO: 4130338 - RNA, 68 nt, Human
gaguaauuuccauuuuaucagaccagcuggggcuuguuuuugagucugugaaaagauaggaagugcuc

SEQ ID NO: 4130339 - RNA, 77 nt, Human
gaguacaaccaauuucuuguuaauucucaggccugucucggggccugagaauuaguaagaaauuuaucuugauccuc

SEQ ID NO: 4130340 - RNA, 75 nt, Human
gaguacacuuucauugauauaguuuuaaaaugcuguagcagcauuuuagugccugauuaauggguuuauuuacuc

SEQ ID NO: 4130341 - RNA, 57 nt, Human
gaguaccauucacaugugcaggcaguacuagggggcuugcauuuguuauuuguacuc

SEQ ID NO: 4130342 - RNA, 66 nt, Human
gaguagaacuagaacaaggauuugauuuugccuuaaaucaaaaagccucucuuuugguuuugccuc

SEQ ID NO: 4130343 - RNA, 62 nt, Human
gaguagaaggaaguuaucuacccaaccuagagggcauaaagaugauuuccuuggagcuacuc

SEQ ID NO: 4130344 - RNA, 124 nt, Human
gaguagcagacacacuugacaaagucaaaaugcucuccugucagugcccauaugaacuauuacaaugacagaagagcauuuuaauuuuguccaguucuucuuucuccuuuucacucugcauuuc

SEQ ID NO: 4130345 - RNA, 55 nt, Human
gaguagcaguggagccagcgcugaacccaacugccuggcuccaaagcugugacuc

SEQ ID NO: 4130346 - RNA, 55 nt, Human
gaguagcccacggacaccucgacugcaggcugagagaggguccagggagcggcuc

SEQ ID NO: 4130347 - RNA, 90 nt, Human
gaguagcuacagccauguuuuauguaaauauaaauugaauuccugcagcaggcaggucacuguauuugcugaugcauaaugagggugcuc

SEQ ID NO: 4130348 - RNA, 94 nt, Human
gaguaggaaggugucgccagggcucucuuggacaacugcugaucaugguuacucaguaugugugagagaaccaaacucuugccuuccgggacuc

SEQ ID NO: 4130349 - RNA, 92 nt, Human
gaguagggaauuacugacagucuuucaguaauaauacugucugguacaguguagguuaucugaaaggcuacggaucuucagggucucuucuc

SEQ ID NO: 4130350 - RNA, 56 nt, Human
gaguauaaugauuuucauucacaaaggcaaucuaugugggugaaauccauuaucuu

SEQ ID NO: 4130351 - RNA, 58 nt, Human
gaguauacacauaucuucuaggccuguaaaugcuagagcccucugauauguuaaacuc

SEQ ID NO: 4130352 - RNA, 62 nt, Human
gaguauaccugucuguaucgguucagaguucauggcgaaccugucaagugaagacacuacuc

SEQ ID NO: 4130353 - RNA, 72 nt, Human
gaguaucugguuccagaguauuucauuucaguuuuaaaaggacuuuacgaaugucuuucuggaauacuauuc

SEQ ID NO: 4130354 - RNA, 88 nt, Human
gaguaugcauauuaaguuuaagcuauacauuguuagaguugucuaacaacucugcuaaauguaaguugguaaauguaaguaaauacuu

SEQ ID NO: 4130355 - RNA, 61 nt, Human
gcagcuggagccagccagacaccggccaagagguggucuuggcuacaaguccagugccugc

SEQ ID NO: 4130356 - RNA, 66 nt, Human
gcagcugggacaugauagaaacagauucugcacuuaagaauucuacuuuuagaauguccaugaugc

SEQ ID NO: 4130357 - RNA, 111 nt, Human
gcagcugguggggauguuguuagcauuugggggguguuuucugaggaggaacagacugugucccuggcaaaacacucucuugagggccagcagacagaaacuuccaucugc

SEQ ID NO: 4130358 - RNA, 56 nt, Human
gcagcuguaaagcagaaauaguaauaacuauuucacagcuuuauuagcaaaagugc

SEQ ID NO: 4130359 - RNA, 57 nt, Human
gcagcuguagacugggcuggauucuuuuggagguuuccuaggcccagccugagcugu

SEQ ID NO: 4130360 - RNA, 75 nt, Human
gcagcugugggccucggagagcgcauuguacacacagauguuggguuucagcucuccggcucucgccagcuccgc

SEQ ID NO: 4130361 - RNA, 55 nt, Human
gcagcuuuaaucugaauaaguacugccaaagugcucuucagcaagauuaagcugc

SEQ ID NO: 4130362 - RNA, 85 nt, Human
gcagcuuuccuuccacagcaggaccauugaggcaucauccugaaaaacaugaaggaugugaagcagucauugcugaaggacaugc

SEQ ID NO: 4130363 - RNA, 58 nt, Human
gcagcuuucuugcccuaaucuuaucaccugccauuaaagaucagaauaugaaagcugu

SEQ ID NO: 4130364 - RNA, 57 nt, Human
gcagcuuuguggagaggcccauauagagagaaacugaggccuccugacaacagcugc

SEQ ID NO: 4130365 - RNA, 75 nt, Human
gcaggaaaaccugaucaguuccaacugggcaggauggacauuccguuugggguucagagugggaaugaucacugc

SEQ ID NO: 4130366 - RNA, 91 nt, Human
gcaggaaagccaggcccugaggagauuguggcuggggagugacggacaccaaagaccagcagcuucucaaaucaaccuagggcuaccuugu

SEQ ID NO: 4130367 - RNA, 74 nt, Human
gcaggaaaggcugacuucaugaacauguggccuguguagccacagagggccccaaguucagaaaggccucgugc

SEQ ID NO: 4130368 - RNA, 63 nt, Human
gcaggaaaguuuuaauucuuaaugcacaaaaauucccuaggagcccaagaagagcuuucuugc

SEQ ID NO: 4130369 - RNA, 79 nt, Human
gcaggaaauggccuucauaaccauucuccaauuuugcuggaggaucagggugguggaagucauuuuaaaaaccagcugc

SEQ ID NO: 4130370 - RNA, 79 nt, Human
gcaggaaggcagccuuuugaguugauucuuuaaaaaugggaagaauuuccuuuuuaaaaagacaaauugcccagucugc

SEQ ID NO: 4130371 - RNA, 73 nt, Human
gcaggacagacccaagcagucugguuucauagcacagcuuccuaaccaccgcacuguuuugcguuuugucugu

SEQ ID NO: 4130372 - RNA, 63 nt, Human
gcaggacaggcguugguccagucguuccuuuccuugcguugguccagucguuccuuuccuugc

SEQ ID NO: 4130373 - RNA, 76 nt, Human
gcaggacccauuccuucuggaggcuccaggggagaagccauuuccuugcccuuuacagccucuagagggugccugc

SEQ ID NO: 4130374 - RNA, 76 nt, Human
gcaggacugcuccacuaguaauucuugugcuggacuccccuguguccugcccaagacuuucuuagugcugcccugc

SEQ ID NO: 4130375 - RNA, 79 nt, Human
gcaggagaaggugcuuccaggagacaaggugugcaaggcuuaauguugcuuaccuguuuaccugcaccuguuuaccugc

SEQ ID NO: 4130376 - RNA, 71 nt, Human
gcaggagagggggcuccugcaggcccccagcccgccaugggguggugcagacaggagccccgcucugcugc

SEQ ID NO: 4130377 - RNA, 61 nt, Human
gcaggagccuggcuggcccacaggcuggcaguggacuggucuggccacccgaggccccugc

SEQ ID NO: 4130378 - RNA, 84 nt, Human
gcaggaggaaaauugcuagacuauacuguaauaccaaucuuacuaagauaaauuuagugucagccugguaaaauaucauucugc

SEQ ID NO: 4130379 - RNA, 55 nt, Human
gcaggagggggccuggagcccagucccacaucugggccucuccacccuuuucugu

SEQ ID NO: 4130380 - RNA, 63 nt, Human
gcaggagguugauucucugaggacccagcaugugggaggacccagagcacagccuccagaugc

SEQ ID NO: 4130381 - RNA, 60 nt, Human
gcaggaguuaggcgucguggaugucagauuuguauuccaaagcaguggcuaacucacugu

SEQ ID NO: 4130382 - RNA, 124 nt, Human
gcaggaucaaccaggagugagcagggagcacugcagagaaggggcccuccggacaugccccaacuggggagugcuggcaccccucuccaguucgcaucuacugccuuucaaaacuggcuccugu

SEQ ID NO: 4130383 - RNA, 58 nt, Human
gcaggaugggagcuucacucugucucaguugcucuggcaaagagaagccucaccuugu

SEQ ID NO: 4130384 - RNA, 55 nt, Human
gcaggauggguguagcccagcaggguggccgccugguguuaccuccuuccuuugc

SEQ ID NO: 4130385 - RNA, 86 nt, Human
gcaggauugauuaccuuuagagcugaguugacuccauuuuauuuaucauuugagaugugucuuuaguugcugaagggacugccugc

SEQ ID NO: 4130386 - RNA, 65 nt, Human
gcaggauuucauacaucuuuacugaauugaaauauuuauucauaagguguagugauaucuguugc

SEQ ID NO: 4130387 - RNA, 55 nt, Human
gcaggauuuuuuacuacaguguuuugaaaacugauguguaaaguugaaauccugu

SEQ ID NO: 4130388 - RNA, 82 nt, Human
gcaggcaacacugggcugugaguuuguccuccaugagauucuauuccauccagggcagccauggccugguggauuguuuagc

SEQ ID NO: 4130389 - RNA, 62 nt, Human
gcaggcagaaaaaugugaaaagagagacuggccuagucucccagccuacaucuuucuucugu

SEQ ID NO: 4130390 - RNA, 65 nt, Human
gcaggcagaugcugacaagaguuugagaaacauugccaucaccaacucacacaaguauugccugc

SEQ ID NO: 4130391 - RNA, 105 nt, Human
gcaggcagcaccacugccuguucucuuuucagugcugucuuguggccuuugcucccacagagucauucacugaugaaguaaauagcagcagugguguuuuucugc

SEQ ID NO: 4130392 - RNA, 88 nt, Human
gcaggcaggaagaaaaugugucccuuauuucacaggugacgaaaaugcauugucaggagccuugcuagggucacacaucucugccugu

SEQ ID NO: 4130393 - RNA, 79 nt, Human
gcaggcaggguguccccaucugcccaagucugucugaguccugggguuuuaugggcuucagaggggagguagugccugc

SEQ ID NO: 4130394 - RNA, 68 nt, Human
gcaggcccuuggaagguagcuggcaguagcugcaauugguuaagcaacugccacguuccaggcuuagc

SEQ ID NO: 4130395 - RNA, 55 nt, Human
gcaggccgggguccacgcagcauccagcuuugucugcagcuggguucugguuugc

SEQ ID NO: 4130396 - RNA, 63 nt, Human
gcaggcgcucugccuuugucuuacacggcugaaacaucuguugcagaggggcggagaggccgc

SEQ ID NO: 4130397 - RNA, 56 nt, Human
gcaggcggagguugcagugagcccagauggugccacugcacugcacuccagccugc

SEQ ID NO: 4130398 - RNA, 104 nt, Human
gcaggcucaguguccuggcccccaggucugaggcaaacagaggagugugcucucuacacuuuucuucugccucagaaucuuaagucagcauccccaaggccugc

SEQ ID NO: 4130399 - RNA, 64 nt, Human
gcaggcuccaaggccugggagagccuccaagccagggucuccaagccaggccucuggggccugu

SEQ ID NO: 4130400 - RNA, 65 nt, Human
gcagacaauccagacuagcacugucaaauagaacuuucugagugauggaaaugaucugggucugu

SEQ ID NO: 4130401 - RNA, 56 nt, Human
gcagacagacugcagugauuuuagggaaagauugacuggaaucagugacugacugc

SEQ ID NO: 4130402 - RNA, 57 nt, Human
gcagacauuuugaaucuaggcuacagagguuaguguucuggggacagcaauggcugu

SEQ ID NO: 4130403 - RNA, 67 nt, Human
gcagaccaggauagugguuucuaagcaugagcucugcagucagcuuggcuucacauucuguaucugc

SEQ ID NO: 4130404 - RNA, 62 nt, Human
gcagaccucaggacaucauuagccaacuccacggggagcuaaaauggcccguccgagucugc

SEQ ID NO: 4130405 - RNA, 55 nt, Human
gcagaccuccuguuucugggcugggucuucauuccugggaaaaggagugucuagc

SEQ ID NO: 4130406 - RNA, 92 nt, Human
gcagaccuugugcugggugggaguugggcugcagaaacagugagggguuuucugugcugcagggucagcacccuccuaggcaccagcccugc

SEQ ID NO: 4130407 - RNA, 55 nt, Human
gcagacgaacauuuagccaguaauuugggaguggccguguuagauguuuggcugu

SEQ ID NO: 4130408 - RNA, 76 nt, Human
gcagacuaagaagugccuugcaggugugauggcuaccuuuuguuauuauggauggaggcauuagucuuuucucugu

SEQ ID NO: 4130409 - RNA, 70 nt, Human
gcagacugagauucuccuuucagaacaguucacaaauacaacugggcugagggagggacuuugagacugu

SEQ ID NO: 4130410 - RNA, 83 nt, Human
gcagacugcagucaagcucaccaguucuggaaaguacaggaggcuuccugaagcuggggcugggaauggcuaaguaugucugc

SEQ ID NO: 4130411 - RNA, 72 nt, Human
gcagacugcugauguuuuuuaaaggaauuuaaugauacaguuucauucccaagaguaaacauaucagucugc

SEQ ID NO: 4130412 - RNA, 89 nt, Human
gcagacuggaauuggcugcaggccaccaaguugcagguucugacagcuccacugucacugggaggcaucuggagcugauuccaagcugc

SEQ ID NO: 4130413 - RNA, 86 nt, Human
gcagacuuaucuauccaauguuccaggguaaauguucuauuauuaacauuccugaggaaauacauucauggauauauauguuuagc

SEQ ID NO: 4130414 - RNA, 76 nt, Human
gcagagaacauaauuaucauaaacugagaauuuuucauuuugaagcuuaucuguuugugcuaaguaucuugucugu

SEQ ID NO: 4130415 - RNA, 76 nt, Human
gcagagaagaugggugccuguucccagaauacacucccaaguucuucaaugggcacagagucccaucugccucugc

SEQ ID NO: 4130416 - RNA, 68 nt, Human
gcagagaccaugauucacccaccacuguaucuucgggaccuacaguagugcucaaucaguguuuuugu

SEQ ID NO: 4130417 - RNA, 60 nt, Human
gcagagagucucgaaggugaugaccuccaaggccuccaucaucccuaaggacagcucugc

SEQ ID NO: 4130418 - RNA, 119 nt, Human
gcagagaugauaggggagcagaaagccaggcaggacauuuuucuuccuacaaugccuuucauagcagguuguuugacaugagaagugucaugucagucauuguguuuacccaucucugu

SEQ ID NO: 4130419 - RNA, 73 nt, Human
gcagagaugugaagaaagcugugaaauggagaaaauggggaagcugaccauuuugcacacuaugcagcuuugc

SEQ ID NO: 4130420 - RNA, 62 nt, Human
gcagagcaaggauggccggggccguggcgccugccagcccgcagccacccuccuucuccugc

SEQ ID NO: 4130421 - RNA, 74 nt, Human
gaguauggcaauauauuaaaaauuauccuauccucuugaggaaggaugaacauuaauacaucagcagacgauuc

SEQ ID NO: 4130422 - RNA, 109 nt, Human
gaguauggucuagauuucccauugauugggagagugugugaaugaaugagugaauguccuuucucacaucauuaagacuucuccugguuaaagaauuuagguuauguuu

SEQ ID NO: 4130423 - RNA, 81 nt, Human
gaguaugugugcagcuauauuucuauguguaucuggaagagcguguacauguaugagauauguguaucugcaugauggcuu

SEQ ID NO: 4130424 - RNA, 65 nt, Human
gaguauuagaagcagccuaauuuuagagagauuauccauaauccuuuaugugaguuguuucccuc

SEQ ID NO: 4130425 - RNA, 66 nt, Human
gagucaagagugcccugcucugagcucugcucccggcagacgcacucacugcagggcaugaugguc

SEQ ID NO: 4130426 - RNA, 102 nt, Human
gagucaagucuuuucaugaauaaugcuuuuacgacauguaccuuggauucuaacgauaugcauuuugugaaaacgucuucagauuucagagaauuaaaauuc

SEQ ID NO: 4130427 - RNA, 91 nt, Human
gagucaauagcucagcacugucagcacuccggagaguuacaggcuauaauuagauggcauggagguguaaggcaugcuuggcaguugauuc

SEQ ID NO: 4130428 - RNA, 111 nt, Human
gagucaccucacccuugagggcagagaguucuccaccucucuuugacaugguauaaaagccccaacuucccugagagguggugaggacuugucuuuaaugugaacaggcuu

SEQ ID NO: 4130429 - RNA, 74 nt, Human
gagucacgguaaucuaggacucccaggcuuucaggaagcuuaagcccuggcccaaccuugauuuuacgugacuu

SEQ ID NO: 4130430 - RNA, 83 nt, Human
gagucacugaaagcucggguaggugccagcgucuguucccagacugcucacgcauuacuugagcaggacauggauggugacuu

SEQ ID NO: 4130431 - RNA, 74 nt, Human
gagucacuugcugcuucagugggcucucuggggugucccagcaggccacugcagcuggagccagcggugaccuc

SEQ ID NO: 4130432 - RNA, 60 nt, Human
gagucagaugaagauaaaaggguuauuccauuuuugggucucuucuucuucaucuucuuc

SEQ ID NO: 4130433 - RNA, 56 nt, Human
gagucaggaguccugugugagacauccgcaaacaucucauaagcagcuucugaauc

SEQ ID NO: 4130434 - RNA, 78 nt, Human
gagucaggcacugcugcugcucuccgaucugccugcccugcuuccaggcugaguuaugcggcaacaguggccugauuc

SEQ ID NO: 4130435 - RNA, 63 nt, Human
gagucagugcaugcacacacaugguauacguguguguacguguguucguguaagcacuguguc

SEQ ID NO: 4130436 - RNA, 58 nt, Human
gaguccagcccuguucuaguaaaauauuacuuacaaaagcaggcagugggcuggauuu

SEQ ID NO: 4130437 - RNA, 70 nt, Human
gaguccagcucccagaacugaccauguugggcccagcgcccucugcuggucacucugggagcugcuccuc

SEQ ID NO: 4130438 - RNA, 66 nt, Human
gagucccagauucuucugugugggcacuuuccugggauaugcuaaaugaugggaaaucugggucuc

SEQ ID NO: 4130439 - RNA, 62 nt, Human
gaguccuggcucuacgggcuucaaagaggggcuccccugaggaccugcuggacccaggacuc

SEQ ID NO: 4130440 - RNA, 76 nt, Human
gaguccuugacacauaguaggugauuaauacauuuuuguuaaauaaaucagugccugaacuugcuguuagggacuu

SEQ ID NO: 4130441 - RNA, 57 nt, Human
gaguccuugucauaauucagugagauacuuauguauagcauugaauauagacagcuc

SEQ ID NO: 4130442 - RNA, 59 nt, Human
gaguccuuuucucuguccacuguaacacacagcuaagucuuggcagaggacaaggacuu

SEQ ID NO: 4130443 - RNA, 80 nt, Human
gagucuaaacaucacaccuuucuuagauuucuggucaguugcuaaagccaugaagacuauuugaaggugccugcagacuu

SEQ ID NO: 4130444 - RNA, 66 nt, Human
gagucuacuagcuacucauucaaauucugaggauaggauuaggagggagaggcaaguaauaacauc

SEQ ID NO: 4130445 - RNA, 89 nt, Human
gagucuacugccaaucucacauagcuaggaguagccaagcccuuucauccugcagcugccuccugccuguguggaggccuuauugacuu

SEQ ID NO: 4130446 - RNA, 57 nt, Human
gagucuaucucacucccccagguccugagagugcacuggagggaaagggguggauuu

SEQ ID NO: 4130447 - RNA, 58 nt, Human
gagucuaugucuuggaacgcugaaaugcauuucuucagauauauucaggauaugacuc

SEQ ID NO: 4130448 - RNA, 62 nt, Human
gagucucacuugcaagcuguggccuugcagacugcaaagaugcuggcucaguuugcagacuc

SEQ ID NO: 4130449 - RNA, 87 nt, Human
gagucucaguuccagauauuguuuguuucaccaaugcaagacauucugaaaagugcaaaauaucuuaaaaguaggugcuguggaguc

SEQ ID NO: 4130450 - RNA, 98 nt, Human
gagucuccugccaugugugucuuuguguguguguauacauauacauguauauguguguauguauacacauagauacguacauacugguacugauacuc

SEQ ID NO: 4130451 - RNA, 89 nt, Human
gagucucgcucuguugccuaggcuggagugcagugacacgaucucaccugcucacugcaaccuccaccucccggguucaagcgauucuc

SEQ ID NO: 4130452 - RNA, 86 nt, Human
gagucucgcucuguugccuaggcuggagugcagugacgcuaucuugguucacugcaaccuccaccucccggguucaagcgauucuc

SEQ ID NO: 4130453 - RNA, 83 nt, Human
gagucucgcugucaccaggcuggaaugcaguggcccgaucuuggcucacugcaaccuccgccucccagguucaagugauucuc

SEQ ID NO: 4130454 - RNA, 82 nt, Human
gagucucuaacccagauucuagagcagaggccuccccaaagaaccaggaaugccuccucuugagggucagggaaugaaucuc

SEQ ID NO: 4130455 - RNA, 55 nt, Human
gagucugagaacugggcucaguccacgggaacaacagccacaaaucucaggccuc

SEQ ID NO: 4130456 - RNA, 77 nt, Human
gagucugauccuguuauaauuuggaugugaaauaaauaguuccuuuucauauauuuuaaaauugaaauaggaaauuc

SEQ ID NO: 4130457 - RNA, 60 nt, Human
gagucuggcccugaugcaucauauucuaucugguguuauuucucagucagguauagauuc

SEQ ID NO: 4130458 - RNA, 65 nt, Human
gagucugggacauuagcagggaugaggagaggguccuuuccuuccuuuuacugucuccggagcuc

SEQ ID NO: 4130459 - RNA, 59 nt, Human
gagucugggcugucugcaggagucuggaugccccuucccaggcucugcagcugaggcuu

SEQ ID NO: 4130460 - RNA, 66 nt, Human
gagucugggguccuuuuggcuuuacccgcacauaaucucuuggguggaucaaaaccucuucaacuc

SEQ ID NO: 4130461 - RNA, 63 nt, Human
gagucuguuggagccuaggaugacagcaaacugaaaggcugacagaucuuggcccaacaauuu

SEQ ID NO: 4130462 - RNA, 87 nt, Human
gagucuugcucuugucacccaggcuggagagcaguggcaugaucucagcucacugcaaccucugccucccggguucaagcuauucuc

SEQ ID NO: 4130463 - RNA, 87 nt, Human
gagucuuggagaagucuuaaccaaauaaauguuacuugaauuaggucuuaaaaaaugagucgacauuuguuaggauuuuuauggcuc

SEQ ID NO: 4130464 - RNA, 71 nt, Human
gagucuuggcucuuuccucacacaggaagaugccuuuuccauguggcaauaggagacagcuaccaguccuc

SEQ ID NO: 4130465 - RNA, 80 nt, Human
gagugaaaagaugaacgauuuguccugauuucauuguguccuagcuugugaccuuggacaaaucucauuauuucugacuc

SEQ ID NO: 4130466 - RNA, 83 nt, Human
gagugaaaauggcuuagcagaguuagaagaguaaaugggcccaauaucuuccuucuuuuaauuccgguugcugccaguaucuc

SEQ ID NO: 4130467 - RNA, 82 nt, Human
gagugacaugaucugacuugcuuuuuaaaggaccaguuugucuacuguggaugguagaaaguaaguauggaguggaagacuc

SEQ ID NO: 4130468 - RNA, 96 nt, Human
gagugacggcaggcaggaccguggguccaagguugaugucugaguggagccagccaggcaugugacccuggacucaggcccucaggcugaucucuc

SEQ ID NO: 4130469 - RNA, 56 nt, Human
gagugacuguaucauuuuacauucccagcagcaaugucugagugauccaguuucuc

SEQ ID NO: 4130470 - RNA, 86 nt, Human
gagugaggagaauggggcaggaaaugggauaagggcuggguaguccugagccagcaauccucuuuuuguuaauucuuuccuuucuc

SEQ ID NO: 4130471 - RNA, 59 nt, Human
gagugaggcagggaaagaggauaauuuuuggaggauuaucuguuuucugugcguuucuc

SEQ ID NO: 4130472 - RNA, 74 nt, Human
gagugaggcugguccucaagggcacagccagauucccacaagugaggcugguccucaagggcacagccagauuc

SEQ ID NO: 4130473 - RNA, 57 nt, Human
gagugagggaggggaagaggagucuagaguugcugggacuggaccucugccuggcuc

SEQ ID NO: 4130474 - RNA, 61 nt, Human
gagugagggcagcaggggcugcacugaaccuugaggcuuccccgagcagcuacccucgcuc

SEQ ID NO: 4130475 - RNA, 71 nt, Human
gagugauguuguuauaucaugccuacaaauaccucaucugggucuguagucucugauauaucugcucauuc

SEQ ID NO: 4130476 - RNA, 76 nt, Human
gcaguucuaaggcaaacaggaaagcaggcaccacuuuuuauaaaggccuucucagauuuguucccuuagugacugc

SEQ ID NO: 4130477 - RNA, 66 nt, Human
gcaguucugggugccagcauggcugaguucuggugaggacucuguaccuggcauguggaugauugc

SEQ ID NO: 4130478 - RNA, 77 nt, Human
gcaguugcccuggggaggugcuggagagaagccuggggcucccaccaggagccaguuccaccccaggauaaggcugu

SEQ ID NO: 4130479 - RNA, 103 nt, Human
gcaguugggagcuguggggucuccagguggcuucugcccgaugucgucugagaacacaacgagcuccuuccgccucggggcccucacacugccgcgccccugc

SEQ ID NO: 4130480 - RNA, 55 nt, Human
gcaguugguagaagguccagggagaccacuuggaauaucuuuuguccccugcugc

SEQ ID NO: 4130481 - RNA, 75 nt, Human
gcaguuuaaccauugcauauccauaggcauaaauuaaaauagccaagagaguauggguauuauugguaagaaugc

SEQ ID NO: 4130482 - RNA, 68 nt, Human
gcaguuuacacuaugaaaagacuaacuacacaggauuuuuguuuguuuguuuguaugugugaaugugu

SEQ ID NO: 4130483 - RNA, 61 nt, Human
gcaguuuguuuguggacaccuugagcuaaugagaagccagggaagaaacaugaagggcugu

SEQ ID NO: 4130484 - RNA, 69 nt, Human
gcaguuuuaaauacauaggaauuucuucagcacugauauaauugucacuucuuuuguguuuaggguugc

SEQ ID NO: 4130485 - RNA, 74 nt, Human
gcaguuuuaguggaucuggggcagggccugagugucucaguuucugaaauguuccgaggugaugcuaaugcugc

SEQ ID NO: 4130486 - RNA, 86 nt, Human
gauucacucucauucacucacuuagcaagcauucaagugccugcaaucugccaagcaagcaucuggcuagguggggaagguguguc

SEQ ID NO: 4130487 - RNA, 64 nt, Human
gauucagagguagaacuggcccucacuuguaguuugagaaagugacuuuuccugccucuguuuc

SEQ ID NO: 4130488 - RNA, 65 nt, Human
gauucagccauacuaucgucuccucacuucaccagagggaauauauaugcugauggcugccaguc

SEQ ID NO: 4130489 - RNA, 60 nt, Human
gauucaggaagaacucuuaggaaaauuucucucucuucccagcugagacuuccugaacuc

SEQ ID NO: 4130490 - RNA, 81 nt, Human
gauucaggccucauuacagagauauaaucuacauucauacauuuauguuagugauucaaaucuauugggagagauugaauu

SEQ ID NO: 4130491 - RNA, 62 nt, Human
gauucagugugaagcuucugaaagccguaauuuaagguuccagaagccuccauauuacuuuc

SEQ ID NO: 4130492 - RNA, 82 nt, Human
gauucauacaggcuuugcucuuaggggcaccaaauaagauccaauacccaauuaaaugagaguacagucugguugugacauc

SEQ ID NO: 4130493 - RNA, 66 nt, Human
gauuccagagaaaggccuggcugcuguugagagacccaggaguagcuaaggccuuauucuggguuc

SEQ ID NO: 4130494 - RNA, 58 nt, Human
gauuccagcuugguauuuacucuggcugggugacgaugaugccaagcuaucuagaauc

SEQ ID NO: 4130495 - RNA, 67 nt, Human
gauuccuccucuggagagacccuggaggcucaucauccacaaauucugggggugcuagggagggauc

SEQ ID NO: 4130496 - RNA, 72 nt, Human
gauucuacagcccuugacaguggcagaagcaucuuucaagacauugcuuugcucucacuguaaggucuaauc

SEQ ID NO: 4130497 - RNA, 89 nt, Human
gauucuacugcugcaaaacaaauuaacccaauacugaguugcuuugcuuaaagcagcaaguauuuguuacuuuguaguuuauuuggguc

SEQ ID NO: 4130498 - RNA, 69 nt, Human
gauucuagguucaugggauucaguguugaacaaucagacaaugccccuguccccaugcaaccuacauuc

SEQ ID NO: 4130499 - RNA, 80 nt, Human
gauucuauuuucaagaaagaguggcuauuccauuuuuauaaauuagauggaauauccacucuuucuugaaaauaagaguu

SEQ ID NO: 4130500 - RNA, 76 nt, Human
gauucucacagaagcacgaagccuauugugaacugcgcaugcgaaggaccuaggcugugugcuccuuaugagaauc

SEQ ID NO: 4130501 - RNA, 98 nt, Human
gauucuccagagauacauuaucuccaaaucaaucaauaugaaggcucacuuugucuuuaaugggauccaucugguuaaugcuguguuucuugaguuuc

SEQ ID NO: 4130502 - RNA, 57 nt, Human
gauucucucugcucuccauuccaguggaaacugcucccaggagcccagaggugaguu

SEQ ID NO: 4130503 - RNA, 91 nt, Human
gauucugacuauauuucccuugacucguuuauauauugguauuaagcccguucuggagcuguggucaacaggaaauuuuauucaguuuauc

SEQ ID NO: 4130504 - RNA, 60 nt, Human
gauucuggaugaccaccuguccaggguccucaagaccccuggcugccagucaccagacuc

SEQ ID NO: 4130505 - RNA, 117 nt, Human
gauucuguagaaaauguaugacugcaugaacuuuucugaagcccagucaaacccgagguuaggaguuccugaauugagcuuuagaaacaguaauaaauacauugucuugcauuuauc

SEQ ID NO: 4130506 - RNA, 74 nt, Human
gauucuuaugagugaacuuuaccuagaagcuuacugacaaaauguucguaagucaaaguuuauucaaaggaauu

SEQ ID NO: 4130507 - RNA, 82 nt, Human
gauugaaaucacagggcugguuugucgaagaaaauuguccuaaugauggguuuucggauggggaaugcagcucuuuucuuuc

SEQ ID NO: 4130508 - RNA, 129 nt, Human
gauugaaguccagggaggaaaaggagcuuuccugaggucacugaguugguggcagagucagagcuaaggccuggguccacugaucaugcuccaguguucuuuacagcuuucuucuuuccccuuucaauc

SEQ ID NO: 4130509 - RNA, 97 nt, Human
gauugacuccaauuuuaaagaaguucuacuguggguaaaauguuauaaaauagcaugacgugccacagagaaccuuuuaugaaaguaagagucaauc

SEQ ID NO: 4130510 - RNA, 82 nt, Human
gauugagaaaagacagcucccuaauuuguuaaugcugguuaaagcacuuucauuacuuguuaaggguagaagucagucuauc

SEQ ID NO: 4130511 - RNA, 75 nt, Human
gauugaggaaacauugagcucuggaguggaaaagguugcagacuuuuagacucccaagucguuguagucucaauc

SEQ ID NO: 4130512 - RNA, 71 nt, Human
gauugaguauaucuguuuuuugcuguugauucuagaaggauauagcaauucagaauacauguacuacaauu

SEQ ID NO: 4130513 - RNA, 79 nt, Human
gauugagucuccugaccacccucugcuccaggugaucucucuagacgggaagcugcagcacagagagguggauucaguc

SEQ ID NO: 4130514 - RNA, 64 nt, Human
gauugauacuaaaugccugauagauuagggagaacuuaaugaaacucaguuuuagucaucaguu

SEQ ID NO: 4130515 - RNA, 58 nt, Human
gauugauagcugcugggauauuuuuagagaauuuugaaaagauuccacaguuuucuuc

SEQ ID NO: 4130516 - RNA, 57 nt, Human
gauugcaaggcauauaguuccccaguuugaggugaggcugggcaccugucugcaguu

SEQ ID NO: 4130517 - RNA, 56 nt, Human
gauugcaucuucccuggagggcugcagaguuuuagggcacucacggaggaugaauc

SEQ ID NO: 4130518 - RNA, 66 nt, Human
gauugcucugauaagugguguauacuguuuaauaaauuuuuaagcaugcaacuugcaguaguauuc

SEQ ID NO: 4130519 - RNA, 75 nt, Human
gauugcugcaucucaggagacgggucuuuucaggagcacuggaugauuaggccaaguuacuugggaaagccaguc

SEQ ID NO: 4130520 - RNA, 64 nt, Human
gauuggaacaaauuaguugcaagacugggggaauucauucuugaucacuaguuagucccagauc

SEQ ID NO: 4130521 - RNA, 128 nt, Human
gauuggcauaaauuuucuccaggcaauagcucuagugcgugguuuacagcuaguuaagcagauagcaaaagguggcugacaaaccucguuacaauggugcuuguccucuuuuucuguuucugcuaauu

SEQ ID NO: 4130522 - RNA, 81 nt, Human
gauuggguccauguucuccuggucugaggcugccucaucaucaucuggggacuccuggaucagagccagagaagcccaguc

SEQ ID NO: 4130523 - RNA, 68 nt, Human
gauuggucccucauggacacaugauaguggggagccuccgucauguuugggccaugaguggacuguuc

SEQ ID NO: 4130524 - RNA, 91 nt, Human
gauuguaaacucugggucuaugugugugucugguaucccauagugaacagagugcagugccaggcauguaguagacuugcaguaaauaauu

SEQ ID NO: 4130525 - RNA, 62 nt, Human
gauuguaauuuucaagagguaaggaguuuaaacucaugaccuaguuuuugagaauuuuaauc

SEQ ID NO: 4130526 - RNA, 58 nt, Human
gauugucugugaucaugagcaacuugaguuuuguugucaucuguguuacaggcauauc

SEQ ID NO: 4130527 - RNA, 73 nt, Human
gauugugcaggcaggagacauuugguugggacaaggcuucucugccaacucagcuucugcccugucaugaguc

SEQ ID NO: 4130528 - RNA, 72 nt, Human
gauugugcauauucaagguguacaaugugacaauuuuauauguguauacauuguauaaugauuaucacaauc

SEQ ID NO: 4130529 - RNA, 65 nt, Human
gauugugguggaggaagugcaguucuacuacagcaaaaguugaguuagaaauuccugccacaguu

SEQ ID NO: 4130530 - RNA, 102 nt, Human
gauugugucccacgccacugagucucugggacacugggucaguugucuagucuggcacaauuggcaggaaucccaagaaacagugugagugaggggacaguc

SEQ ID NO: 4130531 - RNA, 62 nt, Human
gauuguugggccccaccccgagaguuucugauuuaguagcucugggguagggcccaacaauu

SEQ ID NO: 4130532 - RNA, 66 nt, Human
gauuuaaagaguuauaguugguauguggugaaguuugccaaguaugggcuguacacacugaggauu

SEQ ID NO: 4130533 - RNA, 70 nt, Human
gauuuaacaugucuugacuucaucuuuucugugggaugggaggcaagguggagaauagauagguuggguu

SEQ ID NO: 4130534 - RNA, 63 nt, Human
gauuuaauuugugucuuuagcugaacucauguagaccauuuuagcuuuaggcacguuugaauu

SEQ ID NO: 4130535 - RNA, 67 nt, Human
gauuuagagaauguuuuguaaguggagacuucguccuucccuuaauguacaggaccuucuuuguauc

SEQ ID NO: 4130536 - RNA, 62 nt, Human
gauuuaggaaagucucuuggcugggagccacaguuggucccuucugagugcuuuccugaauu

SEQ ID NO: 4130537 - RNA, 71 nt, Human
gauuuagguggcaggagacacauggcauaguaaauuauauucauaugaugcugggucuucugcuguaaauc

SEQ ID NO: 4130538 - RNA, 70 nt, Human
gauuuauccagaguauugugaccauuugucaaucacugaugcugacugguuagauacuugcaauuaaauc

SEQ ID NO: 4130539 - RNA, 129 nt, Human
gauuuauguguguuauuuagaaagccaaaaguaaauguguuguggaugaaguucaagauccagcauucuguaggaagaugcaauuucauucugugacaacauguuuuaauaggaacuaacacguagauu

SEQ ID NO: 4130540 - RNA, 55 nt, Human
gauuuauugucccuguccugcuguuggugagcagugugaccuuuggcaaugcauc

SEQ ID NO: 4130541 - RNA, 96 nt, Human
gauuuauuuuguccauuugcaauuucaguauuuuagcucuaucucauaucauuuuuugguaggugcuguuaacauaugagguuaaagugguaaguc

SEQ ID NO: 4130542 - RNA, 87 nt, Human
gauuucaaaaugacugccaucucuaucuuuauugaaaucuuccauuauugugggaagacagguaaauagagaugcuggucagaaauc

SEQ ID NO: 4130543 - RNA, 56 nt, Human
gauuucaagcccccagagauucugauucacuggguuuauuguggggcuugggaauc

SEQ ID NO: 4130544 - RNA, 76 nt, Human
gauuucagacuuuguggggcccucccgaagccuggguggcagaacuagggcuggaagcuccagaaagucuggcuuc

SEQ ID NO: 4130545 - RNA, 59 nt, Human
gauuucagggugucuuccaacugaaaucucaauguuuucaguaugaaaaaccugaaauc

SEQ ID NO: 4130546 - RNA, 59 nt, Human
gauuucagggugucuuccagcugaaaucucaauguucacagcaugaaaaaccugaaauc

SEQ ID NO: 4130547 - RNA, 59 nt, Human
gauuucagugcacguaguuuauuugggacuugaucccaaggagacuggaagcauugguc

SEQ ID NO: 4130548 - RNA, 59 nt, Human
gauuucccagcaaaagcugguuucccuccuccaaaaccagcuuccugcagugggagguc

SEQ ID NO: 4130549 - RNA, 80 nt, Human
gauuuccuaugaguucauauuuaggcagcccagccacucuaaaagucugaggguucuuauaguaucagagcuaggaaauc

SEQ ID NO: 4130550 - RNA, 90 nt, Human
gauuuccugcuuguucuaagaaaugugaaagguccugcuguugcaaugauuuuaugacacgauucuuccaggaaaagcgcauaguaaauc

SEQ ID NO: 4130551 - RNA, 76 nt, Human
gaguggacuuugcccagcccuacaguaucaccugugagauuucacauggcugugcugcugcuguucaaaccccauc

SEQ ID NO: 4130552 - RNA, 56 nt, Human
gaguggaggugacuucugggcugaggcaguuaagagcacacaggccaccuccacuu

SEQ ID NO: 4130553 - RNA, 61 nt, Human
gaguggagugguaagggggaggaauuggacugcuucccuuuagaauucugccccuccucuc

SEQ ID NO: 4130554 - RNA, 58 nt, Human
gaguggaugagaggcuggacucagagucagaugagccaauuucaguuucuaguuccuu

SEQ ID NO: 4130555 - RNA, 70 nt, Human
gaguggauguuuuuaugaugcuugagggcacuuaaaaaguuuguucucauaaguaauuuaaacauuccuc

SEQ ID NO: 4130556 - RNA, 79 nt, Human
gaguggcaaaugcuaugauuuugaguuuccuuauuuuauuuacacacagggaaauucuaaaucguaacauuuaccauuu

SEQ ID NO: 4130557 - RNA, 77 nt, Human
gaguggcaggcauccggcaccuucuacccccuguuuccaccagccuuuaggaagagaggacuggggugcuugcccuc

SEQ ID NO: 4130558 - RNA, 63 nt, Human
gaguggccuggaaaggcuggucugaagaccucucuucccaugucugccgaccaggcuuugcuc

SEQ ID NO: 4130559 - RNA, 70 nt, Human
gaguggcgggcaggcuggugcaggcgucucagcagcacccuggaggcacagcacaccuggcccccagcuc

SEQ ID NO: 4130560 - RNA, 55 nt, Human
gaguggcuggguguuugaauccuugcuucuaguggcagagacugaccggcuauuc

SEQ ID NO: 4130561 - RNA, 62 nt, Human
gaguggcuuuuuuaugguaauguuuuauaacaacacaaacguacuuugucuuagagccacuu

SEQ ID NO: 4130562 - RNA, 59 nt, Human
gagugggcaccgugggcacacucggggaggugggaggagugggcaccgugggcacacuc

SEQ ID NO: 4130563 - RNA, 89 nt, Human
gaguggguaaguauuccagugagaacagagacaggggagcuacauacauaaaauaacucuuucauucauucuuucugaauauauucauc

SEQ ID NO: 4130564 - RNA, 66 nt, Human
gaguggguagagcggagccccuguagggcagagggaaucugacccuuggucuugcuuuuccuccuc

SEQ ID NO: 4130565 - RNA, 58 nt, Human
gaguggguuagggccagccuguggaggaccugggagccaggcugaguucuaugcacuu

SEQ ID NO: 4130566 - RNA, 77 nt, Human
gagugguggggugggcagcaccagggaaguguaucuaacacagcagcacugucccuugcugucacuccuuauggcuu

SEQ ID NO: 4130567 - RNA, 70 nt, Human
gagugguuagggaaugggucuggaagccagauuaccuggguuugaagccaggcucuuucaccugcuauuc

SEQ ID NO: 4130568 - RNA, 77 nt, Human
gagugguuuggguuuuguugcuguucauguguaucuuuuaaacauuaaggacccacgcacaggaaccccagccgcuc

SEQ ID NO: 4130569 - RNA, 99 nt, Human
gagugguuugucccaggcuguuggaaggggcagaguggcugcccucacccagggcuccuuuucagugcccuuuccauugcaccuuggcagcgcccauuc

SEQ ID NO: 4130570 - RNA, 75 nt, Human
gaguguauuuauguccuguggcugcccugacaaauuaucacaaacugggugguuuugaacaacagaaauguauuc

SEQ ID NO: 4130571 - RNA, 129 nt, Human
gagugucagaaucccuggggaagcuuguuagaaauacaaaugccuagauccuaccccggaaucaaacuuggggaggggaauucuggguguuuguauuucuaacaagcuccccagggcauuaugaugcuc

SEQ ID NO: 4130572 - RNA, 62 nt, Human
gagugucagcagggcagagcacugggugaggucuuaggccacucugaguuucugcugaccuu

SEQ ID NO: 4130573 - RNA, 64 nt, Human
gaguguccaguucuugcucucagcuacugaauaacuuguaaugaagguauuaccugagaugcuc

SEQ ID NO: 4130574 - RNA, 89 nt, Human
gaguguccugcugugggccugaugcugccaugagucccugcugcgcacccgcucugccuggccagcccucgggccacaccgugacccuc

SEQ ID NO: 4130575 - RNA, 71 nt, Human
gagugucuagaauaucuagaaagauccuaagcagagacugugugugguucuugguagcuguucuguggcuc

SEQ ID NO: 4130576 - RNA, 58 nt, Human
gagugugagcaggucaggagaugugagaggcagcaugauccuggagcugcuugaauuc

SEQ ID NO: 4130577 - RNA, 109 nt, Human
gagugugguucaauuuauuguacauggcauuuauagacgagaccuuuaauguucccaagacagggaagugucuccguuuuuaaagguuccaugacauuccuuuacauuc

SEQ ID NO: 4130578 - RNA, 65 nt, Human
gaguguguaggagaggcaccugucaccugugcagugagguagcugucaucuuuccugccaugcuc

SEQ ID NO: 4130579 - RNA, 84 nt, Human
gaguguuucccaaauaagauuguugauagcacuuuagcaaaaguccucucacacuuugcagagaucagcagguuugagauacuc

SEQ ID NO: 4130580 - RNA, 64 nt, Human
gaguguuuuuggcuguagcuggaaaucuggaagucaucaguauugggcaacaguuaauucauuc

SEQ ID NO: 4130581 - RNA, 66 nt, Human
gaguuaaagaaguguuguguggguuuuuauagaaaucaaaaguacaugcaauucuucugaaggcuu

SEQ ID NO: 4130582 - RNA, 70 nt, Human
gaguuaaagugagcuacuuuagguaagcaaggugagcuucagugagccuaagcagaagcuauuugaauuu

SEQ ID NO: 4130583 - RNA, 64 nt, Human
gaguuacacaguugguaggggcagagccaggugacaggcagucugaccccugugcuguggacuc

SEQ ID NO: 4130584 - RNA, 90 nt, Human
gaguuagaucucuacuaugaguuuaaggcuaaaauaggcauuucuuacuggacagcuuuaccuugaugauuuauacugaagaucuaacuu

SEQ ID NO: 4130585 - RNA, 93 nt, Human
gaguuagguaggggcaggaguguggccagggcucuggucuggcucuuugacagugcuccuuugauuccuguccacuucuacccaagccuuauc

SEQ ID NO: 4130586 - RNA, 67 nt, Human
gaguuauaugugaaaacacguauguguguguguauguauauauguguaaauuuuauaaaauuaaguc

SEQ ID NO: 4130587 - RNA, 82 nt, Human
gaguuaugagguagcuguggcuggcuggguuuugaugaaguacccauaauuucauaucagcugccacaggacuuucugacuu

SEQ ID NO: 4130588 - RNA, 59 nt, Human
gaguuauugaguauagaauguaaggucuuuacaugccuacuucuggauauucagaacuu

SEQ ID NO: 4130589 - RNA, 62 nt, Human
gaguuauuuugagcagaugguuauaggugguucuugcucaggaccgucguucagacggacuc

SEQ ID NO: 4130590 - RNA, 61 nt, Human
gaguucagugccuguccacagcuuccaguaaugagaagaagguagaagacacacuguucuc

SEQ ID NO: 4130591 - RNA, 82 nt, Human
gaguucaugguaaaauacagauucugacucagaguucugauucuggaaauucugauucaaaguuugagugggccuugaacuc

SEQ ID NO: 4130592 - RNA, 55 nt, Human
gaguuccggguuccacagcugggacaguguugcccagagcugauuccugggacuu

SEQ ID NO: 4130593 - RNA, 82 nt, Human
gaguucgggaugugcagcugugguggagccaggggcugggcacaccccuggcuccuggccuggcagcgucaucaucggaguc

SEQ ID NO: 4130594 - RNA, 59 nt, Human
gaguucucaagcaaucaaagagcaggagcucuaacuaauuguugccuugagauccacuc

SEQ ID NO: 4130595 - RNA, 60 nt, Human
gaguucugaacugugaaaugcagcaguugggaagugggcugucacucaccguuuaggcuu

SEQ ID NO: 4130596 - RNA, 55 nt, Human
gaguucuuagggagaacccaagguguguuggaacguuggagacacuugaggacuu

SEQ ID NO: 4130597 - RNA, 75 nt, Human
gaguucuuccugccacaggucuuagagguugaguguuuggacuaagcccugagcgugaggaggaaguacugacuc

SEQ ID NO: 4130598 - RNA, 78 nt, Human
gaguucuugccucuguguccuguccuuccuggaagucaggacucugcuuccucagggagcccggggaaggcggagcuc

SEQ ID NO: 4130599 - RNA, 63 nt, Human
gaguugaccgucacuauuuuauauucaaggacaaagacuugagcaaaugugaugguacaauuc

SEQ ID NO: 4130600 - RNA, 90 nt, Human
gaguugagccuguggagucuagagucugucagguugggauuccuuaauuucuuccaaaccaugaauggguucugguguaaggcuuaaguc

SEQ ID NO: 4130601 - RNA, 105 nt, Human
gaguugagcuuugucaagaaccaagggcugaaguucuuuuuguucagacuauguuucuguuaccaguauugagggacuaaggacuuucaagcccuucucauucuc

SEQ ID NO: 4130602 - RNA, 78 nt, Human
gaguugaggccggagacaagagacuuauuuuucaccuggcucagccaccaggucucuugcugucucugggccuuauuc

SEQ ID NO: 4130603 - RNA, 79 nt, Human
gaguugccugucaaaggcuggagggcaggaggagggccuggguuuggguucuuuccucccagccuuuggauggugccuu

SEQ ID NO: 4130604 - RNA, 78 nt, Human
gaguuggaaacccuguagguuugcucugaccuggcuuugcaagaacaguuuaacagaccucgcagccuguuucuacuc

SEQ ID NO: 4130605 - RNA, 69 nt, Human
gaguuggagcccugggucccaguccuggcuuugucacugaccugccagggaacccaagggccucaauuu

SEQ ID NO: 4130606 - RNA, 87 nt, Human
gaguugggagaccguugguuaccuucagaaaugaguugcgacaguuagugccgcuugcugaacaggaaccuggcagucuccagauuu

SEQ ID NO: 4130607 - RNA, 74 nt, Human
gaguugggggagaguuaaaaggaaacuauggaaauccuuuuuuaauuccuagacuuuuaagucccucuuuacuc

SEQ ID NO: 4130608 - RNA, 72 nt, Human
gaguuggggguugagcauuuuauuuuccuagagacuccuugguuucuagacaaauguguucauucccuacuu

SEQ ID NO: 4130609 - RNA, 57 nt, Human
gaguugguauaauuucugcagcccauuggcaggcuguggaaaauuuguauguaauuc

SEQ ID NO: 4130610 - RNA, 65 nt, Human
gaguugucuauucugaauugauuauagugagaggagauuagaagaucaguuaggaagaggcacuc

SEQ ID NO: 4130611 - RNA, 101 nt, Human
gaguuguggcuuuugcgaaugaggaacuggagcuuucauuuuagauaauuugaauuaaauuuaaauuggacggcgcaggucuggaggagccccugcaacuc

SEQ ID NO: 4130612 - RNA, 80 nt, Human
gaguuguuagggcuuuaguggggauguaugggaggcucugauaaggcuuuacaugauuucucacccugguacuaacaguc

SEQ ID NO: 4130613 - RNA, 60 nt, Human
gaguuuaaauaacacauuuccaagucacguagcuaguggcaagauguggaguuugauuuc

SEQ ID NO: 4130614 - RNA, 60 nt, Human
gaguuuaaucauuguucuauccagccuugaucucuaucaacaugaugggaccaugaacuc

SEQ ID NO: 4130615 - RNA, 61 nt, Human
gaguuuaguuuggcuuaaacugauuuuacaagagaaaucuggauuuagguucauugaacuc

SEQ ID NO: 4130616 - RNA, 113 nt, Human
gaguuucaugaacgucacauguuauuuuagagucuuuagagucuuaguguuugcugguugaauuuacuaagccaaugagcauuaaauuuuuacaaggcacgucugugaagcuc

SEQ ID NO: 4130617 - RNA, 72 nt, Human
gaguuucuuuccagggcuucugggcagccaguaccccucacuguccugaaggagcccaaggagagguaacuu

SEQ ID NO: 4130618 - RNA, 92 nt, Human
gaguuugacuauucgagauauauaagugaaaucauacaguauuugucuuuuugcgacuggcuuauuucacuuagcauaauguccgcaaacuu

SEQ ID NO: 4130619 - RNA, 57 nt, Human
gaguuugauggcuuaauaguagauguauuuaugucuuaguuguuugcugucuaacuc

SEQ ID NO: 4130620 - RNA, 59 nt, Human
gaguuuuaaccucagcucucugauuggucugucagaagacagcuugagaguucaggcuc

SEQ ID NO: 4130621 - RNA, 78 nt, Human
gaguuuuagagagaaauaaaugagauuuaaauugcuuagaacagugcaugucucguaaguuucacuucaauaaaucuu

SEQ ID NO: 4130622 - RNA, 65 nt, Human
gcagagcagggagaggaggcugggugccagguccgcagcuuggcugccagcuccucgccuugugc

SEQ ID NO: 4130623 - RNA, 61 nt, Human
gcagagccacagugguggcccacgugcuggcucaagcaucugggugacgcaguggcugugc

SEQ ID NO: 4130624 - RNA, 56 nt, Human
gcagagccaucaugauauggagugccauaagaggaagcccacauccauggcucugu

SEQ ID NO: 4130625 - RNA, 59 nt, Human
gcagagcccuggggguauggugggagauggugucccugagacccuugcaggggcucugc

SEQ ID NO: 4130626 - RNA, 59 nt, Human
gcagagccugugucugagcaaagcagaugauguagugcuugugagaggcagugcucugu

SEQ ID NO: 4130627 - RNA, 59 nt, Human
gaugcaaacugugacauagaguucaaggaaacuuauugagaucuaugcagguuugcauu

SEQ ID NO: 4130628 - RNA, 76 nt, Human
gaugcaaagccccugugugugcgcccucccugguggcccuuucaucucauugcacaaugcagaguggaguugcauc

SEQ ID NO: 4130629 - RNA, 77 nt, Human
gaugcaagcagucccagacccagaaggugggugcacagggacagccacccugaucggacucggagugcuuugccauc

SEQ ID NO: 4130630 - RNA, 84 nt, Human
gaugcacuuguccagauguuuguuaggucccuuguacucauguucucuagugcacaucaaaggcauuuggacaaauaggccauc

SEQ ID NO: 4130631 - RNA, 75 nt, Human
gaugcagaaaaacagugcugcauucauugagccagcccaaaugugagcucaugagugguacuguccuucuguauc

SEQ ID NO: 4130632 - RNA, 79 nt, Human
gaugcagacugcuuuuagaaaucuauagauuaaacugcuaaaaauaauagguuuauagaguucuguuaguauaaggcuc

SEQ ID NO: 4130633 - RNA, 94 nt, Human
gaugcagcugaugcuuuauuauuuugcagggaagggguggagggauccuauuauuuugcuuccaaaguguaaagcguucuuuuaugguuguguc

SEQ ID NO: 4130634 - RNA, 83 nt, Human
gaugcagcugugucucugcucucugcagucuugggcaggcagcaccgcugucuccugauacagaggguugaaugcacugcuuc

SEQ ID NO: 4130635 - RNA, 57 nt, Human
gaugcaggauagcuucacccagguagaagagaaaacuggcauagugagcuuagcauc

SEQ ID NO: 4130636 - RNA, 59 nt, Human
gaugcagggcagcucugggacagucgcugauugaaacaucccugaguucucugagcauc

SEQ ID NO: 4130637 - RNA, 72 nt, Human
gaugcagguuuaauggagauauuucagaaccuggauggcagcuuuugaaauuaagauauuguccauugcauc

SEQ ID NO: 4130638 - RNA, 63 nt, Human
gaugcagucauagugcuuccaggaaauuauauucgacauccuagaauaaucuuugacugcuuc

SEQ ID NO: 4130639 - RNA, 91 nt, Human
gaugccaagcugugcuaagugggaacugccugucucagcucucauccagcuccaagagcugagcaggcucccacuucagugccuuugaauc

SEQ ID NO: 4130640 - RNA, 72 nt, Human
gaugccaguagcacacugucuugauuacuauggguuuguaagaagucuuaaaauuagguaguguuugucauc

SEQ ID NO: 4130641 - RNA, 74 nt, Human
gaugcccagaacuugugcucaugguccagcaugguaacuaaggcaccagcuggcccaugagcacgucaggcauc

SEQ ID NO: 4130642 - RNA, 62 nt, Human
gaugcccaggcccaaccauggaugauuuugauuucacuggccuuggguguggccugggaauc

SEQ ID NO: 4130643 - RNA, 57 nt, Human
gaugccuggcaugggaaguguccagcugagaaauggaggcucccagaaaugggcauc

SEQ ID NO: 4130644 - RNA, 59 nt, Human
gaugcguugguugagauuacauccucuccuucgggaggggacagagggcagcccgcauc

SEQ ID NO: 4130645 - RNA, 95 nt, Human
gaugcuagcuccuggacaacauuuuuccacauacccuaggccagaagggaaauugcugccuuguggggaaggauuuaguccuggcagaauucauc

SEQ ID NO: 4130646 - RNA, 67 nt, Human
gcagccccaaccucuuugggccuugguuuccuuauuuuuggaacucggaggucaggagagguucugc

SEQ ID NO: 4130647 - RNA, 95 nt, Human
gcagcccuaacacccuaaaccaaagcuuuuccucucauuugccagaagcaagccucagacucauggcaggugacggggaugaguaugguuucugc

SEQ ID NO: 4130648 - RNA, 106 nt, Human
gcagcccucuugucuggcugaucaggaagcuacugccagcagccugcagcccugggggcgcacaggucugcugcagagcauggcuuuccucggcccagacggcugu

SEQ ID NO: 4130649 - RNA, 62 nt, Human
gcagcccugcagcuccacaccgccucuugcuaguugccugcuggaguggcugcaggcucugc

SEQ ID NO: 4130650 - RNA, 92 nt, Human
gcagccgcuuccccuggcgggcacugggucuucuccacgcagauugagacgucugcuggcgggguccuagcgccgaucugggaggccguugc

SEQ ID NO: 4130651 - RNA, 76 nt, Human
gcagccgguccuugccagggauggcucaugccccagcuccagagagaagcagguagacaucucugcaaggagcugc

SEQ ID NO: 4130652 - RNA, 64 nt, Human
gcagccuccccagguggggcaacacaccagcuccucaaagcugcuguggggcucggccugcugc

SEQ ID NO: 4130653 - RNA, 73 nt, Human
gcagccuccuaguucucugccagucgcugaaggacacccaggacaguuauugagugcagagcagggcugcugc

SEQ ID NO: 4130654 - RNA, 55 nt, Human
gcagccucgcgcucagucauguuggggcuaaaccugugccuggagaagaggcugu

SEQ ID NO: 4130655 - RNA, 58 nt, Human
gcagccugugcaaaagcuugguuuguccaaauaaagagaaggagaaugacacggcugc

SEQ ID NO: 4130656 - RNA, 66 nt, Human
gcagcgaucuuaugucugaacuuuacaaugguaucuauguuagaaaguucuagaaugacuuccugu

SEQ ID NO: 4130657 - RNA, 59 nt, Human
gcagcgcuguaggcccaaggcaccagggaauccgguccagcucagcccuacagcuuugc

SEQ ID NO: 4130658 - RNA, 63 nt, Human
gcagcggugacagcggugacagcagccuggccgguggcggcagcugcacguugucccgucugu

SEQ ID NO: 4130659 - RNA, 64 nt, Human
gcagcucgcacauuagucacucccugucacccaccuacacggcaggaggcugcugugcuggugc

SEQ ID NO: 4130660 - RNA, 69 nt, Human
gcagcucuaauguuacacugcaugguucauaguugcaaacuugaaagccaggaugcaaguagcagcugc

SEQ ID NO: 4130661 - RNA, 129 nt, Human
gcagcucuccaaagacgcaccaaggcugaccugacuuccucugcccucagccccucgcauccugccacucugcugagaugcugcuccacaggccagggcagccuugggagcggguacacagagacuugc

SEQ ID NO: 4130662 - RNA, 65 nt, Human
gcagcucuccucugugaggaaccugggaagaguuucuuccucaugccuccugaggaugaaguugc

SEQ ID NO: 4130663 - RNA, 59 nt, Human
gcagcucucuggccugcccuggugugauaaugcuaucagcugguugugggaguggcugc

SEQ ID NO: 4130664 - RNA, 55 nt, Human
gcagcucuggggcaggccugagacucugcauuucucucaagcucccaggugcugc

SEQ ID NO: 4130665 - RNA, 86 nt, Human
gcagcugaauaaauagaagcuauugaauuuauagcauauuuaaagcauugaauaucaggaauugaauggcuucaguuuaaagcugu

SEQ ID NO: 4130666 - RNA, 66 nt, Human
gcagcugagagaagaacagggccaguuaaccaaguuuuguuagcauuccuaacuauccuuagcugu

SEQ ID NO: 4130667 - RNA, 99 nt, Human
gcagcugagugugacccaugggagacagugcagggugggaagaaggggaggccagcgucucucccucacucugccuccugggguuuccacagcagcugc

SEQ ID NO: 4130668 - RNA, 62 nt, Human
gcagcugcagacccucagugcuuuuccuccacauauccugccacagagggucugccgucugc

SEQ ID NO: 4130669 - RNA, 63 nt, Human
gcagcugcucacauucucacaacucaacuguucaaaacucuguuguugaaugaaggagguugu

SEQ ID NO: 4130670 - RNA, 72 nt, Human
gcagcugcucagccuggccaggggcucugggcccauagggcaguccuggggaccaggcugaggacgggcugc

SEQ ID NO: 4130671 - RNA, 58 nt, Human
gcagcugcuggaaguuccugccaguaguaaaccuuucaggcagaaugugagcagcugc

SEQ ID NO: 4130672 - RNA, 71 nt, Human
gcagcuggcuggaugguauggaggagcucaggccuuucauggccucuggucccucaugcuguggcagcugc

SEQ ID NO: 4130673 - RNA, 66 nt, Human
gcagcugguggagcugggccugagcaggacuuccccaaaggacugagaaggaagccuccacucugu

SEQ ID NO: 4130674 - RNA, 69 nt, Human
gcagcugucauuuacaacagggauccccagccagucacuuggagccacccugcugugaggggcagcugc

SEQ ID NO: 4130675 - RNA, 55 nt, Human
gcagcuguucaaucugcagcaucuaggauuugguagcagcaggggaaacagcugu

SEQ ID NO: 4130676 - RNA, 74 nt, Human
gcagcuuaaaguguuguaucuccauuugcauauaaccugaauacaaaugcaauucaaugcauauuuuaaguugu

SEQ ID NO: 4130677 - RNA, 78 nt, Human
gcagcuuacauauuuauggugugaaguacuuaacucccuacauuuuaguucucacaucugaaaaaauauugagcaugc

SEQ ID NO: 4130678 - RNA, 68 nt, Human
gcagcuuccuagaucugugguacucagccucagcccaagcuguguauuagaauugucuggggaacugu

SEQ ID NO: 4130679 - RNA, 80 nt, Human
gcagcuuguggucuuuggcugcauucgaguugcuggaacauuuaucuaacaacccaaggugccagagcuacuaacgcugu

SEQ ID NO: 4130680 - RNA, 58 nt, Human
gcagcuuugcuucuuuuccauagcaaaugcuucaccgcugcuaggcaagcaaaggugc

SEQ ID NO: 4130681 - RNA, 77 nt, Human
gcagcuuugguaauuuuugcauuuagaaaauggaaacccacuuugcauuuucuacauucaaaaacuaccagaguugu

SEQ ID NO: 4130682 - RNA, 73 nt, Human
gcagcuuuguucuuucuaguagauugcuagagucuacuaaagauuuucauuugcacucuagaaauggggcugc

SEQ ID NO: 4130683 - RNA, 75 nt, Human
gcagcuuuucuugacagguaaaaugcuaccgcaauucaguggaaggcauuuaggaacugcaaucagaaaaccugc

SEQ ID NO: 4130684 - RNA, 83 nt, Human
gcaggaaaguuuuuauuuccccaagacccuggaggugucggggccucagagguucugugugggaagagagaggacuuuucugc

SEQ ID NO: 4130685 - RNA, 66 nt, Human
gcaggaacuugcaaaaugagcaauuaucucucuuaaauuucauuugauuagguuugcauuuccugc

SEQ ID NO: 4130686 - RNA, 62 nt, Human
gcaggaagcugugaguccaccaggcugcccugugcugggcaccugcucaacuggcuucucgc

SEQ ID NO: 4130687 - RNA, 69 nt, Human
gcaggaaugugcuugucuuggaaacuuguggaccaaaauauguucauccuuaagaaaagcacauccugc

SEQ ID NO: 4130688 - RNA, 87 nt, Human
gcaggaauuucauugcucugcugugugccccagugggaccugaugcccaacaaauggaacugaauauagaagagcaaugauuuuugu

SEQ ID NO: 4130689 - RNA, 55 nt, Human
gcaggaccucuggaugcaaugcguggcaaaguacgggguguuuccugaggcuugc

SEQ ID NO: 4130690 - RNA, 77 nt, Human
gcaggacucguguuuaagugucagaggcuuagaggggucagcucugaacuagaagucucucacauaucugguccugc

SEQ ID NO: 4130691 - RNA, 81 nt, Human
gcaggacuucucuucaggaaggagcuuuggaacuuccauagcauuuauuucagguaucaaaguuguccugugaaguuuugu

SEQ ID NO: 4130692 - RNA, 77 nt, Human
gcaggagacaacuggcuuucucugugguguucagugagccaccgcugaugccucauuagaacgcgagacacuccugc

SEQ ID NO: 4130693 - RNA, 67 nt, Human
gcaggagagagaugaacaacacuggauauucugcauuauccaguucuaggucacucucugggucugc

SEQ ID NO: 4130694 - RNA, 56 nt, Human
gcaggagagucugugccagguuccauacuccuuaucuuccacacgugaccuccugu

SEQ ID NO: 4130695 - RNA, 56 nt, Human
gcaggagauaugaagcuacacagucuuuaauggcuaagucuggcuuuguuccuugu

SEQ ID NO: 4130696 - RNA, 68 nt, Human
gcaggagcaaaucuguuauggugguccagacaggaggauuuaguucugggcacaguuuuugcaccugc

SEQ ID NO: 4130697 - RNA, 67 nt, Human
gcaggaggaugggcggcaucccugcaggucuuggucaccggcuuccagcaggugcugcgccuccugc

SEQ ID NO: 4130698 - RNA, 86 nt, Human
gcaggaggcuguggccaggucccugggggcaguguccugggggcagcgaccacuucccaagggacucaggaggcucagacuccugc

SEQ ID NO: 4130699 - RNA, 57 nt, Human
gcaggagugacauggauguggaucaacccaaaccauggcugcaccaguccuuccugc

SEQ ID NO: 4130700 - RNA, 61 nt, Human
gcaggagugaguuggggucuacacaaaccaugacaggucuguggcuucucuucacuccugu

SEQ ID NO: 4130701 - RNA, 56 nt, Human
gcaggauaaguuuuugagcuuguaauagcaagaaacugguuugaagaaaaucuugc

SEQ ID NO: 4130702 - RNA, 57 nt, Human
gcaggaugagggugcccaggaccaugcccagguugguccugcccacgcccaucuggc

SEQ ID NO: 4130703 - RNA, 58 nt, Human
gcaggauggcaguaagagggagaggcugggauauuucuuccucuugcuuccgccuugc

SEQ ID NO: 4130704 - RNA, 55 nt, Human
gcacucugggcucuuguuucagaauucucaaggauguuugggaagcccagagugu

SEQ ID NO: 4130705 - RNA, 82 nt, Human
gcacugaaaagagauccaccagggagagggcaauguuuaacuucaaagaaugccuuccuaauggugggguuucaggcagugu

SEQ ID NO: 4130706 - RNA, 60 nt, Human
gcacugaagacaaagucaggcccagagucaggcgcucuuuugucuugugucuccagcagc

SEQ ID NO: 4130707 - RNA, 78 nt, Human
gcacugaccugucugaacugcacugaaagacgcauuuuauuugcauuuaguuauucuagugcucagccauuucuuugc

SEQ ID NO: 4130708 - RNA, 73 nt, Human
gcacugacugaccuaacaaaggaagcugcccuggugccugucaccaggaaaaacacuguguuggugucagugc

SEQ ID NO: 4130709 - RNA, 65 nt, Human
gcacugaggcugggucacagacaaggcaggauggagcuggagacuucugaggcugagcccagcgu

SEQ ID NO: 4130710 - RNA, 62 nt, Human
gcacugagggcuccaccuagggacacuggcagcaagaccaacuccaguggugaguccaaggc

SEQ ID NO: 4130711 - RNA, 65 nt, Human
gcacugaggguuggcgucacaaguagaagcaccacuuucagcccagcgcaaacaacuggcagugc

SEQ ID NO: 4130712 - RNA, 71 nt, Human
gcacugcacagucccagaggaugccauucacagacucccaugcaaauagcuucccuggguuugugcagugc

SEQ ID NO: 4130713 - RNA, 56 nt, Human
gcacugcaguccugauggagcggcuuauggaaguuuuucugggaggcacugcuggc

SEQ ID NO: 4130714 - RNA, 59 nt, Human
gaugcuaucuuugacauuguucacuucaaggagugagauaacauggaagaguagcuauc

SEQ ID NO: 4130715 - RNA, 78 nt, Human
gaugcuauggaaggagcuaaggaccugggaccagaaugaaaucacauucuuccuaccccaguuaguugcuuccacauc

SEQ ID NO: 4130716 - RNA, 65 nt, Human
gaugcucaaaaaauaguuguggaauuugaauucucccaguucacaaaaugguuuguugauguauc

SEQ ID NO: 4130717 - RNA, 61 nt, Human
gaugcucaucuguccuuugaugcucauaaauugaaugugcacucagggacauguggguguc

SEQ ID NO: 4130718 - RNA, 61 nt, Human
gaugcuccuggcauccugcuuuuaacuacuucaggguuaaugacaggccugccagagccuc

SEQ ID NO: 4130719 - RNA, 73 nt, Human
gaugcugaaccagggcugggauaggucaggauggcucuggggcccugccuggcuucucaccuuguucuguguu

SEQ ID NO: 4130720 - RNA, 71 nt, Human
gaugcugaccagcuguuuccuuucuccgguaaguaccgacucugaggauaaacaggaaaacuguuaggauc

SEQ ID NO: 4130721 - RNA, 64 nt, Human
gaugcugagagauuggagacuaguuucauucuucuguauguggauauccaguuuucccagcauc

SEQ ID NO: 4130722 - RNA, 67 nt, Human
gaugcugagccaaaaagcagagcuugguaucuccaauuccagcugugcuuuuauugggcuuuacauc

SEQ ID NO: 4130723 - RNA, 69 nt, Human
gaugcugaggagauggcuugcucucacgugggcagcugcuccuuugagaaacaagccaugcgcaguguu

SEQ ID NO: 4130724 - RNA, 63 nt, Human
gaugcugaggaguaacauugagcaucacagauucccagggugcuggagauacugcucaguauc

SEQ ID NO: 4130725 - RNA, 66 nt, Human
gaugcugcugccuuaacuucuucgcuguccucugagguacgcugccgaaaagugaggccagagcuc

SEQ ID NO: 4130726 - RNA, 71 nt, Human
gaugcugucugucaggagcaggcaacagacgguccugggguccaucugugcuaaugcuucacaauagaguc

SEQ ID NO: 4130727 - RNA, 59 nt, Human
gaugcuucuuuaauucagauuugaagggaugaguuuccuuguucuggauuaaacagcuc

SEQ ID NO: 4130728 - RNA, 75 nt, Human
gaugcuuuaaaugucuuuugcuuucuuuccagaacuguuuaugaaggcagagagauaugcuuuuaguagaguauc

SEQ ID NO: 4130729 - RNA, 70 nt, Human
gaugcuuuauuguuaggucauguaaaaauaagccuuuguuguacaguuaaaugcccuaaaauggagcauc

SEQ ID NO: 4130730 - RNA, 77 nt, Human
gaugcuuugguccagagguuguuugagugaaguaagcauuuagguacuuguacacucaguacuucuagacuuccauc

SEQ ID NO: 4130731 - RNA, 72 nt, Human
gaugcuuuguaaaguauacauauauuagccuucgcuaguaauggugaugcuaacuuguauagcuaaugcauc

SEQ ID NO: 4130732 - RNA, 60 nt, Human
gaugcuuuguacagggccuggcacauuguaagcacuugucaguuccuguugcacagcauc

SEQ ID NO: 4130733 - RNA, 130 nt, Human
gauggaaaauacuuuuaaaauaaaaucugcggaggaagaagugugaucauguucugugucucuagcucgaguuuuaauucuggcaggaagaggaaaggucaacauuucucgcucacaaguuaaugcuguc

SEQ ID NO: 4130734 - RNA, 85 nt, Human
gauggaaauaagaucaucaugcccacuugagacuucagauuauucuuuagcuuagugguuguaugaguuacaucuuauuaaaguc

SEQ ID NO: 4130735 - RNA, 58 nt, Human
gauggaagcuauauuguugcuauugucagcuuuagcaauaauuuaggccuuuccuguc

SEQ ID NO: 4130736 - RNA, 63 nt, Human
gauggaauuuggacuggaaguccuuuaguggcccugguauaggacucaaguaccgaauugauc

SEQ ID NO: 4130737 - RNA, 55 nt, Human
gauggacugccaccuccuccgggcucugcuuagugucacagggguacaguucauc

SEQ ID NO: 4130738 - RNA, 77 nt, Human
gauggagguaaaggauguagaagguggcagguggcuuuaauaauuauauguacaucguugaauucaaauccucuauu

SEQ ID NO: 4130739 - RNA, 112 nt, Human
gauggaggucuucucuagacaugguugacuucuuugaugacaaccuaguagucacauaaacugcccaggaaucucaaagaaaggucaugauguaccccugaagaacgccauc

SEQ ID NO: 4130740 - RNA, 93 nt, Human
gauggaguuccaaagaaacugaaggcuuucccaaggucacaccacuaguuauugguaguacugggacuagagcccagccguccuaauucuauu

SEQ ID NO: 4130741 - RNA, 78 nt, Human
gauggauaccaaggccucagacucagugcguugugaccuugggcaggucgcucgcccuuucugggccauugaucccuc

SEQ ID NO: 4130742 - RNA, 72 nt, Human
gauggauuacaaucccauuuaugccuaguaguccauuauuggaaugcuaagcaugugggaguuauuuuuauc

SEQ ID NO: 4130743 - RNA, 55 nt, Human
gauggauuauuggaaaaucuguguacuccccugcacaguucaugauaacuccauc

SEQ ID NO: 4130744 - RNA, 98 nt, Human
gauggcaaucuggcugggacccagggccagcugauaauccuggugacaguaggagcugccaccaggaagugguggccugggccuggaccucagccauc

SEQ ID NO: 4130745 - RNA, 62 nt, Human
gauggccaagaauauuucucaaccuugaaacagguugaaaucuucaagaauguauuggccuc

SEQ ID NO: 4130746 - RNA, 75 nt, Human
gauggccuggguccccuuccggcccaggaauggaacugaagccagauaaugggaagggagggggugccuggcuuc

SEQ ID NO: 4130747 - RNA, 61 nt, Human
gauggcugcuugguguuugaagacaguucccagggcaugcauucauuuguugagcaccuuc

SEQ ID NO: 4130748 - RNA, 69 nt, Human
gauggcuuggagauacaagugguaccuccugaaaaagacacccagguagcaguuguaucugaaagucuc

SEQ ID NO: 4130749 - RNA, 91 nt, Human
gaugggagcacacuuagauuggaaucuugacccuagcugugcugguggccacacugacuggaaucaaggauguucagagguggcuccuuuc

SEQ ID NO: 4130750 - RNA, 61 nt, Human
gaugggaucuugcuauauugcccaggcuggucucaaauuccugggcucaagcaauccuuuc

SEQ ID NO: 4130751 - RNA, 57 nt, Human
gaugggaugcauggcuguggccagacucgcaucauggccucugccauuauuccuuuc

SEQ ID NO: 4130752 - RNA, 78 nt, Human
gaugggcuaggucagcacaggugcucaggccaggacagauacuucgucccuggccacccagccuuggccaugguccuc

SEQ ID NO: 4130753 - RNA, 79 nt, Human
gaugggcugggcuggaaggccaaggcaggcuucuuucaaugucuggugccuuggugcuucuucauguggcccuuccuuc

SEQ ID NO: 4130754 - RNA, 61 nt, Human
gaugggguuggcacuuccuucgcuacccugguacaaaguucacagagaugcuaaucugauc

SEQ ID NO: 4130755 - RNA, 74 nt, Human
gauggguaaggguguuugguuagggugacaauaauccugauuucuaaacccuacaucagaacauuuacccuauc

SEQ ID NO: 4130756 - RNA, 76 nt, Human
gauggguaccuccgugcugacugcugcucagcugcuggccuccuuuccagaagagcagucagggugguaagccauc

SEQ ID NO: 4130757 - RNA, 56 nt, Human
gauggguggaggagaaaggcaucuuacacccacggugcccuuccucuuucccccuc

SEQ ID NO: 4130758 - RNA, 64 nt, Human
gaugguaaagaucuggcugccaggauucaguaagaaaaggaggauucuggcuuucuuauccauc

SEQ ID NO: 4130759 - RNA, 77 nt, Human
gaugguggaggggacuggagcaggagggagggggcagcccuguccacucuccagagcccuuccggccccaccccauc

SEQ ID NO: 4130760 - RNA, 72 nt, Human
gauggugguagaagcacuaugugaacuucauuguccugaagcuauacagggaauugcugucuggucaucauc

SEQ ID NO: 4130761 - RNA, 68 nt, Human
gaugguguggggagcuuggguguuuguuucccauuucacaaaacaaagcagccaaccuuacauucauc

SEQ ID NO: 4130762 - RNA, 124 nt, Human
gaugguguuugugggguuuugcuugguuuuguucuguuuugcuuucacuuuuuauuauggaaaauuucagauauauguaaaaguagacagaauaguuucaugaacccccauguauguacccauc

SEQ ID NO: 4130763 - RNA, 57 nt, Human
gaugguuuuauaaggcagaguuucccugcacaaggucucuguuugccugcugccauc

SEQ ID NO: 4130764 - RNA, 66 nt, Human
gauguaaacugggacuuccuagggcaaacaaaaauguauagucacccuaucacucaaguuuacguc

SEQ ID NO: 4130765 - RNA, 73 nt, Human
gauguaacagugucaggauuacagauauaagaauauauuauaucuguaacagagacugacaaauguacccauc

SEQ ID NO: 4130766 - RNA, 65 nt, Human
gauguaauagauauagauugcuccuugacacucaaagugcaagaaagauccuauuucuuuauauu

SEQ ID NO: 4130767 - RNA, 62 nt, Human
gauguacaaugucacuaugaccucaggaaguggggagaaagaguggugaacauuuuauaauc

SEQ ID NO: 4130768 - RNA, 60 nt, Human
gauguaccuuuuggaucuggauauguagauuuguucccagaaaguuugagaagauacauc

SEQ ID NO: 4130769 - RNA, 92 nt, Human
gauguacugguagauauaauuuuucuguggccaguucuuaaagggaaugucuaaaagaaauugguauaguaacauuauuuuacuuauauauu

SEQ ID NO: 4130770 - RNA, 60 nt, Human
gauguagauucauaugugguguccuagaauuuccacuccauguauaguuggaacuacauc

SEQ ID NO: 4130771 - RNA, 59 nt, Human
gauguaguagaaacagccaaguuuuagagucaaacagaccuggcucuuuuuaugacauu

SEQ ID NO: 4130772 - RNA, 57 nt, Human
gauguauagcuuuaacugacccuggguuuugcagaccaggguuuguuuaauacacuc

SEQ ID NO: 4130773 - RNA, 59 nt, Human
gaugucacaagcagaacuaggcacuggucuuauuaugcauauuuucuguuggugacauc

SEQ ID NO: 4130774 - RNA, 55 nt, Human
gaugucacuuaauuugugugguaaacucucaccaagcaagcuuauuagugauauu

SEQ ID NO: 4130775 - RNA, 79 nt, Human
gaugucagagcacccuugggugccagccacaaguggcccuccagcaggcugagcacccagggggaggcugcccugacuc

SEQ ID NO: 4130776 - RNA, 103 nt, Human
gaugucaggucuucugugugcgggagagcugcacuggggguggaaugaugugcacauugcuucuacuugcccaggcaggcccagcacaggggcuuggaacguc

SEQ ID NO: 4130777 - RNA, 75 nt, Human
gaugucauguauuugacagugaguuguggauggugcucauguuuauucacgauaugccugucacuacauuuuguu

SEQ ID NO: 4130778 - RNA, 101 nt, Human
gauguccacauccuuaugcccagaaccugugaauguguuaucuuaauggcaaaagugacuuugcaaaugugauuauauuuaaggaucuuaaggaggagauu

SEQ ID NO: 4130779 - RNA, 66 nt, Human
gauguccagggggcuugacugguuucucugcuuagggucuuacuagauauuguccagccugggcuc

SEQ ID NO: 4130780 - RNA, 63 nt, Human
gaugucccccauccacaccuacacccugcaaucauucugucagagugcaggucugaugccauc

SEQ ID NO: 4130781 - RNA, 57 nt, Human
gcacugccacugcccagccgguggccuuagauagguggccuugggcagguggccugc

SEQ ID NO: 4130782 - RNA, 56 nt, Human
gcacugccaucaaugcaugacauuuaagagucauccaagguuuugaaggcagucgu

SEQ ID NO: 4130783 - RNA, 129 nt, Human
gcacugcugacguuugggacauuagucguggggacuguccugugcaccgugggauguuuagucauuccugaacuccacacugggugccagcagcauucucccuccccugauugugacaggcagcagugu

SEQ ID NO: 4130784 - RNA, 87 nt, Human
gcacuggaagacaggccugaggagaugcugcccuggacccagagacaugguucccaggcccugggcucuccuggucuggucaccugc

SEQ ID NO: 4130785 - RNA, 58 nt, Human
gcacuggaggguguaguugcuguaucuucccugcuguuaaacuacacuuuucagaggc

SEQ ID NO: 4130786 - RNA, 68 nt, Human
gcacuggauggcagcauauugacagcaucuuuuauuucaggacugugaugcaguugccauccagaagc

SEQ ID NO: 4130787 - RNA, 55 nt, Human
gcacugggugugaggcagcgucguuuccccuucgcgcucuucgaaugucaagugc

SEQ ID NO: 4130788 - RNA, 69 nt, Human
gcacuggugcaugcccaugaagcugguccugguggucauggaccagccucacuggcaucaccuaggagc

SEQ ID NO: 4130789 - RNA, 66 nt, Human
gcacugugguugggggcuggggcccugaccuucaccaccccaggggccaguccccuaauccagggc

SEQ ID NO: 4130790 - RNA, 74 nt, Human
gcacuuaccagagaggauccgcccucgaauggacacauuaccagugaaggggcauuucuugucaauguaggugc

SEQ ID NO: 4130791 - RNA, 90 nt, Human
gcacuuagcaaguaaccuggagugcugguuucacuggggugaacaagccagucaaagccagcauuccagccccuuuuuuguuccaagugc

SEQ ID NO: 4130792 - RNA, 58 nt, Human
gcacuucacaugccuuuuccuggacacaagcauaagucggggguaggcuagugggggc

SEQ ID NO: 4130793 - RNA, 89 nt, Human
gcacuuccccagugaucuuaguucuugguucuuaguucuugguuugguguccaggaugggagauaggaacagaucuugaggagaacagc

SEQ ID NO: 4130794 - RNA, 78 nt, Human
gcacuuggucugggggcaagcagacagcuguggaguucacagcccacggcaacucaccugcccucagguccagguagc

SEQ ID NO: 4130795 - RNA, 86 nt, Human
gcacuuuucauuauuuuuaucagagaaauggagggcgcuuacacugguaagugcuuuaaaauuuccugagcaaugauccuaagugc

SEQ ID NO: 4130796 - RNA, 103 nt, Human
gcagaaaagcaacugggcugcucugaaggggaagggaugggcagcaggucacaggaccauggucuucaccagcccugccucucagggccccugcuuuuacugc

SEQ ID NO: 4130797 - RNA, 107 nt, Human
gcagaaacaaugggaugaugguguuucaggucugcuuuccuugccacuguuagauuucaacgugucagcaaaggcaggccgggagcugcuagagcucagauuucagc

SEQ ID NO: 4130798 - RNA, 69 nt, Human
gcagaaacagcuuuagaggauaauagucauuauuaugauugucaaucuauccuagagcugcuauucugc

SEQ ID NO: 4130799 - RNA, 60 nt, Human
gcagaaacuuggagaagccaggcuuacagcccugucaucauucuucagcguuucccaggc

SEQ ID NO: 4130800 - RNA, 56 nt, Human
gcagaaagcuccuugcgaucugaaagcacaucacacagagcaaggaaguucuuugc

SEQ ID NO: 4130801 - RNA, 69 nt, Human
gcagaaaggcuugcuuuugcucggucgucuuacuagacagccaagcaccaauaagguuggcuccuuugc

SEQ ID NO: 4130802 - RNA, 73 nt, Human
gcagaaauaaagucaucuaggagcagauuuucugcauucugcaaaaucacuuaaauggcuuauuuucguaugc

SEQ ID NO: 4130803 - RNA, 80 nt, Human
gcagaaauaaguaguuuaguguugugaguucuggagccaguuuaucuccuccacuaacuaaauuacuuaaucuugucugc

SEQ ID NO: 4130804 - RNA, 66 nt, Human
gcagaaauuucaugugaacacacaguacuuuguccaguacgugcacucauaccugaaauguuuugu

SEQ ID NO: 4130805 - RNA, 63 nt, Human
gcagaacugccguguuugagaauugguaccaucccaauuagacauuuauuggccagauucugu

SEQ ID NO: 4130806 - RNA, 55 nt, Human
gcagaacugugcuagaauucauuuagucuucugaguucuauuggguagguucugu

SEQ ID NO: 4130807 - RNA, 64 nt, Human
gcagaagaaaaggaaaagagcgacaguuuguaagucuauuagcugagauuguuuccauuucugc

SEQ ID NO: 4130808 - RNA, 80 nt, Human
gcagaagaaggggacuugggguucaccuuaagagggaacgcccccguugagguucacuuccuggauccuuacugcucugc

SEQ ID NO: 4130809 - RNA, 93 nt, Human
gcagaagaaggugguucugcugcggaauauaauucauucgcuacuucaggcacuggauuuugaucugcaagguguacagcuagguucuuaagc

SEQ ID NO: 4130810 - RNA, 77 nt, Human
gcagaagagggcccauagaucgucagcuugcagccucugguuuaaagcaaaaucgcaucuggggccagcucaacugc

SEQ ID NO: 4130811 - RNA, 106 nt, Human
gcagaagccucgguuuguugcuacuguuaguuccuggaaccugucucacucucauuucuucaggguugauuuuccaggaagcaguuagcagccuauccuaguuugc

SEQ ID NO: 4130812 - RNA, 83 nt, Human
gcagaagcuagguacagaaggacuugagaaagacaguggugaggucuugugacuguuugagucuauuugaauucagccucugc

SEQ ID NO: 4130813 - RNA, 70 nt, Human
gcagaagcuguucgaaggccgccagcaguugccguucaguaaugaggucggccacggauuugccuucugc

SEQ ID NO: 4130814 - RNA, 77 nt, Human
gcagaaguucacauagcuggcagguggcagagcugggauuagaauggugaucugccuggcuccaggugagcugcugu

SEQ ID NO: 4130815 - RNA, 72 nt, Human
gcagaauccugugugacucuggggagaagcccagugcucuuggcccucauccacccucacuaggaaagcugc

SEQ ID NO: 4130816 - RNA, 75 nt, Human
gcagaauggcugccagggcaggagguacgcuggaauucuucauggagccuuuucuucccuuuagcagccaguggc

SEQ ID NO: 4130817 - RNA, 59 nt, Human
gcagaauguuguguuagaugaaguuucugcuugggaacuaaauuugacagacaacaugc

SEQ ID NO: 4130818 - RNA, 93 nt, Human
gcagaauuuaucauugcugaugugcugagauucaaggaaaauacucuccaccaugcuucuauuuucuacaugucaguaacugauaauaacugc

SEQ ID NO: 4130819 - RNA, 77 nt, Human
gcagaauuuauuagguuuacauaaagguuauggggaauaaaucacuggcuuuuaucuuugccugguaucaccuuugc

SEQ ID NO: 4130820 - RNA, 56 nt, Human
gcagacaaagacagcaucucagguucccuugucugggcgcccgcccuuugaucugc

SEQ ID NO: 4130821 - RNA, 58 nt, Human
gcagacaccuggccaggccaggaaguuccccuuaccuggcacaguccugggugccugc

SEQ ID NO: 4130822 - RNA, 94 nt, Human
gcagacacgguggugaucacauugcuuggcauuugcugggagcugagcccucuucucucuccaugguuuugucaagcuggcaccauaacuuugc

SEQ ID NO: 4130823 - RNA, 61 nt, Human
gcagacagaggaagggcuccaugagcugcccagaggcuucaggaagccuuucuuggucugc

SEQ ID NO: 4130824 - RNA, 63 nt, Human
gcagacagcauguugggcuauuaucccaccccgaauagggagggaagcccaggcaucgucugc

SEQ ID NO: 4130825 - RNA, 90 nt, Human
gcagaccuccuauuauucugucuuuggucucaaucaaggagaagaugccguugagaagccucaaagaaggaagcagaaaggagaauuugu

SEQ ID NO: 4130826 - RNA, 89 nt, Human
gcagacgagcaaaugccauagaaaguauuauggaauuucagauuaacauugaaguauuguagcuuuuuguguuguuauucaucauuugc

SEQ ID NO: 4130827 - RNA, 82 nt, Human
gcagacucaacaaagcuaguucacugaagccuaugcuauuuuauggaucauaggcucuucagagaacugaauggcagucugc

SEQ ID NO: 4130828 - RNA, 72 nt, Human
gcagagaaaagccaucccagccaagccacagaacuauuuccuaauaaaugguuuggggguguuuuguucugc

SEQ ID NO: 4130829 - RNA, 80 nt, Human
gcagagaagguacauauuauaaaauacagcuauuuucuuaagcuaaaugucuguguuuaaaauguguacauaaacuuugc

SEQ ID NO: 4130830 - RNA, 62 nt, Human
gcagagacaacaaguuuaacuauuuucuuuccaucugaugguuggacugguuugguuuuggc

SEQ ID NO: 4130831 - RNA, 56 nt, Human
gcagagacagacuaaugaaaagcuuuacaagacauuuucucaacugucuucucugc

SEQ ID NO: 4130832 - RNA, 67 nt, Human
gcagagacauuuuacaccaagacuucuucauuaauugacauguuugugugugugaguguguagaugu

SEQ ID NO: 4130833 - RNA, 87 nt, Human
gcagagacugaaugacaugaccugguagagacagauuugagauucaaggucaguguucuuucuaccuguuauguuuuuauaauuugc

SEQ ID NO: 4130834 - RNA, 87 nt, Human
gcagagacuggggaucugucaggugacacacuaggagcaaagaucgccuucugugcccucuguacccaccuacagccagccugcugc

SEQ ID NO: 4130835 - RNA, 68 nt, Human
gcagagacuuuuaucucuggaguuuaaagacuucuaucucuuuaaguccaagaggaaagguuuccugu

SEQ ID NO: 4130836 - RNA, 56 nt, Human
gcagagagcaguaaagugaaguggggucucaagagccccucauacacucuccuugc

SEQ ID NO: 4130837 - RNA, 59 nt, Human
gcagagauuggugcacugaugaauaauuauuuauauucucauuggucauuaagcucugu

SEQ ID NO: 4130838 - RNA, 59 nt, Human
gcagagcaggaaggaagucagggaauaaacaccauuaccuuucuuuucuccugcccugc

SEQ ID NO: 4130839 - RNA, 61 nt, Human
gcagagcaguacucucuugacucuacucaacgaucagaaaauuaaggaguauugauuuugu

SEQ ID NO: 4130840 - RNA, 59 nt, Human
gcagagcagugcuugcccagcgccuccguggcgggcgcugugcacgagccacugccugu

SEQ ID NO: 4130841 - RNA, 61 nt, Human
gcagagcagugggggucuggagccaggggcuggguccagguucugccgcuuacugcugugc

SEQ ID NO: 4130842 - RNA, 129 nt, Human
gcagagcauccccuaguuuccuggcuugaggguucacuggggaauggcugucuuugcaacuuuaaacagaagccuaaagccugcaaagaagccuuugccuucugccucccucggcuauauguguguugc

SEQ ID NO: 4130843 - RNA, 57 nt, Human
gcagagcauuggcucuaugugugccuccuaacacauccaccacaugccaggcucugu

SEQ ID NO: 4130844 - RNA, 57 nt, Human
gcagagcauuuggguuacugcuuuuacucuuuggaagcuguuaucaucuguaucugc

SEQ ID NO: 4130845 - RNA, 70 nt, Human
gcagagccaccucugagcccaaacccugugcuacaugagacgcagguugugugugcaaggccuggccugc

SEQ ID NO: 4130846 - RNA, 57 nt, Human
gcagagccagaauggccaggacccagagccagcucucucccucaguccuggcuuugu

SEQ ID NO: 4130847 - RNA, 55 nt, Human
gcagagccaggagagacccuugggcuuccuuccuucaaggccucuggucucuagc

SEQ ID NO: 4130848 - RNA, 79 nt, Human
gcagagcggcuccgcggcgggagcugagcggaaggcgcgggcugcgaucugcucucuguuccccuggauccgccuaugc

SEQ ID NO: 4130849 - RNA, 60 nt, Human
gcagagcucaagguguucagcuuucuuuucacucugagcuauguucacugagaguucugc

SEQ ID NO: 4130850 - RNA, 71 nt, Human
gcagagcugagcagguguggagaguggucgggugcccagcguugccccuccaccacgcgccggccguuugc

SEQ ID NO: 4130851 - RNA, 74 nt, Human
gcagaggagagggagaaggacuaucaggcugcccucuggggcaggauggcccaaccuucacccagucuuuuugc

SEQ ID NO: 4130852 - RNA, 69 nt, Human
gaugugauaggcagcuuguuuaggaggaaauaaugucgcguacggagugccugagcaugucuucagguc

SEQ ID NO: 4130853 - RNA, 77 nt, Human
gaugugcaaauuuacucuugagacauuguaauuuugaaagcaaaugucuucucuguagguaaauuuacugcauuuuc

SEQ ID NO: 4130854 - RNA, 104 nt, Human
gaugugccugagcuguauaauggcuuaauuaauuguugguguuuaugaaguggaaauacacauaguacaaucaguuaauuaguuuucuucacagccugaacauu

SEQ ID NO: 4130855 - RNA, 83 nt, Human
gaugugcuagcagugucuagguaggccaucauucguuuaguaaaacucuauauggauuugcuuauacacaugugcagaauauc

SEQ ID NO: 4130856 - RNA, 72 nt, Human
gauguggaacaguuaagacuaagcuagauuaugaacuccacuuucuggcuucuaugaauguccuuccacuuc

SEQ ID NO: 4130857 - RNA, 70 nt, Human
gcauuaguuuucccaucuuuaugguggaucauaugaagaacacuauaagguucaugugagaauuuaaugc

SEQ ID NO: 4130858 - RNA, 63 nt, Human
gcauuaugccuuagauauugaauggcuagauuuacuaguagcaauggcucugagcuaucuugc

SEQ ID NO: 4130859 - RNA, 55 nt, Human
gcauuauuuacucccacuagagaucaggccucccagucccaggggugagugaugu

SEQ ID NO: 4130860 - RNA, 88 nt, Human
gcauucacccggagccugucauccgcuuccauaaggcagccuuccugggccagugugggcugguggaggacaauuuccugaugaaugu

SEQ ID NO: 4130861 - RNA, 91 nt, Human
gcauucaccuaaggcucugaagcaacccuuugaagaugagagcccaucucaagcagggcaacuuagaaaacuuccuugggauuuugugugc

SEQ ID NO: 4130862 - RNA, 87 nt, Human
gcauucagagccuuucagcagagaaauuacauaaucauauucgugauuaaaaggaucuuuuuggcugcuggguggagaauaaacugc

SEQ ID NO: 4130863 - RNA, 70 nt, Human
gcauucagccuaaagagaaaagggcuuccuuuuaacaauuuccccccuuaaaucuuuuguguugcaaugc

SEQ ID NO: 4130864 - RNA, 67 nt, Human
gcauucauacaucaauaagcuuugcaugcugacaccuaauuuugcaggcuacuuugguuauggaggc

SEQ ID NO: 4130865 - RNA, 56 nt, Human
gcauucaucuaguaucacucugcaccagguagaaaggauauugagaugaauucagc

SEQ ID NO: 4130866 - RNA, 101 nt, Human
gcauuccaaggccucuguggacucaggcacucagcccucgccagggccccgcggguggggcugcugugaccuuugucuuccacaugaaggcgcuggagugc

SEQ ID NO: 4130867 - RNA, 130 nt, Human
gcauuccagcugauucucagccucucagcccugugcucuugaggcagcugaagcuucaaagaguccuccagacucugaggagacacuuaggcucuaacuugcacaggggaggcagaauuagauugggugc

SEQ ID NO: 4130868 - RNA, 71 nt, Human
gcauucccacggaugcuguagcuggcacugcacugggucauaccugaagccagcacaguacugggucuugc

SEQ ID NO: 4130869 - RNA, 90 nt, Human
gcauuccggggcccugaggaugccagcaugggugguccugggcucgcccucuccacagcauggcuggcguuccucgacugccgccggagc

SEQ ID NO: 4130870 - RNA, 75 nt, Human
gcaggcucccucugggcugaguucauggcccugcccccugguggccagagccggcuucacaggauaagagcccgc

SEQ ID NO: 4130871 - RNA, 76 nt, Human
gcaggcuguucagcuaaggaguuucacuguacugugaagaagcacaggcugugaagaaccuagugaaccuuacugu

SEQ ID NO: 4130872 - RNA, 58 nt, Human
gcaggcuuccagccagguagcccaggaggcugggcugcagggguugagagcuccuugc

SEQ ID NO: 4130873 - RNA, 73 nt, Human
gcaggcuuccccuugugcugccagcguggcucccgagccguaagagccagugaucagacagggaggagcuggu

SEQ ID NO: 4130874 - RNA, 73 nt, Human
gcaggcuucucuuaaguguggcaggcagggaacaggcuaacucacccugucuucaugccugaaagaagaaugc

SEQ ID NO: 4130875 - RNA, 60 nt, Human
gcagggaagggaaacagagaccagggaacccaggggacaggaaucucuuucccuuucugc

SEQ ID NO: 4130876 - RNA, 95 nt, Human
gcagggacaaggaggugucugugaugggagcgauccccggacugagcugggcugucugcuggcacgucacagauaauaaaaccgcgucguccugc

SEQ ID NO: 4130877 - RNA, 75 nt, Human
gcagggagcaggaaggccagaagggucaaaauugguaaauuaauggaagggcccugggcccucuagcuuguuagc

SEQ ID NO: 4130878 - RNA, 73 nt, Human
gcagggaggaacucuucagauauacaguacucucaagaucugaagaugggggucugaagguuuacaaccuugu

SEQ ID NO: 4130879 - RNA, 116 nt, Human
gcagggauucuuugacucuuuuguucgcugauauaucacagcuuacugucacagggccugauaucuaguagaugcuguagaaauacuuaugaaugaauggguagggaaccuauugc

SEQ ID NO: 4130880 - RNA, 80 nt, Human
gcagggauuugaagccuccuuauuaaaggauauguuauuaauaauauaaacuuuagcggaaggaggaguggucuuuuugu

SEQ ID NO: 4130881 - RNA, 58 nt, Human
gcagggcaaauggcauuuuuuccugugggcugaccccaaggaaggcuguuggccuugc

SEQ ID NO: 4130882 - RNA, 59 nt, Human
gcagggcaguaagagcuagagucagaagcucgucucuacucaacucucauuaguucugc

SEQ ID NO: 4130883 - RNA, 89 nt, Human
gcagggcaucaaggagagccccauccucgcagaauggaauacggaagaacacacgcacaaucgccaguauguggcugucuuugaccugc

SEQ ID NO: 4130884 - RNA, 79 nt, Human
gcagggcauguggcccaaacggguccagugaaagucaguccugggacuuuggcugggacuauuggggaacagccucugc

SEQ ID NO: 4130885 - RNA, 60 nt, Human
gcagggccgggcacgcagcaggcauucauggagugcugcugauggaugccuggaccgggu

SEQ ID NO: 4130886 - RNA, 63 nt, Human
gcagggcgcugaaauacuaacauggacagauguguuguacauggcuuuauuuucagcuucugu

SEQ ID NO: 4130887 - RNA, 60 nt, Human
gcagggcugggaagcagggggccuuugucaggcucacggccugagguuucuggccucugu

SEQ ID NO: 4130888 - RNA, 65 nt, Human
gcagggcugugugagcucuuacuguucccggcacugaggagucagcagugaaagcacagccaagc

SEQ ID NO: 4130889 - RNA, 57 nt, Human
gcagggcuuuucugcuuugcucuugcuguaaccucagagccuggcaaaagguccugc

SEQ ID NO: 4130890 - RNA, 68 nt, Human
gcaggggcaggaagggagcagcugaugccccaugcugagcagccugcuucccuuugugccccgucugc

SEQ ID NO: 4130891 - RNA, 55 nt, Human
gcaggggcucugggugaugugaggagcaacaggcacccuccuccacagccccugc

SEQ ID NO: 4130892 - RNA, 56 nt, Human
gcagggguagugucuuccugagucuccuuccucaccagacgcugugaggccccugc

SEQ ID NO: 4130893 - RNA, 79 nt, Human
gcagggguguggcuguguggcaaagggauuacaggggcacuaggagugugaugaggcccacacagguaggccccuuugc

SEQ ID NO: 4130894 - RNA, 80 nt, Human
gcagggguuaaagauggagaugaccuaggacagcaccuggcccacaggggacacucuuaguuagcucccuucuucucugc

SEQ ID NO: 4130895 - RNA, 98 nt, Human
gcaggguaacccagccacccgguuugcccuggaccauccugguuuuaacacucaaagucccauguccugggcagaaugggauggcuggccucccuagu

SEQ ID NO: 4130896 - RNA, 56 nt, Human
gcaggguacaugaccuugaaauuucauguuucaugaguauuucuucauguccuugc

SEQ ID NO: 4130897 - RNA, 92 nt, Human
gcaggguacucggagggucaaaaacuucuugcugcauuuucuguuuucgcgcuggacagacuugcccagaagucacccucugagaacacugu

SEQ ID NO: 4130898 - RNA, 84 nt, Human
gcaggguaggcuuccucugagggcugucaggaaaggcucuguuccaggccucucucccugccuugcagauagccacccccaugc

SEQ ID NO: 4130899 - RNA, 81 nt, Human
gcagggucugcuggagguuaguugcagaaggcagagccguguggcauuggcucugcuggugaugaccucauaacacccugc

SEQ ID NO: 4130900 - RNA, 77 nt, Human
gcagggugaggaccagcagccacagcucuuccaggcaagucccugagaugcuaaagggcugcucaagguuuaucugc

SEQ ID NO: 4130901 - RNA, 111 nt, Human
gcagggugugguggcgggagccuguaaucccagcuacuugggaggcugaggcaggagaauugcuugaacccgggaggcagagguugcagugagccgagauuacgccacugc

SEQ ID NO: 4130902 - RNA, 59 nt, Human
gcaggguucagugagguguacuccgcauccaccaggagccgcacgugcugggcccgggc

SEQ ID NO: 4130903 - RNA, 60 nt, Human
gcagguagugggcugccuugaggugauuuucagucuuuguaaggccaagucuauuucugu

SEQ ID NO: 4130904 - RNA, 88 nt, Human
gcagguauucggugcugccuguggcuucugggucaguucaucuaauucuggugcagcagcaggaagcccaggcuggcacucacucugc

SEQ ID NO: 4130905 - RNA, 61 nt, Human
gcagguccgagagggucggguauagggggaccccaaucuugccuguguauuuccggccugc

SEQ ID NO: 4130906 - RNA, 90 nt, Human
gcaggucuguuagguggugggauaugagcaucuggauuccauggucagguuggcauacuucauagggacucucgcaucuaggcauuuugu

SEQ ID NO: 4130907 - RNA, 74 nt, Human
gcaggugaaaucaguuaagaugaggccauacuagaguagggugggcccuaaaucuaaugacugauuguacuugu

SEQ ID NO: 4130908 - RNA, 70 nt, Human
gcaggugaguaagagcaggaauuagacuccuggucugccaggggucuggcucccacucuuacaaaugugc

SEQ ID NO: 4130909 - RNA, 100 nt, Human
gcaggugcauguaugugagcauguguguacaaguauauuguguguacaugugugugcacguguguaugaguguacauaugccacaaguacaugugcgugc

SEQ ID NO: 4130910 - RNA, 55 nt, Human
gcaggugggagccgcugccugauucuagcuacaacagacauagguuccuccuugu

SEQ ID NO: 4130911 - RNA, 79 nt, Human
gcaggugggcucccuggucggcguggugacggcgcgggaccccgacgccgccaaccggcccguccggugagacccccgc

SEQ ID NO: 4130912 - RNA, 94 nt, Human
gcagguggguaaaaguuuuaggcauguaaaggaccccccaaaucacacugcuuuccuuauuauucaaaaugucuucauagcuuauauccagugc

SEQ ID NO: 4130913 - RNA, 55 nt, Human
gcagguggucaguuccagcagucagcuauaguggcuggcuggaguggccaucugu

SEQ ID NO: 4130914 - RNA, 57 nt, Human
gcagguguggauuugcauccagguaaccaccucagguucacacaggucagcaccugc

SEQ ID NO: 4130915 - RNA, 83 nt, Human
gcagguguugugcuauccgcaguggcuguuucuggaaggcaggagccugccuucacuucugcaccacuuagcacagugccugc

SEQ ID NO: 4130916 - RNA, 58 nt, Human
gcagguuagauuuaauccauuccuaacaggagcuggaaucuauagucuacaagccugc

SEQ ID NO: 4130917 - RNA, 69 nt, Human
gcagguugaucagggcuguauguuuuuugaguaggggaaccuagcuuaaggcaggcccuugucuacugc

SEQ ID NO: 4130918 - RNA, 63 nt, Human
gcagguugccacacugaucacaucuggcugcgucuauaagaaagaucaaaguggcaggccugu

SEQ ID NO: 4130919 - RNA, 56 nt, Human
gcagguugguucccaggaccugggggggaccuccagccccgggaaccuggccgugc

SEQ ID NO: 4130920 - RNA, 84 nt, Human
gcagguuuuacuaaagugucagcuaaaacaguuggucccaggaccaguguuagagacugauacaggcaagaagggagagcaagc

SEQ ID NO: 4130921 - RNA, 55 nt, Human
gcaguaagauguuucccagagcacaaacgagugggugggaggauuucuuaauugu

SEQ ID NO: 4130922 - RNA, 57 nt, Human
gcaguacaaacuaaaucuccugcugguaaacacuaggauguuuggcguuugaauugc

SEQ ID NO: 4130923 - RNA, 64 nt, Human
gcaguacauuuauuaaugguaaaauuuggaaauaaauuuugcuguuuguacaaugaaauacugc

SEQ ID NO: 4130924 - RNA, 55 nt, Human
gcaguagcaguauccagaagcagucuucauguucucucugguucauuucugcugu

SEQ ID NO: 4130925 - RNA, 58 nt, Human
gcaguagccagacacucccauaacucuucuugagcuaucagugugaugaggcugcugc

SEQ ID NO: 4130926 - RNA, 58 nt, Human
gcaguagggccuggcccccaaaagcacaagccacuaagcugugucccaggcucaacgc

SEQ ID NO: 4130927 - RNA, 55 nt, Human
gcaguaguucugauuggaacuuuggguaugagagguuucuggccaggaugacugc

SEQ ID NO: 4130928 - RNA, 94 nt, Human
gcaguaucaacaagcacccccaggugcuucuaaugcacagccagguugaaaaaccagugccuuaggguaccuggugcuugucugauuuuucugu

SEQ ID NO: 4130929 - RNA, 69 nt, Human
gcaguaugcuccucuguggugauucacuucugucgugagucucuuacccaagcagaauguaugaagugc

SEQ ID NO: 4130930 - RNA, 74 nt, Human
gcagucagaccucccagcuucagaucucagcggggccaucugcuagcuuuauaaugcugggcgguuuacucugc

SEQ ID NO: 4130931 - RNA, 79 nt, Human
gcagucagccagccagaucagggcagggguugcuguuagcauguugcaucucuuggaaagacuggccaggcaugggggc

SEQ ID NO: 4130932 - RNA, 69 nt, Human
gcagucauuagaggugggcuagguacuauagaacauauugaaccugacaguccuuuucuaguguauugu

SEQ ID NO: 4130933 - RNA, 60 nt, Human
gcaccagcuacuccagggccgugguugugaagaucgagacacgugaugggaagcuggugu

SEQ ID NO: 4130934 - RNA, 58 nt, Human
gcaccaggagcaucuaggaggcggcuuucaagacaggcugugauggcucauugagugc

SEQ ID NO: 4130935 - RNA, 62 nt, Human
gcaccaguguggaaugggagcucugucuuacuuuauauaagcagaguccccuucccaugggc

SEQ ID NO: 4130936 - RNA, 106 nt, Human
gcaccaucaucuggaagcuuguuagagguguggaaucuugagccccauccaaggccuagggagucagaaucuacauuuuaacaagaucuccaggugacuugugugc

SEQ ID NO: 4130937 - RNA, 56 nt, Human
gcauuccuacaggcugcuaugagagccuuaccuaacuuaugguagucacagagugu

SEQ ID NO: 4130938 - RNA, 116 nt, Human
gcauuccugccagugccccuacugcucuugcacauggcaaugcugcucccaggacucaaguggcuuuggacuagcaggcauuggcauguugggcaggguugggggcagcuauaugc

SEQ ID NO: 4130939 - RNA, 60 nt, Human
gcauucucuguugauguuuaccuuugaaauuuugaacaaagcauuguaagcagaagaugc

SEQ ID NO: 4130940 - RNA, 129 nt, Human
gcauucugaaaaacuuuuaaguugacaaacacaguaacaguuuggguuccaauugcacuagaaaauucaguuuaauaacccauagcuuuuauagccaguugauauuuuaaaaaauaaacagauccaugu

SEQ ID NO: 4130941 - RNA, 76 nt, Human
gcauucugacauacauaguauuuuuaguguaaguggaguacaacuuaucuauacacacaaagaaugcuucagaggc

SEQ ID NO: 4130942 - RNA, 58 nt, Human
gcauucuugguggagugcuaaaagugcuacuacacagcauggccuguaaccaaagugc

SEQ ID NO: 4130943 - RNA, 66 nt, Human
gcauugaaauggcaaaaagagaauaaaguucaaucaucacuauuucuuuccuugcugauuucaugc

SEQ ID NO: 4130944 - RNA, 55 nt, Human
gcauugaacuaaauaagcagucauggacgaaguggccagaggauuuguucagugu

SEQ ID NO: 4130945 - RNA, 73 nt, Human
gcauugaacucugaagauugcugcuaacuccaguuuucuuggugucagacacauuucuuucagugauuaaugc

SEQ ID NO: 4130946 - RNA, 80 nt, Human
gcauugaggauggcagugugcucagccagucugauucucuggcugauuuugagaagcacagucugccuuuccuaacuugu

SEQ ID NO: 4130947 - RNA, 81 nt, Human
gcauugcuuauguuguaauugccauuauggauaucuugcaguggccauaaaguauuuggaauggcauuuuuaaaguaaugc

SEQ ID NO: 4130948 - RNA, 71 nt, Human
gcauugcuucucucuucugguccuaauccccccuguggggaaacugaggccagagaggggaccagccuugc

SEQ ID NO: 4130949 - RNA, 106 nt, Human
gcauuggcaucaccugggagauugcuagagaugcagaucccaggcccucgcagauccauggagucaucaccugcauuuuagcaagaguuccaggugauucgugugc

SEQ ID NO: 4130950 - RNA, 55 nt, Human
gcauuggccugaaacugguucagcaucucugcugccacauuuucaggacuaaagc

SEQ ID NO: 4130951 - RNA, 85 nt, Human
gcauuguacaauugaugggugacauuaggaagauagacccauuuuuagggucauaaucacaguuuuaugcacaguuuauaauugc

SEQ ID NO: 4130952 - RNA, 71 nt, Human
gcauuguccaugucaacaggcccagaaaauaagaaaucaaagguauuuuuugcauguugcauggugcaugc

SEQ ID NO: 4130953 - RNA, 58 nt, Human
gcauugugggccugucguggguggggccagcagcacaugcaugccaggcucacagagc

SEQ ID NO: 4130954 - RNA, 70 nt, Human
gcauuguucucccaguccucugugcuuacccucagcacagaggguaagcuaagugauuaggacuacaugc

SEQ ID NO: 4130955 - RNA, 81 nt, Human
gcauuguuguaaacuguguaauaugaugucuaacuuuuccuacuuagcauuauuuuauauaugguuuauaaaacuaugugc

SEQ ID NO: 4130956 - RNA, 81 nt, Human
gcauuguuuauuguuugcagcagacugaguuacguggcuauaauaccacuagagaagcuguuguagcuuguuagaccaugu

SEQ ID NO: 4130957 - RNA, 79 nt, Human
gcauuguuucaauauuugcaucauuagcuauucaguaauuuauaucugggugcaguugcucaaauauucaaagcaaugc

SEQ ID NO: 4130958 - RNA, 69 nt, Human
gcauuuauaaaagauuuuucucaggagacggcuaauaaauuagggcucacugagaugaauauuaaaugu

SEQ ID NO: 4130959 - RNA, 64 nt, Human
gcauuuauuuugugccaagcacuguuccacgcucuuuauaugugcuggcuuauuuaguaaaugu

SEQ ID NO: 4130960 - RNA, 65 nt, Human
gcauuucagacauaccaguuauugaaagcaaauccguuuuaagugacuucucaaugcugaaaagc

SEQ ID NO: 4130961 - RNA, 84 nt, Human
gcauuucagaguuuuguauguaaaauguguaucaguuuucuguugguacauaagaaauuacuacagauuaacuggauuuuaagc

SEQ ID NO: 4130962 - RNA, 78 nt, Human
gcauuucucagauaagaagacugaagcccacucguguuuaguaacauguguaaggucucucagucuaagaucugaugc

SEQ ID NO: 4130963 - RNA, 81 nt, Human
gcauuucugggauaaaucuuguuuagauaaaaauauauuuuauuaugcugaauuugguuugcuauuuuuuaucugaaaugc

SEQ ID NO: 4130964 - RNA, 130 nt, Human
gcauuucuuaaugaaguccugcaugaagcugcugcauuucaaggaccacccugggaacaggaaggcacuaugccagccauccucaguguggucccuggaucagcagcaucugcaucaccugggaacuugc

SEQ ID NO: 4130965 - RNA, 58 nt, Human
gcauuugaaaugcaagaaagugacugguauggcagcccucccugugcauuucaaaugu

SEQ ID NO: 4130966 - RNA, 56 nt, Human
gcauuugacacaggaaaguuguaacuucucagaaguuaaccuuucgacugucaugc

SEQ ID NO: 4130967 - RNA, 91 nt, Human
gcauuugagaaacagguauuuacugagagccacucuguuaaaaacacacuugagacuagagggcugccucagucagcuauccaucaauagc

SEQ ID NO: 4130968 - RNA, 63 nt, Human
gcauuugcagucuggccugcuuugggcuuguuggacacaccccagggcagccaacccagaugc

SEQ ID NO: 4130969 - RNA, 68 nt, Human
gcauuuggaccauugaccugaucuacaaaguugcaauagcucagugagcucaguggauccaauuaggc

SEQ ID NO: 4130970 - RNA, 81 nt, Human
gcauuugguuugauagauguaguuuggcaaaguuacggugaacagugaagggacaggcugccucuauuuaggaucaaaagc

SEQ ID NO: 4130971 - RNA, 69 nt, Human
gcauuuguaaaaguauauggugcaagaauguuauuguuauuaaggcaccauaauauauuuaauguaugc

SEQ ID NO: 4130972 - RNA, 56 nt, Human
gcauuugucugggauuguggauggaugcgcuuccuucccauauaaccagcaagugu

SEQ ID NO: 4130973 - RNA, 57 nt, Human
gcauuuguuggucagauuguagucaacacagaugacucaaguagcccaauuagaugc

SEQ ID NO: 4130974 - RNA, 63 nt, Human
gcauuuuaaugagguuuaugaggaugcagacaaacauaguccccagaaaacccuuugagaugc

SEQ ID NO: 4130975 - RNA, 69 nt, Human
gcauuuuacucuaaaaagaagcagaucuccucagagaaaggacugauucaaauuuagggcaagaaaugu

SEQ ID NO: 4130976 - RNA, 73 nt, Human
gcauuuuacuugguuguuuuaacuuggcaugauaugcacaauaccuugccaguagcaccaaugagaauuuugc

SEQ ID NO: 4130977 - RNA, 84 nt, Human
gcauuuuauauaagccugauucacuugucauuuucaacauguaggugacuguggugacaggauagucagcuuuguaaaaaaugc

SEQ ID NO: 4130978 - RNA, 81 nt, Human
gcauuuucacacauuaucucauuaaauacucaaaauuaccuagucaaguugaguauuaagugagauaaugugugaaguugc

SEQ ID NO: 4130979 - RNA, 84 nt, Human
gcauuuucccaaaugaggaauguuuggcaucucacuuaaaccguggcguccagcagucacaggaaaugcugccuuauuuggugc

SEQ ID NO: 4130980 - RNA, 56 nt, Human
gcauuuuccuagagaauggagcacucuuagcuuuagcaauaucauaaggaagaugc

SEQ ID NO: 4130981 - RNA, 91 nt, Human
gcauuuuuacacauugugggcauuacuguaugaauuauguuauuuagagcucugcaacauaguuacuucauauagcuuuguguagaaaagc

SEQ ID NO: 4130982 - RNA, 60 nt, Human
gcauuuuucugauuuucccuacacuugagaguuguguaggaaacaaaguggaugaaaugu

SEQ ID NO: 4130983 - RNA, 98 nt, Human
gccaaaauaagggaagguggagaugcuuuccaguggggaucugcuccaggauuguaggccccacucccaggguggcaucuaaccaacccccauuuggc

SEQ ID NO: 4130984 - RNA, 57 nt, Human
gccaaaaugcagauuccugggucccagugauucugacucaguacaucuggaguuggc

SEQ ID NO: 4130985 - RNA, 66 nt, Human
gccaaaccaggaacuuuugugagagccauaagaagauacuguuuuuacuaagguugcuaaguuggu

SEQ ID NO: 4130986 - RNA, 86 nt, Human
gccaaaccucagagauucacgucagucccaaagccuccagagaaagaaaauaagccaggccuggggcuggggaucuugagccuggc

SEQ ID NO: 4130987 - RNA, 71 nt, Human
gccaaacucccuagaugacuuuuucuaacucugauuauuuucauuagcaauugugcaucuaguagcuuggc

SEQ ID NO: 4130988 - RNA, 77 nt, Human
gccaaacuuuugacuacugaugguguacgcgugcccuggcagggauggccauugugcugucaguaucaagggauggc

SEQ ID NO: 4130989 - RNA, 67 nt, Human
gccaaauacuggaaucauagaaaacugaguauucuuaucgguaucccugugacucagugauuuuggu

SEQ ID NO: 4130990 - RNA, 58 nt, Human
gccaaauaugguggacaguuugagcaaaaaaaggcugaaauuguacauugaguuuggc

SEQ ID NO: 4130991 - RNA, 71 nt, Human
gccaaaugugaagcagggaaggaaaggaucugaucagaagggacagaacuggcccugaucuucaccauggu

SEQ ID NO: 4130992 - RNA, 77 nt, Human
gccaaauuaaggaaagugccaugauuucuuuggaacuaaucauuaacaagagacauuguuggccuauccucuaaugc

SEQ ID NO: 4130993 - RNA, 63 nt, Human
gccaaauucuagaaggcaaagcaagggaaggaagacuuugcuugcuguaccauucugaauggc

SEQ ID NO: 4130994 - RNA, 89 nt, Human
gccaacuauauucuccuaaacaagacugugaauguugaauaaauccugcauagaggcaggguuaauuuggaauucauucuggagauggc

SEQ ID NO: 4130995 - RNA, 130 nt, Human
gccaacugaauugggaaagagggaggggcacugguggggugcugauggcaucugcuacugaccuaauguugguaagccaucugcugcucuccaguguaacaaccucuucaccucuccccaucucaguuuc

SEQ ID NO: 4130996 - RNA, 76 nt, Human
gccaacugcagaucaugggacugucucagccccauauguaucugaaggcugagaagucccaugauccgcacuuggc

SEQ ID NO: 4130997 - RNA, 92 nt, Human
gccaacuuauaacugauuauguuuguagacuuucuuuguguuaguguuucuuacggguuauacuuauaaagcaagaucuauguuguuauggc

SEQ ID NO: 4130998 - RNA, 58 nt, Human
gccaagacguggcaggacuggacgcacacagaucuguugauccuuucccccauguugc

SEQ ID NO: 4130999 - RNA, 62 nt, Human
gccaagccaagaaucaugagcuaauaaacauggauguuuaagacucuaaauuuugggguggu

SEQ ID NO: 4131000 - RNA, 69 nt, Human
gccaagccaccagcucuguccugacuuuggggcaaaaccccacaaggaggacagcaguuggggcugagu

SEQ ID NO: 4131001 - RNA, 56 nt, Human
gccaagcugccugaggcaaauuugcauguguuagguuuaacucaggcaacuuaggu

SEQ ID NO: 4131002 - RNA, 65 nt, Human
gccaaggauauuuucauucggaugcucacauaugacugaguugccacaugaggaugauccguggc

SEQ ID NO: 4131003 - RNA, 76 nt, Human
gccaaggauggaauggcuuuuccugacugggaguguccucaucacagacuuuugcucaggcaucauucuuccuggc

SEQ ID NO: 4131004 - RNA, 63 nt, Human
gccaaggccaccaccagcgagggggcgcggggagagccauccucccugguggugccuacacgc

SEQ ID NO: 4131005 - RNA, 94 nt, Human
gccaaggccggcuccacaggcagccucagggcacccgaccccggccugaagcccaaguccccuccugaggcccuguuagggucuugccuccggc

SEQ ID NO: 4131006 - RNA, 69 nt, Human
gccaaggcuccagguuuaaggguauguucaagguugucaugaucacauucccuuggcuugaagcagggc

SEQ ID NO: 4131007 - RNA, 59 nt, Human
gcccaggaucugcucagaucauaggcaaccuugaagcacucagcaguuccgcuuugggc

SEQ ID NO: 4131008 - RNA, 101 nt, Human
gcaguggagguuacccagagggacuucugaggcgcgaucauaagaggccuaggagcaucuguucuggccucuugggaugcucccucugggaacccagcugu

SEQ ID NO: 4131009 - RNA, 60 nt, Human
gcaguggcaaaggcucuaggcccagacuaucuggaaucaaauccuggcuuuucuacuugc

SEQ ID NO: 4131010 - RNA, 69 nt, Human
gcaguggcaggagacuggaagauggggagaaagagugaagcccuuccuagccuuucugucugccgcagc

SEQ ID NO: 4131011 - RNA, 61 nt, Human
gcaguggccgcggggcuguggguccugugcacggugaucgcagaaggccccccggcgcugc

SEQ ID NO: 4131012 - RNA, 61 nt, Human
gcagugggaggaagagaugccucuagauauagggugauuagaacaucucucuucugccagc

SEQ ID NO: 4131013 - RNA, 65 nt, Human
gcagugggaggauaaacucccucagccucuuacaguaggagcuggagaauucuuccuuccacugu

SEQ ID NO: 4131014 - RNA, 77 nt, Human
gcaguggguccuggaaggcgacagguuuuaaaugaguguuuucauuccucgccugcgguuuggcgggacagcgcugc

SEQ ID NO: 4131015 - RNA, 82 nt, Human
gcaguggguggaaugggagguaguaugggagguggcauguucuaacuccuagaauagugcuuuaccuuuauucaugaacugu

SEQ ID NO: 4131016 - RNA, 110 nt, Human
gcagugguaaugagaucuucaggcaguggccauguugggaguugagcaauggaugcucucuucagggugacgcaggcugcagcugccuuguaguucauguuaccuacagc

SEQ ID NO: 4131017 - RNA, 77 nt, Human
gcaguggucacuaauuuucaggaccaaggccacacaaaaugucaggccuagggagaaaauucaucugugcccacugc

SEQ ID NO: 4131018 - RNA, 88 nt, Human
gcaguggugauguauggggcgugagagcagcguuuguggaacacuuuuuuggagaguagggcuguguuuuugcugucguuaccacugc

SEQ ID NO: 4131019 - RNA, 101 nt, Human
gcaguguacagguccaauuccauuauuugcucaauaauaguuuuaugcuuaggcucagcguaugaggcugauaauuguggcaugauaagacugcacagugc

SEQ ID NO: 4131020 - RNA, 103 nt, Human
gcagugucaugcucuguccugucuucaggaccuggaauuuuggggucugagugacaccagcauucacuggaccugcagagaaggagaacaaagcugaugcugc

SEQ ID NO: 4131021 - RNA, 58 nt, Human
gcaguguguuuauccggccacacccugaggucagggcugcuugcuggagacagacugc

SEQ ID NO: 4131022 - RNA, 56 nt, Human
gcaguguugacuaugguaugagugccuucuguggccaacuagauuuucaaugcugu

SEQ ID NO: 4131023 - RNA, 64 nt, Human
gcaguuaagugcacagcaguagagcuuggaaaaggucuaggcuuaaguccugaauuuaugcugc

SEQ ID NO: 4131024 - RNA, 61 nt, Human
gcaguuaaugugggccaaguucuucaaguucuucacccagugccuggcacauauuaacuuc

SEQ ID NO: 4131025 - RNA, 67 nt, Human
gcaguuacagagaauaaggagcacuuaaugcagaaccuugcagaguucugaauuuuauucucucugc

SEQ ID NO: 4131026 - RNA, 66 nt, Human
gcaguuacaugacugccggcggugcugcaauuaugauugaugcaugcgucuggagucugaggcugc

SEQ ID NO: 4131027 - RNA, 79 nt, Human
gcaguuacucagaauguucaucuacaaggcauuguuaggccuuuaugauaauuacuguggauagaauuauagugauggu

SEQ ID NO: 4131028 - RNA, 96 nt, Human
gcaguuauucuguucguuucucucuguugucccagaccugcacaucaucuggcacuggauaaucacagaggagcaucccaucagaaugauuccugc

SEQ ID NO: 4131029 - RNA, 77 nt, Human
gcaguuccacuacacagcucugagauauuacuauugguacuauuaauagcaacuuuuauugagggcuuaguguaugc

SEQ ID NO: 4131030 - RNA, 70 nt, Human
gcaguuccauuuucaucucauguauaaauuggaguuucaccauuuagaaaaaauguuugaaaagggcugu

SEQ ID NO: 4131031 - RNA, 64 nt, Human
gcaguucccaaggcuagaaguccaacaucaagauguugaugggacguucucccucugaagcugc

SEQ ID NO: 4131032 - RNA, 70 nt, Human
gcaguuccucugcuaguuuugccugggcuuauucaugcaucagcaaggcagucagcuggcugggaggugc

SEQ ID NO: 4131033 - RNA, 81 nt, Human
gcaguucugagacuucauucaguaaaagcugcagacauauuugaaccagcuggucaacugaaugaacaugagcucaacugu

SEQ ID NO: 4131034 - RNA, 69 nt, Human
gcaguucuggagauggauaauggugauaguugcacaauaaugugaacguaguuaaugccacugaacugu

SEQ ID NO: 4131035 - RNA, 64 nt, Human
gcaguugaagauccgugaggugcccagaagauuaugcagucaucagucccacggagcagcccgc

SEQ ID NO: 4131036 - RNA, 60 nt, Human
gcaguuggagcuggggagcaaacuuucuauacccugaacacugaccccacgcuccagagc

SEQ ID NO: 4131037 - RNA, 79 nt, Human
gcaguuguaugaaauaggauuuuuggaaauacugguaacuaaaccucuccuuugaaaagaucuaugggcauuuagcugu

SEQ ID NO: 4131038 - RNA, 66 nt, Human
gcaguuguccacgggcccuuccaaguuaaacauuacucauggcgacaagagcccgcagggcagugc

SEQ ID NO: 4131039 - RNA, 82 nt, Human
gcaguuguggcaaauuaucauuuucauagauuuuuguauauucaguauauugaaaugaaugacagugauuaugccuuacugu

SEQ ID NO: 4131040 - RNA, 56 nt, Human
gcaguugugguuucguuuccuuuuggaaucuucaaaggcagcgauuuucauauugc

SEQ ID NO: 4131041 - RNA, 88 nt, Human
gcaguuuacaaagcauucucuucuguugcuucauuugauucucccauccaccuuguguguaugaggggagaauguuuucauacuuugc

SEQ ID NO: 4131042 - RNA, 90 nt, Human
gcaguuuaugagacaccuugagggcugagaccauguuugucuugugggcaagacaugcauaggagaagucuuuauaagugagaugagugu

SEQ ID NO: 4131043 - RNA, 67 nt, Human
gcaguuucagaaaaauauggccauuuuauaauggucaaauuuagucucuggaagaugaauaaacugc

SEQ ID NO: 4131044 - RNA, 103 nt, Human
gcaguuuuagagaugaaauugcuaggagauuuuaauaauuauagaugaguuguccuacauuugaaaccuggaaucuaccagcaugauuuaucuaccaauuugc

SEQ ID NO: 4131045 - RNA, 59 nt, Human
gcauaagccucucucuccaucugcucauuuuccacaaaaguagacagacagguuugugc

SEQ ID NO: 4131046 - RNA, 98 nt, Human
gcauaauacaugaaaaauuggagcaggugcucaggguaauaauuuguauaaauagcuauugccuuacacuagcaucuaaauuauaaucauuaacuagc

SEQ ID NO: 4131047 - RNA, 73 nt, Human
gcauaauauuuucagagaugcucaacucauccugagccuaaagggauauggauauucucugaauauuuuaugu

SEQ ID NO: 4131048 - RNA, 82 nt, Human
gcauaaucauaagcuucaaagauucacaguuucauugugcucaaugcucuugugaaaugacagucuuaagcucugauucugu

SEQ ID NO: 4131049 - RNA, 58 nt, Human
gcauaauggauaagagcacagauguuggagcaaaccugcauuugaaucuccauucugc

SEQ ID NO: 4131050 - RNA, 74 nt, Human
gcauaauuauugcaaguggcauaaaauuuagaccagugaguaacugagcaaauguucuacuuugauaauuaugu

SEQ ID NO: 4131051 - RNA, 124 nt, Human
gcauacaguauauacuguguguagaguauauacugcauacaguauauacuguguguagaguauauacugcauacaguauauacuguguguagaguauauacugcauacaguauauacugugugu

SEQ ID NO: 4131052 - RNA, 61 nt, Human
gcauaccacaauuauuuugcuaagcucagccucugaagugcaaaaaaguguugugacaugc

SEQ ID NO: 4131053 - RNA, 107 nt, Human
gcauaccuugucccuacaaaaguaugcagcacacaauagguacccagcaaauauuugcugaacuuauugagugcuugcuaagugacugaaagggagagagugugugc

SEQ ID NO: 4131054 - RNA, 63 nt, Human
gcauacugagauguuaauagggugugcaauuuggugucaugcuuuauucgacaucugguaggc

SEQ ID NO: 4131055 - RNA, 59 nt, Human
gcauagaggugccaggcaaguuucaaugcccguuggagcccugcccuaggcagcucugc

SEQ ID NO: 4131056 - RNA, 81 nt, Human
gcauagaguaggcuucaggaaauauacauuuaaugaauaaauaagucaauagauaagugaccuuugauuccuacuaugugc

SEQ ID NO: 4131057 - RNA, 71 nt, Human
gcauaggagugcaaauaguccagagaaaagaucagacuguuuccucugguuauacuugcacccagccaugc

SEQ ID NO: 4131058 - RNA, 68 nt, Human
gcauaggaugcuagauuuaugaguuuggaaagaucugagauggagguauaagucuggcauauguaugc

SEQ ID NO: 4131059 - RNA, 61 nt, Human
gcauaggauguuucucugugguuccuagagauggaguucacugaagagaagcauuuucugc

SEQ ID NO: 4131060 - RNA, 79 nt, Human
gcauaguguuggagagccaugcucaaggccacacgcuguucuaaggcccaaagccagugugcucucccaguguuuuugc

SEQ ID NO: 4131061 - RNA, 88 nt, Human
gcauauacacagagagucccuuccugauaaugagauuuucccugcuuagacuggaggaaaauauucagggagguuucuguuauauagc

SEQ ID NO: 4131062 - RNA, 85 nt, Human
gcauauacuuugcgaugaauuguuugaaaaguggagauuuauuaaaugaggaaagauuccuuuugaagcuuuuugugcaguaugc

SEQ ID NO: 4131063 - RNA, 73 nt, Human
gcauaucaccuagcagagcacuacugcauuaauaauucaucacuuaauguguacaggccuugcuagacucugc

SEQ ID NO: 4131064 - RNA, 109 nt, Human
gcauaugagucuccuggacauuuuguuaaaaaugcagauuccuauucuacagcucuaggacaggccugagauuuugcauuuuucacaaguuccuaggugauggugaugc

SEQ ID NO: 4131065 - RNA, 61 nt, Human
gcauauggccuuaucacuaugcuguuggacaacagauacgaugaauagagagcacauaugc

SEQ ID NO: 4131066 - RNA, 61 nt, Human
gcauaugggguggaauacuuacuugacucagagccccugagagagcaggccacacaugugu

SEQ ID NO: 4131067 - RNA, 65 nt, Human
gcauauguuacauuguugccucccuuucugcccuuggccugcaggaggcccagugaauauauugc

SEQ ID NO: 4131068 - RNA, 61 nt, Human
gcauauuaguaaucuuucaacaagcauuagcuguuauugcuguugaugaugaugaugaugc

SEQ ID NO: 4131069 - RNA, 68 nt, Human
gcauauuuaagccauuagacaugcaggaauguuaacauuauuaugcguuauugugucuggcuaugugu

SEQ ID NO: 4131070 - RNA, 108 nt, Human
gcaucaacaucaccuucaagcuuguuacaaaugcggaguuugugguaucauuccaaacuacugacccaaagucugcauuuuaacaugauucgaaggugacguauaugc

SEQ ID NO: 4131071 - RNA, 69 nt, Human
gcaccaugacauuuuaauuuucacuuagugagaacuagugauuuugcuuugaagugacagcaugugugu

SEQ ID NO: 4131072 - RNA, 68 nt, Human
gcaccaugcagguguaaauuuucaagagcucagaaggaacucuuugaucccuuacacacucaugaugc

SEQ ID NO: 4131073 - RNA, 95 nt, Human
gcaccaugucuggggcaguucaggaaaucaagaagcagaugagugaauauuauuuuucugucugaucaugauuguuucuacugcuagcuuguugc

SEQ ID NO: 4131074 - RNA, 62 nt, Human
gcacccagagggcagggucuccaugguagaccaaaguccccuuaaacaugcucucuuggggc

SEQ ID NO: 4131075 - RNA, 55 nt, Human
gcacccagaggucagcagugcuuucauaaaaaggagggcugcucguagugggugu

SEQ ID NO: 4131076 - RNA, 66 nt, Human
gcacccaguaagcaugaggcccugggcgcagcacgccuucaggagcugguagucucauugggaugu

SEQ ID NO: 4131077 - RNA, 60 nt, Human
gcacccaugaguagggaacuguagacuuuucguugucuucuuuauaaaucaaugggaugu

SEQ ID NO: 4131078 - RNA, 118 nt, Human
gcacccccucuacuguuacagcagugguuuucaacuagaggugauuuugccccccaggugaccuuuggcaaggccugcagacauuuuugguugucacaacugauggggagggggaugu

SEQ ID NO: 4131079 - RNA, 85 nt, Human
gcaccccucaagaggguugggaaggcaagaaguagaagcagcugcuuccuuuuuuguccuucccagauacccaugaugagggggc

SEQ ID NO: 4131080 - RNA, 58 nt, Human
gcacccugcccugucacuggcuagggcugggaggcucuguagaaacagggcagaaggc

SEQ ID NO: 4131081 - RNA, 61 nt, Human
gcacccugcucuauccuugcuauaugggauggguaagaauguaacaggauaaguaggaugc

SEQ ID NO: 4131082 - RNA, 71 nt, Human
gcauccccuucagcuguucucuugggcaugcuggcaacggcagugggacaugggcacugggcgugggaugc

SEQ ID NO: 4131083 - RNA, 60 nt, Human
gcaucccgaggagcugggauuacaggcaccuuacaggccucccagagugcuugggacugc

SEQ ID NO: 4131084 - RNA, 108 nt, Human
gcauccgugguccagcuuagcugaggggaggagaaggaaguugagccagcaucccacagaggacccuggcagccuucuguccugagagcuaagcugggccauggaggc

SEQ ID NO: 4131085 - RNA, 78 nt, Human
gcauccucugagccuguguuucucuggcagguggaucaauuacuuccacaugucuuggaaggcaggcuuuccacaugu

SEQ ID NO: 4131086 - RNA, 67 nt, Human
gcauccugagugaaaugaaugauuacauggcuuuaauuugaaauacauucagcagugcucaugaugc

SEQ ID NO: 4131087 - RNA, 69 nt, Human
gcauccugucugggcuugaguauuuacuauguaguaggugagugaaaaaagccugagauacuuggaagu

SEQ ID NO: 4131088 - RNA, 129 nt, Human
gcauccuguggcucggccggguccacgggggucagcgccggcuugaggcaggcggcaggcagcucgccuucgcccagcuccaggcuggccugcuugcugcugaaggagucccgcaggcugagcagcugc

SEQ ID NO: 4131089 - RNA, 82 nt, Human
gcaucgaauacaagcauacucauuccagacucucccggaucgugcguggcagguggggauggggugaggcuguggcuggugc

SEQ ID NO: 4131090 - RNA, 103 nt, Human
gcaucgucacagcaagaucccugaauuauaaacuagugacuucagaguuaauuuuccuucuuucggucuaauuuguaaccagggagcauuguauggcacaugc

SEQ ID NO: 4131091 - RNA, 88 nt, Human
gcaucuagagaggcacacacgcagcggcgcucugcgaaacgucuguguuucacaugguacugccuguuugccugucggcucucaaugc

SEQ ID NO: 4131092 - RNA, 55 nt, Human
gcaucuccagcuggcugugauaaaucugcauuuuguaccagcaaguagggagagu

SEQ ID NO: 4131093 - RNA, 57 nt, Human
gcaucucuacaacgaagacagucuuugaaggcuguuuucaaagagagagaaugaugc

SEQ ID NO: 4131094 - RNA, 58 nt, Human
gcaucucugauggugguggcuggaggugacaguggcccaguggccacugcagagaugc

SEQ ID NO: 4131095 - RNA, 78 nt, Human
gcaucugaauauagaaucaucugugcacuaguaaauuaagcuguauacuagucauuuaggugauauuauaacagaugu

SEQ ID NO: 4131096 - RNA, 59 nt, Human
gcaucugccuuugucauuggcuacaaaaagaaugggccaccuggacucugggcaggugc

SEQ ID NO: 4131097 - RNA, 126 nt, Human
gcaucugguggcugcuuaaguaguaacccugcugcaggcuucaggaggagcaaaucacaacaucuguguuucuccagcaaaacagcagggcuauuaaaauagcucuuaggcacaaucuaucacugc

SEQ ID NO: 4131098 - RNA, 83 nt, Human
gcaucuuaaccugacugcucuuuagaauuagggagcaucuuuaaaaaauuccauucugauucauuaggucuagggaagggugc

SEQ ID NO: 4131099 - RNA, 90 nt, Human
gcaucuucaugugacuuauggucccagugucgccucuagggucaccagcaucuagaggugacacugagaccauaacucaccuguaggugc

SEQ ID NO: 4131100 - RNA, 68 nt, Human
gcaucuuggcccccuguuuguggccugaccacccugagaggucccacaccuugaggggucuugggugc

SEQ ID NO: 4131101 - RNA, 66 nt, Human
gcaucuuuggcuugcacuauuacacuguuagucuucuuuguaagugugucuguguaaccgaaaugu

SEQ ID NO: 4131102 - RNA, 119 nt, Human
gcaugaaaaucuuuuaucuacuuaaugaaaucgaauucuggugcacuuuguuccugguugucagcacuaacauuaacaccgugaguuugguuuuggugcaguuaaggauuuuaucaugc

SEQ ID NO: 4131103 - RNA, 65 nt, Human
gcaugaaucaugacucaaaauuauuguuuugcuuucugauugggccagugugagucacaucaugc

SEQ ID NO: 4131104 - RNA, 82 nt, Human
gcaugaaugaauacaaaaaguggugaguguauacucuaaagugguuauauacuaagcucauuacauuuuggcuuaugacugc

SEQ ID NO: 4131105 - RNA, 69 nt, Human
gcaugacagcauucaagacauagaguuagcaacugaagcuuaaaccucugugugugugugugugugugu

SEQ ID NO: 4131106 - RNA, 68 nt, Human
gcaugacagguguuuguaguggcaagaugauaguaacuguagcuaccauuauugagcaccuacugugu

SEQ ID NO: 4131107 - RNA, 65 nt, Human
gcaugaccuggggucaccaaaacugccugcuacccagcagcagcagaagggagacccagguuggc

SEQ ID NO: 4131108 - RNA, 128 nt, Human
gcaugagaaggaccuggagugcuugcugaaauucagauuccuaggcaucacccagaccaacagaaucaaucauccuggcagggcccaggaguuugcauuuuaacaaguuccccaggugauuuuuaugc

SEQ ID NO: 4131109 - RNA, 102 nt, Human
gcaugagaggucuggggcugcagacuggggccugagaguucucugcuucucauagcugcugucacacauggccccagcuuucacuucccaggcuccucaugc

SEQ ID NO: 4131110 - RNA, 71 nt, Human
gcaugagagugccuuguaaaccugcccugcugcagcaaugagggcauggcuucugccaggcaccuguaagc

SEQ ID NO: 4131111 - RNA, 55 nt, Human
gcaugagccauuucuccaaggaucccuguucuuuccaauuugaaaugguauaugu

SEQ ID NO: 4131112 - RNA, 84 nt, Human
gcaugaggccagggauauaccauaaugucugacacaguaagauaucaguaucugcuuguuaaauguugauuccugcuuuauugc

SEQ ID NO: 4131113 - RNA, 58 nt, Human
gcaugauauuccaaggugugaaguuuugguuugagaacuuuacuauuuugaauaaugc

SEQ ID NO: 4131114 - RNA, 59 nt, Human
gcaugaugaaggaggaggagucagacagcccuagacuuuaauuuccacuucuaucaugc

SEQ ID NO: 4131115 - RNA, 95 nt, Human
gcaugaugaggacacuauacugcucuguuuucguauguuuucaauguuccacgacaaacauguuuagaaagcagcugaagcaucuucuuuuaugc

SEQ ID NO: 4131116 - RNA, 100 nt, Human
gcaugauggugguugccuguaaucucagcuacucgggaggcugaagcaggagaauugcuugaaccugggagguggagguugcagugagccaagaucaugc

SEQ ID NO: 4131117 - RNA, 71 nt, Human
gcaugauguuugggcugguuugccaugcccccaggucucagagggguaugcaggugggccuagaugcaugu

SEQ ID NO: 4131118 - RNA, 64 nt, Human
gcaugcacaggcugugggcugguuucagcucuucuccugcgaacuagcuaggcagccugucagc

SEQ ID NO: 4131119 - RNA, 72 nt, Human
gcaugccaaaaaauaaugugugcugcagucuuaaaggaauuuagaggcuuguagcaucauugaguugacagc

SEQ ID NO: 4131120 - RNA, 57 nt, Human
gcaugcggaucucaucacugugauuacaccguguuagccacagugauuguucuaugc

SEQ ID NO: 4131121 - RNA, 116 nt, Human
gcaugcggccaauccuagaggcugguggagcuguggccacgaccacaccucuccccccaucuauggugagggucagccccaaauaguuuccuccgucuuaagaauaggcaacaagc

SEQ ID NO: 4131122 - RNA, 59 nt, Human
gcaugcucaguagccuaguuguuuacuaccuguaauaauuggcuaacccugggaagggc

SEQ ID NO: 4131123 - RNA, 62 nt, Human
gcaugcuccacgcuugugagcgaugucugucugccugccaaaagaagcugcuggaugcaugc

SEQ ID NO: 4131124 - RNA, 58 nt, Human
gcaugcuccagugugaugcuucauugagugcacagucaaaagagcccuuggagcaggc

SEQ ID NO: 4131125 - RNA, 68 nt, Human
gcaugcugauaggaguuaauggugaugcagaauauuuguuuacauuuaguacaacuuuuacagugugu

SEQ ID NO: 4131126 - RNA, 70 nt, Human
gcaugcugcaucaggccaauuaagaaugaaguauacuuacaaauuuugcauugccucugauaagguuugc

SEQ ID NO: 4131127 - RNA, 59 nt, Human
gcaugcuggaauauuuuauuugguggcuggaugugcuaugaugaaauuuucuaucaugu

SEQ ID NO: 4131128 - RNA, 90 nt, Human
gcaugcuguuucuuuccugccagaagguuccugcugcagcucuccugcuaguuuagcuuagccuucugguuugagggaugagucacaugu

SEQ ID NO: 4131129 - RNA, 124 nt, Human
gcaugcuuccaaaacgcaucaauggcagcucuuuuguguauauacuuucuuccuggguagauagaauuuaacugccucaagguaugugguagaauaguagccauucaguuuuugguuaauaugc

SEQ ID NO: 4131130 - RNA, 84 nt, Human
gcauggaaggcaauguaaauuacagcuuaaugcacguacaguguagucagacaggcugagcuugcaucccagccuuacuacugu

SEQ ID NO: 4131131 - RNA, 62 nt, Human
gcauggaucugaggcaagacacugucagguuacaccugcaggaagcuggucagauccugugu

SEQ ID NO: 4131132 - RNA, 88 nt, Human
gcauggaugagcacauggcaggggcagcagguaaagaaagaccaccuggaacccugugccugcugccacugcuguuacugauccaagu

SEQ ID NO: 4131133 - RNA, 75 nt, Human
gccaagggcgggugggugggcgaagaugggggucacagccucucucccucccaucccuccuccaccagcuagggc

SEQ ID NO: 4131134 - RNA, 57 nt, Human
gccaagggggcagugcaugggugaccucaugggaacauccaguccuaucuguuuggc

SEQ ID NO: 4131135 - RNA, 61 nt, Human
gccaaggugcuccaggucgcucagagagucuucaggauuccugagucgccgagucuauggc

SEQ ID NO: 4131136 - RNA, 66 nt, Human
gccaagucacagcugcuuucuugcaagaggcuucauggugucugagaaaucaguggugaauauggu

SEQ ID NO: 4131137 - RNA, 60 nt, Human
gccaaucaggaggcuguacaucagggcgggggcgggaggagcugcagcuuugugauuggc

SEQ ID NO: 4131138 - RNA, 76 nt, Human
gccaaugaaggguuuggagcagcacaguggucaggcagaccaagcugacucccagcuguuuccccuucacaguggc

SEQ ID NO: 4131139 - RNA, 67 nt, Human
gccaauguguuuucucgcuauuuaucaaaucuuuuauacucugaugacuaauggaaaauacaauggc

SEQ ID NO: 4131140 - RNA, 98 nt, Human
gccaauuccaaauaagagacucuaaguggucaggguuguuacugugugaggcagccuggcaguaauaccccuggcucagguuggggccucaugguggc

SEQ ID NO: 4131141 - RNA, 72 nt, Human
gccaauuucuagauauugccuucagaugaggaaaugagaaaauuuucaauaaggcaacauuaaguuaauggc

SEQ ID NO: 4131142 - RNA, 106 nt, Human
gccacaaaaauuagagacuacgguuugacacggugcgucuucagaaacagggacauuuucugccauccugagaugcuacuugucacauaaagcuucaauuuguagc

SEQ ID NO: 4131143 - RNA, 81 nt, Human
gccacaauaagguauuauugucuauguacuagaacagauaagguaauaauuuaaaauauggcgaugauacccaaugcuggc

SEQ ID NO: 4131144 - RNA, 71 nt, Human
gccacacaaaaguaggaggcaggcggauuuggcccacuggccauaguugauugauuccuccugcuuuaggc

SEQ ID NO: 4131145 - RNA, 67 nt, Human
gccacacuggcucugugcuucuaguaucugcauuuaaugcuuagauucuaccagagcuaguuugggc

SEQ ID NO: 4131146 - RNA, 69 nt, Human
gccacagagcaggcacucagcacacagagcagcagacaugcuauguguuugacacccugcaagacuggc

SEQ ID NO: 4131147 - RNA, 71 nt, Human
gccacagcagucuuucacuaaauaaaggagaaaagugucuuucccauguaagugacagaggcugugguggc

SEQ ID NO: 4131148 - RNA, 74 nt, Human
gccacagccaugugggcagugaugggugaguguguccugcaacuggacguuuaaccagcacgcuuggccguggc

SEQ ID NO: 4131149 - RNA, 82 nt, Human
gccacagcuuugggauucuguaaagauaaaagaugcaccagagggauuccuaaaugcuuugucuucauccuucgagcugggc

SEQ ID NO: 4131150 - RNA, 71 nt, Human
gccacagggcagaugcgcagaguaacuauuauucauuuugcaaccugcacucugucuuuaauaacuguggu

SEQ ID NO: 4131151 - RNA, 56 nt, Human
gccacagguaagaguguaaagcaaaguuugacuuagcuugccuuccuaucuuuggc

SEQ ID NO: 4131152 - RNA, 55 nt, Human
gccacagguaggaaccuaccuccugaaaggcuggugcuaugcuuuaccugugugc

SEQ ID NO: 4131153 - RNA, 81 nt, Human
gccacaugacuugggggccugagaagcagagccugcaggagccaggccugcugucuugaggccaagaggggaagggugugc

SEQ ID NO: 4131154 - RNA, 105 nt, Human
gccacaugccaggcagucuuacaugcuagggccucaggccuugcucugugagaguuuucucauaguuuaaugccugggcuagcaaauggauugauuggaaguggc

SEQ ID NO: 4131155 - RNA, 100 nt, Human
ggcugggggccaggcgggcagaacagggccagggccaccuccuaauguccugauguucugggcagugguggcccuucccuuccccuggggucccccugcc

SEQ ID NO: 4131156 - RNA, 62 nt, Human
ggcugggggugagcagcagcgacggugccaucggcugucgcaucggcguccucagccccgcc

SEQ ID NO: 4131157 - RNA, 74 nt, Human
ggcugggguugcagucauauugaggcugcacagagccuggaggcuccagcacccaauguggcuaagcucuggcu

SEQ ID NO: 4131158 - RNA, 130 nt, Human
ggcuggguaaaggagaaccugaugggaaagaagcaaugauuuagcugagccaucauugaugacaggagcuuuuaaugaugugugcugaucaagcuucugggacauuuaccucuuucuugcuggugauuuc

SEQ ID NO: 4131159 - RNA, 85 nt, Human
ggcugguaaaggccaacuuugacagguauagggccaggcagcccugggccuggaguuuguccagagugguggaaagcagccaguc

SEQ ID NO: 4131160 - RNA, 69 nt, Human
ggcugguaugaggaguauggcaguaaacaugacagauucugucccuacuguucaugccuucauaaagcu

SEQ ID NO: 4131161 - RNA, 122 nt, Human
ggcuggucugauuucuagguccuucucccagggcauguggacuuguauguuugacugaaguuccauaagccaaugcuagcccacaugcaagggugacagccaccacuuagccaucacuagcc

SEQ ID NO: 4131162 - RNA, 62 nt, Human
ggcuggugagguggcuggaucucagccuggcgggccagcugaggaaccagucccugcuagcc

SEQ ID NO: 4131163 - RNA, 57 nt, Human
ggcuggugcucaggaaguguuuuugaggugaucuugagaguucuugcugagcaagcc

SEQ ID NO: 4131164 - RNA, 106 nt, Human
ggcugguguguggccccugggugugcaugggggcagcuccaggaauuggggacccuuacaguccucugcaacaccccuucacaccccgggagcccacaccucugcc

SEQ ID NO: 4131165 - RNA, 73 nt, Human
ggcugguguuguccgggugagaguuaguuagaagggcaguaucaguucccacuccuggccuggacugcucccc

SEQ ID NO: 4131166 - RNA, 68 nt, Human
ggcugguuuagaccaaucauaauuuaucccuggcccugggaugaaucacgauugguuuaaacccaucc

SEQ ID NO: 4131167 - RNA, 61 nt, Human
ggcuguagagaggcuuugucagcuggacccaguaggacucagcugcuuccuccugccugcc

SEQ ID NO: 4131168 - RNA, 57 nt, Human
ggcuguagucagugacaugguaaaaagcacgaggcugcugugguaaugacuauaucu

SEQ ID NO: 4131169 - RNA, 94 nt, Human
ggcugucacgcugcccguuguccugugauuccagcucuucucccagggugacagaggacugaaacuuacaggaaaggagcucugaugacagacc

SEQ ID NO: 4131170 - RNA, 70 nt, Human
ggcugucucucuuuuguucuauguuguaucuucagcucccagcaacaugggacagagaaagaggccugcc

SEQ ID NO: 4131171 - RNA, 73 nt, Human
ggcugucugcccggcuucaggagauacaguccagccuccuuggugacugugugaggcugggugagucacugcc

SEQ ID NO: 4131172 - RNA, 86 nt, Human
ggcugucugcugccuggccaggccucuuggugcccacugugcuccugauuaguuggcgccggcaauggcaggagcagcagacggcc

SEQ ID NO: 4131173 - RNA, 96 nt, Human
ggcugucuuccuguggcugcuccuggguggucaggcccuguguucgaggcggcuuugacugugacugucccgggugcagccaucacuaacccagcc

SEQ ID NO: 4131174 - RNA, 59 nt, Human
ggcugugaaguacguugaagguggaucuugucacaugccccuucaguguucaccuggcc

SEQ ID NO: 4131175 - RNA, 67 nt, Human
ggcugugacccccacaggggugucccuaggcacacacucugcccugucacccauguggguuccagcc

SEQ ID NO: 4131176 - RNA, 75 nt, Human
ggcugugaggaggcagagcguucaguugguaaaugagggaggagccagcugacgaugccuggucucuccauuucc

SEQ ID NO: 4131177 - RNA, 57 nt, Human
ggcugugauugguggaugugaauuccuucugcugaaucaugccaccacucugcagcc

SEQ ID NO: 4131178 - RNA, 63 nt, Human
ggcugugcagggcagagucucaacacaggaauuggaacauaacaaaucugccgacugccagcu

SEQ ID NO: 4131179 - RNA, 70 nt, Human
ggcugugcuaaggacugggaggcaggggaaugagcccaccugcugcuccuggccuuuggaggcugcagcc

SEQ ID NO: 4131180 - RNA, 67 nt, Human
ggcuguggcaggcgugcauugaggacugugagggugacaacagagacugggaugccugccuuuggcu

SEQ ID NO: 4131181 - RNA, 60 nt, Human
ggcuguggccaaacaccaguuuaggauuuuuccuuccuuucuaguuuugcugccacuucc

SEQ ID NO: 4131182 - RNA, 97 nt, Human
ggcuguguuguucccauguggggcugucaggcaacugguaagcacgccuuguguccccagccagaugauaagcucuaugugggcugaacucacggcu

SEQ ID NO: 4131183 - RNA, 97 nt, Human
ggcuguucaaugguaucagaaaauccaaagagguuaagaacgagaacucaaaauauguugcuggauuuugauccuuugcaauugauggaugauagcc

SEQ ID NO: 4131184 - RNA, 100 nt, Human
ggcuguucugaucuuuaaaagauuuugguuuuuaauacaaaguacaugaugauuugcauguacugaauaagauugugauccaaugucuuugaugguggcc

SEQ ID NO: 4131185 - RNA, 85 nt, Human
ggcuguugacagaguguugaccauaagcccauuaaacagaagguggaaccgcaauuguggucaaaggcucccucccaagauggcc

SEQ ID NO: 4131186 - RNA, 87 nt, Human
ggcuguuuucaucuccuuuauuggcauuuuuccucagcuggaguagcccuuuacuccacauaaagucagcagaggggaagaacagcu

SEQ ID NO: 4131187 - RNA, 72 nt, Human
ggcuuaagaugguagcuuugagcagguuugauauaaaauuuuagagaaaagcauaggcaucaucuuaaggcc

SEQ ID NO: 4131188 - RNA, 63 nt, Human
ggcuuacaccugugaucccagcacuuugagaggccgagguggguguaucacaggucaggaguu

SEQ ID NO: 4131189 - RNA, 62 nt, Human
ggcuuacugacaggcagugauuuccucugguaaacaccuggaagcaauugccuucagcugcu

SEQ ID NO: 4131190 - RNA, 58 nt, Human
ggcuuagaaggcaaaugacuuguccacgaucgcgaggcaagucagacccuucagagcc

SEQ ID NO: 4131191 - RNA, 66 nt, Human
ggcuuagcaguguuugcacagcuacagaaguagggccugugggcuggcacgaagcccugcugggcc

SEQ ID NO: 4131192 - RNA, 63 nt, Human
ggcuuaggugucucucugcaccagucucagacuccaaguugcugcagguaaggaaccuaaguc

SEQ ID NO: 4131193 - RNA, 73 nt, Human
ggcuuagugguuuaggggaaagaacugugaauaggaugaucuugguacagucuagcuucuccacuaaucagcu

SEQ ID NO: 4131194 - RNA, 59 nt, Human
ggcuuauguguucaacacuaaggaacaugccauguuucuucagugacaaaggcaaaacc

SEQ ID NO: 4131195 - RNA, 76 nt, Human
ggcuuauuagaggacaagaggccuggcugauaaauuccugaccagagggauggaggcuaagccuuucccugcagcc

SEQ ID NO: 4131196 - RNA, 86 nt, Human
ggcuucacccaggcggcuggcugaggucuagacaccccaggggcagcuguggccccugguauggacuucgguugccuggggaggcc

SEQ ID NO: 4131197 - RNA, 68 nt, Human
ggcuucacuguaauguuuuagcaggucuguggagagcagauauaucaccuucuccauuacaguaagcu

SEQ ID NO: 4131198 - RNA, 61 nt, Human
ggcuucagaagacuggacagguggcuugguaauuaaaaccuuucccuucuaacugcaggcc

SEQ ID NO: 4131199 - RNA, 55 nt, Human
ggcuucagcugguuauuuccuucucucguguggaaggccagagcagacuggaguu

SEQ ID NO: 4131200 - RNA, 86 nt, Human
ggcuucaggagcguguccuggugcuccagguggcugcggaagaucuccugggccagcugggccaccaggugcuugcuguagagguc

SEQ ID NO: 4131201 - RNA, 65 nt, Human
ggcuucaggcccagcacagcgcgugucauucugggaaaacaucuugucuuuuugggccugaagcc

SEQ ID NO: 4131202 - RNA, 70 nt, Human
ggcuuccagcugggccuuggaggacaggguccaccccuaccuccuggucuccuuccucagcuuggaagcc

SEQ ID NO: 4131203 - RNA, 68 nt, Human
ggcuuccauguacugcaguaauuuugaauuggauauguuauguccaaauugacaguagugauuaagcc

SEQ ID NO: 4131204 - RNA, 85 nt, Human
ggcuuccucccugcugcucacuaccauucucgccagcagaauggugacaaaccaguagcaauaaagaggugggaggacuugagcc

SEQ ID NO: 4131205 - RNA, 58 nt, Human
ggcuuccugaaucagaaacucugggggugagacccagcaaucuguguuucagcaagcc

SEQ ID NO: 4131206 - RNA, 57 nt, Human
ggcuuccuggagaaggucugaguuuuauuaaaggaugagacagucaccaggcaggcc

SEQ ID NO: 4131207 - RNA, 64 nt, Human
ggcuuccuguuguauuugugagccaugcugugcugagggcucaggacugcagcguagagaggcc

SEQ ID NO: 4131208 - RNA, 86 nt, Human
ggcuucgucgggcucgcucuccuagcggagggggcggcggcggcccccaggucccgggcaggucgagcgagccacggcccccggcc

SEQ ID NO: 4131209 - RNA, 55 nt, Human
ggcuucuaaggaguauccuuugcuuggggaggaaggucacagaacuuagcaagcc

SEQ ID NO: 4131210 - RNA, 114 nt, Human
ggcuucuaauguagucucaggaucaccccagcuggcccguggcaguacugaggcuuucagauugcuuucagugucugugggcaggauggggaauccuagucuucuucagagguc

SEQ ID NO: 4131211 - RNA, 107 nt, Human
ggcuucuaccacgagaaaggcaaaaugugaaaaugcuggcaagagaguagcucgggagcuacagcugccguguuuuucauguuaaaaagccacuuaauguggagguc

SEQ ID NO: 4131212 - RNA, 62 nt, Human
gggugacucaggaggaaagacuccaccuaaaauagucgugguaugcagucucugagucacuu

SEQ ID NO: 4131213 - RNA, 62 nt, Human
gggugagcuggcugccuucuccuuaggccauuguggccccuaaagcccagccagcuucaucc

SEQ ID NO: 4131214 - RNA, 56 nt, Human
gggugaggagcugccagucauguccagauggaaugacucccauccucuccucaucu

SEQ ID NO: 4131215 - RNA, 66 nt, Human
gggugaggaggacggugcgacacuuggggaaacaaacugcacagguccagccugcccucucucccc

SEQ ID NO: 4131216 - RNA, 130 nt, Human
gggugaggcagaggcagccccagagggagcaugagggcuggaagagugggcagcagagucucuggucuggaagcugucacucuccggccuucccagggccuggcucugagcacucacaaccaugaagacc

SEQ ID NO: 4131217 - RNA, 78 nt, Human
gggugagguggaccagcaugugaucugucaggcagggcugcugcacuguggucaccaggcuggggccaacagacacuc

SEQ ID NO: 4131218 - RNA, 94 nt, Human
gggugaguccaugacauaaaauucaauaauuuguggcgaaauaauuaaguugccuugacaagccuaauguugauuuuacugucuucucuuuccc

SEQ ID NO: 4131219 - RNA, 75 nt, Human
gggugaugcugacaggaguagggagcaagcaggaaggaccacgugccuucucuggcuucuaccuugcaguuuccc

SEQ ID NO: 4131220 - RNA, 104 nt, Human
gggugcaugugugcguacaugcuuguggccgcacaacucccagacucacccuggggucuccgggugcaugugugugccaugugccaggaugucugcaugugucc

SEQ ID NO: 4131221 - RNA, 69 nt, Human
gggugcggggauggauuccgggucccugugucuuggaacuaggagcucauucauccucuuuucugcccc

SEQ ID NO: 4131222 - RNA, 79 nt, Human
gggugcguggccucgcuggggugucucgucugccauuguuccucaguuccaccgagugacaccucguuagucuccaccc

SEQ ID NO: 4131223 - RNA, 61 nt, Human
gggugcucuguguccacagcuggaaaaggaucaaagacuuuugcgguagcacaggggaccu

SEQ ID NO: 4131224 - RNA, 71 nt, Human
ggguggaaucuuaccuuucagaguguuuugguucuaaagcagucucagacuuaagcacaguuaauuccccu

SEQ ID NO: 4131225 - RNA, 60 nt, Human
ggguggauggggagauguggagagaacagauguggagcuccccaguguccucaugcaucu

SEQ ID NO: 4131226 - RNA, 65 nt, Human
ggguggauggugagguagcucucagcccccaccacugguugcauuugcuguucugaccaucaccc

SEQ ID NO: 4131227 - RNA, 65 nt, Human
ggguggcaaucguugacuauagggaauagagggagaaaauccuuaauguuuaauguuguccaccc

SEQ ID NO: 4131228 - RNA, 70 nt, Human
ggguggcagauggauugggcugugcaggggcugaaggacucacccgcaggcccagagucgcuggccuccc

SEQ ID NO: 4131229 - RNA, 59 nt, Human
ggcuuuuggguccaaaucucagguucuaauaaaugcuccuugaggucaaggacuaggcc

SEQ ID NO: 4131230 - RNA, 65 nt, Human
ggcuuuuuauugaucugcacugauguccucguuugcugaggugcuuacagaauccaugggaaguc

SEQ ID NO: 4131231 - RNA, 55 nt, Human
ggcuuuuuggcuuugguuccuggagcagcuucagagccauaaaggugaaagaguc

SEQ ID NO: 4131232 - RNA, 57 nt, Human
ggcuuuuuugucagggccacagggacaucugguccaggcuggcucuucaaaauuguc

SEQ ID NO: 4131233 - RNA, 68 nt, Human
gggaaaaagcagguacucagcuugggggaugucugaauccuaccucaguguucacuuaguuuuucucc

SEQ ID NO: 4131234 - RNA, 109 nt, Human
gggaaaaaguugcagccgagcuucuuguuucuucaucugacuucaaagcaugacucacacaugcucuccccagaauggagugcagcgagaggcaggcagcagagacccc

SEQ ID NO: 4131235 - RNA, 59 nt, Human
gggaaaaaucauugccugucaggagcuuggagauuuaguccccaggcagagauuuaccc

SEQ ID NO: 4131236 - RNA, 69 nt, Human
gggaaaacuacugauuugugaauugaucccuaauuagucuucuuaggucaguaguuucauuuuuuuccc

SEQ ID NO: 4131237 - RNA, 84 nt, Human
gggaaaauggaacucucuuuagagagggacaaaguaucagauuugauuaauuguucuuacuuaagagugaauucauuuacaccc

SEQ ID NO: 4131238 - RNA, 58 nt, Human
gggaaacaggaaaacagcacaauagcaaaauccuuuuggcuauaagauuuccuguccc

SEQ ID NO: 4131239 - RNA, 75 nt, Human
gggaaacuaagcagaacacacgucagaguuuccugccuaggaggugaggaagcugggguguucuucauaauuccu

SEQ ID NO: 4131240 - RNA, 101 nt, Human
gggaaacuugucaagcaugcaaauuucugggcuccauccccagaagcucugauacagcaagucuggagaagcccagggagcugcguguuuaacaagcuccc

SEQ ID NO: 4131241 - RNA, 65 nt, Human
gggaaagaaauguauguuucuuuauauuuaaugcaacugcacuaagaaauguaucauucuuuucc

SEQ ID NO: 4131242 - RNA, 60 nt, Human
gggaaagaagaucuagauacuguuuuguuguuuuaaugaugaucuagaaacuucucuccu

SEQ ID NO: 4131243 - RNA, 78 nt, Human
gggaaagacauggcucuagugaugcacugggaacuuucuccgucucucagcucagcuuccacagagcagcucuuuucu

SEQ ID NO: 4131244 - RNA, 68 nt, Human
gggaaagacuuucuugcagaaauauucccuguggaacuuuggggaaagacauucugagaaguaaucuc

SEQ ID NO: 4131245 - RNA, 106 nt, Human
gggaaagagcauccuuguaauaaaauuacuucuugauguggaauuucuucccauuauugaauuucaacguuagauguaauagugcaaguagagagcuucuuguccc

SEQ ID NO: 4131246 - RNA, 60 nt, Human
gggaaagagugcuuguccagagagcagauggcagcucuacuuagcagccaccucuguccc

SEQ ID NO: 4131247 - RNA, 64 nt, Human
gggaaagcauaacuaauauuuauugagcaccaaccaugucagugucuauuuauaugcuguucuc

SEQ ID NO: 4131248 - RNA, 72 nt, Human
gggaaaggagugaauauuugugaccaaaagggcaaacaguggccauugucuguagauauucacuccuucccc

SEQ ID NO: 4131249 - RNA, 108 nt, Human
gggaaagggaaggcccacggggcccuggagcugucuucacaggccuucaacugucagagggauguauuuaggacacagaucuggccacgccguggcccacccucaccc

SEQ ID NO: 4131250 - RNA, 77 nt, Human
gggaaaggggauggugucgggaggaaagagaguauguggggccuccacaucccuccucuggaaccucacccuugccc

SEQ ID NO: 4131251 - RNA, 95 nt, Human
gggaaaggggugccuggcaggcauugcagucugcaugugucucugggacaaguguguuuccgugauugagggugucugcaggccaguguguuccc

SEQ ID NO: 4131252 - RNA, 62 nt, Human
gggaaagugccggccugcuacagagaaaaaggcaacaucuguaacaauucccagccuuugcc

SEQ ID NO: 4131253 - RNA, 77 nt, Human
gggaaaucauccuggccggaucacauggcgcgagaaccagcucuucagugcuuauauucugagccucauguuuucuc

SEQ ID NO: 4131254 - RNA, 60 nt, Human
gggaaaucuggggcagucugauuauuuccuauuggcaaauccugcugcuguggacuucuc

SEQ ID NO: 4131255 - RNA, 65 nt, Human
gggaaaugaaggagaaagagcagaauggccaaaugaaggguuugcuugucuucccuuuaccuccc

SEQ ID NO: 4131256 - RNA, 59 nt, Human
gggaaauugugugagaucuuuguaaucuccaauucagauucucucuuaacacaguuccc

SEQ ID NO: 4131257 - RNA, 59 nt, Human
gggaacagccagggcauugucgccgagccgggaggcucuguguguuccguggcuuuccc

SEQ ID NO: 4131258 - RNA, 82 nt, Human
gggaacauaagaaugaggcagagggcugugccagcucaggagaaagagccaggugagcccugcugcuucuuguauuuuaccc

SEQ ID NO: 4131259 - RNA, 74 nt, Human
gggaacauccauuacauguccaaagacacccuagauucccacauaucugugaugucuuguacauaugauuuccc

SEQ ID NO: 4131260 - RNA, 128 nt, Human
gggaacccauggaggcaggaugcagcgggggacaggguggagccuggcauuggagccggggcauauggguuccaguccaugcucuggaccaugacuaugugccuuccccuuucuaagccucaguuucc

SEQ ID NO: 4131261 - RNA, 79 nt, Human
gggaacccugaaugaggaaaagagugagguuuucugaauagggcaguuaucuuccuuuaguuuucccuucuucaguccc

SEQ ID NO: 4131262 - RNA, 89 nt, Human
gggaacccuuuuagaaauuugccuugaauuaaacgauuguuguucaugagaccaagaaguguuuauuucagcaacagaaagaccuuccu

SEQ ID NO: 4131263 - RNA, 63 nt, Human
gggaacgauucggauggugguguugacagucauguuuacauugcuguuugugucuuuuuuccc

SEQ ID NO: 4131264 - RNA, 62 nt, Human
gggaacucuuauuuagaguuuaaggcccaagccaaguaucuccuucucucugaagaguuccc

SEQ ID NO: 4131265 - RNA, 77 nt, Human
gggaagaaaaccugacaguggaauggugggccugcaugcgagggcuuggaggcuuuccuuccacuucugaccuuccc

SEQ ID NO: 4131266 - RNA, 126 nt, Human
gggaagaaccaagcaccuaacuaaugagugucacugguugugagggcaaguaaaugaguugguuguuccccaaauucuggcuacccuccuaauguuagagauucucaugauuugcauugaauuccc

SEQ ID NO: 4131267 - RNA, 104 nt, Human
gggaagaaggggggaacauggauauuggggagcaucagcccugucugcugaaaaucaacacucagagugcaucuccuauuuguagucucuacuccuugcuuucu

SEQ ID NO: 4131268 - RNA, 56 nt, Human
gggaagacuuccugggcuuaaggauuuccuuaagugcuucaagggaagcucauccu

SEQ ID NO: 4131269 - RNA, 84 nt, Human
gggaagaggaaggaaugcaguguaugccccuuuccuuuuauaggaacacccuagaaauugcacacacuguuuuccucacauccc

SEQ ID NO: 4131270 - RNA, 129 nt, Human
gggaagagggagugggagggaggaggagggagaaaggagagagaauacauuaaggaaauuacagaguaccucuuuccuugaaugaauguucucucccaauuuccuucucucccaguuggcugccacccc

SEQ ID NO: 4131271 - RNA, 72 nt, Human
gggaagagucuuuguauauagcagcagauuaaaccaaaagaaugcacugacaugcacaaaaagacucuuucu

SEQ ID NO: 4131272 - RNA, 59 nt, Human
gggaagaucaggauggagauucauacaaauauagaugaaaacagaauccuuguuuuccc

SEQ ID NO: 4131273 - RNA, 55 nt, Human
gggaagcagcauugugcuggcucagcauugaagcaggugcacagugcugcugcuc

SEQ ID NO: 4131274 - RNA, 76 nt, Human
gggaagcagggccaguaccagguggguggggagccaggccugcccuggccagccuggugcuugcuccugagcacuc

SEQ ID NO: 4131275 - RNA, 82 nt, Human
gggaagccaguauucugucuuucuaccacuugauuguuauuuuucuauuaguccucagaaagacaaaaugcaguggcuuuuc

SEQ ID NO: 4131276 - RNA, 57 nt, Human
gggaagccucagagcucaggcuuagcugcggcugugcccaccuggcucugagguccc

SEQ ID NO: 4131277 - RNA, 57 nt, Human
gggaagcuggucacccacaggccuaccguuuuccaggaacgagggugcccauuuccc

SEQ ID NO: 4131278 - RNA, 68 nt, Human
gggaagcuuugaaaaugguaagcaugauauuauaauaauagccaagcuccuucauguucuggcuuccu

SEQ ID NO: 4131279 - RNA, 55 nt, Human
gggaaggaaagacccauuuuguaucugaucccgaguuugcaguugaguccuuccc

SEQ ID NO: 4131280 - RNA, 72 nt, Human
gggaaggacuuagacccugucuuuauucagaggacugccugguuaagacaguauuuuaagauuaucugcucc

SEQ ID NO: 4131281 - RNA, 63 nt, Human
gggaaggagggagggaggaaagugaggugucucacacucuggcaagcuuccacuuccuaucuc

SEQ ID NO: 4131282 - RNA, 80 nt, Human
gggaaggauaaagagugggugacagaaggagguaauuucuuugccugcuuguuuaccuacuccccucuuuucuuccuccc

SEQ ID NO: 4131283 - RNA, 66 nt, Human
gggaaggcaggccucuguuggauucagcucugacuucaagaggcaaaacagagcuugcuguuuccc

SEQ ID NO: 4131284 - RNA, 55 nt, Human
gggaaggcauaauagucaggugaccuggugucacuuuaagaguauaugacuuccc

SEQ ID NO: 4131285 - RNA, 69 nt, Human
gggaagggacuuguuuaaggucauauggaaaauuuccuggcuaggccuggagcaggucuucagauuccc

SEQ ID NO: 4131286 - RNA, 89 nt, Human
gggaagggaguagcagggaaggugugcugagccaucaggguaccagcucagcucagggaccgucacacuuuuccugguuucccauuccc

SEQ ID NO: 4131287 - RNA, 84 nt, Human
gggaagguaggguagcauucugaguucgcagagcuaccugugggcuuugcugaagcucggaagcuccccugaugaccugaucuc

SEQ ID NO: 4131288 - RNA, 72 nt, Human
gggaagucagccguccgggccugguguggcugcucagcagcacaaaguccccagggacccaguuuccuuccc

SEQ ID NO: 4131289 - RNA, 64 nt, Human
gggaaguucugauauuugcagguaccauguuaucaagguuuuuguacauguaagauugcauccu

SEQ ID NO: 4131290 - RNA, 76 nt, Human
gggaauaaguugcucuuggcucucauuuuauuauagcagaugcagcaaugaaauguaaguagagaguuuuauugcu

SEQ ID NO: 4131291 - RNA, 78 nt, Human
gggaauaauggccagcacuuagcccuuaccaaguagaggcacuguuccacagguuugggguauguguugguuguuccc

SEQ ID NO: 4131292 - RNA, 59 nt, Human
gggaauaucuacagcugaaagcccacccugcaaggcagcuguuagucaguggaugcccc

SEQ ID NO: 4131293 - RNA, 58 nt, Human
gggaauaugggacucuccaguggaguuuguuaaaacacagcuucgaggaucucauccc

SEQ ID NO: 4131294 - RNA, 63 nt, Human
gggaaucagcauggggcuuggagucagcccaaucuggguugaaaccugucucugcugcuuuuc

SEQ ID NO: 4131295 - RNA, 90 nt, Human
gggaaucagccaggcugguguguccugaagccucccagaccccagugggagccuaggauuccucagggucugccagaucccggcuaaccc

SEQ ID NO: 4131296 - RNA, 63 nt, Human
gggaaucucgcauuuaguucucaacucccugccaggggaggaaacuguccucccgagguuucc

SEQ ID NO: 4131297 - RNA, 70 nt, Human
gggaaucuguucuccccauuuccaaaccaugacaugaaugggugcugacauguggagagaacagauaucu

SEQ ID NO: 4131298 - RNA, 79 nt, Human
gggaaucuuguuaaaaugcagauucugguuaagucaaucuggaauugugccugagagucugcguuucugauuagcuccc

SEQ ID NO: 4131299 - RNA, 84 nt, Human
gggaaugaagaagccugugguuuuuguccuaauuuguuugguuuggggcuggacccuaagcuugggaaccacgguaaucagccc

SEQ ID NO: 4131300 - RNA, 61 nt, Human
gggaaugagguuggcauaauuaaaugaaugcaguuuauucuuuggggcugaucuuauugcc

SEQ ID NO: 4131301 - RNA, 78 nt, Human
gggaauggaagggggaaaaugacaacagaaaacuagcaguguuuuguuauuucguuuaccuuccuuaggauaauuuuc

SEQ ID NO: 4131302 - RNA, 55 nt, Human
gggaauggaauucuaaguuagauuucagucuauuuggagccuauccauagauccc

SEQ ID NO: 4131303 - RNA, 69 nt, Human
gggaauggagacgcaagggaccuaggagucucagcuccuacguucagcccuagcgagauacucaguccc

SEQ ID NO: 4131304 - RNA, 63 nt, Human
gggggugcaggagccacuucagggaugcagcaggagcugcccggugacugucuccugccugcc

SEQ ID NO: 4131305 - RNA, 66 nt, Human
ggggguggaucaccugaggucaggaguuugagacaagccuggccaacguggugaaaccccaucucu

SEQ ID NO: 4131306 - RNA, 62 nt, Human
ggggguggguauugugucaaucucugggaauguaucugagagauugugcuacucacccaacc

SEQ ID NO: 4131307 - RNA, 80 nt, Human
gggggugguggucaggauucucagcccuucuuugauuuauugggaaguaaugaacuggauccaauggcaagcccuccucc

SEQ ID NO: 4131308 - RNA, 119 nt, Human
ggggguguuuuuggagacagauccucacuuugucacccaggcuagagugcaguggugugaucucggcucacugcaaccucugccucccagguucaagugauucuccuaccucagccucc

SEQ ID NO: 4131309 - RNA, 70 nt, Human
ggggguuucaaguaacagggagaaccauuuaaccccuuugugguuuauucuuauuuacuuuggaaucucc

SEQ ID NO: 4131310 - RNA, 74 nt, Human
ggggguuuggauuucagcauauggauuuuggggggacacaaaucuuucaguccguaauaguuggccuccucccu

SEQ ID NO: 4131311 - RNA, 79 nt, Human
gggguaaucuuaaucaccaagcaauuacuaaaugccgaccauguucucaggcuuggcagaggugggugcuuguuacccc

SEQ ID NO: 4131312 - RNA, 67 nt, Human
gggguacccaacagaguaauuuagugaaguauuucaaagagcuauucaguugugguauuguaaccuc

SEQ ID NO: 4131313 - RNA, 71 nt, Human
gggguagaaugcuccugggaacucggaaagcucugggaugccagcuuuucccacauguucucacucacccc

SEQ ID NO: 4131314 - RNA, 67 nt, Human
gggguauaagcaggaggucuaggaggagcuguucucugcccuccagagcuugaccugcugaggcccc

SEQ ID NO: 4131315 - RNA, 79 nt, Human
gggguauuuaagacaaauuuguuuuccugucugcuagcuccugaaaagacaauuaaaaaauuaugcuuaaguaaacccc

SEQ ID NO: 4131316 - RNA, 81 nt, Human
ggggucacuaugucauauuuugguuugguugcagugcugaaccuuaugcaacccuggcccuggaauaggcauggucuccuc

SEQ ID NO: 4131317 - RNA, 61 nt, Human
ggggucaguagcaaagucagaaauggagacacucaauccauuucuccaagugacugauucc

SEQ ID NO: 4131318 - RNA, 88 nt, Human
ggggucauuggaguguucccgucucuuggauuucacagugcucaccaggauggccacgaugaugaaagagaacauuccaaucaucacc

SEQ ID NO: 4131319 - RNA, 80 nt, Human
gggguccaagccucaaggcuggggaaggucagauuugagccugugucccuguuccuccagugucuggggccuuggguccu

SEQ ID NO: 4131320 - RNA, 55 nt, Human
ggggucccugcaccagcaugucagcaucagcuugugcacgcugggcgggcacucc

SEQ ID NO: 4131321 - RNA, 130 nt, Human
ggggucgggacggcagccccgcggcguccugcuuucuggcacagccgcgggaucccggcacugaacaacuggcugucccgcggcgguccgggcagggcgcggugcguggcaacggcucccgucccucccc

SEQ ID NO: 4131322 - RNA, 65 nt, Human
ggggucggggcauagccacuuacugacgacuccccacccagcaagugguuuugaacccggacccu

SEQ ID NO: 4131323 - RNA, 106 nt, Human
ggggucuaggagugaccaaggugugggcaggguugcuuucuccgaggccucucuccucggcuugcagauggccauccucacugcaccccgccuuagucuucccucc

SEQ ID NO: 4131324 - RNA, 77 nt, Human
ggggucucaaagaacaucaucugaaaugugacaggaagucucuggaggcuuuuagaugugugucuucuggagguuuc

SEQ ID NO: 4131325 - RNA, 79 nt, Human
ggggucucuuguuauggcaagcgggguugggggacucuuucaauggagaauagaacuauugcaauaacaagaaugcucc

SEQ ID NO: 4131326 - RNA, 88 nt, Human
ggggucuuggucugucacccaggcuggagugcaguggcacgaucucggcucacugcaagcucugccucccggguucacgccauucucc

SEQ ID NO: 4131327 - RNA, 112 nt, Human
ggggucuuguacaagcugcuuugccuccagcugccucagucucuucaugugaaauuggggauaucugucuuagauuggggguccccugaagcagaccuagagacaagaauuc

SEQ ID NO: 4131328 - RNA, 75 nt, Human
ggggugaaggggcaguaauucucagucaccaggaaagauccccgcccacuggguggcugccuccuucucaccacc

SEQ ID NO: 4131329 - RNA, 92 nt, Human
ggggugacugcucuaaguuguauauaccgcuuuaagcuauaaaaucauuauuuugagcucuuuaugcaauaaaacucagagcagugcauccc

SEQ ID NO: 4131330 - RNA, 55 nt, Human
ggggugagcggcuagggauguggggaauccccugccucugaagcugcucagaucc

SEQ ID NO: 4131331 - RNA, 119 nt, Human
ggggugaguggggagggaaguaagugccccaggcuguuaacauaagucucacuuaacaagagcucaggaagagacauaaagggcaggugccugggggcaucuuccuuccuccucucucc

SEQ ID NO: 4131332 - RNA, 67 nt, Human
ggggugaguugggguucacaggucauucaaugggaagagguugaccugggaaccuuaucucaauccc

SEQ ID NO: 4131333 - RNA, 61 nt, Human
ggggugauauugggccugugcugggcccccgagggccucccaccaggcccggugucuccuc

SEQ ID NO: 4131334 - RNA, 73 nt, Human
ggggugauuuccuugaggccacaguaucagaacaguaaaaucuguugugaaauguccaucaaccagacacccu

SEQ ID NO: 4131335 - RNA, 107 nt, Human
ggggugcagcuggggcugggggaaggugggcggugucuuggaucguggcagcuauuuuagggccugagcuggcugaccucccccagcgugaucuccgucugcucuuc

SEQ ID NO: 4131336 - RNA, 55 nt, Human
ggggugcgggccccaucuggcuagaugaugugggcuguguggggaccgaggcuuc

SEQ ID NO: 4131337 - RNA, 60 nt, Human
ggggugcugagaucuucccucacuggaauaagguucucagugcagggcaacucagacucc

SEQ ID NO: 4131338 - RNA, 62 nt, Human
ggggugcugcucuccuccauguugcacucauucaguuaguccaguuggccagagcaggcccc

SEQ ID NO: 4131339 - RNA, 82 nt, Human
ggggugcuggguugagauggcugggccccaggagcagcagcuguagcuugagggcucggcugggcuccacugcagcacaccc

SEQ ID NO: 4131340 - RNA, 57 nt, Human
gggguggauggguggaggcagugccaucucccccagugccagcugcccuuccacccu

SEQ ID NO: 4131341 - RNA, 64 nt, Human
gggguggccacugcaaggccuucgaagacaugagucaugaagcugugggcaguggagccacccc

SEQ ID NO: 4131342 - RNA, 75 nt, Human
gggguggccccccuucccgguuuacauauuguaucuauguaacguuuuguauauuccagaggguagggccgcccc

SEQ ID NO: 4131343 - RNA, 57 nt, Human
gggguggccuguaggcagcaugggugucccgugcuccuggacauggccagugauccc

SEQ ID NO: 4131344 - RNA, 81 nt, Human
gggguggcgcuuucucucuacuggggcacuaggagugcuuacucuccugcucccucugguccucgguggagagccacaccc

SEQ ID NO: 4131345 - RNA, 81 nt, Human
ggggugggaagagccuaggagacaagcgugaaagucccaccucugcaaccaucagguauguccuuggagucaccucaucuc

SEQ ID NO: 4131346 - RNA, 62 nt, Human
ggggugggcuggggcugagacccauggcaugaccccaauucucucuccucaagcucgacccc

SEQ ID NO: 4131347 - RNA, 87 nt, Human
gggguggggccagugguagaggggaggccgugggaaaagagagacuggcugcacgcccacagcccccugcugcucuggcacagcccc

SEQ ID NO: 4131348 - RNA, 81 nt, Human
ggggugggucaucuggaccuuggcccugcccuggugcugcagggcgcugugugaggcccgagguucgugugcacccacgcc

SEQ ID NO: 4131349 - RNA, 62 nt, Human
gggguggguggggcacuuuugaccgcaguuucuggcgcagguccucacgccucacccuuccc

SEQ ID NO: 4131350 - RNA, 73 nt, Human
gggauuuaguaggauaguauacguagcucauagaaucauugggagagcuggggaauucuccugcugaaguccc

SEQ ID NO: 4131351 - RNA, 96 nt, Human
gggauuuaugugacuguuaaaauuaggugacuacugggcacuugagauaaaugucuuucaggauauuaccuaauauuugacuuagcaauaaauucu

SEQ ID NO: 4131352 - RNA, 58 nt, Human
gggauuucuccuuccuuuaaacaugcaacaggcacuugaaggaaagagggaacauccc

SEQ ID NO: 4131353 - RNA, 86 nt, Human
gggauuuggggcaaugcauuucacuucacugggcuucaguuuucuuuucugugcagugaggcaguuggguuggcuucccaggugcu

SEQ ID NO: 4131354 - RNA, 79 nt, Human
gggauuuuacugcaguugguuuagaauuucuagggguaggagguuucaccuggagagagaggccaacugcaaagaucuu

SEQ ID NO: 4131355 - RNA, 74 nt, Human
gggauuuucucaguugacguuauagacuuauuucuuggucaaucguuuuggguuuaaacucaacucuaaauucc

SEQ ID NO: 4131356 - RNA, 86 nt, Human
gggauuuucucuucccucuggaccugucccccaccaaccagcaaauagcuccugggccuagguugagggagagagagaagugaccc

SEQ ID NO: 4131357 - RNA, 62 nt, Human
gggcaaacaccugucagcugauggcuauguauggcuaugcagguccucagugacaggggccc

SEQ ID NO: 4131358 - RNA, 123 nt, Human
gggcaaauauccccacuuccucuacacaggccuccacuccacgcagacucaaagagcaucccuugggcacuugugugccuggggcaguguagggggcaguuauccacaugggccaucuugucu

SEQ ID NO: 4131359 - RNA, 81 nt, Human
gggcaaaucaucggaucucucuuagccucagauguucagauauaaucugaauguuuggacuggaaggucccucaaauuccc

SEQ ID NO: 4131360 - RNA, 73 nt, Human
gggcaaaucuuugucaguaugguuuagagaagguaauacuuucucuaauacauuuugacaaauaugauugacc

SEQ ID NO: 4131361 - RNA, 64 nt, Human
gggcaagaaggccucugcccuggcuucuguguauuagagguucuguucuagcccuucucugccc

SEQ ID NO: 4131362 - RNA, 70 nt, Human
gggcaagagaccuugaccuugagcaccuguuagugacaguggcugcuaggaguggugggucaaggagccc

SEQ ID NO: 4131363 - RNA, 74 nt, Human
gggcaagagaugaguaggagacaggguccucacagaucccuuuguuccuggccuuauccccaaacugcuugccu

SEQ ID NO: 4131364 - RNA, 85 nt, Human
gggcaagauuccggagguggaacacagaacggugugcagcaggaacaagcuacgcuucugguucuggcuuuaggacuucaagccc

SEQ ID NO: 4131365 - RNA, 58 nt, Human
gggcaagcacuuggccucugagcucugcauccagugcucacucuccacagugcccccc

SEQ ID NO: 4131366 - RNA, 58 nt, Human
gggcaagccucuggugucuugugugugucuccugcaccauccauuuucuugcuugccu

SEQ ID NO: 4131367 - RNA, 68 nt, Human
gggcaaggaagagcagguggugcuagagucuggucucuauggggauggcccagcugugcuuccagccc

SEQ ID NO: 4131368 - RNA, 83 nt, Human
gggcaaggagcccagcuuccuucugucucuuguguaguacaagaguccuggaauagaaggcaagaggcuugggcucuguuacc

SEQ ID NO: 4131369 - RNA, 55 nt, Human
gggcaagugucaagcaugucauuuaaacaaucaaaauguggccucgcauuugccu

SEQ ID NO: 4131370 - RNA, 72 nt, Human
gggcaaucugcuucacuuccccaagcuucagauuugauguuuggaaacuggaagugaucauaguaccugccc

SEQ ID NO: 4131371 - RNA, 58 nt, Human
gggcacagccuaacuauggagacccagggcuccuuccugcugcacuaggccugugcuc

SEQ ID NO: 4131372 - RNA, 58 nt, Human
gggcacagcugcugcuucucacuggggccaugccucugaccucuagccagcucugccu

SEQ ID NO: 4131373 - RNA, 60 nt, Human
gggcacaggcugcacgaccccagccuggccucgggcuugcugggagucgcgucuguggcc

SEQ ID NO: 4131374 - RNA, 90 nt, Human
gggcacagggaugggggaaacacaggagauauguaauggcucagaguugagacuccagagccaguucucuuguguuuuauucccaggccc

SEQ ID NO: 4131375 - RNA, 58 nt, Human
gggcacaguacuccaaucaacuuuauagaaauguauuguuaugguccaaauugugucc

SEQ ID NO: 4131376 - RNA, 94 nt, Human
gggcacagugcucaguuugcuguggcugccugaguaguaauaaucacagcuacaacugcaggugcgcucaggugccaggccugcgcacugucuc

SEQ ID NO: 4131377 - RNA, 69 nt, Human
gggcacaguggcucaugccugucaucccaacacuuuggaaaggcugaggcaggcagaucacuugaaccc

SEQ ID NO: 4131378 - RNA, 81 nt, Human
ggguagcugaggggaugguagaccggugacgugcacuucauuuacgauguaggucacccguuugacuauccaccagcgccc

SEQ ID NO: 4131379 - RNA, 61 nt, Human
ggguagcuugcaguuucugcuguuuuaaaaucuuuuagaacgaaagagagcuacaagcccc

SEQ ID NO: 4131380 - RNA, 83 nt, Human
ggguaggacacguucaggcacggcuggaucuaggugcucaaacaaugccucugggagcuggcuuugccucagcugugccuccu

SEQ ID NO: 4131381 - RNA, 69 nt, Human
ggguaggagaggugucugugugugugugugugugugugugugugugugcaacagaugcuuuugcugccc

SEQ ID NO: 4131382 - RNA, 78 nt, Human
ggguaggcaaauuuuuauucugcauuugaaaaagauugauaauuuaauaaucauugcagaaauaaaggugaacuacuu

SEQ ID NO: 4131383 - RNA, 91 nt, Human
ggguaggggguggcugagaacaggaccccaaacacuucugcuuccacuacuuccccuguaaaugaggggguccuuucucuccuuccugccc

SEQ ID NO: 4131384 - RNA, 93 nt, Human
ggguaggugcugggcaagcggcaaccuuuaucgccaucauugugcaauaaaugcgccccgaugcgugguagagcgcccccacccguuccaccc

SEQ ID NO: 4131385 - RNA, 81 nt, Human
ggguaguggguucuaguugugacacugccacaaacucacugugagacaguggcagacacugucgaagccuacccaacaccc

SEQ ID NO: 4131386 - RNA, 86 nt, Human
ggguauaauguacauuauucgagugaugguuacacugaaaggccagacuucaucacuaccuaauauacccaugugcacuuguaccc

SEQ ID NO: 4131387 - RNA, 121 nt, Human
ggguaucaugcuugggcacccauggcucccaggaagggaugccaaggaagcagggcagagagaacaagcauccccuuccugaggccucccuuccuagaccucaggcacaggaaaagagccc

SEQ ID NO: 4131388 - RNA, 79 nt, Human
ggguauccugcuuaaacauacuauuuauauaaaaauccuuacagaugaagaaauauaguuaguaugagguauauugccu

SEQ ID NO: 4131389 - RNA, 82 nt, Human
ggguaugaaguaagauauuguucagcuccuggcuucauugcucaugccuuaagcucaugaauucaauuucuuccucuuaccc

SEQ ID NO: 4131390 - RNA, 121 nt, Human
ggguaugagggguauaagugguuaaauuucgccaaauauucugugauucuguaccauauacaaguauuugguacuuggaggcagaaaaauauaaaggugaagaaggcauuaauaccugccc

SEQ ID NO: 4131391 - RNA, 92 nt, Human
ggguauguaagucccgcaaagcuuuggccaaccucguguggagcucuggaacgagaacugcugaaguucgccagacucgggcacuccugccu

SEQ ID NO: 4131392 - RNA, 81 nt, Human
ggguauguuguuuuccaguguuucuaaguagaugugaaagaaaaccucauuuaaacucuacucagaaaucaacaaaagccu

SEQ ID NO: 4131393 - RNA, 107 nt, Human
ggguauuaagcugagaggcuagcuuuguguauuaggcuuaguuuuguugaaagguaggaccagaccgaacuagcuaauuuuagucugaacuauuccauuuagugccc

SEQ ID NO: 4131394 - RNA, 68 nt, Human
ggguauugcaauuacucuucuucuucagaugaggaaacugagucucagaaagauuaagcaacuugccc

SEQ ID NO: 4131395 - RNA, 110 nt, Human
ggguauuggaauagccuuuucucucaguuaaacuuugugaauguuaucuguguuuaacuccaaguuugagacugagaguggggcaaaugaagccuuuuuccacuaauucc

SEQ ID NO: 4131396 - RNA, 74 nt, Human
ggguauugggugagggcaaaggguugcaaaucagagaaauuugcauuagagccccagcucugccacaacuagcu

SEQ ID NO: 4131397 - RNA, 84 nt, Human
gggucaaagggugcauguauuuaaaguugcaaucaauauugcuguuauauugcacuccaaauaaguugcaccaccuuuuggccc

SEQ ID NO: 4131398 - RNA, 66 nt, Human
gggucaaaguguccuuggggugaauacauuguacuuuuaaaauuuacagacauucaauuuugaccc

SEQ ID NO: 4131399 - RNA, 80 nt, Human
gggucaaaugcuuuuaaacacgauugacgaaacuauuuuuaaaaauuaaagguuuccaagugguugaaaaguauaugccc

SEQ ID NO: 4131400 - RNA, 60 nt, Human
gggucaagccguugcccaaggccacagaguuggugaguggcacggccaggacuugaaccc

SEQ ID NO: 4131401 - RNA, 96 nt, Human
gggucaagggcuucccaggaaugcagcugccccuccagggcugggggcuggccagcgccuccuguguugggcagcagcucucugaagccagggccc

SEQ ID NO: 4131402 - RNA, 113 nt, Human
gggucacacuuuauuugcaaguuaucugggaagggcuggcaauuuaugaauaaauuucagaugauggccauguccucucccuguuucagacuuccaguauuaaucagugaucc

SEQ ID NO: 4131403 - RNA, 69 nt, Human
gggucacgcagaggcuguagggaagguugcuauucuuaggccccuacuaucucaggcgucugcugacuc

SEQ ID NO: 4131404 - RNA, 72 nt, Human
gggucacuaccagagggaaaauuuguagaaaaaaaguuaguuuauaucacagguucaccucagguagguccu

SEQ ID NO: 4131405 - RNA, 73 nt, Human
gggucacucacugcaagcugggacuuagcgcagauagcacuugauugcgccacucccugcucagagaaggccc

SEQ ID NO: 4131406 - RNA, 66 nt, Human
gggucacuuuugcuauguuggcucuauccugaggcagucucucuccucgugguaaccagguggcuc

SEQ ID NO: 4131407 - RNA, 56 nt, Human
ggucgacuaauguuucauuucaugugcaugcuaagugaagcugguuagugaugacc

SEQ ID NO: 4131408 - RNA, 65 nt, Human
ggucgagcacauuaagugaguucauguggcuaacuaaggacacagagcaugcucagugugugacu

SEQ ID NO: 4131409 - RNA, 78 nt, Human
ggucgcacccauccuugcagggaaacuggacccagccagacccuggcuccagcccugagcaagcucuugggagaggcc

SEQ ID NO: 4131410 - RNA, 57 nt, Human
ggucgcgguggucucguccaugcacccaagggauugcguacggcugccagugugacu

SEQ ID NO: 4131411 - RNA, 65 nt, Human
ggucggcaaagucaaauaaauuuacugucuggcccuuuacagaaaaaguguuuugacuucugacc

SEQ ID NO: 4131412 - RNA, 66 nt, Human
ggucguacuuccucagccagcacuuaggggccgugagguccauagccaugagcugagggagugacc

SEQ ID NO: 4131413 - RNA, 75 nt, Human
ggucgucacccugggcugggccuguuaaguauuuccucauuaaagcucuggcagcucaguucaggucugcaagcc

SEQ ID NO: 4131414 - RNA, 62 nt, Human
ggucuaaggaaugcauggguacucagggcuuuaccggcagggcuccaugcauuucuccaacc

SEQ ID NO: 4131415 - RNA, 79 nt, Human
ggucuaauagcugguaaguggagucuuugggacuagaacccaguccugacccaaaggcuguacuuguaaccacuaugcc

SEQ ID NO: 4131416 - RNA, 97 nt, Human
ggucuaauuugaaccugucagaguuacuguugccugcgcuggcccaaagugcagauuuuuagucagcuugugauaggccagguguuuugucuggacc

SEQ ID NO: 4131417 - RNA, 74 nt, Human
ggucuaucuuguucucugaguggauuuuguagcaucaugcauugcauuggucauuuagaaaauacugguucacu

SEQ ID NO: 4131418 - RNA, 92 nt, Human
ggucucacucugccacccaggcuggauugcaguggugcgugaucucggcucacugcaacuuccgccuucuggguucaagcaauucucuggcc

SEQ ID NO: 4131419 - RNA, 55 nt, Human
ggucucagaucuuuauuaaggcaaaagcauugcagccacauggaaguuugagacc

SEQ ID NO: 4131420 - RNA, 78 nt, Human
ggucucaggcacuccuccaccccuccccuugcaccagcgcacagcaagcagagaaucugggagcgagggccuuaggcc

SEQ ID NO: 4131421 - RNA, 74 nt, Human
ggucucaugaaggaggcauaauugugaagaagauauuucuuauaccucuucacaucauguuuuuuaaugccacc

SEQ ID NO: 4131422 - RNA, 76 nt, Human
ggucuccaaccguuucuccacacgcucugccuuucugacagcaaaucuauguuuggcaaggaaugggauggagacu

SEQ ID NO: 4131423 - RNA, 130 nt, Human
ggucuccaacuggucuggauuaguuaauaacgcaagcucugaccauggcuuuaggguuaccaaauccaauguguauggaaucuugcgggcacauggcagagguauugauucuuuucaggcccucagggac

SEQ ID NO: 4131424 - RNA, 62 nt, Human
ggucucccugcagacccagccuggaacucccuugcugccaaggcuggacaucccaggagacu

SEQ ID NO: 4131425 - RNA, 64 nt, Human
ggucucggcauagaaaaugugcccucugucuugaggcagagacauccauuuuauaugcucaauc

SEQ ID NO: 4131426 - RNA, 59 nt, Human
ggucucuggccuuggagauugaagcguuucacuugugcaucucacagcccagagaagcc

SEQ ID NO: 4131427 - RNA, 128 nt, Human
ggucucuugacugcauccuggcuccucuagugguuucucuguuaucuaggcucccagugggagcccaagcauaggagggaggcaacagaggacugggcuuauucuacauguccuuccaagagucaacc

SEQ ID NO: 4131428 - RNA, 57 nt, Human
ggucugagagccacugaauccccagcccuaggauucuccacagcaaguucucggauc

SEQ ID NO: 4131429 - RNA, 56 nt, Human
ggucugagguuugggauucacuaguaaacuagcucugauucccuaaucccagcacc

SEQ ID NO: 4131430 - RNA, 59 nt, Human
ggucugaguggggccugagauucuccguuucuaaugaccuuccaggcauccuucaggcu

SEQ ID NO: 4131431 - RNA, 63 nt, Human
ggucugauagagccaggagagacuuuaugaaauccagacucucacacuaaugcucuaucagcu

SEQ ID NO: 4131432 - RNA, 80 nt, Human
ggucugcacagugaugucagaauuggaaaucuucaccugaaaguccaauuuucugauuucacuugaaauauuggcagacu

SEQ ID NO: 4131433 - RNA, 64 nt, Human
ggucugcuguugagcacaagugaaggaaggaagaacaaccuccauguguggaagacggugaauc

SEQ ID NO: 4131434 - RNA, 56 nt, Human
ggucuggaagcgcaguaggcugguaacccuucuccaguacuguggcucuucaggcc

SEQ ID NO: 4131435 - RNA, 61 nt, Human
ggucuguuuaauguaaggguuggauaguuuccugacuuaacagcaaaucauugggcagacu

SEQ ID NO: 4131436 - RNA, 102 nt, Human
ggucuguuuuugcauguuauguucuuuaucaugguaaaccuguccauagacaguaaguacuuggcaaacaacguggauauagugaaaacuuugaaucaggcc

SEQ ID NO: 4131437 - RNA, 67 nt, Human
ggucuucaaaaaauauccaucaguuacgucauuucuuuuggcaaaauucuugauguuugugggggcc

SEQ ID NO: 4131438 - RNA, 56 nt, Human
ggucuuccuugggggacuugaacaucuugguaaaugacaggucuucuuggaggacu

SEQ ID NO: 4131439 - RNA, 94 nt, Human
ggucuucgggguguuaugagagacuauggguacaagugauuuauuccguguaauuuagaagugggccuauaguccucuuguguuuugggagacu

SEQ ID NO: 4131440 - RNA, 113 nt, Human
ggucuucucacucugucacacccugguuggagugcagcuugugcgaucagcagugagccaugauugcacaucugcacuacagccugggugugacagugugacacacaaagauc

SEQ ID NO: 4131441 - RNA, 91 nt, Human
ggucuucuucaugccaggaggcucauugcauugugcauucuucuaaggacagaacaggauguuccaaagagcacuuuucaugauccugacc

SEQ ID NO: 4131442 - RNA, 101 nt, Human
ggucuucuuuuucaaguugcauuaucuuguagagauauuuucgcaagugguuauucuaguggaauaauccuccagggcucugccgcuugagaaguaagucc

SEQ ID NO: 4131443 - RNA, 95 nt, Human
ggucuuguuuuauuuugcuuugcuauguuuugcuugauuuuuauugccaaugauguuucaggcgaacuaacaugcuuuuaagauacagacauacu

SEQ ID NO: 4131444 - RNA, 60 nt, Human
ggucuuuaacugaugaagcccacccacauuaugaaggguaauuggcuuuacuuaaagucc

SEQ ID NO: 4131445 - RNA, 108 nt, Human
ggucuuucaaaguuacaucuuuugggagagguagcaguaagaacaggacacacaagccugaaauuauuuuauuucuucuguauaggugugcuaaaacucuaauaggcc

SEQ ID NO: 4131446 - RNA, 75 nt, Human
ggucuuuuccagcuguguuuuuuccaucuaaacaguaaaguugagugcaggggaaagccaguuucuggaaguacc

SEQ ID NO: 4131447 - RNA, 62 nt, Human
ggugaaaacucccuguguaacucccauggaauaaacuuuguuauugacagaaaguguucacc

SEQ ID NO: 4131448 - RNA, 79 nt, Human
ggugaaaaugcacauuccugagcuucgaccugcaguguccuggagggguaggugugggcucaggaaugugccucuuacc

SEQ ID NO: 4131449 - RNA, 56 nt, Human
ggugaaauauuuuugauauguuggguuacauaaaauauauuaagauuaauuucacc

SEQ ID NO: 4131450 - RNA, 84 nt, Human
gguuaaaaagugaaggcauaugcauagaagacagacuaucuaaauuacaucuuaucuguuggugcaggugcuuuagcguagacc

SEQ ID NO: 4131451 - RNA, 90 nt, Human
gguuaaaaccauaccaaacaaauccccauucuuagucauuaguuaugaaaaugucaugcuugaauggguauuuuuggagguuaaaggacc

SEQ ID NO: 4131452 - RNA, 84 nt, Human
gguuaaaagugcuuuauaacuuaguuuaugguaauauuagcauauaauuuucuauuugaauuaugaagcacuguauguagaacc

SEQ ID NO: 4131453 - RNA, 77 nt, Human
gguuaaauacuggacucucacuauuuaagaauagaauaagaauaaucaaauagaggugagacuucagugacaugucc

SEQ ID NO: 4131454 - RNA, 94 nt, Human
gguuaacugacuugcccaaggccauauugccuguaugugauauagcugggauucaaauccagguaguuugguuugagaguccacacuguuaauc

SEQ ID NO: 4131455 - RNA, 106 nt, Human
gguuaacugcaaagcaggaaaaggcggcucggggcuggaacguuacucccucugcucaugauccagggagaaguuuugggcccccuucucucugcugcugauggcc

SEQ ID NO: 4131456 - RNA, 78 nt, Human
gguuaagacacauucauaucugucuuucugcagugcuagugaacugagugcuuaugggcaguuauguuguccuuggcu

SEQ ID NO: 4131457 - RNA, 102 nt, Human
gguuaagagaaaagugagauguuuucuugucuuauauuuauuuggcuuugccaccuauuagcugaaugaacauggacaaguuaauaauacuccuccuuuacu

SEQ ID NO: 4131458 - RNA, 67 nt, Human
gguuaagauuguuuuggaugcuaacuguuaaugucaaaaccaaguuagcgauguaaaauaacaagcc

SEQ ID NO: 4131459 - RNA, 83 nt, Human
gguuaauaauaguggccagugucuauugguuuccugccuuuuggcuaaggacaaaccaauagacacuggccacuacuguaacc

SEQ ID NO: 4131460 - RNA, 84 nt, Human
gguuaaugugucaaacuaaaauuaacuucuagguaauauacuuuuguaacacuggagaguugguuguggcaaacaucauuuacu

SEQ ID NO: 4131461 - RNA, 83 nt, Human
gguuaauguuagacuaugugauauuuugacuugaauugccugugacaauucuguauguacauauguguauuagaauauaaacc

SEQ ID NO: 4131462 - RNA, 70 nt, Human
gguuaccaggacauguugcaaguuuauaugcauguucucauaugaacaauaaucaugucuaugauuagcc

SEQ ID NO: 4131463 - RNA, 78 nt, Human
gguuacccggaaagcucugcuucagccugcagcucagccuugcuuggcuccaggcugugcaugaguuuaggucugacc

SEQ ID NO: 4131464 - RNA, 71 nt, Human
gguuacugagccuguuucuuccagaguggcucccaguuggauccacacugucuaacaaggcauacguagcc

SEQ ID NO: 4131465 - RNA, 58 nt, Human
gguuagaaguuaccacauacuucucugacucaauguaauagagauccagcuucuagcu

SEQ ID NO: 4131466 - RNA, 94 nt, Human
gguuagcaagugguagagcuggagcuggaauuugagcuggaaguuugacuccagaauccaugcucuugucuagccuccuugccucauugcaucc

SEQ ID NO: 4131467 - RNA, 81 nt, Human
gguuaggaauaaaggccaaaauuugcauuuaaauggauauauuuuaagaagaaaugccaauuugugaccuuuacccuugcc

SEQ ID NO: 4131468 - RNA, 98 nt, Human
gguuagguacauucuugaugguuugguucaugagaaaacuuuuugggggcaggauagaccccagaaucuuggaacucagaucacagaaaucccuaauu

SEQ ID NO: 4131469 - RNA, 67 nt, Human
gguuagugguggcaagcucucuucccuucaacgaucccugaccaauucugagagcugcuaccuagcu

SEQ ID NO: 4131470 - RNA, 69 nt, Human
gguuauacagaucuucaauauuuuuguguagaucuacggauuuagcaagucuuugaagucauuagaauc

SEQ ID NO: 4131471 - RNA, 69 nt, Human
gguuaucaacuuagcuuucagccuuucucaccuacuuggauguuggugguggggcugaaaguuuuaacc

SEQ ID NO: 4131472 - RNA, 82 nt, Human
gguuaucucagaacuucauauugacguuagcuauagauauuaagcuauaaagugcuaaccagucaauaugguuugaaugacu

SEQ ID NO: 4131473 - RNA, 84 nt, Human
gguuaucugcagaauagggcauaacuuugcucaaaaaugaaucugcuauggguaccgagaaaaggcucuauucauagaaugacc

SEQ ID NO: 4131474 - RNA, 80 nt, Human
gguuaugagaugcaaggcugguggaguggggauguccuuuugggacugggucauccaauaccaguuugcaggcuaagacc

SEQ ID NO: 4131475 - RNA, 71 nt, Human
gguuaugcagcugguuaagaacacagcuagaagugauucacguuucugugauucucagccaacuguccacu

SEQ ID NO: 4131476 - RNA, 116 nt, Human
gguuaugggggagcggggagguguaucuuuccacaucuucaguagugucaucuugagguagggaaggaagugguggugguaguuggggagauggauaucucugcaauccuaagacu

SEQ ID NO: 4131477 - RNA, 98 nt, Human
gguuauguagcaaauaaaugacagagccagaacuagaccuuguauuuuuuaaccuacagucuaaucuuguguucuguaugcuuguuuguuuuccugcu

SEQ ID NO: 4131478 - RNA, 86 nt, Human
gguuauuaagaugugucuucagaauuaagaguaugcuguaaggaugaagacagccaucuuaauucuaaagacaaagcacaaugacc

SEQ ID NO: 4131479 - RNA, 59 nt, Human
gguuauucaggucauggacugucaucugcuuagaaagaugauaucuuuuccugagaauc

SEQ ID NO: 4131480 - RNA, 89 nt, Human
gguucaaggaaaauggcucucaguucacaguuaaaguuaucaucagacuacugaaggacuugaggguuucguuuuccuggcuuugagcc

SEQ ID NO: 4131481 - RNA, 80 nt, Human
gguucaaggcccauuugcaguuccauccaggcagauggaggcaacucuacccucuuccuauggggcugcaggaagccacc

SEQ ID NO: 4131482 - RNA, 61 nt, Human
gguucaaguucaucccggcugggucauuccuuuugcucugagcucuauggaggacugaacc

SEQ ID NO: 4131483 - RNA, 64 nt, Human
gguucacaaaagaguuuuauagcaacuguuauucuggcagcgcuggugaucucuauuuugagcu

SEQ ID NO: 4131484 - RNA, 69 nt, Human
gguucaccucagcucacucuuuugugcuuguguaaaaagugcagguggagaaagugaguuguguuuacu

SEQ ID NO: 4131485 - RNA, 63 nt, Human
gguucacucucaagucugccuaucaccauauguuuugcuugggcaugaaaaaugagaagaacc

SEQ ID NO: 4131486 - RNA, 63 nt, Human
gguucagcaaaggaccagcacaggcuuuggucuuaggcuuggcuggcugaccuugcaaagacc

SEQ ID NO: 4131487 - RNA, 55 nt, Human
gguucagcaggcucugguugaccgugaugucagugauggucccauacugcuggcc

SEQ ID NO: 4131488 - RNA, 56 nt, Human
gguucagccccauuuccuggcagugcagcucgcgcauuccccaggaggcugacacc

SEQ ID NO: 4131489 - RNA, 76 nt, Human
gguucagggggaugauuucacaccuugcacuuuaguuuuacccaguguaggaaaaacaaugaucugccugacaacc

SEQ ID NO: 4131490 - RNA, 61 nt, Human
gguucaggucucuucagcuuggucuugucaggacuccagggcugaacgaggcccaagaauc

SEQ ID NO: 4131491 - RNA, 77 nt, Human
gguucagugaacauuggcacaaggcagcaggaaacaaauccuaagcugcacugaguggcaacaaaguuucuugcacc

SEQ ID NO: 4131492 - RNA, 64 nt, Human
gguucaguguuuuuauugacagguugacuuucaacaguaugugucaauauguaaagccugaagc

SEQ ID NO: 4131493 - RNA, 85 nt, Human
gguucauauccacugcuguuacuuacgcaaaaggcaaauauuugugcuuuguaacaaguugaucugguagccuggaaaauggacu

SEQ ID NO: 4131494 - RNA, 62 nt, Human
gggcuguuuuguuuacuuucacagcccccugauuauguaaugagagcuaacagugacagcuc

SEQ ID NO: 4131495 - RNA, 80 nt, Human
gggcuuaccuuagaggcaggaagaauugcauguuaagaaagcugcauacacucuggcuuuuugcucuuugaguuuagcuc

SEQ ID NO: 4131496 - RNA, 93 nt, Human
gggcuucaaguucacggcccugugaugggaugugggcagggccugucugggacaggccgaacccagcuccuuacagggccgaauccuuugccc

SEQ ID NO: 4131497 - RNA, 57 nt, Human
gggcuucgugucuucaacaggugucucaaacuugcagcucuugggcccaaagggccu

SEQ ID NO: 4131498 - RNA, 59 nt, Human
gggcuucuagaccagcagugaggcccuuaaaagccacagcccacugacacaaggagccc

SEQ ID NO: 4131499 - RNA, 69 nt, Human
gggcuucugaaguguuugaugauugaguaagugaauguccagcccucaaaccacuuccaggauuugccc

SEQ ID NO: 4131500 - RNA, 88 nt, Human
gggcuugacuauaaguggcacaguccagacuccuggaguugccccugggguaacagcagggaugggguggccagugcagugugggccc

SEQ ID NO: 4131501 - RNA, 64 nt, Human
gggcuugauaaauguugaaauagcugcuaucuauaguuauucaucagugcauuaauuucagccc

SEQ ID NO: 4131502 - RNA, 80 nt, Human
gggcuugccuucuucccuccuaccacgugaaaaguaugcugugacuagcuuauuggucccaggaggagaaugggcagccc

SEQ ID NO: 4131503 - RNA, 55 nt, Human
gggcuugcugucuugcauuucugccauugccacgagaaaaacacgauauaagccc

SEQ ID NO: 4131504 - RNA, 72 nt, Human
gggcuuggggaccuggguuucucuugcaggggaugggcaugcucugggcaggagcccuggacucugcagccu

SEQ ID NO: 4131505 - RNA, 57 nt, Human
gggcuugguggagagaaugcugugaucaugcgucaaaaaauucuaaucaucuggucu

SEQ ID NO: 4131506 - RNA, 71 nt, Human
gggcuuguauuaagcuuagagaggcagguugcucaccaaauuuagcagguuuacugaguuugaauagggcc

SEQ ID NO: 4131507 - RNA, 71 nt, Human
gggcuuguuccugccaagcugguaugagguugaugaccugcagcacaguuugcuuggcagagcaguugucc

SEQ ID NO: 4131508 - RNA, 59 nt, Human
gggcuuuaaucuuguuaacuagggaggagccacuguguccuaauaaucuuuuaaagccc

SEQ ID NO: 4131509 - RNA, 64 nt, Human
gggcuuuauguguacuuuccauuuuaucacacagaauguugaaaagauaaguacucaagggucc

SEQ ID NO: 4131510 - RNA, 82 nt, Human
gggcuuuggagauguaggcagguggaggagugaaggcccaaggauggcucuucagcccuucccuguuuucaucagccagccu

SEQ ID NO: 4131511 - RNA, 79 nt, Human
gggcuuugggcugcagcuggagcaucuucucaucuugcauuuggguguggugggguccuccagugugggauccaugucc

SEQ ID NO: 4131512 - RNA, 126 nt, Human
gggcuuuuuaguuguauggguuguccucagauaacaauggccuuguuucauuacacgugguccuggcugggaagaaaagacacuacagugugauaagaggggccuugggggaccugaccugggccc

SEQ ID NO: 4131513 - RNA, 75 nt, Human
ggggaaaagacuagcauuuauauguacauaauaaaaauaaucaacguggcauaauaaugacuaguuuagaaaccc

SEQ ID NO: 4131514 - RNA, 62 nt, Human
ggggaaacugaggcucagcgugaggaaaggccucugcuuggaucacucugaagccuuacccc

SEQ ID NO: 4131515 - RNA, 75 nt, Human
ggggaaagaagggaggaggagcaaggcugguuuucauccaagccugggcaacuccauucacuguguucaguuccc

SEQ ID NO: 4131516 - RNA, 71 nt, Human
ggggaaagaaucugaauugccuggggaccuuuuaaaaauguaggucuccaggcccacugauuuauaucuuc

SEQ ID NO: 4131517 - RNA, 58 nt, Human
ggggaaaggccauggcaagaaccacgagccucuguggggcuaucugcucaccuuccuc

SEQ ID NO: 4131518 - RNA, 56 nt, Human
ggggaaauaaaaagcuggaaugugaucuacaccuguaccuucagcaguguuucucc

SEQ ID NO: 4131519 - RNA, 103 nt, Human
ggggaaauuuuuaaaaauauguagggcccgaucccacuuaaaccauuuaaaacaaacugucuggggaugggaguugggcuucgguguuuuuugaaagcucccu

SEQ ID NO: 4131520 - RNA, 94 nt, Human
ggggaacugggcuaauaagugacucacuagcucucagugacugccuuuguccugggguguaagcuuugagucagggugguggugcagauucucu

SEQ ID NO: 4131521 - RNA, 69 nt, Human
ggggaagaacugugacagaagcaguuucacagccuauauguguacuucuuuugcuuaggguuuguuccc

SEQ ID NO: 4131522 - RNA, 65 nt, Human
ggggaagaaugcucucuagagaauucucuuuguccucugaaguaaauagagaucaugucuucccc

SEQ ID NO: 4131523 - RNA, 60 nt, Human
ggggaagaauggcagaaaacaucaccagagaagccagugaaaaacaugccauucuuucuc

SEQ ID NO: 4131524 - RNA, 62 nt, Human
gguugaccuacauggacuacaucagugggcagcauggccucuggcuuccaguggguucaacc

SEQ ID NO: 4131525 - RNA, 73 nt, Human
gguugacuuagcuaaacuguaacuagaauucucagaauucucuuccuuguacaguucuaaguuaggguuggcu

SEQ ID NO: 4131526 - RNA, 129 nt, Human
gguugagagggaaaugacuacagugguaaauaaggcggaaucaggaugacugucauuucaguaagaauuuauugaacgcauaacuuuguucucagcacuauuggcacuguacaaauuccagggaagacu

SEQ ID NO: 4131527 - RNA, 62 nt, Human
gguugagccaggguuuccggcugcugccuuagcaacagcagaggagcgauggcugcccagcc

SEQ ID NO: 4131528 - RNA, 97 nt, Human
gguugaggcaggaaggcaggaggaagcgugggucuggcuggagccucacaaucaaagccucuguucaguuguaccuuccccucuucccuccuccacc

SEQ ID NO: 4131529 - RNA, 72 nt, Human
gguugauggugggcagguagugaugucuuagauaccaaggaugacaucaccacuacaaacaucauugugacc

SEQ ID NO: 4131530 - RNA, 69 nt, Human
gguugauguggaaguucugguguuugcauguuuuggugcugauaauuugcugacuuucaguuauuaacc

SEQ ID NO: 4131531 - RNA, 102 nt, Human
gguugauucuaccacucucuuuagucaacaguaauggcauugccaugacuauuagucgugguuggauauacuuugcuagaaauggggguuauugaauuggcu

SEQ ID NO: 4131532 - RNA, 66 nt, Human
gguugcaagggauaggggaugaggguccuaaccuauccagaggccuccuguuccauucccucaacc

SEQ ID NO: 4131533 - RNA, 76 nt, Human
gguugcaauugacuguucacugucuaugcccaugcauuuuauacaaggcugggcaguaugaauauucaaagcaucc

SEQ ID NO: 4131534 - RNA, 59 nt, Human
gguugcaauuucuggaacuaauucugacaaacuauuguuggaagaauagagauugcacu

SEQ ID NO: 4131535 - RNA, 82 nt, Human
gguugcccagcuuccuuugguuggagcgccgucuccuggccagagaaugugaagcucagccaaaggagaucuuugggcuucc

SEQ ID NO: 4131536 - RNA, 70 nt, Human
gguugcccaugggagugguugacuugaaagcauauuuauguauugacuuucucuccucccaggugucacu

SEQ ID NO: 4131537 - RNA, 124 nt, Human
gguugccgcuggucuuccuuauuuuaguguuuucgugauacucaggcuguuuuuuccuuguuuaugaccugacugggaaagugcugccugcagcugaugauuaacucugggaggccuggcaucc

SEQ ID NO: 4131538 - RNA, 98 nt, Human
gguugcuaaugauauuuuuccaugugggacucuauaagucuugacuggaggguagagggcagagagaguccugaguggaaaaauggucaggagagauc

SEQ ID NO: 4131539 - RNA, 104 nt, Human
gguugcuguaggccuuuguuuucuagagugacaacaaaguugguucugacaguuuggcuuguuuauucaguguuucaguuuggaaaugagagcuuggagcuucc

SEQ ID NO: 4131540 - RNA, 69 nt, Human
gguugcugucaagguuacaugcuuucucuuccauaugcagaaagcuucaccugcuggcaggucucagcc

SEQ ID NO: 4131541 - RNA, 81 nt, Human
gguugcuuaacagagagaaguguugcuuaacuucccagaaaccauuugagcugauacuacuguucuauuauaaaugcaacu

SEQ ID NO: 4131542 - RNA, 61 nt, Human
gguuggaauuugaacggaagucuuuuuuucacaaauauaagacuucaugggucaaccaauu

SEQ ID NO: 4131543 - RNA, 65 nt, Human
gguuggauggucuuggcucggagucuccaugaaauuacaguuagauaucagcuggggcugcagcc

SEQ ID NO: 4131544 - RNA, 86 nt, Human
gguuggcggaucgcagggguugagagaacguaugcuguuuuguagacccgcggccagcagcagggcucugcccgugcauccgcucc

SEQ ID NO: 4131545 - RNA, 97 nt, Human
gguuggcuggggugggguuggugggacuuguguggcaguauuugcacaauccugagagauccuccaccugcaagaauucccccaauacccagugacu

SEQ ID NO: 4131546 - RNA, 69 nt, Human
gguugggagucacuguuguugaggguggucaaagaauuuguuuccccacaaggcauguggcuuugggcc

SEQ ID NO: 4131547 - RNA, 56 nt, Human
gguugggauuuggauuccucuggagccacagagguguugggagccaggagcccacc

SEQ ID NO: 4131548 - RNA, 61 nt, Human
gguugggucucucugucucucccugggucgagagcugagaggaaagaauauagaugcaauc

SEQ ID NO: 4131549 - RNA, 63 nt, Human
gguuggugagugcaggguguuaaggaagagaacggcuccucucuggccaccugcgucccagcc

SEQ ID NO: 4131550 - RNA, 74 nt, Human
gguuggugcaaaaguaguugugguuuuugccauuacuuuuauggcaagaacugcaauuacuuuugcaccaaacc

SEQ ID NO: 4131551 - RNA, 80 nt, Human
gguugguuuuugguguuagcuucacucuccuaaacccugcaacacaauaggaagcuuagugaaaggaccacauauuaacc

SEQ ID NO: 4131552 - RNA, 86 nt, Human
gguuguacacuguacaacuccagggaacacuauucacaucaaagacuuuaugaaugacuuuuccuguaguugugcaauguacaacc

SEQ ID NO: 4131553 - RNA, 97 nt, Human
gguuaaaguucaacccaugccuuucccaacaggguggguccacagggauuaguggccucugcuggggacaggccacucaggucacugggcuuugauc

SEQ ID NO: 4131554 - RNA, 62 nt, Human
gguuaacaguuauucuggggauucagauggagguugaacuccagagcucacaugucuaaacc

SEQ ID NO: 4131555 - RNA, 125 nt, Human
gguuaacuagugcagaaauuucuagccaugagaucaaagccaugagagauuuguuaauaaaacguagagaauaauauaaucuuuggcucugguccauugguccucggcauacugccucucuaacu

SEQ ID NO: 4131556 - RNA, 87 nt, Human
gguuaaggagcuuaacucugauuagcucaaguuaagcuugcagucacauagcagguuguugagaaucuagaggcuauacucuuaacc

SEQ ID NO: 4131557 - RNA, 60 nt, Human
gguuaauacaugggugugcuuuaucuguccgcuaccuggauauuaacaucaguguuggcc

SEQ ID NO: 4131558 - RNA, 60 nt, Human
gguuaaucuauuaugcugagaaacugucucuggggucacagcuuccuggcauggagaacc

SEQ ID NO: 4131559 - RNA, 85 nt, Human
gguuacgaggagagcugaggggcugcuggguccgccccuagccgccuggggauggacucagcuggccgcucauguccccucuucc

SEQ ID NO: 4131560 - RNA, 82 nt, Human
gguuacucauugcugaggcacugguaaugggcaugagaauuuuggcuaguuuaugcacuauauaccauguuuuuggguagcc

SEQ ID NO: 4131561 - RNA, 78 nt, Human
gguuacucuaaagacuaggaucuugguuucucagucaguauuauuaggaauucuuugaucuuaaucuugcguguaacc

SEQ ID NO: 4131562 - RNA, 117 nt, Human
gguuacugcugaaggugucagggugagggcggccugggugggcugcagcuuccucuugcucacagccuggacaguugccuggacuaaggaagcugacaucuucaccaucccaaugcc

SEQ ID NO: 4131563 - RNA, 129 nt, Human
gguuagcuugcuuuuugguuuuccaccaagugaggacacggcauuccaucccuccagaggaugcaguaaugaagcaccauacuggaaguggagaguggcccucuucacacaaccaaaccugccagcacu

SEQ ID NO: 4131564 - RNA, 95 nt, Human
gguuagguuaaugagugucauacagaaugcauaaguuaaaacugaaucuucgguauccuauuccuguguaugucuugcugccuuauaauuuaacc

SEQ ID NO: 4131565 - RNA, 78 nt, Human
gguuaguuuaauuuuucagcugugaauugagaacaaacuauccuaauacauaguguuuugaagaauuaaacauggacu

SEQ ID NO: 4131566 - RNA, 61 nt, Human
gguuauaaggaacaggagucauucaagguacuaugaauucaacuugcugggcuuuguuacc

SEQ ID NO: 4131567 - RNA, 63 nt, Human
gguuaucaguacguuuguagaugcugccaaaaucuuuuggcuccaaaucaacugcuguuaacu

SEQ ID NO: 4131568 - RNA, 76 nt, Human
gguuaugacacuuuacuguuuacagcuaaugcauaguuacuugcaugccaugguuguacaguagcagacuaugacc

SEQ ID NO: 4131569 - RNA, 71 nt, Human
gguuauggggaugggauaugguagguagaauaaugcccucccaaaaugugcauguucgaauccccagaacc

SEQ ID NO: 4131570 - RNA, 82 nt, Human
gguuauguucuagacuuuugcugugaaacugaguguguaaaauuugcuauuccuucuccacugcaguaacucuaggacugcc

SEQ ID NO: 4131571 - RNA, 72 nt, Human
gguuauucauugugcuaaaguaauaagucagcucauccuuugauuuuaucuguuguuuuaguacaauugacc

SEQ ID NO: 4131572 - RNA, 70 nt, Human
gguuauuuucauuggcucagacugggcaaaguuuugccugcagguuuuuggugcucuuggagaauuaauc

SEQ ID NO: 4131573 - RNA, 69 nt, Human
gguucacaagaguuacagacagacacuuugcuguuuuuauuucagcaguuugugguuacugugugagcu

SEQ ID NO: 4131574 - RNA, 60 nt, Human
gguucacagguccgacugcuggucacaguuauccguggcugucggucauccuagugagcu

SEQ ID NO: 4131575 - RNA, 67 nt, Human
gguucagagguaaaaacucacuguauuugauucucacaucaaauuucugaggucuuaccauugugcc

SEQ ID NO: 4131576 - RNA, 78 nt, Human
gguucagguaugagauaaaucaaugaaccccuugaaguggaauuggguuguuugaacacuaauuuuaagccauggacc

SEQ ID NO: 4131577 - RNA, 97 nt, Human
gguucaggucuguuccaugcauggucaugcugggacuaauucggauaugcuuaucaugacagcaguucgccagugugcaugcaggagggcaugagcc

SEQ ID NO: 4131578 - RNA, 64 nt, Human
gguucagugcugcccuccccagcaggaaguggguuaguggacuugcugggaacaggauugaauc

SEQ ID NO: 4131579 - RNA, 75 nt, Human
gguucaguuacaugcucaugucaucauugucccauagcaauuugaacaugcugcaugauaauuauuucuugagcc

SEQ ID NO: 4131580 - RNA, 78 nt, Human
gguucauccauauuauagcauguaucaauccuucauuccuuuauuuggccgaauaauauucuguuguauggaugugcc

SEQ ID NO: 4131581 - RNA, 77 nt, Human
gguucaugaaguuuguuagaaucagaagagagguauuuuuucagucuagcuuuucugacucagacuaguucguagcc

SEQ ID NO: 4131582 - RNA, 77 nt, Human
gguucaugcagacccaggauccaaauguugccugguaucuugucuggaguaauauuucuacccugcugccuuggacc

SEQ ID NO: 4131583 - RNA, 82 nt, Human
gguuccaagucuuugcuacugugaauagugccgcaauaaacacaggugugcaugugucuuuacagcagcaugacuuauaauc

SEQ ID NO: 4131584 - RNA, 82 nt, Human
gguuccaagucuuugcuauugugaacagugccacaauaaacacgugugugcauguggcuuuauaguagaaugauuuauaauc

SEQ ID NO: 4131585 - RNA, 83 nt, Human
gguuccaccauauuggucaggcuggucucaaacuccugaccucaggugauccaccagccucggccuccuaaagugcugggauu

SEQ ID NO: 4131586 - RNA, 68 nt, Human
gguuccacugcuaacuugcugcagcuuacugggugaucuguaaauaaaaagggagguggcgguggucc

SEQ ID NO: 4131587 - RNA, 64 nt, Human
gguuccaggcauggcaggauguagaaguuaacauuuguuggagacuguuuugcuuccuggaauc

SEQ ID NO: 4131588 - RNA, 58 nt, Human
gguuccaggguuggaugagucacuuaguaaaucugagugaccuaacucccccucuucc

SEQ ID NO: 4131589 - RNA, 66 nt, Human
gguuccagucucucccagaggagcagcguuuuccugucuuuggcuucucugagacacucuggagcc

SEQ ID NO: 4131590 - RNA, 56 nt, Human
gguuccccgcagccuugguuuaugguuaaauauuacagaggccccgugggagagcc

SEQ ID NO: 4131591 - RNA, 89 nt, Human
gguuccgauaacuuugcugggaggaguuugaaaaccuugcuuguugaaacccaguuucacaauuuccuugcuucacuuugcaaagagcc

SEQ ID NO: 4131592 - RNA, 55 nt, Human
gguuccucagcccaugacagauggaaggcgcuauauucaaaggcaaggaggaacu

SEQ ID NO: 4131593 - RNA, 61 nt, Human
gguuccugggguuuagagggaagugagcagagcugcucccuggccuacaggcccagagacc

SEQ ID NO: 4131594 - RNA, 74 nt, Human
gguuccuugagcacagcggcuucaggaggggaucgggacagcucccuuugauaagcguaacugugcucugagcc

SEQ ID NO: 4131595 - RNA, 63 nt, Human
gguucuaagacagcaugauaggccucuaggccuggccuggacucuggcucaguguugcuuacc

SEQ ID NO: 4131596 - RNA, 113 nt, Human
gguucucgauccuugccucagaccuaguaaaucagaagcuguggggugcagcucagcccuuugucuucacagguuuccuaggccauuuugacacaggcuaaaguuuaagaacc

SEQ ID NO: 4131597 - RNA, 56 nt, Human
gguuucuauguaggauuuugguaacugaaucgguuuccucaucuagcacagaaauu

SEQ ID NO: 4131598 - RNA, 55 nt, Human
gguuucucaacagaguaugcccuugacaucagguaugaaucucuggugggaauuc

SEQ ID NO: 4131599 - RNA, 59 nt, Human
gguuucucaccuucagcacuacugucauuauggacuuugcuggggaaacgugagaagcc

SEQ ID NO: 4131600 - RNA, 71 nt, Human
gguuucugggauagggucugagaauuuaaauuuccaacaaauucucaagugauccuguugauucagagacc

SEQ ID NO: 4131601 - RNA, 62 nt, Human
gguuucugguucacagagcuuguucauggccucccugaggcuaucgacucugugcaggcucc

SEQ ID NO: 4131602 - RNA, 74 nt, Human
gguuucuguuccuuguauucagcaucuuaacuaaaauauuagaaugaaauguugaaugcaguuugauuagaacc

SEQ ID NO: 4131603 - RNA, 85 nt, Human
gguuucuuacuacagaugccuugggauauauggacacuggcauuaccugcugcaacagguccucucccaggguacugcugagacc

SEQ ID NO: 4131604 - RNA, 59 nt, Human
gguuucuuacucacuuaugcuuuauucauagagagggagagcauacaucauaagaaacc

SEQ ID NO: 4131605 - RNA, 73 nt, Human
gguuucuuuuauuaggccucuaccuuugggaucaaaacugcuaaauuccaacagaaacaugaucaaaggaacc

SEQ ID NO: 4131606 - RNA, 61 nt, Human
gguuugaagccuaggaccaauaggcuauacaauauagucuagauguguacuagguuauacc

SEQ ID NO: 4131607 - RNA, 72 nt, Human
gguuugcaugugauguugggcaacagguuuauuuggcuacauucaugcccacauccacuagacaugcacacu

SEQ ID NO: 4131608 - RNA, 69 nt, Human
gguuugccuuccugcccagcuucugugacccagggggcagcuggacggcugggcaggggucuggggacc

SEQ ID NO: 4131609 - RNA, 79 nt, Human
gguuugcucauugacaucacagauugugaauaacuaugagaaaagggcucauaguauucaccuguggcuuaaguagacu

SEQ ID NO: 4131610 - RNA, 59 nt, Human
gguuugcugcagugagacucacugauacaguuucauucaguagaagcacuaggcaaacu

SEQ ID NO: 4131611 - RNA, 97 nt, Human
gguuugggacuccuaccuguccgccugguccagguaaggaaagccauugcugagaagagggccgacccaccccaagguaugaguuauuucccaaacc

SEQ ID NO: 4131612 - RNA, 59 nt, Human
ggggagggacuuggucuggggcccacagaaaggcuggacaccagagucaugucuccccc

SEQ ID NO: 4131613 - RNA, 73 nt, Human
ggggagggaggcccaguggagggccauggcacaugaccugguucugcccugccagugggcucagccccucucc

SEQ ID NO: 4131614 - RNA, 61 nt, Human
ggggagggauuuucccaaaauaagaagcaggggauucagauucugggacuccuuccucccc

SEQ ID NO: 4131615 - RNA, 66 nt, Human
ggggagggcacgaaacaaccacuucuggaggcauucauccaaggaggguuacacugugcucucucc

SEQ ID NO: 4131616 - RNA, 76 nt, Human
ggggagggccaggcggagacaggcgaggccaacagagccccugccaccuugccugcucucucaccugccccgcccc

SEQ ID NO: 4131617 - RNA, 78 nt, Human
ggggaggggaacauggcaaagaaccugcugugaagucugucuuuaugccuccagaucuugcuuacauuuucucucucc

SEQ ID NO: 4131618 - RNA, 55 nt, Human
ggggaggggauaaggggcccgggggcaggugccucugagccagggucuccucccu

SEQ ID NO: 4131619 - RNA, 66 nt, Human
ggggagggguaaagagaaagugaaacuggagggagggagguuucugcuucucagacccugaacccc

SEQ ID NO: 4131620 - RNA, 94 nt, Human
ggggaggggugaggggggcguuuguucuucaggagccccuucuccacuggcagcccuggcuccugaggaccaggcacagucuucaccucucuuc

SEQ ID NO: 4131621 - RNA, 64 nt, Human
ggggaguaagucagugcuagcuaauggcuaagagcuuggccaaggcuauacacugguggccucc

SEQ ID NO: 4131622 - RNA, 130 nt, Human
ggggagucgcccaagcccgcuucugacccaggagggaggaguuccugagggcucccuugcuccccugcccucaggcagcuguucccuccuugugucuuuggcggaggcccugggcugagguguguucucc

SEQ ID NO: 4131623 - RNA, 74 nt, Human
ggggagugaaguaaggccuucuugagcaugaauuuuagcccaaauuuauuuucuggacagucuugcuuuucccc

SEQ ID NO: 4131624 - RNA, 59 nt, Human
ggggaguuuacagccuagcgcuuccuacuugcuuugcacacuggucugucaugcucccc

SEQ ID NO: 4131625 - RNA, 57 nt, Human
ggggauacuguaggccugaaucugccucguccuugaauuagguuggacaguaucccc

SEQ ID NO: 4131626 - RNA, 65 nt, Human
ggggauaguggauuggggagcaaauaagagaugaagaagucuuguguccuuaaugcaauguccuu

SEQ ID NO: 4131627 - RNA, 56 nt, Human
ggggauauuugagcagaugcaguugaauuugaaaacucugaacacaauauaucccc

SEQ ID NO: 4131628 - RNA, 57 nt, Human
ggggaugcacgaaggcgccucggagagaccccuuucuccgggugcccacgugccccu

SEQ ID NO: 4131629 - RNA, 62 nt, Human
ggggauggaauguaguagugaucuugauaccccauccaauucacucuccuauucauuucccu

SEQ ID NO: 4131630 - RNA, 130 nt, Human
ggggauuccagacgaggcuggaguuggaagacagagggcauggccgggaggacgaccucggcugcagcgguggcuguggagccuccugggcuccugucugcaccccugguccuggcuucacaaacagccc

SEQ ID NO: 4131631 - RNA, 77 nt, Human
ggggauucugacacagcuugagguggccuagggcacaagcuagagucaugagacccuuugggucugugcaggacccc

SEQ ID NO: 4131632 - RNA, 70 nt, Human
ggggauuuaagauacaccaagagccuaguagaaauuugcccaggauucuuggguauuaacagccuuccuc

SEQ ID NO: 4131633 - RNA, 105 nt, Human
ggggcaagaaaagacgaacuugagcauacacagcccacgagcuacacuuauccagaaauacagcacccucuugagugcgcuuggguguucuagugauuucucucc

SEQ ID NO: 4131634 - RNA, 64 nt, Human
ggggcaaggcuggguaaccuguccacugccugaugucagaguggcagagaccccagccagcccu

SEQ ID NO: 4131635 - RNA, 108 nt, Human
ggggcacacgagagcugagcagucacuuccuuccuugugugugagacugacuucugucuauaagcagggggauggaguugaaaugccugcucaucuuuuauguguuuc

SEQ ID NO: 4131636 - RNA, 73 nt, Human
ggggcacaggaagccgagggaggugauggagacggcgaagggugcucugguccucccucggcgccugcguccc

SEQ ID NO: 4131637 - RNA, 81 nt, Human
ggggcacugcagggagggcccuccucuuucuagcugaggucaccgaggugcagagagguggagggacuuucucaaagucuc

SEQ ID NO: 4131638 - RNA, 55 nt, Human
ggggcagaaagcccacagagugcccagccugccucugugugugccccccugcccc

SEQ ID NO: 4131639 - RNA, 56 nt, Human
ggggcagacgcgagcaccggggcagagagacccacugccuggagucgcgcugccuc

SEQ ID NO: 4131640 - RNA, 69 nt, Human
ggggcagagaggaagggguuaggggucccugagucagcucaggcagccccgccccuccccaccuccucc

SEQ ID NO: 4131641 - RNA, 62 nt, Human
ggggcagaggaaggcuucaccugcaaaguagacacuucugggccauggccuuccucagcccu

SEQ ID NO: 4131642 - RNA, 56 nt, Human
ggggcagagucuggacuguugucuuccagcuccaagcacagcacuccuuuuguucc

SEQ ID NO: 4131643 - RNA, 62 nt, Human
ggggcagauagcagaggccuuauuacguauuucucucuugugauaaaacucuaaucuggccu

SEQ ID NO: 4131644 - RNA, 59 nt, Human
ggggcagccagccaggcucagggcaggaagcugcugauucugggucacuuggcugcucu

SEQ ID NO: 4131645 - RNA, 64 nt, Human
ggggcagcccagaaggagcuguuggguggcgccagcaaccaggucuccuugugggucuugcccc

SEQ ID NO: 4131646 - RNA, 65 nt, Human
ggggcagcuccuguggaauccacuccuaaguggcgcucacucggugguuccacuggcagugcucc

SEQ ID NO: 4131647 - RNA, 76 nt, Human
ggggcaggaggcaggugcauuuugagcucuuccuaaaguggacuccuuugcuuugcacuucucgagcuuucucccc

SEQ ID NO: 4131648 - RNA, 73 nt, Human
ggggcaggcucuuuggggggauuuuccuaagcuggacugcaggcuggcuucccagcagagggcgcacugcccc

SEQ ID NO: 4131649 - RNA, 90 nt, Human
ggggcaggcugggcaggagaaggcugcacacggaaccucagugaguccccauggccugccuccuccuggugccacccaaccgccugcccc

SEQ ID NO: 4131650 - RNA, 86 nt, Human
ggggcagggaaugaaagcggcgcuugagacuggaaauuuagggagaugaguuccuugggaacaacgcugaaccaucucacugcccc

SEQ ID NO: 4131651 - RNA, 73 nt, Human
ggggcaguuauagcuucucccuuuccuauugguuagcaacucugaccagggcccgggagagcucuccaguccu

SEQ ID NO: 4131652 - RNA, 55 nt, Human
ggggcaguucucuauucugugcacugucugcccacugcaggguguugacuguccc

SEQ ID NO: 4131653 - RNA, 81 nt, Human
ggggcaucuccacugcucucagaaacacaacuuuguacacacgccaaauugcuuuugggggcaguuacagcagagauccuc

SEQ ID NO: 4131654 - RNA, 62 nt, Human
ggggcauuuggugagacagaaaucaaggguuuggcuugggaccugauauguuugaucacccu

SEQ ID NO: 4131655 - RNA, 68 nt, Human
ggggccaaaacauucucugcagcagggccugcccugugcauuggaggguguuucacaucccuggccuc

SEQ ID NO: 4131656 - RNA, 87 nt, Human
ggggccaagcagggcucccuggggacucggggcuggggaaggaaagccccaaaggcuggagucugcgguuuggaguccugugacucu

SEQ ID NO: 4131657 - RNA, 60 nt, Human
ggggccacacagggcagcucccucugagcuuucgagauuuggagggugacccugagcccc

SEQ ID NO: 4131658 - RNA, 62 nt, Human
ggggccacagcagggaugaauggaguggacacgucgcuucucugugauuuguugcaggcccu

SEQ ID NO: 4131659 - RNA, 78 nt, Human
ggggccagcagggugcuuccguggagcugucuuuguuuaugucuucagcaagcggccugugaaagccccuccaguccc

SEQ ID NO: 4131660 - RNA, 67 nt, Human
ggggccagucugggccacggucgggacccaguggagggccggacuggucaggguucaggcgggaucc

SEQ ID NO: 4131661 - RNA, 114 nt, Human
ggggcccauguguguggcaugggacugggauugcugggcucuucaacacacaguuucugggagccuguggcuguugaggaccccaagugccccagaauggccucgcuuggcucc

SEQ ID NO: 4131662 - RNA, 68 nt, Human
ggggcccauuuggucauugggcugggggggcagaguccucucaggcucaaagggccggaugagguccc

SEQ ID NO: 4131663 - RNA, 85 nt, Human
ggggccccuauucaguaagauugaauugcagccuuuggaaggccugucuguuucugauucaaccuuaguugcagggugcagcccu

SEQ ID NO: 4131664 - RNA, 85 nt, Human
ggggcccugggagaggcugcuccgcucucaaucccgcaaccgcggucccggagggcccugggcuucugccuuucccgcgggcccc

SEQ ID NO: 4131665 - RNA, 71 nt, Human
ggggccgcucaggaggugcuaggauuggccggugcagacguggagcugcaguguuggaccucagggguccc

SEQ ID NO: 4131666 - RNA, 68 nt, Human
ggggccggggaccccugccgcgcccccguacccggacggggauggggcgaggaggggugcugggcccc

SEQ ID NO: 4131667 - RNA, 59 nt, Human
ggggccgggggacugggcuucauguuauucuucaaaggaaagacaccagccucugcccc

SEQ ID NO: 4131668 - RNA, 80 nt, Human
ggggccugagauaauagcaggcagguuuugaaaccaguagacuugacuuuaaagguucugcugcuuccaaguuaggccuu

SEQ ID NO: 4131669 - RNA, 55 nt, Human
ggggccuggcagcucagguggcucugcaccuucuguccuugagcuaagggacccc

SEQ ID NO: 4131670 - RNA, 112 nt, Human
ggggccugggggagacgagggagucccccucuguccccagugcaggccugggacugcacuaauuccgcauuggguggcagcgcaggacccccguccccucccccaacgcccc

SEQ ID NO: 4131671 - RNA, 60 nt, Human
ggggccugggggcugggcucugccacacagucaccuaccagagcuggccugccaggcccu

SEQ ID NO: 4131672 - RNA, 82 nt, Human
ggggccuguaggauggcacacaggucugcaagggagacugagcuuucuaccuuugccuggagacuucugaugccuuugcccc

SEQ ID NO: 4131673 - RNA, 93 nt, Human
guagcuaucuguggcugguaauugcauguuugaaaaguaacucacaugaaauauuagacaggcaauacuaacuagucacucaaggauuuuuau

SEQ ID NO: 4131674 - RNA, 64 nt, Human
guagcuccacauggcugggaggccucagaaucauggccugaggcaaaaguuaugugguagcggc

SEQ ID NO: 4131675 - RNA, 59 nt, Human
guagcugccuuucuggcccaggaccacaccaugagugggcagacuaaggucaaagcugc

SEQ ID NO: 4131676 - RNA, 104 nt, Human
guagcuggggagagugggguucaagcagggcagggagcuuagaaugacccucaggguccucaguguaccauugcugaaguugacaacucccucuuuccaccugc

SEQ ID NO: 4131677 - RNA, 60 nt, Human
guagcugugcagagguuuggcuuaagauccaaauacuauagcucagccgggcacaguggc

SEQ ID NO: 4131678 - RNA, 56 nt, Human
guagcuugaagaagauuguagagcagagcugcaguacaauugauggcuuaaguugc

SEQ ID NO: 4131679 - RNA, 80 nt, Human
guagcuugcuccuauuuuuuucugauuggagucucuuuauuaaaagaauuguuuaauuugaaaugaguaacccaaguuac

SEQ ID NO: 4131680 - RNA, 74 nt, Human
guagcuuguuaaggaugcauauuauaauaucuaaagaaaacacuaaguuguaaaauauugcauaacaagcuaac

SEQ ID NO: 4131681 - RNA, 59 nt, Human
guaggaagcucugaggcuaguugauuuuucaucaucuuuagauagccuuuccuuucuac

SEQ ID NO: 4131682 - RNA, 73 nt, Human
guaggaauucacaguuacugcugaaccauuauauuuaauaaaacacaauguguucuuuuauugugaauuucac

SEQ ID NO: 4131683 - RNA, 63 nt, Human
guaggaauugugggggaaaaaaugcaaucaacaaaagccucuucuucccucaggauguccugc

SEQ ID NO: 4131684 - RNA, 76 nt, Human
guaggacacccagucagcugccggacacucagguaaggagguacuggagccaaacugucugagugacugggucugc

SEQ ID NO: 4131685 - RNA, 69 nt, Human
guaggagaacaggacacagucaucccuauucucaaggauacagaaaacuucuggguccuguucuuuuac

SEQ ID NO: 4131686 - RNA, 96 nt, Human
guaggagaauaagcacuuccuggggccagcacugugccuuugugggcauccuaaaccugggagggcugccguggccuugggagcugauacucuugc

SEQ ID NO: 4131687 - RNA, 78 nt, Human
guaggagaggugagagguacaaguucaauucaaaucaacaaguaacuuuugagcagguguaucggucaccuacaauau

SEQ ID NO: 4131688 - RNA, 81 nt, Human
guaggagauaggacccauguaggagaaugcauuucaaaagcacauucugaauaguucuacuacuugacacuuauuuuuugc

SEQ ID NO: 4131689 - RNA, 70 nt, Human
guaggauaaacuggguaucaagaggccuauauguauagacuuccugaauaagaccuaguuuuuaaucuac

SEQ ID NO: 4131690 - RNA, 80 nt, Human
guaggaugucaaggauuuaggauuuuauucuaaucccaggaggaaucuuaaaucggaaucuuaagucuauuuucauuuac

SEQ ID NO: 4131691 - RNA, 69 nt, Human
guaggcaagagugugacacccagagcccacugggagugaacuggcugguguuacagucggcagcgcugc

SEQ ID NO: 4131692 - RNA, 62 nt, Human
guaggcacugcagaaagaagguuugggcaaguuucaagucuguuucauugcauguuguuuau

SEQ ID NO: 4131693 - RNA, 55 nt, Human
guaggcagcuuagguuagaaguguuggggaccccacuuuuaagagggcagccugc

SEQ ID NO: 4131694 - RNA, 72 nt, Human
guaggccacuggacagacccuacuucguccuaaaguaaggugaaggccaaaagacgggcuuccagggccaac

SEQ ID NO: 4131695 - RNA, 62 nt, Human
ggguacaauuuauggcuguaaagaaugagguuuaucuuaacagacauuccauaauguacacc

SEQ ID NO: 4131696 - RNA, 80 nt, Human
ggguacagaggagguggaauuccaggaauugagggagcaaaaccauggcacaguucaaggaauguuggcuucucuggcuc

SEQ ID NO: 4131697 - RNA, 74 nt, Human
ggguacauucagaauugggaggcaaugaauugauaacugacacaaccuuuuugucauuccuuucuaauuguccc

SEQ ID NO: 4131698 - RNA, 90 nt, Human
ggguacauugucucucaccugcuguccaggagugcccugugggacucaccaggagguacaucuugugauggauguugaaacaagaaaccc

SEQ ID NO: 4131699 - RNA, 86 nt, Human
ggguaccaggcuggggggcggggggagcuggaaugaauuaacgccauuaaugucuggaaaccaccccguuucuccagaaacugccc

SEQ ID NO: 4131700 - RNA, 71 nt, Human
ggguaccuggccaggccccuugcagggcagaaccucaggugaaugggccucucagggucuggccggguccc

SEQ ID NO: 4131701 - RNA, 71 nt, Human
ggguaccuggccaggccccuugcagggcagaaccucagguggauaggccucucagggucuggccggguccc

SEQ ID NO: 4131702 - RNA, 75 nt, Human
ggguacugggccugggagggcagacgcugagggcagagcaagggcccuggagucagaacccaggcuucuaguccc

SEQ ID NO: 4131703 - RNA, 77 nt, Human
ggguagaaauggcaauguggcuuauuuggaggauuguauauuuuguuuucuagaauguuccaccuuguuuccuacuu

SEQ ID NO: 4131704 - RNA, 81 nt, Human
ggguagacaagagacagagaguaaauggugauguuagaguaauaggauguuaacacaggacucucugccuuaguuuugccu

SEQ ID NO: 4131705 - RNA, 58 nt, Human
ggguagcugcacuuugccaggaaaaugaggaguaagccuuccagaguucagucugccc

SEQ ID NO: 4131706 - RNA, 130 nt, Human
ggguaggaugacuggaauagcucugggaguauuuaguuguggacauaggucugucccuuagggccacuuggagggcccaagggagugccuggucaacuugugcaaucccuuugcuguggcuggcaugacc

SEQ ID NO: 4131707 - RNA, 57 nt, Human
ggguagggaaggcucugcggggaugcacuggccgcuucccccuugucugacccuccc

SEQ ID NO: 4131708 - RNA, 78 nt, Human
ggguaggggcagcucgcuuuccugagaaaggagaaggagguccccuucuucuccuaaggagaguccugcccagcgccc

SEQ ID NO: 4131709 - RNA, 55 nt, Human
ggguagggggcagcugggggugauuguccagccucagcugcguguccucccaccc

SEQ ID NO: 4131710 - RNA, 63 nt, Human
ggguauaauguuugggaaggugcuuuguaaacuauaaggggcaauacaaacauguaguacacc

SEQ ID NO: 4131711 - RNA, 61 nt, Human
ggguaucucagaggcucaucugccuugcagguucauugcaggcaaaugaguaucugugucc

SEQ ID NO: 4131712 - RNA, 100 nt, Human
ggguaugaaaaagacuggguaaaguagauacugugaaauucuuuucuggagugauuuuaucaauuuacucaccagcuuuguaggagaauucaaacugccc

SEQ ID NO: 4131713 - RNA, 74 nt, Human
ggguaugcauuucuggaucucccagcaguccugaggccaggagucuggcuggccauguagagaugauuguaccu

SEQ ID NO: 4131714 - RNA, 87 nt, Human
ggguaugcucucauuuacuguagaacaguuaggauuauuuuucaccuuucacuacucuaguuuuguaguaaauacccucguauaucc

SEQ ID NO: 4131715 - RNA, 57 nt, Human
ggguaugcugcaugcuggggagcuaggucagagacucagacaguuugcagugugccu

SEQ ID NO: 4131716 - RNA, 68 nt, Human
ggguauuuacugugacauucuugguguuggcaaaaaagcuggugacaaagagaaguaacaguaccccc

SEQ ID NO: 4131717 - RNA, 83 nt, Human
ggguauuucugcucuugcugcuucaccuguuguacaguuucccugaucuugugcuaugcaguugggguagcaaagaagugucc

SEQ ID NO: 4131718 - RNA, 79 nt, Human
gggucaauuacagcacaguacuccauuucucuagcuucagugauugguacaaguucuggcaugugauucuaaccgaccc

SEQ ID NO: 4131719 - RNA, 130 nt, Human
gggucaauuuaaauuggucagcacgcuguucuguucugagggguugaggcucucccaaauuaucaucccuaggacugcugcauucauaucagauagaagaggugaaggaccugaauuauauguugagccc

SEQ ID NO: 4131720 - RNA, 66 nt, Human
gggucacaaguuggggcuugggacuggucucucauaugggagugcuguaggacugagcccuugccc

SEQ ID NO: 4131721 - RNA, 55 nt, Human
gggucacugcucuaaacaaaaguagugaucuuaaucaugacugagcagcagacuc

SEQ ID NO: 4131722 - RNA, 70 nt, Human
gggucagagaacgcaaauccaaaccuagaaauaugaaacugccuucuaaagagaaugcguuucugcuccc

SEQ ID NO: 4131723 - RNA, 56 nt, Human
gggucagaucagcgggccaacugggaaagagccagggcccacuggcugucugaccc

SEQ ID NO: 4131724 - RNA, 56 nt, Human
gggucagcgauuucaggggcagucccuuucacugcuuaauccaaccuggcugacuu

SEQ ID NO: 4131725 - RNA, 83 nt, Human
gggucagcggccggccgggcucucgccgagcuaugugcguuggccaccagguuccgggcagagcugaagccaggcagggaccc

SEQ ID NO: 4131726 - RNA, 119 nt, Human
gggucaggggugcaggagcagacaugccuccuagggucccagauaggagccagaaauggccuggcucugagugguaucuugaaaugggggcugccuagggccacugcacccugggaccc

SEQ ID NO: 4131727 - RNA, 59 nt, Human
gggucaggguggggugggguggggcauucuaaucccauggucacccaggcugcuggcuc

SEQ ID NO: 4131728 - RNA, 55 nt, Human
gggucaguuuggagguuuucuggcuaaggcguuggaugagucuacacacuggcuu

SEQ ID NO: 4131729 - RNA, 70 nt, Human
gggucaucgguucgcucauuccacaggcaucugcugagucuucgccaggccugguugagcccugagaccc

SEQ ID NO: 4131730 - RNA, 63 nt, Human
ggguccaagcaagucagggcuucugagggaggcugcugccaagggcucugacuugccugcccc

SEQ ID NO: 4131731 - RNA, 59 nt, Human
ggguccagacacuccagaggaaggucauauuauccuccucuuaaaagaguguauggcuc

SEQ ID NO: 4131732 - RNA, 64 nt, Human
ggguccagcuacaucaggguggguacuuguguccucuucccauacucgccucaauccuggaccc

SEQ ID NO: 4131733 - RNA, 59 nt, Human
gggucccaggacucugacacccccaauggcccuuguagccuuggggaguccugugaucc

SEQ ID NO: 4131734 - RNA, 61 nt, Human
gggucccuggaagucccucuucugaugacccagaaccuucuuccaggccuuccagggaacc

SEQ ID NO: 4131735 - RNA, 72 nt, Human
gggucgguacggggaaguucgguuggccggcaggcugcggcuucggccacgggguuuccuccaauuagaucc

SEQ ID NO: 4131736 - RNA, 73 nt, Human
gggucguggcacccccugguggcugauccuagguagugucacugcccagccccaguaagggagggccuggccc

SEQ ID NO: 4131737 - RNA, 82 nt, Human
gggucuaaguuuauggaugaguuccugaggaguggagaucugcuuccccacucugucaccuacucacuguauccaaggaccu

SEQ ID NO: 4131738 - RNA, 61 nt, Human
gggucucaugcucuuuaaaguauguguuuugcagaaaagaacacauuaugagcauagacuc

SEQ ID NO: 4131739 - RNA, 63 nt, Human
gggucucaugugaccgcugucacugucuucuaugggacacuguucugcauguaccugaggccc

SEQ ID NO: 4131740 - RNA, 76 nt, Human
gggucuccugggagguccccagagggucuccugggaagucagccaagaggcccuggguuagggcccacugagaccc

SEQ ID NO: 4131741 - RNA, 88 nt, Human
gggucucgcucucuugcccaggguggagugcaguggcgugaucucggcucacugcaaccuccgccucccagguucaagagauucuccc

SEQ ID NO: 4131742 - RNA, 55 nt, Human
gggucucugagugaggaccugggcccgguaaccagcccuggccuguuucaugccc

SEQ ID NO: 4131743 - RNA, 78 nt, Human
gggucucuucuggcaaggcaagccuggcuuguacucucuguggaaacuuaacuagccauggcugcagcuagagggccc

SEQ ID NO: 4131744 - RNA, 85 nt, Human
gggucucuugaggaaggggagcuaaaucuacuguaaaucagaugugagccugguccaguaguucccuuugccucacugaaugcuc

SEQ ID NO: 4131745 - RNA, 83 nt, Human
gggucugaagggacaauugugcuuccuggguuguagguuacuugguuuuaacagcuuuauugagguauaauugauaucccccc

SEQ ID NO: 4131746 - RNA, 62 nt, Human
gggucugaaugucuaaaaagaauuggcuuaaauuuuagcaauuuaguuugagacauuagccu

SEQ ID NO: 4131747 - RNA, 55 nt, Human
gggucugaggaguaccauuguccuauagauguuagacagcuguggccuugcaccc

SEQ ID NO: 4131748 - RNA, 79 nt, Human
gggucugauuuauacuucauaaugucuauuuggcugcaaugggucaacagaauugaaggagguaugaguuaaugggccu

SEQ ID NO: 4131749 - RNA, 100 nt, Human
guauguuuaagcacacuuuuaacuuggcauugucuucuacuguucuguuaauaucuaggaggggagcugaacugcugaaguuggaguugguuuauacugc

SEQ ID NO: 4131750 - RNA, 78 nt, Human
guauguuuuucuugaauagggauugauaaauggaagugcuuaccagcccaacuuugccagccuuaauaagaagcaugc

SEQ ID NO: 4131751 - RNA, 58 nt, Human
guauuacucuuguuugacaauuaauccuaaggauuaaguguauugcugaggguaauau

SEQ ID NO: 4131752 - RNA, 74 nt, Human
guauuagcaagaguugugauuuuaucaccaauagaaaucauauuuuccuguaacauuacggcuguggcugauau

SEQ ID NO: 4131753 - RNA, 62 nt, Human
guauuauuaggugcucucugacaagacaaauguuuucauuggaaauggcuaccuuaugauau

SEQ ID NO: 4131754 - RNA, 72 nt, Human
guauuauuuugaacaaugcguaaaaggugaaggccagcugaagaggccuuuuuguugugaacagaauaauau

SEQ ID NO: 4131755 - RNA, 99 nt, Human
guagggacaggguuuugccauguugccaaggcugguaucgaacuccugagcucaaccaaugagaccagccuggccaacauggcaaaacccugucucuac

SEQ ID NO: 4131756 - RNA, 66 nt, Human
guagggccuuguuaugguagaagguaggguugugcagucuggcagcaagauaacaaugggcccuac

SEQ ID NO: 4131757 - RNA, 93 nt, Human
guagggcuggcagcugugugaagaacugaggugaccagcaucaucuuccuacacauuauuguauucacccaucuuucaguuugucagucuuau

SEQ ID NO: 4131758 - RNA, 70 nt, Human
guagguagaugcaguuucuuucucagaaggcucugugccuuucaaaacagaacacuagcauucuguuugc

SEQ ID NO: 4131759 - RNA, 98 nt, Human
guagguaguuugaagagaagacuuuauauguuuuuggaaagaacacagaauaacugugucuuaaguuccaagacauuaagcuugccaaacugacuuac

SEQ ID NO: 4131760 - RNA, 109 nt, Human
guagguauuugcuuguugaauaaggaauuguaugguugguuacucuuuacggucaaagacucuaacucaugccauugcugaugguauauaauaagccaggaauaaauac

SEQ ID NO: 4131761 - RNA, 73 nt, Human
guaggucacucugggcccuacugggcuugguuccagguugcaguuuggguccagauuuguucuaugugucuac

SEQ ID NO: 4131762 - RNA, 55 nt, Human
guaggugaaguucuggcgagcuguggcacucagcaguuucaggaaguucagcugc

SEQ ID NO: 4131763 - RNA, 68 nt, Human
guaggugagguccaacacaauggguguuacuuuuucagugagcagcaucuccauggaucugaugcuac

SEQ ID NO: 4131764 - RNA, 65 nt, Human
guaggugcaugguagacucucgggucaugggagauuauccucauggcagagucaccugucccugc

SEQ ID NO: 4131765 - RNA, 83 nt, Human
guagguggcuggcuggaggugaggaagaauuugcuauucaaccagcagacauuuauccugucuccuccaugccaggcacaggc

SEQ ID NO: 4131766 - RNA, 75 nt, Human
guagguguagacuucccacugcagugacugagccuaggggacuuugccagugacaaagucggaaguccugucuac

SEQ ID NO: 4131767 - RNA, 55 nt, Human
guagguguuccuaaacugguugccauuugugcuccagauuuguaggggcucuuac

SEQ ID NO: 4131768 - RNA, 87 nt, Human
guagguuugcucuguguccccagagccgguggugcucacagcgcugcuagaggggucuguguacugcucuggggaggccagcaccuc

SEQ ID NO: 4131769 - RNA, 70 nt, Human
guaguaauaagggagguugugguacagucaucaaucacccucuuggaacugcuccaaaaccuccaucugc

SEQ ID NO: 4131770 - RNA, 75 nt, Human
guaguaauuagcacuugggaguauuuauuuauuuauuaaauauuuauugauuaaauacugcaggcuaagcacuau

SEQ ID NO: 4131771 - RNA, 58 nt, Human
guaguaauuguuuuaagccaccagccuguaguccuguggugguuugcgcaauugguau

SEQ ID NO: 4131772 - RNA, 58 nt, Human
guaguacagugagacaauguuuuccuucuucucugaaaauaaugcaaucacugucuau

SEQ ID NO: 4131773 - RNA, 81 nt, Human
guaguaccuagcucauucugagacuucaguaaauauugguuaaaugagagacugcaggaauucaaagugagcugaugcugc

SEQ ID NO: 4131774 - RNA, 57 nt, Human
guaguacugcuauuggaauagagucaagagccuagccauuuccaguagcuguaucac

SEQ ID NO: 4131775 - RNA, 61 nt, Human
guaguauacagauaugggcggaaaugguuauucaguuucugugugugccuguuaauauuac

SEQ ID NO: 4131776 - RNA, 93 nt, Human
guaguauucaaggaagauccugagcugcagaagggguuuuccugaugcaaacuggcaggaaaaaaucuuuggcucaagguuagccuaugcuau

SEQ ID NO: 4131777 - RNA, 90 nt, Human
guaguauuccaugauauggaaguaacacaguuuguuuaaucauuuucccacugaaagauaucuguauuguuuccaauuuuuggcuacuau

SEQ ID NO: 4131778 - RNA, 84 nt, Human
guagucaauaauucugagcgaaaaauauuuccuucaaaggaggauuauuuccuuaggaugaguuuuugcguuuggaguaacuau

SEQ ID NO: 4131779 - RNA, 70 nt, Human
guagucauuggugucugggguaaccgagaaccucaggauguggagggagucuagcccagagccuggcuac

SEQ ID NO: 4131780 - RNA, 64 nt, Human
guagugauuguuccucagggguuaugcuuuacacagcucggauuuccuaaaagauaaucauuac

SEQ ID NO: 4131781 - RNA, 69 nt, Human
guagugcaggggcaggcggcggggacaggaccaagacaaacaaaguuuccccucuuccucugacacuau

SEQ ID NO: 4131782 - RNA, 56 nt, Human
guagugcggggguaacuucucaugcaaacggugucugagauaaauuuccuuacuac

SEQ ID NO: 4131783 - RNA, 93 nt, Human
guagugcucaauuaauauuuguggaauuaaugcauaugaauuacaacuguggucaggauaauuacguucuacaagcauugaucuaguagcuau

SEQ ID NO: 4131784 - RNA, 104 nt, Human
guaguggcacaugccuguggucccggcuacucgggaggcugacgugggaggaucucuugagccuggguggucgaggcugcagugagcuaugauugugccacugc

SEQ ID NO: 4131785 - RNA, 60 nt, Human
guagugucugaguuuggaaaguccagagagcucuggaauucugaacagcucaguuguuac

SEQ ID NO: 4131786 - RNA, 78 nt, Human
guagugucugguuucugcugucugaauauauugaguauaaucugauuauauugaguauaaccagagaaaugcaacugc

SEQ ID NO: 4131787 - RNA, 71 nt, Human
guagugugaaguuuuagccaugucuguggguguugauuuguuccaauguaguaucuaaaugcuuacauuac

SEQ ID NO: 4131788 - RNA, 70 nt, Human
guaguguggggaucguguaaguauaaguaccaaucacauguguacaugucuacaugcauuuuugcauuac

SEQ ID NO: 4131789 - RNA, 59 nt, Human
guaguuacuguuuguucaauuugcuuuguucaggaaguaucucaaaaacaguaaucugc

SEQ ID NO: 4131790 - RNA, 59 nt, Human
guaguuagaguugugcuggagaugacgggaaaccuggauuagcacagacuuuugcuuac

SEQ ID NO: 4131791 - RNA, 70 nt, Human
guaguuagcacugucagcaagccucuagcacagucuauguguauauuaguggaaugauaugaagaauugc

SEQ ID NO: 4131792 - RNA, 63 nt, Human
guaguuaucaucauacuccagaccaauacuucucaucugugucuggguuauuaugauggcuac

SEQ ID NO: 4131793 - RNA, 63 nt, Human
guaguuauuuuacauggaaguuugcuguaggaauguugcuaacuucuuugugggcauaaguac

SEQ ID NO: 4131794 - RNA, 99 nt, Human
guaguugguccagggucacacagcucguagaggacaugaguacaaucugaauccaggcagucuaucucuggagccucuguguguuccuaaccacucugc

SEQ ID NO: 4131795 - RNA, 106 nt, Human
guaguuucauaaauauuuuccaaagaugucacaagaugugaugacuauacuaugaauuuacuuaaaagcaacacguuuuugauauugaaaacuaugugaaaacuau

SEQ ID NO: 4131796 - RNA, 96 nt, Human
guaguuugcagcgucaggcagcggguccgcgcccagcgagcggcuccccagcuccugggaggaugcggacccgggacgcccccgugagcucacugc

SEQ ID NO: 4131797 - RNA, 67 nt, Human
guauaaaggauuugacuuuuccucuccagcugucuggagaacagcacaggaaguguaucuuucaugc

SEQ ID NO: 4131798 - RNA, 64 nt, Human
guauaaaguagaaaaaugggaaauuggacauuucaacuucacuucccauuucucugcuuuagac

SEQ ID NO: 4131799 - RNA, 71 nt, Human
guauaagcccauucucagagacacaccucacaucugauguuuggggaccaucaacucugagaguuuuauau

SEQ ID NO: 4131800 - RNA, 95 nt, Human
guauaauacggucagauucuaagugggcacauuuaucauuaugaaaaaagcauuucuagaauguguuauuucagaauccaguacuguaaacaugc

SEQ ID NO: 4131801 - RNA, 121 nt, Human
guauacacggucaugggguuugggcucuggguucagaugccugcauuuaaaucuuggcucccuuauggaugagcaaugcaaucuuaaccuugacugcucugugccucaguuccacaucugc

SEQ ID NO: 4131802 - RNA, 60 nt, Human
guauacaugugguaaaaugcacccauuuggaguguucagagaguuuuggcagauguuuac

SEQ ID NO: 4131803 - RNA, 75 nt, Human
guauaccaagguuuauuaaaaguugauggcagcuugaaaacuagugcugaccugacagugguagccuuggcagac

SEQ ID NO: 4131804 - RNA, 96 nt, Human
guauaccucaaaauccucaaacauuugacuucucucaggcucuucuuuuucagaucugucaucagucaaggguuugagggcuuuggggagguauac

SEQ ID NO: 4131805 - RNA, 74 nt, Human
guauacuuacuuaucacagccuuuuggugagggaacaauuucacuguucucuccuauugugugguaaggaauac

SEQ ID NO: 4131806 - RNA, 69 nt, Human
guauacuuuacaaauuagcucucgggacucuuccaaauggaguuuuaugagggauuugcuaagguaaac

SEQ ID NO: 4131807 - RNA, 55 nt, Human
guauagaagaaaaauggaaagacagaagaagcauucucugucauuucuucuguac

SEQ ID NO: 4131808 - RNA, 86 nt, Human
guauagaggaaacacaugcagcuccauagauaagagcuccuccauccaagguuguguuuucugugugauugugugugucuguguau

SEQ ID NO: 4131809 - RNA, 63 nt, Human
guauagauaagcuaacccaagcccuuuaauaagauuagagaagguaaguagcuugucauguac

SEQ ID NO: 4131810 - RNA, 72 nt, Human
guauagcaaagauuagacauauagucacauagguauauauucauaugaagauauaucugaucucugcuauac

SEQ ID NO: 4131811 - RNA, 76 nt, Human
guauagcacuuuuguagagcucagcauuggcuccauucccagccugcugcuagcuguauugcaagagccagcaugc

SEQ ID NO: 4131812 - RNA, 83 nt, Human
guauaguaguaguguugcucuguuuggggguugcagacauuuaguagucaucaaagccauagaguagauaagauugcccuugc

SEQ ID NO: 4131813 - RNA, 107 nt, Human
guauauaugguauaaagggugauuagacaguguguguauauaugguauaaagggugauuagacuguguguguauauaugguauaaagagugauuagacuguguguau

SEQ ID NO: 4131814 - RNA, 60 nt, Human
guauauauuggauaaaccagaggucuaacuuggagaccuuucugaguaaacaguaaauac

SEQ ID NO: 4131815 - RNA, 87 nt, Human
guauauauuuguuuggaacaagacaaaacauuagaucaucuucgaagauaaguaauggaaaauguccuguucucaggccuauaauau

SEQ ID NO: 4131816 - RNA, 91 nt, Human
guauaugcuccguccucccucagugugcagcagcaucugcuaugaauucauuuucgggcucuacugguauacugcaaaggagagcauaugc

SEQ ID NO: 4131817 - RNA, 119 nt, Human
guauauuaaagggaaugcauaagauucaaaugagggugcauuuagcauguagagggaaugaucgauuccacuauaugccugugcagucuuuguaauuuucaaaauuucauucaaugugc

SEQ ID NO: 4131818 - RNA, 101 nt, Human
guauauucugguuaggauguguucauagcugacgcaucuccaaaaauuuuuucaugaaggcggccagcuccugaacaucuucaauugugacagaauuauac

SEQ ID NO: 4131819 - RNA, 125 nt, Human
guauauuuggaccugauuauuuguucccuggaaaaaucucuucuaucccuuucuuauuuuuaccaaaugcccuaaagguagauucuggaucgaagguucagggaaucuaugaguuccaaaucuau

SEQ ID NO: 4131820 - RNA, 81 nt, Human
guaucacaagaccagugaccccuuuccuauaaccugaauucgaaaauccuccagaguaaaauggguuucuguuuuguggac

SEQ ID NO: 4131821 - RNA, 62 nt, Human
gcuuaguuuuaagccuagaacucaagagccuaggcaucuugaguucuaggcuuaaaacuagc

SEQ ID NO: 4131822 - RNA, 88 nt, Human
gcuuauaaccugggaaggggaaaguugagcaaauauuauggaagaaaaggaaauauagcacugcaauauuucccugacagcugugagc

SEQ ID NO: 4131823 - RNA, 57 nt, Human
gcuuauagauggcuauguucucccuguguuucuucacagggcauuuccucuaugugu

SEQ ID NO: 4131824 - RNA, 65 nt, Human
gcuuauauauaguauaugacuuugcuaaaagucaccuuaauguaaagucacauauuagagugagc

SEQ ID NO: 4131825 - RNA, 73 nt, Human
gcuuaucauuuuuguuggauaccugcuuugcaaauggcuugcuauaaguagacauucaacacugugagauagc

SEQ ID NO: 4131826 - RNA, 73 nt, Human
gcuuaucuuuggaaagugguucaggugacaagaugcccacauuucuuaccuuucuuaacuuauuaaggagagc

SEQ ID NO: 4131827 - RNA, 83 nt, Human
gcuuaugagacuuauucuauuaauauuucuaggaaauuuuagcaauuuucaagggccauuuaauaguguuuggucucauuugc

SEQ ID NO: 4131828 - RNA, 70 nt, Human
gcuuaugcugcucaugcuggggacagauguguguccacacgaguguaacuguaugggagagcaauuaggc

SEQ ID NO: 4131829 - RNA, 90 nt, Human
gcuuauggugugaugugggugaaauuaguauaggcaggguguuuggaauuauguaacuagauaaugcuauuuaccacacaucauuuaggc

SEQ ID NO: 4131830 - RNA, 93 nt, Human
gcuuauguagcucauaauuauagacaaugguuugccaagaaauuccuuuguauuuuuuucagccugucugugccaagagccguacaaaugagc

SEQ ID NO: 4131831 - RNA, 62 nt, Human
gcuuauuuauuuucucguugcucacagcucuggagcugucaucauuugagagaagaaagagc

SEQ ID NO: 4131832 - RNA, 78 nt, Human
gcuuauuucaaacugguugccuccccuguaaaaugccauuuauggcaacuggcugagagggagcuauuuauaguaagc

SEQ ID NO: 4131833 - RNA, 59 nt, Human
gcuucacaacgacaucugguuagagcucagcuuccucugaccaaaacuguugcugaggc

SEQ ID NO: 4131834 - RNA, 94 nt, Human
gcuucaccgcccccgaucccccacugggaguacaaagaauggggcucgugugcugaccguuugcuucuuccaguuggguggguggccuuggagc

SEQ ID NO: 4131835 - RNA, 76 nt, Human
gcuucacugccugacugugggcucuguuugucuugguccccguggcauuaccagagcuuagcagauaaggaggagc

SEQ ID NO: 4131836 - RNA, 59 nt, Human
gcuucagccccuuguugcaugcacagccgaggugcugugugcacgcugggagcuggagc

SEQ ID NO: 4131837 - RNA, 64 nt, Human
gcuucagccugggauggggccugagaauuuguaucucuggcagguucccauguuaugcugaugc

SEQ ID NO: 4131838 - RNA, 76 nt, Human
gcuucagcugacgucaaaacaccuggcucugggcuggaaugaauuacccaagaauuugguuggcuuuagcugaagu

SEQ ID NO: 4131839 - RNA, 70 nt, Human
gcuucaggucugaguagagaaaaggcaaagcccaaauuuggcuacauuucuuuggcagacauuaugaggu

SEQ ID NO: 4131840 - RNA, 77 nt, Human
gcuucaucaccacccugagagguugagugucugcacugggugcggguccuacagccuucucagacucacugggaagc

SEQ ID NO: 4131841 - RNA, 59 nt, Human
ggacgaagaggaugacaggagccggugaacucuuaucaggcaacugcauuacuccguuc

SEQ ID NO: 4131842 - RNA, 79 nt, Human
ggacgggaacagagagguggcagccgagacauaaggcaccuguuccucaggacuugucugccugcaccccugcccugcc

SEQ ID NO: 4131843 - RNA, 58 nt, Human
ggacggggcagccagcugguggccacuaacauagcgccaucugcugggugccccggcc

SEQ ID NO: 4131844 - RNA, 83 nt, Human
ggacggggcaggagaggggcagccagcauuuccugagcgccagcuaauggcggggaccuggcaccuuugcucugugacucucc

SEQ ID NO: 4131845 - RNA, 64 nt, Human
ggacggguggcugaggaggccucucauauaugugguuugguggggccuccucagccccgugucu

SEQ ID NO: 4131846 - RNA, 95 nt, Human
ggacgugaaggaaacacaggggcguggcucuuacucucuauuugugugugugcaugucccguggcgagucacguguccuguggggccuucacucc

SEQ ID NO: 4131847 - RNA, 88 nt, Human
ggacgugcacccuggccauggaccccgagcugaccucggccccucccugacucgguugcucucagguccaaggccacugcugcugucu

SEQ ID NO: 4131848 - RNA, 83 nt, Human
ggacuaaaauuuaagcaucuauagguucuaggagaugauucauuuucuugcguuuccuauccucuagaggcuguuuauauucc

SEQ ID NO: 4131849 - RNA, 125 nt, Human
ggacuaagucaugccuaaggucacuugguugauacauagcacaguuuagguuuggauucugggcaugucacuccugaguuaguugcugugucucaguggcagugauaagauagguucaggagucc

SEQ ID NO: 4131850 - RNA, 95 nt, Human
ggacuaauuauugugaguuuguuauuuugaguuauauggcucugaggcuaggugucagucagaguuucaggauacaaauaacauaaucccuagcc

SEQ ID NO: 4131851 - RNA, 63 nt, Human
ggacuacgauagcucaccuuugucacagacuuuggauuucuguacaaguugcuuuugaagucc

SEQ ID NO: 4131852 - RNA, 58 nt, Human
ggacuagaaguauguuucugacauauuccaaauggaauacauucaucacuuuuggucc

SEQ ID NO: 4131853 - RNA, 128 nt, Human
ggacuaggguaaggcaagccagggugcagaauuuaaggaggccuucacucucaggcuugugcaaauucagaagcagcauuaagagugagugccuccuuaauguuugugcccugagugcacccuagucu

SEQ ID NO: 4131854 - RNA, 74 nt, Human
ggacuagguugaaccugcauaagauuucaugugacggaguugugucaagaugaaagauguagccauucuggucc

SEQ ID NO: 4131855 - RNA, 66 nt, Human
ggacuauaaagcggcccagccgagggcaggggcccauccggccugaggcaggugcucgcuuggucu

SEQ ID NO: 4131856 - RNA, 83 nt, Human
ggacuaucuaauaagcaugauuaccgggagcaugucagaacauucuguguauccaugguggucaaugacuuaaaucuacaucc

SEQ ID NO: 4131857 - RNA, 80 nt, Human
ggacuauuaauaaugaaauauuacaguggaggggauguuucacuuaggaaguaucacuuaauaauauuaguuaauagucc

SEQ ID NO: 4131858 - RNA, 71 nt, Human
ggacuauuuuugcuccacaacuuugaagugaccacucaaaugucauuguuuaaaauguagcaagaaaagcc

SEQ ID NO: 4131859 - RNA, 57 nt, Human
ggacucaggcugguguucggaccccuucucccuuauccagacgcaggccuuuggucc

SEQ ID NO: 4131860 - RNA, 67 nt, Human
ggacucagucuugugcuaugugaggccacacaguggaaugguuuacaggguucaagaaugaaacucc

SEQ ID NO: 4131861 - RNA, 68 nt, Human
ggacuccuggggcucauacuccagcccaaucaugaggauuucagcccaguaugagcccccagagugcc

SEQ ID NO: 4131862 - RNA, 81 nt, Human
ggacucugauagagcaaaagucugggaaugccacgggcgagaguugcugaaaucuccaaucuuuucuuuagucccagaucc

SEQ ID NO: 4131863 - RNA, 58 nt, Human
ggacucuguagagguucucauucacaucucauagugcugaaacaaucagacagagucu

SEQ ID NO: 4131864 - RNA, 68 nt, Human
ggacucuucauacagucaucuaauacagcuaauaucaauaaugcucuauuaaacaguauguagaguuu

SEQ ID NO: 4131865 - RNA, 92 nt, Human
ggacugaaauuaugaagggaacaguaaauuuaugcagcacaaauagcauauccaauuguguuauuaaauugcuguucacuuccuuaaaguuu

SEQ ID NO: 4131866 - RNA, 76 nt, Human
ggacugaggcuggagagauaggcauggggucuugugaucaagauagugaagucagucugcuucuagagccaagucu

SEQ ID NO: 4131867 - RNA, 126 nt, Human
ggacugcuggguguuugcccucucccccucccuagucugcucacccuccuuccuggauguuaaugggagagggggugucagcacugcagugugggaggggagaggcgauuucaguccagacaggcc

SEQ ID NO: 4131868 - RNA, 73 nt, Human
ggacugcugucagucaaggcgagcaguccuucuaucuggaggcuccauaugaugcuuuuucuaauagcagucc

SEQ ID NO: 4131869 - RNA, 89 nt, Human
ggacuggauccaccauugcuggcuugaagauagaggagccaagagaggcuccuggguaacagccagcaaggaaaugggaauuuuagacc

SEQ ID NO: 4131870 - RNA, 77 nt, Human
ggacuggccgucccaagaccuggcauccaaguuggcucugcugcuaacucacuaggaaccuugggaaaauccacuuc

SEQ ID NO: 4131871 - RNA, 55 nt, Human
ggacuggucugagagggauucaugauggaagcauguucauucugugaccugguuc

SEQ ID NO: 4131872 - RNA, 87 nt, Human
ggacuguccccugggaggugcagcaaaaaucagaacggagacagaagcucacagucugguuuuagcugccaacuccuauggaagucc

SEQ ID NO: 4131873 - RNA, 63 nt, Human
ggacugugagaaaauaaacuguugcuuaagccaucagucuaugguguuuuguuaaagcagucc

SEQ ID NO: 4131874 - RNA, 70 nt, Human
ggacuguggaggagaaagccugucacuggaaauuacuaacuucucauggacaggaacucccuuggcaucc

SEQ ID NO: 4131875 - RNA, 60 nt, Human
ggacugugugggccgcucacugggaggcgagggccuugacaagagcauucccacaccucc

SEQ ID NO: 4131876 - RNA, 124 nt, Human
ggacuuaguucucauuuuccuccccuguuuucuccggauuguggcuauuguucccugguugcuagaucaaccuggagcacaguaaagcagugucacaaagcuggaaggggucugggaugagucc

SEQ ID NO: 4131877 - RNA, 60 nt, Human
ggacuucaguacuugaugcgagcuauaaaggcugugaagacaucagugccugacaggucc

SEQ ID NO: 4131878 - RNA, 56 nt, Human
ggacuucuauuaauaccucuacucuagcaaccagcuaaguggguaauagaggcucc

SEQ ID NO: 4131879 - RNA, 56 nt, Human
ggacuugagcguuuuuauaaugaacuugaaguucauuauaaacauaugcuaaagcc

SEQ ID NO: 4131880 - RNA, 64 nt, Human
ggacuugaguuugggaguucuguauguuugagggcauccagaagucagaguccuugaccagucc

SEQ ID NO: 4131881 - RNA, 94 nt, Human
ggacuugcauuagagacagaauagcauggcugguuagagccacucucuaaagugggcuggcugccugguuaugccuuuaagugucugugccucc

SEQ ID NO: 4131882 - RNA, 74 nt, Human
ggacuuggcacuggcccuugaaucuauuuaucuuucaaaaaaccggaagauaguuuaaggaacuaugcgauucc

SEQ ID NO: 4131883 - RNA, 59 nt, Human
ggacuuuagcuguaauguguguguguuccauuaucucacacaucacugcacugaauucc

SEQ ID NO: 4131884 - RNA, 74 nt, Human
ggacuuuccaugggcugcuuggcuuccacccagcauagugguuggguuccaaaaacaagcaucccaagaaaacc

SEQ ID NO: 4131885 - RNA, 73 nt, Human
ggacuuuugagcugccuguugaagggucugugggagaacauuccaggcauggggagagccagaucgaaggucc

SEQ ID NO: 4131886 - RNA, 69 nt, Human
ggacuuuuuugaaagcaauggagcacucuuaaucugggcuuagcucuauuacuuucaauaaaaaacucc

SEQ ID NO: 4131887 - RNA, 93 nt, Human
ggagaaaaagaagcuuuuguuuggauuuuacccaaagaaauguccuuugguaacaacccuacaaauccacauagcagguacauuuuuuuuucc

SEQ ID NO: 4131888 - RNA, 71 nt, Human
ggagaaaauggaagacagauaaggcagaaaauaugcuuuacaacuuucuguucuguauucuguuggaaucu

SEQ ID NO: 4131889 - RNA, 62 nt, Human
ggagaaaggcaaaggcugguauggcugcccuggcagugaucuaucaauuuuuucuucuuucc

SEQ ID NO: 4131890 - RNA, 82 nt, Human
ggagaaaggcagagagcaagaugcagggggaacgacgcccuggaaaccggggcccuauuuucacuccuguggccugccuucc

SEQ ID NO: 4131891 - RNA, 83 nt, Human
ggagaaaggcugauacaguuccagaaaaaaauguauaucuaaacuuuaggugaaguuuuuuucuggcuuugcaguaauuaccc

SEQ ID NO: 4131892 - RNA, 78 nt, Human
ggagaaauagggaacuuugggagagggauugagguggaauuuuccugcccuauccuuggauccuguguuccugguccc

SEQ ID NO: 4131893 - RNA, 88 nt, Human
ggagaaaucgcuugaacccuggagguggaggugcagugagcugaaaucgcgccauugcacuccagccugggugacagagcgagacucc

SEQ ID NO: 4131894 - RNA, 128 nt, Human
ggagaaaugggacgcaggagaucuggggucaggggaauguggaucacagggguguguccagaucccuggaccugccacguuugugaucucggaaacaugauuccaucucuccagguuuguauuucucc

SEQ ID NO: 4131895 - RNA, 72 nt, Human
gcuaggaagcacugugcugcuaaguugucaaugaaaaccuuuaauaacccuguauuuacgugcuauccuggc

SEQ ID NO: 4131896 - RNA, 114 nt, Human
gcuaggauucuugauuggucagagaauguuguuaaauacaagauuuuucugggaaaagaaugacuuuuaugauaaucaauguucuuuguucaauuccuggacaaaaaucuuagc

SEQ ID NO: 4131897 - RNA, 57 nt, Human
gcuaggcccagcugggccaggaacaggaacccuguagaaggauccagagggcccugc

SEQ ID NO: 4131898 - RNA, 91 nt, Human
gcuaggcuggucucgaacuccugaccuuguaaucuguccaccuuggccucccaaagugcugggauuacaggcuugagccaccaugccuggc

SEQ ID NO: 4131899 - RNA, 59 nt, Human
gcuaggcuuggcacagguacaggggagagguuacggagugggugugugcagggccuggu

SEQ ID NO: 4131900 - RNA, 94 nt, Human
gcuagggacauuguacugagacauuaugacaaguggaugcugauucaugcccagaucucaaguuuucucauaaucucuuccaauaacacuuagc

SEQ ID NO: 4131901 - RNA, 82 nt, Human
gcuagggagacuugugucaucauccacaaccuuguuucucacuuccugguugggcucaucucugaagaacaggucucccagc

SEQ ID NO: 4131902 - RNA, 87 nt, Human
gcuagggguucaccaaaaguauaggguuuggagucaaauggcccaggauugaauccuaauucuaucacuuacugugcaaccuccagc

SEQ ID NO: 4131903 - RNA, 58 nt, Human
gcuaggugaguuaguguccaggcgugcaaggcgaugggcugcuuccucagcugagagc

SEQ ID NO: 4131904 - RNA, 56 nt, Human
gcuagguugaggaaguucuccuggauaauauccugcagaguauuuuccaacuuggu

SEQ ID NO: 4131905 - RNA, 56 nt, Human
gcuagguuggagaaguucuccuggaugauauccugaagaguauuuuccaacuuggu

SEQ ID NO: 4131906 - RNA, 56 nt, Human
gcuagguuggggaaguucuccuggauaauauccugaagaguauuuuccaacuuggu

SEQ ID NO: 4131907 - RNA, 57 nt, Human
gcuagguuggggaaguucuccuggauuaauauccugcagaguauuuuccaacuuggu

SEQ ID NO: 4131908 - RNA, 80 nt, Human
gcuaguaaugggauaaucuguaaggcugcacugucuguacuggacaguaagugcagacuuacagauuaucccauuacugc

SEQ ID NO: 4131909 - RNA, 84 nt, Human
gcuagugucaugucauauaagagcuuuagagucaguugaguuuagaucuuggcuuucccacuuauuauauguaugacauucagc

SEQ ID NO: 4131910 - RNA, 81 nt, Human
gcuauaauuccauaguacagauccauuaauuaugccuccccugaaagcauaauuaauggaucuguccuaugggauuaaagu

SEQ ID NO: 4131911 - RNA, 78 nt, Human
gcuauagugucaugaaggcugccagcaggcauggagugugagugguuuucaugagugugagugguuuucaugaauagc

SEQ ID NO: 4131912 - RNA, 57 nt, Human
gcuauauaauucucagguuugacuaugucauuaugucacuugcugagauuuaugugc

SEQ ID NO: 4131913 - RNA, 77 nt, Human
gcuauaucuacauuugcuguuuggcuccucuuauaaauaucacucagacuaacagauuguaguguagauauaauugc

SEQ ID NO: 4131914 - RNA, 70 nt, Human
gcuauauuauuggaccacagacuuuaaggccuugggccaaccaccucaauguucuggguuuaauuuuagu

SEQ ID NO: 4131915 - RNA, 94 nt, Human
gcuaucaucaucuucaucaucaucauuaccaucauuaguaguaacaguaggaguauuuaggaugaauagugguaggaugaggaagauguugagc

SEQ ID NO: 4131916 - RNA, 82 nt, Human
gcuaucauggaacccaugcaauucccaguguuucuacuauggagggaaauguuucuggauauuguggguucugugcaucugc

SEQ ID NO: 4131917 - RNA, 64 nt, Human
gcuaucguccagcccuugcagcuucuuuggucaccagaaaaaugacagagggcugacuaauagu

SEQ ID NO: 4131918 - RNA, 57 nt, Human
gcuaucuaccacaucagccagguauuccuccucuagguugaggauguggucaauggc

SEQ ID NO: 4131919 - RNA, 83 nt, Human
gcuaucucuuaacuuauugguauuaucucaaucaaucaugggucauuccauggaauuaauaggggaauacuuaagacuuuagc

SEQ ID NO: 4131920 - RNA, 100 nt, Human
gcuaucucuuauccuagaagaggcuugacaauaugauuggcgguuuauucccccacuaaauagacuaauuagugugucaacagccuuggagugagaaagc

SEQ ID NO: 4131921 - RNA, 95 nt, Human
gcuaugaacugggauaucuucaugaggguaaucuacaaagguuuacaucuuucuuuguguuuuuccuuuagauuauguugacaguuacguuuagc

SEQ ID NO: 4131922 - RNA, 102 nt, Human
gcuaugaccaagugucagaaacagggaaggcauccgcgaauguccagcuauguggcaugaauguguugcuuucucuuuuccuaaucaggucccaaaaguggc

SEQ ID NO: 4131923 - RNA, 85 nt, Human
gcuaugacugcggacuuaaagaauguggcucagccaugaaggauugcuucuguaugaacccauauacuuauugcaggcacaaagc

SEQ ID NO: 4131924 - RNA, 55 nt, Human
gcuaugcaggagccuaaugacaaggacuuucucucaucauggugaccugccuagu

SEQ ID NO: 4131925 - RNA, 62 nt, Human
gcuaugcauugaauccuaucaggcaaauugaagaaaauuuagcaaagguaggguucagaagc

SEQ ID NO: 4131926 - RNA, 56 nt, Human
gcuaugccaugcuauuucaucaugugaccuucacccagcugaagaugcauggcagc

SEQ ID NO: 4131927 - RNA, 80 nt, Human
gcuauggauccgagagccccaccugugcgucugccgcagagguuggcugcagcccaggcgucaggugguuuggacauagu

SEQ ID NO: 4131928 - RNA, 80 nt, Human
gcuaugggaacacaggaguguccugagugaggccuggcccagggcuggguggcucucugucagugacagagccugugggc

SEQ ID NO: 4131929 - RNA, 68 nt, Human
gcuauguuggccaggcuggucuugaacuccugaccucaggugauccacccgccucggccucccaaagu

SEQ ID NO: 4131930 - RNA, 66 nt, Human
gcuauuaaggguguugaucagagaggaugaagaugguuaucugucuuuagcaccaccccaaacagc

SEQ ID NO: 4131931 - RNA, 100 nt, Human
gcuauuaccauaaaucuuccaugaacauuuguuuagaagucuuuauaugcacauaagcauugaaaguuuuucuuagauaaauacuuaugaguggaauggc

SEQ ID NO: 4131932 - RNA, 65 nt, Human
gcuauuauugccugauaaaggcucggagccugaggcuggccuuuucuuucacaggcaagauuagc

SEQ ID NO: 4131933 - RNA, 67 nt, Human
gcuauucaaagugcgaggucagggcuggaugcagaaucaccccuguaaucuuagcacuuugggaagc

SEQ ID NO: 4131934 - RNA, 72 nt, Human
gcuauucaggaaagaguguauccaucaauccauguaaugugacgugaugaguuuacucuuuucuaaaguggu

SEQ ID NO: 4131935 - RNA, 72 nt, Human
gcuauugccgaaugccaccacagagaauuuccccgcagagugaaggcugugcucuggcaucgcugcaauggu

SEQ ID NO: 4131936 - RNA, 82 nt, Human
gcuauuugagauuaugggguuugucuugugaugcagacauuccaaguuuaccuguuuacagaaggcagacuuccagaguagc

SEQ ID NO: 4131937 - RNA, 63 nt, Human
gcuauuuucaguuagcaugugaaagaugacacugucuggcuuucacauuuacuguuagauggc

SEQ ID NO: 4131938 - RNA, 74 nt, Human
gcuauuuuguuuguucagaaguuuaaagaauugcuuuucaguauuucaacugugcucugaauaaauuaaguugc

SEQ ID NO: 4131939 - RNA, 82 nt, Human
gcuauuuuuuaucccuuuuuucauuaaagcaagguuguuuaugugcauuuuuguucaccucaaggaugggagagagaagagc

SEQ ID NO: 4131940 - RNA, 74 nt, Human
gcucaaauacaaaugcucuugggaaaggcaguauguuaagcuuuuaucaaucauuaagacauuugugguagagu

SEQ ID NO: 4131941 - RNA, 55 nt, Human
gcucaaauguguguguugaaugaaugaaugaaucaugcugacagacaucaugagc

SEQ ID NO: 4131942 - RNA, 95 nt, Human
gcucaagaaauagacuuacacuugcugaaguuaaugcuugcaaggcuaaacuugaagcaauuuuagacacagaguacaaagagucugcaaugagu

SEQ ID NO: 4131943 - RNA, 55 nt, Human
gcucaagaucaucaauauaccaaaguagcauauguugguguagcauauuuugggc

SEQ ID NO: 4131944 - RNA, 67 nt, Human
gcucaaggaggccugggcuggaagggaggggagcugagaagcccccuggguccaggcuucucugggc

SEQ ID NO: 4131945 - RNA, 63 nt, Human
gcucaaguguguagggccaagagccacaaaauuacuaggcuguggccaacaaaccacuuuugc

SEQ ID NO: 4131946 - RNA, 60 nt, Human
gcucaauacugcugaaccuuugcuagauaaugucccauuauccaggcucagacagagggc

SEQ ID NO: 4131947 - RNA, 57 nt, Human
gcucaaugaggugauugcuguccucugugaagaugaaggcaguuaaacgucaucugu

SEQ ID NO: 4131948 - RNA, 57 nt, Human
gcucaauucaacacaugcacauugccacuuggguaaauacaugcagugaauugcagu

SEQ ID NO: 4131949 - RNA, 79 nt, Human
gcucacacauacaauagguguccaauuaacaauuguugcaugaauuguugcagaggucaccugugacccuugggugggc

SEQ ID NO: 4131950 - RNA, 63 nt, Human
gcucacagagguacaagcuaaguugggggaaagguuagcauccaaaaugugugcuuuuugagu

SEQ ID NO: 4131951 - RNA, 60 nt, Human
gcucacagccuacacaguagauucuuaggagacaggaagacaaucugugugcugugcugc

SEQ ID NO: 4131952 - RNA, 65 nt, Human
gcucacaugcacacugcaacaaggacuggcauccuucauccauguuuagaggguguauauggagc

SEQ ID NO: 4131953 - RNA, 84 nt, Human
gcucacaugucuggggagggccaaugugucccugagcucguacuaggcggccuguggguguuuggcucucucacacgugagagu

SEQ ID NO: 4131954 - RNA, 78 nt, Human
gcucacaugucugguggucgaugcuacaggucagcugagacuuuagcgagacugucaaccaccauaccgacauguggc

SEQ ID NO: 4131955 - RNA, 115 nt, Human
gcucacuaacgcaacuuguuuuaaauacagaaguuugaauuuaagcacugauguuaaguuugagaucaaacuuugugcuugacuucuagcuauauggcuuaagacguuaguaagu

SEQ ID NO: 4131956 - RNA, 71 nt, Human
gcucacuagcaguccugccugugguuagcacuuccgaaagcgagugccagcuuguggucagaggcuugagc

SEQ ID NO: 4131957 - RNA, 60 nt, Human
gcucacucugagugagaaguccugggcuagaguccccaggcaaggucuccuagagagagu

SEQ ID NO: 4131958 - RNA, 61 nt, Human
gcucacuucuacauuauugccuuucucaugcuacuagcaggcacugaaugugucagugagu

SEQ ID NO: 4131959 - RNA, 94 nt, Human
gcucacuuuguuuuguuucaugauguagugacuuggcagagauuguaaaacucuuuucaaaauuucacugcauaaacguaucaaggauuugagu

SEQ ID NO: 4131960 - RNA, 60 nt, Human
gcucagagagaggauauguuauggcucaaugacuagaguuuucauuccccaucucugagc

SEQ ID NO: 4131961 - RNA, 75 nt, Human
gcucagagaggcugguaaagucugaacugauuucggaagaguucucugguauccucuuuucuagccuuuaugggc

SEQ ID NO: 4131962 - RNA, 60 nt, Human
gcucagagauggggaaugaaaacucuagucauugagccauaacauauccucucucugagc

SEQ ID NO: 4131963 - RNA, 57 nt, Human
gcuuaccagcuuccuucaagauguguauuuauauaaauuggugguggguuggggagc

SEQ ID NO: 4131964 - RNA, 89 nt, Human
gcuuaccaugaugaccccuugagguagacugaacaccuuacagcagacucaagacacaggugugacucgcccucagggacacauggugc

SEQ ID NO: 4131965 - RNA, 78 nt, Human
gcuuaccucuguaucacuucaugcuuuugccauuggucaguauaaaccuaugucagaagcuggaugacagcucuuugc

SEQ ID NO: 4131966 - RNA, 78 nt, Human
gcuuacucugugcuaggcaaugugguagauauuugaaauacaaacgugaaccaggcacauuuccuacacauggcaagc

SEQ ID NO: 4131967 - RNA, 62 nt, Human
gcuuacuugaaugcugugaucucaucuaggcuuggauaccugggaucacagauucacugggc

SEQ ID NO: 4131968 - RNA, 127 nt, Human
gcuuagaaaaaagaagccuuaugcacuacauuuuuaguuuuaugaauugguauaaugagggauaugauugauugaucuucauauucacugagcauaaagccagaagaaaugggcuuaaaagucaggc

SEQ ID NO: 4131969 - RNA, 91 nt, Human
gcuuagaaacuccagaaaagugugaaugacuuauucugauucuacuuuagacagauaaagaaacaaucacagauggaggacuuuucugugc

SEQ ID NO: 4131970 - RNA, 59 nt, Human
ggaaguguggcuaagccaagaaggagaggugccuuauaaaucuuggcuuucauuuuucc

SEQ ID NO: 4131971 - RNA, 62 nt, Human
ggaaguguuuccuugggcagcagagccaggcuccuuaaugacugcuucagcugagcauuucu

SEQ ID NO: 4131972 - RNA, 70 nt, Human
ggaaguguuugugcagauggccaccugagucugucaccuccaggcauagccaaugacaaguaucacuucc

SEQ ID NO: 4131973 - RNA, 91 nt, Human
ggaaguuaaaaugaaacaguguguauagcaaaaaccuugccuuguaaauugacuuuugugccuauacaugcgacugguuuuauguaacucu

SEQ ID NO: 4131974 - RNA, 61 nt, Human
ggaaguuauugcagcaauccaaguaacagauaacaguugccaggguuguaguuguaaagcc

SEQ ID NO: 4131975 - RNA, 59 nt, Human
ggaaguucuagagguugauuuggucuuuccuucaagggcugucuaauaugguagcuucc

SEQ ID NO: 4131976 - RNA, 56 nt, Human
ggaaguugcaagggguggauuaaggaaaauagcccgucuuuuuaauugcgauuucc

SEQ ID NO: 4131977 - RNA, 80 nt, Human
ggaaaauggacgugugucucaugguagccgcaguuuaaguaaacauaaacucugaaccagagaucauacccgccauuucc

SEQ ID NO: 4131978 - RNA, 66 nt, Human
ggaaacacagggauauauauuccaggccacaaauuuucucccuggaaaauuuaugucuguggaucc

SEQ ID NO: 4131979 - RNA, 66 nt, Human
ggaaacagugagaacuuuuccugaaaggggcugcuccacugcagggaaauguuuucgguguauuuc

SEQ ID NO: 4131980 - RNA, 86 nt, Human
ggaaacauaagaaagcuccagggaugagacagaguagcucaguugcacagaguucaucucaugcugugggugaaucucuugauucc

SEQ ID NO: 4131981 - RNA, 80 nt, Human
ggaaacugagggacaguguggugauggcacuugcuccagggguggagcaaggauuggaauccacugcccccuugguuucc

SEQ ID NO: 4131982 - RNA, 114 nt, Human
ggaaacugcuauagaauaugugagcagcagcagaaacccagcaaagccaaggggaagagguagcccuggccuuggccuuuucugcuccucucccucccauagcaagagcauucc

SEQ ID NO: 4131983 - RNA, 71 nt, Human
ggaaacuguugagcugaggucaggaugggguaaaugaaccauuucccacuucaucccagcucagauauucc

SEQ ID NO: 4131984 - RNA, 68 nt, Human
ggaaacuuacuuacucacauuucuggagucuagaaguaaagaucagagugccaguauggugaguuucu

SEQ ID NO: 4131985 - RNA, 102 nt, Human
ggaaagaaaggagagaggaugagaagaagggaggaaggaaauaaaaacauuaucaggauauuucuuugcaacucccauuuccauccuucuuuuguucuagcu

SEQ ID NO: 4131986 - RNA, 87 nt, Human
ggaaagaagaaaggaaaggaagaagggaggggaguuaguugagucuaacuaugucccagacacuuuaucuuauuucauuuucauucu

SEQ ID NO: 4131987 - RNA, 64 nt, Human
ggaaagaagggucuuguuuauauaaggugguuuaaaaugaauccaccccuacaaggccuucucc

SEQ ID NO: 4131988 - RNA, 60 nt, Human
ggaaagaccugagauaggaauaaucuagguagcuuuaaauguuccuguucucuaggaucc

SEQ ID NO: 4131989 - RNA, 81 nt, Human
ggaaagacgccucugagagcggucuguggcuucacauuuauuauugaugcaggcuucagcagcccucucuugggcauuucc

SEQ ID NO: 4131990 - RNA, 82 nt, Human
ggaaagagaguauggaggauggaauuugcuuccuaaaaacuuucaccaggaaaacagcacacaucacuucugcucauauucc

SEQ ID NO: 4131991 - RNA, 65 nt, Human
ggaaagagcaaaugagaugugaauuacagggugacgaggcuuguaugaaucucauuuguuuaacc

SEQ ID NO: 4131992 - RNA, 57 nt, Human
ggaaagagcuaaaagggugagauugccacaacacucccgccacuggggacucugucc

SEQ ID NO: 4131993 - RNA, 77 nt, Human
ggaaagagggagcaaguagcaacucucaggacugcaggaauccaggcugacuuuaggcccugccugucccucuuuuu

SEQ ID NO: 4131994 - RNA, 100 nt, Human
ggaaagagucugugcuagggcagaagaguggggugcagucucccagagcugaaauagcaccuuaacucugcugcgugauccuuagacauuuaaucuuucu

SEQ ID NO: 4131995 - RNA, 83 nt, Human
ggaaagaguucucugcgaggcugacauauacaaccugcaucucuucuuacagaucauuugugcugucagcaugcaguuuuucc

SEQ ID NO: 4131996 - RNA, 56 nt, Human
ggaaagcaccuugcgcuguacuagucacagccuagacagcagcaaucugucuuucc

SEQ ID NO: 4131997 - RNA, 85 nt, Human
ggaaagcagcagaggucagaaagguacaagccgcuaaauuagaaagaccaguccugaaugccuaaauuugccucauuugcuuuuc

SEQ ID NO: 4131998 - RNA, 66 nt, Human
ggaaagcaggcauuccagagacaauugcuuaaaaugcaauacuuuuggccuggaauguuguacucc

SEQ ID NO: 4131999 - RNA, 70 nt, Human
ggaaagcuauagaguguaagaugauaaggguuucagggauacucauaucucucaccucugguagcuuacu

SEQ ID NO: 4132000 - RNA, 60 nt, Human
ggaaagcuuccauuuuguacauuuuuuacaaacggaaaauaagagaaagggaggcucacc

SEQ ID NO: 4132001 - RNA, 60 nt, Human
ggaaaggagaugaauaggauuaagcuauaaauacagccuggagauugucaucucuuuucc

SEQ ID NO: 4132002 - RNA, 77 nt, Human
ggaaaggcaaaagaggugucaucacagaaguccuauggggaugggugaugaggaaucuuauuaaguuuugcuuuuuc

SEQ ID NO: 4132003 - RNA, 64 nt, Human
ggaaaggcugagacagcacaggucccaaagcccagaggcugggcgugcauuacucagcaaaucc

SEQ ID NO: 4132004 - RNA, 71 nt, Human
ggaaaggcugagccagggccccuauauaaacaagcauacuuguuccaucgggacccuugguuggcuuuucc

SEQ ID NO: 4132005 - RNA, 76 nt, Human
ggaaaggcuuuugacgguugccucucccauauccacacucuccugggaccuagagagaggcaaccaaaguuuaucc

SEQ ID NO: 4132006 - RNA, 60 nt, Human
ggaaaggguuuuuaauuugcucucuaaaccaugugauguaggcagcaauucacccuaucc

SEQ ID NO: 4132007 - RNA, 85 nt, Human
ggaaagguagacauuuuuuaauauaagacaauauaaaaagagauuuucaguuguuucaugaguguaaagggaacucugccugucc

SEQ ID NO: 4132008 - RNA, 65 nt, Human
ggaaaguaacaugcucuugucuuggcuaauucguagcuguuaguugagcaacaccguuuauuucc

SEQ ID NO: 4132009 - RNA, 59 nt, Human
ggaaaguccagggaaagagcgucuuuuaauucagaaaggaggccuugcuggaauuuucc

SEQ ID NO: 4132010 - RNA, 91 nt, Human
ggaaagugugaacagugauuggcuguuugauguucuuaagaaauuauuguuaauuuuucaggugcaguaaucauauuguuauauauuuuuu

SEQ ID NO: 4132011 - RNA, 71 nt, Human
ggaaaguuuucaaagugauacaggauggugauaaaugcacacauguuuacaauucaguauuacagcucucc

SEQ ID NO: 4132012 - RNA, 84 nt, Human
ggaaauaaagaagcugcgugguaugugaacuaucucuauaaagauaaacuguacaccuuacucauaauaacagcaucuauuucc

SEQ ID NO: 4132013 - RNA, 94 nt, Human
ggaaauaaguaggcucugaaucuggggggaaaauaguugucaagaaccaaauauuuggcuuccuguuucccagaaaguguuugcugcuguuucc

SEQ ID NO: 4132014 - RNA, 124 nt, Human
ggaaauaauaauacauguugcuucuauucacaaagaaaggcauguggucaaggcucaaaucaauuggguauggauauauccuuaucuccccauagggauggaagcaaauauuuaaaauauuucc

SEQ ID NO: 4132015 - RNA, 58 nt, Human
ggaaauacggaaacacaugaucagacaucugugaagugacugaaauguguuuuccucc

SEQ ID NO: 4132016 - RNA, 73 nt, Human
ggaaauagccaccaaguucuaauuuugcauucaggggauugucuuccauggacgugaagagacugauguuucc

SEQ ID NO: 4132017 - RNA, 69 nt, Human
ggaaauauaaucuaaguguuuucccagaaggugaggaaacagauuuugaugaacacuuacuauauuucu

SEQ ID NO: 4132018 - RNA, 126 nt, Human
ggaaaucugagauuaaggugucagcagggcugguuccccugaggaccaggaaggagggaucgcuuccaagccccccuuccuggcuuguagauagccauuucucucuguaucuucacaucaucuucc

SEQ ID NO: 4132019 - RNA, 59 nt, Human
ggaaaucuuuugauguuuuuuuccuuucuccugaaaugaugaggcaugagaggguuucu

SEQ ID NO: 4132020 - RNA, 63 nt, Human
ggaaaugaggcagggaggaggcauuugggagggacauuuguuucaacuccugccauuauuucu

SEQ ID NO: 4132021 - RNA, 92 nt, Human
ggaaaugcuugucaaauuccaaguuuuaugcugcaaugguuuuauucagcaaugagcuuggauuuuaagucaagaaagcauguauaauuucc

SEQ ID NO: 4132022 - RNA, 64 nt, Human
ggaaauggccuaauugcauuugcgcaggaacaccaaaucccucgcagcugcacggggcugagcc

SEQ ID NO: 4132023 - RNA, 74 nt, Human
ggaaauguaguucuuauucugggcagccauaugggcagccaucugcccagcuaaaaaugggagguccuauuucc

SEQ ID NO: 4132024 - RNA, 77 nt, Human
ggaaaugugguaaacauuacugugcuguauagcuucuuugguuuuauagagcucaguuguguuuuguaaauauaacc

SEQ ID NO: 4132025 - RNA, 127 nt, Human
ggaaauuauaccuuaauaaagaaaacuaaagcauauguguggucacaaccaauccuugucauuaugccaugaaagccuugggauuugugaucaaagcaaugagcuuauccugaacugugguguaacc

SEQ ID NO: 4132026 - RNA, 79 nt, Human
ggaaauucacauugugcaggucaguuauugcaauuuuaugaacugauuuguaauuuuacgugacacaguuuguguuuuu

SEQ ID NO: 4132027 - RNA, 59 nt, Human
ggaaauucagguuauauuugcaacuaugcucuaguugugagaaugaacacugaauuuuc

SEQ ID NO: 4132028 - RNA, 64 nt, Human
ggaaauugagggagaaaguuggaguagggagccucuaaaccugccuauaaacugccucaaaucc

SEQ ID NO: 4132029 - RNA, 61 nt, Human
ggaaauuucaguggacacgagcucucccgaggaaaggucucacaguuguccacugaaaacc

SEQ ID NO: 4132030 - RNA, 73 nt, Human
ggaaauuugcuuuaguuuagaagauccuccucaauauggcagaaacaaauauuuugaacuagagguaaauucc

SEQ ID NO: 4132031 - RNA, 69 nt, Human
ggaaauuuuagacuccugggucuaaguucuuggcuucagaagcauugggccauaggagcucagauaucc

SEQ ID NO: 4132032 - RNA, 67 nt, Human
ggaaauuuugccauguaagucaauaguguuuaaacuuuacccuauuauuagacuuauaugguagucu

SEQ ID NO: 4132033 - RNA, 104 nt, Human
ggaacaaaggugacauuaguauuucaugugauggucuguuuacucuguauuaaaaugucauaugcuguauacauaugaaauuacugauuucacuucuggaaucc

SEQ ID NO: 4132034 - RNA, 84 nt, Human
ggaacaaauucugaaguugcaggagaagcuuuuggcccuacaggaagagaagcaccagcuuuuccugcagcucaaggaaguuuu

SEQ ID NO: 4132035 - RNA, 100 nt, Human
ggaacaaggugguuccaaggccuuugggggccugguccugcauggguggggugcuggggcuuggccccagaagagcuacuugggagaacuguuuuguucu

SEQ ID NO: 4132036 - RNA, 79 nt, Human
ggaacaaugugccaagaucaaacuuuucuuauuauaaaaggauauuggaaggauaaguuugauucuugccauagcuucc

SEQ ID NO: 4132037 - RNA, 87 nt, Human
ggaacacaaggugaauagacaaggcccccuugggcucuuuaugcaagcacaauguagggagugaguggccuugucacugcuuguucc

SEQ ID NO: 4132038 - RNA, 62 nt, Human
ggaacagacugacuucuugaauuaagcucaaaaacagcggucaggaauuuuguucuguaucc

SEQ ID NO: 4132039 - RNA, 93 nt, Human
ggaacaggauaugcauuuuuugggaguggguaagaauuucugguuagacaagcuccaaauucuuuggccuacuuugaaggcacugccuguucc

SEQ ID NO: 4132040 - RNA, 89 nt, Human
ggaacagguccuugguuucaggagcagggucuguuaccaccucagggugugaccuuggacaugccucccgucucuucugggccuguuuc

SEQ ID NO: 4132041 - RNA, 79 nt, Human
ggaacaguugcacagucuuuccuggacuuacaacguugauacuuuggaagaguccaggcaaguuguuguguagaaugcc

SEQ ID NO: 4132042 - RNA, 84 nt, Human
ggaacauauggaacugagcuugccaaacugggcuuaucaucaagauuacuaucucaguuugggaacacuucagcuagcaugacc

SEQ ID NO: 4132043 - RNA, 68 nt, Human
gcugccugcucacccggccuggcagacucugcaucugcuccacuucacaggccggggaggcuggcagc

SEQ ID NO: 4132044 - RNA, 58 nt, Human
gcugccugcuucaugugggagaagcacagacuuucucaagugugaauugagcagcagc

SEQ ID NO: 4132045 - RNA, 62 nt, Human
gcugccuggagcucagccugccgcccucaccguggaggcuacgcuagaugcccaggaccagu

SEQ ID NO: 4132046 - RNA, 61 nt, Human
gcugccugggcuggcauucccacuuggugugugaaguugggcauguugcuggccuggcagu

SEQ ID NO: 4132047 - RNA, 55 nt, Human
gcugccuucaguucugauucaugcucugacucagacgaaaacaugaacaugcagc

SEQ ID NO: 4132048 - RNA, 87 nt, Human
gcugccuucuccagggugugcaggggaucagguugcagcaccagcagagcaggaacugggcugccugcccccacacccucaggcagc

SEQ ID NO: 4132049 - RNA, 95 nt, Human
gcugccuuuuucagauuucuacuugcauuacuguuuggaaguuguucuucauauuccaugggagaugauggggaguggaaagauaagaagggagc

SEQ ID NO: 4132050 - RNA, 83 nt, Human
gcugcgcacaguguuggcucggcuggcugcccucuccaaccgguggucuggggcgggugagcccggcugaccugagugccugc

SEQ ID NO: 4132051 - RNA, 78 nt, Human
gcugcgcagagccaagggauggaagcucgucugcaaggucagccucagucgccccuugucuguccggcucugucuagc

SEQ ID NO: 4132052 - RNA, 55 nt, Human
gcugcgccggaucccacguuccacucaccgagguugggggucuucacgguguugu

SEQ ID NO: 4132053 - RNA, 55 nt, Human
gcugcggggccggccuaggugccuggacagggccagcugggccucagccugcagu

SEQ ID NO: 4132054 - RNA, 88 nt, Human
gcugcguuggcacacccugcucugcugugcggcccggcacaacucagccaggaaaggcggcaggcugaguccggggaagugccccagc

SEQ ID NO: 4132055 - RNA, 110 nt, Human
gcugcuaugcuggaggagaagggcuggggagguagaauacaccuuuaaggcccagccucugugcuuucccugccuucuuaguaaucccuuucuccuauccagucuacagu

SEQ ID NO: 4132056 - RNA, 68 nt, Human
gcugcucaaaaccagcccucaggucagauacuccagggaugaguguuuacauugaagcuuguagcagc

SEQ ID NO: 4132057 - RNA, 100 nt, Human
gcugcucaucaauuaaugcagaccauggcauugagcauaauaguauuuaacaaacuguaugcuuuccaaaaaugcugugugguuuuucaguuggagcagc

SEQ ID NO: 4132058 - RNA, 57 nt, Human
gcugcucauuuguauccuuuguaguauccuuuguaauaaacaguaaaugugagcagu

SEQ ID NO: 4132059 - RNA, 59 nt, Human
gcugcuccgcagagugugugugccuucuacacgcacgugcagacugugcgggguguggc

SEQ ID NO: 4132060 - RNA, 76 nt, Human
gcugcuccuugguauccgagcucuggaaugucugggcugcaacugacaggaguucagaggacaccccaggggcagu

SEQ ID NO: 4132061 - RNA, 62 nt, Human
gcugcucuggcugggaugagugcacagcagcagaaugucuaagcagccagccagagcucagc

SEQ ID NO: 4132062 - RNA, 83 nt, Human
gcugcucugucauaucuccuccagcacaggccugacucuccaaaucuuuaggcuuucuugaaggggauaugauucuaguuggc

SEQ ID NO: 4132063 - RNA, 66 nt, Human
gcugcucuugaggggcucacugugagaagggcccucagcaaucccauucccaggccucuuugcagc

SEQ ID NO: 4132064 - RNA, 85 nt, Human
gcugcugaccauggggcuggaggggggcagcccucgacucccacuccccgcggugcugcagcucgccuuccggccuggcagccgc

SEQ ID NO: 4132065 - RNA, 81 nt, Human
gcugcugagccccagccugggaacuggaggaagcagucccaguugcugaccucuuguggucccuggcuucgggugugcagu

SEQ ID NO: 4132066 - RNA, 61 nt, Human
gcugcugagccuggugcgggaugcugcgggcaaggaagacaucaucgaguggcucagccgc

SEQ ID NO: 4132067 - RNA, 91 nt, Human
gcugcugaugcuggcggugaucccgauggugugagcuggaaauggggugcuacgucaucguugucaucgucaucaucaucauccgagcagc

SEQ ID NO: 4132068 - RNA, 89 nt, Human
gcugcugcgggacgagucgagcagaaagccgucggggcacacacacguguacccgccgcgcguguuugcacacucgccgugcuggcagc

SEQ ID NO: 4132069 - RNA, 61 nt, Human
gcugcugcuggucuggggccacacucugagaacacagaaaagccugggggugagcagcagu

SEQ ID NO: 4132070 - RNA, 55 nt, Human
gcugcugcuugaaggcucggagccaaaguauaggguucaggaauaagauagcagc

SEQ ID NO: 4132071 - RNA, 107 nt, Human
gcugcuggaaaacugaguggaggccaucuuccuugcuccuugucacuugugggaaaaucuccaaaagcugccauagaacgagagguggaaccauuuaggauggcagc

SEQ ID NO: 4132072 - RNA, 63 nt, Human
gcugcuggacuacaggaagaguuugaucauccauuugcaaacaauuuccgcauagucuagugc

SEQ ID NO: 4132073 - RNA, 56 nt, Human
gcugcuggacucccaccggcagcagggcgcccugcuguccuccugggcccagcagc

SEQ ID NO: 4132074 - RNA, 82 nt, Human
gcugcuggccagggcagcugccagaggccauggccuggcgugggccuggagccccucuggccagccugccaggggccagggc

SEQ ID NO: 4132075 - RNA, 57 nt, Human
gcugcuggcuggacuugugcaugucaggaauccuugagugucauugccaggcacagc

SEQ ID NO: 4132076 - RNA, 92 nt, Human
gcugcugggugccggggcaggagugugaguuugguugagacuuaagaaacucacucuuaagucucaaccucccucaccucgguuuccucagc

SEQ ID NO: 4132077 - RNA, 79 nt, Human
gcugcuguacggagggcccagccggcgagucucgcgggggcuuugcaggacccgggcuguggucacccguacugcaugc

SEQ ID NO: 4132078 - RNA, 73 nt, Human
gcugcugugaguuuuagcuuguguugaauaucuugggaaaaugagcccagaacacaaagcugauuccaguggc

SEQ ID NO: 4132079 - RNA, 65 nt, Human
gcugcugugcaggugccuaugaucaguggauggaaucagggaccacaccuguguacucagcaugc

SEQ ID NO: 4132080 - RNA, 70 nt, Human
gcugcuuagaggacuguuacagaaucaaaaggauuagagaauccuguccugugugacaucacugggcagc

SEQ ID NO: 4132081 - RNA, 89 nt, Human
gcugcuuaggaagcgggaccugugcagcccugcauugucuccagauugcuguuaccaacagguucccacuuccgcuucccgccagcagc

SEQ ID NO: 4132082 - RNA, 73 nt, Human
gcugcuuccugugaagaauagcacucaauuaauaauaguugcauugcuuggucuucaagaucaguaaagcagu

SEQ ID NO: 4132083 - RNA, 77 nt, Human
gcugcuugcacauguugguucuugaaaccuuagcuagaagaauuucaggucauaccaacauguggauaggcuauagc

SEQ ID NO: 4132084 - RNA, 83 nt, Human
gcugcuuggaaggcugaggcagugaggcagaguuugcaaugagccgagaucgcaccauugcacuccagccaaacuacaagagc

SEQ ID NO: 4132085 - RNA, 92 nt, Human
gcugcuuuacuauauugucucucuggaaggcacacuuuggguauuguuugcuagcacaaagagucuuucagagucgccuuguaaaggauugc

SEQ ID NO: 4132086 - RNA, 70 nt, Human
gcugcuuugaaagccauggcaugccaggaucacccuuggugaccaccagcagggccagguugaaagcagu

SEQ ID NO: 4132087 - RNA, 58 nt, Human
gcugcuuugcaguagaguaauagccaaauuagcaauuuuuucucugcuacaaaggagc

SEQ ID NO: 4132088 - RNA, 63 nt, Human
gcugcuuugguaugaauucacuacuuccaaacaaacuaggguuuggaucaugucaaagucagu

SEQ ID NO: 4132089 - RNA, 84 nt, Human
gcugcuuuugggugcuucgucagcucugaggcacgucaaauacguguauuuugcuuucagcguugugugagggacccuggcggc

SEQ ID NO: 4132090 - RNA, 62 nt, Human
ggaagcucagcugugugggcucaucauggaaaugguggaagcuguggcauaacugagaguuu

SEQ ID NO: 4132091 - RNA, 63 nt, Human
ggaagcucugccuagauuucagaggauguauggaaaucccuggauguccagguagaaguuugc

SEQ ID NO: 4132092 - RNA, 82 nt, Human
ggaagcuggggaaaucaguuaggguguuaaugaggcuuucuuugguggcaacuuuaacugagcacucucauucuccaucucc

SEQ ID NO: 4132093 - RNA, 61 nt, Human
ggaagcuucugugcguaggcgaugcaguuugagaggcugaaaacgucacgacgcgaaaucu

SEQ ID NO: 4132094 - RNA, 64 nt, Human
ggaagcuuguuggagcagcccugcuuaaaggacauuuauugcacagcaauuucuauaagcuccc

SEQ ID NO: 4132095 - RNA, 82 nt, Human
ggaaggaaagagaaguaugaaggcgagagcccacuacuagcucaugguagaggaguaaauuucgccuccacuccugccuucc

SEQ ID NO: 4132096 - RNA, 67 nt, Human
ggaaggaaagaggcuucagauccuucagaugcauacaauuugacaugggcuguaggucuccacuucc

SEQ ID NO: 4132097 - RNA, 69 nt, Human
ggaaggaaagcaauuuaauggaccaugacagaguaagucacugucauucccuggcuuuguuucccuucc

SEQ ID NO: 4132098 - RNA, 112 nt, Human
ggaaggaaggaaggaaaaugcaggagaagaauacauuggaaaucagaauaaguuaaguuauuucaauucagcaaugucaugauuuuuuugaucaggguuguuucauuuuucu

SEQ ID NO: 4132099 - RNA, 60 nt, Human
ggaaggaagucauuagugcagacugagcuguggaguuggguucuugcaggauuuccuucc

SEQ ID NO: 4132100 - RNA, 82 nt, Human
ggaaggaaguuaguacacugaauacuaguuuuccuggcuuuuagccugaggcaaagcacauuagguggcacucauuccaacc

SEQ ID NO: 4132101 - RNA, 77 nt, Human
ggaaggaccuguccguggugcugcuugugagucccagcucugaacaaauuauccagcuucagggacagcuucuuuuc

SEQ ID NO: 4132102 - RNA, 55 nt, Human
ggaaggagcauuugccaguuuauuaucuuuaaaaguagucuaaaaugcuccuuuc

SEQ ID NO: 4132103 - RNA, 72 nt, Human
ggaaggagcuuucauuacagccuugugggucuugacucaccagucccugcaggagccaguggaguuccugcc

SEQ ID NO: 4132104 - RNA, 88 nt, Human
ggaaggaggaaggaaggacagggaugguugauuguaugugagaaauuucagacacugcaguguucccuucuuccugcuccuaccuucc

SEQ ID NO: 4132105 - RNA, 67 nt, Human
ggaaggaggagcggaggcuuguugcuuggacacugccaggcugcucuguguucuguuccucuugguc

SEQ ID NO: 4132106 - RNA, 84 nt, Human
ggaaggagggcccuuucccucagagcuugaaggcuucucuguauccuaugccaacaagucuggggagaaaaggcuaacacuuuc

SEQ ID NO: 4132107 - RNA, 65 nt, Human
ggaaggaugaguggucagaaucuucaggaguacuguuuuccuggugaaugacuuuuuauuucccc

SEQ ID NO: 4132108 - RNA, 64 nt, Human
ggaaggaugugucacucucaggagguuguaagucauugggacgccuccagggaugauuccuucc

SEQ ID NO: 4132109 - RNA, 81 nt, Human
ggaaggcagccucccuaaugcagaagaaaccauggcuucuuugggggccugauucuuuggugucacuuagggaguuguucc

SEQ ID NO: 4132110 - RNA, 56 nt, Human
ggaaggcaucugaccucagggugucugggggaagccagaggaacgcagagcuuucu

SEQ ID NO: 4132111 - RNA, 68 nt, Human
ggaaggccacacaugauuuuuaaagagauaauagcagcacuauugucacuuaaaagugcauguuuucc

SEQ ID NO: 4132112 - RNA, 76 nt, Human
ggaaggcgggucugaguagagggcuggcgacugaugaucauuggaggacuuggcaaccccucuccacuccccuucc

SEQ ID NO: 4132113 - RNA, 65 nt, Human
ggaaggcucgaggaugcuucugguuuuucaucuuccagucuccagcagccuuccuuuugcuuuuc

SEQ ID NO: 4132114 - RNA, 60 nt, Human
ggaagggaauccaucugguuagaguuuuuccccacucccaccaccugcacuuuucuuucc

SEQ ID NO: 4132115 - RNA, 126 nt, Human
ggaagggaugaaggugauagggucuccuuggcaaagagacaugcaucggggcuuugacaaacaugaguccuccuuguuuugucucugcugauuaaugaggagaugcugccaucuuucuuuacuuuc

SEQ ID NO: 4132116 - RNA, 77 nt, Human
ggaagggcuuccugccagcagcccagugggcaagggaagagaaguuggaagguuuauugggccuggaggaucuaucc

SEQ ID NO: 4132117 - RNA, 130 nt, Human
ggaaggggacugcgaauaccaacccuuaucccagucuaagauaauguucucuacccguggaaguaccuacuauggacuuccccgaagcuggaaauaguaucuagaggcucuuugguauagauuuccuuuu

SEQ ID NO: 4132118 - RNA, 130 nt, Human
ggaucgggggacccugggggcucaggauccagcaaggggcggcaggaguaaaggaggaaggaaugacaggugcaaauaccuucccaccaaagcccuuguugcccucuggcuccuccccagaguugucccc

SEQ ID NO: 4132119 - RNA, 72 nt, Human
ggaucuauauaguccaggaugugccaugugauucaagaaugcuaaaaugcacaucuggagcucuguggaacu

SEQ ID NO: 4132120 - RNA, 59 nt, Human
ggaucucagaucuacagaucuacaguggcaaggaacugagaucuacagaucucagaucu

SEQ ID NO: 4132121 - RNA, 62 nt, Human
ggaucugagagcaagcaggaccaggaauaacacauccugagaugucucuggauuucaggucc

SEQ ID NO: 4132122 - RNA, 76 nt, Human
ggaucugcauaccuccaugugccccuggaagagcagaacuguuugccaaauaucuaauacaggaggccugcaaucu

SEQ ID NO: 4132123 - RNA, 87 nt, Human
ggaucuggcagaggccuaaccaagauguccucauguugucaucauggaucaggauaugaugguucugggcaaacugaucacaugucc

SEQ ID NO: 4132124 - RNA, 71 nt, Human
ggaucuguggaccgucuuacuggcuaccugguguuguaagauuauuugagcucaaggcaguccacauuucc

SEQ ID NO: 4132125 - RNA, 77 nt, Human
ggaucuuguuaaaaugccgauucugauucuguagaucuagggugagauucaagauccugcauuuguagcaaguuucc

SEQ ID NO: 4132126 - RNA, 115 nt, Human
ggaugaagacauaguaaaaccaaaugcaacauaaauuugaaguggcaaacuugguaguuucucaguuucucacccaagaguuauuuuguuuuguuuuguuuuguuuuaaccaucc

SEQ ID NO: 4132127 - RNA, 121 nt, Human
ggaugaaucagcucugaaagaaagaagcucaguucagucacuaucagugagccucaagcuuuggcuuauguaaaaagcuccuggagagauugagaaagcuucagauucccaggccucaucc

SEQ ID NO: 4132128 - RNA, 79 nt, Human
ggaugacagcaguucucugugccucgcugggacagaguguauucugagguccagcgucugcauggagaucugccuaucc

SEQ ID NO: 4132129 - RNA, 63 nt, Human
ggaugacauugacagaccugcugcucugcguugcaauugugcaguugucucucaauaucauuu

SEQ ID NO: 4132130 - RNA, 66 nt, Human
ggaugacucauuuucugguuguuggagacucuuaagggaucugcuuucauucacaaaauagcaucc

SEQ ID NO: 4132131 - RNA, 83 nt, Human
ggaugagcugggauucaaacucagaucuccaacuccaggguucuuucccugguaucugaaaguuuagaauucuuguccuaucc

SEQ ID NO: 4132132 - RNA, 64 nt, Human
ggaugaggcagaaaaaagucggagggcugguuaacuuuuucuuccucuugcuucaguuucaucu

SEQ ID NO: 4132133 - RNA, 68 nt, Human
ggaugagguaguguuuaguccaguccuauauuccaacaacuggaaaaaucuguagucacuaccuaucc

SEQ ID NO: 4132134 - RNA, 74 nt, Human
ggaugauaaguuaugggggcuucuguagagauuucuaugagaacaucucuaaggaacucccccaaacugaauuc

SEQ ID NO: 4132135 - RNA, 89 nt, Human
ggaugaucagaaaggagaucaguaguaagauggaggaacaccagggaaagaucaucuugccacuucauccccuuuccagcuccccaucc

SEQ ID NO: 4132136 - RNA, 76 nt, Human
ggaugaucugcccaucuguccugcuucacgggcaccaagaacccguggcucagauccaggacucgugugcagcucc

SEQ ID NO: 4132137 - RNA, 59 nt, Human
ggaugauguuccuuugagcccugcagcugucaugccacaguuucacagaggggccgucc

SEQ ID NO: 4132138 - RNA, 58 nt, Human
ggaugcucagucuugucuccugaagucaagguaucuucuaggcucugauugggcuucc

SEQ ID NO: 4132139 - RNA, 56 nt, Human
ggaugcuccuuggugauagaauauuuccuuguagaugucugucuccuggagggucc

SEQ ID NO: 4132140 - RNA, 121 nt, Human
ggaugcugaacuugauaaaucuguaaggucugugaaucuagaagucauucaauuaaauacaaacaugggucuggauaauuccaguaccuuagaguugaaaugauccugaguuccugccucu

SEQ ID NO: 4132141 - RNA, 69 nt, Human
ggaugcuguuuaacuucauuuuucuuccuucucagaaaaaccucagaaaauggaaguuuaaagguaucc

SEQ ID NO: 4132142 - RNA, 79 nt, Human
ggaugcuuagaaaaaagaacuguaucaagauguaguauaaagacugaucaaaauacaauucuuuguucaaacaagaucc

SEQ ID NO: 4132143 - RNA, 99 nt, Human
ggauggaaacuucaggauaaggcaaugguuucugugccuucuaauuuccuggaaggaaucacuuugaaguugucguuucugaaagugucaguuacaucc

SEQ ID NO: 4132144 - RNA, 63 nt, Human
ggauggaagcauuuccugugugugccacugcugugcuagcggcucacacggagugccuccacc

SEQ ID NO: 4132145 - RNA, 55 nt, Human
ggauggaaggcauuucacacaggaugagcaauuauuuguguuguguuuuaccacc

SEQ ID NO: 4132146 - RNA, 106 nt, Human
ggauggaauuaggaauucaguuuauuguguguguuuuuuuagacguuuguaaccaccagauuaggaaguuuuaacaaguacuuacuauagggugaaucuuccgucc

SEQ ID NO: 4132147 - RNA, 64 nt, Human
ggauggacagcuggccucaagggaacacugcaaaguggcucuaggaagaagccacugucccucc

SEQ ID NO: 4132148 - RNA, 128 nt, Human
ggauggagaguggauguggaggggcaauuggcagagacaccgaaugacucuguggaaagacaucucagugucugugcaagagugcucaucagucucucuacuuauugucuaccauuacuguccauucc

SEQ ID NO: 4132149 - RNA, 71 nt, Human
ggauggaggccucugcuguggcugcccacuggcugugcccaggccuugaagccacagcgaaccucucuucc

SEQ ID NO: 4132150 - RNA, 59 nt, Human
ggauggaggggugguggaagucagcccgugaacucucccccauugcccucauaguaucu

SEQ ID NO: 4132151 - RNA, 75 nt, Human
ggauggauggauggauagguggauagcuaagauaacagcuucucucucuaaagcuaacacauuccagcuauuucc

SEQ ID NO: 4132152 - RNA, 55 nt, Human
ggauggauugagggggagaguuggaaaacugcuuaaaaagcuccaucaauaaucc

SEQ ID NO: 4132153 - RNA, 68 nt, Human
ggauggccagaguugaggggguuucacauggugaugagcuccuugaagacucugagcucuaggcagcc

SEQ ID NO: 4132154 - RNA, 79 nt, Human
ggauggcugggaaagagcuggagaugcagguuucgggccacagugagccccaaaugccucagcuccaaaugaagccucc

SEQ ID NO: 4132155 - RNA, 68 nt, Human
ggaugggauagggcucuugcuggccaggugagccccugcacuuccuggcugagcccacuaucuuggcc

SEQ ID NO: 4132156 - RNA, 64 nt, Human
ggaugggauguuugagauuuuuggcuuucauuucuuccggaaguuauuuuucaagauccuuucu

SEQ ID NO: 4132157 - RNA, 63 nt, Human
ggauggggauuccucaagaaaacaaguugcucauggguccugacauugaggaguucacugucu

SEQ ID NO: 4132158 - RNA, 68 nt, Human
ggauggggcugaaacauggaagagagguacaagauccagcccuucuggcuccacucagccccacagcc

SEQ ID NO: 4132159 - RNA, 56 nt, Human
ggaugggugacuuugggcaauggacuucacaucuccaagccucaguuuucucaucc

SEQ ID NO: 4132160 - RNA, 79 nt, Human
ggaugggugcaggucugagugccagggagagaagccaggcacccgaacuccuagccagcucacuuagccugcaccgucc

SEQ ID NO: 4132161 - RNA, 61 nt, Human
ggauggucacuucacccaugagcucaaagccuucguagcacaugaaggugagggacucucc

SEQ ID NO: 4132162 - RNA, 64 nt, Human
ggauggugacccaggguuucugcacagggucugccucccugcuugucaccccuggguccucucu

SEQ ID NO: 4132163 - RNA, 79 nt, Human
ggauguaaguggccccggaguuuguuggcugacuugguuaucuuuccaggcuuucccagccucuccauugccaugcucc

SEQ ID NO: 4132164 - RNA, 100 nt, Human
ggauguacaguaagugggucuuucggggggacagccuggagugggaggagcucucgguccccucuucuaggacguccuuguggguccccuugcggagucc

SEQ ID NO: 4132165 - RNA, 65 nt, Human
gcuugcacgggauguucggccgggucagaagucccuucugccugccgagaacaccuaccgagagc

SEQ ID NO: 4132166 - RNA, 68 nt, Human
gcuugcauagaacaggcccugccauuuauccagacagacuggaaagacuucaguccugauuuccaggc

SEQ ID NO: 4132167 - RNA, 71 nt, Human
gcuugccugaggaacagaggguacuggucugucaccuuguaugccugauaacugugucucucagggcaagu

SEQ ID NO: 4132168 - RNA, 76 nt, Human
gcuugcucacaguaccuggcuuggcugcuuacaacuauuaaauuagcuagauaauccugugcuguguaaguacagc

SEQ ID NO: 4132169 - RNA, 71 nt, Human
gcuugcucagggccuggcagccuccaaccuucaccuauuugaagccugggguccguggguaggggguaggc

SEQ ID NO: 4132170 - RNA, 75 nt, Human
gcuugcucccuugcgaaaucgcucuuuuccucuuguagcuggaggaacagagacgggaucgcuuuggggccgggc

SEQ ID NO: 4132171 - RNA, 59 nt, Human
gcuugcugugagauugcugcauuucugcugaaaugcucugcaucugauagacacaaagc

SEQ ID NO: 4132172 - RNA, 59 nt, Human
gcuugcuguugcucuuuucuugguuggcuuuugugcagauuacuuuguagcagucaggc

SEQ ID NO: 4132173 - RNA, 56 nt, Human
gcuuggacauuuuaggcuugagauguuuauuagacacucaaguggagaugccaggu

SEQ ID NO: 4132174 - RNA, 107 nt, Human
gcuuggacugucugaggcuuuuagaauuugagcuuucuccccaguaugcauccuuugaugcugggcuaggguggagcucuggcugaaggccuucccacacuccuugc

SEQ ID NO: 4132175 - RNA, 57 nt, Human
gcuuggagaugggggaugagccugaagggguaugguucaacccuugcgucaccaagc

SEQ ID NO: 4132176 - RNA, 55 nt, Human
gcuuggagcauucauuucagcgagcaguagcucacuagcugaaugucugcuuugc

SEQ ID NO: 4132177 - RNA, 82 nt, Human
gcuuggagugcuggucugugcucuggagccucugaggaacugggacagcagagagccaugcagagcagaugggugcccaggu

SEQ ID NO: 4132178 - RNA, 109 nt, Human
gcuuggcaccccagcaggaccccaggcuaaggagugugaugcucaccuugcaucugaggguggcaaccaaguuccuggccugugggaucaaugcuaggacuccccaggc

SEQ ID NO: 4132179 - RNA, 75 nt, Human
gcuuggcauguauguuagacaagccuacagggcuuaccuaauuugugggacugacuggcucuuuacaugccaggu

SEQ ID NO: 4132180 - RNA, 56 nt, Human
gcuuggcccauugaucagcuggaaaaaaaugcucauuaaugaaacuuugguuaagc

SEQ ID NO: 4132181 - RNA, 62 nt, Human
gcuuggccuugguccucuuugcaaucagaucaguuggaugaaacagaacaucgaggcugagu

SEQ ID NO: 4132182 - RNA, 59 nt, Human
gcuuggcuuacgcaggcuucgugauuguaaguaagugacagaggcugaguuagucuggc

SEQ ID NO: 4132183 - RNA, 62 nt, Human
gcuugggccacagcucacacauccaaucuaccugcucagccuggacggcauguggcuuaggc

SEQ ID NO: 4132184 - RNA, 61 nt, Human
gcuugggcugugggccaagugcauggagucccaggacacuuccaggggccagcacccaagc

SEQ ID NO: 4132185 - RNA, 71 nt, Human
gcuugggcuuaaggguuggggauguagauuuaauuucaccuacaucucuuauaaacucucugaucuugggc

SEQ ID NO: 4132186 - RNA, 125 nt, Human
gcuugggugccgccccccuagccaccccagcuccuaggaaugauuggaauuccaggaguaugauccuuaggugcccugggcggcucaucccugggaggugggcaggguguggggguggccucugc

SEQ ID NO: 4132187 - RNA, 57 nt, Human
gcuugguagaaugaacauucauugaccaucuguuaugugauaggcauuuuacugagc

SEQ ID NO: 4132188 - RNA, 73 nt, Human
gcuuggugggcagguaggcaccagcuacgucuucuauaccuccuguggugggugccucacugucacccagagc

SEQ ID NO: 4132189 - RNA, 94 nt, Human
gcuuggugucauagccgcagaaguuagugucugccaguaucugaugaauauggugacuugcagccuaauuuuugugaaauuaugaggccaaagu

SEQ ID NO: 4132190 - RNA, 65 nt, Human
gcuuggugucccagucacuguccaugcagcacacagcugcuguaugguccacgugggugcccagc

SEQ ID NO: 4132191 - RNA, 55 nt, Human
gcuugguguucucaagagucugcccuuuccgaggaagaagaggauacaaccaggc

SEQ ID NO: 4132192 - RNA, 65 nt, Human
gcuugguuacugauggaaaggaugcugccucuagugaggagagaguucugacaguaauaccacgu

SEQ ID NO: 4132193 - RNA, 66 nt, Human
ggaagauuugcccaugcacuuuugagauccacaguccucagggguaaaucugggugcaauucuucc

SEQ ID NO: 4132194 - RNA, 66 nt, Human
ggaagcaaagacuuucucccaaauccucagcaggcaucugcuggagcaugagagucuuuagcuucc

SEQ ID NO: 4132195 - RNA, 82 nt, Human
ggaagcaaggaaugaauucuacaugcauccuaguuuuuccuguuguaaaugaggaguaugguggggucauucuuuggcuucu

SEQ ID NO: 4132196 - RNA, 96 nt, Human
ggaagcacucaaauauuaaugggauuuagucaggagagcguggaagcuagcuugaaggggcucccauugaccaaauuuggggccauuuaagaaucc

SEQ ID NO: 4132197 - RNA, 130 nt, Human
ggaagcauggaaaagauauugacaaucuggaauugggaguuacaaaguucugaguucaaacagugcaaagcacuguucacuggcugugugacucugagugaguuaauucacuuuucugacucuuauuuuc

SEQ ID NO: 4132198 - RNA, 61 nt, Human
ggaagccagagugcugggcaggcagggccauacaaggggagggccuucggacuuugcuuuc

SEQ ID NO: 4132199 - RNA, 66 nt, Human
ggaagccagcaguggagaaaggagcuuuuuggaaaggaacauucuggaacuauacuguuggugacu

SEQ ID NO: 4132200 - RNA, 74 nt, Human
ggaagcccaucuuaugagacccauaaagaucagccucucagagcugacuguuggcucauuggcaugaggaaccc

SEQ ID NO: 4132201 - RNA, 71 nt, Human
ggaagccccaaacccucgccaucgagagacccccauggcccggggugauggcuguggggcuuggugcuccc

SEQ ID NO: 4132202 - RNA, 55 nt, Human
ggaagccuaaagcccaggucuccucucugagggaagcugguggcucuagccuucu

SEQ ID NO: 4132203 - RNA, 63 nt, Human
ggaagccucugaccagaguguacagagcuuuuccaggaaggacaggcacagugguggaggccc

SEQ ID NO: 4132204 - RNA, 65 nt, Human
ggaagccuucacaguccugauguaauagccgagguggacagcagggggagcuguuggacgcuucu

SEQ ID NO: 4132205 - RNA, 68 nt, Human
ggaagcggcgcgggugcuguccagcuucccggugcugaaaaccggagggcucgucauccaccacuacc

SEQ ID NO: 4132206 - RNA, 55 nt, Human
ggaagcuauugagucuuggacaaguuacuucguucuucuaagccucaauguuuuc

SEQ ID NO: 4132207 - RNA, 67 nt, Human
ggaagcucaggaaagagucugguuaaaguuacauugagcuggaaaccaauuuccuccuaaugcuucu

SEQ ID NO: 4132208 - RNA, 81 nt, Human
ggaagcucucucucagugccgcucugcugucauuuggcugcagauugggccagcagcagagcucuggucugcauggcugcc

SEQ ID NO: 4132209 - RNA, 56 nt, Human
ggaagcugcagucccccccaagaggccugauggugcugggcggguuugcagcaucc

SEQ ID NO: 4132210 - RNA, 65 nt, Human
ggaagcuggagauguccgggugcuguugagcauuuuggacgaaaacuuggauaucuccuguggcc

SEQ ID NO: 4132211 - RNA, 128 nt, Human
ggaagcuugagucuugguaauggaucaaaagucuuacucaauagcucacugauuucucuuuuggcuguaagagaagaaaggaaguagcuuuuaguguuucucuugggaauucugaaacucaagcuucc

SEQ ID NO: 4132212 - RNA, 79 nt, Human
ggaaggaaaaugcauauuggauuagcagccagcaguuucugugauuuucuaggcaucuaugcaauuugcagaucuuuuc

SEQ ID NO: 4132213 - RNA, 61 nt, Human
ggaaggaaguaaaugaugcuauuuuaggauggcucaacaucccucaucacuugguccuuuc

SEQ ID NO: 4132214 - RNA, 67 nt, Human
ggaaggaauaugggccaauucugagggcuaauugucuuugcucucaacaagagcccaugcuuuuucc

SEQ ID NO: 4132215 - RNA, 83 nt, Human
ggaaggaauggagcagggguucacauucaagucuguuauaugacaaacuuccuguauuuauccauagccucacacuuccuucu

SEQ ID NO: 4132216 - RNA, 97 nt, Human
ggaaggaggcaggcaguuguagagagggcucuguuauuguagucucccucgucucugcuucccaucucucucacgcacugucugguggucucuuucu

SEQ ID NO: 4132217 - RNA, 57 nt, Human
ggaaggagggcggcaaugaugaucauaguugauaaauacugacacugucuucauucc

SEQ ID NO: 4132218 - RNA, 127 nt, Human
ggaaggauaucuugaaggugucauuucccagggaaugggcaggcagccuccauccacaggguguccucugagguccuugacugcuugccuauuuuaaggagagcauccagaucuuagguuucccucu

SEQ ID NO: 4132219 - RNA, 56 nt, Human
ggaaggcagaggugucgugggggcugcagaccugcguccacagccugcugucuucc

SEQ ID NO: 4132220 - RNA, 88 nt, Human
ggaaggcucucucacucugcucuuuggacaaugccuugccccucuugguggcagcuuccuaggagagggcagagucgggggcucuucu

SEQ ID NO: 4132221 - RNA, 110 nt, Human
ggaaggcugaggacucaagggcucguuaggaugcugguaucaugggcugaagacucagagcagucccuccagccagugccagucaugccugcagcuugucccagcuucuc

SEQ ID NO: 4132222 - RNA, 55 nt, Human
ggaaggcuuugaggggugcugguaauauuuuacuggugcuugcuuuaagucuuuu

SEQ ID NO: 4132223 - RNA, 56 nt, Human
ggaagggaacugggauggguguagauauagaauagcagccaccucauuucccuacc

SEQ ID NO: 4132224 - RNA, 61 nt, Human
ggaagggaacugggucuccuuguucaccaugaugggcggggacagaaggcgguucucuucc

SEQ ID NO: 4132225 - RNA, 86 nt, Human
ggaagggacaggaaggaggcaggcagguggcaucuugugaacaccuucugggugcccuuugcucuguugaguacuuccaacuuucu

SEQ ID NO: 4132226 - RNA, 58 nt, Human
ggaagggaggccagagguuuugcagggaaaucccuuaaauaugccucuuuucuuuucu

SEQ ID NO: 4132227 - RNA, 72 nt, Human
ggaagggcagggacaggauaggguuuuggggggaagcuauccccaaagcccuggcacuuguucugcagcucc

SEQ ID NO: 4132228 - RNA, 79 nt, Human
ggaaggggagcuggaaaggguaugguacgggaaggugaucuuucccugaagccuggcccucuacagcuggacuccuuuc

SEQ ID NO: 4132229 - RNA, 60 nt, Human
ggaagggggguugggcuugcaggaagcugcuuuaacgcugagggucucauguccccuucc

SEQ ID NO: 4132230 - RNA, 84 nt, Human
ggaaggggucauuugcaaagacuggcuuaacaguaguaugcaaaauauaacugugagagagguucuugguauuaaccaacuuuc

SEQ ID NO: 4132231 - RNA, 58 nt, Human
ggaaggggugucgcccauggauggagagcauccauucuucccuccugacacugcuuuu

SEQ ID NO: 4132232 - RNA, 69 nt, Human
ggaaggguaucuuaaaaguuaugggaugcucugggucuagagucuucuugaucuuuucagugcacaucc

SEQ ID NO: 4132233 - RNA, 123 nt, Human
ggaagggugugguggauggaggagaagaagggggaggaauaugaggguuggguauuuaauucugugcugcuuuaaaucaaugcuuuauuuccuccccuuuuuuucuuucuuucuuucuuuuuc

SEQ ID NO: 4132234 - RNA, 78 nt, Human
ggaaggucgagcugcaucuggcccccacgaccuuuuccacaucugaguauuucugauuccgcgacagcccgaccuucc

SEQ ID NO: 4132235 - RNA, 129 nt, Human
ggaaggucuauugucccuuccuuacuggugugugcacauguguaugcaugcaugcauguguaauagcacaugcauuuauguguguacauugcauguguggugugguggagggcaccaaauaggccuuuc

SEQ ID NO: 4132236 - RNA, 68 nt, Human
ggaagguggauggcucugaccuaggcucaccgcaacugcugugugaagccacagagccacgccgugcc

SEQ ID NO: 4132237 - RNA, 126 nt, Human
ggaagguucuccugagccagccaaggggcuucccgggugacgugcuccuguuccugggcgggcgccccucccacaggcugcugcaggucccgggcugagcccauggcugcaugcucuuggccuucc

SEQ ID NO: 4132238 - RNA, 68 nt, Human
ggaaguacagggguucuuagguaauguagaaguuuguccuuuaaaauacccuagauuccuguuauucu

SEQ ID NO: 4132239 - RNA, 114 nt, Human
ggaaguaccaaguugcucugcuuuuugaucaguggaugaacgaaauuaaauuguugguuaaagaccaggcuaauaguuaugguugguucucauggcaaguagcuuuucacuuuu

SEQ ID NO: 4132240 - RNA, 129 nt, Human
ggaaguagcagaaguaguggcuguggcagagaggagcagcacugggguuccacggaggggcagccccaggagagucuguccccagagccuguuccugcagcaucugcauaaauauuaacucuccagucu

SEQ ID NO: 4132241 - RNA, 95 nt, Human
ggaaguaucuucaagugagcccagcagcagacaucuuuuaucuucaggauggaguuccauuucugcaaagaguaagaugaggcccuugaacuucu

SEQ ID NO: 4132242 - RNA, 73 nt, Human
ggaagucagagaggcuguaaguguggagccuaggccugaaugagaauccugggccucuugcucucucugcucc

SEQ ID NO: 4132243 - RNA, 64 nt, Human
ggaagucaggacaacaagacuuguuuaaagcuaccuuuagguaggaaguguuguuuuuacuuuc

SEQ ID NO: 4132244 - RNA, 58 nt, Human
ggaagucagggaguguuggcaggaucagugucugcugauuaggucuacucuuggcucc

SEQ ID NO: 4132245 - RNA, 90 nt, Human
ggaaguccauucugagucaguuuucuaggcccugggguuagugagcacuugggccaccagguucuggguuaagcugacuuuauuaggucc

SEQ ID NO: 4132246 - RNA, 67 nt, Human
ggcagggcauuuugauaaacuuuguacucauuacuccuuauaacaaguuuaugaaucuuguccugcu

SEQ ID NO: 4132247 - RNA, 88 nt, Human
ggcaggggagagggagcgggccagccuuacagagcacccccugcagcuugagggaucugagcuggagcccaucaccucuguuacugcc

SEQ ID NO: 4132248 - RNA, 64 nt, Human
ggcaggggagcaguaacaacuugguccugagccugagcugcugcaggauuuacuacuaccugcu

SEQ ID NO: 4132249 - RNA, 86 nt, Human
ggcaggggagccucucacccggccucuuuccaaucccacagcacagaccuuggcaguguggagggagagagccugguucuucugcc

SEQ ID NO: 4132250 - RNA, 92 nt, Human
ggcagguaaaaugucuaacugaaaccaaacacuuuagggagaaaagaaaauacuuuuuacgugaaggguuucauggacugcaucuaccugcu

SEQ ID NO: 4132251 - RNA, 93 nt, Human
ggcagguaggugcugguggcugggacagcugagacaggagagggcaguuacuauuuuccagucucugccuccaagggcaucuacuguacuguc

SEQ ID NO: 4132252 - RNA, 95 nt, Human
ggcaggucacucguggcaugagugguucuaauuagaucagcgagacauggagcaaggcucuuugcugagcugguuguucaacaugaguggucacc

SEQ ID NO: 4132253 - RNA, 77 nt, Human
ggcaggucauugggggccaucucagaggcugcccaacacaggcuacucuuuggcccccgaugauucauguuccuucc

SEQ ID NO: 4132254 - RNA, 85 nt, Human
ggcagguccuguguccaucuuuucagauucuguaucccagcacuuaggacauagacaaacacgaagaugacaaucaauauuugcc

SEQ ID NO: 4132255 - RNA, 72 nt, Human
ggcaggucgcaucuuuauuuauauagacaggggccaguucucuuugcuaaaagugaugaagacacaucugcc

SEQ ID NO: 4132256 - RNA, 76 nt, Human
ggcaggugacagggauggcgcuggcugcccgcgggccguccggcggccgcagcagugucggcccaaacacaaugcc

SEQ ID NO: 4132257 - RNA, 66 nt, Human
ggcaggugagagcucuuugaaaaugaaaacauucugcuauuugaaugcaaaguguucuucuuuguc

SEQ ID NO: 4132258 - RNA, 67 nt, Human
ggcagguggaucacuugaggucagcaguuugagaccagccugaccaucauggugaaaccccaucucu

SEQ ID NO: 4132259 - RNA, 67 nt, Human
ggcagguggauuuucuacucuaaaaaucuagucguuuuaucagaaaggagugcaggauuuacguguu

SEQ ID NO: 4132260 - RNA, 67 nt, Human
ggcagguggcagggugcucaucaugcaccuccucuuugugagugcaagacuaugacccucccuugcc

SEQ ID NO: 4132261 - RNA, 56 nt, Human
ggcagguggggcugcuaccagaauaauggguucaacauucaggcugccucccugcu

SEQ ID NO: 4132262 - RNA, 61 nt, Human
ggcagguuauccaacuacaaugugcuguuuucuuaacacguuuguugauggauuacuagcu

SEQ ID NO: 4132263 - RNA, 73 nt, Human
ggcagguuugaaauuaugauaaaucugcuacauauucauucuaugagcagguuuaaacucuaaugcaucugcc

SEQ ID NO: 4132264 - RNA, 64 nt, Human
ggcaguaaacacuaccuacaaaugcagcaguggaagagaccaguguguaagguacuuugcugcu

SEQ ID NO: 4132265 - RNA, 90 nt, Human
ggccacacuucuggccuggacagcagagaggaaugaagccauccauggagaucaggaaggcuuucuguucugugacgccccaggaaggcc

SEQ ID NO: 4132266 - RNA, 81 nt, Human
ggccacagaaacauguauaaaguuguaaaaauucuuugaugcauuuccaaauugcacuuugagaaguguuucuguuuaguc

SEQ ID NO: 4132267 - RNA, 63 nt, Human
ggccacagagggcgggaugcuggauuucucagcaucucuaugucuccuucugcaaaaugagcc

SEQ ID NO: 4132268 - RNA, 102 nt, Human
ggccacagauguugucuauuuuugugagaugauuugaaagugugcaaaaagaaacaucuguaugguuaucucagaaguuuaaagaaaauaucuuauugugcc

SEQ ID NO: 4132269 - RNA, 129 nt, Human
ggccacagccagagguuuugggggauuagggcauggacgucucugaggccaugauucagcuggccguggucaucuggagugucuuuccuugccccauucugaucuccucuccuugcuguuguaauggcc

SEQ ID NO: 4132270 - RNA, 89 nt, Human
ggccacagcccuagaaacacuaguccuuggcuuuuucuccaucugugauuacagcuggacagaaacccgagugaucugucuguguugcc

SEQ ID NO: 4132271 - RNA, 60 nt, Human
ggccacagggaaccaaggcugggcccugagauucugcagggcaggugggucucuguugcu

SEQ ID NO: 4132272 - RNA, 85 nt, Human
ggccaccagggacugcacuugucuugggcucucaaggcuagaggcaagggcugcccacagagcccuggagggcagucccggggcc

SEQ ID NO: 4132273 - RNA, 69 nt, Human
ggccaccuccgugaaggaaugacauugcugaagacugaguuugcacuucaccucuaccagaguguggcc

SEQ ID NO: 4132274 - RNA, 64 nt, Human
ggccaccuuaaguuaaggauauuauuuauauccuuagaaaauuuacuugagaauugucaaggcc

SEQ ID NO: 4132275 - RNA, 91 nt, Human
ggccacgcaucuccuucuuaaucccuuauauauuugcuuccugcauguaaauauaaaggauugcagccggggagguaaaaauagcgcggcu

SEQ ID NO: 4132276 - RNA, 100 nt, Human
ggccacgccgauggccacccggguggagccugggcugugggcuucgccugcguccccgcggccuguccacgcguccggcacccggagcuagggcguggcc

SEQ ID NO: 4132277 - RNA, 64 nt, Human
ggccacgguguguguuuucucacucucgaaugcaagugggagagagaaaaugacuccggacgcc

SEQ ID NO: 4132278 - RNA, 92 nt, Human
ggccacuaaaauauuugaccugaaacuuugcuuuucuacaaaacuuaaaggaaaauaaguuuaguauuagggaaaaguucagggauaaugcu

SEQ ID NO: 4132279 - RNA, 64 nt, Human
ggccacugccagcugucuguaagcucaggauuagagagccuggccuuucgugagagcuggggcu

SEQ ID NO: 4132280 - RNA, 64 nt, Human
ggccacugucugagcacagagggacccuggagggaggcuucccaaggugcucggcaacagggcc

SEQ ID NO: 4132281 - RNA, 71 nt, Human
ggccagagaacuuagcuaguuuucccucggucauaucucugggauucaagcccagcuaagugauucaugcc

SEQ ID NO: 4132282 - RNA, 61 nt, Human
ggccagagaagucagacccuugguauuucauagcaaagcacggucuucugcaucguuggcc

SEQ ID NO: 4132283 - RNA, 57 nt, Human
ggccagagggagggcacaaaucuggaagcugagguuagagugcuuugccuuuuggcc

SEQ ID NO: 4132284 - RNA, 55 nt, Human
ggccagaguuucuguugcuggaggguggacugcacagcaguaggaccucugggcc

SEQ ID NO: 4132285 - RNA, 68 nt, Human
ggccagcaagacucagcaggauaccaggaagauguucacuggaagacuaucccgugauuuuguaagcc

SEQ ID NO: 4132286 - RNA, 63 nt, Human
ggccagcaggguauguuagagcuguagcagagaaggcuugcaaauuguauuauuuugcuggcu

SEQ ID NO: 4132287 - RNA, 93 nt, Human
ggccagcauggucucgaucucuugaccucaugauccaccugccuuguccucccaaagugcugggauuauaggcaugagccaccgugccgggcc

SEQ ID NO: 4132288 - RNA, 61 nt, Human
ggccagccccagacauccuaucgccacaaugccaugucgcaauaggaagcaggggccggcc

SEQ ID NO: 4132289 - RNA, 87 nt, Human
ggccagccgcagcuuggcugggaugguauggugguccauaaggccucgugggcuguccagcuccagccagccagccucggugaagcc

SEQ ID NO: 4132290 - RNA, 58 nt, Human
ggccagcggucagugcccacuggauucaaccacacagaagcuuuuggugaccuuggcc

SEQ ID NO: 4132291 - RNA, 80 nt, Human
ggccagcuccuguucagguccagagcugcuaacguggguucuacucagucccagugacuuggccagaauagagcuuugcc

SEQ ID NO: 4132292 - RNA, 57 nt, Human
ggccagcucugcacagcagcugccucucagcccgcugcugaugaagcguugucugcc

SEQ ID NO: 4132293 - RNA, 64 nt, Human
ggccagcuggaguuccgggugggcaugggcuuggcgggccugcacucggagcagccggccggcc

SEQ ID NO: 4132294 - RNA, 55 nt, Human
ggccagcuuucugucuucuagggaaccuguuaguuccauuuaggggcggcuggcu

SEQ ID NO: 4132295 - RNA, 57 nt, Human
ggccaggaacuuuugggauggggacaccaccucucagcccucccucucuuccuggcc

SEQ ID NO: 4132296 - RNA, 55 nt, Human
ggccaggaggcaauaucaaguccacacaugucuguggagcagaaccucuuuggcc

SEQ ID NO: 4132297 - RNA, 93 nt, Human
ggccaggauggucucaaucucuugaccucgugauccgcccgcuuuggccucccaaagugcugggauuacaggugugagccauugugccuggcc

SEQ ID NO: 4132298 - RNA, 93 nt, Human
ggccaggauggucucgaucccccgaccuugugauccauccaccuuggccucccaaaguguugggauuacaggugugagccaccgugccuggcc

SEQ ID NO: 4132299 - RNA, 63 nt, Human
ggccaggcagagccccgugcagccauggagucgcuccugcugccggugcugcugcugcuggcc

SEQ ID NO: 4132300 - RNA, 63 nt, Human
ggccaggccaccgcugugcgcuuuaaaagcaugguucuuuccauggcaccaggugguggcccc

SEQ ID NO: 4132301 - RNA, 75 nt, Human
ggagucaaagcuacaggcauuugaguagcccagggcugguuaauucauuguaugccugaggacuuugaaagaacc

SEQ ID NO: 4132302 - RNA, 57 nt, Human
ggagucaccaaguaggagucuuggucucgccuugacuucugccugcugagugccuuc

SEQ ID NO: 4132303 - RNA, 60 nt, Human
ggagucaggagucauuggaagagagauuucuuuuccaaaguaauuucacuucuguccucu

SEQ ID NO: 4132304 - RNA, 59 nt, Human
ggaguccaacgugcagccaggacauugcucacaguggccccuucuguacauuggacucu

SEQ ID NO: 4132305 - RNA, 99 nt, Human
ggagucccugccagcugcuucuccagaauuugcuucucugccuucuccuacugggguggagaugaagaguaucuaggauggccaguuggagcagauaac

SEQ ID NO: 4132306 - RNA, 86 nt, Human
ggaguccucauggguaaagcaggaagagagugggaaagagaaccaccccacucugucuucauauuugcauuucauguuuaaccucc

SEQ ID NO: 4132307 - RNA, 76 nt, Human
ggaguccugggcguccugggagggagggaaggaggagggcaccuucccuccaccaagcagggcgccagguaacuuc

SEQ ID NO: 4132308 - RNA, 85 nt, Human
ggagucuaaauugauaaacuuagaaagaauguugugguucuauagcuaaagcaagauuuuucagguuaguauagagcuagacuuu

SEQ ID NO: 4132309 - RNA, 57 nt, Human
ggagucucacaauguugccuaggcugaucuugaacaccugggcucaagugagccucc

SEQ ID NO: 4132310 - RNA, 87 nt, Human
ggagucucacucugucaccaggcuggagugcaguggugcaaucucagcucacugcaaccuccgccugcuggguucaagugauucucc

SEQ ID NO: 4132311 - RNA, 88 nt, Human
ggagucucacucugucgcccaggcuggagagcaguggcaugaucucagcucacugcaaccuucgccucucggguucaggugauucucc

SEQ ID NO: 4132312 - RNA, 88 nt, Human
ggagucucacucuguugcccaggguggagugcagugguacaaucuuggcucacugcaaccuccgccuuccggguucaagcgauucucu

SEQ ID NO: 4132313 - RNA, 87 nt, Human
ggagucucgccuguugcccaggcuggagugcaguggcgugaucucagcucaccacaaccuccgccucccagguucaagcgauucucc

SEQ ID NO: 4132314 - RNA, 87 nt, Human
ggagucucgcucugucaccaggcuggagugcaguggcaugaucucagcucacugcaaccuccaccucccggguucaagcaauucucc

SEQ ID NO: 4132315 - RNA, 88 nt, Human
ggagucucgcucugucacccaggcuggagagcagcagcgcaauuguggcucacugcaagcucagccucccggguucaagcgauucucc

SEQ ID NO: 4132316 - RNA, 87 nt, Human
ggagucucgcucugucacccaggcuggagugcaguggugcgaucucggccacugcaaccuccaccucccggguucaagcgauucucc

SEQ ID NO: 4132317 - RNA, 88 nt, Human
ggagucucgcuguguugcccaggcuggagugcaguggcaugaucuugguucacugcagccucugccucccgggcucaagcaauucucc

SEQ ID NO: 4132318 - RNA, 85 nt, Human
ggagucucgcuguugccagacuggagugcaguggcacgaucucggcucacugcaaccuccgucucccagguucaagcgauucucc

SEQ ID NO: 4132319 - RNA, 60 nt, Human
ggagucugaguugcccugcacugagaaccuuauuccagugagggaagaucucagcacccc

SEQ ID NO: 4132320 - RNA, 72 nt, Human
ggagucugccuucaggagcagacucugccuggcaucccagaggagucugugucuugaagcagucagugcucc

SEQ ID NO: 4132321 - RNA, 101 nt, Human
ggagucuggcucugucacugaggcuggagugcaguggcgccaucuaggcucacugcaaccuccaccucccgaguucaagugauucuccugccucagacucc

SEQ ID NO: 4132322 - RNA, 88 nt, Human
ggagucuggcucuguugcccaggcuggagugcaguggcgccaucuuggcucacugcaagcuccgccucccggguucacaccauucucc

SEQ ID NO: 4132323 - RNA, 78 nt, Human
ggagucuggucauuuucucucccuguaaccaacucuauguguuuuaaaucuggugggucaugaaauugaacaggcucc

SEQ ID NO: 4132324 - RNA, 73 nt, Human
ggagugaaucagcccauccaaggcuuggcaugcaguagugagccaaggguugccauggagaugggcgaggccc

SEQ ID NO: 4132325 - RNA, 65 nt, Human
ggagugacuuccuucaauauaauuuuuacuugaaaaguagaacuuuugauugauggaaagacuuc

SEQ ID NO: 4132326 - RNA, 75 nt, Human
ggagugcaggauaaaaaaaucugaagaauucugccuagaguucuuacaucaguuuauuuuguaaacuugcacacc

SEQ ID NO: 4132327 - RNA, 76 nt, Human
ggagugcaguggcaggaucucgguucacugcaaccuccgccuccuggguucaagugauucuccugccucagccucc

SEQ ID NO: 4132328 - RNA, 57 nt, Human
ggagugcaugggugcuagaacuagcuggccacuuuggugcuggcacggguggacucc

SEQ ID NO: 4132329 - RNA, 73 nt, Human
ggagugcugagcagauccagaggggaaagcaacacagacucuuuuuuccacccagagcauuuguuucccaccc

SEQ ID NO: 4132330 - RNA, 64 nt, Human
ggaguggaaggagcagagugagcggcacccacagccccuucucugagcgcauuccuccggcucc

SEQ ID NO: 4132331 - RNA, 64 nt, Human
ggaguggccaaggugcagagcagcugugaaaaccggaacagccuucguuccugcgggcucgccu

SEQ ID NO: 4132332 - RNA, 77 nt, Human
ggagugggaacuuauacugccagauucugaagccaauuauaaaguuaaaauaguuguaguagaacuguaguagcucc

SEQ ID NO: 4132333 - RNA, 70 nt, Human
ggagugguggaagggguuacgcagcaggauggacaccacuuccaugcgcgauggccuggcuucccgcucc

SEQ ID NO: 4132334 - RNA, 60 nt, Human
ggagugguguguaggggcacugccagagaucuucccuggcagaggccuaucacagacucc

SEQ ID NO: 4132335 - RNA, 118 nt, Human
ggaguguauauguauuuacugugggaauuuguuuuuaauaaaacuguuguaaggcauuuuuauuccuuugcuuuguuacauuaaaaacauucacugcauaaguaauguauuuuauucc

SEQ ID NO: 4132336 - RNA, 62 nt, Human
ggaguguauuuauuucauauacaacagaaaaaugacuguguauuaucaaguaaauacaugcu

SEQ ID NO: 4132337 - RNA, 107 nt, Human
ggaguguccuuuuagggcccgugacuggcuccagcucaaguauggcacgagugggucgccgugaagggguggagcaggugaugggaauagagcugacagggcacucc

SEQ ID NO: 4132338 - RNA, 88 nt, Human
ggaguguggcuaugucaccgaggcuggagugcaguggcauggucuuugcucacugcaaccuccacuucccagguucaagcaauucucc

SEQ ID NO: 4132339 - RNA, 68 nt, Human
ggcaguugggcaaugucuguguuuaagggaacuaugagccuuuauguucaguacaaugcuucacuguc

SEQ ID NO: 4132340 - RNA, 68 nt, Human
ggcaguuuacagaugacugagaaguucuuuccugaugcuuaguaaauaccuaagucauuugaaaugcc

SEQ ID NO: 4132341 - RNA, 102 nt, Human
ggcaguuuaccuaaaauuaugcgugaaaccauucucagguacacuaugaauaucaaagguguauuucuagauaugguauuccugcauuuguguaauacaccc

SEQ ID NO: 4132342 - RNA, 63 nt, Human
ggcaguuuggggcuagugggcaaggagauuuuucccacuucuugcuucucuagaucaacuacu

SEQ ID NO: 4132343 - RNA, 83 nt, Human
ggcauaaaaauauaucucuguaauuacaugauauuuagugauuagauaauuauggauaauugcaugggguaguucuaagugcu

SEQ ID NO: 4132344 - RNA, 63 nt, Human
ggcauaaacucuugagauucuuguugggucaauacccaaaacauuauccaggagaguuuaccc

SEQ ID NO: 4132345 - RNA, 81 nt, Human
ggcauaagcaagacaaggguuccugcaagauuuaagccuggccuagggcuacauuuuucaccgagccucugguugcuugcu

SEQ ID NO: 4132346 - RNA, 72 nt, Human
ggcauacagguaggggacauacauccugccuucaaagcaggcauucgaugucugauucccuacucugauguu

SEQ ID NO: 4132347 - RNA, 62 nt, Human
ggcauagaauguaauaaagaguagggauuuugcuuuauucaacuuuauauguucuguaggcc

SEQ ID NO: 4132348 - RNA, 84 nt, Human
ggcauaguagagauacaguuggcugcaggcuguacacaauaaucugaagccuggcuguaaaccuucucuucacauuaaucugcc

SEQ ID NO: 4132349 - RNA, 76 nt, Human
ggcauaguagugaggggagguccagauucuggccuucagggaacuggugucaggucugaugccucauccauuggcc

SEQ ID NO: 4132350 - RNA, 59 nt, Human
ggcauauccagccuacauuuauucccugccuugagagaaaagaugagaacuggauggcu

SEQ ID NO: 4132351 - RNA, 91 nt, Human
ggcauaugguugauuaaaacaacuuuccuuuuuuuccaccaaaacauuuaauuggcuuuagagucaaggaagguucauagucaaagaugcc

SEQ ID NO: 4132352 - RNA, 109 nt, Human
ggcaucaauauguucuaauguccuaggcaugauuuugugaaauguuuaguuuauuuuuauaaaguuacacagccauagagacauauuagcauaguuccauuuguuuguc

SEQ ID NO: 4132353 - RNA, 76 nt, Human
ggcaucacuguuuuaaggauugagccauuuuuacacuugguuuucaggaaguagaaaacucaguuucaagugagcc

SEQ ID NO: 4132354 - RNA, 65 nt, Human
ggcaucauuauguccaccuguuggaucacuugugagaaaaauaacaguugguguaauuucuugcc

SEQ ID NO: 4132355 - RNA, 58 nt, Human
ggcauccaaauaccaagauguaggucaacaggaccuuuguauguggauuuuuggugcc

SEQ ID NO: 4132356 - RNA, 105 nt, Human
ggcauccacaucuguuggaguuuguggagaguuaguugagcagucugagcuuuguuucugaggcgucucccugagcucacucuccugccagagcuguguccugcc

SEQ ID NO: 4132357 - RNA, 72 nt, Human
ggcauccugggaagcugacauugaagcugacauugacauauuuccuuacuucaauuucgagcuuucugugcc

SEQ ID NO: 4132358 - RNA, 76 nt, Human
ggcaucgaguucugaugucccuucuuucagcaguaacaggacagacuggcagaagagggccucgggcucggaugcc

SEQ ID NO: 4132359 - RNA, 65 nt, Human
ggcaucuaccuuauuaaguuguuaugauaauuaaacauaaucauucacauaaggugcuuggugcc

SEQ ID NO: 4132360 - RNA, 100 nt, Human
ggcaucuaugagccccucugugcacugggcuuccuggcacuacccucccuguggaaccuggccggcugccaggagaagcucagugggcaucaugggugcu

SEQ ID NO: 4132361 - RNA, 85 nt, Human
ggcaucucaaggaaagucuggagaagaagaaacuauuuguggcuuaaaacuuguucucuuuauagggcuucucuuugugguagcu

SEQ ID NO: 4132362 - RNA, 59 nt, Human
ggcaucucggaacacgccuccgacucugcuuagaggaugaggaguguguguaugaggcc

SEQ ID NO: 4132363 - RNA, 66 nt, Human
ggcaucucugugugugugaaucccccauggcuagggaggacuuucaaacacagacagcagcaugcc

SEQ ID NO: 4132364 - RNA, 65 nt, Human
ggcaucucuucaauugucacaaagcuuaucauguucacuugcuggcaauuuagagauuucuagcc

SEQ ID NO: 4132365 - RNA, 80 nt, Human
ggcaucuggaagcccucauccccaugggcgucugcccuucggccacaaugucccagcugagagacaacuucacaggugcc

SEQ ID NO: 4132366 - RNA, 73 nt, Human
ggcaucugguggagaugccuggccccuccugggagcuucacucagcagaggcugggcuuuucuaccuguggcc

SEQ ID NO: 4132367 - RNA, 60 nt, Human
ggcaucuuguugcucaaaucuaugaaggucaucuugauggauucgagagaauaaagugcc

SEQ ID NO: 4132368 - RNA, 56 nt, Human
ggcaucuuuaucuccagagcgguacccagaagaauacugaaaggagucgggauguc

SEQ ID NO: 4132369 - RNA, 72 nt, Human
ggcaugagaacuuacacaucauucaauggugauauuaauaauaauucaguaaucauuaaugauguacaugcu

SEQ ID NO: 4132370 - RNA, 55 nt, Human
ggcaugagggcagcccaggaagucagcccacacaguccugagccuccaccauguc

SEQ ID NO: 4132371 - RNA, 64 nt, Human
ggcaugagucagcgugcucagccuauuauuacuguaauaauauuugucaugcugaucuaugacc

SEQ ID NO: 4132372 - RNA, 85 nt, Human
ggcaugauucaacucaaccagccaugcuauucaggguucaaaaucuagaaaaagagccuuguuggucugaguuuggacauaugcc

SEQ ID NO: 4132373 - RNA, 64 nt, Human
ggcaugcagcagcagggaggaggcucugggcauaauuucagugcugauuccagguuggcugguc

SEQ ID NO: 4132374 - RNA, 57 nt, Human
ggcaugcugcguacagaugaacuugcaaaaacaugccauccuaugcaugagcaugcc

SEQ ID NO: 4132375 - RNA, 82 nt, Human
ggcauggaugcuggguagcauuuuagccaauuuucuucaaacccugguuggaaauuuauucaucauucauucaaaaagugcc

SEQ ID NO: 4132376 - RNA, 88 nt, Human
ggagaauugcuugaacccuggaggcggaaguugcagugagcugaaaucgugccauugaacuccagccugggugacagagcgagacucc

SEQ ID NO: 4132377 - RNA, 90 nt, Human
ggagaauuucuugaacccaggaggcagagguugcagugagccaagaccaugcaauaacacucuagccucugggugacaaagccagacucc

SEQ ID NO: 4132378 - RNA, 104 nt, Human
ggagaauuuguaacacuuucacaguucugcacuuugauuucagagaaggugcuaaucucucuggaauuuugagagugacaaaaugaguuguauacuguuuuucc

SEQ ID NO: 4132379 - RNA, 82 nt, Human
ggagaauuuuaguuugguuaauauuaggaaaagaaugaaacaaucuuuuauccuacauuuagcucuuauaagaauucagucc

SEQ ID NO: 4132380 - RNA, 67 nt, Human
ggagacaaaaguuugcacugugcugaggauuccgaguaaauuuucuaagccugucagacuugucucc

SEQ ID NO: 4132381 - RNA, 67 nt, Human
ggagacaaagguuuuucucuuugacagggauucugccuuuugccucagaguagcaauuuuucucucc

SEQ ID NO: 4132382 - RNA, 66 nt, Human
ggagacaaccauacuguuacaguuucccuaaugggggccagaaggagaaaacaguguuuugccucu

SEQ ID NO: 4132383 - RNA, 91 nt, Human
ggagacacaggcagguaauuuacauauugcuauagaagagucuagugcaauacuugugaauucaaagucugucauaccugucuuuguuuuc

SEQ ID NO: 4132384 - RNA, 55 nt, Human
ggagacagauggcgucucaguucccagcucugggucugaccagcagccugucucc

SEQ ID NO: 4132385 - RNA, 78 nt, Human
ggagacagccuaaccccuguacaagcucuuggugacaguuugugggugucuuugaaaagcuugacagaggcuuucucu

SEQ ID NO: 4132386 - RNA, 65 nt, Human
ggagacauuaacagugcuucagaggagcucuuggcuaagggagguuauugcacugggaugucuuc

SEQ ID NO: 4132387 - RNA, 66 nt, Human
ggagacauuagagcauauuugucuucaucuacuccuucaugagaacacauaagccuaaucaucucc

SEQ ID NO: 4132388 - RNA, 67 nt, Human
ggagaccccagucaacccaagauuugcauaaagcaugagcaagaaauaaggcuuugcugggguuucu

SEQ ID NO: 4132389 - RNA, 86 nt, Human
ggagacccccacccucaccugcccaccugcuuccacacuuuucugucccacagaggccuccgaaaggugggcugugugugggcucc

SEQ ID NO: 4132390 - RNA, 63 nt, Human
ggagacccccgacugugagaccaggaggagccuggcuuccacuuacaguugauggaguauucc

SEQ ID NO: 4132391 - RNA, 59 nt, Human
ggagaccugucucuuaugcaaaucccaggccacuaccugggggugugccagggaccucc

SEQ ID NO: 4132392 - RNA, 111 nt, Human
ggagacggggggcaggcagccacaggaguagggcugguggagaggggcuaugcuucugucuccacuugagacuggcucucugugguguugcucuucugcuccuccaucucu

SEQ ID NO: 4132393 - RNA, 59 nt, Human
ggagacuaccuagcaggcuguucuggaaauucaaccuguaugagccagcacuggucucc

SEQ ID NO: 4132394 - RNA, 58 nt, Human
ggagacuagaguuuagacaagggcuugcuuaaauccugugugugaguccuggcuuucc

SEQ ID NO: 4132395 - RNA, 78 nt, Human
ggagacuagcaggaaauuuaagaguguacaauaaaaguuaacuuauuucaugguuuaaaauuucuuccagcugucucc

SEQ ID NO: 4132396 - RNA, 66 nt, Human
ggagacugcauuguccaaggguucacagcaagcauugguagaaccagaagcagaaugcaaguuucc

SEQ ID NO: 4132397 - RNA, 100 nt, Human
ggagacuggacacagcaaagcaggaagcuccugacagagcacuggugcccugccuggcaucccugucacugaugcuccugccacuuugugccaaaucucc

SEQ ID NO: 4132398 - RNA, 60 nt, Human
ggagacuuaggugagauguuuguauuuaucacaacugcugcaucaauugccuaggacuuc

SEQ ID NO: 4132399 - RNA, 66 nt, Human
ggagagaaacagaacucuuaaaggaccuucauacagccuggaaaugucaagauucugcuucucucu

SEQ ID NO: 4132400 - RNA, 76 nt, Human
ggagagaaacagagggagaaaugaaaaggaaacaaacaaagaauaguuuauuuuagacuccaucugauucagcucu

SEQ ID NO: 4132401 - RNA, 67 nt, Human
ggagagaaacccuuugaaugcaaugaauguggaaagaccuucagccacaguucaucguucacucacc

SEQ ID NO: 4132402 - RNA, 100 nt, Human
ggagagaaaggacagccaagauugucacaaagaaggaauuggucuuuagggccucauucugaguguuuugcuuucucuguaauguuggcgcuuucucuuc

SEQ ID NO: 4132403 - RNA, 58 nt, Human
ggagagacccuggagaagguccuguuuacaaaaggguuaaucuuccccagggcucucc

SEQ ID NO: 4132404 - RNA, 57 nt, Human
ggagagagaggugcugccaggcacgagguggggcagcugccugagcaccucuguccc

SEQ ID NO: 4132405 - RNA, 77 nt, Human
ggagagagggguggacaugagagauggaaagagacuccugucuacauguuccuauggcucaguugcauuucucuucc

SEQ ID NO: 4132406 - RNA, 70 nt, Human
ggagagauaggaguccuggacuaauguggcuauuuacucacccccucaguaauucaggcucuuucuuucu

SEQ ID NO: 4132407 - RNA, 66 nt, Human
ggagagaugcuaagcucaggccacaguucaacuucacaggaaguugaagagcuacuuagccuuucc

SEQ ID NO: 4132408 - RNA, 56 nt, Human
ggagagauggaaaaccucccagccaugggagcuggaaggggucggauccauccucc

SEQ ID NO: 4132409 - RNA, 83 nt, Human
ggagagcaaggcuggugguggugaagucacucagccagagaagccagaguguaaccuauuuccugguaccaggcuuucucucc

SEQ ID NO: 4132410 - RNA, 83 nt, Human
ggagagcagaaagagcucgggauuaacagucaagacaguuaacuugucuguugcaucauggcucuuaauuuacaggugucucc

SEQ ID NO: 4132411 - RNA, 60 nt, Human
ggagagcagaagucacaguuggaauauugcaauauccuccuaacugauucugcagucucu

SEQ ID NO: 4132412 - RNA, 70 nt, Human
ggagagcaggacagggaauucugaggccucuauuuuuuauguaaccuugaacaaaucccuuccugucucc

SEQ ID NO: 4132413 - RNA, 65 nt, Human
ggagaggaacucccagugccugggcaugacugugugcuaggcauuguacuggguguuuuucaucc

SEQ ID NO: 4132414 - RNA, 70 nt, Human
ggagaggacugaggccuuuauugagacagcuucacagucuagcuucucucugccuaggucugcuuucucc

SEQ ID NO: 4132415 - RNA, 64 nt, Human
ggagaggauguuuuaguaacuuggacacuuuggugcauugucugggaccuggaauuucucaucc

SEQ ID NO: 4132416 - RNA, 62 nt, Human
ggagaggcuccugaagccagccuugcagauacauaguuacaggcugagcaaagggccuuacc

SEQ ID NO: 4132417 - RNA, 73 nt, Human
ggagagggaagcccgaggaggauuggcugggcugggcauguuccagccucauuucuccugcuuugcccucucu

SEQ ID NO: 4132418 - RNA, 74 nt, Human
ggagagggaaugacacugaauauuccuugacagucugucugguaaaugugaaugucauuuagcagucucuuucc

SEQ ID NO: 4132419 - RNA, 76 nt, Human
ggagagggauggagaagucaaagugaacaggagcuuuaauuugugcuccuauuccuagccuacuccaacccucuuc

SEQ ID NO: 4132420 - RNA, 78 nt, Human
ggagagggcaguggggaagagcaugggcccuggaccuuagauggcucaggguucgaaucuccucuucaccccuucucu

SEQ ID NO: 4132421 - RNA, 78 nt, Human
ggagaggguggcaggggcuggcuuaucugagagucucaggucucugggaaccucuggcagagccgcucugcccucucc

SEQ ID NO: 4132422 - RNA, 72 nt, Human
ggagaggugacauuaaauuucauagugauuaaaauuagauuuuuaguucauagcaauuuaguuuaccauucc

SEQ ID NO: 4132423 - RNA, 80 nt, Human
ggagagguggccugcagcugggucugugugggcugggacccaggcucugcugcuacagcugugugaggcccaaccucucu

SEQ ID NO: 4132424 - RNA, 62 nt, Human
ggagagguuaaucaggagcuggaggaacgcacugcccacucagcucugugguuugagucucc

SEQ ID NO: 4132425 - RNA, 95 nt, Human
ggagaguaaaggucuaaagugcuuguuuaugcaauguaugcagccaacaaaauaagcuguaagcuggcaaacaagcaucauuugucuuugccucu

SEQ ID NO: 4132426 - RNA, 60 nt, Human
ggagaguagagaaugggcugcuugcuugacuagaauggucuugccuguucccuacuaucc

SEQ ID NO: 4132427 - RNA, 89 nt, Human
ggagagugggccagggcaccaugccuacagaacucaccuugcuguugcaaugucuagucugagggcuuggcaacccugccuaauucucu

SEQ ID NO: 4132428 - RNA, 69 nt, Human
ggagagugggggcagcuaccggaaguagggggaugagaagcucccuccggaauguaugccccccucucc

SEQ ID NO: 4132429 - RNA, 74 nt, Human
ggagaguuguugaucuuucauuuuguuuaguuucuuauuugucaagauugagagaugacuucuaagugcuuucc

SEQ ID NO: 4132430 - RNA, 80 nt, Human
ggagaguuucucagucucugucaucucaugggaauucucccacugaguuuccauagguugcagagaaugacaagguugcc

SEQ ID NO: 4132431 - RNA, 80 nt, Human
ggagauaaaaggguugguuuacaagugaugggcagaguagccaagaacaucuuuaauuugugacaacuauuguuaucuuc

SEQ ID NO: 4132432 - RNA, 67 nt, Human
ggagauagacuuggugagccacuaaccaaucuucccagagugagcauccaucguaugguucuucucc

SEQ ID NO: 4132433 - RNA, 88 nt, Human
ggagaucaaagaugggcagagagaaaaaugguaugugggugaaggagagauuuuugcauaacauuugcugucuccuauguuuguuucu

SEQ ID NO: 4132434 - RNA, 60 nt, Human
ggagauccgucccuaggucagucugguugaaccagauauuccugaaggacaggguucucu

SEQ ID NO: 4132435 - RNA, 95 nt, Human
ggagaucucauaauuuucuagcaagaaagagguggaaagugcaaaucaaaccuguucaccuguuauuacuagguaagaaugaauuaaguaucuuu

SEQ ID NO: 4132436 - RNA, 90 nt, Human
ggagaugagguaucaggacuggguggcuagccagguuccaggccgggccucaggauagcugcgcagccuggcauuuucgccucacuuucc

SEQ ID NO: 4132437 - RNA, 71 nt, Human
ggagaugcauggccugggcccgcuucagauggucucccuucuacucccuugcgacgcucgggcugcccucc

SEQ ID NO: 4132438 - RNA, 65 nt, Human
ggagaugcucgaagaccucagaauauacacacccuuaagguucaagggcugggguugagcucucc

SEQ ID NO: 4132439 - RNA, 93 nt, Human
ggagaugggaugucuucuaugggcuguccuaguccagcccugugcuccccauggggaccgcugccacagccuccugacugauacccagccucc

SEQ ID NO: 4132440 - RNA, 130 nt, Human
ggagauggugaaaacggauugguuuguaaccuacuggggacuugcagacacaauuggguuauuuuucaugugggcuggaguuccuagaugagcagaugggacaagaaccagugaaauuuaagcuaauucu

SEQ ID NO: 4132441 - RNA, 72 nt, Human
ggagaugguuuaaccucuguaguagguuuuguaguuaugguaagcuccagguccagagguugaacgguggcu

SEQ ID NO: 4132442 - RNA, 62 nt, Human
ggagaugucugucagggcaaggccaggccacugaccggucuggcagucuuguaggcaucucc

SEQ ID NO: 4132443 - RNA, 83 nt, Human
ggagaugugauugcauuaaggaucuugagaugggggauuaucccggauuauucaggugguccuaagugccaucacagguaucc

SEQ ID NO: 4132444 - RNA, 89 nt, Human
ggagaugugggaugcauugggagagauuagggcaaugucucuaggaauggcugcuccauucucuagccagugcucccuccacgucgucu

SEQ ID NO: 4132445 - RNA, 111 nt, Human
ggcggucacggcacuacgacugcucuggcugucuuggaggaaggaggcccugaggugguccuccugaauaagagcagccccagcgucgacacugguggugacgugggugcc

SEQ ID NO: 4132446 - RNA, 69 nt, Human
ggcggucagggacaaagggcuagccacaacuacuucucccuaguucugcuccuccuauguuauggcccc

SEQ ID NO: 4132447 - RNA, 96 nt, Human
ggcggugaguuggugaggaagucaccagcuggaauguuggagucugaacagauaaacucuuagcccagcuuggccuauuucuuuauacuuauuacc

SEQ ID NO: 4132448 - RNA, 68 nt, Human
ggcggugguugagaggacggcggccgagagacaacaagggggcacguuagaaacucucgaccauugcc

SEQ ID NO: 4132449 - RNA, 67 nt, Human
ggcguagagcagaugagagggagugacgacuuggacaagcaggucacugcucagucuguacuacacc

SEQ ID NO: 4132450 - RNA, 91 nt, Human
ggcguccaaucucauugguuugccuuucuguucgucaggcuugggcgccuggugaaaggcagagagcgcgucacuauuggggcuggaggcc

SEQ ID NO: 4132451 - RNA, 65 nt, Human
ggcgucguggcucacgucugucaucucagcacuuugggaggcugaggcaggcggaucacgagguc

SEQ ID NO: 4132452 - RNA, 75 nt, Human
ggcgucuccaaagcaggguuuuuccaccgcagcaugguugauauuuugggguggauaauucuguguggaggggcc

SEQ ID NO: 4132453 - RNA, 81 nt, Human
ggcgucucgcucugucacccaggcuggagugcaguggcgugaucucggcucacugcaaacuccgccucccggguugacgcc

SEQ ID NO: 4132454 - RNA, 57 nt, Human
ggcgucugacgugcuauagcagccaaucugcuugucaucagcagcugucagaaugcc

SEQ ID NO: 4132455 - RNA, 73 nt, Human
ggcgugcucuagccuuauagauuuugcugccuuuucaaagcagcucaaaucccagcgggcuccugagaauguc

SEQ ID NO: 4132456 - RNA, 89 nt, Human
ggcguguaggacgcuccgggaguccccgggucugggggccgccauggcaggcagcccaggcagcggggucuccuuggaggguauauccc

SEQ ID NO: 4132457 - RNA, 82 nt, Human
ggcguuuguacaguuuguauggucaggaauguuugugaggcauuaauugaauauuucuuaugaauauugacugugcaagguc

SEQ ID NO: 4132458 - RNA, 78 nt, Human
ggcuaaaugguauuugucaagcauagucuuuuagcaguaguuaagaauguaaaacugugugacacuauaccaauuucc

SEQ ID NO: 4132459 - RNA, 82 nt, Human
ggcuaaccuguaccuggucuccauuugauuaaacuucauuuguuuggccaaaggaaagacuacuguugguaagguagaagcc

SEQ ID NO: 4132460 - RNA, 56 nt, Human
ggcuaagucaauggagcuguuuuuaaagccuuaacuacaguuuauuuuacuugguu

SEQ ID NO: 4132461 - RNA, 57 nt, Human
ggcuaaguucuccaggguucccugugaaauucaucacacaaagccuuaggaacagcc

SEQ ID NO: 4132462 - RNA, 59 nt, Human
ggcuaauggaggugucuggccugguagauagagugcagggugcugcgccuccacuggcc

SEQ ID NO: 4132463 - RNA, 87 nt, Human
ggcuaauuaaaacuucagcucagggaggcccccuuggggcauggauugccucagucagcuucccugggggaguccccuaauuggacc

SEQ ID NO: 4132464 - RNA, 78 nt, Human
ggcuaauuguacauucagcuuagcacuucuagaugcaauugccucuacggacucagucaguugaaggugaaguuagcu

SEQ ID NO: 4132465 - RNA, 65 nt, Human
ggcuaauugugaugcuggagugcgaauaucugugcagauuuccccacaccaguauuuuauuaguc

SEQ ID NO: 4132466 - RNA, 76 nt, Human
ggcuacaguacuggaugcucagcccuccaccauuauggggguguuuccuggccauucagcugaucacuguuaagcu

SEQ ID NO: 4132467 - RNA, 83 nt, Human
ggcuacggguaucuuccaggaacagaugaagguugcgaaauaacugccaacugucuucugcucuggcaguuaucccguuagcc

SEQ ID NO: 4132468 - RNA, 55 nt, Human
ggcuacuccuggagcucagcugugggaucaggguuugggcugaggaucaggugcc

SEQ ID NO: 4132469 - RNA, 78 nt, Human
ggcuacugagugcuagcauuaguauauaagaguaccuuauacucuuauauacugugguaguacuguauuacaguaguc

SEQ ID NO: 4132470 - RNA, 63 nt, Human
ggcuacugcugucccagagcaugucagaucuccuagcuguucagcugugagcagccaguugcc

SEQ ID NO: 4132471 - RNA, 58 nt, Human
ggcuacugugauggucugcaagcgauuuccaacugagcuuuauuucagcuaaguagcc

SEQ ID NO: 4132472 - RNA, 76 nt, Human
ggcuagaagaacuuauaggaaugucauaaugugcuguaggggacagugauacuuuuaaagguucugacauucagcc

SEQ ID NO: 4132473 - RNA, 57 nt, Human
ggcuagaguggaacuggagcgggguuacugaccuccucacagucaacacuuugagcu

SEQ ID NO: 4132474 - RNA, 82 nt, Human
ggcuagauuuuauucauaugcuuuaacauuaaacaacaguuuauaacugauugaaugcagaagcaaguaugagaauccagcu

SEQ ID NO: 4132475 - RNA, 67 nt, Human
ggcuaggcucucagggucccugcggaggagcccacagccuuucucccccaagcccugggagugagcc

SEQ ID NO: 4132476 - RNA, 97 nt, Human
ggcuagggaccucagggagaggccucuguugcccuuuucagcaaggcuggaaaugggauaugggcaggggacgucuucucugacuucacccuagacc

SEQ ID NO: 4132477 - RNA, 77 nt, Human
ggcuagggcaugccugcuuacuccaggugcugugaggcuccaggaccuucuugagugagcaggaacagcuuguaguc

SEQ ID NO: 4132478 - RNA, 73 nt, Human
ggcuauaugcaaauauucugucauuuuauauaaagauaaugagcaucuacagauuuugguauuugcaaugguc

SEQ ID NO: 4132479 - RNA, 72 nt, Human
ggcuaucagcugcccaggaagccugggguuuccaggggaaccaaagggguuucugcgcacccaggaugagcc

SEQ ID NO: 4132480 - RNA, 74 nt, Human
ggcuaucagucauuguccuuaaaacacuggaggaguagcucagugcacacaggagcagucugauaaaagcagcc

SEQ ID NO: 4132481 - RNA, 84 nt, Human
ggcuaugaaguccacugggcuaccccaccauuacccucgguucccaugacgggggugccagaguggcccaggggcagcagggcu

SEQ ID NO: 4132482 - RNA, 79 nt, Human
ggcuaugagcuggguggucugcgcagcccagggucagaucacauugcauccaggccccaagaccccgacagcccaagcc

SEQ ID NO: 4132483 - RNA, 77 nt, Human
ggcuauguguccagcaucuuugaucuuacugguuuucagucugguuauuguaacagggacucgcuggacauaccguc

SEQ ID NO: 4132484 - RNA, 59 nt, Human
ggcuauugcuaucauucugguggugacaguuauuaccaucgacgguagauagaauggcc

SEQ ID NO: 4132485 - RNA, 71 nt, Human
ggcuauugugaauagugccgcuauaaacauacguguauauaugucuuuauagcagcaugauuuauaaugcu

SEQ ID NO: 4132486 - RNA, 123 nt, Human
ggcuauuuaauacacauuuucugagucucuacuaugugccuguuggacacugcugggguaauaguuuccacaucuguccucugcagagcucagaguguggaagagcagugagacuugaguacc

SEQ ID NO: 4132487 - RNA, 71 nt, Human
ggcuauuuugaugcacuauguaacuuacaccauauagauggucaguugccuccauagucauccgaugagcc

SEQ ID NO: 4132488 - RNA, 83 nt, Human
ggcucacaccacaccuguucuggcucccgcucagagguggaggccgccaggugcuccagcuggagaugggggcugguggagcu

SEQ ID NO: 4132489 - RNA, 68 nt, Human
ggcucacagagagugacuuguugcuguguccuuacauggugaaaggcauaaaagggcucucugggguc

SEQ ID NO: 4132490 - RNA, 99 nt, Human
ggcucacagcagugaagaugggcauaguaaccguuugcuuuggagauggggccuaagcucuucaguuggucacuauucucgccuuuacuauugucuacc

SEQ ID NO: 4132491 - RNA, 111 nt, Human
ggcucaccuaagcagggaagccgauuuggaacuuaaacaagcucccaaguugugaucagucgagcuuggcaagcacuguuugagagaguaggcuucccgcaagcaggagcc

SEQ ID NO: 4132492 - RNA, 59 nt, Human
ggcucacgcaauuaucccggccucagccucccaaguggcugggauuacagguguaagcc

SEQ ID NO: 4132493 - RNA, 56 nt, Human
ggcucacuggaauucaagauacugaggcugucccuccccucugcauuccagcagcc

SEQ ID NO: 4132494 - RNA, 83 nt, Human
ggcucacuugugcuuauccaaacuggugaaucauuagcugucacccuggagagcagugcaguuugggaaggcgugggugcgcc

SEQ ID NO: 4132495 - RNA, 111 nt, Human
ggcucagacacgguuugcauucacuuggaagagauaacauuauaaguucacugucuggcccagacugauguuaacccucucuucucugucacaauguaggccuaaugggcc

SEQ ID NO: 4132496 - RNA, 55 nt, Human
ggcucagagcccugcaugcuccaucucccccagagaaaaggccaagggccuagcu

SEQ ID NO: 4132497 - RNA, 78 nt, Human
ggcucagcccugugaggcccugggugcuggacagaaagacucuugcuccuccagccaccucagugcucucagcuggcc

SEQ ID NO: 4132498 - RNA, 62 nt, Human
ggcucagcuuggugcgcagaaacccgacgucaaucagagcauuuugcgcagcugggcgagcu

SEQ ID NO: 4132499 - RNA, 59 nt, Human
ggcucaggagcacuuccuuguccaggaagccccucccuuuccaagagcugcuccuggcc

SEQ ID NO: 4132500 - RNA, 55 nt, Human
ggcucaggcauagagauggaggauuuugcaccaaaggucugaguuuugccaggcc

SEQ ID NO: 4132501 - RNA, 77 nt, Human
ggcucaggcugcuggcuuccucaggagcagugggugacuacagcuguaaaaggaaugucuuccugcacuucugagcc

SEQ ID NO: 4132502 - RNA, 73 nt, Human
ggcucagggccagggcugugcucuguggagaccauucugagacaaggaaacauggagagcccuugccugaguc

SEQ ID NO: 4132503 - RNA, 68 nt, Human
ggcucaggggaaugggcugccguagcuaagauggugaagccagcggcgccuccugguuccccugugcc

SEQ ID NO: 4132504 - RNA, 89 nt, Human
ggcucaggggcugugguuuuguagggggcucagagcgagggucaggccaggccccagccucaguccccugaccgccucccucuugggcc

SEQ ID NO: 4132505 - RNA, 59 nt, Human
ggcucagguugggucacaugaccaucucugccccaaucacugugacuccaaccugaguc

SEQ ID NO: 4132506 - RNA, 68 nt, Human
ggcucaguaagucagguucauuuuccauuauuuauggcguauuaauaaaucuggcauuugucugagcc

SEQ ID NO: 4132507 - RNA, 119 nt, Human
ggcucauggacuggguggaagaugggcagcucuuuguggaacggcaguguccaggaauuuaacgauccuggccgggcuggccacagccagaguugcucugccacccaaaccgcugagcc

SEQ ID NO: 4132508 - RNA, 83 nt, Human
ggcucaugguugucaucccaagacuuuggaaggcugaggcaggaggauugcuucagcacagaaguuugagaacagccugggcu

SEQ ID NO: 4132509 - RNA, 68 nt, Human
ggcucauuuggaaugaaauaugcuuacaguauuuuucuuaguacuguauaguauuuauucuuagaguc

SEQ ID NO: 4132510 - RNA, 73 nt, Human
ggcuccaaagggcagugugaggaaccucggaagccucccuugaccccuuuuugccuccacuuccuuuggcguc

SEQ ID NO: 4132511 - RNA, 68 nt, Human
ggcuccacaguggaggcacuaauuggauuucauuaaagugaaauagauuuccuagcauuggaagagcu

SEQ ID NO: 4132512 - RNA, 68 nt, Human
ggcuccacugggcugggcuucccuuuggaaugagcucugcuaagaggccucagcucagugugacagcc

SEQ ID NO: 4132513 - RNA, 63 nt, Human
ggcuccagaaaucauagagcagagaucgccucucccuacucugcuuuguccaaguucugggcu

SEQ ID NO: 4132514 - RNA, 69 nt, Human
ggcagcagagccagaccauugccgugcacuccaggaggugcaggcaccauucugccucucagcccugcc

SEQ ID NO: 4132515 - RNA, 129 nt, Human
ggcagcagagcuaggauucaaacucaggucugccugacuuaaaggcuuaacuuuacuguuaugcaaaaucaagugcaagguaauuaagcugucacugcaaacgagaacgauuagcuccaccugacugcc

SEQ ID NO: 4132516 - RNA, 59 nt, Human
ggcagcagaggcccuacucuuuggcaggcuugcuucacuguuucuagguucucucugcc

SEQ ID NO: 4132517 - RNA, 88 nt, Human
ggcagcagagugauucauauuagagcagaagaggggaucagggcugcagaaagacaagauccccucccugugugccucauuugcugcc

SEQ ID NO: 4132518 - RNA, 76 nt, Human
ggcagcaggacugccguuaaagugaugucagaguuuccauuucaguuccuuauuuucaaugcuuuagcccucugcc

SEQ ID NO: 4132519 - RNA, 93 nt, Human
ggcagcaguucccuccaccaacacuucuuugucaccugcuucaaggccgauaacucugaagaagguggcccagggguagguggaggggcugcc

SEQ ID NO: 4132520 - RNA, 63 nt, Human
ggcagcaucucuggcagcagcugcaucuccuccucaacuccagcucuuggcagauuaccuguc

SEQ ID NO: 4132521 - RNA, 60 nt, Human
ggcagccaugugggcagcgagucccagcaguccaccuuccuguucuguccagcaucugcc

SEQ ID NO: 4132522 - RNA, 62 nt, Human
ggcagccccaucagagacgcugggcugacacacucaccgucuuggagauauucugggcugcu

SEQ ID NO: 4132523 - RNA, 56 nt, Human
ggcagcccuuuuaggcagcagauguggccaccacccugugcccagcagaggcugcc

SEQ ID NO: 4132524 - RNA, 62 nt, Human
ggcagccuaggaaucaaaauucuagcuuugcagucaaaagccugaggguguugcuagauguc

SEQ ID NO: 4132525 - RNA, 56 nt, Human
ggcagccuugagggaggccuggcagguucagaugccaggguaauccaugggcugcu

SEQ ID NO: 4132526 - RNA, 59 nt, Human
ggcagcgagucgccaagucucguaugcgccccgcaacgcgggaacuaggcgaucgcucc

SEQ ID NO: 4132527 - RNA, 71 nt, Human
ggcagcuacaaggcagcagagcuuauuaacuaaaagcacagcuuuuagaaccaaucugcccaugugcuguc

SEQ ID NO: 4132528 - RNA, 64 nt, Human
ggcagcuaucaaagugcuuuacgcacauuaaaacauucauagcccaggcaccuugauggcuucc

SEQ ID NO: 4132529 - RNA, 56 nt, Human
ggcagcuauuccaagcagcacuggaacuguuacugugguguuuggacaggcauguc

SEQ ID NO: 4132530 - RNA, 55 nt, Human
ggcagcuccucucagcaaaagauaaagucuauuucacccugaauaggggcuggcc

SEQ ID NO: 4132531 - RNA, 77 nt, Human
ggcagcugccagcccaggucucucuuccaguccaggggaacuccaaaggcugagggggccugggugggaaucaggcc

SEQ ID NO: 4132532 - RNA, 78 nt, Human
ggcagcuggaagugggcuggagcacccugagagugcaaguaauguggucagggcucaccagccucugccagagaggcc

SEQ ID NO: 4132533 - RNA, 79 nt, Human
ggcagcuguagcuucugcgggaccuccacugcucgggcgucaggcucagguagcugcuggccauguacuugcuguugcu

SEQ ID NO: 4132534 - RNA, 73 nt, Human
ggcagcugucaaacaccaacauuucucccugagaauagguuuaguguaguguguuuuucaaggacaaguugcu

SEQ ID NO: 4132535 - RNA, 70 nt, Human
ggcaggaacacagguggcccggcagggaaggcugcucuggcccugccuugccuccccacccaguauugcc

SEQ ID NO: 4132536 - RNA, 95 nt, Human
ggcaggaagcagaggagaggucuuuuccuggguuucaaagguuauacccugaggcaacagaaagggccaauguccccuacucagcuucuccugcc

SEQ ID NO: 4132537 - RNA, 75 nt, Human
ggcaggaaggccaagaucaaggugccagcagaguugguuucugcugaggccccucucuugagcuugcggacugcc

SEQ ID NO: 4132538 - RNA, 77 nt, Human
ggcaggaccucaccaggaacagcugcggaggggugaccuugggcaguagccucuugguguuggcaaauaauccuguc

SEQ ID NO: 4132539 - RNA, 67 nt, Human
ggcaggagaguccuuucuguagauggaaccccucuucuggucacaucugaaaaggcauuuucuuccc

SEQ ID NO: 4132540 - RNA, 58 nt, Human
ggcaggagguggccugagcgugcccggcccuggcugaggucagugggggccuccugcc

SEQ ID NO: 4132541 - RNA, 57 nt, Human
ggcaggaugaagggcaaaggcaagacucaaggaaacucucugcccccuucugucccc

SEQ ID NO: 4132542 - RNA, 60 nt, Human
ggcaggcacugugcuaggcgcugagcaaacaaugcuaaugagauccacacagugccugcu

SEQ ID NO: 4132543 - RNA, 80 nt, Human
ggcaggcagccagaggggccuggcacugagcuggcacggaggagaacggcccugcuggcccaggccccuugcugucuguc

SEQ ID NO: 4132544 - RNA, 57 nt, Human
ggcaggcaggaaggacuaaguaacugcgccauuauuuuuaugccuuccuguguugcu

SEQ ID NO: 4132545 - RNA, 60 nt, Human
ggcaggcaucauguggucauuaaaguuucccaagacgauguagccgggauggugccuguc

SEQ ID NO: 4132546 - RNA, 63 nt, Human
ggcaggcaugggccaugggaagugggcaguucuuagugccccugcucaggcgugugcccugcu

SEQ ID NO: 4132547 - RNA, 90 nt, Human
ggcaggcuucuacaaugagcaugcaggcuugaauucucuuuuguauaacccaagacuaaaguccugugugcuuacacuugugaauucucc

SEQ ID NO: 4132548 - RNA, 72 nt, Human
ggcaggcuucuggaacacugcaaugcuuuguuccucaaccugugugccagucauccagauguguagcuuguc

SEQ ID NO: 4132549 - RNA, 81 nt, Human
ggcagggacagagcucagacucgggccuggggcucuuuguggagccugccagauccccugagcugacugccucucucugcc

SEQ ID NO: 4132550 - RNA, 76 nt, Human
ggcagggagagcaugcugauaacgcagcccccugaaaauauaaauauugcaugaauguauuagccucaucccagcc

SEQ ID NO: 4132551 - RNA, 89 nt, Human
ggcagggaggcaucuagaccaggcccacacacggggcaaaagaugggcccuggagucagguuggccugggcuuggauugaggcucugcc

SEQ ID NO: 4132552 - RNA, 80 nt, Human
ggcagggccuuuuaaagugucugccucagcucagagaggcuguggaaccugucagagcucacacagcacugggcuccgcc

SEQ ID NO: 4132553 - RNA, 124 nt, Human
ggcagggcuugcuagucugacauaauauaaagagucuuggaacaugccgggguccagggccuaaaaccccuuguggucuuuggaacacccagcucugugccaaaggguggaaggcugcccugcc

SEQ ID NO: 4132554 - RNA, 85 nt, Human
ggcaggggguauucagcauuagagacaucagagcagagaauagcucuguauccugacucugguguccucuacccauccccucgcc

SEQ ID NO: 4132555 - RNA, 63 nt, Human
ggcaggggugaggccacucugaaaaacaaggccccccuuguugcaggcacacucauuccugcu

SEQ ID NO: 4132556 - RNA, 58 nt, Human
ggcaggguaugaauuuggugcucuggaauacagagugauaaccacaugauaucuugcc

SEQ ID NO: 4132557 - RNA, 75 nt, Human
ggcaggguggaucucugcagguaagcguucuuggaccggucaugguccugccguccuccggggccuccacccucu

SEQ ID NO: 4132558 - RNA, 88 nt, Human
ggcagguaggcagggcucauugccaggcauuggaaacauguggcggagcuggaccacugccuggcagagguuugcaaggccccgagcc

SEQ ID NO: 4132559 - RNA, 67 nt, Human
ggcagguaucucagcuggaucaguggaaaggcaaagcacuuucauuucccagccugagggcucagcu

SEQ ID NO: 4132560 - RNA, 95 nt, Human
ggcagguaugauaaauauaguuggaucauggaaugucugcuuuuauuucuauguucauugaaaacaguguuuuuaugauuuauguuguaucuguu

SEQ ID NO: 4132561 - RNA, 75 nt, Human
ggcaggucagggugucccagaggacagggucacaugggccaaaucaugugaaccuggguccugggcccuuuugcc

SEQ ID NO: 4132562 - RNA, 57 nt, Human
ggcaggucaucgauucauaaacacugagaguguuuucaugugauaguugaaccugcc

SEQ ID NO: 4132563 - RNA, 68 nt, Human
ggcaggugaguucauuaucugcacauugguauuucugcauauguaaaaaugaauuuauaauaccugcc

SEQ ID NO: 4132564 - RNA, 71 nt, Human
ggccaauuugucccagugaugacuaauucucugauguuccagauauccagagaucacacugggcagggguc

SEQ ID NO: 4132565 - RNA, 67 nt, Human
ggccacaauuuuacuagaccguauucucaacugaaucauuagaucaugagguggucuucaguagguc

SEQ ID NO: 4132566 - RNA, 67 nt, Human
ggccacagagguggggauuccugaucacuguguaguacaagagaugacaggucgccacaaauggguc

SEQ ID NO: 4132567 - RNA, 60 nt, Human
ggccacagauuaggaaaugaggggagagaaaugcuccugucuuaaugaucucgugcagcc

SEQ ID NO: 4132568 - RNA, 57 nt, Human
ggccacagcugcagacuucccagcaggagggcuuugccugggagaugcguuguggcc

SEQ ID NO: 4132569 - RNA, 71 nt, Human
ggccacaggcaagagcccugccaauggaugaggccugccauagguucuagugcugggcucugcugugugcc

SEQ ID NO: 4132570 - RNA, 75 nt, Human
ggccacaugcccugcccauggcugaggcagaagcuuugucagaagugucugccuggccuggagggcacaggggcc

SEQ ID NO: 4132571 - RNA, 57 nt, Human
ggccacauuccuggugcucagcagccacgcguggcugugcagauguagggaguggcc

SEQ ID NO: 4132572 - RNA, 71 nt, Human
ggccaccacucagucacacuuaccgcauggcaggcuggggagugucaucuuguggcugggugccaauggcc

SEQ ID NO: 4132573 - RNA, 61 nt, Human
ggccaccagagugaaaagcugggagggcaucuccugcuccuccagcuucucuuuugggguc

SEQ ID NO: 4132574 - RNA, 86 nt, Human
ggccaccaggagcaguggugguguguuagagugcagaggaugcuugcacucgcccuggaacaucuccgccagcuccugccguggcc

SEQ ID NO: 4132575 - RNA, 64 nt, Human
ggccaccuuccuguggucucugcuguggugcaggcaggggccaccaccaaggaaggugggaucc

SEQ ID NO: 4132576 - RNA, 57 nt, Human
ggccacgguggggcaggaggauagcuugaggccaggaauucuaccuuacuguaggcu

SEQ ID NO: 4132577 - RNA, 84 nt, Human
ggccacgguggguagcuguuaucuguuauugccaguucuucaguaaggaggagcacgaaguagauacagaauuccacaguuguc

SEQ ID NO: 4132578 - RNA, 103 nt, Human
ggccagaaagaggaaccuaaauaacuugugagagcagcugggccugggacuggcaggcugaaacucggggucuaugaagugaguucccaugucuuuacuggcc

SEQ ID NO: 4132579 - RNA, 82 nt, Human
ggccagaagggcagagaggacaucugaaccuagaguugugcuccacucuaugugcuugacuacucucuauuccugucuuguc

SEQ ID NO: 4132580 - RNA, 65 nt, Human
ggcauggcuggguucuggugagggcccucuucuugguuugcagacagccagcacccagcuguguc

SEQ ID NO: 4132581 - RNA, 59 nt, Human
ggcaugguacagugcacugaauggagucaggaggccugggaucuggcacuggccgugcc

SEQ ID NO: 4132582 - RNA, 59 nt, Human
ggcaugugaggcggggcuuugggugaaaauguccaguuguuagcucucccccacaugcc

SEQ ID NO: 4132583 - RNA, 78 nt, Human
ggcauguugugaugagguagauaacaacagcaacaauaauaauaauagcuaccauuuacuaaugucauaucgcgugcc

SEQ ID NO: 4132584 - RNA, 74 nt, Human
ggcauuaaaggaucaaguggauuuucuuagcauaaaaauaugcugagcgugccuguugguuuaccuauaauguc

SEQ ID NO: 4132585 - RNA, 65 nt, Human
ggcauuaucuguauccccaucuagcuaggucaucaccaucuuguuaguguggaugagacaguguu

SEQ ID NO: 4132586 - RNA, 70 nt, Human
ggcauucugauucuagagacuauauacucuuaacagcuacagucucucacagaggauucuccagaaugcc

SEQ ID NO: 4132587 - RNA, 81 nt, Human
ggcauucugcuuuuaaguuaguuguggguucauucuuuuauaaaacucgaaucacaagauacaguuagaagcagggcugcc

SEQ ID NO: 4132588 - RNA, 80 nt, Human
ggcauucugggugagcugccucgggucagcccaggggugcaggcuccucugacugggaccacaggcagccacccgaggcc

SEQ ID NO: 4132589 - RNA, 63 nt, Human
ggcauugccauuccaggguauuaggguauuggggccugaggccccugaggauagcaugaagcc

SEQ ID NO: 4132590 - RNA, 117 nt, Human
ggcauuggcaauggggcaugcgcccuuuguggucagaggccugguucugcaaacacugccugcagcuauggaugccagcugccauaagagcagccuuucugccccguugcuauugcu

SEQ ID NO: 4132591 - RNA, 129 nt, Human
ggcauugguggugaugcaagagcuacccuugaaggagaagagcagaaguccuuggauccaaguugaccuauuuuuggccgagucuccuuuuauccugucgcugguggaucuguagcuugauuugucacc

SEQ ID NO: 4132592 - RNA, 82 nt, Human
ggcauuguucacuugcauuuuuagaugcuucugucuugucacuauaacuagauaugagcuugaaaugaacugaaaucuugcc

SEQ ID NO: 4132593 - RNA, 58 nt, Human
ggcauuuagauugaauuucuguagggcagaagccuuguuuuauucuucuuugaaugcc

SEQ ID NO: 4132594 - RNA, 81 nt, Human
ggcauuuauuagcaugaaagcauaggacagucauacaucccagugccaggcuuccauccuuuuaagugcuccaagagugcc

SEQ ID NO: 4132595 - RNA, 92 nt, Human
ggcauuucacuucauuuuugucagcagcugguuugcuguuaugauauauauuuagcaguagugauggccccugagacuguugguuugaugcc

SEQ ID NO: 4132596 - RNA, 66 nt, Human
ggcauuugacuguuucuacucaaauaaaaugaacuggcaaaauauuugagcagaaauguguaugcc

SEQ ID NO: 4132597 - RNA, 101 nt, Human
ggcauuuuaaaauguguuuauuauaucuuguuuugaacucaucaggaaauuuuaaacauuuacugaugucaaaggaggaauaaauauugucuucaggugcu

SEQ ID NO: 4132598 - RNA, 117 nt, Human
ggcauuuuuuuuucuuuuugggaacuugacaguacuucuggaaguggaauuuuuguagaaaauauauuaaaguugucauucucagguucuucagguugaaaaguaaaaauugaggcu

SEQ ID NO: 4132599 - RNA, 62 nt, Human
ggccaaagcuggacugcucaguucauuuuccaguucaguagcuguaguaauccagcuucgcc

SEQ ID NO: 4132600 - RNA, 126 nt, Human
ggccaaccccaacauuuacuucuucgugggcuccuuuaggcagugucaaaauaggcagaaccugaagcugguucuccagagggcucugcaggacacgacugaggugaaugaagguggacgauggcu

SEQ ID NO: 4132601 - RNA, 74 nt, Human
ggccaagacagugugcaagugacuuuguuucccauccaugaacuaaauggaaagacauguccuucauuauggcc

SEQ ID NO: 4132602 - RNA, 70 nt, Human
ggccaagauguaagugacaaaaagaaauguaagguauacuacuuuacuguucauguuguacacuugggcu

SEQ ID NO: 4132603 - RNA, 102 nt, Human
ggccaagcauauugccuuauauuuagcaagcaugcgguaaauaugcauugcauugaauggaaugaaauugcauugcagcuagauuuugagaugcuuauggcc

SEQ ID NO: 4132604 - RNA, 58 nt, Human
ggccaaggagaaaugcugugcuuuccuucacaggacaagccaggguuucucuuucucc

SEQ ID NO: 4132605 - RNA, 86 nt, Human
ggccaaggcaucuucccucccuggcugccauuuccucaucuguaaaugaagggguuggauuacuuagggagaaguaaacuauggcu

SEQ ID NO: 4132606 - RNA, 62 nt, Human
ggccaagguuagugcaucuuuuguuuguuuauaaaggcaaccuuggcauaaugaccaugguc

SEQ ID NO: 4132607 - RNA, 74 nt, Human
ggccaaugcccuuuuaacauugcacugcuagugacaggugcagacaguagcacaaugugaaaagagcucuggcc

SEQ ID NO: 4132608 - RNA, 58 nt, Human
ggccaaugucauuucacugggcuuacuccuaagguaagccaucaucauggcuuuggcc

SEQ ID NO: 4132609 - RNA, 128 nt, Human
ggccaauugggguacuguuuggagaauuaacaggcaacaguugacucugaguuugccuuucaugaguuucuaucaaauucagggcauccauugccuguugaauuguuucaguauuagccaugauugcc

SEQ ID NO: 4132610 - RNA, 67 nt, Human
ggccaauuuucuuagagaagcauguuuggaagaacauucuagauggaguggagaugaguaaauggcc

SEQ ID NO: 4132611 - RNA, 92 nt, Human
ggccacaaacuguucauuuuaaguuuggugugcucaagaccugaucauauuuuccucucuauucuuauaucagaguuaaaagaauguuggcu

SEQ ID NO: 4132612 - RNA, 78 nt, Human
ggccacaaggagcagagcugggauccugggucuggcaccgcugagggcccaugacccuagccaacugcccuccaugcc

SEQ ID NO: 4132613 - RNA, 69 nt, Human
ggccacacucugguagaggugaagugcaaacucagucuucagcaaugucauuccuucacggagguggcc

SEQ ID NO: 4132614 - RNA, 62 nt, Human
ggccacagaacugguuaauagcagagucccuaccagauucuuauauuagaggguuuuggguu

SEQ ID NO: 4132615 - RNA, 95 nt, Human
ggccacauagggaguagcaagguggggaggagugucucuuuguuuucuugccacagagagucauucuuuuuuaagcuugggaguucuugguggcc

SEQ ID NO: 4132616 - RNA, 95 nt, Human
ggccacaucauuuuccuuccccugcccucuucaugaccacccugggggguuuagcugauguaagagcuuugcagggaaaggcugugagugcugcc

SEQ ID NO: 4132617 - RNA, 73 nt, Human
ggccacaugcaaagccacaggacccgggcuuuggccucaggcagaaugggugagaaucugugcuuugcaugcc

SEQ ID NO: 4132618 - RNA, 75 nt, Human
ggccaccaacacauggcccagccagugcugcugggcucugguuucuguguucuggugaggccaugggguggggcc

SEQ ID NO: 4132619 - RNA, 66 nt, Human
ggccacccuagcugucauuucaguuccuugauacucagggaaacuugggcaugguuaugggaggcc

SEQ ID NO: 4132620 - RNA, 74 nt, Human
ggccacccucugcaggacugaggccuguuuguucucaucaguaaccaaacauugaccucauccuggcacuggcu

SEQ ID NO: 4132621 - RNA, 55 nt, Human
ggccacuccgcugcuacuggaagguagauccgagccgaguacgcgcgcgugcgcc

SEQ ID NO: 4132622 - RNA, 63 nt, Human
ggccacugagaggucucauuuccaauccugcuaguccaguuugaagacugaucuuuuaggguc

SEQ ID NO: 4132623 - RNA, 67 nt, Human
ggccacugaggcaggagguugagaacuguggggagugcugggcaguggccaacuuccugccucugcc

SEQ ID NO: 4132624 - RNA, 63 nt, Human
ggccacuuuaacucacauuucagcuugcuuucucaaguggagguuauugaguuaagguuggcc

SEQ ID NO: 4132625 - RNA, 59 nt, Human
ggccagacugagugaggucaaggucuuuugccucugaaguuccaugcucagucccggcu

SEQ ID NO: 4132626 - RNA, 63 nt, Human
ggccagagaauaugccuuacguaauuuugguucuuuauguuuucucagguuuguuuuauggcc

SEQ ID NO: 4132627 - RNA, 78 nt, Human
ggccagaguuucaucccacuagcuuagagcagcaccaggucagguggcacugggagaggugagacggaaacuaaggcc

SEQ ID NO: 4132628 - RNA, 61 nt, Human
ggccagauuuuagucaaauggccacaaaacuucaagagaggcuaggaacuauggucuggcu

SEQ ID NO: 4132629 - RNA, 79 nt, Human
ggccagcccuugccccaggagggccaaugggaaguuccagauggaaagucacuuacagcucuuuugucugaggguggcc

SEQ ID NO: 4132630 - RNA, 107 nt, Human
ggccagccuuccauagggagcuguggucagcucagucgcucacugcagagcucaguacucucugaccauugcucccuacaaaaacaaacucccggccaaguuuggcc

SEQ ID NO: 4132631 - RNA, 61 nt, Human
ggccagcgccgcgccuugggaguucccuccgcgaagggggugaucaaggugcggcggcgcc

SEQ ID NO: 4132632 - RNA, 62 nt, Human
ggccagcuucuggacaaagucccuucagggaaggggaggaaggauuuguccugagcugagcc

SEQ ID NO: 4132633 - RNA, 68 nt, Human
ggccaggcaggcgggugugcggcggacggaaggcagagacgcacacgcacagggaggcuggccuggcc

SEQ ID NO: 4132634 - RNA, 63 nt, Human
ggccaggccaagaggguuggaagccaaggaacggguuaaggauccagucaacuuggcuuggcu

SEQ ID NO: 4132635 - RNA, 82 nt, Human
ggccagggaaucagggcccgggcuuccuggggguguggggccuuguagccucuuggacugggccagacacugauucccugcc

SEQ ID NO: 4132636 - RNA, 75 nt, Human
ggccagggugagcaugugguccagggucaggggcugucaaaagaaaacgacccugugucacaguggccuguggcc

SEQ ID NO: 4132637 - RNA, 64 nt, Human
ggccaguauucaucuaaggagcuugcuaaguuucccuucuuauauugagcuccugaaucucgcc

SEQ ID NO: 4132638 - RNA, 56 nt, Human
ggccaguuggauuuuuaguggucacuuaaguggaguagccacuuugcagccuggcc

SEQ ID NO: 4132639 - RNA, 58 nt, Human
ggccaguugugcuuuaaacccucuacuccuaagaaagaggcacagcacuuggcuggcc

SEQ ID NO: 4132640 - RNA, 88 nt, Human
ggccauacgguuccugucacgaugacugcacucugccauuguagagugaaggcagccauggacaguauauaaaugaaugaguguggcu

SEQ ID NO: 4132641 - RNA, 77 nt, Human
ggccauacuuuauguaguaaacuaaaauaagccucaaauagagugaauuauugaaggaacugaaauaaaauaugguc

SEQ ID NO: 4132642 - RNA, 67 nt, Human
ggccauauaugauugugaagauuuuaaacauacuaagaaacauuaguuucacauuuuacauguggcu

SEQ ID NO: 4132643 - RNA, 60 nt, Human
ggccauggcagcaugggauugguagauuucuuaucccuccauuugcaugcugucuuaguc

SEQ ID NO: 4132644 - RNA, 61 nt, Human
ggccauggcgggagccggcgucaucucaggcuucgacaugacaucggaggccgcccuggcc

SEQ ID NO: 4132645 - RNA, 57 nt, Human
ggccauggugaggucuucucaguggaaguuuaaaucauagaggggacaaucauugcc

SEQ ID NO: 4132646 - RNA, 59 nt, Human
ggccauggugguuugagcaccuccagcaccaggggagaugcuguccuagaaccagggcc

SEQ ID NO: 4132647 - RNA, 75 nt, Human
ggccauuacugcaguaguuuuugacucuagauaugcuucagugucaccuagagagcuuuuaaaaauacugaugcc

SEQ ID NO: 4132648 - RNA, 72 nt, Human
ggccauuagcgguauauauauuauuugcucuuauuucaacaauaaacaugaugucauauaugccauuaggcu

SEQ ID NO: 4132649 - RNA, 62 nt, Human
ggcuccaggaagggaaaucuccaugucuugcaugcaaagcugggcucucucaccuggaggcu

SEQ ID NO: 4132650 - RNA, 77 nt, Human
ggcuccagguaaacaugaggcccagggugaacauuaggcuucugguaaacaccaggcccauguggauuacuaggacc

SEQ ID NO: 4132651 - RNA, 57 nt, Human
ggcucccaaauaauugcaccaaguagauacaaauuugguuacuggauuugaggggcc

SEQ ID NO: 4132652 - RNA, 63 nt, Human
ggcucccagggucuaggcugcuggcaccuggcccaagauggucccuacagcucuccuggugcu

SEQ ID NO: 4132653 - RNA, 56 nt, Human
ggcucccuagggagagugggagaugaggagccugccuggugggucccuggggggcc

SEQ ID NO: 4132654 - RNA, 65 nt, Human
ggcuccgauguaccaguguuguuggcaagcacagguuuuuguccaggacugguucacacggugcu

SEQ ID NO: 4132655 - RNA, 130 nt, Human
ggcuccggcagcuggcauucuucgggggcagccucagcuggcaccucggggggcaccaggcaguggccagagcagggggucuccaggugccggggacugaggcuaccccugcugugggcugcagcuugcu

SEQ ID NO: 4132656 - RNA, 95 nt, Human
ggcuccuagcauauguccuuuagcccuuucuucuuuguuccuuccuccuuucacaugccuggaaugcagauguaauggcuggaggucaagcagcc

SEQ ID NO: 4132657 - RNA, 129 nt, Human
ggcuccucgguagcugccugaaagucuggacucugggggcugggcugggcuggguggggagauugcuguuggucccacugugccuguuguaauccccagguucaugaaagaggugccugccuuagagcc

SEQ ID NO: 4132658 - RNA, 65 nt, Human
ggcuccucuggcaggcuugggccucuuucccucucucucugcccugagcugugcucucaggagcc

SEQ ID NO: 4132659 - RNA, 71 nt, Human
ggcuccugacugggcccaagugcaaugcagugaucuauuuucuguaaauuauuggugcccaggucauagcc

SEQ ID NO: 4132660 - RNA, 62 nt, Human
ggcuccugagaaugggccaucaguggugugauccucagcuuccaaucccuauucucugagcc

SEQ ID NO: 4132661 - RNA, 93 nt, Human
ggcuccugcuuauucuaaaauucucuugaucuugacagcucucuauuauagcuaaguuaaguuagagugaauuaaauggaagaguuaacagcc

SEQ ID NO: 4132662 - RNA, 56 nt, Human
ggcuccuggcagcaacauuuauauagaauauacuguguuugguggcuccuaggguu

SEQ ID NO: 4132663 - RNA, 95 nt, Human
ggcuccugguuccagccucucccgcuuccugcuggcugccccauucaugugugcacccagggcaggaagugaggaccuggcaggucccuaggauc

SEQ ID NO: 4132664 - RNA, 72 nt, Human
ggcuccuguggggaggcauucuucucccugcugaggcagauggugguaauugccuccuuugucccgggagcc

SEQ ID NO: 4132665 - RNA, 117 nt, Human
ggcucggaggcauucagucuuuauucacaggcuggagugauguugcgguggacuuaaugcccccugagaggucugacuucaagccugugggugacacggagcuacuguuuuugaguu

SEQ ID NO: 4132666 - RNA, 92 nt, Human
ggcucggggaggaagcggugguuucucuuugaagccuggcugcaacaaguccaggagcggccaaauugcagagagaagcugccuccccagcc

SEQ ID NO: 4132667 - RNA, 71 nt, Human
ggcucggugguguuggguuggaaagcccccgccucguccggcggccaugcaguccccagcaccucugaguc

SEQ ID NO: 4132668 - RNA, 63 nt, Human
ggcucguguuguggcaguaacauguuauauugcagacguguuucagccagggccaccucaguc

SEQ ID NO: 4132669 - RNA, 65 nt, Human
ggcucuaauaugacagagcacuugacuugccggacagcuggggcaagucaaugauuauaagaguc

SEQ ID NO: 4132670 - RNA, 60 nt, Human
ggcucuagagacucuagagaaaauguggaagauacagggcucagaggcaucuguugggcu

SEQ ID NO: 4132671 - RNA, 65 nt, Human
ggcucuauuuguguguucguaaacauccucugauggcuucuaggaacuggacacugaggugagcu

SEQ ID NO: 4132672 - RNA, 69 nt, Human
ggcucucugcacuggggucccagcgcacguccaaguggccugcuggcggggacccagugauucgaggcc

SEQ ID NO: 4132673 - RNA, 91 nt, Human
ggcucugagaaggucugcauugagagcuugugaggcauugcuuaaccugaugucucugggugauucaguccuggaccuuugcugcagaguu

SEQ ID NO: 4132674 - RNA, 129 nt, Human
ggcucugcucccgguuggugcagcgggugcagaggcuggcuggccggagcgaggcgggcgacacgccgcgccgggcuucgccugccuguccuccaccuccgcagcaaguuucccuaccuucgggcggac

SEQ ID NO: 4132675 - RNA, 57 nt, Human
ggcucugcugggggaugugucccaggauccccuggccaagcuucucuaagcagcgcc

SEQ ID NO: 4132676 - RNA, 81 nt, Human
ggcucuggaagagucaacacaagcaauauugaaauuguucauuuaaaaucgcacugcuguuguuaaaugcuguugugagcc

SEQ ID NO: 4132677 - RNA, 71 nt, Human
ggcucuggagacauguggagaggcugcuggaggcagaaauucagaaauucuagaaccaugacuucagggcc

SEQ ID NO: 4132678 - RNA, 62 nt, Human
ggcucuggaggaaagggugggccauggcuuugaagccaggcaggcacacuuccuccagggcc

SEQ ID NO: 4132679 - RNA, 80 nt, Human
ggcucuggguaaggcguuugacccuggcaccuucauugucuaucaaauggggacccuguuagacucagccucccagaguc

SEQ ID NO: 4132680 - RNA, 83 nt, Human
ggcucugguaacuuuagucaucuauuuggugggcagggggccuacucaggcccucccuauguagaugauguuuuacaaaagcc

SEQ ID NO: 4132681 - RNA, 130 nt, Human
ggcucuggugaaaagagaacuaagacuuauuaauggaaaguguaaacuucaggugaucaaggcaugacuggguuuuuguaacuuaaguuuugcauauucuagaguaaaguaaggauuuucacgaagucac

SEQ ID NO: 4132682 - RNA, 58 nt, Human
ggcucugguugaccaugauggcgaugaugccucccaugccacuggccccaccauagcc

SEQ ID NO: 4132683 - RNA, 73 nt, Human
ggcucuguggccuuucuccagagcucccagaacugcugagcucagcaaaguggaggcaggaugcuaaggaguc

SEQ ID NO: 4132684 - RNA, 56 nt, Human
ggcucugugguguagcuaaguacauuuugaauuagggugagcaagcuauggagacc

SEQ ID NO: 4132685 - RNA, 61 nt, Human
ggcucuuccaaacaaaaaucuguguuauaaauuaacagcagguuauuguuauggcagaguc

SEQ ID NO: 4132686 - RNA, 66 nt, Human
ggcucuugacacaauguauauuuucaagacccaaaaguuuccugaaaaauuacauguucagggguc

SEQ ID NO: 4132687 - RNA, 62 nt, Human
ggcucuugauguucauugacuuggccaagacuagcuuucuaaguaaaugcaauaugaggacc

SEQ ID NO: 4132688 - RNA, 65 nt, Human
ggcucuuucauuauugagucucccuuuggcucuugugccgcagggcagacuaggauggaagugcc

SEQ ID NO: 4132689 - RNA, 86 nt, Human
ggcucuuugggaaucuuaggggcuuucggggucuuggguuccuugggcucuuuuuucuccuuggguucuuucgguuccuucggguc

SEQ ID NO: 4132690 - RNA, 73 nt, Human
ggcugaaaauuucgggagucaccuggggugguuuaccagccugcaggggagagacuucuaggaaaacgcagcc

SEQ ID NO: 4132691 - RNA, 56 nt, Human
ggcugaaagcgcgacuugccccgaaacagaaaguuacagggcaagcggcugucacc

SEQ ID NO: 4132692 - RNA, 75 nt, Human
ggcugaaagcucagucagugguguaugcuuccuggcacacuaugguguucaugugccaccuggcuagcucuggcc

SEQ ID NO: 4132693 - RNA, 72 nt, Human
ggcugaaauagauauggagauuucgcacuuaauuaaaggagaagugugcucaauucaagucuuuucaaaacc

SEQ ID NO: 4132694 - RNA, 61 nt, Human
ggcugaaauuggauccuugggcuauuuacaucuaguuuagcauuacagagccaguuuugcc

SEQ ID NO: 4132695 - RNA, 57 nt, Human
ggcugaacaaggucggggggaaagaaaugcuucacauaccuuuggauuuguuuaguc

SEQ ID NO: 4132696 - RNA, 89 nt, Human
ggcugacaacucuuuggauguaauacaagauuuauaguuguuuguuucuucuaaugagguggcaagguaaaucugcaucuguuacagcu

SEQ ID NO: 4132697 - RNA, 56 nt, Human
ggcugaccccagcaaggacucuccaugaguggaguguggcagcgcugugguuagcu

SEQ ID NO: 4132698 - RNA, 88 nt, Human
ggcugacucuuagaaauggcagcucuccuguuuaccuguaaucauuucaguuggaauuacaaagcaggucagcugaaaagagucagcc

SEQ ID NO: 4132699 - RNA, 61 nt, Human
ggcugagaguuuccucuggggcacacuggaaaagcauguuguccagggcaaacucaucacc

SEQ ID NO: 4132700 - RNA, 119 nt, Human
ggcugagccuccaggguggccaucugcuccaucagaaaguggcaggauaccuggguucccaaggggaacaggggugggugcuacuggauggagagaggccagugggaggccugcuagcc

SEQ ID NO: 4132701 - RNA, 102 nt, Human
ggcugagcuccauggagaaggacugagguaugauuuuuaaaaugaggcuuauaacugcugacauuuuuauaagagucaaacugaccccaguggagcucaucc

SEQ ID NO: 4132702 - RNA, 65 nt, Human
ggcugagcuugaauuauucugcucuuacucuuuuuggagugagaaagaugacauuaaagccagcu

SEQ ID NO: 4132703 - RNA, 55 nt, Human
ggcugaggagaacaaugagaucaaaggucuuccuuggaucaggauuucccuagcc

SEQ ID NO: 4132704 - RNA, 75 nt, Human
ggcugaggcagaggccugcacucaaaugcggaccaggggcuguuagagaauuagagugggggcuggggcuuagcc

SEQ ID NO: 4132705 - RNA, 55 nt, Human
ggcugaggcagauauuuauuggguugucucccaaaacagugauuaucucuucucc

SEQ ID NO: 4132706 - RNA, 107 nt, Human
ggcugaggcaggagaaucgcuugaacccaggaggcggagguugcagugagcugagaucaugccacugcacuccagccuaggcgacugagugaaacucugucucagcc

SEQ ID NO: 4132707 - RNA, 75 nt, Human
ggcugaggcuggaacaagggcguggcggucgcaggcuccagggcacgacgguccuuccucuuccccuucucagcc

SEQ ID NO: 4132708 - RNA, 59 nt, Human
ggcugaguaaguguucuuuauggcucggugccuaucauggggcucaacacuuaguagcu

SEQ ID NO: 4132709 - RNA, 84 nt, Human
ggcugaguagcccauaacaggaacauuuacugagugcaaaggcagcuuucaaguaaaucacuuuuuguccaguggggcccagcc

SEQ ID NO: 4132710 - RNA, 56 nt, Human
ggcugaguggagguagcccugugcugagaauaggaacauuuuacugcucacuugcc

SEQ ID NO: 4132711 - RNA, 102 nt, Human
ggcugaguuugaucuuaauucuuuuuaguagauucucauugaucugguuaugaagcaauuacuugacaaggacauaggaaacuacaaaagagaagcucagcu

SEQ ID NO: 4132712 - RNA, 101 nt, Human
ggcugauaggugcaaggugcuucaaggagucagauuguuugaaugucacacaugugacauucaaaauauuucugauguugaaaugaucucuaccuucagcc

SEQ ID NO: 4132713 - RNA, 67 nt, Human
ggcugaucaggugcaaaugcauaccuggcuuuuuccaucaauggcuucugcuuugccuugauuagcu

SEQ ID NO: 4132714 - RNA, 61 nt, Human
ggcugaucucgugugaccuuguaaugccccagggcaggggaagguagcauggguugcagcc

SEQ ID NO: 4132715 - RNA, 77 nt, Human
ggcugaugaauaugagacugagagccugaccccuucauugucaaguaauguaaaaggcuucauccauauuuauugcc

SEQ ID NO: 4132716 - RNA, 57 nt, Human
ggcugaugacgccugagucugaaccauuaggaaggacgggcucugcauccaucagcc

SEQ ID NO: 4132717 - RNA, 57 nt, Human
ggcugaugagcuuagcuagagaaguuguacgauguccugucuguccucucaugagcc

SEQ ID NO: 4132718 - RNA, 57 nt, Human
ggagauguuaacuacauagcuacaacuaccuauaagguagguaguguuaguauuucc

SEQ ID NO: 4132719 - RNA, 89 nt, Human
ggagauucacuugaaccugggauggggagguugcagugagccgagaucaugccacugcacuccagcccgggcaacaaaagugaaacucc

SEQ ID NO: 4132720 - RNA, 104 nt, Human
ggagauuccgaaaguuagguguggauuucucauaaugcacagguuugcugggcagagaguugggaaaaucccugccugaugacuuauacucuuucccaauuucc

SEQ ID NO: 4132721 - RNA, 83 nt, Human
ggagauugaaaugaugguuaaacacuggaggagucucuuuaaaauuuuccugaugcugguuguuuaaucucagaauaguuccc

SEQ ID NO: 4132722 - RNA, 80 nt, Human
ggagauuuagccuucuuuuuauuggguuuugguguucauuuuuagcaaauacuugaauaaaaagaauaaucacaaucucc

SEQ ID NO: 4132723 - RNA, 70 nt, Human
ggagauuucacuuggcuuuucuagucuuggguggggacccauuauggaagugaagagcucuggaaucuuc

SEQ ID NO: 4132724 - RNA, 59 nt, Human
ggagcaacccugccugacaacagaggauugacugcaaucguuugaaaggacagagcucc

SEQ ID NO: 4132725 - RNA, 88 nt, Human
ggagcaagaguugccaugguuuccuauaacucaggcaccagcuaucucauccgcuggucugacuacaauaggaagaagcagcuccucc

SEQ ID NO: 4132726 - RNA, 60 nt, Human
ggagcaagauuguccuggugcccuggcucagccccccugggucaguggcuuucuugcacc

SEQ ID NO: 4132727 - RNA, 78 nt, Human
ggagcacaaggccuucucuugugucugugaagggaagaaaugucucagaacauggacauaugagaccuuuccagcucc

SEQ ID NO: 4132728 - RNA, 86 nt, Human
ggagcacaugguaccccacagcauacaaaggcaccuccauuaagggccuauuggguuaaugcugauggguaaacaugaaucugccc

SEQ ID NO: 4132729 - RNA, 71 nt, Human
ggagcacgugguggccguggagguaguccaggccuuguagcagcugcaccauguaaguggccacgucaucc

SEQ ID NO: 4132730 - RNA, 87 nt, Human
ggagcacucagcuuggccugccacugccacgccacucugccuuuuggucaagugagcccucacaauggcggucagugagccugcucu

SEQ ID NO: 4132731 - RNA, 61 nt, Human
ggagcagaugagccucaugacugggccgaggggcccgcaugcucuagcucacucuggaucc

SEQ ID NO: 4132732 - RNA, 58 nt, Human
ggagcagaugucuucauggccuccaugucuguuggagaggcgacaagcuaugugcucc

SEQ ID NO: 4132733 - RNA, 69 nt, Human
ggagcagcacugauuagcgguucccacaagcguauagccaucugcaggcuccccugguggguuuguucc

SEQ ID NO: 4132734 - RNA, 70 nt, Human
ggagcagcagagggaacagcagccaggccugggacaggacuuagagcugggcagugcucugagcugcucc

SEQ ID NO: 4132735 - RNA, 65 nt, Human
ggagcagcccugugcggagggcccugugcggagugccacagguaccccuuuaugcaggugccucc

SEQ ID NO: 4132736 - RNA, 55 nt, Human
ggagcagcucagaggacuaguguuccauggagaacacugugacaaaggcuguucu

SEQ ID NO: 4132737 - RNA, 67 nt, Human
ggagcagcugcagugcagacccucagccucccaggagcaggagggucccagcagcugggggggcucu

SEQ ID NO: 4132738 - RNA, 55 nt, Human
ggagcagcugugggguugaccauggcagcugucacagccccacgugggcugcucc

SEQ ID NO: 4132739 - RNA, 107 nt, Human
ggagcaggagagaacuuuugggggugacagguauacucaccauugugacuguggcggugguuucauggguguacacauaugucaaaacuuaacaaauucuaugcuuu

SEQ ID NO: 4132740 - RNA, 91 nt, Human
ggagcaggggggaggaaagaaagcagaccaagaauauagaggccuggaccucuuuaguuuagugccugguuuccuucuugccuucaguuuc

SEQ ID NO: 4132741 - RNA, 58 nt, Human
ggagcauguuugagaaaugcgcucuucuguuugagucugcuguuucugagcuugcuuu

SEQ ID NO: 4132742 - RNA, 71 nt, Human
ggagcauuuaauugccagugcaguucccuccagaguauguuucccuuuggcuugaugacuggcaguguuuc

SEQ ID NO: 4132743 - RNA, 71 nt, Human
ggagcauuugcaucuguggaaauuggcaagugcuacaaaucgcauuuccucccuccacagcugguuguucc

SEQ ID NO: 4132744 - RNA, 57 nt, Human
ggagccaaggcuugcaaucugcagaacacgcuuucuggcugaauuagccuuggguuc

SEQ ID NO: 4132745 - RNA, 70 nt, Human
ggagccaaugggagggugaggaggcagcuguuggaaagcccuugaguagucacuucacccaucccacucc

SEQ ID NO: 4132746 - RNA, 127 nt, Human
ggagccaccacagcucauucguggaggugucuaaucagcuaugcuaauugauugucgugucugcaauaucagaugcaugcuuaauuagcacaugaacucuccugucagauauuccuggaggggcucu

SEQ ID NO: 4132747 - RNA, 128 nt, Human
ggagccagaggcagagcccagcugggagccgggguuucacuggucagucggucagucucugcagcugcagccugagaucagccaagccccuccugaggcuccuaccuggcucacuuugcccuuucucc

SEQ ID NO: 4132748 - RNA, 64 nt, Human
ggagccagaggcugcugcuguggccagcauggacagcacuaaaccaaagccgccucuguucucc

SEQ ID NO: 4132749 - RNA, 64 nt, Human
ggagccagcacuauuagauaugccuuuguugaauccccaaagaauugucuuuggucugaguuuc

SEQ ID NO: 4132750 - RNA, 65 nt, Human
ggagccaggcuaagaaaggugugaugagucaguggacuucagagcaccaaggugguuuggacucc

SEQ ID NO: 4132751 - RNA, 116 nt, Human
ggagccaggcugccaagaggcaggaaagggaagagucugcagccacaggaguguauuguuuccugccagcuggggcugcuuccuccccccagcagucucccggcagccgagccucc

SEQ ID NO: 4132752 - RNA, 67 nt, Human
ggagccagguuugaaucucaguccucuuacuuccuggcugugugaucgagguuugucacuugguccc

SEQ ID NO: 4132753 - RNA, 93 nt, Human
ggagccaguuuggugugccauccucccacaagcagguggugaguaauuucauccaguuguggagagggaaucuugagacaccaaagucaagcc

SEQ ID NO: 4132754 - RNA, 61 nt, Human
ggagccauacaaaaacaguuauuggguuagauugggcuuguaggcuguaguuuguaggucc

SEQ ID NO: 4132755 - RNA, 77 nt, Human
ggagcccagccgcauguuucagaggguucagaggguucgggaaacuccccaaggccacguucugcaugcggagcucc

SEQ ID NO: 4132756 - RNA, 79 nt, Human
ggagcccagggagggagugcagggacagaccggggcacuccaggccccauccacuggccacugcaccucuuccuuuuuc

SEQ ID NO: 4132757 - RNA, 70 nt, Human
ggagcccuggagcggagcccacuucagauggaugaguccagcagaguuuaaggccuggauuuagggcucc

SEQ ID NO: 4132758 - RNA, 114 nt, Human
ggagcccuuccuuugugccaggcuggaagcugugugcagaugaucucaucucaucuuuaguacccucuugcgagguaagguuacugucacacagugguuaagcacaagggcucu

SEQ ID NO: 4132759 - RNA, 70 nt, Human
ggagcccuugcugaccuuccaaaggguuuacugcagagaaaaagccaaaucagagaucaguaaaggcucu

SEQ ID NO: 4132760 - RNA, 112 nt, Human
ggagccgccgagccccccauuuccagggccagggacacgcugucaggcuccaggucauccaccucacuggcugugucccuguccagaguaggggaggacggcacgguggccc

SEQ ID NO: 4132761 - RNA, 70 nt, Human
ggagccgggacgagccccaggcuggaggcgggaccagccgcugccgucuccgucucggugucccggcccc

SEQ ID NO: 4132762 - RNA, 98 nt, Human
ggagccggggcucgcaacaccuucagucccggcagucgcgggcgugggcuugagcgcgugccuucugcgcucgugucuccgccggugccccuggcucc

SEQ ID NO: 4132763 - RNA, 77 nt, Human
ggagccucuccacagcucaggcucagaguaggcccucagcuucagcucugaagggugagcuguucgagagaggaccc

SEQ ID NO: 4132764 - RNA, 60 nt, Human
ggagccugaggcaggugacagaacaaaggacacagccuauguuggaugcuaccagguacc

SEQ ID NO: 4132765 - RNA, 55 nt, Human
ggagccugcaguccagacucugagccaggguggccagugucugggccucaggccc

SEQ ID NO: 4132766 - RNA, 59 nt, Human
ggagccugcgggagcucccauuccccacccuugaagggccagcuucaccugaaggcuuc

SEQ ID NO: 4132767 - RNA, 101 nt, Human
ggagccuguccccuuuggaggcugccccuuccucagcuggcucuugcucuaugaaggauauaugcuaguagcaggggguaccucucagggcugugggcuuc

SEQ ID NO: 4132768 - RNA, 65 nt, Human
ggagccuguguuuccuguagccaaaggcuuuugcaaagauuuguggcuaugaaagauaaaccuuc

SEQ ID NO: 4132769 - RNA, 85 nt, Human
ggagccuugcucugucauccaggcugaagugcaguggugcaaucacggcucacuguagccucguccuggguucaagagauccucc

SEQ ID NO: 4132770 - RNA, 81 nt, Human
ggagccuuuuuggacuaaacucuuggucaacaugaggaagaaagcucagucuucucuuuguuaccguguccauaggguuuu

SEQ ID NO: 4132771 - RNA, 62 nt, Human
ggagcgagauccugcuguccuggagaagugcagaguuagaacagcuguggccacuugcaucc

SEQ ID NO: 4132772 - RNA, 76 nt, Human
ggagcgcaguggcaggaucacggcucacugcagccucaaucucccaggcucaggugauccucccaccucagccucc

SEQ ID NO: 4132773 - RNA, 69 nt, Human
ggagcguggggcgucggggcugugugugguguggaacacaggggaggauccugagugugcccaggcucu

SEQ ID NO: 4132774 - RNA, 78 nt, Human
ggagcguuuagauaggauuuauucuacaauauugcauagaggcugugcuucguauuauuaauccuguuaaaaaucucu

SEQ ID NO: 4132775 - RNA, 83 nt, Human
ggagcuagggcuuuuccgcuggaaagucgaucuugguugaagauggcuuagaguccuggugagaaagagucauugugagcucc

SEQ ID NO: 4132776 - RNA, 105 nt, Human
ggagcuaugggugucuuagggauugcuucgggcucuguguguaugaaagaaacggagagagaucagcuucaaaagccagaagccugcguccccagcccaugcucc

SEQ ID NO: 4132777 - RNA, 56 nt, Human
ggagcucaagauguggccucugaagcagagcucugccagcugcuccuugagguucc

SEQ ID NO: 4132778 - RNA, 55 nt, Human
ggagcucaccuuggagucucuggugccugagagggcauggcuuccagguggcucu

SEQ ID NO: 4132779 - RNA, 86 nt, Human
ggagcuccagccgcuggggugagcagaaacagggguaagcagcuccggucuucagcagcgcuucuguggccugggcauacagcucc

SEQ ID NO: 4132780 - RNA, 55 nt, Human
ggagcucgguccccuccuccaagccagaccuuugcagagguggcaucugggcucu

SEQ ID NO: 4132781 - RNA, 56 nt, Human
ggagcucuccugaugugaagauuggaccaaacagcuucucuagccucagcagcucc

SEQ ID NO: 4132782 - RNA, 60 nt, Human
ggagcucuuccagcuuguugcucugcuguguugccugcaguuccucagcuguagagcucc

SEQ ID NO: 4132783 - RNA, 58 nt, Human
ggagcugaggcugaggccucacugucaccuucugugagguccaugacauccucacucc

SEQ ID NO: 4132784 - RNA, 70 nt, Human
ggagcugccacagacaggacagaacaggacguugucaagcgcucuguggcugaucugucucuguugcacc

SEQ ID NO: 4132785 - RNA, 55 nt, Human
ggagcuggaauauauugaaaccuucuugggagguuucagaauauauucuagcuuc

SEQ ID NO: 4132786 - RNA, 75 nt, Human
ggagcuggagcugccugggcgucugucuuccguuccuguuacuacagggccucugacgcccccagccccagcucu

SEQ ID NO: 4132787 - RNA, 69 nt, Human
ggccauugucagcauuuaaggaguaaggagcccacucaugcuucccuguauucuuugaugcuauaggcu

SEQ ID NO: 4132788 - RNA, 71 nt, Human
ggcucucugaggaaacccuuccagaaagggucagaaggcaauucuuaaauguaaugggugcuuuagaaguc

SEQ ID NO: 4132789 - RNA, 85 nt, Human
ggcucugacaugugucuccuuccgucucauagucauccccaccccagcuggagggaggaggcggggaggcgcugcuguaggggcu

SEQ ID NO: 4132790 - RNA, 82 nt, Human
ggcucugacccuuuagaauacagacuuucuauacccuuuuguuuaggauuuuuuggauucuggauuggaaaauuucagagcu

SEQ ID NO: 4132791 - RNA, 60 nt, Human
ggcucugaccuuucuuccaacugccagaaacacucacuggcucugagagguucagaugcu

SEQ ID NO: 4132792 - RNA, 59 nt, Human
ggcucugagguuccuuugcccucgccuugcugaauggugagccgcugccucucggagcc

SEQ ID NO: 4132793 - RNA, 68 nt, Human
ggcucugagucugcuccugguagcagaucuuggaugggucaaaguugcacagggcggucuuuuucgcc

SEQ ID NO: 4132794 - RNA, 57 nt, Human
ggcucugcaugcagguugucaggaggggcaccucagauccacaaccagcugcaagcc

SEQ ID NO: 4132795 - RNA, 66 nt, Human
ggcucugccugccccagcugagauaucacuuaacagugcgggcucuucaggggcagggccagggcc

SEQ ID NO: 4132796 - RNA, 94 nt, Human
ggcucugccuuuuugaggcuucccuuccucugggggugcugaugcuguggcauauucuagaucgaggugaugcggccccacuucuaggugagcc

SEQ ID NO: 4132797 - RNA, 57 nt, Human
ggcucugcuuccuggaauuguguuguauaaagucagaaccuccuggaagcaggugcc

SEQ ID NO: 4132798 - RNA, 58 nt, Human
ggcucuggagacacucccagcgguuccuccccaaggcugugucccuugucccagagcc

SEQ ID NO: 4132799 - RNA, 59 nt, Human
ggcucuggagauguccgaccugcauuuggaugacagguauugaccaccuccuugaugcc

SEQ ID NO: 4132800 - RNA, 107 nt, Human
ggcucuggauuaauucccucuggcagaugcaugacuuuucccugccuuucuuuugcaucucggaagcagggcuccauuucacugccaggauggauuuugccauugcc

SEQ ID NO: 4132801 - RNA, 80 nt, Human
ggcucuggcaagugagacucucagcagugcuaggguucaccaccaaacuggcagcuguggacgucgucauuucagaagcu

SEQ ID NO: 4132802 - RNA, 81 nt, Human
ggcucuggccaucuggagaggugcugggccauauguaaagcacacaagguggcugagccacuuguucagaugagccuggcc

SEQ ID NO: 4132803 - RNA, 57 nt, Human
ggcucuggggggaagucuguugccccucuuggcauuuauaccugcucucucuaggcc

SEQ ID NO: 4132804 - RNA, 61 nt, Human
ggcucuggguuuaggcucaggaaguggaucucugcaccuccuugagugucccccaagaguc

SEQ ID NO: 4132805 - RNA, 82 nt, Human
ggcucugugaggccagguccaguggaaggcccagcaagaggcacagccuggguuuggaucugaucuggcugacuucagagcc

SEQ ID NO: 4132806 - RNA, 124 nt, Human
ggcucuguggggaggugugcccagggucaccagauggagagcggcagauuaggaacagaaugggguuagccuguguccucuuccagugcuccuucugggcccuacuccuuccugaucaggugcc

SEQ ID NO: 4132807 - RNA, 85 nt, Human
ggcucugugggugcacuuucugaugacuuuagaagucaggugaggcugauggcuuccuuacagguuacagaaagcaauucaagcu

SEQ ID NO: 4132808 - RNA, 72 nt, Human
ggcucuucugccagcccugggccaucauuugcauaggaagcagauuuggcucggcugcugauggugaucgcc

SEQ ID NO: 4132809 - RNA, 94 nt, Human
ggcucuugagggcagggacccuguaugcuauaucccuaauaccuguguuagcagauaaauauaugguuucugugucuucuuacacuugagggcc

SEQ ID NO: 4132810 - RNA, 55 nt, Human
ggagggggacugacacugauuuuucauuugaaaucagccacuuaaaucucuuucc

SEQ ID NO: 4132811 - RNA, 74 nt, Human
ggagggggcuggucagagagaaaggaggcccugcuaggcagaguccccagcuaaucucuuugcccacacccucc

SEQ ID NO: 4132812 - RNA, 87 nt, Human
ggagggguacagcugucuggauauaccuuggccaaauuucaguguauauagaaaagugggagguuaucgacuauguuaaaccuuuuc

SEQ ID NO: 4132813 - RNA, 81 nt, Human
ggaggggucuggcugcuugugacccauggcccuggaccccaaaacucaggcuccuugcucacaggcucagccguucccucc

SEQ ID NO: 4132814 - RNA, 78 nt, Human
ggaggggugcuacugggaacuaguggguuugaggacaaaaacggcauuaagcuuccuaaaugcacagggcagcccccc

SEQ ID NO: 4132815 - RNA, 87 nt, Human
ggaggguccuagcucucucccucaugaaacagugagagcaacuuguuucaaacugggagugaggggacuuagaucugggaucccuuc

SEQ ID NO: 4132816 - RNA, 70 nt, Human
ggagguaucagcaucuccucaaagauauggugccuguaagaccccaccugucugcaguguuuauacuucc

SEQ ID NO: 4132817 - RNA, 60 nt, Human
ggagguauuugucaaucuguuucaguguuucuuaaugcuacugagcacuaaaaugcuucc

SEQ ID NO: 4132818 - RNA, 71 nt, Human
ggaggucagguguuagggacacugcucaugaguucaagacuggauugcaucauuguucucaccugaacuuc

SEQ ID NO: 4132819 - RNA, 63 nt, Human
ggaggucagugaaaggggaaagccacuguuuuuuaaagugauuugacucuuuuauuguuuucc

SEQ ID NO: 4132820 - RNA, 65 nt, Human
ggaggucauggaaacugcaguucccggggaugacgggcaucccuugcuggagguuucuagacccu

SEQ ID NO: 4132821 - RNA, 62 nt, Human
ggagguccaugugaauguggccuggaguuuuccuugugcucugggucagcacacuggucucc

SEQ ID NO: 4132822 - RNA, 65 nt, Human
ggaggucuguuuugaugccaccucucuucauaugugcucgggagguggccugaaaauguggcccu

SEQ ID NO: 4132823 - RNA, 64 nt, Human
ggaggucuucacaaagcuguuguuaaacucugucaagaguuucuuacuuugccugugaaccuuc

SEQ ID NO: 4132824 - RNA, 75 nt, Human
ggaggugacaucccggcagcagaggcccucuucuuccaggggguucucgccacugcuguugaaggugacauagcc

SEQ ID NO: 4132825 - RNA, 72 nt, Human
ggaggugagggucucuggggcuggcauuuguccuuccucuguucuuggcauccagagccccaauucaccucu

SEQ ID NO: 4132826 - RNA, 60 nt, Human
ggagguggcagagggacauucuugcuugaguucaugcuuuaguuuccucucuuacucucc

SEQ ID NO: 4132827 - RNA, 97 nt, Human
ggagguggcaucagaugggcacagaaguggugggcaggacuaggccacagguuuguaaagcuuugaguguuuauccuaaaagugaugaggagccuuc

SEQ ID NO: 4132828 - RNA, 63 nt, Human
ggagguggguuuggaagagcaggcugugugaaccgggcacucucccccaggacccacucaucc

SEQ ID NO: 4132829 - RNA, 56 nt, Human
ggaggugguuugauuucuauauuuugaauuauaguucaugcaaccauacuaccucu

SEQ ID NO: 4132830 - RNA, 65 nt, Human
ggaggugucacuauuuugcuuaugguauggauuugaugaugcgcagaagcaagucugacacuccc

SEQ ID NO: 4132831 - RNA, 59 nt, Human
ggagguuccagcccaauauggccucggagguggccaagaugccccugguagggaucucc

SEQ ID NO: 4132832 - RNA, 57 nt, Human
ggagguugcagccagguuguuaucuggugcuugacuauggcugguggcucagccucc

SEQ ID NO: 4132833 - RNA, 95 nt, Human
ggaguagggaguugggggcuggguuggcuucagaggguucggccuccugagcaaggccaccuggacagcugugcccucccccuucauuccucucc

SEQ ID NO: 4132834 - RNA, 67 nt, Human
ggaguagggggagcggaaugggaugcgaggcaggucugcucguguguauucccucuccuucagcucu

SEQ ID NO: 4132835 - RNA, 70 nt, Human
ggaguaguggcugugaaauacaugggaaagaguuugaaaaguauguaucccacauuucacagcacuuucc

SEQ ID NO: 4132836 - RNA, 80 nt, Human
ggaguauaaugauuuagugugcuuuuuccccuguguuugcauguuugcaaagauuuaaagcaguauucgcaauguacucu

SEQ ID NO: 4132837 - RNA, 114 nt, Human
ggaguauagauuuaaucuggauaauucaucauuuuauagcuaguuggauuaaucagaccaguucuacacuagcaaaaugaaagugaugaaccaaguuaauuaucuagaccaucc

SEQ ID NO: 4132838 - RNA, 89 nt, Human
ggaguaucacucugucauccaggcuggagugcaguggcacgaucuuggcucacugcaaccucugcccccacggguucaagugauucucc

SEQ ID NO: 4132839 - RNA, 72 nt, Human
ggaguaucugucaucucccagugauggaugcuugcacaggaagcauccauccauguaggaagauggugcucc

SEQ ID NO: 4132840 - RNA, 113 nt, Human
ggaguaugcugguuugaaacuauuguuuugaaggucuucaaccuguuagaucaauucuccaccuagcagcaaaaugaccuucuaaauauauaaguaggaucacagcacauucc

SEQ ID NO: 4132841 - RNA, 66 nt, Human
ggagucaccagcccaaagucaccccgggaugacuggcgaugcugggggguuggggcugggggaccc

SEQ ID NO: 4132842 - RNA, 59 nt, Human
ggagucauguucugaaucuuuugucauaacaggagaauuaucuggaacaaacagauucc

SEQ ID NO: 4132843 - RNA, 103 nt, Human
ggaguccacaggucugaaauccaggugugggcagggccgugcucccuccgaaggcucuaggggaggauccuugcucaacuuauuuuugagacagucuugcucc

SEQ ID NO: 4132844 - RNA, 55 nt, Human
ggaguccaccaaguauuucagguucucuccugggccacuugaaaguggauguacc

SEQ ID NO: 4132845 - RNA, 86 nt, Human
ggagucgcacucuaucacccaggcuggagugcagugacacgaucucuguucacugcaaccuccgccucccggguucaagcgauucc

SEQ ID NO: 4132846 - RNA, 88 nt, Human
ggagucucacucugucacccaggcuggagugcaguggcacaauuucggcucacugcaaccuccgccuccuggguucaagcaauucucc

SEQ ID NO: 4132847 - RNA, 91 nt, Human
ggagucucacucugucucucaggcuggagugcaguggugcaaucucagcucacugcaacaaccucuaccucccagguucaaaugauuuucc

SEQ ID NO: 4132848 - RNA, 88 nt, Human
ggagucucacucuguugcccaggcugaagugcaguggugugaucuuggcucacugcaaccucugccuccuggguucaagcgauucucc

SEQ ID NO: 4132849 - RNA, 129 nt, Human
ggagucucacucuguugcccaggcuggagugcaauggcacgaucuuggcucacuacaaccuccaucucccagguucaagcaauucuccugccucagccucccgaguaguugggacuauaggugggcacc

SEQ ID NO: 4132850 - RNA, 88 nt, Human
ggagucucgcucugucacccaggcuggagugcaguggcacgaucucggcucacugcaagcucugccuccaggguucaugccauucucc

SEQ ID NO: 4132851 - RNA, 88 nt, Human
ggagucucgcucugucaccgaggcuggagugcagugacgcgaucuuggcccacugcaaccuccgccucccagguucaagcgauucucc

SEQ ID NO: 4132852 - RNA, 88 nt, Human
ggagucucgcucuguugcccaggcuggagcgcaguggcacgaucuuggcucacugcaagcucagccucccggguucacgccauucucc

SEQ ID NO: 4132853 - RNA, 88 nt, Human
ggagucucgcuuugucgcccaggcuggagugcaguggcaccaucucgguucacugcaaccuccgccucccgcguucaagccauucucc

SEQ ID NO: 4132854 - RNA, 66 nt, Human
ggagucugauguuuuccuggugacuucauaucacuguaugacacauaccgaaaauauuugggcucc

SEQ ID NO: 4132855 - RNA, 93 nt, Human
ggagucuggcucugucgcccaggcuggagugcaguggugcagcgcaaucugggcucacugcaagcucagccucccggguucaugccauucucc

SEQ ID NO: 4132856 - RNA, 87 nt, Human
ggagucuugcucuguugccaggcuggagugcaguggcgcaaucucugcucacugcaaccuccaccucccggguucaagcgauucucc

SEQ ID NO: 4132857 - RNA, 88 nt, Human
ggagucuugcucuguugcccaggcuggagugcaguggcgcaaucuuggcucacugcaagcuccgccucccgggcccaaguguuucucc

SEQ ID NO: 4132858 - RNA, 86 nt, Human
ggagucuuguucugucacccaggcuggauugcaguggugcuaucacagcucacuguaaccucgaccaccugggcucaagugauucc

SEQ ID NO: 4132859 - RNA, 67 nt, Human
ggagugaagagaagaaaauuaucuuugugaauggaguuagagaagguuuucuauuuuuaaggacucc

SEQ ID NO: 4132860 - RNA, 63 nt, Human
ggagugcaguggcgugagcucggcucacugcaagcucugccucccauguucaugccauucucc

SEQ ID NO: 4132861 - RNA, 73 nt, Human
ggcugggagcugggcuggcuuccucccuccucgaccacacgcagcagccaagccucagcccggcucaccagcc

SEQ ID NO: 4132862 - RNA, 56 nt, Human
ggaguucacuuucauucuggcuucugguuaagagccaggaucugauauugggcucc

SEQ ID NO: 4132863 - RNA, 89 nt, Human
ggaguuccuauuuucacuuauuucugcuacuaccauuagaaaauggaauauuuuagccaggcaauuaugggugaucaaauagcuauuuc

SEQ ID NO: 4132864 - RNA, 121 nt, Human
ggaguugaguggaggacaggggagcuugaggcauggccugaucccaggcuuauauuccauaguacagcauuuauccccaggucgggccucuggcauccucugcucucugaaaaucugcucc

SEQ ID NO: 4132865 - RNA, 90 nt, Human
ggaguugcaaagcacuuugcuguuauaaugauagcucccuugaugucuguucauuauuaacugcuuuucaaaagugcugcuuucaacucu

SEQ ID NO: 4132866 - RNA, 87 nt, Human
ggaguugcugcagggccugagguugugccuccuacucugaaagaguucugggccuggacaccugaggucuuaccugccugcaauucc

SEQ ID NO: 4132867 - RNA, 59 nt, Human
ggaguugguggcccggaaucucucugggauuucuggaguucccuggagccuccaacucc

SEQ ID NO: 4132868 - RNA, 87 nt, Human
ggaguugugugcucaggacuucauuaccucagguggucugagugcagaugacugauguaaaugaggucugccuggcacagccucucc

SEQ ID NO: 4132869 - RNA, 123 nt, Human
ggaguuguugagauggacuuuagaggaugccugcagccauguggagcuguauuccaacucagagaggcagcugaauguccauugcugcaggcaaacuucagaugucccagucuuacaaauucc

SEQ ID NO: 4132870 - RNA, 118 nt, Human
ggaguuuagaaacauguugcuuaacacuugugagaaaaugauugcacagucucuauuagaaucucauuagcauacgugcuccauuuuuuugaguguagacuuacaauuguaaaucucc

SEQ ID NO: 4132871 - RNA, 88 nt, Human
ggaguuucacucugucacccaggcuggagugcaguggcacgaucuuggcucacugcaaccuccaccuuccggguucaaaugauucucc

SEQ ID NO: 4132872 - RNA, 129 nt, Human
ggaguuucaguguuauuguaauuaaggugcaaguguaaaugugaccuucauuuuauagucccgggcuugugaaugcaggcauauuaaucaaacauugaucuuaaauuagcuuuaagcauguagacuaac

SEQ ID NO: 4132873 - RNA, 89 nt, Human
ggaguuuugcucuuguugcccaggcuggagugcaauggcacaaucuuggcucaccgcaaccucugccucccagguucaagcgauucucc

SEQ ID NO: 4132874 - RNA, 56 nt, Human
ggauaacauuuuuaagaccaagugcuauuuuagcaugagcuuaaggguguauguuu

SEQ ID NO: 4132875 - RNA, 65 nt, Human
ggauaacgcgcuucguagguaugaacucaguuaaccccacagucacacuaugaaguguguuaucc

SEQ ID NO: 4132876 - RNA, 79 nt, Human
ggauaacuuaaccaaauuccaguucuaggaucuagaucccaauucuagaaguuggggcuagggauauggucuucuuucu

SEQ ID NO: 4132877 - RNA, 66 nt, Human
ggauaacuugauguuauuuguccaccugaccacuagguggcaauaaagaccaacagguuacaaucc

SEQ ID NO: 4132878 - RNA, 75 nt, Human
ggauacagugaugaucauuguaacaucaucagucauagugacucagggauaaguucagugacaucauaaauaacc

SEQ ID NO: 4132879 - RNA, 69 nt, Human
ggauacauaaaguagcagagcaugacuccauguggguugguuccacuuuguguuuuggcuuuuguauuc

SEQ ID NO: 4132880 - RNA, 61 nt, Human
ggauaccucaggcucucagaccaacagcauguucacaucuugguuucagauccugaaaucc

SEQ ID NO: 4132881 - RNA, 89 nt, Human
ggauagaacauuugaaguugagauaucuugagauaacuguuauauuuaauugaccugaauugucauaucuuauucugaaaugucugucc

SEQ ID NO: 4132882 - RNA, 84 nt, Human
ggauagauggaagcaaagugggaugacagugcucauaugaagucaucauauugcugucauugucccuccaggcugcugucuucu

SEQ ID NO: 4132883 - RNA, 78 nt, Human
ggauagccaguaugguggcaggucccauuggagcagcagcaauagguugguuguggguccugcuacaucaggcuguuu

SEQ ID NO: 4132884 - RNA, 68 nt, Human
ggauagcccuuucccuguaccaggccuugcccauucagugcuaccaggccuagggagaugggacugcc

SEQ ID NO: 4132885 - RNA, 70 nt, Human
ggauaggaugggggcagacaggcacugucaauggcuagccugggccugaucuuugacccucauccuugcu

SEQ ID NO: 4132886 - RNA, 72 nt, Human
ggauagggaaaagaauaacugaagaaacuagcuuacaauagcuagguuucgucaggcuuauucuauccagcc

SEQ ID NO: 4132887 - RNA, 105 nt, Human
ggauagugcuccaccaaugcucaaaacuggcuuuuagugugaagacuuggacucucauuuugauauguggaagcccacugaguuugguaaacagguguaucaucc

SEQ ID NO: 4132888 - RNA, 104 nt, Human
ggauagugcucuccuugauguguuagcuggcccuucuuucagguccccuuugaaugguaauauuggcacagaaauuaacaucucacagagacccaauauugucc

SEQ ID NO: 4132889 - RNA, 82 nt, Human
ggauauaagcgcagagggacuccucaggaucuaggagugcuucagccucugaaguacuuuuacuugggccucugugguaucc

SEQ ID NO: 4132890 - RNA, 81 nt, Human
ggauauauuacacagugguuaagucugggcauuuaguguaaccuaauaguguacauuuuaccauuaaguaauuucucaucc

SEQ ID NO: 4132891 - RNA, 87 nt, Human
ggauaucgacaauuccuaaucccauuguggaauuaaggaauguuagauacauuucguuauccaggcaauguggauuuugaugcaucc

SEQ ID NO: 4132892 - RNA, 75 nt, Human
ggauaugaggagugggugguggcagcuguucuuaggugugguucuagaaaccuccauuuauucacucuccuaucc

SEQ ID NO: 4132893 - RNA, 101 nt, Human
ggauaugcagacauguaggaggucuaaccggcugcugaaaacuuggacccucagggccugacuacagaggcuggauggacuugccuacugugugcaggucc

SEQ ID NO: 4132894 - RNA, 109 nt, Human
ggaucaacaaaaugugauuauuuugcaaaggucuaagaaaucagaugaugagguuuuauaaucccaacuucuccauccucuucccuuuguggaauguuauguucauucc

SEQ ID NO: 4132895 - RNA, 56 nt, Human
ggaucaagaaagucagaugaagagggggggcauuucugcucacugacauuuuugcc

SEQ ID NO: 4132896 - RNA, 108 nt, Human
ggaucaaguagugcacguucucagggaggugcccaggaguggacuuuuaagcaaacaccuucucaggucugaucaugggcccacuuugggaaccacugcuuugcauuc

SEQ ID NO: 4132897 - RNA, 61 nt, Human
ggaucagauggucagggggcaagguaagucucagacucccagggccccuacaccacugucc

SEQ ID NO: 4132898 - RNA, 75 nt, Human
ggaucagcagacagacuugaaaauguucuuuuccuuccuggaaaggguucauuuagcaggaucugaucgcugccc

SEQ ID NO: 4132899 - RNA, 70 nt, Human
ggaucauugggcagggaaaggacaggcagagggcuuuuuuaugccaucuuuucccuucuccauccccucc

SEQ ID NO: 4132900 - RNA, 56 nt, Human
ggaucauuugcaggaaacauuaaacaaacuguuuaauaauuguggcaaauagaucc

SEQ ID NO: 4132901 - RNA, 90 nt, Human
ggauccaaaggggaauguuuuagcuugacuuuucuaaaauaaauuccagcaggaaaaaaguuaacaugaaauauuaagcccagaagauuc

SEQ ID NO: 4132902 - RNA, 68 nt, Human
ggauccaaguguuuuauaagggacagugagcuugccugcucuuugcuucagagggagacacuuuaucc

SEQ ID NO: 4132903 - RNA, 94 nt, Human
ggauccacugugucugccauggaagggggaucaucaguccuggcuugaacaguugggcuugaaaaugacucuugugaagacucacagugugucc

SEQ ID NO: 4132904 - RNA, 88 nt, Human
ggauccgagaugauucuuggcuuuagaacaugggagccagguaaauaauuaugcuaccguguucugugcuaaaauugagacuuggucc

SEQ ID NO: 4132905 - RNA, 87 nt, Human
ggauccuagcucuccugauuagguuuccauagcugguagagaagauucaguuacacaugggaaccugaucaggaaauuggcaggucc

SEQ ID NO: 4132906 - RNA, 59 nt, Human
ggauccuccaguuuuaggauccucgggcccugucuggagauccacugaccuggggaucc

SEQ ID NO: 4132907 - RNA, 55 nt, Human
ggauccuuaacuaucacagugaggaguacugauuauaacuggauguaaagggucc

SEQ ID NO: 4132908 - RNA, 83 nt, Human
ggaucgacccccacacaccaccgucccagccuccugccccacagaaaugcaggagcuacucagguuggguuggggccacgacc

SEQ ID NO: 4132909 - RNA, 73 nt, Human
ggaucgcauggcucauuuaucuugcagccauuaauuaauggugguuaauuguaguuaugagcuguugaauucc

SEQ ID NO: 4132910 - RNA, 86 nt, Human
ggaucuaaacaaaaauaguaacaguaacaucuuccuagagcauauuaacuucucuuuggggagaaauaguguuauugcauagaacc

SEQ ID NO: 4132911 - RNA, 129 nt, Human
ggaucuaggcuaagcaaagaguucuuaugcuauaugcacugugaucaaggcuaagcaaagaguucuuaugcuacaugcacugugaucuaggcuaagcaaagaguucuuaugcuacaugcacugugaucu

SEQ ID NO: 4132912 - RNA, 95 nt, Human
ggaucuaucugugucuauauauaggcauccuccguuugguuuguagaacugucaaaauaacuuaugaucgucuggcuuauggacacagguuaucc

SEQ ID NO: 4132913 - RNA, 55 nt, Human
ggaucucagaauuggacgguaguccaaugaugauaacuguauuuuucugagauuc

SEQ ID NO: 4132914 - RNA, 77 nt, Human
ggaucucucaugagguuucagucaagcuuuugacugggcugcauuuaucugaaggcuugacugaggcaggaggaucu

SEQ ID NO: 4132915 - RNA, 65 nt, Human
ggaucucuguuaauuacccacugacaggcauuaugaccuaacaggagguugguagcaguagaucc

SEQ ID NO: 4132916 - RNA, 80 nt, Human
ggaucugcccacugcagauguacaucuuuauaacaagcuuuaucauaauagaguaugauuacauuuguuaguugcagucc

SEQ ID NO: 4132917 - RNA, 82 nt, Human
ggaucuggaaagacuccauauuuaccugggcaaaagacuuucugugcugagguuucugacuauggagucucuaacagucucc

SEQ ID NO: 4132918 - RNA, 100 nt, Human
ggaucuggcaaacagccaggcgcagaagucuucauagaauucaaaugaggaagcacaaucccuuuugcgaauuuuggcugaaagaaagcaauacaggucu

SEQ ID NO: 4132919 - RNA, 61 nt, Human
ggaucuggccuaggaaugguuuuccggaugcgaaucugugagacuuucuuuggccucuucu

SEQ ID NO: 4132920 - RNA, 64 nt, Human
ggaucuggcugacagauguugcuuugugccuacaaauaacaaacacaucugcaagagccagacc

SEQ ID NO: 4132921 - RNA, 71 nt, Human
ggaucugguuuuggucuggaagcgucccaaaggugucgcaugccagggaaacugcagaccagcccacaucc

SEQ ID NO: 4132922 - RNA, 79 nt, Human
ggaucuuauauccacuauaccaccaaaaaguguguguuuaguaaauauuuauuggauggauggauggauggaugaauuc

SEQ ID NO: 4132923 - RNA, 79 nt, Human
ggaucuuuauagaauguuuccaaugccuucuucaugaagaauguccuacgucugcuggguuuggagacauauaaugucc

SEQ ID NO: 4132924 - RNA, 111 nt, Human
ggaucuuuuuugaaggggugaaggaaucaggaaacguugauaaaaggaaguuccuauaaccuuugggaauguuacaguuuuaauucugauucucacuuuagauuuugauuc

SEQ ID NO: 4132925 - RNA, 64 nt, Human
ggaugaaaagcccauguggaaguacaggccucccugguuacugccuuucccagguuucccuucc

SEQ ID NO: 4132926 - RNA, 64 nt, Human
ggaugaagagcucuacuccuuagagucuguuaaccaccagaccuggagugaagaguucccaucu

SEQ ID NO: 4132927 - RNA, 91 nt, Human
ggcgcaggccgcgaggcaggcccgggugugcagcaggacgggaagccaggccagcaggcacaccugccacuggcgggcauccggcugcgcc

SEQ ID NO: 4132928 - RNA, 59 nt, Human
ggcgcagggauuucaaggggccuuugcggaggcgguaaugaggucaccgucacugcgcc

SEQ ID NO: 4132929 - RNA, 86 nt, Human
ggcgcagggggugggagagugggagcaacuguugcucaagugaggcaggugcccucuucuccacgagucccagguacccucugccc

SEQ ID NO: 4132930 - RNA, 64 nt, Human
ggcgcauguggccggcggccgcgggccgugucaguugcggcagccaccgcguggcccgcgcgcc

SEQ ID NO: 4132931 - RNA, 109 nt, Human
ggcagaggggcugggggaguugggggaaacaugagacuggguuuguagggccccuaaggaggagcucaggacccgguccagguggguacgaguccuagguuccuuugcc

SEQ ID NO: 4132932 - RNA, 79 nt, Human
ggcagauaacuccagcagguccgagacaaguugguguaaacguuggcacggacuggcucaccuguugugugauuaaguc

SEQ ID NO: 4132933 - RNA, 67 nt, Human
ggcagauauguggauucuauuagccagagccugauucuagaagcugcucaugauccaaauuccugcu

SEQ ID NO: 4132934 - RNA, 60 nt, Human
ggcagaugacagaccaguaugugaaguuucucuuccaaauauccaucuuugucaucuucc

SEQ ID NO: 4132935 - RNA, 70 nt, Human
ggcagaugggagccccaggggagccgauuccaacagcagggagcugugacucuccuggggaccaucaacc

SEQ ID NO: 4132936 - RNA, 67 nt, Human
ggcagauucuguuacaaagcauuacaguaacaccccacuggaugcaaagcacacacagaauccugcc

SEQ ID NO: 4132937 - RNA, 63 nt, Human
ggcagcaacgaggcuugauaccaucuaguaugacacuaguuccaccaucaaccucuuccugcc

SEQ ID NO: 4132938 - RNA, 66 nt, Human
ggcagcaacuuaggcagaacaucuagaaccuagauguucuagacacuugagaaaugcauuuuugcc

SEQ ID NO: 4132939 - RNA, 58 nt, Human
ggcagcacaugcuucuugucgcuuggaagccagcuuccaugcaagaaguauggcuccc

SEQ ID NO: 4132940 - RNA, 80 nt, Human
ggcagcagaguaaggcaggcaacgucccuauggaggaaacaagcucagagaugcugccugauuuauucaagcucacaguc

SEQ ID NO: 4132941 - RNA, 56 nt, Human
ggcagcagcaagaagguuggacuagaaaggaguuuuacacauuucuuguagcagcc

SEQ ID NO: 4132942 - RNA, 58 nt, Human
ggcagcagcagggagcaggggugucacgagguucguguauccuccuuccucuguuucu

SEQ ID NO: 4132943 - RNA, 58 nt, Human
ggcagcaggagccaucugguagguacgcugccacuacucagacucaccucugccugcc

SEQ ID NO: 4132944 - RNA, 63 nt, Human
ggcagcaucuguauccuaggcugauugugaggaaucaaugagaaaagccugcaaaugcuugcc

SEQ ID NO: 4132945 - RNA, 65 nt, Human
ggcagcaugcaaguccagaugugggucugcucaugcacuuccauggccaauugcaccuugcugcu

SEQ ID NO: 4132946 - RNA, 61 nt, Human
ggcagccagcaaugagaaguuuguugaaaaccucuucauggagcuccuccuucuguaugcc

SEQ ID NO: 4132947 - RNA, 70 nt, Human
ggcagccagcagaaucuguccuuggaagaugugugaaacucuaaucucaacugguucuguuccggcugcc

SEQ ID NO: 4132948 - RNA, 63 nt, Human
ggcagccaguagggccagccugaccuccaggcacaagagaggcugcuuccuuacguggcugcc

SEQ ID NO: 4132949 - RNA, 124 nt, Human
ggcagcccccgccagcccaccagcaggcuaugucagggccgcucacugcuucuuucuggacacugcugagcagagcugccuguugcauagcaacugcccgggcauauuuguagggggcuggacc

SEQ ID NO: 4132950 - RNA, 58 nt, Human
gggacuuugucuccuaagaacucucagagcuguugugguugggaguggggaagguccu

SEQ ID NO: 4132951 - RNA, 72 nt, Human
gggagaaagucugcuuucuggauggcagagacgaccuucacgccaugcacaccagcaggcagacacuucccc

SEQ ID NO: 4132952 - RNA, 97 nt, Human
gggagaacuagaauaauuuauucuuauaagcaaacugcugagaagauagaaagaccugaaaaccuuucucaagcuguugcuguaagauuguucuccu

SEQ ID NO: 4132953 - RNA, 129 nt, Human
gggagaagauucuggaaggccccuuggaggagguggcaucugaguggggcagggaaaggaaagguggugguuagggcagcgcuuuggagucccugcuuuaccccucagccaaggccguccaacagucuc

SEQ ID NO: 4132954 - RNA, 58 nt, Human
gggagaaguggaaaucucauuauccaggcugccagcaugcugauuuccacugucuccc

SEQ ID NO: 4132955 - RNA, 56 nt, Human
gggagacaccacacacagaacagaggccgaguuuucuuauguguaccugugcuccc

SEQ ID NO: 4132956 - RNA, 77 nt, Human
gggagacauaugcccaccuagaauuucagaacuuauaguuguuauauugagaguuugggggcaauaugauaguuccc

SEQ ID NO: 4132957 - RNA, 65 nt, Human
gggagacugcugguaaagaugggagguggccuuugccgcuuuccaucuucucacugcaguuucuu

SEQ ID NO: 4132958 - RNA, 67 nt, Human
gggagacuggcucaugugaugagggcaacugugcuugcuaauuguccauuacugaaguugggcuccu

SEQ ID NO: 4132959 - RNA, 86 nt, Human
gggagagaagccgagcugggagagaagcgaagcugggcagcccaagggucugaguccuugcuucuauucccugcuacuucuuuucc

SEQ ID NO: 4132960 - RNA, 55 nt, Human
gggagagcgucauaugcccaggaggcaguucugccucuggcucuuugcuccuccc

SEQ ID NO: 4132961 - RNA, 87 nt, Human
gggagagcugaggagaggggcucccaagagccgacuggugcuuccccuugucugccuugacuugucucuccuccuguccccucuccc

SEQ ID NO: 4132962 - RNA, 68 nt, Human
gggagagcugcagccgagagggggagcugaagagaagugccccuucuguguccugucagccucauccu

SEQ ID NO: 4132963 - RNA, 72 nt, Human
gggagaggagaaaggcaauuuguugugaggauuuucauccugaaagccuuuaaugaauuguucuuugcuccc

SEQ ID NO: 4132964 - RNA, 107 nt, Human
gggagagggagcccccugccugagcagcagagaccccaggaaggaggccaagcccuccucacacaggaggucuccagcugcccucugaggugaggggugccucuccc

SEQ ID NO: 4132965 - RNA, 64 nt, Human
gggagaggguuaaagaggcaagacauccuagaaaguauuagucauagcucuuuugucuucuucc

SEQ ID NO: 4132966 - RNA, 94 nt, Human
gggagaggguuacagaaauggggguaagauggagcaccaaagaugaauuucauugucuuuaucauuuugccugccauuugaguucucaaguccc

SEQ ID NO: 4132967 - RNA, 90 nt, Human
gggagagguggcucuuuucacguccccucugacuuccuugucggccugcagaugguggugugagaagagggaaaagccgccucugcaucc

SEQ ID NO: 4132968 - RNA, 61 nt, Human
gggagaguagcuggaagguucugggagaccaagagcuugauuaaagccuaacaacucuccu

SEQ ID NO: 4132969 - RNA, 60 nt, Human
gggagauacaaugauugguucucacccagguggaucugaguggagacucauugauuuccu

SEQ ID NO: 4132970 - RNA, 71 nt, Human
gggagauaugucuauagagccugugggacgaauugcugucuuaaaggucauucuguugauaucuaauucuc

SEQ ID NO: 4132971 - RNA, 62 nt, Human
gggagaucgcagcuugcucaagaccacacagccagggaguggcaaagcugggauucaaaccc

SEQ ID NO: 4132972 - RNA, 60 nt, Human
gggagaugcacagaaaaauugcuuacugcugucacaguaauuuucuuaagugcauggcuc

SEQ ID NO: 4132973 - RNA, 72 nt, Human
gggagauggcucuggcaaggggaggcuacuuuuccauuggcugguauuuccucgcuugugggauucauuccc

SEQ ID NO: 4132974 - RNA, 96 nt, Human
gggagauguaggguccaggauaggccaguaggggugcugagaucuggaauguggcugccugaguuccauagucaccucuuccuggauuugucuccu

SEQ ID NO: 4132975 - RNA, 74 nt, Human
gggagauguuaccucuagacucauagcaaccacucuuggaaguggucagcucuuugggcugguggacauauccu

SEQ ID NO: 4132976 - RNA, 95 nt, Human
gggagauuaucaagggauuggcauuugagcuggaaggaugaguauuaauagcaauagcuaacauguauugagcucuuaugugaacagaccuuccc

SEQ ID NO: 4132977 - RNA, 106 nt, Human
gggagauucgugguuauugccggauucaggaaucuagacuuaagccuuaugcagggaaagguucagaguuguugauguuugucagauguaacuaggagauucucuc

SEQ ID NO: 4132978 - RNA, 60 nt, Human
gggagcacagggacaaugccagguguccuggggacagucggcagcaucccagugacuucc

SEQ ID NO: 4132979 - RNA, 85 nt, Human
gggagcacugaggacagugaggagggcuuuuaccuuguuaauccuuuccuuauuuagcuagcuuuccuuuuugucuagggcuucc

SEQ ID NO: 4132980 - RNA, 59 nt, Human
gggagcagaagaauggagaugcugcucuuaaucgccugcaccagcugccuucugugccc

SEQ ID NO: 4132981 - RNA, 94 nt, Human
gggagcagaagacagaguagaagaagaguuuacaaauauaaucaacugagaaaggauuugcacagccuuucuggcugcucuuguuucuucuccc

SEQ ID NO: 4132982 - RNA, 68 nt, Human
gggagcagaaggaguuguaaaauggggaaauguaccacauuucaacuagccccuaaguccucugcccu

SEQ ID NO: 4132983 - RNA, 55 nt, Human
gggagcagagaccugguuuuguugaguuguuucucagucugucagucucugcccc

SEQ ID NO: 4132984 - RNA, 64 nt, Human
gggagcagcuggagaugcccagcaccggguuuuaugacucuguuggaacuuuucagucuuucuc

SEQ ID NO: 4132985 - RNA, 78 nt, Human
gggagcaggagggaggaggaggauggugugcguucugauuguagggggcaggcaguuugcuuuucccuccugacgccu

SEQ ID NO: 4132986 - RNA, 60 nt, Human
gggagcaucuggcuagaggagugaaguccuaggguuuuauuucaauaacuacauguuuuc

SEQ ID NO: 4132987 - RNA, 74 nt, Human
gggagcauuuucuccuggagcccagaugcuggcuguccacgcaucccuccacagagaggcuacaaaaugguccc

SEQ ID NO: 4132988 - RNA, 77 nt, Human
gggagccaccauguccaugagccagcucuaagcaaauuacauccuccaaguuaauuagagcugauguucauauuccc

SEQ ID NO: 4132989 - RNA, 88 nt, Human
gggagccagagccuccuagccugucccuugagcuggguccccacuggggcugugugccaggggaaggcuggcccgaaaucuggguccc

SEQ ID NO: 4132990 - RNA, 91 nt, Human
gggagccagguuucaacuuauuagcagccaacuuagcuguacaacuggcugcugugaggcggguuggcuggugguugugaggccaguuucu

SEQ ID NO: 4132991 - RNA, 68 nt, Human
gggagccccaggagucaccugcccaaagucacccuggggugauuggcaagggcagggacugggcugcu

SEQ ID NO: 4132992 - RNA, 59 nt, Human
gggagccggacacagucacuccugggagccgaguucaggcucucucuggucuggauccc

SEQ ID NO: 4132993 - RNA, 78 nt, Human
gggagccuguugagagaagaacaaugucauucaggauuauuuuccuaaugagauaccucuugcugucagaaugcccuc

SEQ ID NO: 4132994 - RNA, 58 nt, Human
gggagcgcgccacaaggagcggcggggggcuggucugcugcccgcuuggcacgcuccc

SEQ ID NO: 4132995 - RNA, 91 nt, Human
gggagcuagggaaagagguggcuuccugucuuucugcugguggaggcaagacucugagacaugaaccaucaucaucagcccgcagccuucc

SEQ ID NO: 4132996 - RNA, 79 nt, Human
gggagcucaggccugaggaccuucuggaggccaggcgcuggaggugcccucuucacuguggaggccucagcaaguuccu

SEQ ID NO: 4132997 - RNA, 55 nt, Human
gggagcucucccugaggccugggcugggcuagaggcaggguggggaggggcucuu

SEQ ID NO: 4132998 - RNA, 73 nt, Human
gggagcugacccaggguauccagagcugcucagaaagagggugcauggaaaagccucuggggaugcugcuccc

SEQ ID NO: 4132999 - RNA, 66 nt, Human
gggagcugcugggaaugaacaguguugucuggucagcaggaagccuaacuggugcucacagcuccu

SEQ ID NO: 4133000 - RNA, 69 nt, Human
gggagcuggugcucggggagcuggcgugccgggcacccaugucugccuguucuccagcauccaggucuc

SEQ ID NO: 4133001 - RNA, 56 nt, Human
gggagcugugugccuggauggucucacuggggugaugacccaagcucauggcuccc

SEQ ID NO: 4133002 - RNA, 55 nt, Human
gggagcuucucgcuuggcagcugguuuaugguacacuuuugaaaaguaagcuccc

SEQ ID NO: 4133003 - RNA, 97 nt, Human
gggagcuugguuaaaauguagguuccugggucccugccagagauggauucaggaucucugggguagggcccaggacccugcauuuucacaagcuucc

SEQ ID NO: 4133004 - RNA, 101 nt, Human
gggagcuuguugaaacacagguugcugggccucacccccagaguuccugauucaguaguucucaggugagggccaagaauuuguguuucgaacaaguuccc

SEQ ID NO: 4133005 - RNA, 65 nt, Human
gggaggaacccaagcucaccgucagguuuaccaggcuugaaacacgggaggcuuguguuuccacc

SEQ ID NO: 4133006 - RNA, 59 nt, Human
gggcagugguuacacagcugaggcccugagccugcccagcucccugcacgacccugccc

SEQ ID NO: 4133007 - RNA, 61 nt, Human
gggcaguuaucugacugacaaguuuuaaaugugggaccuuucagcccaggugucuuugccc

SEQ ID NO: 4133008 - RNA, 59 nt, Human
gggcauagaggcacggaggcugcauggagaucccucacugcauuguccgcugucuuccc

SEQ ID NO: 4133009 - RNA, 59 nt, Human
gggcaucuuguagccuucacuucaaguccucaucuguaggaaagcggggauacaugccc

SEQ ID NO: 4133010 - RNA, 55 nt, Human
ggcuucaggggucugucugcacaggggcuagccccucccagaccucugugaagcc

SEQ ID NO: 4133011 - RNA, 57 nt, Human
ggcuucagugaacuuugaauuguucuaauuucaacacaguuuagaggccaacaagcc

SEQ ID NO: 4133012 - RNA, 57 nt, Human
ggcuuccccuccagugcucugugucccccucacaccagccuggcccagggggaggcu

SEQ ID NO: 4133013 - RNA, 93 nt, Human
ggcuucucagacucucagggguuggcuuguuguguuugcuuuugcaaauaacucaggcuuaaguccugcuacuuucagagccuaggggacgcu

SEQ ID NO: 4133014 - RNA, 63 nt, Human
ggcuucucagcgugaauguggagcuauuaauacccacagcccagccagucugccagagaagcc

SEQ ID NO: 4133015 - RNA, 77 nt, Human
ggcuucucucacccaggguguuuggugucugcugggaagcccuucacucaggcacauccacuggacugggaaaaguc

SEQ ID NO: 4133016 - RNA, 67 nt, Human
ggcuucucugcugugugaucauuugucuccuaagagcaggugaguccugggcacagguaaggaaucc

SEQ ID NO: 4133017 - RNA, 63 nt, Human
ggcuucucuggcagacuggcugggcuguggguauuaauagcuccacauucacgcugagaagcc

SEQ ID NO: 4133018 - RNA, 83 nt, Human
ggcuucugacaccauggcuggugcaccucugggaggcugugcccucucggggcugccccaugccacagugcccacagcaagcu

SEQ ID NO: 4133019 - RNA, 59 nt, Human
ggcuucugguaacuuccucccuggcccuauaaaggccacaggaggaacaauuagaugcc

SEQ ID NO: 4133020 - RNA, 78 nt, Human
ggcuucuggugaaauauacuagaugaugacccauuuuaggaccuauuugguuguguuauuuagguguuuucaaaagcc

SEQ ID NO: 4133021 - RNA, 93 nt, Human
ggcuucuguuggugcauaaaugugcacacacaugugugcauguguaugucuuugugugcauaugugugcacacacguauguguaagagaagcc

SEQ ID NO: 4133022 - RNA, 130 nt, Human
ggcuucuuagaacauggugacuggguucugagaaacaguguuucaagaagcaggaaguggaagcuacuagccuuuucaaagccuggguuuagaauuccuagaauaucacuucuaucacauucuauugguc

SEQ ID NO: 4133023 - RNA, 130 nt, Human
ggcuugaaauuuggagacugcuccaugugugaggccagucucauugggaccagcucuccagucugaaguaggaagcugaagaugccagugggagugcuuagguggaacgcucucucccaggauucacgcc

SEQ ID NO: 4133024 - RNA, 61 nt, Human
ggcuugaacucccaaucauuuagaagcauccugggugauuguuugguauucacauucugcc

SEQ ID NO: 4133025 - RNA, 89 nt, Human
ggcuugacagcaggcugguggcugcuugcaggggaucuucugggggucuccaguuacagcagccaggacccagugugcgacuucaggcc

SEQ ID NO: 4133026 - RNA, 92 nt, Human
ggcuugacgugcguaaugauuccuaaucacgaacauuauuuucgcuagcgcggagacauguuccaguuguugugacagaucgcauuucagcc

SEQ ID NO: 4133027 - RNA, 67 nt, Human
ggcuugacucuaagcugcagguugaauccaggugugcuccaccuguguucauuugcggcugcaagcc

SEQ ID NO: 4133028 - RNA, 110 nt, Human
ggcuuggaagauuggcuccucccauacuuauucauuccuuauccguaucuuuuguaauguccuauaaauugcacccgaggaggagguugugggaaccucgauuuagagcu

SEQ ID NO: 4133029 - RNA, 129 nt, Human
ggcuuggaccacgagaggcaccugagucaggcagucacauacuucccacuggggucuaccaugugaggcauggugugggauccugggaaggagaccaagccucauuucaguuugcuuauggccaaagac

SEQ ID NO: 4133030 - RNA, 59 nt, Human
ggcuuggagucauacugagaauccaguucugccauuuacgagcaguaugaccuuaagcc

SEQ ID NO: 4133031 - RNA, 63 nt, Human
ggcuugggcucccagcaauugaggcagccuuuuggcuucauuacuuuuggugggacuugagcc

SEQ ID NO: 4133032 - RNA, 64 nt, Human
ggcuugggggcuaccuuaacauugccuguaugaaaugcaggcuuugacuuggggcaaccaggcc

SEQ ID NO: 4133033 - RNA, 80 nt, Human
ggcuugguuauggaggagaucaccugggaagaucuuugaagcuuaugaagcgaucuucccagguaccaaaucaauaagcc

SEQ ID NO: 4133034 - RNA, 118 nt, Human
ggcuugucuuugugggagauggagaagauagagugauaaauuauaugccacuucuuaaagcuuaugccugaaagugacacauggcacuucuauaacauuucacuggccaaaacaaguc

SEQ ID NO: 4133035 - RNA, 71 nt, Human
ggcuugugucaccaugcgaggcuaauuuuuauauuuuaguagagaugggguuucaucauguuggccaggcu

SEQ ID NO: 4133036 - RNA, 125 nt, Human
ggcuuuaaggauauaguauuggcccagcugggguggcugcccaucccugaaccaacuggggugaguaggacacucuguuucguuggggugggcugccacugugucuggccagcucacuagaaguc

SEQ ID NO: 4133037 - RNA, 88 nt, Human
ggcuuuacagaugugauuagguuaaggaccuugagauagggauaguguccuggauuauacaagcaggcuuaaccugaucacaugaguc

SEQ ID NO: 4133038 - RNA, 103 nt, Human
ggcuuuacuccuguuuagucauuucauuuucucacaauccuauggggugggaaugaucacuggccccauuuuagagaagaggaaacugagaaacagggagguc

SEQ ID NO: 4133039 - RNA, 64 nt, Human
ggcuuuacuucagcaagcuuuccugggagacucuaauggcagagacuguugaaauagaaaugcc

SEQ ID NO: 4133040 - RNA, 61 nt, Human
ggcuuuaggaguccaaagguuuuacaauuuaauacauaauugcuaggcuccuccuaagguc

SEQ ID NO: 4133041 - RNA, 92 nt, Human
ggcuuuaguggaaaagaggguaguguuagggaugagguuaaagacugauauuaauuuaacacauauuuaucaauugcacauuuccauaggcc

SEQ ID NO: 4133042 - RNA, 66 nt, Human
ggcuuuaguuucugaggauugaaagaugagauaauuacauucucuuuccuuaaggaacucacaguc

SEQ ID NO: 4133043 - RNA, 75 nt, Human
ggcuuuauuccaggccuuguugggaccuuugugcucuggugagagcaauucccacauaugcaauccugaauaacc

SEQ ID NO: 4133044 - RNA, 86 nt, Human
ggcuuucccucccaccugagugucaguauucucagaggagccaaucuggaaacgagaucucaggaggucugaggggagcuguggcc

SEQ ID NO: 4133045 - RNA, 70 nt, Human
ggcuuuccuuagguguucuugcucacagccuggacagcagagauggagcugagcaccuccagggcaggcc

SEQ ID NO: 4133046 - RNA, 129 nt, Human
ggcuuucucucucuguuuucagaucaaugguagcuucuuuuucucagcuuuguuaggauagaaucuauaaucuucacagacacagggagaagcauauaaacauuaauuuaaaaagagagcaauacugcc

SEQ ID NO: 4133047 - RNA, 85 nt, Human
ggcuuucuugaagcagaaccaggugaggugcaggcgguaaaugaacuccgcugggcacucaguaccaggucacugcucauuggcu

SEQ ID NO: 4133048 - RNA, 76 nt, Human
ggcuuugacggccucuggcccuacagauggcucuuuggagaggaaaaaauuaagccaggccugaggccacagaucc

SEQ ID NO: 4133049 - RNA, 65 nt, Human
ggcuuugcaaacugucacacuuuccccaggaaacggggaaaggugauuugguuugaaauaaaucc

SEQ ID NO: 4133050 - RNA, 55 nt, Human
ggcuuugcauuuugauggagguggguuuuuccuucugaguaaccaugacgaagcc

SEQ ID NO: 4133051 - RNA, 121 nt, Human
ggcuuugcuggaacaaucuugagguuggaaaucucacucugguccauccgagagcuuuacuaaaucacuuuuugcucucaacuugcuagagugacuaacuacgacucuggacagaucugcc

SEQ ID NO: 4133052 - RNA, 55 nt, Human
ggcuuugcuuaacgugcuucuagcucccuucaaugcuauuauuuguagcaaggcc

SEQ ID NO: 4133053 - RNA, 82 nt, Human
ggcuuuggaguaacaacgaggugagguggccccugguucccaccagaggcaguuucggcugguuugaauaauuccauggguu

SEQ ID NO: 4133054 - RNA, 82 nt, Human
ggcuuuggguccacagucuucacaguucccaaggcauguucaccuugguuuagccuuacuguggccuuguggguucaggguu

SEQ ID NO: 4133055 - RNA, 66 nt, Human
ggcuuugguuuguucaucguccuugcucuguaggauuacagagauggagagaaucaaagcaaagcu

SEQ ID NO: 4133056 - RNA, 109 nt, Human
ggcuuuguagaugaugugaaggguuuaagacuugauccaaagaacuaugagaacuacugaaugguuuuaagauggauacaaguuauucuucucacaugcuuacuuugcu

SEQ ID NO: 4133057 - RNA, 87 nt, Human
ggcuuuuaugaugcaauccacuuugugccccucucuugcagcagcugcggccagggaaaaagcacuaagugggcuugcucacugguc

SEQ ID NO: 4133058 - RNA, 103 nt, Human
ggcuuuucucucuguguacagggucccacagcuaucugacuuugacucauuuuucuaacccagugauucucaaaguguggcuggcccauggacugaaauggcc

SEQ ID NO: 4133059 - RNA, 81 nt, Human
gggaaaaauggaauguuuauacacaguugcugggaauguaaauuaguucagccacuguggaaagcaguucagauguuuccc

SEQ ID NO: 4133060 - RNA, 63 nt, Human
gggaaaaggccuggggcaaaguguaaggccagcaggggcgacagucguagguauccuuuuccu

SEQ ID NO: 4133061 - RNA, 79 nt, Human
gggaaaaugagcucacaggcaggcgucuggaaagcugaggaacccucagaccccacagggccuguccuguugguuuccu

SEQ ID NO: 4133062 - RNA, 69 nt, Human
gggaaaauucaucugagucucaucugggauucccacuuuggcuuuauccccagacuuuagauuucuccc

SEQ ID NO: 4133063 - RNA, 97 nt, Human
gggaaacacagcugacguuaauuuuauucuguuauucugcagugagauugcuaacuggggcaguuuaguagaugacauuauuucagcucuguuuucu

SEQ ID NO: 4133064 - RNA, 90 nt, Human
gggaaacagagcaaagagcuagaccucagccagcaccagggcaggagcccggggcugcugggucccucugugccaacgucucugccuccc

SEQ ID NO: 4133065 - RNA, 68 nt, Human
gggaaacagaggcaggaaaagucacuuucucaaacuacaagugagggccaguucuaccucugaaucuu

SEQ ID NO: 4133066 - RNA, 71 nt, Human
gggaaacauuuggcuaccaugaggaugggcaggaacacugagagagcuccauucucaaggucuagacaccc

SEQ ID NO: 4133067 - RNA, 75 nt, Human
gggaaaccugucuccucuucauauaccuguuccuuucaaggaaggcuauaaaaauggggaugagagaggauaacc

SEQ ID NO: 4133068 - RNA, 115 nt, Human
gggaaacggcuggggaggcuccaccucuuuccuccccacaaccauuuacugggaaguuguguauacuuggcagugugggaggaagguacuuggaagacccugccagccaucuccc

SEQ ID NO: 4133069 - RNA, 95 nt, Human
gggaaacugaacacugucccacaagacaaauuauuccuuuaaaguauucgagauaaucuuugcuagugauuuguuuagggucagucauguguccc

SEQ ID NO: 4133070 - RNA, 59 nt, Human
gggaaacuucugcuaaaaccagagcugaccggcccgaagguuuugaucagagguauccc

SEQ ID NO: 4133071 - RNA, 90 nt, Human
gggaaacuuuauaugguuggggauaagaauugaaugcaaauuaaugaacuagauuugcauuuauggaguuaccucaucauggaguuaccu

SEQ ID NO: 4133072 - RNA, 68 nt, Human
gggaaagagcuuugcuuucuaggcgugugucuccagaugggcccaggaaagauagggccucaguucuc

SEQ ID NO: 4133073 - RNA, 91 nt, Human
gggaaaggcagaagccaguucaaaggcaggauagcagcugagucuaaaaauaaagauuaguuccguuuaugaguggcuuuuucugccaccc

SEQ ID NO: 4133074 - RNA, 85 nt, Human
gggaaagggacuaauauuuguaaggcagagguaccacuaggccagggcacugugcugggcaccucucccagauuguuccauuccc

SEQ ID NO: 4133075 - RNA, 66 nt, Human
gggcaugagcaggccagugugcuucccaggcaggucguagggaaaccagcgcuggccucagugccu

SEQ ID NO: 4133076 - RNA, 94 nt, Human
gggcaugguggcaccuggcucugacuccgcauauuucucgaguaugaagugaugugaaguggggucccuggguguccucugcauccaccugcuc

SEQ ID NO: 4133077 - RNA, 68 nt, Human
ggcaggaggcccugggcagaggagugggcugacucccggaccccagccccugcccagagcacucugcc

SEQ ID NO: 4133078 - RNA, 69 nt, Human
ggcaggagguugcaguugggcgcucagcagcuguggcagccgguugaggucuggcaguagcguugggcu

SEQ ID NO: 4133079 - RNA, 95 nt, Human
ggcaggauccucuggcccaggagagcaggcauugcccuggugggugcugagcagugucugggcucccuuggagcugcuggcaguuuuguccugcu

SEQ ID NO: 4133080 - RNA, 57 nt, Human
ggcaggaucucgguucacugcaaccuccgccuccuggguucaagugauucuccugcc

SEQ ID NO: 4133081 - RNA, 56 nt, Human
ggcaggcagaggcugagacaggagucugguguccugguagccagccugggccuguc

SEQ ID NO: 4133082 - RNA, 76 nt, Human
ggcaggccugugugagagaucccccacucaucuccccuagggaagaagugaggaaauccucuuuaaauugcccgcc

SEQ ID NO: 4133083 - RNA, 67 nt, Human
ggcaggccuuggagguuauuaacacuggccuacuuucaaaguccugagucaaagccccaggguaucc

SEQ ID NO: 4133084 - RNA, 69 nt, Human
ggcaggccuugggccauagucuccugcaucccuccagagccugcagcaggagcugggcccaaggaugcu

SEQ ID NO: 4133085 - RNA, 61 nt, Human
ggcaggcgguggggcagagcugggcaguuucugaaagcccugcugugccugacugccaucc

SEQ ID NO: 4133086 - RNA, 56 nt, Human
ggcaggcgugguggccucagaagcccucggcccuggaaugaggcaccgcacuugcu

SEQ ID NO: 4133087 - RNA, 59 nt, Human
ggcaggcuagcacugauguccuucuaauuuguuagguggaaagguugaacuagcauguc

SEQ ID NO: 4133088 - RNA, 55 nt, Human
ggcaggcuuugagaaagagcaucagaagccugacaguucuucuucagccucagcc

SEQ ID NO: 4133089 - RNA, 66 nt, Human
ggcagggaaacaggugcuaaggaaacaccgcuggucaguccgacguccucagucuccuucucugcc

SEQ ID NO: 4133090 - RNA, 75 nt, Human
ggcagggacacugaggcaugcagagccgggauacagaccaagcaaguccuggcuccucuucugggugucccagcc

SEQ ID NO: 4133091 - RNA, 60 nt, Human
ggcagggcuguaaaggcacuuagagauguuuuugguuggaagugccuugcuggcugugcc

SEQ ID NO: 4133092 - RNA, 69 nt, Human
ggcagggcuugcguuuaaauuaaaguaagccugauuccaaggcccugcucuucugacucaagcuuuguc

SEQ ID NO: 4133093 - RNA, 82 nt, Human
ggcaggggcagcuuucuuuuugcaugucucuagugugaauucuuuccuucaagaagaccaagaaccggaggacucccuugcc

SEQ ID NO: 4133094 - RNA, 130 nt, Human
ggcaggggguugggggcuagcacacagaaaaauguaugauggaggugcuaucacuuuuucuuguuugaaaauguaccauuucuacauaucuuguccuguggcacacuagcucugcaacuacaauuuuguu

SEQ ID NO: 4133095 - RNA, 58 nt, Human
ggcagggugccuggcuccuguucccagcucaggcuguggcuuugccaagcaccuugcc

SEQ ID NO: 4133096 - RNA, 59 nt, Human
ggcagggugguaccagcaucuagugaguagaggccagggaugccgcuacacauccugcu

SEQ ID NO: 4133097 - RNA, 106 nt, Human
ggcagguacccaaguuuaucuguguuuauggggaucugcaguguugaucuguggugcauggaagcgugcagguccguauacuccauagucaauuacguuuccugcu

SEQ ID NO: 4133098 - RNA, 105 nt, Human
ggcaggucccagucucagugacagcugugaauugucuuaucuacaccaucagugaaauuguagaagaguugcauuauagcaaaugagaaugaaaugaacuuggcc

SEQ ID NO: 4133099 - RNA, 88 nt, Human
ggcagguccugagaagcuggagagugaggggagcaaggccuuccuggagccugucccuucauuauucacuacuuacccucucuaugcc

SEQ ID NO: 4133100 - RNA, 57 nt, Human
ggcaggugagggugucugaauagacaaauggugaucuauuuucauucuuacauuguc

SEQ ID NO: 4133101 - RNA, 55 nt, Human
ggcaggugcucugugggccuggguagguuucugcacuguggcucaugcaucugcc

SEQ ID NO: 4133102 - RNA, 60 nt, Human
ggcaggugcugggagcaucucaaacaggacaggccugaccugggaucucuugcaccugcc

SEQ ID NO: 4133103 - RNA, 61 nt, Human
ggcaggugggcacagcuggggcugaggaauucacaggcagcucugcagugcccaccuugcc

SEQ ID NO: 4133104 - RNA, 80 nt, Human
ggcaggugggcaugaugucuggcuaccacucgcacuggacgccacacacacagccaggguggcagaaggccccaccugcc

SEQ ID NO: 4133105 - RNA, 77 nt, Human
ggcaggugguucagugguuagggccaaccaucuacuucaguuccugucuggcccagaucucugaccuugaccaugcc

SEQ ID NO: 4133106 - RNA, 94 nt, Human
ggcaggugugccgucccagccaugguccuguugccacagagcugcaacggccucagacugggcuuaggaccuggugcggagcaggacauuggcc

SEQ ID NO: 4133107 - RNA, 83 nt, Human
ggcagguuuguguguggggaggcagcagauguuggugaugagggaagcuggcagaccugcccccgcuccaccaccugacagcc

SEQ ID NO: 4133108 - RNA, 62 nt, Human
ggcaguaaucuucgaaugguagccaugauuaacauuuuuggguaucaguaggauauucugcc

SEQ ID NO: 4133109 - RNA, 77 nt, Human
ggcaguaggugcugggguacccaacaguuacagcaacaugaaccaguuguauguccuccagcaaaucagccacugcc

SEQ ID NO: 4133110 - RNA, 76 nt, Human
ggcaguauaaaugugggggccacgggcuuuaggucugagcgcugugagcugcuggcuccucagguuaucggcugcc

SEQ ID NO: 4133111 - RNA, 115 nt, Human
ggcagucacaagcgaggggacagaacuagccucaggcuuacgggcaauggacagccauuccucaggcuccauagccacagaccggaugcugggaucugauuggcgcuugggggcc

SEQ ID NO: 4133112 - RNA, 56 nt, Human
ggcagucccaggcugcauguugggucuagagaggcugaacugcagccugggaugcc

SEQ ID NO: 4133113 - RNA, 62 nt, Human
ggcagucccaggguauccuguaguaaaaauaauuuuuaugacuuucauauccuagguuuguc

SEQ ID NO: 4133114 - RNA, 87 nt, Human
ggcagucuagcuucccugcuggaucauaagaccaggacagcagagauuggguuuguauugaucaguaguagggaaguauugauuguc

SEQ ID NO: 4133115 - RNA, 77 nt, Human
ggcagucugggaggaaaagaaaguugggguggcagauccaaguggggcagcacacccaaauuucucucucagguguu

SEQ ID NO: 4133116 - RNA, 83 nt, Human
ggcagugagccaggcuggacauuagauacauagucgacuucaccuacucugugauuuagcuuccagcuuuaccguuugcuguc

SEQ ID NO: 4133117 - RNA, 60 nt, Human
ggcagugcaaggcagccuggauuugggugcaaagccagggccaggcccacgaugcacgcc

SEQ ID NO: 4133118 - RNA, 64 nt, Human
ggcagugcaaggcuggcacagugguuuuaugauauauucacugucccagauaacuucuacuguu

SEQ ID NO: 4133119 - RNA, 57 nt, Human
ggcagugcuucucuggcccaagcauucagccaggccaggcagcaggaagccagugcc

SEQ ID NO: 4133120 - RNA, 68 nt, Human
ggcaguggucagaauggagcccaggaggccagugcuggcucccgggcccucccucugacccugcugcc

SEQ ID NO: 4133121 - RNA, 63 nt, Human
ggcaguguccuugcagcucuacccagcucuuggcucugggaaaagggaacaauggacgcuguc

SEQ ID NO: 4133122 - RNA, 56 nt, Human
ggcagugucuuguaggcugugcugggaagucccggccucagcgcacagaaacugcu

SEQ ID NO: 4133123 - RNA, 62 nt, Human
ggcaguguggccugaguaaguccacagcuugucaugcuuccuacauguuaugccacacugcc

SEQ ID NO: 4133124 - RNA, 59 nt, Human
ggcaguguggcugagacagaggcuggaguggauccuggggcacugcugggccaucugcu

SEQ ID NO: 4133125 - RNA, 61 nt, Human
ggcaguguucuccugaaggucauagaauuugaaaaucuaaaccuuuuguagaacaauugcu

SEQ ID NO: 4133126 - RNA, 94 nt, Human
ggcaguucuuguaugaaguuacugagccucuuaauggccaaacugacuucagugcacagccaggggcucaguuacuuuggcaguugaucugacc

SEQ ID NO: 4133127 - RNA, 74 nt, Human
ggcaguuuauaagcucugaaaucuccuaacaaaugaauggaaaauuucuuuggagguuccaugauuugucugcc

SEQ ID NO: 4133128 - RNA, 66 nt, Human
ggcaguuuuaaccaugggcagaaucuuugcagaucaauguuucagagaaaugccuaucaaacugcc

SEQ ID NO: 4133129 - RNA, 98 nt, Human
ggcauaaaccuuguuuuuaccccuaacucagcugugaggcauuccuagaagccagcuaagccuggcagguguggaguggggugagcugaggaugugcc

SEQ ID NO: 4133130 - RNA, 62 nt, Human
ggcauaaugaacauuagcuacuguacugagcccauaagagcagagguuauguuuuuuaggcu

SEQ ID NO: 4133131 - RNA, 75 nt, Human
ggcauacugguuaaugcuuaacagcuggcuuuucagaaggagaaaagcucauauuuguagcauuugccaauuucc

SEQ ID NO: 4133132 - RNA, 56 nt, Human
ggcauagcuuccagaauuuaaugucaaaauauuuuggcuuccuggaagaaugugcu

SEQ ID NO: 4133133 - RNA, 89 nt, Human
ggcauagggagauuaaguaacuuguccaaaugagcaggucauagaacaagcugugcaacucugggcaagucacuuaagcucucuugguc

SEQ ID NO: 4133134 - RNA, 72 nt, Human
ggcauagucaucagugugucaaaagcacaaagauccccagguguuuggcucagcucacagaucccuuuuguu

SEQ ID NO: 4133135 - RNA, 74 nt, Human
ggcauauggacaaauguaaggcauaauaauaaaugacuccaaaauaucguguuuuuccauuugauccaaguguc

SEQ ID NO: 4133136 - RNA, 62 nt, Human
gggcgggaaggagaccucuaguugacugcauaacccaaucacaucuaauuccauuucugccc

SEQ ID NO: 4133137 - RNA, 57 nt, Human
gggcgggagaaagaaaagucaagagagagguuauuggccacaacuugcuccuagccc

SEQ ID NO: 4133138 - RNA, 57 nt, Human
gggcggugccugucuccgaagcgaggagcggauuggcuucacggaggccgcgccccc

SEQ ID NO: 4133139 - RNA, 84 nt, Human
gggcgugaaaaguuguaagaggcacaaggaagagggguaggaacuuccuucaaaugugauuuuaauaacuagucaagugugucc

SEQ ID NO: 4133140 - RNA, 69 nt, Human
gggcgugguggcuucucgccugucaucccggugcuuugggaggcuggggcgggaagacugcuuaagccc

SEQ ID NO: 4133141 - RNA, 56 nt, Human
gggcguguacacgcacacguguccucugucccguguggaggggcguguacaugcuc

SEQ ID NO: 4133142 - RNA, 57 nt, Human
gggcuaccuacagagcugaggacuaaaugauacagugccuggcaacuguggugggcu

SEQ ID NO: 4133143 - RNA, 58 nt, Human
gggcuagaacagucaaagugagcucugucauggaagggcugagguccugcucuagccc

SEQ ID NO: 4133144 - RNA, 102 nt, Human
gggcuagagugagagguucggaugcucugugggggcugagcugcagccaugggcacacagggcucagggcacgucauccagggacaucaugauaccaagccc

SEQ ID NO: 4133145 - RNA, 62 nt, Human
gggcuagcauuuugucugcuauuuccuaaauaaugguagguaagcaggaaaagugccagucu

SEQ ID NO: 4133146 - RNA, 66 nt, Human
gggcuauaguucucacucagaauuugaauuuugacuuuagacauuaaguguugaggagaauggccu

SEQ ID NO: 4133147 - RNA, 106 nt, Human
gggcuauauuucacauaaccuugacuaacuuggcauugaaguuucauugguggggaacuagagaaaaaugucaugccauagaaggaaaugggaagucugaagaccc

SEQ ID NO: 4133148 - RNA, 86 nt, Human
gggcucaaugacugucuuuucacugcuugauugacaugcacgcuugcagggugucgccuggggacaagcagugagcgaggcggccc

SEQ ID NO: 4133149 - RNA, 61 nt, Human
gggcucacugccaugcucgccaucugcggcuccuucuuggccugaguguggcacugggccc

SEQ ID NO: 4133150 - RNA, 115 nt, Human
gggcucagaacagugcuggcacauaguguguguucaauaaauuuaaguuaaaagacuaaaugaauaaugucuucuuaaaaaagcuguugaaugacugccuuagcugacagggucc

SEQ ID NO: 4133151 - RNA, 69 nt, Human
gggcucagacugaaacaaucugcaggcaaaucaaaagcuuugcuuagauauuuguuucagcucuguccc

SEQ ID NO: 4133152 - RNA, 59 nt, Human
gggcuccagaggcucacccuggccuccuucuccuggcccagggcagcagcacggagccu

SEQ ID NO: 4133153 - RNA, 72 nt, Human
gggcuccagggucucuccuugugcucgucaacaggcuggauggauagaauaaaguggaagauucuggagcuc

SEQ ID NO: 4133154 - RNA, 97 nt, Human
ggggcuccuugagugcaggagcaggagccaugucuggcucaccuuuaaauccugaagagcccugagcaccugccuccucauuugaccaaggagcgcc

SEQ ID NO: 4133155 - RNA, 55 nt, Human
ggggcucugcucugagccguguacaagucuuaacucguucagccccagcagcccc

SEQ ID NO: 4133156 - RNA, 64 nt, Human
ggggcucuuagaaguacauuuagaacauauuuuaaguuucaauguguucauaguucuaaacccc

SEQ ID NO: 4133157 - RNA, 77 nt, Human
gggagccuagaacacaagaugugaagcuagcauauucaugaaacuguagugcagcaagucuaguuuguaggcuacuu

SEQ ID NO: 4133158 - RNA, 70 nt, Human
gggagccuugggccauggacugcugcccaucauagcuggaggagcggucagcuggccacacggggcuccu

SEQ ID NO: 4133159 - RNA, 76 nt, Human
gggagcgggggcugcagggacccaagucuuugguuuucucagugacucaaagauccucucucacccaccugagccu

SEQ ID NO: 4133160 - RNA, 78 nt, Human
gggagcgucuaagaguguguuguaggcucaaaugguuuuuccaaaagccaagccuaaaaacaggcuucaggggugccu

SEQ ID NO: 4133161 - RNA, 112 nt, Human
gggagcugaaggcugacaugacagaggcugcagugacaggggacgaugguuggcauguggcaggcauguggcuaguccucugcggcagccagguagggucaccuccagcccc

SEQ ID NO: 4133162 - RNA, 56 nt, Human
gggagcugagcuggaagagaauuaagaauuugucucucuaauccccagcucuuccc

SEQ ID NO: 4133163 - RNA, 66 nt, Human
gggagcugucacagaauuucuauaguguugaaaugccuuuagaguaaaaacugugaccucguuccu

SEQ ID NO: 4133164 - RNA, 70 nt, Human
gggagcuugagcacaggugaacagcaucucgccacccugccagggcccuucaaaugugccucaggucccc

SEQ ID NO: 4133165 - RNA, 97 nt, Human
gggaggaaggaagacccaaagcaugaacuugagcccagaucccuugaggccagaucuggaguuucaguuuucuggaaaugggagcugccuuacuccu

SEQ ID NO: 4133166 - RNA, 63 nt, Human
gggaggagcuuggagauucacucagauucacaccucccuugggcuuccucuucacuuccuccc

SEQ ID NO: 4133167 - RNA, 78 nt, Human
gggaggaggggcuguaugaugggagcuggaaguacagaagagacgcagccacugcuagagaugcauccccuuccuccc

SEQ ID NO: 4133168 - RNA, 57 nt, Human
gggaggaucugaggcccaccagcagccacaggcacagggcugggagcagacccuccc

SEQ ID NO: 4133169 - RNA, 72 nt, Human
gggaggaugggacgcguggggacugaaggcggcaucugccugaauaaagcccucgcgcgcucugagccuccc

SEQ ID NO: 4133170 - RNA, 98 nt, Human
gggaggauggguggggguagaagcgccccuugcuaggcuuggaacaucuggccgaguccugggcggagggcugcuguccagucccugguccacuuccc

SEQ ID NO: 4133171 - RNA, 107 nt, Human
gggaggauucuuuuuagcuuuauaaucuuuuuuaaggaugccggcagcugaggcuucggaaauaggacaucuagaaaaaagaccuguugagcucaaggaaaccgccc

SEQ ID NO: 4133172 - RNA, 81 nt, Human
gggaggauuggaugggggguuguuuaaugugcauaacccauuguuaugcacauuaucuaauccauuguuauccagccuucu

SEQ ID NO: 4133173 - RNA, 96 nt, Human
gggaggcagcggaaaaaugggagaaaaagaaggccaugucuugguacuuuaaggauauuuccuagaaguuggacaugccauuucugcugaccuccc

SEQ ID NO: 4133174 - RNA, 67 nt, Human
gggaggcaucccaaguagcaauccugguagccuucaaggaaaugccaagugcuuacuuggcccuccc

SEQ ID NO: 4133175 - RNA, 104 nt, Human
gggaggcccagucaaggcuccaggcagccaggucuucccugugucaacaaggggaaggaaagcagcuuggcccugucuggggcauccugagaaagggguuuucc

SEQ ID NO: 4133176 - RNA, 88 nt, Human
gggaggcccagugauggauccugcugggguguaggugggaggccccuccuguccaugccccaccaggacgcugcagccagggccuccc

SEQ ID NO: 4133177 - RNA, 127 nt, Human
gggaggcgcaggggccgcagccagccgggugcugcagcagugcgggcagcuccagaagcucaucggcaucuccguuggcagccugcaugggcugcgcaccaagugugcuguguccaaggaccucacc

SEQ ID NO: 4133178 - RNA, 61 nt, Human
gggaggcucugccaucugucacaggugccuuucaaauuugucucagacugagggguuuccc

SEQ ID NO: 4133179 - RNA, 59 nt, Human
gggaggcugagguguggggaacuauagcucuugggcuguuccugaugccucguccuguc

SEQ ID NO: 4133180 - RNA, 73 nt, Human
gggaggcuggccuggugcccccaagccagcugcuccaaggagcagcuuucuccggggccugcucccucuuccc

SEQ ID NO: 4133181 - RNA, 84 nt, Human
gggaggcuuuaaaaauacugauucuagggcuccacucccagagauucugauuaaauuucugugggguggagcucaggaauuccc

SEQ ID NO: 4133182 - RNA, 97 nt, Human
gggaggcuuuaggggucuuggcuugcuuggggagcccacucaccuccccuuacccugggggauuguucugggugcccucggggccuugcugccuccc

SEQ ID NO: 4133183 - RNA, 73 nt, Human
gggagggcaaagacacgggaaacaacguuguauuaaagaggaaucagcguuuugugucuaguccuugaugccc

SEQ ID NO: 4133184 - RNA, 59 nt, Human
gggagggcagaguccccugcugagcaacaaaggccuccugcagccuucucugucuucuc

SEQ ID NO: 4133185 - RNA, 68 nt, Human
gggagggccaggcucacccagggcaucacacggucucagagccccugcagggagagccaggcucaccc

SEQ ID NO: 4133186 - RNA, 90 nt, Human
gggagggcccgcaagcucuagcuggcgcugaccuggggcugacccucuccagcagccugcaggaagcucagcggggccgggcugccuccc

SEQ ID NO: 4133187 - RNA, 56 nt, Human
gggaggggagaguuacggcuccagggccuuguccuugagauagaucucaucuuccc

SEQ ID NO: 4133188 - RNA, 94 nt, Human
gggaggggcagaggagugggggcagagccucucucggagaaguccaccuccgggagcccccagcccccagccccagcucacucugugcccuucc

SEQ ID NO: 4133189 - RNA, 73 nt, Human
gggaggggcagucaagagggagucugaauuucuggaaagucggcaccuucuccucccaucugucugcacucuc

SEQ ID NO: 4133190 - RNA, 58 nt, Human
gggagggggaugagccagggcugagccguggcaucaggcugggcuccucuccccaccc

SEQ ID NO: 4133191 - RNA, 96 nt, Human
gggagguaagaaggguagggaaggccagcagucacagggucagaugagaaauuucugcuggacaugccuggcugcuccagugucuucgauuauccc

SEQ ID NO: 4133192 - RNA, 62 nt, Human
gggaggucaaaggaguuucugcuucucaccacagauguagucagaaacuugcuuugccuucu

SEQ ID NO: 4133193 - RNA, 61 nt, Human
gggagguccuaaaggggaccaggucuuuagaggcccaaagccuacccuuaggaguccucuc

SEQ ID NO: 4133194 - RNA, 55 nt, Human
gggaggucuguuuguaguucagauucuucucauuccaggcucagcaggcucucuc

SEQ ID NO: 4133195 - RNA, 94 nt, Human
gggaggugacugccugguaccuuuuccuggggcuucuggacucuauuaccuacuauagauuugugaaacucagggaaaagucccuuuacuuccc

SEQ ID NO: 4133196 - RNA, 69 nt, Human
gggagguggagcuggaaguuccaagcuucuaauccuggcuugguccuucuguugaccagcccccauccc

SEQ ID NO: 4133197 - RNA, 72 nt, Human
gggagguggccaucuuuggcccugacucagcccugcagggagaagaggggcuggaggugcagguggccugcc

SEQ ID NO: 4133198 - RNA, 68 nt, Human
gggagguguggauauggcuggacuugcaggcucagggccagggcuugucucugucauuucaccuuccc

SEQ ID NO: 4133199 - RNA, 90 nt, Human
gggaguacaugugggguguaugugccuuacauuuuauuucuacaugugggggugcaugugugcguacaugcuuguggccgcacaacuccc

SEQ ID NO: 4133200 - RNA, 81 nt, Human
gggaguagauuaccuuacaccaguauagacugaguuguugaaaaacuggguuucaacuuuugugaggaauaaccuauuuuc

SEQ ID NO: 4133201 - RNA, 86 nt, Human
gggagucacacuuccuuuuagaaucaugaagacccucaggggguccugccuuucaugaaaaagguaguauuuaaacagugacuucu

SEQ ID NO: 4133202 - RNA, 63 nt, Human
gggagucacagcugaaucucccuucagagcuccugggccagaggagggucgugcuguguuccu

SEQ ID NO: 4133203 - RNA, 71 nt, Human
gggagucauggagguguggcauggugcucagaugugaucugcaccuacagccacauuuaccacaggcuucc

SEQ ID NO: 4133204 - RNA, 60 nt, Human
gggagucccuggaaaagagcuggugagugacagcagucaucucucgugucugggacaccc

SEQ ID NO: 4133205 - RNA, 103 nt, Human
gggagucgacaagagaggugcaggaggcggcuccggggcuguauccagagcaggaagcuggugcaguucccagggccggggucuguccucauaggaggcucuc

SEQ ID NO: 4133206 - RNA, 82 nt, Human
gggagugaauaaauguauaaccauaggaaauuuuaaguauaaucacccuuagaauuuguuagauuaucauuacuugauuucc

SEQ ID NO: 4133207 - RNA, 80 nt, Human
gggagugacacggaaaaggagacagagggggagugugccaaguucucucuauaaacuuucuucauuucuguggcugaacc

SEQ ID NO: 4133208 - RNA, 110 nt, Human
gggagugagagggaggcugagaaggauacugggaccgcuuugcuuuagugauuaucagcauggucucugggaucagguggcccagaucaaaucccaccccuaccacuucc

SEQ ID NO: 4133209 - RNA, 61 nt, Human
gggagugaggcuggaaucauggcuguguguuuccuccagacccucuccaugcccacugccc

SEQ ID NO: 4133210 - RNA, 128 nt, Human
gggagugcugacauguggaaaugcaacagucaugaagcugcagucguuaacguaacugacaaaaccuguacagcauuaacaggcuguuuaauuuuaugccaaguccauaauuuuugcagcauguaccc

SEQ ID NO: 4133211 - RNA, 68 nt, Human
gggaguggcuggcaggggaggguccacagggcuccucuucugggacucucaggcugucggcuucuccu

SEQ ID NO: 4133212 - RNA, 80 nt, Human
gggagugggcccacgggcuuuggugcuggauagcuggaguucagaucccagcccugucaccaacuggagguaagacuccc

SEQ ID NO: 4133213 - RNA, 90 nt, Human
gggaguguaugggacgugccucugcuaguuacucuuaacaacccaggggugugggaagauucuacaguagguacauuccuacccaguccc

SEQ ID NO: 4133214 - RNA, 89 nt, Human
gggaguguucauagguagcuccuguucugagagcaggaugucaccguuccacuccugccagucucgaugcagguaucucugagccuccc

SEQ ID NO: 4133215 - RNA, 87 nt, Human
gggaguucucacccugcuggccaugccuggucuggcaccaugaguucuuauccugccaggagugcuggcccugcugggugaccucuu

SEQ ID NO: 4133216 - RNA, 59 nt, Human
gggaguugcacacuggcuauaacaagauguuuuuguucauccaauguguguguguaccc

SEQ ID NO: 4133217 - RNA, 78 nt, Human
gggaguuggaguggcaguagaugagcugguuguugacugugggcagccggucaucgaugaccacguccacccauuccc

SEQ ID NO: 4133218 - RNA, 61 nt, Human
gggaguuggggcuuacuacuguuuuuuauaauugucucagaaaacagcuaaaccagcucuc

SEQ ID NO: 4133219 - RNA, 78 nt, Human
gggaguuuguuagaagagcagaaucuugagcccuaccucagaccuaccgaaucagaaucugcauuuuaacaagcuccc

SEQ ID NO: 4133220 - RNA, 125 nt, Human
gggauaaaguguggagaagguuuccagagguucuuaaacacugccuuggugggucaaggacagagcagaaacuugaaccccuaguuuuaagacacacucagucugguuuucucccaccuuuuccc

SEQ ID NO: 4133221 - RNA, 72 nt, Human
gggauaagccggcaccaggggauguaauguccuguccccugcuaugccaggacgcaccccugcugccauccu

SEQ ID NO: 4133222 - RNA, 60 nt, Human
gggauaaugagaugaguaaacuguuuggagaucugaaagcaggauaauuuuauuaugccc

SEQ ID NO: 4133223 - RNA, 91 nt, Human
gggauagacuguagcaucuugaaauauaaagucaaugucuuuuuauuaugaauauauuucaacaugcuguauuagcuugacagaucauucu

SEQ ID NO: 4133224 - RNA, 65 nt, Human
gggcugggagggugagcucuggcuguggguccagccaagccugcagcaaggcagccucucagccu

SEQ ID NO: 4133225 - RNA, 70 nt, Human
gggcugggauuuggaaguaaaugaguguuuuaaucauaauagagaaaguccacauuuuaaaccacagccu

SEQ ID NO: 4133226 - RNA, 83 nt, Human
ggggaggggacagugagccugggcagguggguaguggccagguagagccuuggaugccaggcucaggaugucccugggucccc

SEQ ID NO: 4133227 - RNA, 55 nt, Human
ggggaggugggauuaggaccuaaacaguuuagcucuagaguccacgcucuuaccc

SEQ ID NO: 4133228 - RNA, 56 nt, Human
ggggaggugugcaggacaccucaguuuguccugacucaggcugccucacccucccu

SEQ ID NO: 4133229 - RNA, 70 nt, Human
ggggagguucuagagggacagggcaagugagaagaugcaaugcaggucaguccuguuccugaaccuuccc

SEQ ID NO: 4133230 - RNA, 78 nt, Human
ggggaguauaaguguagcagaaccugccuggcagccaagccacgugggcuccugggcagcucugcuccuuggcuccuc

SEQ ID NO: 4133231 - RNA, 74 nt, Human
ggggagucuaagucuucauagucuaauguccaaguggguugcacuagauguagacacuuggaggcuuacuuuuc

SEQ ID NO: 4133232 - RNA, 71 nt, Human
ggggagugaaagaguuuuagacaaacugauugguucggcaacacagucuuccggcagaauucuuacuccuu

SEQ ID NO: 4133233 - RNA, 73 nt, Human
ggggagugcaacuuucuccagugccaacuauuaccagagcuggguaacuguuggaagagaaagggccaccccc

SEQ ID NO: 4133234 - RNA, 56 nt, Human
ggggagugccugagccagucaccucgcugugguuggucacuggccagaguagcccu

SEQ ID NO: 4133235 - RNA, 70 nt, Human
ggggagugguaggagggaucagaguccagaucuagacucugccugaaccuccugcaagccuuucaccccc

SEQ ID NO: 4133236 - RNA, 57 nt, Human
ggggaguguggaaggcaaauuauggagaaaaaggcuaggcagccagucaugcucccu

SEQ ID NO: 4133237 - RNA, 57 nt, Human
ggggaguguuucauagcauccuauuuuauaugacaggauauuuaugacucauuccuu

SEQ ID NO: 4133238 - RNA, 57 nt, Human
ggggaguuuuaacaacaguacugcaaaaauuaaguuaugcucugucuaaaacuuccc

SEQ ID NO: 4133239 - RNA, 70 nt, Human
ggggauaaaauucagugucuggcacugcuguuggugaggcugcggacugcuuuggcacugaaggguuuuc

SEQ ID NO: 4133240 - RNA, 59 nt, Human
ggggauaccagugugugccaaucaccugcugauugacuuccauagcuaccugguacccu

SEQ ID NO: 4133241 - RNA, 102 nt, Human
ggggauccugauggugcaauaaaguuguagaaccaccucacuaagugcucccaauuccuuuuacaauucucuauuauugcaauuuaauccuuucacuucccc

SEQ ID NO: 4133242 - RNA, 89 nt, Human
ggggaucucuuccagucgggacuucuggggacuguagauugacuggggucgcucuccuugcuagagguucuagauuggcuaugauuucc

SEQ ID NO: 4133243 - RNA, 75 nt, Human
ggggaucugaguccaagagucuggaagaaccugugccaguggaggacacugacuuguucuuccagcacugucccc

SEQ ID NO: 4133244 - RNA, 56 nt, Human
ggggaucugcacugugguugcugcaugaagacaguagcuggcagugccuggaccuc

SEQ ID NO: 4133245 - RNA, 63 nt, Human
ggggaucuuuagauuagaaacucuaauuagcgaguucagauuagaaagggucuggggauccuu

SEQ ID NO: 4133246 - RNA, 58 nt, Human
ggggaugaguuugagauaguagagugugggcacuuguucuggcuggaaacuuagccuu

SEQ ID NO: 4133247 - RNA, 73 nt, Human
ggggaugccggcaccugaguucgguugcugccucauccgugagccgggcuggcucccagguguugaaguccuc

SEQ ID NO: 4133248 - RNA, 63 nt, Human
ggggauggguuugguagucauucaauugcuaucuugcccugugaagacacauaaccucucucc

SEQ ID NO: 4133249 - RNA, 65 nt, Human
ggggauuacugcacacaucgcacugcccgugacaaagaguaaugauucagggcuguggcuucccc

SEQ ID NO: 4133250 - RNA, 74 nt, Human
ggggauuccauuguguguuuaugcccagauaucuuuaugcgucuagaagacauuuggaagauacacauaaaccc

SEQ ID NO: 4133251 - RNA, 60 nt, Human
ggggauugggaaauguggaaaacagucauuguggcugacaucauuguguugccaauuccc

SEQ ID NO: 4133252 - RNA, 77 nt, Human
ggggcaaacagucuagaugcuagaaaauauacaccauaauguuuuauguuuuauuuagcuucaguacauaaaucccc

SEQ ID NO: 4133253 - RNA, 76 nt, Human
ggggcaagcuaggaggcccugcacgcuuacccugagaguggggcuccccaguaagagugcaucuuccagcagcccc

SEQ ID NO: 4133254 - RNA, 85 nt, Human
ggggcaauguggucaucucuagggacccucccugcucuaacauucuuugaaugugguggguccugagguggaagcacucuguccc

SEQ ID NO: 4133255 - RNA, 110 nt, Human
ggggcacacaggauuucaauagaaauugcaugccuuuuuagaugugcaaauguuucauuaagcguaugaauauuugaagagauguaugacacuuugaaaacuguuuccuc

SEQ ID NO: 4133256 - RNA, 57 nt, Human
ggggcacccugaggcugaggauaggugggucugcucaccccguaagcccagggcccc

SEQ ID NO: 4133257 - RNA, 57 nt, Human
ggggcagagggcccuaggccaagcccacccugggcaccagggacaauccucuucccc

SEQ ID NO: 4133258 - RNA, 55 nt, Human
ggggcagcaaaggagcccuggaugacagaacaaggcaggguuacccgcugccacc

SEQ ID NO: 4133259 - RNA, 91 nt, Human
ggggcagcugguggcuccacugccccugggcaccggggcccugcgugccagucuggugcacgugggcagucggccauacaccgaguucccc

SEQ ID NO: 4133260 - RNA, 81 nt, Human
ggggcaggaauuagggagccaucauaaggucuguccaccuucagaauugugccugggguggcuccuccuaacguucuccuc

SEQ ID NO: 4133261 - RNA, 95 nt, Human
ggggcaggcugacaggcagggucagcagggcugugguguggcugugugaccuuggacaagugacuugagcucucugagccugccucgcuucaccc

SEQ ID NO: 4133262 - RNA, 73 nt, Human
ggggcagggaugcuaucucucugggcccugaccuggggccucccaccauuuagagagagcagcuccccacccc

SEQ ID NO: 4133263 - RNA, 64 nt, Human
ggggcagggcgcgcaggggucuggauccgacggacgucccaggcucacuguccgcuuccgcccc

SEQ ID NO: 4133264 - RNA, 129 nt, Human
ggggcagguucuucagagaaaguggggaucauggugcuaacagagcugccgggagaacugggacccacucagaccugugccugccugugaguucugauggucugauacuuucacauacauuauuucuuu

SEQ ID NO: 4133265 - RNA, 76 nt, Human
ggggcaguggggagguaaggaccaauguacccaagauccuuguuuuuugucuuuccccuccucauuguggggcccc

SEQ ID NO: 4133266 - RNA, 110 nt, Human
ggggcaugauggugggaucaaaugcaauaaauagggaauagaagaggaagugcaggcauuuguauuuauuucuugaguuuuuguuuguuuuguuuucucuuauuugcuuc

SEQ ID NO: 4133267 - RNA, 105 nt, Human
ggggcaugucuucucugccaugaacuugaaugucuagugcuccugagcccaaguguucagggacaggaugggcauuucacaaggacagcagucccacccaccccc

SEQ ID NO: 4133268 - RNA, 64 nt, Human
ggggcauugaauuugaaagagaauaaaagagccuauacaaucuuucaauccauucauauguccu

SEQ ID NO: 4133269 - RNA, 62 nt, Human
ggggcauugugacauaucucugggccuacacccagguuauaugacugucaugccugugcccc

SEQ ID NO: 4133270 - RNA, 68 nt, Human
ggggcauuuauuacacuuuacucuuacaccauugccuaccuuuggcaaaggaaguuuguaaguguccu

SEQ ID NO: 4133271 - RNA, 82 nt, Human
ggggccaaggccuaggagggggaacaaggcauaccugucaggcuugaucaguauuucuuucccucucuuuagccuuggccuc

SEQ ID NO: 4133272 - RNA, 59 nt, Human
ggggccaagggugcguggcaggacguacuaaucaagugucucuugggucccuuggcccu

SEQ ID NO: 4133273 - RNA, 65 nt, Human
ggggccacuggcaggaccuuggcacuccucccccuccaugugagccaagcuguccuguuggcccu

SEQ ID NO: 4133274 - RNA, 72 nt, Human
ggggccagagaggacccagguggcccuccuuaguugacucugguguugcuugucgguuccacucacggcccc

SEQ ID NO: 4133275 - RNA, 63 nt, Human
ggggccagauaucacuaagguuccagauuucugauucugugaccugggguguaucuggcaccc

SEQ ID NO: 4133276 - RNA, 103 nt, Human
ggggccaguagaauauaaagggaaggagcuugauaaagggcacuguuagcugcacguuaaagugcaagcuggcauucuccuuguuauuccuuuuucucucccc

SEQ ID NO: 4133277 - RNA, 71 nt, Human
ggggccaguggcaggcggagauguaggacucaggcucagcccccguguccugcccucuccuccuuggcccu

SEQ ID NO: 4133278 - RNA, 117 nt, Human
ggggccaucagccauggaaggcaggcugccucuggaagcuggagaaggcaaggaaacagauucuucucuagagccuccagaaggaaugcagccugcugauaccuggauuuuagcccc

SEQ ID NO: 4133279 - RNA, 77 nt, Human
ggggccauggagcagccuguguagacggggaccugcccugcaugggcacccccucacuggcugcuucccuuggucuc

SEQ ID NO: 4133280 - RNA, 61 nt, Human
ggggcccacagggacuugucuggaaccacauggcuggcagggcacagcccagugggguccc

SEQ ID NO: 4133281 - RNA, 62 nt, Human
ggggcccuuggaaagccaaggcagcugugcuuuccugcagcuuggcacccuccaagggcccc

SEQ ID NO: 4133282 - RNA, 61 nt, Human
ggggcccuuguggcugcaggccaggacagucguuaugucugauggggucaagagaggcuuc

SEQ ID NO: 4133283 - RNA, 75 nt, Human
ggggccgagucuaugucuccaccuucgcagaguucagggaacucuguuuuguauuuggagggauagaaaggcccc

SEQ ID NO: 4133284 - RNA, 57 nt, Human
ggggcugagaauucagucucggcagguagaaggcucagagggaagaaucucagcucc

SEQ ID NO: 4133285 - RNA, 80 nt, Human
ggggcugauaguauuacuggcaucaaguggguagaagccagggaugcuucugaacauccagcaaugcacaggacagcccc

SEQ ID NO: 4133286 - RNA, 74 nt, Human
ggggcugaugcugcugggaguggugcucauugucagaucaagugacggccucacuccaagucagcuuuagcuuc

SEQ ID NO: 4133287 - RNA, 89 nt, Human
ggggcugcgacgucugcuuugucuuucaugauacucaaccccaagcagagaaaaauaucuuaaaaaucgaagcagauuaacccaguccc

SEQ ID NO: 4133288 - RNA, 71 nt, Human
ggggcugcuaauuacgcuggggcaggcggggcaaaccaggacccugccaggcgagucuaggccauggcccc

SEQ ID NO: 4133289 - RNA, 75 nt, Human
ggggcugcuaggcugguuagauuuguggucuucuuccuccuguggaggacccuagagagagccagccugagcccu

SEQ ID NO: 4133290 - RNA, 58 nt, Human
ggggcugcugaggccuucccuguccucagcauacugaggaagauggcuucacaccucc

SEQ ID NO: 4133291 - RNA, 60 nt, Human
ggggcugcuggaguuaggugggcuugaaucucuccuucagcucugcuagcucugugcccc

SEQ ID NO: 4133292 - RNA, 126 nt, Human
ggggcugcuugaugauuuuguaaauuuagacuuucaaggauagugcuccaagagcuguauguuuccuucuugauaacacucuugcauuaccugaauaucucuuaggccuuaccagcaugcagcucc

SEQ ID NO: 4133293 - RNA, 78 nt, Human
ggggcuggaaaagcugugucuuggguuuuaucaaaucuaaaauguuugagaaguaauucaagacauuccacagacccc

SEQ ID NO: 4133294 - RNA, 58 nt, Human
ggggcuggagagacccugggcgggguggugggaauggcccaggaggagcuccggcucc

SEQ ID NO: 4133295 - RNA, 98 nt, Human
ggggcugguuuggggccccuccagccccuuccuggcaucuggagcagcaucuccagagggcgauggcugggggcggagggaacuugccaaccagccuc

SEQ ID NO: 4133296 - RNA, 59 nt, Human
ggggcuguggagcuuguggcaguggguaaggaggugcccaggucaaaauucacaggccu

SEQ ID NO: 4133297 - RNA, 58 nt, Human
ggggcuuguugcgcugaagauuuacaauguacuucuugcaggcggcucagcaaccccc

SEQ ID NO: 4133298 - RNA, 120 nt, Human
ggggcuuguugugagaaugcaguggaaaguggggcagccccagaaacaguucagcagcuguacuuugaccugagcuccggggcugcuuccuucuggcuguaucucaccuucucaugcccc

SEQ ID NO: 4133299 - RNA, 80 nt, Human
ggggcuuucugggaaggaagggcuggcugucuuggcccuggccuuggcccuaguucccuuccacugcccagaugugcucc

SEQ ID NO: 4133300 - RNA, 68 nt, Human
ggggcuuuuauugucuuuacgacgaccugaauuuaaaaccuccuccaggugacaauaacuauggcccu

SEQ ID NO: 4133301 - RNA, 61 nt, Human
gggauuggagaguggaacaugcugguucuccuggaguggcagagucucuccuuuccagccc

SEQ ID NO: 4133302 - RNA, 61 nt, Human
gggauuucaaguaucuugggcgagaagaaaagguuuuuacguucuagcugcuucgaauccc

SEQ ID NO: 4133303 - RNA, 61 nt, Human
gggauuucugccaaauaccuguuguauuuuagaauuaaccagcaggcaaaggugaagucuu

SEQ ID NO: 4133304 - RNA, 60 nt, Human
gggauuugugggauggccaguguaugcacuuccagugacugcuggcauuaccacaaaccc

SEQ ID NO: 4133305 - RNA, 75 nt, Human
gggcaaacauuucugucauuucaauaugguuaaacucuauuuaggcaauguggagguggcaacuauaauuugucu

SEQ ID NO: 4133306 - RNA, 58 nt, Human
gggcaaagguuugaggugggaagagguucagugacaucucuccaauuuaaauucaccc

SEQ ID NO: 4133307 - RNA, 70 nt, Human
gggcaaagugguggaggcaguuuuugguggguggagagacauugagcacuuccuuccaccugcucugccc

SEQ ID NO: 4133308 - RNA, 61 nt, Human
gggcaaaugacuucaccucugugaagcagcaguauccucuucugugaagugagguuagccc

SEQ ID NO: 4133309 - RNA, 108 nt, Human
gggcaaaugucuuacuauaauuuaugauuuugauagagguuuuagaguguuuauuuauaaaaaucuuuaaguuuaccacuuucagaauuaagagcaggauauuuaucu

SEQ ID NO: 4133310 - RNA, 100 nt, Human
gggcaacagcaguaucugacaucugagcugcuagguaugcauugucaccgaggcgaucauccacaguugcagcccacaugccagauacccacacaggccc

SEQ ID NO: 4133311 - RNA, 88 nt, Human
gggcaagugagucagagacaaacuuccucucugaaagguucauugagagagccaauuagccagggaggaggugcuguucugcaugccc

SEQ ID NO: 4133312 - RNA, 69 nt, Human
gggcaauuaaggucccguuuccuuggagaacuccaagagauagugccaaacggaccucagaauugaccc

SEQ ID NO: 4133313 - RNA, 95 nt, Human
gggcacacgucaauugccuuuccugccaggugagaccuacugcuugaaggugggagcagcucuguuuaccuggaggaggcagggcuggugugcuc

SEQ ID NO: 4133314 - RNA, 57 nt, Human
gggcacagagcuccagccuuggcuccagauucuggguccugguagggcucugugucu

SEQ ID NO: 4133315 - RNA, 84 nt, Human
gggcacagcgcagccauccagggguacccuggagcccgacagaagcagggccgggcuccagaugucuccuggcaaaugcgcccc

SEQ ID NO: 4133316 - RNA, 59 nt, Human
gggcacaggaauuugggaugugugauagacaaagaaugugucaugaaguccgugugucc

SEQ ID NO: 4133317 - RNA, 68 nt, Human
gggcaccagcuccagcaucaccggcagcagacacucccaggccugccaugguccaggaccuggugucc

SEQ ID NO: 4133318 - RNA, 127 nt, Human
gggcacccagccagccccaacccuucugcaguuucagccuuucuggcccaucuacaugucuucccucagaggggccagcuagagcauggggcaggcuggacaggggcucagggcuguggcacagccu

SEQ ID NO: 4133319 - RNA, 61 nt, Human
gggcacgggugguaaugagaaaaggaaaucauuaaaguuucuuuuccuaccaccugugauc

SEQ ID NO: 4133320 - RNA, 96 nt, Human
gggcacuaccaaagugagucucuagucugguccuggcuucucagggcaagaaaugauuuguuagggcaccuggagguguuuggcuuaggacugccu

SEQ ID NO: 4133321 - RNA, 99 nt, Human
gggcacucuauaaccccaaguacaacgcauacagagaaaacccugaaaguaguacucaguuucuuccauucgucuguugugcauuguuguuaugugccu

SEQ ID NO: 4133322 - RNA, 55 nt, Human
gggcacucucaccugaccacaugcccuugggggcuggucucagugcuggguuccc

SEQ ID NO: 4133323 - RNA, 89 nt, Human
gggcacugaggccucuggaauuaaggaagccuguaauucuuccaacuacuacagcccuuaucuccuaagagagcuuuuccucagugccu

SEQ ID NO: 4133324 - RNA, 57 nt, Human
gggcacuggaaggcucucaggcucuggaauacaccagcacccuacuuucacaugccc

SEQ ID NO: 4133325 - RNA, 61 nt, Human
gggcacugggaagacuggaauugcucagcacagcagaggagaaucuggcuucccagagucu

SEQ ID NO: 4133326 - RNA, 59 nt, Human
gggcacugggagccagagucaccuagagagaguccugucugaaacuugguccuaugccu

SEQ ID NO: 4133327 - RNA, 80 nt, Human
gggcacuuuuggcaauguuuacuggggacccagaccucacucuuggucucccacagugcuaagacaggggcaaaaggcuc

SEQ ID NO: 4133328 - RNA, 76 nt, Human
gggcagaauacccuauagacagaauacucugucuauagaauauccuagaguauucugucuauaggauauucuacuc

SEQ ID NO: 4133329 - RNA, 130 nt, Human
gggcagaauaugcaaccauuugugaagugauuuugccuccauucucuugcucugcccucucugagacaucaugaagcagacagagaauggguuugucauccccacuuuacagaugagaaugcugaggccc

SEQ ID NO: 4133330 - RNA, 64 nt, Human
gggcagagaggagcccuagcacuacccagaagcucaacaggugcugggagcccuggucugcucc

SEQ ID NO: 4133331 - RNA, 76 nt, Human
gggcagaggcuccaggguguguuuacuggggucucuggcgacaccccgugaguacucuccuccuccagccaugccc

SEQ ID NO: 4133332 - RNA, 72 nt, Human
gggcagaguucuaaauucuuuacauuggcuucuucccuucugggauucccacugugaagagaguaugugccc

SEQ ID NO: 4133333 - RNA, 77 nt, Human
gggcagauuuacucagcuccuggaaaaaaaccaaaggccuaugcucuuuucucaggacaaugggugaauacuugcuc

SEQ ID NO: 4133334 - RNA, 80 nt, Human
gggcagcacccuccaaggacccccugagguagggucccccauccacaccucagaacggcguucuugaacccaguuagcuc

SEQ ID NO: 4133335 - RNA, 57 nt, Human
gggcagcagagcccugccgagugagaggcuguggggcagcggcucuguccugugccu

SEQ ID NO: 4133336 - RNA, 57 nt, Human
gggcagccaaggggaccgaacguggcuccuucccaaucucacucucccugucugucc

SEQ ID NO: 4133337 - RNA, 58 nt, Human
gggcagccugugccuucuuauuccagggaccuggggcacagaguuggcagagcugcuc

SEQ ID NO: 4133338 - RNA, 83 nt, Human
gggcagcucuucugcucauccccaaccccuucccagcacucggguuuggugcugagccgggugggauggcaggagccgcuccc

SEQ ID NO: 4133339 - RNA, 65 nt, Human
gggcaggaagcauuaaaacgauucugcugcaauacgguuguuugauuucuuugugcuucaugucc

SEQ ID NO: 4133340 - RNA, 61 nt, Human
gggcaggaugcaguuucagagaagagcaauuacacagguucuuaauggaggcaucuggccc

SEQ ID NO: 4133341 - RNA, 89 nt, Human
gggcaggaugcuguggccacuggcugcgaucuuggcgcuucacaagcuggagccgucaggcccugagccacucggccgcgcagaugccu

SEQ ID NO: 4133342 - RNA, 68 nt, Human
gggcaggcacugaccugcuuccuugauagggagaagccaucauuuccuguagucauugccugaauccc

SEQ ID NO: 4133343 - RNA, 60 nt, Human
ggggccggcgcugacccggcuccagccgccuccaggggcggggucugagcgccgcgcccu

SEQ ID NO: 4133344 - RNA, 74 nt, Human
ggggccgggaggaggagagaaucacugaggccgguauaugaucaccucaugaguucuucugcccauccaccccc

SEQ ID NO: 4133345 - RNA, 68 nt, Human
ggggccuagggaguggccaugccugcccgggcaauggggaucacaggcaaccacuccccgcggacccc

SEQ ID NO: 4133346 - RNA, 62 nt, Human
ggggccucagagaccagcuagauuuuaaaauaaggaaaaagcugggaauuuucugaagcuuu

SEQ ID NO: 4133347 - RNA, 79 nt, Human
ggggccuccgcgccucagccugagggcuccaggagccccccgcucucugaggccccgaagcugagguuuguugggucuc

SEQ ID NO: 4133348 - RNA, 73 nt, Human
ggggccugguaggaggugacuggaucaugggcauggaguucucaugaaugguuuagcaccaucuccccucccc

SEQ ID NO: 4133349 - RNA, 56 nt, Human
ggggccuuggaucugugccccgcccauggaacagcgcccgggcucggagaggcccc

SEQ ID NO: 4133350 - RNA, 60 nt, Human
ggggcgagccuggcacugaucuggcuggcuuacaugacucagccaggcucaagcuccccc

SEQ ID NO: 4133351 - RNA, 122 nt, Human
ggggcgagugugucacuggacuguuuccacagcucgguuggugccacacugucccgaagguucugaaggagacugaggucaccaggcugucugggcagacagagcugccagacucucguccc

SEQ ID NO: 4133352 - RNA, 105 nt, Human
ggggcgcaugcuuguguuuggacuugugccugugcccacccugugugugagucuggguggauguccccaugucaggacaggcucuggacugagcugcuuugcccu

SEQ ID NO: 4133353 - RNA, 82 nt, Human
ggggcggggccugagguucggggcccggcgcugcguuggcggguucgccgcggcgccuaagccccgaccucccucccgcucc

SEQ ID NO: 4133354 - RNA, 83 nt, Human
ggggcgugggggcugccaagccugccugccucucgagagacccagggggaggcucuggagcccgagccucagaucacagcccc

SEQ ID NO: 4133355 - RNA, 80 nt, Human
ggggcguuuaccaauucccacagcugguauaaauacccucccuggugcuuagcaaaggcugcugggagugggguugcccc

SEQ ID NO: 4133356 - RNA, 69 nt, Human
ggggcuacagugaggugguuuccuuuacuacuaagugaagucaugcccugccucaaugauuugaguccc

SEQ ID NO: 4133357 - RNA, 74 nt, Human
ggggcuaccaagaauggcagaguggaccauacucaacucauuguaggaguuggcacccucuucaacuguacccc

SEQ ID NO: 4133358 - RNA, 57 nt, Human
ggggcucaggguacagacucuggagcuacaccgcaccuaacuuugaguccuggcccc

SEQ ID NO: 4133359 - RNA, 78 nt, Human
ggggcuccacuaaggcagcagcggcucggcaggccaugucuuuuggccucugcaccaaccugucaagaguuaagccuc

SEQ ID NO: 4133360 - RNA, 81 nt, Human
ggggcucccccaccguguuccugcucggcauccacaaagcagcgcgugugccggacgcccccuacuggucgggggagcccc

SEQ ID NO: 4133361 - RNA, 66 nt, Human
ggggcuccggcuuggugugcagggugaggcugucccuccagggcucguacaccagcguggaggucu

SEQ ID NO: 4133362 - RNA, 79 nt, Human
ggggcuccuaguugcacaguuccucaagcaggagguauuucaucuucgcaacaucuggaacugucaaagagguagcgcu

SEQ ID NO: 4133363 - RNA, 55 nt, Human
ggggcucgccgcugccccuccccuccacaccaaggccugagacagcaggagcccc

SEQ ID NO: 4133364 - RNA, 68 nt, Human
ggggcucugggcugugguuccacuccgucuccaggacacagugcaaucggccacaaauuuaggacccc

SEQ ID NO: 4133365 - RNA, 58 nt, Human
ggggcugacgggcauguggcuucccaauucauugugaagagcccgucuguucagcugu

SEQ ID NO: 4133366 - RNA, 73 nt, Human
ggggcugagacccaaguccugagccucccagugcaugccuccccagaccgcucucagggcaugggacagcccc

SEQ ID NO: 4133367 - RNA, 73 nt, Human
ggggcugcccugugcauuauaguacguuuagcaacaucccuagcuuccaccuacuaaaugccacuagcacucc

SEQ ID NO: 4133368 - RNA, 84 nt, Human
ggggcugcuuugaggccaauuauggugguaauauuuuuuaguuucucuaggaaaguuguuuccuaaggucuaaagagcuguccc

SEQ ID NO: 4133369 - RNA, 80 nt, Human
ggggcuggaacccagaccucuggcagcugucacuuucacaaugcccuugggcugacuaggcugcagagggguuucacccc

SEQ ID NO: 4133370 - RNA, 65 nt, Human
ggggcuggcuaagacuuuucugugugaggggcugaccucuguguuauagaaugucuagcagcucc

SEQ ID NO: 4133371 - RNA, 61 nt, Human
ggggcuggcuguggcccagcuggguguggaguuucacagccagaggagccaggcuggcccc

SEQ ID NO: 4133372 - RNA, 89 nt, Human
ggggcuggggggucuuggaagccauuccuucugcucccggcaggccugggagucccuggaauagcuccuuccugggccagaacagcccu

SEQ ID NO: 4133373 - RNA, 88 nt, Human
ggggcugugucucccucagaguggggcucccugaggcagggcugugucuccccucagacuggggcucccuguggacagaaccggcccc

SEQ ID NO: 4133374 - RNA, 57 nt, Human
ggggcuguuuuuggaauggcugaauguucaugcugcgugccuguccugaacugccuu

SEQ ID NO: 4133375 - RNA, 74 nt, Human
ggggcuuaaagaguagagacaggaagauuacuccagguggcagcuggagugguaacuaaguccugcuuaguccc

SEQ ID NO: 4133376 - RNA, 91 nt, Human
aaaaaaagagaacgugaauuacuuuagggauguuuugcuuuuuauucaaggcagauggcuacuuuccugggucuucaauuucucuaguuuu

SEQ ID NO: 4133377 - RNA, 67 nt, Human
aaaaaaagguuuauuuaaucagggagccucugaagacaccugguuucuguugaauauaucuuuuuuu

SEQ ID NO: 4133378 - RNA, 101 nt, Human
aaaaaagggacuaaggcuggcagagacaagaagacuaaacuuuguauuaauuuguuguauggucauuccuuguuuuuucagaauggacuccucucuuuuuu

SEQ ID NO: 4133379 - RNA, 72 nt, Human
aaaaaaucacagcuggaauaggucuugguucaugaaaacauguaaacaaagaucuuccugcacugaauuuuu

SEQ ID NO: 4133380 - RNA, 114 nt, Human
aaaaaauggucgugggcuauauuucauguccaguccaacauguugugugugcacagcuguucggggcuggcaugugguagcauaauaaaaggaagauuaccauuuccaauuuuu

SEQ ID NO: 4133381 - RNA, 95 nt, Human
aaaaaauucaagauggcgccagcagagcauuaaaaccagcucugggacuucuaggacaggaucaugaugcuggcucugcccaucuugggugcuuu

SEQ ID NO: 4133382 - RNA, 121 nt, Human
aaaaaauugggaaaauugaaaaauaaaucaaggagggauuauauuuauuuugguuagcuucaaaaacauuuuuuaccauuugaaauaagaaauucuucuuugcaguuaucucuaauuuuuu

SEQ ID NO: 4133383 - RNA, 112 nt, Human
aaaaaauuuaaaacaaguaaauuaaugcauucacaugaucacuucuugaaaaugguucaaagcauguuuuccugauggugggauuguuuaaaugacauguuuuaaaguuuuu

SEQ ID NO: 4133384 - RNA, 107 nt, Human
aaaaacaagaaagaaagaaagacaucauguucugcuaauagucccauuuaaagucaucuggggaguauuaggcacggcgggacugcacuuuauuuugcuuuguuuuu

SEQ ID NO: 4133385 - RNA, 58 nt, Human
aaaaacagaaugugucuaacucuagaaacugugaggggagacagcaucucuuguuuuu

SEQ ID NO: 4133386 - RNA, 95 nt, Human
aaaaacaugacggacaucauaauguuaaguuuagauuauaacuuggaagucaguaccagguuacauaauacuguagauugcccuguuauguuuuu

SEQ ID NO: 4133387 - RNA, 58 nt, Human
aaaaacuaguuguucccaagaauacaauuccuuucccuuuugggcacggcuagauuuu

SEQ ID NO: 4133388 - RNA, 109 nt, Human
aaaaagggaaugccgauaacucguggagcacugaauggaucugaugagcauaaauaugugugucagaaaucagugccucggcaguaauggcuauacacauuuccuuuuu

SEQ ID NO: 4133389 - RNA, 103 nt, Human
aaaaauaaugagcuaccaaugguucaauugcuuggcaguguaacaucucagagagaaugggagaauacauuguucaugcaugagaaaaggaguuuuuauuuuu

SEQ ID NO: 4133390 - RNA, 117 nt, Human
aaaaauauucaaagaguggauagcuuugcauaaaugcuuaaaauuuguauacaauaaacccaaauauauacuuuuuugauacuuuguggcuaguuacuuuaauugugaaauauuuuu

SEQ ID NO: 4133391 - RNA, 106 nt, Human
aaaaauuccacaugguucacaacacuuuuuauauauuguaucuuuggcuaauagguauauguuugugaguaguguaugucugugugcuuccauaucuggaauuuuu

SEQ ID NO: 4133392 - RNA, 78 nt, Human
aaaaauuuacuauuccugggccccauuccagacuagucaaauuagaauuucugagugaggcccaggcaugcgauuuuu

SEQ ID NO: 4133393 - RNA, 96 nt, Human
aaaaauuuagcccaccgugguuuagccuucauuaaccugguaugcauuugaagaauucaauagaguuaaugcaggccaagccugaacuaaauuuuu

SEQ ID NO: 4133394 - RNA, 82 nt, Human
aaaacaaucgcaaugucuaguuucccaaauccgugcguaaugguacaggaguuaggagugcucagaacaucugucuuguuuu

SEQ ID NO: 4133395 - RNA, 84 nt, Human
aaaacagagcuuugauaagccccguggaugcaccugacacgagagaaucaauggugcagguggauuugggcucaaggugguuuu

SEQ ID NO: 4133396 - RNA, 68 nt, Human
aaaacaugaaauucuagcugaacccgguuaugcugguauauagugggauuauugugauuucauguuuu

SEQ ID NO: 4133397 - RNA, 83 nt, Human
aaaacauuauauaacuuuaaagagucauuauguaugcccuuaugaucuauggcuuugcauacaauuuuuagaaaugguguuuu

SEQ ID NO: 4133398 - RNA, 86 nt, Human
aaaaccaaaaauacaugagccugggaccaaggaaugaaaguggcaccuugcucucaaaccugcugucuuguucauaauuuuguuuu

SEQ ID NO: 4133399 - RNA, 130 nt, Human
aaaacccccaaaucagugcuccuucccuucccagggcacucugcagggaccaccugagucagacacagagucucugaccagggugccaaggggauaucuuaaggguccagggacauggagggggcacuuu

SEQ ID NO: 4133400 - RNA, 75 nt, Human
aaaaccuggcaagguaagggcugcgacuauaaggcugcacagcucagggucacaucuugccuaagaccugguuuu

SEQ ID NO: 4133401 - RNA, 89 nt, Human
aaaacuacacauaagcauucugagaaauuucuuugugaugugugcauucaucucacauuguugaaacuuucuuaugauugugcaguuuu

SEQ ID NO: 4133402 - RNA, 67 nt, Human
aaaacugggaaauugacacugauaaaaugccaguaacuauagcauuuacuuggauuuccccaguuuu

SEQ ID NO: 4133403 - RNA, 79 nt, Human
aaaacuguagcauuuaauguugaagauaacugacaugcaugaagucauuguauuaaaauauugguuuaucuaugguuuu

SEQ ID NO: 4133404 - RNA, 130 nt, Human
aaaacuguauauauauauuguucuuggauaggaauagccaacauuuauugaaugcuuuguacuaugugcuaggcacugugcugaugucuuauugccuaauuuaagauaguauuuuaaauaauuguguuuu

SEQ ID NO: 4133405 - RNA, 70 nt, Human
aaaacuguuuaggaggcuuauaugcauauuuguuccuuagcuaaugacaucuagacuucugcccaguuuu

SEQ ID NO: 4133406 - RNA, 68 nt, Human
aaaagaacuugauauucugagaagcugaagaacaauuuguuuuccucagcuagguauuuaggacuuuu

SEQ ID NO: 4133407 - RNA, 56 nt, Human
aaaagaaugucugaacagcuggcugaauaaaucagccaaaguugaaacacucuuuu

SEQ ID NO: 4133408 - RNA, 70 nt, Human
aaaagagggauaggaaacuuagguacacugugcccaucagugaccuugggaaccuguuauaaaaucuuuu

SEQ ID NO: 4133409 - RNA, 129 nt, Human
aaaagagucauguaaauuagcauuuguuuuuggaagguuuugcauuguaaagucauagaucauguuuacagaagcuuuaggaaugaauaaaaaucuucucacugacugcacauuaucucauuuuccuuu

SEQ ID NO: 4133410 - RNA, 106 nt, Human
aaaagcacaagagauagacgucacccuggagagugcuguaguaaucccuaaaugccuuauaggauuacugaacccuacuuuuacagguucuuucuguuguucuuuu

SEQ ID NO: 4133411 - RNA, 114 nt, Human
aaaagcaggcuacugagaggcuuuaacagauaguuucuucuguauuccagaacauuccccaauauccaggagaaacauguaacugugucuguuaagugucaguagcuuuuuuuu

SEQ ID NO: 4133412 - RNA, 63 nt, Human
aaaagcccuuucaaggacuaaagaaauaaaggcuacaaaugucuggagcuugaaauggcuuuu

SEQ ID NO: 4133413 - RNA, 81 nt, Human
aaaagcgauggggaucagaauuuacuuauaauuguuguuguuggcaauauuauagucuuguuauguuucaccauugaguuu

SEQ ID NO: 4133414 - RNA, 72 nt, Human
aaaagcuaagguagcauuggagaccuccuaagaauuuuauuagguggaucucaugaugauuauuuuacuuuu

SEQ ID NO: 4133415 - RNA, 64 nt, Human
aaaagcuggcaauuaucaaaacugguacaauccucuaccucugaguucaugguagccagugguu

SEQ ID NO: 4133416 - RNA, 120 nt, Human
aaaaggacugagaggcagcuucaggaacugaguuguauggugauccccucaacacaaagaguucuccaccauugauauaacucagucucucauuuggucucugcuucucucauuccuuuu

SEQ ID NO: 4133417 - RNA, 68 nt, Human
aaaaggcauggagguugauaguacaaaggccuacaucugugggaacauuucuagccacuauucuuuuu

SEQ ID NO: 4133418 - RNA, 124 nt, Human
aaaagguaagugaauuugguggcauaacuagaagacauuuuagacauaaaagauuugaaggaaaaaugucuuacaucuuccuugacuuggaauguuugguuauguaagaaaugucuuaucuuuu

SEQ ID NO: 4133419 - RNA, 68 nt, Human
aaaagguugaauucaggauccacagaucugcuucaucaauuagacaaguguuuccugaauuuccuuuu

SEQ ID NO: 4133420 - RNA, 80 nt, Human
aaaaguagagcuucuugggcuuuacacaaagcaauucugauucaguaaauuuaugcugaggcccaggaauauguauuuuu

SEQ ID NO: 4133421 - RNA, 78 nt, Human
aaaagucauaaauuguacccauuccaacacaaaucccugauuguggugucagugaagguagaguuuucuuugucuuuu

SEQ ID NO: 4133422 - RNA, 70 nt, Human
aaaaguccaguccaaggugguuugcuaaucccaacucuagacagugguuggcaaagcuccaccgauuuuu

SEQ ID NO: 4133423 - RNA, 60 nt, Human
aaaagugguuuaugauauuccaagaaugaacuccuauucuugguaauuuuugacccuuuu

SEQ ID NO: 4133424 - RNA, 55 nt, Human
aaaaguguucaggaagaauaauguugcauuuccuuaugucuccugaaacacuuuu

SEQ ID NO: 4133425 - RNA, 60 nt, Human
aaaaguucaugacauccucuugauaaggaguucuuauucuggguucaugagugagcuuuu

SEQ ID NO: 4133426 - RNA, 61 nt, Human
aaaauguuguguuucaguucaagaaaugugucaaaugguucugaacauccuacaacauuuu

SEQ ID NO: 4133427 - RNA, 69 nt, Human
aaaauuguggauugcguuuuaucagaagucauuugagauuucauguaugaggccaaucuuugaaauuuu

SEQ ID NO: 4133428 - RNA, 67 nt, Human
aaacaaagcaucuugcuaugcauagaacaauuauuauaacugugaguaauugcaauguguuuuguuu

SEQ ID NO: 4133429 - RNA, 130 nt, Human
aaacaaaggaaauauuaauaauaggaagagaauucucacagcagaaauaugaaggcagaggagagauuucacuuauguuacacuguuuugcuguguuuuuuaaaucauuuuaaucccuuuuccuuccaau

SEQ ID NO: 4133430 - RNA, 74 nt, Human
agcccugucaucuggccugauugguguggaugugguaccccacuaagacauuccucagugccaguugaggagcu

SEQ ID NO: 4133431 - RNA, 58 nt, Human
agcccuucccagcuuagauuugcucauuuguaaaacggggcuaugaagugggagggcu

SEQ ID NO: 4133432 - RNA, 81 nt, Human
agcccuuucccauuaguacuuuagcauaaagcaguuuaucagauucagcugguugauucuaaggugauaauaugcagggcu

SEQ ID NO: 4133433 - RNA, 57 nt, Human
agccgagaguauuugccagagcggccauguggaggucauggccagguacugucugcu

SEQ ID NO: 4133434 - RNA, 84 nt, Human
agccgagggcacagugcucacaccucuauuauagcacauugugcugucuguucgagcguguguuguuuuugucuucacuaggcu

SEQ ID NO: 4133435 - RNA, 112 nt, Human
agccggaaaggggcaggguggaagaauagaugucauugucauccauccugggucacaugggguuugauggcagucggcgugcuggcauaugcccuguccuuucuuuaaggcu

SEQ ID NO: 4133436 - RNA, 69 nt, Human
agccggaauggacugagauagggcuauaggcacagccucucaagccacugcccuuagccauuugaagcu

SEQ ID NO: 4133437 - RNA, 66 nt, Human
agccuaagacaaguuguacucaagccugccuaauauccaaggcugugcucuuaacuuuuuugggcu

SEQ ID NO: 4133438 - RNA, 93 nt, Human
agccuaauaacuaugggcuuuugguauguuguuuagaggaaaugacaucaguuaaucuggcaggauaucgaagugaaaaguaguuaagggguu

SEQ ID NO: 4133439 - RNA, 69 nt, Human
agccuaggcuuguuuucaucagcuccaaauuugccuugacacaggaauguugacucuacaaccugggcu

SEQ ID NO: 4133440 - RNA, 67 nt, Human
agccuagucaagcaauccaauguccugagauggguauuuacucugacaagggauuguugaguagucu

SEQ ID NO: 4133441 - RNA, 68 nt, Human
agccucaaaucaagcagugaaaaaugcuagugaaugaucacauuuuaaugcugcuuaauuuuuaggcu

SEQ ID NO: 4133442 - RNA, 57 nt, Human
agccucacaauucagaaaccaaguagcucccaguugaccuugcuuggguugugagcu

SEQ ID NO: 4133443 - RNA, 57 nt, Human
agccucacacguuccaacuuggcugccuucagcggcauccaggagcaguggugagcu

SEQ ID NO: 4133444 - RNA, 89 nt, Human
agccucagccuaaagcccuccuggggccacgcugguucccuucccugauggcuggacccgggucgucucaggggcuucccagcugggcu

SEQ ID NO: 4133445 - RNA, 61 nt, Human
agccucaguggggcgacagggugcucggcggacuccaccucaggcccuccccacuguugcu

SEQ ID NO: 4133446 - RNA, 57 nt, Human
agccucaguuucaggccuccuccuuuuaaaguggagaagagcugcacacuggggacu

SEQ ID NO: 4133447 - RNA, 62 nt, Human
agccuccaucucccaucugugaggcaugauaacacuaguuucaacagguugugguggggguu

SEQ ID NO: 4133448 - RNA, 71 nt, Human
agccucggccuggccugaacuaggaggugaaaugcagauagcacccaccaccaggcaggacaccgaagguu

SEQ ID NO: 4133449 - RNA, 66 nt, Human
agccucugacugucagcaagguaagcauucugcauauacuuccacuugccuugcuuaacagaggcu

SEQ ID NO: 4133450 - RNA, 88 nt, Human
agccugaacaucaugguguuaaccagcuaaacuuugcuugaacccucaguccauugcagaggagcaagcuggacaccacuguggggcu

SEQ ID NO: 4133451 - RNA, 69 nt, Human
agccugacucacuucagaaccacucagcagccccugaucagcucugcagauuggccugauguucaggcu

SEQ ID NO: 4133452 - RNA, 71 nt, Human
agccugagcacauccaggacaugggacauuucuaccugcccguccuguugcuaccuggaguguguuaggcu

SEQ ID NO: 4133453 - RNA, 75 nt, Human
agccugcagcaguuucugucuguucuuauccaguacugccaccuauugggcaagcucuucagaagcucugagguu

SEQ ID NO: 4133454 - RNA, 77 nt, Human
agccugccaauugugucauuauauuuuuccguaaguaauucaaguuuguggaagaaacaagacacuuuugguauguu

SEQ ID NO: 4133455 - RNA, 73 nt, Human
agccugccuuggauugcagggaaccuucuaacccucaguuagcaggucccuacuuaucugaaggcaucaugcu

SEQ ID NO: 4133456 - RNA, 81 nt, Human
agccugcguuuugggugugccuagggccagggcucagaccauuaucucccugcagccuugcaugccuucccuugccuggcu

SEQ ID NO: 4133457 - RNA, 77 nt, Human
agccuggccaacauggugaaaccccgucucuacaaaaaauuaguggggcaugguggcacgcaccuguaauccaagcu

SEQ ID NO: 4133458 - RNA, 86 nt, Human
agccugggaaacauggcaaaaccccguuucuaguaaaaauacaaaauauuagccggguguugugucaugcaccuguagucccagcu

SEQ ID NO: 4133459 - RNA, 63 nt, Human
agccuguauugcuauauaguaggacuugggaagcaaguccaucagauaagcaagacagcagcu

SEQ ID NO: 4133460 - RNA, 65 nt, Human
agccugugcucuccuggcugcccugaccaccauggguuaggguccacagaaaagggcugaggacu

SEQ ID NO: 4133461 - RNA, 82 nt, Human
agccuguuguccuguuuguuuucacuguuauuaugauuuuuaccacaaggugucaguacaggaaccaggcaggucgauugcu

SEQ ID NO: 4133462 - RNA, 68 nt, Human
agccuuaaaaaugugcauaucgccaggcgugguggcucacgccuguaaucccagcacuuugugaggcu

SEQ ID NO: 4133463 - RNA, 80 nt, Human
agccuuccauaacauacuuguacuaugcauauuuaaucaucuuauaauacgcuuaguagaggaaugugccuuggaaaucu

SEQ ID NO: 4133464 - RNA, 59 nt, Human
agccuuccucuuagaccugagaagugaugaaauuuggagucaugcaggagaggaagguu

SEQ ID NO: 4133465 - RNA, 58 nt, Human
agccuucuuagggucauuccucucuggggaguggggagagugggacaugggagugguu

SEQ ID NO: 4133466 - RNA, 69 nt, Human
agccuucuugagaaucuggugaacuguccaaacauaaagacuacaucacuuaauucuuagaaugaugcu

SEQ ID NO: 4133467 - RNA, 65 nt, Human
agccuugagaagccuccuugcagugauaaggguuauccuggaggacagaggcaucucagcaggcu

SEQ ID NO: 4133468 - RNA, 70 nt, Human
agccuuggaaggcagccagauggcagccugcaguaggaccuggcaggcucuucuuucugcccagccggcu

SEQ ID NO: 4133469 - RNA, 66 nt, Human
agccuuugcaaaguguaccuagagcauuuacuaauauaggccaaaugcuagaacauuuuaaagguu

SEQ ID NO: 4133470 - RNA, 93 nt, Human
agccuuuucugaaguucucagcuuucucuucuaucgauauuucccaugucaguuaaaguguuuguagagacagcugaugcguuuauugagguu

SEQ ID NO: 4133471 - RNA, 63 nt, Human
agccuuuuuaaugugacaucuuuuagaggaauucugcuggaauaauuucauguuaacgaggcu

SEQ ID NO: 4133472 - RNA, 59 nt, Human
agcgacuccggaaggccuuggagcuccauguauguugccuggcucuucgggaguuuguu

SEQ ID NO: 4133473 - RNA, 63 nt, Human
agcgagggggcuagcgcagugcccagcucgcugggugaccucgggcacggcucguccccuccu

SEQ ID NO: 4133474 - RNA, 60 nt, Human
agcgagguguggcaguucuagaccugcgcacuuuggcaggaugcuggcugcacuucugcu

SEQ ID NO: 4133475 - RNA, 56 nt, Human
agcgauucacacacugggcugugauuucaugcccacugcucagucuccugauugcu

SEQ ID NO: 4133476 - RNA, 61 nt, Human
agcgcaggacuccugggccuaagaacugcaucugaagcagccaggccugggguuuugcacu

SEQ ID NO: 4133477 - RNA, 98 nt, Human
agcgcucugaguccuaucagugaggguggacuuaggugcguuuccaggcauucuucacuggaguccgcuccaaguucucuccaccggaaggaugugcu

SEQ ID NO: 4133478 - RNA, 62 nt, Human
agcgcuuuaacuccuucuaguucuguuuuuccuuugaugguauuagaagguauuuagggccu

SEQ ID NO: 4133479 - RNA, 68 nt, Human
agcggcacugacugcaagcuugcaguuucguaaggcuacuugcaagguugcaguuagaacuggcuguu

SEQ ID NO: 4133480 - RNA, 58 nt, Human
agcggcccugaauacugguuggaagcccaaggcuuuguuaccaggccucagaggcccu

SEQ ID NO: 4133481 - RNA, 70 nt, Human
agcgggaaggagaauggggcugcagccagaacagcugcaugcauguuccaacuccaucacucccuuagcu

SEQ ID NO: 4133482 - RNA, 61 nt, Human
agcgggcacuggagacuguuaugagagcuucaagguuccucaccauuccucugugccugcu

SEQ ID NO: 4133483 - RNA, 112 nt, Human
agcgguaucucauuaugauuuuaacaugcauuucccuaaugucuaacgcuauugaguaucuuuuuaugugcuuauuggccauuugcauguauuauuuugugaagugucuguu

SEQ ID NO: 4133484 - RNA, 80 nt, Human
agcgucagacgugaggacacggccuuuuggaaaaugugucuugcguuuuuagcauuagacuguuauccugauugaauguu

SEQ ID NO: 4133485 - RNA, 69 nt, Human
agcgucuaggccgugcccugaggucuggcugugacucaguuuccgcaccagaggccuggccuaggcccu

SEQ ID NO: 4133486 - RNA, 66 nt, Human
agcgugagccacugcgcccgacugaagauguucuaaagcacuuuguagguuucagugaaacauguu

SEQ ID NO: 4133487 - RNA, 68 nt, Human
agcguggccugcagcucccaggaucccugcagggacagggagaggagcuauugggggcucaggaaccu

SEQ ID NO: 4133488 - RNA, 66 nt, Human
agcguggcuggggcgacuccacggugcgccuucccgagggaccuguggcugucucuuucccaugcu

SEQ ID NO: 4133489 - RNA, 65 nt, Human
agcgugugcgcaccuugcgccgggcgcugcagggagucuccagcuccuggaggugcgcacucgcu

SEQ ID NO: 4133490 - RNA, 67 nt, Human
agcguuacuuguuaggcugagaauuuugaagauuauuuuucaaguucuuugccagacacguguggcu

SEQ ID NO: 4133491 - RNA, 66 nt, Human
agcuaagcucuuuucauucuuuucuuuuaagucaaauuaaugugaaaccugugaguagaguaagcu

SEQ ID NO: 4133492 - RNA, 73 nt, Human
agcuacaaagacaaauuuguguaguuauggcaaacagaaacuguaugcucuggaaauaaaugauuuaguagcu

SEQ ID NO: 4133493 - RNA, 93 nt, Human
agcuacagaauguaaucugcaaauauuagcauucgauaucagcacuguaauaugcuugauuugaguaaugguauaugcauacugcuuucagcu

SEQ ID NO: 4133494 - RNA, 67 nt, Human
agcuacagagauagucuuguaggugagaaguucagcuacuuuucacuugacuccaguuucuucugcu

SEQ ID NO: 4133495 - RNA, 78 nt, Human
agcuacauaguaauggaucuaauacuaacguuaagugcugacuuugguuacuuuacaguauuagauaauuacggagcu

SEQ ID NO: 4133496 - RNA, 61 nt, Human
agcuacauuguacuuacaaauagugguuauauaccauuacaccuuugaaaguaugugaguu

SEQ ID NO: 4133497 - RNA, 57 nt, Human
agcuacuucuagguuaaauuagauugucguggaccagucuagcuuaggagccuagcu

SEQ ID NO: 4133498 - RNA, 69 nt, Human
agcuagaaaggcauggaggcaaacuuggucuuaaauucagcacauucauuuugcuucaugucuuuugcu

SEQ ID NO: 4133499 - RNA, 70 nt, Human
agcuaguaaggaauaaauuaugauuuugaauaacaauaucaagaauguucauucuucuaaugugcuagcu

SEQ ID NO: 4133500 - RNA, 61 nt, Human
agcuagugugugaucuaauaugaccccuucuccuugaggucauuuacaugacagauugguu

SEQ ID NO: 4133501 - RNA, 58 nt, Human
agcuaucaguaggaccauguucucucuccaaccuucagaauagagucugccuggugcu

SEQ ID NO: 4133502 - RNA, 63 nt, Human
agcuaugcaaacaaggaacuaagaucuccaacauguuuucaaucuuggccuuguuucauaucu

SEQ ID NO: 4133503 - RNA, 55 nt, Human
agcuaugcaggauaucccuaggaggacagaaccuucuggaccaccuuguaaagcu

SEQ ID NO: 4133504 - RNA, 75 nt, Human
agcuauggucagggauuauagaugccuuguuauuccaccaauaagcaccagucucugaaauccuuuaucuuggcu

SEQ ID NO: 4133505 - RNA, 117 nt, Human
agcuaugucgggacuugcagaaaaugcacauuucccagccccaccaggucguucagguccaggcugggcucagggacacauguguguuucuuuuccacuccaggccggcagguggcu

SEQ ID NO: 4133506 - RNA, 75 nt, Human
agcuauucucauguuaccaaauucuaucugcgcauauguuuuuguauaacauuucggugacagugggagucgguu

SEQ ID NO: 4133507 - RNA, 60 nt, Human
agcacagaugcaugaucaccagacacuuguucaucggcuggugaaagcagcuuccuggcu

SEQ ID NO: 4133508 - RNA, 81 nt, Human
agcacagcugcauccaugacccucucaacaacccucuggagagcgggugcucuagggguuggagguacagggucagcgucu

SEQ ID NO: 4133509 - RNA, 65 nt, Human
agcacaguguucuugauauuacaguuaucaaacuguccauaauauuggugaacuuuugaacugcu

SEQ ID NO: 4133510 - RNA, 68 nt, Human
agcacaugcuccauacagaaugggucaugcagcuuucaaagagcagcccuuccucaaggagcuguguu

SEQ ID NO: 4133511 - RNA, 57 nt, Human
agcacauuuuauuuaagaaaaugugaugaguuaaugucacuuuuuuugaaaugugcu

SEQ ID NO: 4133512 - RNA, 69 nt, Human
agcacauuuucucaaagcucauucaugcggcuguuugccacgugccuacugcguguuggacaaugugcu

SEQ ID NO: 4133513 - RNA, 57 nt, Human
agcaccaaucuggaccccugcccaggggucuccaggggccuaggggcagauggugcu

SEQ ID NO: 4133514 - RNA, 70 nt, Human
agcaccaggcaccaaagggccuccgucaaagcuuacgacccagaggccugaccguggugacucugcugcu

SEQ ID NO: 4133515 - RNA, 55 nt, Human
agcacccucagccuuauccagauugucugacucuggagaaaggcuaaagggugcu

SEQ ID NO: 4133516 - RNA, 59 nt, Human
agcaccugccugcauuggcuauggguccacaccaagcaucagcugauaaggcuggggcu

SEQ ID NO: 4133517 - RNA, 66 nt, Human
agcacgaugcugguauacagugguguuaaccauaugggggcugcuguuauauggguguuaugugcu

SEQ ID NO: 4133518 - RNA, 64 nt, Human
agcacgcaccugcuucgcgucgcccccggccccuccggaaaucagagcuggggcgguguguguu

SEQ ID NO: 4133519 - RNA, 101 nt, Human
agcacggcuuggcauuggaaguuuuauuugaaucaggggagaauauuauuugagauauuuuccuaaaugacaaaugaaugauuuaccugcagcaauguguu

SEQ ID NO: 4133520 - RNA, 58 nt, Human
agcacuagacauguaagugagccucuaggugauccuagcccuuagauguuuaguugcu

SEQ ID NO: 4133521 - RNA, 85 nt, Human
agcacuagcucagaggacaugauauuucaggaagacugaaaacacagacuaaagaaaaauuauguugcauuucugaaagugugcu

SEQ ID NO: 4133522 - RNA, 56 nt, Human
agcacugccgucuuuuuucuucugaaggugccuccuucagaaguugagggcagguu

SEQ ID NO: 4133523 - RNA, 57 nt, Human
agcacuguucuccuuuggcuauauccaauaggaagccacagggaaggagaacaagcu

SEQ ID NO: 4133524 - RNA, 56 nt, Human
agcacuuaacugacaguacuauuuaucuugucacuuaguuaaauucaguaagugcu

SEQ ID NO: 4133525 - RNA, 83 nt, Human
agcacuuacaguguguuggaggagacugucauuaaaccagucauuuuguaaacagucuuucuacauucugugcaguaaguguu

SEQ ID NO: 4133526 - RNA, 78 nt, Human
agcacuuggccagcuggagcucgcagauaggccuucccuaauacccacuuugccuguccguuuuccaccuggauugcu

SEQ ID NO: 4133527 - RNA, 55 nt, Human
agcacuuuccuggcaaauguggucucggccaucaagcugccaaugguaagcugcu

SEQ ID NO: 4133528 - RNA, 80 nt, Human
agcagaaaagaugaaagugaagcuaggacagguagagaugggauuaccuuucuuuccuccuagcaucuuuuuuaaggguu

SEQ ID NO: 4133529 - RNA, 100 nt, Human
agcagaaaaguugacuuagaggcuauggcauugaguaaagucaguaaauauauggcauaauugcugucuuuucccaauccuggaucuaaagcagacugcu

SEQ ID NO: 4133530 - RNA, 66 nt, Human
agcagaaaauuggaaaugacaaggcugaaauccaaagaaaagugucuuucguuucuauacuuuguu

SEQ ID NO: 4133531 - RNA, 61 nt, Human
agcagacagggcuacagagguacuuuuucucccugaaaguacuguaauuucccucuuuguu

SEQ ID NO: 4133532 - RNA, 69 nt, Human
agcagacauugaagcaacucccuccucauuuuucccgucuguuccugggaaaagagugcuucaacugcu

SEQ ID NO: 4133533 - RNA, 88 nt, Human
agcagaccccuuuucuuagccaaagguaaacuccuguuauaaaggaucuuuacaacagcgauuuaccugucacugcagguggucuguu

SEQ ID NO: 4133534 - RNA, 55 nt, Human
agcagagacaugaaauaugcuuguguaguugagcuuggucucuugugucucugcu

SEQ ID NO: 4133535 - RNA, 73 nt, Human
agcagagcagggauuuugccauagcuaucugauuuuccuucuuacagaaucuguguauuccuugcucaugucu

SEQ ID NO: 4133536 - RNA, 62 nt, Human
agcagagccugggcuaggggugcaguaggguugucaacagacuugggaguuuaggcucugcu

SEQ ID NO: 4133537 - RNA, 67 nt, Human
agcagagucuucagcagccuucucaggaagcgggaucccugcccuccccgguagcugaggaccugcu

SEQ ID NO: 4133538 - RNA, 80 nt, Human
agcagaguguggaaaucauauguagucauuuuauaaagcacaaguauugacaaagggucauaugaguuucagauguugcu

SEQ ID NO: 4133539 - RNA, 66 nt, Human
agcagauaauggaagagacuccaaaucaugcaggccuaaacaugaguaucucuccaucuauuuguu

SEQ ID NO: 4133540 - RNA, 89 nt, Human
agcagauuaccuaagauuuccauguuaguacacaggguuucuaucagaaagaguugaaaacuaacaguggcacucucaggcaauuagcu

SEQ ID NO: 4133541 - RNA, 62 nt, Human
agcagcaauuuucacugucaauuuuugcuagucuaauggcuaugacaugauauauuguuguu

SEQ ID NO: 4133542 - RNA, 75 nt, Human
agcagcagaaaccuacuucauuccuuuguaaaaugccuacacguaauagguaccauaaaauggaguaugcuagcu

SEQ ID NO: 4133543 - RNA, 60 nt, Human
agcagcagaaaguugauggcaguagaaccauuuuagaaaugucacauugucccugcugcu

SEQ ID NO: 4133544 - RNA, 74 nt, Human
agcagcagauaaugggacugucucugcaugcuaugucauuacagcuuugcacugagacagcucaguccacuucu

SEQ ID NO: 4133545 - RNA, 57 nt, Human
agcagcaucucuuauugcagugguuuucaaacuauacacucaacuggagagccuguu

SEQ ID NO: 4133546 - RNA, 76 nt, Human
agcagcaucugguucugauguguuuaccgggcugguauggaaaugcccaggcugcauggcagaaaccugagcugcu

SEQ ID NO: 4133547 - RNA, 63 nt, Human
agcagccacaggaaacauugcccccgcacauguccucauuugcaugcuuucuugugugcugcu

SEQ ID NO: 4133548 - RNA, 77 nt, Human
agcugaggccaaagcccaggagacagccaugugugcgagcugcggaaacuggaggucuccugguauugaccccagcu

SEQ ID NO: 4133549 - RNA, 69 nt, Human
agcugagggggugucauuaauugugaugaaauaauuuaaaccaucaggaauaaaugaggcuguuaagcu

SEQ ID NO: 4133550 - RNA, 96 nt, Human
agcugaucuguagaaacuguauguaguuuuugggaaauauuccagauuuucccauaaguucuccacucauccagucaucaucuacagauuccagcu

SEQ ID NO: 4133551 - RNA, 63 nt, Human
agcugauguauauggaguguuuacucugucaggugcuauucagacacuucauuugcagcagcu

SEQ ID NO: 4133552 - RNA, 82 nt, Human
agcugauucugaugugcagccaggguugagaaccacugccuuaauaucaaaucucaacuccuuaaugcauuucagaggugcu

SEQ ID NO: 4133553 - RNA, 68 nt, Human
agcugcaggacucaaaucugaaggcaggauagucugccucugaagugauucugagucucucuggagcu

SEQ ID NO: 4133554 - RNA, 56 nt, Human
agcugcagguggacccguaccggcugaagaaugggcggggcaucauccugcuggcu

SEQ ID NO: 4133555 - RNA, 70 nt, Human
agcugcaugucuuuugggcaguuaugguuuuugaucccguagaguacacgcucaaagggcuugccaugcu

SEQ ID NO: 4133556 - RNA, 91 nt, Human
agcugccaaugccugauucgccccucagcgacccaccagccacuuaugggaaguuggcaggaaguuggagguggugggagggaguggcacu

SEQ ID NO: 4133557 - RNA, 69 nt, Human
agcugccacaugcccaagggcaccccuaaacaccacuccccggcguccacccagcacacugugguagcu

SEQ ID NO: 4133558 - RNA, 90 nt, Human
agcugccacuuccaggccaggguauucuggacagaugggagaagaaagccaaaacucugcacagagacccuugccagaaacuggguagcu

SEQ ID NO: 4133559 - RNA, 59 nt, Human
agcugcccaaggucacagagcuagcaaaguacagagcuagauucacacccaggccagcu

SEQ ID NO: 4133560 - RNA, 55 nt, Human
agcugccucagucacucauggccaaagugauauggcccaaugaaccugggcagcu

SEQ ID NO: 4133561 - RNA, 94 nt, Human
agcugccuggagauagcagaagcaggccucugggcagcacacgagccagcaccaggaggcccuucucaucccugcuccucuccacacaguagcu

SEQ ID NO: 4133562 - RNA, 80 nt, Human
agcugcuaauuaagaccaagccacuuguguuuuucaaaaaucugaaaaccacaaaaguggcuugguuuuaaguaguggcu

SEQ ID NO: 4133563 - RNA, 129 nt, Human
agcugcuauaaacauuuguguuuagguuuuuguguggauauaguuucaacucaauuggguaaauacuuaggagugcauaaaacuauauuuggcuuguaaaaaacugucaaauucucuuuuauuguggcu

SEQ ID NO: 4133564 - RNA, 93 nt, Human
agcugcucuguucauuucccuggcccuggcacgcucugcuuagggauacaguggcagggaggcuggggcuguggaauucacgagggcuuagcu

SEQ ID NO: 4133565 - RNA, 55 nt, Human
agcugcucuugggugacuucaaacuaugaaauuugcauguagcccaugaguaacu

SEQ ID NO: 4133566 - RNA, 65 nt, Human
agcugcugagagucugccgggcaaugcacaauugcuuugcuucaccaaagcagauauucauggcu

SEQ ID NO: 4133567 - RNA, 55 nt, Human
agcugcugccgguggccacccuggagccagguaucgccagaggccggcaggggcu

SEQ ID NO: 4133568 - RNA, 76 nt, Human
agcugcuuaggcauucacucagcgaugccaguaugucuuacuauacaaaacagugcugaguuaauuucacacagcu

SEQ ID NO: 4133569 - RNA, 60 nt, Human
agcugcuuccucuuugaugucauuacuuaacauucauaugaaucuugaggaccaguagcu

SEQ ID NO: 4133570 - RNA, 71 nt, Human
agcuggaaguccaaggucaagguaucagcaggcuugguuuccucugaggccucucuccuuggcuugcaguu

SEQ ID NO: 4133571 - RNA, 61 nt, Human
agcuggaauaaaggggugaagagaguagucccuucucugggagggagccccuuuccaaguu

SEQ ID NO: 4133572 - RNA, 91 nt, Human
agcuggauaccagauucugggggaauacagcuaugagaaauguaagaauucucaaaugcuugucacuuccccauguugguuuuguuuagcu

SEQ ID NO: 4133573 - RNA, 56 nt, Human
agcuggcuaugcccugugaacccaugguucagucccuucuccaggucagcacggcu

SEQ ID NO: 4133574 - RNA, 91 nt, Human
agcugggaggcagaagugacuuggaacagcugaaguccuaaaaaagagccuuaggucugauuuccauucagucguguuggccucccuugcu

SEQ ID NO: 4133575 - RNA, 71 nt, Human
agcugggcauuggauggacuggaacucagaaugcuggguuuucucaggaugguguguacaaugcacuggcu

SEQ ID NO: 4133576 - RNA, 62 nt, Human
agcugggucuagggagcaggaggacagggacgagcugguccuugagccucccagacucaguu

SEQ ID NO: 4133577 - RNA, 58 nt, Human
agcuggugaggguugagggguagcaagcgggggucucuaggccucauccucuccagcu

SEQ ID NO: 4133578 - RNA, 55 nt, Human
agcuggugcugaagcucuugagaccuuugaaccacuuaagggcagcacucuggcu

SEQ ID NO: 4133579 - RNA, 56 nt, Human
agcugguguccuccuggagcugggcucaaccggccaccuucugcugggacacagcu

SEQ ID NO: 4133580 - RNA, 59 nt, Human
agcugguuuauuucuauauccuugccaaaacuggcagugcauauaggcugaaccaugcu

SEQ ID NO: 4133581 - RNA, 67 nt, Human
agcugugacugaguagcgcuaaaaacuaugcugaccaccagcaugcuacagcaucucucaucaggcu

SEQ ID NO: 4133582 - RNA, 63 nt, Human
agcugugccauuccaagaucaggguuucuuuaagcauucccccggccuuggaauagcacagcu

SEQ ID NO: 4133583 - RNA, 62 nt, Human
agcugugguucugggcagcgacuccggggagaugcuuaaccgcccaggaacccccgauggcu

SEQ ID NO: 4133584 - RNA, 93 nt, Human
agcugugguugaggagucugaacugguccccuggcucccuccugccucaccccagacaggcuagccagacucaccacccucucagccacagcu

SEQ ID NO: 4133585 - RNA, 63 nt, Human
agauagcccuccaauaagcuuggagucuuguguucuaaacgagcuaaggacuggaggguuucu

SEQ ID NO: 4133586 - RNA, 81 nt, Human
agauagcuuucucagacuuuuaaagacugaaugagggaccgcuucuacauauuuccaugaaguuuggagacacaccugucu

SEQ ID NO: 4133587 - RNA, 73 nt, Human
agauaggaaagggcagagcugggagccaaguguuaaguauuuuaguccccagagucucugcucuugccucacu

SEQ ID NO: 4133588 - RNA, 90 nt, Human
agauaggaugggugcaccaaccagaccugggaggggguaaaaggggagccuuugagccaggugugguggcauacaccuguaguuccaucu

SEQ ID NO: 4133589 - RNA, 77 nt, Human
agauagggagucaggagaccugguaagccaagugugugacauuggcugagcuaacaggucucucaauuucuucaucu

SEQ ID NO: 4133590 - RNA, 68 nt, Human
agauauaaaugugcuugguaaacguauucuuucagguugaaacuagaugauuaugaagcauaguaucu

SEQ ID NO: 4133591 - RNA, 60 nt, Human
agauauaucaguugguggcaucugcaacgucaggcagcagagaagccaagugacauguuu

SEQ ID NO: 4133592 - RNA, 90 nt, Human
agauaucauuuuuugaacagggagcauuuuguugcauagguguuuuggcaauugugaaacacugcgauaaaauccuuuuucauugguacu

SEQ ID NO: 4133593 - RNA, 67 nt, Human
agauaugaagauuucccagagacaugcacagcuaaucugaagcacagcugggacaguuuucaccucu

SEQ ID NO: 4133594 - RNA, 129 nt, Human
agauauuuuuuuuguuucggaugucugcccuaugcaguguacgauguuuaguagcaucucuggccuccacucacuaaaugucaguagcacaugcaccacccagucacuugugacaagaaaaaaauaucu

SEQ ID NO: 4133595 - RNA, 88 nt, Human
agaucaauaaauacaggaaaaacauagaagaugguuaauuguaggauuuauguaugccucuuaaucugugguuuuguauuaaagauuu

SEQ ID NO: 4133596 - RNA, 62 nt, Human
agaucacagaaacauguguugggagcugccugucagcaaaugcugcuagaaauucugugacu

SEQ ID NO: 4133597 - RNA, 75 nt, Human
agaucagucccaagaucugccauuguaugagcaaagcuucuucugcuucugaguugcaggacuugggaauggucu

SEQ ID NO: 4133598 - RNA, 77 nt, Human
agaucaguuuaaggaguguugccaucuuaacaaugaaucuucugauucaugaacauggaauaucuuuuuauuuaucu

SEQ ID NO: 4133599 - RNA, 55 nt, Human
agaucauugcaaugggugaaauuaaguuaaauguauuucacuaauuguaagauuu

SEQ ID NO: 4133600 - RNA, 90 nt, Human
agauccaguuuucucagugauuauugauugcauucagaacagcuucuguuucccuaugaacagaucaauagaacugacaagccucaguuu

SEQ ID NO: 4133601 - RNA, 59 nt, Human
agauccuaggcagcagggcuauauuuuguaacagauuuccuggcuccugccugccuucu

SEQ ID NO: 4133602 - RNA, 76 nt, Human
agauccugggaaggguguugucuuaucuucuuuauuuguacuaaacaaagguuggaagacacuuuucuaaaaaucu

SEQ ID NO: 4133603 - RNA, 76 nt, Human
agaucggccgggggccgccagaagccaggaggaggcaaggaaggauguuccccagguccugucggcuccuugauuu

SEQ ID NO: 4133604 - RNA, 72 nt, Human
agaucucaauagguucuccacagguucuccauagguuguccauagaaccuccacaggaccuccauaggaucu

SEQ ID NO: 4133605 - RNA, 102 nt, Human
agaucugucugaauaugcagcccauuugcuuuccuguuaacccaagaaccaagagucucauguguacaguaaauguaaauggauuauauuuuggcaguggcu

SEQ ID NO: 4133606 - RNA, 101 nt, Human
agaucuucagguauagcuggauccaggggcaagaaugcugucagcaggcuucugcucugguguucucugccuuaacuccauuuucaagcagcuuggagucu

SEQ ID NO: 4133607 - RNA, 60 nt, Human
agaucuuguuaaaugcugccucugguugagcaaaauagguuggcauuucuaacaaggucu

SEQ ID NO: 4133608 - RNA, 120 nt, Human
agagagaugaggcaaguguggaagggaagccccagaaggggaaagccugguuaaggggcccuucaccccccucuccaaggcacauuccccuuucugucccuuugucguuucauucacucu

SEQ ID NO: 4133609 - RNA, 82 nt, Human
agagagcaagcaagagagauagcuuauugacuguaaguauccaauuacucaaauguuauucauucuuguuuaaauguuaacu

SEQ ID NO: 4133610 - RNA, 70 nt, Human
agagagcagucuuuauuuagaguuaggacugaaacuuuuuaggccuaccuaguuuaaggaagugcucccu

SEQ ID NO: 4133611 - RNA, 64 nt, Human
agagagcuguauccccuuaccaguucugugacguggcugggcugguuucauauacauucuuucu

SEQ ID NO: 4133612 - RNA, 85 nt, Human
agagagcuuaaagaguauuuaauauaaugcaggcaaauuuuuuaaaagcccuuauuauuuagaagaaaucuuuuuaaugcucuuu

SEQ ID NO: 4133613 - RNA, 60 nt, Human
agagagcuuccauucuagugauuggcccugagucacuaaccaaugauggugaguucaucu

SEQ ID NO: 4133614 - RNA, 105 nt, Human
agagagggacaugucuugcccgggguuacacagcaagucaagacucagcccaaaccagagucacagaaugauggcuccaggcuagaagacauuucuugacuuucu

SEQ ID NO: 4133615 - RNA, 62 nt, Human
agagaggucaucucccaucagcaaccuuuacaaagaugcugaucugguagaugaaacucuuu

SEQ ID NO: 4133616 - RNA, 64 nt, Human
agagagguuaaggagcucuugucuaagcuucccagauaggacaaauuugaauccugacuucuuu

SEQ ID NO: 4133617 - RNA, 71 nt, Human
agagagguuugcuggaagauucugagaauaaagcuuccuuuauuaugaaaaaucuuucagacaauuucucu

SEQ ID NO: 4133618 - RNA, 93 nt, Human
agagaguggccuggagaagcaggaaggugucuggcccagagucucaugcauugcaggaccagcuagcaccuuggcuuucacagguuucuuuuu

SEQ ID NO: 4133619 - RNA, 90 nt, Human
agagauaaccuuauguucaguagaagcagagguuguaucacauauguacuucaacuggcacaugcuucuguuucaagaacuaauuguccu

SEQ ID NO: 4133620 - RNA, 57 nt, Human
agagaucccaggaggccuuccagugaaacucuaucaucaugcaaucuugggauuucu

SEQ ID NO: 4133621 - RNA, 68 nt, Human
agagaucuagcaccugcugguccucuaugugggcgggaacugugagguccagccugguguaugucucu

SEQ ID NO: 4133622 - RNA, 55 nt, Human
agagaugccaccuuuuugcuguguccucacaugguggaaggggcaaggcagcucu

SEQ ID NO: 4133623 - RNA, 55 nt, Human
agagauggcgucucagagccugcucugcucuguaggggcuguggaaaccaacucu

SEQ ID NO: 4133624 - RNA, 104 nt, Human
agagaugugggaccacauucaaguauauuuaacaucguaucaagcaguuaaucuuuugaaaaucuaugguguuaaaugguauuuagcauaauccuacaaacucu

SEQ ID NO: 4133625 - RNA, 80 nt, Human
agagaugugucugagcuucuuuauuuggccagaaaauauuuuuucucuucuaggcuuuggaguugcagaaaaacaucccu

SEQ ID NO: 4133626 - RNA, 77 nt, Human
agagauguuccagccaaugggaaugggagguugagguguauaacaugggaacauuugcuauuaggcugagcaucucu

SEQ ID NO: 4133627 - RNA, 98 nt, Human
agagauguuucaagagggaacuagguacugaaaaaggggaaagguaucacuuucaaucauuuuuacauagucccaaaaccuugaaacuagguaucucu

SEQ ID NO: 4133628 - RNA, 77 nt, Human
agagauguuucuagagcuuugucccauguuaaaacacaaaauuauuugcucugggagaauauauuuaaaacuucucu

SEQ ID NO: 4133629 - RNA, 78 nt, Human
agagauuacauugggauaguuucuuuugaccaaagguccuggcuccuuucagaaguaagguucucccaagcucucucu

SEQ ID NO: 4133630 - RNA, 60 nt, Human
agagauucuguagucaggcaucuaagcauggcuuagcugaggcugcuggcucaggguccu

SEQ ID NO: 4133631 - RNA, 64 nt, Human
agagauuucuacugcacucuuugguuaccuguucugggacaaauauaguccauuagaagucuuu

SEQ ID NO: 4133632 - RNA, 75 nt, Human
agagcaacaucugucccagcagcuggguucucugcaugagugggcagagcgacacauugggacaaauucuguucu

SEQ ID NO: 4133633 - RNA, 85 nt, Human
agagcaauauuuuuggugcaggagcugacucaucagauuagcagccucucaagauugaugauguuucugccuugccuauuccucu

SEQ ID NO: 4133634 - RNA, 63 nt, Human
agagcaauggcauccagcugauuuuauuuauaauuaaugucuuuggagaggugccauuucuuu

SEQ ID NO: 4133635 - RNA, 87 nt, Human
agagcacugcuggguaguuacaaccaugacacaagcagguuaaaucaugugucucccugugggguggaugugucccaguacuucucu

SEQ ID NO: 4133636 - RNA, 96 nt, Human
agagcagacggcccagaaaagcugcuguuuguccgguugcacuuucugccaaauuaugcaaauggaucugacuggcuuuucuucugauuuuguuuu

SEQ ID NO: 4133637 - RNA, 55 nt, Human
agagcagaggaaggcaagauacuagccagcuagcaugguguuuuuucccuguucu

SEQ ID NO: 4133638 - RNA, 66 nt, Human
agagcaggcauaaagcuuugaagaccuacagaccuggcucuaauuccuagcucugcuauuugcucu

SEQ ID NO: 4133639 - RNA, 87 nt, Human
agagcaggccugggugccaggggaccuagggaugucuccucuuuugaaugggguauaacugcuaccaccugaugccuugccugcccu

SEQ ID NO: 4133640 - RNA, 110 nt, Human
agagcagggaaauaucugggaaaguaggcagaggccaaguuuugaagagccaugaguaucauggaaagaauuuaggcuugucugcuguguagaauaacuauucucaaucu

SEQ ID NO: 4133641 - RNA, 95 nt, Human
agagcauacacauccauguuguaauguuccucauugacacauaauuuuaauuauaaggaaggaacaauuaacgacaauggacuuugaacuguucu

SEQ ID NO: 4133642 - RNA, 70 nt, Human
agagcaugaauuguguaguugaaggauuugucuuaucaauuuaguacuaauuauacaauugucaaguucu

SEQ ID NO: 4133643 - RNA, 83 nt, Human
agagcaugcgguguccuggaagaagcuacaagcggugagugauagccucucuccagcugaggccuucuucccaucacaacucu

SEQ ID NO: 4133644 - RNA, 63 nt, Human
agagcauggucaggggccuugggugagaguccugcagcucuggcuggcucucugacgugcuuu

SEQ ID NO: 4133645 - RNA, 62 nt, Human
agagccaaccccgugaagaucugaaagaacuuccuaucagaggacgcacuaggguugucucu

SEQ ID NO: 4133646 - RNA, 105 nt, Human
agagccucuccugcaugcugcaccagagccucuccugcaugcugcaccagagccucuccugcaugcugcaccagagccucuccugcaugcugcaccagagccucu

SEQ ID NO: 4133647 - RNA, 59 nt, Human
agagccugagccugaaagcccucagaccuccugacacugaagcacagagcccaggcucu

SEQ ID NO: 4133648 - RNA, 67 nt, Human
agagccugucaauuguaaagaggagaaaagaaaagaaugggcucucucugggcacuguauggguucu

SEQ ID NO: 4133649 - RNA, 73 nt, Human
agagccugugccccguccccaucccagcuuggggggccccggccuccagcuggggacaugggcuucaggcucu

SEQ ID NO: 4133650 - RNA, 79 nt, Human
agagccuucucggcgcggagcauucccagggacccuuccaggccccgaccccugggacccgcugcagaggcagggcuuu

SEQ ID NO: 4133651 - RNA, 124 nt, Human
agagccuuuauuauacuuguuuguaucguacaaaaggauguuuucaugaaacauccuuucggauuaguguuucaugaaacauguuuagggauaugcugaauuaacauaaauaaaacaagguucu

SEQ ID NO: 4133652 - RNA, 69 nt, Human
agagcgaaacacuuugggaauggggcguuuucguaacgucauuuauuuagucuagaugaauuuugcucu

SEQ ID NO: 4133653 - RNA, 60 nt, Human
agagcggggauaguuaauauuccauuuuaugcuguguucuuuuagacuaaccccaacucu

SEQ ID NO: 4133654 - RNA, 56 nt, Human
agagcuaaucacaggagaugcuccagaaugccuaaaguaucauaaugaauaguucu

SEQ ID NO: 4133655 - RNA, 74 nt, Human
agagcuagaaguacagccauaugacguuacaacuaaguucucuguauuuucuguggugauuucuaauaugcuuu

SEQ ID NO: 4133656 - RNA, 61 nt, Human
agagcuaggaccagagugaacguuggucucuaaauuagcagcuuucuggucucuacacucu

SEQ ID NO: 4133657 - RNA, 62 nt, Human
agagcucagggcuccaggaccgcucagauccuccuuccagggccccaauagcccuuggcucu

SEQ ID NO: 4133658 - RNA, 60 nt, Human
aggcccuguuguagcauuuugguuucgcaguugcuuuggaaugcugccaggacagggccu

SEQ ID NO: 4133659 - RNA, 82 nt, Human
aggccuaaugagucauuuuaauccuguuacucugguaauuuucuauuauggguauaacacaguuauuuccuuaguggugccu

SEQ ID NO: 4133660 - RNA, 70 nt, Human
aggccucaccccucugcuucccgugucuguggcuucguguccagcagugagcacggccagaggggagccu

SEQ ID NO: 4133661 - RNA, 56 nt, Human
aggccucugcuggaaagaguugaaauacugccagcaacucaaaucacuagaggcuu

SEQ ID NO: 4133662 - RNA, 59 nt, Human
aggccugaaggaagaugagcugauggcauucccagcuuacuaccacuccuugggggccu

SEQ ID NO: 4133663 - RNA, 112 nt, Human
aggccugauguuauuggcaaaaguaaagcauggcauaguuugacuuugaggacuuuaaaagugcuucaaagggucacuauuuaucaacuuauuugcugacuuaucuuggcuu

SEQ ID NO: 4133664 - RNA, 56 nt, Human
aggccugccuugagcaaccagcuuggauaguccugcugugugcugggcauggcacu

SEQ ID NO: 4133665 - RNA, 89 nt, Human
aggccugugcaauccauauaggcagauggcacagaagagcccuacagugugccugguacugccuaagguguggcuuguaagccaggccu

SEQ ID NO: 4133666 - RNA, 73 nt, Human
aggccuuaaugacaucauaggugaagucauaguugacucuucucuuuccuuccugggaugucauuggcugccu

SEQ ID NO: 4133667 - RNA, 69 nt, Human
aggccuugagagaguuggaagggcuagcuacaaccaugguguucugcccaccacacuuuaucugacccu

SEQ ID NO: 4133668 - RNA, 64 nt, Human
aggccuuuguacaauaaucauaguauccuaaaacuuccccaauaguaugagcugacaaaggccu

SEQ ID NO: 4133669 - RNA, 66 nt, Human
aggccuuuuugcaguagacaucuuauuuuccacuuuuaagaccaagauuuuuguugcaauaggccu

SEQ ID NO: 4133670 - RNA, 90 nt, Human
aggcgggcggccccgcggugcauugcuguugcauugcacgugugugaggcgggugcagugccucggcagugcagcccggagccggccccu

SEQ ID NO: 4133671 - RNA, 108 nt, Human
aggcgggcggcgggugggcugcggcccuggggcuggggccgggccgcgugcaccuugcugaggcccaccuuggccccggcucccacugcagcucaggccgcuccuccu

SEQ ID NO: 4133672 - RNA, 74 nt, Human
aggcgggggacaggccugagacaucugagauaauaaagacaugauugucucagcccuggggcuugucuccccuu

SEQ ID NO: 4133673 - RNA, 59 nt, Human
aggcggguugugcuaauugcuugcuguuuuuccuacaagcagaaccugcagaccugucu

SEQ ID NO: 4133674 - RNA, 72 nt, Human
aggcgugguggcugagaaugggaugaugccagguucacaucugugcucuuccacgucgcagcuguacgaccu

SEQ ID NO: 4133675 - RNA, 64 nt, Human
aggcuaaugugcaggcucaaaccuuguaauuuaaaaaggacacggguauggcugcacauuguuu

SEQ ID NO: 4133676 - RNA, 79 nt, Human
aggcuagaaguucaagaucaagguguggcaggguugguuucuucugaggccucucuccuuggcuugcagucuucucccu

SEQ ID NO: 4133677 - RNA, 59 nt, Human
aggcuaggccuugagcuuaaaacucuucaccaacuguuuauacccuccauaccuggccu

SEQ ID NO: 4133678 - RNA, 57 nt, Human
aggcuagucaagucaagcagugggaguaaagaaacaccacugcacuugugccagccu

SEQ ID NO: 4133679 - RNA, 62 nt, Human
aggcuaucagauagaaugaagguagaguaaaacuuuuccuuaacuuuaauaucugagagucu

SEQ ID NO: 4133680 - RNA, 129 nt, Human
aggcuaugaucucucggaguaguggggaaagcaguccuucccuuaaggucaccucuuuuugaucuggucaccuuuuuccaaugagggaaguaaucagacugcauugcuaguguccuagagcaugaacuu

SEQ ID NO: 4133681 - RNA, 78 nt, Human
aggcuaugcuaagauaauguauggggaagcacuaugaaauuugacauuaaggugacauuaucauuauuuuaaaugccu

SEQ ID NO: 4133682 - RNA, 60 nt, Human
aggcuaugguggggccaguggcaugggaggcaucaucgccaucauggucaaccagagccu

SEQ ID NO: 4133683 - RNA, 91 nt, Human
aggcucagaaaauuuaaguagaaaguccagugaaauagaaugcaaguggugaaauugaauucguacacaggauugcagaucuucagagccu

SEQ ID NO: 4133684 - RNA, 81 nt, Human
aggcucagaaauggcagauggagagauguaccuucuugaacuuauuuuucuaacuuaccugcuguuauuuuguucuguccu

SEQ ID NO: 4133685 - RNA, 61 nt, Human
aggcucagaggccugaaagaauuuggcauuuuaggggaauggccagagguuugcugggccu

SEQ ID NO: 4133686 - RNA, 69 nt, Human
aggcucagucuguucaugcacugguguguauuaauucaguccauucauagucaugagcugacugugccu

SEQ ID NO: 4133687 - RNA, 58 nt, Human
aggcuccagcccaaggcugcaggacuggaagccacaguccagcaugggcgggaagccu

SEQ ID NO: 4133688 - RNA, 56 nt, Human
aggcuccugcaggugaggugcuccauguugagcagcccuagaauccugcacagucu

SEQ ID NO: 4133689 - RNA, 57 nt, Human
aggcucuuugagacuaccuggaguccuugucaccacagguacaggucuugugagucu

SEQ ID NO: 4133690 - RNA, 72 nt, Human
aggcugaacgguggcugagaggacgucgggcucagagacccuggcccaccagacccucggcauucccagccu

SEQ ID NO: 4133691 - RNA, 57 nt, Human
aggcugacuucuaguaaagaccuggaccuuccuauggucagcucuuagaggucgcuu

SEQ ID NO: 4133692 - RNA, 58 nt, Human
aggcugagaaagugggaagauggacaugucugagguuuucuugaacuuucuucagccu

SEQ ID NO: 4133693 - RNA, 75 nt, Human
aggcugaggauuuggcagugaagggaucacagauccaugaagguguggucuccccagugccagcucucugggccu

SEQ ID NO: 4133694 - RNA, 60 nt, Human
aggcugaggcuuuccuuggagaaagaagagauucuugcuuguggacaguagcuucagccu

SEQ ID NO: 4133695 - RNA, 68 nt, Human
aggcugccuuguggcagguggauggugccccucgagaugggcagggcaccaucuggccacacgugccu

SEQ ID NO: 4133696 - RNA, 64 nt, Human
aggcuggacccgacaccugcccacgagaagcagcauaccugggacuggagggacuuccuggccu

SEQ ID NO: 4133697 - RNA, 72 nt, Human
agauugagaaaucggaugguugccgugucuguguagaaagagguagacaugggagacuuuucauuuuguucu

SEQ ID NO: 4133698 - RNA, 72 nt, Human
agauugagaaaucggaugguugccgugucuguguggaaaguaguagacaugggagacuuuucauuuuguucu

SEQ ID NO: 4133699 - RNA, 76 nt, Human
agauugcaaaguugcuaauaaaguuuuuaugugguaacaaugccacuuguagaacuuguauuguaaccucaaaucu

SEQ ID NO: 4133700 - RNA, 63 nt, Human
agauugcuucauguccuuugccggcagucccuaagauucagcgaagucagaugugagguuucu

SEQ ID NO: 4133701 - RNA, 86 nt, Human
agauuguagagaguuuguguaacaugaugaugaugaugauguaaggauuuguaucucuuaugucacauaaaccauaaauacgguuu

SEQ ID NO: 4133702 - RNA, 130 nt, Human
agauugugccauuaauugagggagcauauauaaagaggaguacauuuaagagggaauauggugaauucagauuugaauauuccuuucggauaugcacaguuuuucccaaaauaaaaaaauggcccaaguu

SEQ ID NO: 4133703 - RNA, 83 nt, Human
agauuuauugcugcagagaugggugcccuuuuuguagcaugacuuuuauggaaagggcaguuuucuuugcauuaaguuugucu

SEQ ID NO: 4133704 - RNA, 59 nt, Human
agauuucccaaauacuuguuaucuacuuaaaguuuauagcaaaguuguuugggaaauuu

SEQ ID NO: 4133705 - RNA, 130 nt, Human
agauuucuugaagugcuaagggaauagcucaaaauguaagauggaagcucccaaucaggucuguguucccuggauuucuccagcucuccauuuaaauucuugauccuuaaaacaauacauuuuaaaaucu

SEQ ID NO: 4133706 - RNA, 68 nt, Human
agauuugagucucugcacaguaagaagcaguggugggagacuguuuucagaugcagggacacagaacu

SEQ ID NO: 4133707 - RNA, 62 nt, Human
agauuuguguuguuuuaagcuguuaaguuugcaguaacuuguuacagcagcaauagaaaacu

SEQ ID NO: 4133708 - RNA, 82 nt, Human
agauuuuaaauuacuucaguuacguuccuagggacacuauuaacucaggaugauguuaauugaaguuucagauuugauauuu

SEQ ID NO: 4133709 - RNA, 67 nt, Human
agauuuucauuuugcagggugagaucaugaguucugauucucaacuaauggugcaagaugagguucu

SEQ ID NO: 4133710 - RNA, 67 nt, Human
agauuuuggcuggcuggagagaaguauuccuguauuugguucucaacucagcucagcucaugagucu

SEQ ID NO: 4133711 - RNA, 76 nt, Human
agcaaacaagauuuggcauucugaggagucuaauuaucucuccaagaagacuuagcagaauuccaagcuugaaguu

SEQ ID NO: 4133712 - RNA, 77 nt, Human
agcaaaccuuugggaauagcagggacugagcuuuagaugauggcucugaacugcugguuuccaaccacuagggugcu

SEQ ID NO: 4133713 - RNA, 57 nt, Human
agcaaagacugggacugcagcaggcaaugccuuugcccucgcaaccuauucuuuccu

SEQ ID NO: 4133714 - RNA, 64 nt, Human
agcaaagggacauguucuggcaaugguacacacagccuacuucuagccaggacauccuccugcu

SEQ ID NO: 4133715 - RNA, 97 nt, Human
agcaaagguuggcgggcaccugugucagccccugccuccacuccaccccuaacaaguaucaggugcccacacgggccugcugcucgccuccugggcu

SEQ ID NO: 4133716 - RNA, 70 nt, Human
agcaaauguuuccguuaaacaaauguguauuuuauuugaaacagaugaaaucauaacaguuuggcuugcu

SEQ ID NO: 4133717 - RNA, 62 nt, Human
agcaaauucucacagaggcuugggcucaugaaacaaccaagaguaagaaccuugagauugcu

SEQ ID NO: 4133718 - RNA, 62 nt, Human
agcaaauuguugaucuacaguaagggcugagcagagcagauccuugagaacaucaauuugcu

SEQ ID NO: 4133719 - RNA, 82 nt, Human
agcaacacagcugcggggauccuaagguuuccugaguucuaaccucgggccaggcugcugggaccccgccgcugcugggguu

SEQ ID NO: 4133720 - RNA, 59 nt, Human
agcaacaggguggucuucagaauggugagaacacaucacacuggacacacucuauugcu

SEQ ID NO: 4133721 - RNA, 66 nt, Human
agcaagaagcuuugcugugauacauuuaauuugacauacaaguaauuacagcagaaauguuuugcu

SEQ ID NO: 4133722 - RNA, 58 nt, Human
agcaagacugugaauaguuugcauuuacaauuccuguguacacaaccuacagucugcu

SEQ ID NO: 4133723 - RNA, 63 nt, Human
agcaagccaaggggaaaguccucaggagggacaacccugcugacaacuugauuuugaacugcu

SEQ ID NO: 4133724 - RNA, 69 nt, Human
agcaaggaaaguaggcacggaagcucccagguaugugccaagagugccaccuggccuguguccugugcu

SEQ ID NO: 4133725 - RNA, 65 nt, Human
agcaaggauauuacagggcuaguuaugaguuuccaggcuuuaggacaguccuguaaacauuugcu

SEQ ID NO: 4133726 - RNA, 63 nt, Human
agcaaggcauuuuuguuaaucuuuggagugaucagaagguuugaaagaugucuuaauccugcu

SEQ ID NO: 4133727 - RNA, 69 nt, Human
agcaaggccgcccuuuuugugaagacaaacgugcacgaacacaaaagguccaaaaaggagcguccuucu

SEQ ID NO: 4133728 - RNA, 59 nt, Human
agcaagggcaucaccugggagcuuguuagaaaugcaggaucucaggcccccuccuugcu

SEQ ID NO: 4133729 - RNA, 72 nt, Human
agcaagggcugcuuuguggaaucacacuggagucuucaugaagcuguguguuuacuuauaaaguuccuagcu

SEQ ID NO: 4133730 - RNA, 71 nt, Human
agcaagguaaugucuccagaagccuagacagccaaugugagcauauuuaaggcuucugagucacauuuguu

SEQ ID NO: 4133731 - RNA, 75 nt, Human
agcaaggugucacugguugggagcacagacacugcaggaagacuguccuguucaagcccagcuugaccaccugcu

SEQ ID NO: 4133732 - RNA, 59 nt, Human
agcaagguuuuggucaucccucaggcgaucacaugauucugggagccagacccuuugcu

SEQ ID NO: 4133733 - RNA, 56 nt, Human
agcaaguaguaccaaguagcucaugaacuguugggcaggucucucagcugcuugcu

SEQ ID NO: 4133734 - RNA, 89 nt, Human
agcaagucaacacagauggaguuuagcauccccagcccuggaguuuccacucaguucuugggcugcuaggacccugcauugugcuuguu

SEQ ID NO: 4133735 - RNA, 67 nt, Human
agccugacaggauaguaggaagaucuuuauucaacuuuacagacucuguugaacuauuuugggggcu

SEQ ID NO: 4133736 - RNA, 62 nt, Human
agccugacaucaauauucugcagggauaccugauauuccuaggaauuagggauggaagggcu

SEQ ID NO: 4133737 - RNA, 73 nt, Human
agccugcacagccgcuuuguggagcugagcgaggcauaccgugugcucagccgugagcagagccgccgcagcu

SEQ ID NO: 4133738 - RNA, 85 nt, Human
agccuggccaacauggugaaaccccaucucuacuaaaaauacaaaaauuagcugggcaugguggcaggcaccuguaaucccagcu

SEQ ID NO: 4133739 - RNA, 57 nt, Human
agccuggcggucgucggucaggcaacaguacugcagcgugacuggguccgucuggcu

SEQ ID NO: 4133740 - RNA, 69 nt, Human
agccuggcucccugcaggaucggcuucaauucccugaugucuguccaacccugcagggcugccuagacu

SEQ ID NO: 4133741 - RNA, 67 nt, Human
agccuggggugaggccuugcugccaucaguucuccccaagcugcugccgggcuuuauccccaaagcu

SEQ ID NO: 4133742 - RNA, 63 nt, Human
agccuggguggggguucggagagccgggcacaccccgaguccuccugcacccucccuguggcu

SEQ ID NO: 4133743 - RNA, 67 nt, Human
agccuguucagggagacagacuaaacuaccaugguaacaguguggacuuuuccuaggagguuaggcu

SEQ ID NO: 4133744 - RNA, 90 nt, Human
agccuguuuuagcauguccucuuaaugaccuuaauucaagauaucacuuugaguuuugaaccuuauaauaggagauggcuccuacaggcu

SEQ ID NO: 4133745 - RNA, 73 nt, Human
agccuguuuuuugcccugaccccaaccacuccucuuuggagaggagagcuggugucuggaaucuggaugggcu

SEQ ID NO: 4133746 - RNA, 86 nt, Human
agccuucaagagucuucagugaugagaaugauuugccuaggagccaaagccuuagucauucuccuuacaaagccuaugugacagcu

SEQ ID NO: 4133747 - RNA, 61 nt, Human
agccuuugcuggccacugggcaggaccuagcugggagcaagugccagggccagcagaggcu

SEQ ID NO: 4133748 - RNA, 59 nt, Human
agccuuuucaucuucucugagcaugugccuauagccaguguugagcagaugcaaagguu

SEQ ID NO: 4133749 - RNA, 96 nt, Human
agccuuuugcugucguucauuaaggguuuagcagcuugguauugauuuucuugcagcugccucugaacuuuaauuccugcagcagaaaacaaggcu

SEQ ID NO: 4133750 - RNA, 64 nt, Human
agcgagugagggccaacauccagcuucagcagggaggagaggcuggccagggcccucgcuggcu

SEQ ID NO: 4133751 - RNA, 67 nt, Human
agcgcagcuuugucacggagugucggcugacaccguuucuguuuggcacucugcugugaucugugcu

SEQ ID NO: 4133752 - RNA, 110 nt, Human
agcgccuggcgggcaggaggaaggagggcgucggagcuggucaguuucagggccagauuacacguggauggcagagacaaggccgggccucgccccugcaccccggggcu

SEQ ID NO: 4133753 - RNA, 59 nt, Human
agcgccuggggcuggccagaguggucugaaacccaacccagcuggccuguccuaggccu

SEQ ID NO: 4133754 - RNA, 82 nt, Human
agcgcuggguuguggccugggcuagggggccaagagggccgagucuaaggugguuugccugcccacgacuacagcaggggcu

SEQ ID NO: 4133755 - RNA, 70 nt, Human
agcggaaugaaauccagucauuuccauuguucccaggcuuuuuucuugcuacagcugacugucauucccu

SEQ ID NO: 4133756 - RNA, 61 nt, Human
agcggccaacguccugcugucugagcacugcgaggugaagcugguggacuuuggcauggcu

SEQ ID NO: 4133757 - RNA, 80 nt, Human
agcggcgagggagcgccuuugccuaccaggccggagaacccuguucuucagucgccuuggcaggggcagccccuccuucu

SEQ ID NO: 4133758 - RNA, 78 nt, Human
agcagaagugggaucacacugccucccugucuucagcuccaccaggacccuugggccugcagugcuggugccucugcu

SEQ ID NO: 4133759 - RNA, 92 nt, Human
agcagacaaaguuaaaucuucuuugaaagugguaucuacuauuaucuuuaucaugccucagucuuaaggaaagauuagcauuuguaacugcu

SEQ ID NO: 4133760 - RNA, 64 nt, Human
agcagacaccaggaguaaagaauaugugaaaccauagugcuuucaguggucuuggcugauuguu

SEQ ID NO: 4133761 - RNA, 103 nt, Human
agcagaccaacuuuguuguaaauauuuagauaaaaaugggcuuuagagcagccacaucugaagacccacaaggcugaauguuacacaggguauguauucugcu

SEQ ID NO: 4133762 - RNA, 128 nt, Human
agcagagagacgagggaaagaaggaguguucagggguaguuauguauugggaaauccaagccuuuguguggguaucuccuaguucauauggaacccaagaauucucaacuauucucgaggacucugcu

SEQ ID NO: 4133763 - RNA, 76 nt, Human
agcagagcccuggcagcgugagcagcauccaccugcagaggcacuugggaguguaugcucgaccugcaccucuguu

SEQ ID NO: 4133764 - RNA, 114 nt, Human
agcagaggaaauucgagguaucggcuuucaguauaaaaucaaagugauguguuucagaacagauuuugacguugacaugacuuucuaguugacuuuuuuaguauuccucuugcu

SEQ ID NO: 4133765 - RNA, 67 nt, Human
agcagagguagaaggcaugcagugagacauggugaugguguacuauugucuccuucaacuucuuguu

SEQ ID NO: 4133766 - RNA, 57 nt, Human
agcagagguuuguuggaaaccugaauucuaucagucauuucaaacugcaccuuugcu

SEQ ID NO: 4133767 - RNA, 62 nt, Human
agcagagucugguaggugcuggugaagcucaugacagcccacucaucaugugcugagcugcu

SEQ ID NO: 4133768 - RNA, 78 nt, Human
agcagaucccagaaauauuucucagaggaggugaugaaguguuaaacgcagcagggcuuuccugagaagugauuugcu

SEQ ID NO: 4133769 - RNA, 68 nt, Human
agcagaucuggcaguauuaagagaagugacucauacaacaggagucacggcuaaacuucaggucuccu

SEQ ID NO: 4133770 - RNA, 61 nt, Human
agcagaugcauuaugauugaaaagcucuuggcacagaguccugcacucaugaagcacugcu

SEQ ID NO: 4133771 - RNA, 62 nt, Human
agcagcaaagccaggggauggggauggauggccggggccagcccucacuccuggguuucucu

SEQ ID NO: 4133772 - RNA, 61 nt, Human
agcagcaaggaacagaauggacaugccuauuaagccugccuucucugcucuuaugcaugcu

SEQ ID NO: 4133773 - RNA, 65 nt, Human
agcagcagagccuggcgaugucauggaauauuccuuccuuucuuccauuccccgagcucugugcu

SEQ ID NO: 4133774 - RNA, 55 nt, Human
agcagcagcucaguucucagcuggagcagagccagagaaccuugagcugugagcu

SEQ ID NO: 4133775 - RNA, 56 nt, Human
agcagcagcucauucuuccuguagucucucacccagguggaucuugguaggcugcu

SEQ ID NO: 4133776 - RNA, 79 nt, Human
agcagcagcuuucaacuugaguuuuugugauggaacaauaguuaacuauggcuuucaaaggaacucggaggcagcuccu

SEQ ID NO: 4133777 - RNA, 66 nt, Human
agcagccacacgccuccuucucccucccuguuaauccccaccgaaagcaggcuugguguggccgcu

SEQ ID NO: 4133778 - RNA, 69 nt, Human
agcagccaggguuaauuauauuuaacugguauguuagauaaauaaaaaguuuaacuccugguaacugcu

SEQ ID NO: 4133779 - RNA, 80 nt, Human
agcagccuagaaaagagacuucuagauuuguugaaugaaugaaugcuuggauaucaacacaucgaggugcucuggcugcu

SEQ ID NO: 4133780 - RNA, 59 nt, Human
agcagccuggacuuggauguggugugaaaguggucuugcauuacucaagcugugcugcu

SEQ ID NO: 4133781 - RNA, 65 nt, Human
agcagccuuccucacuccccuaguaauaaggcaacuuguucugggccuccuaggacaggcauguu

SEQ ID NO: 4133782 - RNA, 56 nt, Human
agcagcugccagagagaguuccuuucaaaaaguuccugacucugucuugugcugcu

SEQ ID NO: 4133783 - RNA, 61 nt, Human
agcagcuggugagcaagcucagugucacccccuagugugaacugugccguucaccucugcu

SEQ ID NO: 4133784 - RNA, 61 nt, Human
agcaggaacugacaccaagccaggccccaaggaggccugugaguguggccaguucccugcu

SEQ ID NO: 4133785 - RNA, 74 nt, Human
agcaggaaggggccuagccuggauuaaagcugcagcuugugugacucuuccuacagcugugccucucuccugcu

SEQ ID NO: 4133786 - RNA, 96 nt, Human
agcaggagguaagaaaaauggauggacaguuggaaaggugugaggggauagccuucacuagucaucaacuuccauucuauuguguuuucuuuuguu

SEQ ID NO: 4133787 - RNA, 60 nt, Human
agcaggaugguggaaggccugcucagaagccaucugcagcuuucuuuucccccaccugcu

SEQ ID NO: 4133788 - RNA, 61 nt, Human
agcaggcacuaugccaggaucuagugauagaaggguaaaugaaauuggcauugugucugcu

SEQ ID NO: 4133789 - RNA, 59 nt, Human
agcaggcguggacuggacugugacucucugcuuacuuaucaucuggucuggggccugcu

SEQ ID NO: 4133790 - RNA, 68 nt, Human
agcagggccagggcuauggugaagugugggaggugcccaguccccuucacugcagucauggcucuguu

SEQ ID NO: 4133791 - RNA, 59 nt, Human
agcagggcucacuacaacccugggacuccucagggacuccugggucugugagccauacu

SEQ ID NO: 4133792 - RNA, 69 nt, Human
agcagggggaguuagacuagaugauauuuuggguuccuuuuaucuuacgauuuaccugacuuucccucu

SEQ ID NO: 4133793 - RNA, 71 nt, Human
agcaggugacagggcuguggugaagggcaaaggagaaucauuccaauuaugucccauagcuuuuacuuguu

SEQ ID NO: 4133794 - RNA, 96 nt, Human
agcaggugucuauuugaaaacuuucuagaccaagaggaccaggcuaguacaaggccuuuagguuucucagagggucccuuggaguaggcauuugcu

SEQ ID NO: 4133795 - RNA, 57 nt, Human
agcagguguuagggauccaaugaggucuguuggacaaaugauucauaaauaucuguu

SEQ ID NO: 4133796 - RNA, 59 nt, Human
agcagguuuguuuucuucugaggccucucuccuuggcuugcagauggcugcugcuugcu

SEQ ID NO: 4133797 - RNA, 102 nt, Human
agcaguagaaucuagggacaaauggucacuggugagugucauugcuggaguuaaaugagacucauuaguggcuguuaugauuuccacucuuacuucauugcu

SEQ ID NO: 4133798 - RNA, 58 nt, Human
agcaguaggucaccugagacuuugcauaucuaaugugcucccaggugacgcugcuguu

SEQ ID NO: 4133799 - RNA, 63 nt, Human
agcaguaugaaaauuagcaaguuucauguuuuaaaagagacaauaugaacuuuuccugcugcu

SEQ ID NO: 4133800 - RNA, 67 nt, Human
agcagucauuggcuaaagcucccucuacaauauguaguaccaccuggggaugcugccagugguuguu

SEQ ID NO: 4133801 - RNA, 72 nt, Human
agcaguccgcuuaaggcagauguggaaucaauuugggcaaaugcaaguugccagcgucuguacuuuucugcu

SEQ ID NO: 4133802 - RNA, 59 nt, Human
agcaguccuccaguguguuuuagaauccuauucauugcugacacugggagaagacugcu

SEQ ID NO: 4133803 - RNA, 61 nt, Human
agcagugaguaacacagaccagccccugcuaucaugaagccuuuuccuuguugccgcugcu

SEQ ID NO: 4133804 - RNA, 69 nt, Human
agcagugcugccauagucauggguauccacaggguuaaaggucucaagacugaucgcaguggaacugcu

SEQ ID NO: 4133805 - RNA, 62 nt, Human
agcagugggugguuuuugagcaggggagugaccuaagauuugugcuuuagaacaaucacucu

SEQ ID NO: 4133806 - RNA, 89 nt, Human
agcagugucgugguagguuggcaagugccggcugcaaaacccuccuccuuugcugcagguggauauugcuacuugaucacagcacuguu

SEQ ID NO: 4133807 - RNA, 59 nt, Human
agcaguguucaaugauacacugcaauauaucacugcaagcaguguaucauugaacuguu

SEQ ID NO: 4133808 - RNA, 80 nt, Human
agcaguuggcaguagugguaguacauucucuuaacuuucagguucuguuaaaagaaguaaguuucucucuccaagauguu

SEQ ID NO: 4133809 - RNA, 81 nt, Human
agcaguugugaagcuuccugggucagccuggagguauuucagaucugcuacuaggaagauuccaggauuuuaacagcugcu

SEQ ID NO: 4133810 - RNA, 72 nt, Human
agcauaaguuuggaugguauccaccaggaggaaaaugcuuuauaauugguaaauacuauaaucaaauauguu

SEQ ID NO: 4133811 - RNA, 60 nt, Human
agcauaauauugaagagccuuggccacggagucaggcuaccuaaguucucaauauuggcu

SEQ ID NO: 4133812 - RNA, 84 nt, Human
aggaaggcaucagaggaccuaguugggcaggggccuggggaaguagaccugcuugaaugacuagcuccugcuggccuagcuccu

SEQ ID NO: 4133813 - RNA, 62 nt, Human
aggaaggcggacaguaaggaauaggcuagcagaaaaagucuucaggcucuggcugccuuuuu

SEQ ID NO: 4133814 - RNA, 69 nt, Human
aggaaggcuaagggaugacuggaguggcaguuucaggcccuaccaaagucuccauuagccaacuuuccu

SEQ ID NO: 4133815 - RNA, 73 nt, Human
aggaaggcuccagcucguggcucccagccagguccugagacuucaguugugaaagcugagcuggggccucccu

SEQ ID NO: 4133816 - RNA, 56 nt, Human
aggaaggcugaucacugcuuguucuucuuuucacauggcagcaaagaggccuucuu

SEQ ID NO: 4133817 - RNA, 126 nt, Human
aggaagggccuugggaaaggagauuuauguucugcaaaacagugccaaggacaccuauuacuggcaggugugaggacuucuagugguacugugaacaccaacaaaucacuuucugagggacuuccu

SEQ ID NO: 4133818 - RNA, 57 nt, Human
aggaaggugcaguagggugugccgggacuuaguuaaccuggcacucccccaccuccu

SEQ ID NO: 4133819 - RNA, 74 nt, Human
aggcuggaccgguuguuacaacaauuuuuuccgucuagaauucggcgguaaggucugagacaacaccucagcuu

SEQ ID NO: 4133820 - RNA, 79 nt, Human
aggcuggagugcaauggcgugaucucggcucacuacaaccuccacuucccggguucaagcaauucuccugccucagccu

SEQ ID NO: 4133821 - RNA, 71 nt, Human
aggcuggagugcaggcuuggcucacugcaaccuccaccucccggguucaagcaauucuccugccucagccu

SEQ ID NO: 4133822 - RNA, 73 nt, Human
aggcuggagugcaguggcgugaucucggcucacugcaagcucugcgucccggguucacgccauucuccugccu

SEQ ID NO: 4133823 - RNA, 55 nt, Human
aggcuggagugcaguugcaugaucauagcccacugcagccucaaacuccuggccu

SEQ ID NO: 4133824 - RNA, 63 nt, Human
aggcuggauuuccaaaccuccagcuucccaaucuaucagcugcagagggacugaagccagcuu

SEQ ID NO: 4133825 - RNA, 56 nt, Human
aggcuggcuggggaugcgucuucaugucgucucagggcacauccuaggguuagcuu

SEQ ID NO: 4133826 - RNA, 59 nt, Human
aggcuggcuuugguagcaugguacagcagucacaucucucuaaguuccaaagucaguuu

SEQ ID NO: 4133827 - RNA, 129 nt, Human
aggcugggcuccaagccugcuccuggaccugcccugcuuuuucuggccacacccagcucuuaggaccucagcuggcaggaagacguggggcaccaucugagggcaggacacuccuuugguccccucccu

SEQ ID NO: 4133828 - RNA, 63 nt, Human
aggcuggucuguuggcauuuuuacuggacacauuguucacucaaaauaucagcacaucagccu

SEQ ID NO: 4133829 - RNA, 70 nt, Human
aggcuguacauaccugaaagcaggaauuauacuucuaaauuuucuaugcuuaucguuuaguacauugccu

SEQ ID NO: 4133830 - RNA, 57 nt, Human
aggcuguccaagguggcgaagucaguggcaagacugggucaugaacucagggcaccu

SEQ ID NO: 4133831 - RNA, 71 nt, Human
aggcugugaccaaggaggaauuucagggugaauggacugcucuagcuccugaguucacugcuacucagccu

SEQ ID NO: 4133832 - RNA, 56 nt, Human
aggcugugagaaguccuucaguaaagaaacugauuuaacuuucucucaucuagcuu

SEQ ID NO: 4133833 - RNA, 57 nt, Human
aggcugugaggcggaaaggacucucccucgcucagggcagggucagccuuucagucu

SEQ ID NO: 4133834 - RNA, 79 nt, Human
aggcuuauaggaaauuuaucuccuggguuguaauagaacacuguguaaucccaggaaauauguuucuuaacuauagccu

SEQ ID NO: 4133835 - RNA, 56 nt, Human
aggcuucaccugcaccugagcuauggacaaaauauguuugagugcuacagaggcuu

SEQ ID NO: 4133836 - RNA, 63 nt, Human
aggcuuccgaguagcugggacuacaggugugcaccaccaugcccagcuaauuuuugaauguuu

SEQ ID NO: 4133837 - RNA, 75 nt, Human
aggcuucuaggaaacuuucuggcuguggugggugggaaguggaauaggacagcaacagaguuauccuaaaagucu

SEQ ID NO: 4133838 - RNA, 60 nt, Human
aggcuucugguacucucucuagggccuguucucauucucuucagugauugcagaaagccu

SEQ ID NO: 4133839 - RNA, 56 nt, Human
aggcuuggaaaauuuacaguguuuccuccagggacuagcuagugaaugccagggcu

SEQ ID NO: 4133840 - RNA, 71 nt, Human
aggcuuggcucagcugggacuguugagcaaagggccugcacauggccucuccagccuagcagaucaaggcu

SEQ ID NO: 4133841 - RNA, 101 nt, Human
aggcuuggggaaucuggaacuugccugcuaaauaaggucgugguggacucucagccauugggcaggucuaucaggcugcagguuccuacacacccacgccu

SEQ ID NO: 4133842 - RNA, 89 nt, Human
aggcuuuggcaggacucugugcagggucuuagacauuauacuugugcccucagcccugugcuaagcacccucaccccccaccaaggccu

SEQ ID NO: 4133843 - RNA, 76 nt, Human
agggaaaagagcuccuggaccuuggacaaauacauuucuaaaaaagguuuaggauauuaauguucagaguuucccu

SEQ ID NO: 4133844 - RNA, 62 nt, Human
agggaaagaaacaggaaguuaagguaggaaaguuaucuucaucugcuucuugauuuugcccu

SEQ ID NO: 4133845 - RNA, 74 nt, Human
agggaaagacugcaaaaacgcacagauaauuguugauaaucucagcuuucugcugacuuuuugcuucuuucuuu

SEQ ID NO: 4133846 - RNA, 68 nt, Human
agggaaaggaaguagaucuauucaugguugcccuuuagggcucaaugagguuuuacugccauuuuccu

SEQ ID NO: 4133847 - RNA, 57 nt, Human
agggaaagggaaaggauggguguugcaccucagcugucaucuuacaguccuuucuuu

SEQ ID NO: 4133848 - RNA, 70 nt, Human
agggaaaguuuacaugaaggguugacauuucacauuuagcauguuguuuaauuuuucaugagccaacccu

SEQ ID NO: 4133849 - RNA, 98 nt, Human
agggaacaagaugugaaggaacaguaugugagauuuacacaucaucacugcaugccauguuuaaauagaacauacugcauaacaucuuaacaugcccu

SEQ ID NO: 4133850 - RNA, 74 nt, Human
agggaacugcugauaguguuguaaauuauuauaauccuguagaaaggaauauggcaauauguaucaagaucucu

SEQ ID NO: 4133851 - RNA, 72 nt, Human
agggaagacauuuguaacacuugcacuuuuaaaaccauauuuauuaugcagcauugcaaagcagucuuuccu

SEQ ID NO: 4133852 - RNA, 65 nt, Human
agggaaggaaaagcugucgcuuugcuccauuaauucccacaauuaacgacagcaaaucugucccu

SEQ ID NO: 4133853 - RNA, 70 nt, Human
agggaagggaguuucaauuauauuauuauguauguuccaagcauuuuagaauauuggagcaaacuucucu

SEQ ID NO: 4133854 - RNA, 77 nt, Human
agggaagguggguaacuagcccagguuucugaugcugcuggugucugaaggcugaggcuguguuguuuucaaucccu

SEQ ID NO: 4133855 - RNA, 78 nt, Human
agggaagguuaaaugguuacuuuugguuguuuugaaguauuucuuugagaaaacugcagaguagccucagaccucccu

SEQ ID NO: 4133856 - RNA, 84 nt, Human
agggaaguucuuuauagcagugugaaaauggaccaauacacucccccaaauuucuucacacucuaugaucagaaauccuuuccu

SEQ ID NO: 4133857 - RNA, 68 nt, Human
agggaauaggaugagggguggccaaguaagaguuuaucuuucuuguagaauucuuauuugaauucuuu

SEQ ID NO: 4133858 - RNA, 62 nt, Human
agggaaugcuacauagauacaaaaaugaaaagcuucuuuuguaaugauauggagcaaucucu

SEQ ID NO: 4133859 - RNA, 62 nt, Human
agggaauggaugauggcagguuugucaauauuuuacacuuaugaaccugccuguucuucucu

SEQ ID NO: 4133860 - RNA, 69 nt, Human
agggaaugugaaacaguaagggaaguugaggguuuuuaccagccccauagucuccauugucacuucccu

SEQ ID NO: 4133861 - RNA, 92 nt, Human
agggaauuaauaaugugaaggcucuggaguaagagucugugaucuuggcucuaccacuuauuagcucuguggccuuggcaaguuaauugcuu

SEQ ID NO: 4133862 - RNA, 56 nt, Human
agggacacgagguccugcuggggcaccaguucagccaaggaccuacuugugugccu

SEQ ID NO: 4133863 - RNA, 59 nt, Human
agggacaggcccucuggucagcuuggcaucugccaucuggucagucaggcacugucucu

SEQ ID NO: 4133864 - RNA, 70 nt, Human
agggacauaaaucaggcagcguccugcuuccuguggccccagccaaggaggacaggaccugcccagcccu

SEQ ID NO: 4133865 - RNA, 71 nt, Human
agggacauaagugcacaauaaauauugagugaauuaauaaauacucauagcucaauugcauuuguuuccuu

SEQ ID NO: 4133866 - RNA, 66 nt, Human
agggacccagcccagaaucuggggccucuauacauugauuggguuccagagugggcugggaaaccu

SEQ ID NO: 4133867 - RNA, 71 nt, Human
agggacucucccacguucgacucuaagcggaaguacccgcucagggcuccggaaguggccucagagccccu

SEQ ID NO: 4133868 - RNA, 80 nt, Human
agggacugugucuugauguugacaauuucugauugccuuaccuauuaucuguuuucuccucaucaggacccucaguuuuu

SEQ ID NO: 4133869 - RNA, 80 nt, Human
agggagacugggaagugugcaauauugggcuggggacggaaucaaauucacacagcucagugaugccuucacagcuccuu

SEQ ID NO: 4133870 - RNA, 64 nt, Human
agggagagccucaggcccaggacagggcccagccaggccugacccagagguucugggccucccu

SEQ ID NO: 4133871 - RNA, 108 nt, Human
agggagagccuggugccagccuggaggaggcagguggaaagccuuagcgggcugccguuucuccucugcacucuccuggcucaccaggcuggaugccaggcccuccuu

SEQ ID NO: 4133872 - RNA, 71 nt, Human
agggagauucugguuaaacugaccuaaaaggauucuugcugaagguaggccaaguugaucagacauccucu

SEQ ID NO: 4133873 - RNA, 56 nt, Human
agggagcccacuuuaguuaggccagcagggcaggccugucugaggaggugcucuuu

SEQ ID NO: 4133874 - RNA, 55 nt, Human
agggagcuuuaccccagaucacauacagauuguguuugggaaaauauuguucucu

SEQ ID NO: 4133875 - RNA, 60 nt, Human
agggaggagcuguguguaagggccuuuccacagucccugcacacauauggcuucucuccu

SEQ ID NO: 4133876 - RNA, 57 nt, Human
agggagggaaguuuaggugagcagagccucuguccuucugucucagugucccuuccu

SEQ ID NO: 4133877 - RNA, 83 nt, Human
agggagggcuuuccagggcuagggagcccuccugggcuucucaagucugccugggcugcaguuccugguccugaaccuuccuu

SEQ ID NO: 4133878 - RNA, 65 nt, Human
agggaggggaggaggaacuauggagcuggguuggcaacucauuccuuuggacuccuccuugcucu

SEQ ID NO: 4133879 - RNA, 81 nt, Human
agggagguguuuugggcgaccgggggcaggacccuggcucucucagccccuggagccagcugcggucucccaaaguucccu

SEQ ID NO: 4133880 - RNA, 86 nt, Human
agggaguaacugggcuccacagcagugaguggaauggaaauaaaugacaguguucaacaaauggcuagucggagaggguuuuccuu

SEQ ID NO: 4133881 - RNA, 76 nt, Human
agggaguaauuggaggcuuuugaauaggagagugaugugaucagaacacuugaaugaaagagacuccuuugucccu

SEQ ID NO: 4133882 - RNA, 63 nt, Human
agggauauuuuuaggugaugcaggcccugcuaggcagaagccugaguuaaugagaauaguccu

SEQ ID NO: 4133883 - RNA, 88 nt, Human
agggaucuuuauuguaaaauuuuuagcccauuaaaguaaauuauaucuaacuggcuuaaauuuuaucaagggaauuuaugagaucucu

SEQ ID NO: 4133884 - RNA, 55 nt, Human
agggaugagaugaauauuuggggugaguuuacacuaaaguagucaucccauucuu

SEQ ID NO: 4133885 - RNA, 99 nt, Human
agggauguagauuuuaagaagaacaaagagaccaugagccaaacuugagugcccuuccuccagguguuuuuuugucaucuuaaucaaacuaagguuccu

SEQ ID NO: 4133886 - RNA, 76 nt, Human
agggauuaugaaguugagggacccugcacugggggcugggggcucucuuaggauccaucacacuuccauagucccu

SEQ ID NO: 4133887 - RNA, 64 nt, Human
agggauuauuacuagaaaaaucagacagcuccgcucacaauggggcuguccugguuuggucccu

SEQ ID NO: 4133888 - RNA, 87 nt, Human
agggcaaauccauaagaaauaaugaugaugacacuauaagacauuaaaaaguaaguuauccuccauuuucauuaagggauuugucuu

SEQ ID NO: 4133889 - RNA, 79 nt, Human
agcucuuguacauucucaauaguagaugaguaaauugggcuguuuacacacuaugauuugaagccuguauuauaaagcu

SEQ ID NO: 4133890 - RNA, 80 nt, Human
agcugaauaagcaggcaggaaugguggaacagauuaaacauuuaaaugccaccuguuuccugucgcucccauuacuagcu

SEQ ID NO: 4133891 - RNA, 65 nt, Human
agcugaauacacaguuacaugauucuugugagcuguagggcacauuaagaauaaugagacuagcu

SEQ ID NO: 4133892 - RNA, 66 nt, Human
agcugaaugccagcacuucugggccuccuagggccagagcuccucagcccagagggugcgucagcu

SEQ ID NO: 4133893 - RNA, 55 nt, Human
agcugacugagugacuugggaauguuuuaaaaauuucuuugagucucaguuugcu

SEQ ID NO: 4133894 - RNA, 82 nt, Human
agcugagaaaauuucaggaagugucagggucaagggguccuugggagggacuucaccuuuaccuucaccuuucuacucagcu

SEQ ID NO: 4133895 - RNA, 74 nt, Human
agcugagaaaccugaauaugcuucaaugacacaaaauuauuucuacugccaucuucagguguuuuccaucagcu

SEQ ID NO: 4133896 - RNA, 57 nt, Human
agcugagaauguuccuacugguaaguacaacacuuccaggacccucacauuuuugcu

SEQ ID NO: 4133897 - RNA, 91 nt, Human
agcugagcaacaucuauugaagguuugcuaggaucccuugcuuuaccucauguaaguuucauggcagcccuuuacuagagauacuuuaguu

SEQ ID NO: 4133898 - RNA, 57 nt, Human
agcugaggcauggacaggcugcucuccuaccaccugccaggccgcucuugcccagcu

SEQ ID NO: 4133899 - RNA, 94 nt, Human
agcugaguggucuggcucagagucucucaugcaguuacagucugaugaugguuggagcuggcauugcagggagcugcccagguaucucucagcu

SEQ ID NO: 4133900 - RNA, 57 nt, Human
agcugauacauuucuuguagccacauugaggcccuggcacaggaaagcuacucaguu

SEQ ID NO: 4133901 - RNA, 75 nt, Human
agcugauggaacagauuaaagugagggcuagaucuucccccucugcccuauccccucacuucucuuccuccaccu

SEQ ID NO: 4133902 - RNA, 63 nt, Human
agcugcaaguguugccuccuacauguuguuaauuuagagguaaucagguuugcauuugcagcu

SEQ ID NO: 4133903 - RNA, 69 nt, Human
agcugcaauuaaagacugugaaguagugcugcugaggacuacuguaaguuuauguguuuacuuguagcu

SEQ ID NO: 4133904 - RNA, 126 nt, Human
agcugcaggaugcuaagaccacccgguggacuccaggguuuugcaccuggaccaagaugccaaggggaggggcaggucuagcagaauucggcguuugcugucaucuggggcucuuuaguugcagcu

SEQ ID NO: 4133905 - RNA, 61 nt, Human
agcugcaugaauugccaauuauaaacaucugaguuuagauuugaaaguaaauucagcagcu

SEQ ID NO: 4133906 - RNA, 70 nt, Human
agcugccagaugacagugcuauugggcugcuccuaacuaugaucacuccuuagccuguccucggguagcu

SEQ ID NO: 4133907 - RNA, 55 nt, Human
agcugccaggguggggccgcguuuuggcgacggccacucggccaccccugccgcu

SEQ ID NO: 4133908 - RNA, 75 nt, Human
agcugccugaggaaguugaucucaucagucagaccuuccaggcgagacuccagcucuaacuuguucagguaagcu

SEQ ID NO: 4133909 - RNA, 56 nt, Human
agcugcgauugggcgggcgcggcgaucccuuugaaguguggcugccgaucgcggcu

SEQ ID NO: 4133910 - RNA, 59 nt, Human
agguuuuggagaccuagcacugaacaauauaggcuaggccacuugcucucauggaacuu

SEQ ID NO: 4133911 - RNA, 84 nt, Human
agguuuugguuuccaaugacaaacacuguuccuaaaaagugaaaauaaggaagaagucagauuuuaaugggaugaccaggaccu

SEQ ID NO: 4133912 - RNA, 85 nt, Human
aguaaauacugguaagaaugauccugcaccuucaagaaaauaaucagauuauuuuaaagaaggcagagaauauaacaguguuucu

SEQ ID NO: 4133913 - RNA, 75 nt, Human
aguaaaucuucacaaagccgugcuguuauuucuuugcuuucaccuugacagcacuggaguuuagugggauuuauu

SEQ ID NO: 4133914 - RNA, 81 nt, Human
aguaaauguuuguuaaauggaugcagaauaagaugguguuuuaauauugcaguacauuucuagaauaauaaacaugugacu

SEQ ID NO: 4133915 - RNA, 129 nt, Human
aguaaauuaucuuguuugggauaauacguuagucaaaucuuaucugguuacaagggauaaaaucauaugauuuuauccguuguuaccagauaagauuugacuaacguauuauccucaagaaguuuauau

SEQ ID NO: 4133916 - RNA, 63 nt, Human
aguaacacucacucucuugggcuucauucuguccauguguucaauaagggaguugauguggcu

SEQ ID NO: 4133917 - RNA, 79 nt, Human
aguaacagguguuuuaaaucuuucugagucauugguacaccuaagagccagacugguaagguauuggaauucugugacu

SEQ ID NO: 4133918 - RNA, 63 nt, Human
aguaacaugcuaauuugauuauuauugcuuuguaguauguuuaaaaucagguaguaugaugcu

SEQ ID NO: 4133919 - RNA, 84 nt, Human
aguaaccacuaaucuauuuucugucucuauagaguugccuauucugagcaauucauauaaacggaaugauauaauguggucucu

SEQ ID NO: 4133920 - RNA, 65 nt, Human
aguaaccaguagucauucauucaccaguauuaaugccugguacaugcaaaagacuauuuguugcu

SEQ ID NO: 4133921 - RNA, 77 nt, Human
aguaacugcucagugaguauuuuuaagcuauuagcaugaucaaauuuagagaggagaaauauaauggagcaguuucu

SEQ ID NO: 4133922 - RNA, 59 nt, Human
aguaacuuaguuuaggguauugauugauuugguauucacaauacuauaagcuggguucu

SEQ ID NO: 4133923 - RNA, 95 nt, Human
aguaagaaaugugguugcagaggcaguaauuugagguaucugugugacauccaaacagagaugucagauuggcagcugugugggugcaucuugcu

SEQ ID NO: 4133924 - RNA, 95 nt, Human
aguaagaagcuugugggcaagcuuaaucagucugguugcaugucccauauuacccuuguuccuugcuggcuuaggcuaauauauugcuucuuauu

SEQ ID NO: 4133925 - RNA, 66 nt, Human
aguaagacuuccaggaaaaggugguggagcaauggcuccuuuccauuuugucuccugaaaucuacu

SEQ ID NO: 4133926 - RNA, 59 nt, Human
aguaagaggagugggaagccucaucugaaauucggugggcuuuuuaguauuccucuucu

SEQ ID NO: 4133927 - RNA, 77 nt, Human
aguaaggcauuguaaagucacaccuuaggcucugcagucagacagagcuggcugugggugacuuuccgauauuuacu

SEQ ID NO: 4133928 - RNA, 59 nt, Human
aguaagggagauguauagauguagccagucaggugguuucuguacuuugcuuccaugcu

SEQ ID NO: 4133929 - RNA, 55 nt, Human
aguaaguuccaguuucauuaugccauuuuucagguuugauggcuggaacuauacu

SEQ ID NO: 4133930 - RNA, 67 nt, Human
aguaaguuucuauuuucaugucuguuucuuccacuaggaagagcaccuugaggacaggaauugagcu

SEQ ID NO: 4133931 - RNA, 85 nt, Human
aguaauaagcagaaaagucugggccacagagugagaaauguccuaaaaaguggacaguuuuaaugugguucaaucuuuuuuuacu

SEQ ID NO: 4133932 - RNA, 59 nt, Human
aguaauacuagcuagcagggauaauuuagaaaaaugcuuugugcuaaugcuagauuacu

SEQ ID NO: 4133933 - RNA, 86 nt, Human
aguaauaggaccaaaugaucacauuuauaguggcacgcauaguaguuuaugaguggcaguauaugugugaguguuuccuuugugcu

SEQ ID NO: 4133934 - RNA, 129 nt, Human
aguaaucacggugaauaacagucguaggggugaagugacagcucaagguuuuacuguugucauaaaaguggugcaguuuuagagcuuuaagaugagcaaaucucuggggucuauguccaccgugguucu

SEQ ID NO: 4133935 - RNA, 61 nt, Human
aguaaugaggauguuugcaaaagucucaauuaaggacaaaguuguuggcacccuuauuacu

SEQ ID NO: 4133936 - RNA, 58 nt, Human
aguaaugucccuuaaaugugguuuuauucuuucuuacugugaguuaagggacaucauu

SEQ ID NO: 4133937 - RNA, 60 nt, Human
aguaauguguaaaugaggagucuuggcuguguuuccaguaagacuuuauuuauagauacu

SEQ ID NO: 4133938 - RNA, 70 nt, Human
aguacaccagugggagagaagcaaguaguaagugcauuuccuccuuguuuuccuguuuacacaguguacu

SEQ ID NO: 4133939 - RNA, 58 nt, Human
aguacagauuucugggcccuaccauagucuuucgagguggggaccaguauuuuauacu

SEQ ID NO: 4133940 - RNA, 82 nt, Human
aguacauccuaggaguuugaaaacuuaacuaagguuuaaaauuuaccuuguuuaaagaacuucugacuuuugaggaaaaucu

SEQ ID NO: 4133941 - RNA, 65 nt, Human
aguacaugguuauaaaaguccucucauuacagaguuaaguaauggugggaaaugugaccucuacu

SEQ ID NO: 4133942 - RNA, 68 nt, Human
aguacccauugcugggcauuuaugcagaugguccccucaugguaaagagcugcccaaguucugggucu

SEQ ID NO: 4133943 - RNA, 76 nt, Human
aguacggacuacagcagcucuucacuuacuccuuuccaggguaagggaaaggagaggcagagagcuuagagaaacu

SEQ ID NO: 4133944 - RNA, 83 nt, Human
aguacugauccaaauucaacucccuauucacuuguuucagagucaucucuaugaacacagggaauggggguuuccacaguacu

SEQ ID NO: 4133945 - RNA, 73 nt, Human
aguacuggguacaagcuggagggauagaaguauauuuugguuuauucuguucauguugggcuuuucccugucu

SEQ ID NO: 4133946 - RNA, 66 nt, Human
aguacuguagauuggcuucugcccuggccccggucaggcugaaggaggccuaucucuggcugugcu

SEQ ID NO: 4133947 - RNA, 85 nt, Human
aguagaccgaaguuagguuggaauggagaggacguuguuuaaccauuaacaaugucuuugucuccuucagucuauauaguguauu

SEQ ID NO: 4133948 - RNA, 73 nt, Human
aguagagugaccaacuuacccugauuuuaaaacugaaagucccaggcaaaucagagugguuggucauccuacu

SEQ ID NO: 4133949 - RNA, 74 nt, Human
aguagccuugucaccguguccucuugccuuuuccauguacacagccggcucuggagcaggugacggggccugcu

SEQ ID NO: 4133950 - RNA, 80 nt, Human
aguagcuggauugggguagcuguuucacaccacuaaugcuagcagauuggcuggcgaggcucugugacaaucaagcugcu

SEQ ID NO: 4133951 - RNA, 83 nt, Human
aguaggccuuggguuuugacuuguuuuuacuguugugaggucauguccugagacaacauugggcaagucccaaagggccuucu

SEQ ID NO: 4133952 - RNA, 60 nt, Human
aguagggugcuuaauacuagauuucacagggcauguaagguucuaauaagcgcugcuacu

SEQ ID NO: 4133953 - RNA, 89 nt, Human
aguagguauuugaaaaauugauuaauguuagggucugaguuuaucauauugagaauucuacaauagaucaaguaacaaauagugcuacu

SEQ ID NO: 4133954 - RNA, 75 nt, Human
aguaggucccuggcugcuauagcagcaugugcuccaugccagggcagguguguggggagcagcagggggucuacu

SEQ ID NO: 4133955 - RNA, 67 nt, Human
aguaggucuuaggagucauccggcaucuuguuucuguagcugagcugggcaacucuuagaucuuauu

SEQ ID NO: 4133956 - RNA, 60 nt, Human
aguagguuggggauucauuuagcacaaacacuaaaugugaacuuacuguccccacagacu

SEQ ID NO: 4133957 - RNA, 70 nt, Human
aguagugaaauuuguuuagauaggucacucaagaaaaauggcaagauuauguucuaaacaagucagugcu

SEQ ID NO: 4133958 - RNA, 66 nt, Human
aguaguugagagagagcuuuggauuguaacuuagaaggaauaaauuccaaaccugucucuggcucu

SEQ ID NO: 4133959 - RNA, 67 nt, Human
aguaguuuacaacaugccaacugggcuuuauuuguagccuauaucacagcauugugugugaaaagcu

SEQ ID NO: 4133960 - RNA, 59 nt, Human
aguauaaugaaaugugucaguagaacuguuucuaaguuauuugacaguuucuuuauauu

SEQ ID NO: 4133961 - RNA, 68 nt, Human
aguauacugaguuuuaccuuuuaugcccagaacagugcuugguauacagguggacuucaguuaguauu

SEQ ID NO: 4133962 - RNA, 62 nt, Human
aguauaucacauguaguaauggcaaauacuguuuuguaaaaacuuugcuauauguauguucu

SEQ ID NO: 4133963 - RNA, 116 nt, Human
aguaucacacagucaaguucaaagagaaucauuagagagaaaacuuugaggacggcaaaaaaaaucaaaagugacacauuugugaugaauuaauuuugaaugaggauagagauacu

SEQ ID NO: 4133964 - RNA, 119 nt, Human
aguauccccucacucuacagacccuaugccucuuccagcugcuagcuagaugcaacaugacaucguuuuguuucuggaaaaggcgagaauugcugggaagcauugucuggggccguacu

SEQ ID NO: 4133965 - RNA, 85 nt, Human
aggcagucauggccauggcacauagaaaaggaucaauaaauauuaguuuagugguuaugagugugucucuggggacagacugcuu

SEQ ID NO: 4133966 - RNA, 72 nt, Human
aggcagugcauauaugugcagcaucaaauaggcugggccuccgcagagauugagcugacuguggcacugucu

SEQ ID NO: 4133967 - RNA, 57 nt, Human
aggcaguuucugggacagcauauuaaaagacaugagcuucagacaaagaaacugcuu

SEQ ID NO: 4133968 - RNA, 69 nt, Human
aggcauaaguguguaaggcauucugucaacuaucauuccuucucuuugacaggcaccaugccugugccu

SEQ ID NO: 4133969 - RNA, 61 nt, Human
aggcauauuucuaaaaugccugucuccuaucauuaugagucaggcaugaagguaauuaccu

SEQ ID NO: 4133970 - RNA, 70 nt, Human
aggcaucagaggcagacauggauuugaguucuagcuaccuauaacuacaguaguuugcccuucuaugcuu

SEQ ID NO: 4133971 - RNA, 65 nt, Human
aggcauggcacugagcagcuucuuuuaagaacauaauuuguagccaggcgcaguggcuuaugccu

SEQ ID NO: 4133972 - RNA, 72 nt, Human
aggcauguauguaugaucauacauauuuaugguacccuagaaaugucuguuagucauaucaugucagcgccu

SEQ ID NO: 4133973 - RNA, 55 nt, Human
aggccaaagcucaccugcagcucauuuauccuuagagaagggagggcaauggccu

SEQ ID NO: 4133974 - RNA, 68 nt, Human
aggcagaagcugagaaugaauuaagacuccuuguacaagucuuuuuuagcugguucuuagcuuugccu

SEQ ID NO: 4133975 - RNA, 83 nt, Human
aggcagagaaaauuauuuuuaaaacucugggaauuucucauaagaaaauaagaauaguguuuucuagaaugguuuuaucuccu

SEQ ID NO: 4133976 - RNA, 85 nt, Human
aggcagaggugggaagugugaaugcauaauauacuguuauguaaaugacauucaaguuugcaguuaggauuucugauuucugccu

SEQ ID NO: 4133977 - RNA, 83 nt, Human
aggcagauggguggcuuauuuucugugaaauuaaacaguuuuaaacacuggcuagaaaauguuccacugccauuucaacgcuu

SEQ ID NO: 4133978 - RNA, 66 nt, Human
aggcagaugguaacugugauaucugugugauauacaguuacuccucaucaaccauaagcauugccu

SEQ ID NO: 4133979 - RNA, 60 nt, Human
aggcagcagcguuggguuuuuagggguucagucuuuccucagagcauagcgcugucuccu

SEQ ID NO: 4133980 - RNA, 57 nt, Human
aggcagcaugcucugcuucuaccaauaaagcacugcuaagggcaggggcugcuguuu

SEQ ID NO: 4133981 - RNA, 130 nt, Human
aggcagccauggccaggcugggcuggaaggguaagggcgugcucuggacucguggcacagcugcugggaugugcgugauggaccgggccugcccgcuugcccacccccugcccacacuaugcugcugccu

SEQ ID NO: 4133982 - RNA, 58 nt, Human
aggcagccuuuuuggaaacauagcugaucauuucagcucuguagaucugagucugucu

SEQ ID NO: 4133983 - RNA, 106 nt, Human
aggcagcggguaggaaagaggucaugagacaaggaaaggaagcugaaaaaccgaaguuucagaugcccuuuguuuuagacaccccucauuuccagaacugucaccu

SEQ ID NO: 4133984 - RNA, 73 nt, Human
aggcagcuguguaggaugguuuuggacagaggcugaauaacagcaaaaugaccagcuacuuguacaguucacu

SEQ ID NO: 4133985 - RNA, 74 nt, Human
aggcaggaaauaguuuucaguuacugcuauaucauuguccucaauuaggagcugacugaugacacuguccuucu

SEQ ID NO: 4133986 - RNA, 100 nt, Human
aggcaggagacucacuugaacccuggaggcagagguuguugcagugagcugagauagugucacugcacuccagccugggugacagagugagacuccgucu

SEQ ID NO: 4133987 - RNA, 59 nt, Human
aggcaggauugcugacaacaaucacgaacaaauaugugacuccugucaauagcuugccu

SEQ ID NO: 4133988 - RNA, 58 nt, Human
aggcaggcacaguaauacauguucauucuuuuggccugagcuauuacaguagccuccu

SEQ ID NO: 4133989 - RNA, 65 nt, Human
aggcaggcuacccuaggucuuggugguugcugcugccucgcugugugaccuugggugaguugcuu

SEQ ID NO: 4133990 - RNA, 120 nt, Human
aggcagggaaggaggguuuuguggcuucuacgcccacaggcuacugcugccugaacuggcaaaaguaucucaaagguggcuguuugaacccagaggucccagagugcccccucccucccu

SEQ ID NO: 4133991 - RNA, 58 nt, Human
aggcagggcugcugaggaagccuugcggagcccugcaagugaccucagcauguucccu

SEQ ID NO: 4133992 - RNA, 93 nt, Human
aggcaggugugcaccucauccuuagggcauugcaguucugguccauguugucaccaggcugagggcuccugagggcagcagcaguaucugccu

SEQ ID NO: 4133993 - RNA, 111 nt, Human
aggcagucagacuaaggcugugcaggugggggagaaguugugacacgccacauguccugccccucauaucgcuccuccccugaccucacuggccuaccaggauggcugccu

SEQ ID NO: 4133994 - RNA, 58 nt, Human
aggcagucugauucaagagcccauguuuccugaaagaggaauuuuggguggaaagucu

SEQ ID NO: 4133995 - RNA, 65 nt, Human
aggcagugcugugcccugaacccucugauaaguacuacagugaggcuucagggcauuugcuguuu

SEQ ID NO: 4133996 - RNA, 67 nt, Human
aggcaguugaguggcuuuuucacacuguaaagacagccuguugauuuaagaagcauacuuacugcuu

SEQ ID NO: 4133997 - RNA, 55 nt, Human
aggcaguuggucauugcucuuuuacaacugaggaaacagcaugaguaauuugccu

SEQ ID NO: 4133998 - RNA, 62 nt, Human
aggcaguuuggucacuggauuuggcugucucugaaagacagcauucccuuuggcugcuuccu

SEQ ID NO: 4133999 - RNA, 130 nt, Human
aggcauaaugauaaguaagaccaugaaguuucuguuugaauaauguguauguuguuauuuuuaucugucugaauaauuuguaugucguuuuuaucagaaauuauuugggguuuuuuugaugauuauguuu

SEQ ID NO: 4134000 - RNA, 125 nt, Human
aggcaucacuuccaguacuucuccagggaccacugggcugggcagggucuugggaauuggggaccuggucccaguccugugugacccugcacaggccacuccuugucucugggcugugugcgccu

SEQ ID NO: 4134001 - RNA, 61 nt, Human
aggcaucagggcuuugcacucucagggguccuuccgccuggauguccuuccccugaagcuu

SEQ ID NO: 4134002 - RNA, 76 nt, Human
aggcaucuucuggcucaguguucaucuguaugcacaguuauguguaagcacuaggagcugagccugaaaaguaccu

SEQ ID NO: 4134003 - RNA, 64 nt, Human
aggcaugcaucacuauucuuaggcauuaaaugaagaaacuaaggcacacaguugcugcaugccu

SEQ ID NO: 4134004 - RNA, 71 nt, Human
aggcauucaccauacauaaauuacauuguuaggauaaagucaucaaacugguuucaugugggcugaagccu

SEQ ID NO: 4134005 - RNA, 98 nt, Human
aggcauuccaugccccucacaauugggcuccaauuuguccuuucaugcucaccccuugcugaaagucccuuggacccaggcugagugguauguggccu

SEQ ID NO: 4134006 - RNA, 56 nt, Human
aggcauugauuuaaacaucucucuuccuuuaaggaagacucauggaauggaugcuu

SEQ ID NO: 4134007 - RNA, 81 nt, Human
aggcauuugcaucuagggcaacccagagcuucccuagccuuaagcuuuccuuuagcugguuguucuggaugggcaggguuu

SEQ ID NO: 4134008 - RNA, 56 nt, Human
aggccaaagcaagacccuguaaagcacaaagcccagagcagguaaugcuguggucu

SEQ ID NO: 4134009 - RNA, 56 nt, Human
aggccaaauagcagguuugcuaaauguuuuaauguuguaaacugcuuccuuggccu

SEQ ID NO: 4134010 - RNA, 79 nt, Human
aggccaagagcccugcucaucuggaucccgcacugaggcuggcuagaacucccgggcagugggccgggcuguugggccu

SEQ ID NO: 4134011 - RNA, 55 nt, Human
aggccaagugguggcuauuuauaggaggcuguagaaaagcuuggacacauggccu

SEQ ID NO: 4134012 - RNA, 63 nt, Human
aggccacagaggaagcagacacaucuugcuggucgauuccuugcaagcuucuuauaguggccu

SEQ ID NO: 4134013 - RNA, 59 nt, Human
aggccacucagggggccaagauccugucacuccuuuucucuaggcccugcgaauggcuu

SEQ ID NO: 4134014 - RNA, 63 nt, Human
aggccagcaagaaagagagucuuugaugguuucaaccaugcugacugcuucuuucucugaccu

SEQ ID NO: 4134015 - RNA, 57 nt, Human
aggccaggaauccuugucccagcagacaugcacuggagcaacggucuccugucgccu

SEQ ID NO: 4134016 - RNA, 80 nt, Human
aggccaggauccgcaaaccacacucagcguaucgggcgugcaggucgacgagcugaguguaguuuacuucggucuugccu

SEQ ID NO: 4134017 - RNA, 78 nt, Human
aggccaugagcaggguugcugcagacuuucauguuuacauguguguaugugaaugcaguuaucuauaacucugugccu

SEQ ID NO: 4134018 - RNA, 94 nt, Human
aggcccagagggaguuacugccucaggcagcaaggggaagaauugggauucagacuuagguuggcugaugcaagagcuuccugcccuggugcuu

SEQ ID NO: 4134019 - RNA, 66 nt, Human
aggcccagcccuucccaacuggccaggaccugacccaggagcuggucugcgggaaggcgugggcuu

SEQ ID NO: 4134020 - RNA, 73 nt, Human
aggccccaguuguagacaggagucaggcuagaaucaggggcuacugcugaagcuacucuagcugucugggccu

SEQ ID NO: 4134021 - RNA, 56 nt, Human
aggcccuuccauguugucauggagaccuggacacaccaugauacuuggaagggcuu

SEQ ID NO: 4134022 - RNA, 63 nt, Human
aggcccuugcuaucauggagcuuacauucuaguggagaagccaggugauaagcaaauaagccu

SEQ ID NO: 4134023 - RNA, 78 nt, Human
aggccgagucagcguugcucgagguccccaccggcucaggccucugcgccuccucugccucgggaaugggcuucgccu

SEQ ID NO: 4134024 - RNA, 63 nt, Human
aggccggcucuaaauuuggauggcuucgguugauccuggauuuagaagagccucccauggcuu

SEQ ID NO: 4134025 - RNA, 84 nt, Human
aggccgggccgugggcuccagaugaaaggccagaggcgccccugcuaucucugcugcuccucaccugguguuccuggccggcuu

SEQ ID NO: 4134026 - RNA, 75 nt, Human
aggccguuagucacuuggauuguuuuugcuuggucuccugaaggcaccuugcgguccagugaauauugauugcuu

SEQ ID NO: 4134027 - RNA, 65 nt, Human
aggccguuucuuugcaguucuguauuucaggguccugaaaguuuuauaugcugcagcgaauuccu

SEQ ID NO: 4134028 - RNA, 60 nt, Human
aggccuaugaguaauauucugggcucagugcuuuguccacugggcccauauacucagucu

SEQ ID NO: 4134029 - RNA, 88 nt, Human
aggccucacagaagcaacacugaagagcacuuucaaaguuuacucagaugaggucaccuuugcaagugcuuuguaguccuggaggccu

SEQ ID NO: 4134030 - RNA, 77 nt, Human
aggccugcccaggcuggggguggccaucaucacggggcagggcagggucaagggugaaggcuccuccaggaaggucu

SEQ ID NO: 4134031 - RNA, 71 nt, Human
aggccuguccagccugccuggcuaucaggagcuuaugucucagccucuagcugggccagguggucagaccu

SEQ ID NO: 4134032 - RNA, 56 nt, Human
aggccuguuccaggccccuuuugucccccaggcagcagaggccuagcgacaggccu

SEQ ID NO: 4134033 - RNA, 81 nt, Human
aggccuuuaacuaauuuagacuuaguaugcaguaacuuauuuuguaauuugugaaagucaaauuaauugaacgauuggccu

SEQ ID NO: 4134034 - RNA, 84 nt, Human
aggcgacagcucagacgcaggucgagcaccuggguccggacuccacccuccacaugcugccccgaccucguucugaaacucccu

SEQ ID NO: 4134035 - RNA, 68 nt, Human
aggcgaguacagacggggccugggagggggcagagauguuccccaggcccugccugugguuccugccu

SEQ ID NO: 4134036 - RNA, 102 nt, Human
aggcggccccaggcuggccccacacuggugggagcagcaggcagcuccuccuugggcagcuccuccucuuccccugugaggcagcucuggucauggccuccu

SEQ ID NO: 4134037 - RNA, 57 nt, Human
aggcggcuccgggagugugggccccccugggacgugugcguguuuccggggucuccu

SEQ ID NO: 4134038 - RNA, 60 nt, Human
aggcggggggcaggcaguacguugggggauccgaguaccuccgcuuggccccagguggcu

SEQ ID NO: 4134039 - RNA, 59 nt, Human
aggcuaagccugcaugaaccaugagaaucugucuucucugaaauauguaugcuuggucu

SEQ ID NO: 4134040 - RNA, 95 nt, Human
aggcuaccuguuuaagaagaauggaaauauuucauagguaauauguucuaauuucuaauaugucauauguaauauguucauuucuuagguaguuu

SEQ ID NO: 4134041 - RNA, 62 nt, Human
agcugcuccaauuuuuaccauuacagagaacuucguagaauugcugggaauuggagccagcu

SEQ ID NO: 4134042 - RNA, 64 nt, Human
agcugcuguuucuugcacguauucuuaaaaucaacaaaauaccuccacaagacaacuggcagcu

SEQ ID NO: 4134043 - RNA, 65 nt, Human
agcugcuguuuggugagucuugaagcuggcucaugugcugggaagaggcccaugggacaggggcu

SEQ ID NO: 4134044 - RNA, 78 nt, Human
agcugcuuccaggucccuggggagauuuucuugaugagagaauugcuaacucuccuccuggaugugggacccgcagcu

SEQ ID NO: 4134045 - RNA, 78 nt, Human
agcuggacuuugaacuccugguucccaguugagauguaucauacaauuucugcuaaccaaggagagauguguucagcu

SEQ ID NO: 4134046 - RNA, 81 nt, Human
agcuggagcauggcugugagcacccugccucgaugagccgggccaucuuucacaugguaggggcagggccaagcuguggcu

SEQ ID NO: 4134047 - RNA, 60 nt, Human
agcuggcagcauuagacccugggcccauuuggugccuuuuacuacacuaggcugccagcu

SEQ ID NO: 4134048 - RNA, 59 nt, Human
agcuggcagcucucagggguacgugaguccaggcugaucucauccuuggggcugcugcu

SEQ ID NO: 4134049 - RNA, 58 nt, Human
agcuggccaggaagagucucagacugugguguaggucugagaagguuucagccagacu

SEQ ID NO: 4134050 - RNA, 58 nt, Human
agcugggcaccccgcugcgucuaggcugaaaggaccgaggugcacgggugugccugcu

SEQ ID NO: 4134051 - RNA, 72 nt, Human
agcugggcuggcagccaagugaagagggcugggauugagcggacucuugucugugggcugcugccuccagcu

SEQ ID NO: 4134052 - RNA, 65 nt, Human
agcuggggaagauggcccuccauguguccaccauuacugugauaccuguuucugucauccccacu

SEQ ID NO: 4134053 - RNA, 59 nt, Human
agcugguagaugaacaguagccauccccacuuauugagcacuauuuauauaugccagcu

SEQ ID NO: 4134054 - RNA, 65 nt, Human
agcugguccacuuuuguaucuuccagagugcccagaacuggguuguacacacagguggaugggcu

SEQ ID NO: 4134055 - RNA, 61 nt, Human
agcuggucuggcuacccagcgaaucccacagcagggagucccucugggagcaggacugacu

SEQ ID NO: 4134056 - RNA, 56 nt, Human
agcuggugaaccugaggcacagagagauuaagcgacuugcucagggucacacagcu

SEQ ID NO: 4134057 - RNA, 127 nt, Human
agcuggugcugcacacagugaaaugaguaauuagccaggaugauuuugauuaaaauggaacauaccaauuaauaaaugaaagugcuggcauacuugcuaauuuaacaacuuguucauggugccagcu

SEQ ID NO: 4134058 - RNA, 65 nt, Human
agcuguacguguggccguguauccauggcucugugugaguuugugugugcggccgcgugggaguu

SEQ ID NO: 4134059 - RNA, 74 nt, Human
agcuguagugaauagagcaugcugauuaauugaaugacaugacauugaauuauaagugugucuacuuuccaguu

SEQ ID NO: 4134060 - RNA, 56 nt, Human
agcuguauucucuuuguauuaauauccuuaccguguuucacagggcagaaacagcu

SEQ ID NO: 4134061 - RNA, 71 nt, Human
agcugucugaguaagagaauccuuguuuuuucaugaacacauccaaaggacucuucuccucaaacaaggcu

SEQ ID NO: 4134062 - RNA, 61 nt, Human
agcugugcugcagcuugcucuggcaggugggaaggaugccaggaaugggugacagucagcu

SEQ ID NO: 4134063 - RNA, 60 nt, Human
agcuguggcaggcuaggcuuuuuggcuauagaucuugguuacauugccccuuccacaguu

SEQ ID NO: 4134064 - RNA, 59 nt, Human
agcuguggugugugucacagaacccaagucaggacucuuggggacccagaaucacagcu

SEQ ID NO: 4134065 - RNA, 66 nt, Human
agcuguucucuggcgguggcuguuccugauucuggugguuucuaagcagcaggcuagggaacugcu

SEQ ID NO: 4134066 - RNA, 77 nt, Human
agcuguucuuacuuuguccuucaaggugugucauucuuuggcagauggccaggccggggacagaacugaagacagcu

SEQ ID NO: 4134067 - RNA, 63 nt, Human
agcuguuuccauaaaugagacacagaggccugaaaacucuguuuaguacucaggggagaaguu

SEQ ID NO: 4134068 - RNA, 61 nt, Human
agcuguuuucuugccguccuagaaucuauuuuguaagagcuuaguuggggggaaaacugcu

SEQ ID NO: 4134069 - RNA, 85 nt, Human
agcuuaaaaauucagcaggcaugcaaaagggucucagauugaagggacaaagugauuucccuguagccucugaauaacuuaagcu

SEQ ID NO: 4134070 - RNA, 73 nt, Human
agcuuaaauuuuaagugcaucugaucuuucaugcugcccaagacagcuaugaaggguguacaaaauggaggcu

SEQ ID NO: 4134071 - RNA, 72 nt, Human
agcuuaacugaaggcagaugugauuaauuuccucaucauugauugacauuaacuauauuagccaguuuugcu

SEQ ID NO: 4134072 - RNA, 112 nt, Human
agcuuaguugggugccucuggcucaaggucucucagauggcuacagucuuagcugugggccagugcugcagucaucugaagauuuuguuagaggauaaucagcuuucaagcu

SEQ ID NO: 4134073 - RNA, 58 nt, Human
agcuucaucuuuauguacaggauuucaagguccaaacuccuuugcaugcugugaggcu

SEQ ID NO: 4134074 - RNA, 88 nt, Human
agcuuccuaagggcagaacucuuagucuguuuuauuugcuguugcaccccaaaguccuagaacagugcuugacccaugccagguaguu

SEQ ID NO: 4134075 - RNA, 78 nt, Human
agcuucucagagguauccaugugccccuuacagaacccugcuguguaggacacagauaucucugagauuauccgagcu

SEQ ID NO: 4134076 - RNA, 89 nt, Human
agcuucucaugguuuguccugagacauuguucuuucaaagcucucugccuggauacaacugcucucagauaaguagucauggaaaagcu

SEQ ID NO: 4134077 - RNA, 77 nt, Human
agcuucugauuauauucacagugacagcuauacagagaaaagcuuuuuccaauaaagugucauuguuggcagcagcu

SEQ ID NO: 4134078 - RNA, 82 nt, Human
agcuucuugcugaaggaacuucccagaaacuuccccaauccuaaaacagaacuuuggaaugguaccuucaguugggaaagcu

SEQ ID NO: 4134079 - RNA, 80 nt, Human
agcuugacagaaaucacuguacccauuuaaauaaauucaaagcagagaauaugcuaagugugcaguaacgacuacaagcu

SEQ ID NO: 4134080 - RNA, 65 nt, Human
agcuugagguccugggaguucuagugugggauucugggccugagcucaccaggggcauccaagcu

SEQ ID NO: 4134081 - RNA, 55 nt, Human
agcuugcagaaaauaugaugugucuaaucugaagaauaacaaggcucugcaagcu

SEQ ID NO: 4134082 - RNA, 73 nt, Human
agcuugcugcugucuccuuucuggucuuggaugggagaaugagagagaaggaccagagaaaacacagcaggcu

SEQ ID NO: 4134083 - RNA, 89 nt, Human
agcuuggaggaccauacauuaaaugacuuucaucacaauuuuucuacuccaacuugaccugaagaucagugaauguguuuccccauccu

SEQ ID NO: 4134084 - RNA, 71 nt, Human
agcuuggcgagggagcucaguuggaagcggugaaacaagcaucauucuauuguugagcugccucgccagcu

SEQ ID NO: 4134085 - RNA, 69 nt, Human
agcuuggcuacaaauggguuaaaauauagugugaaauauuauacuuucuccuauuugauuuugucugcu

SEQ ID NO: 4134086 - RNA, 69 nt, Human
agcuuggugcaaaagugauugcgguuuuugccauuauuuucaauggugcaaucacuuuugcaccaagcu

SEQ ID NO: 4134087 - RNA, 69 nt, Human
agcuugguugaccagagacucucagaagccaguagguccuucuuuucaucccugguugcaacuugggcu

SEQ ID NO: 4134088 - RNA, 56 nt, Human
agcuuguaugugugugugugugguguguguauguugcauacaugcauuuacaugcu

SEQ ID NO: 4134089 - RNA, 83 nt, Human
agcuuguauucagaucuaagagauucaaaagcucuaauucuagcuguugugcaauuuaaaaucuuccuaggcugaaaugagcu

SEQ ID NO: 4134090 - RNA, 82 nt, Human
agcuuuacacuaguuuuugaguuauugaaugcaugagucagacuccuaagccuucgagauuuaaacacugauuguuauggcu

SEQ ID NO: 4134091 - RNA, 62 nt, Human
agcuuuacaucgaaguucaguccucagguagagggcuaaaucaaaggcuuucaaguaaagcu

SEQ ID NO: 4134092 - RNA, 125 nt, Human
agcuuuagcccaugaauuacuuaguuuuuacagucuauguugaauuaagacagcuuuguuauauucuggaaauugauuacaaaguagauacauugaugaauugggaaauuaaucggaucaaaguu

SEQ ID NO: 4134093 - RNA, 60 nt, Human
agcuuuaucagaggagucucuacuuuucuaaggauuaggucaauuccucuguuagaugcu

SEQ ID NO: 4134094 - RNA, 58 nt, Human
agcuuucuuauauuuuuugaaagacaugcaguucuuuucagacaaauuugaggaagcu

SEQ ID NO: 4134095 - RNA, 69 nt, Human
agcuuugcccgcuuugcuauccagcuaacagaaaaacggaggucagugaggaaugggaaugggaaagcu

SEQ ID NO: 4134096 - RNA, 92 nt, Human
agcuuugcugcuucaguugcuagaagggggaaccaaguggagaacgugauggccuauuaacccuucugccaagaaaacuggguugcaagguu

SEQ ID NO: 4134097 - RNA, 68 nt, Human
agcuuuguggcuuugcaagacuuaccugaucuaucaugucuacugaaggacuuagaagccucaagguu

SEQ ID NO: 4134098 - RNA, 75 nt, Human
agcuuuucaggggccaguaggagugauguacggggcaccuacuugggguucacaugcuggccccuuuauugaguu

SEQ ID NO: 4134099 - RNA, 76 nt, Human
agcuuuuugaaguggauagaggcccugcuuugaagcugaaaauccaacuuaaggcucccuuugccacuuguuagcu

SEQ ID NO: 4134100 - RNA, 126 nt, Human
aggaaaaaaagugcauguuuucuuuucccuuuuucaguucaguuuauuauaucuugacauucugucuuguaauugaauaguaauucuggauuuagaguggagaagaaagaaauuuaagucaguccu

SEQ ID NO: 4134101 - RNA, 78 nt, Human
aggaaaauuugugucuguggaacagagcuguuuucuauaagaagucaauuuauguucucagacccauagauggagccu

SEQ ID NO: 4134102 - RNA, 63 nt, Human
aggaaacucugagcggaccagcaaggccagauaauggccaauggugaagucucagugucuccu

SEQ ID NO: 4134103 - RNA, 87 nt, Human
aggaaacuugaguucuauucucacuuuugccacaaaacagccauaaaguuguuacagggauaaaugagguaggagcaaaaguuuuuu

SEQ ID NO: 4134104 - RNA, 73 nt, Human
aggaaaggcucacuuuagaucaugcauuccacugcugugcauggauuaauauggcuuugaaagggcuuuucuu

SEQ ID NO: 4134105 - RNA, 70 nt, Human
aggaaauggcucugggaaucuguugcuuggcuccucguccgucacccagcaggaacccaggccagaucuu

SEQ ID NO: 4134106 - RNA, 74 nt, Human
aggaaauuuuccgggcuggccucaggguccucgcuguacagcagcuuucaaacacucuggccagccgauuucuu

SEQ ID NO: 4134107 - RNA, 70 nt, Human
aggaacaaacagucaggacagucuggacucuauuauuucauuucuuccacacaacuaauuguuuguuucu

SEQ ID NO: 4134108 - RNA, 61 nt, Human
aggaacacugccuuuuauuuucccccuuacuccaugggaaaggagagaaggaggugucccu

SEQ ID NO: 4134109 - RNA, 68 nt, Human
aggaacaucuuuuuucucuaauuguggucauuggccuacuguuuaaaugaaaagagagugugguuucu

SEQ ID NO: 4134110 - RNA, 62 nt, Human
aggccaaggccagcaggggagcugaaauccaaaauuagcacacugaccugaagccuuggccu

SEQ ID NO: 4134111 - RNA, 63 nt, Human
aggccaaguagcuagcauugaauugauugugguuucauuucaguggauucucuauuaaggccu

SEQ ID NO: 4134112 - RNA, 65 nt, Human
aggccaagugaacaaugcuaguagaauacauuaaguuaucuuccuucaguguuguucauugguuu

SEQ ID NO: 4134113 - RNA, 130 nt, Human
aggccaauuuggaggaaggagauucauaaauccacgggauuauucuaacuuugucaguucaccagaguuaaagaaagauaauucgccuuggggaaaagucuauguaauuaccuacuuuuaaaaaggaccu

SEQ ID NO: 4134114 - RNA, 72 nt, Human
aggccacaccauuagugauuaaaggcagaauguucauccccagagccccuuucuuuugaucauugugugccu

SEQ ID NO: 4134115 - RNA, 82 nt, Human
aggccacagguccuggcaggcaagaggaagggaggccugagaacggccuuuguucccgggaucuccggaccagaugugcccu

SEQ ID NO: 4134116 - RNA, 75 nt, Human
aggccacauuguauuguggaaaguuagcauaugcccuccaaagccugguuucuuucccaguagaugugaaagcuu

SEQ ID NO: 4134117 - RNA, 66 nt, Human
aggguuugggaguccuuggagaguaagacauccuuagcacgcucugcaagggguucuuuaggcccu

SEQ ID NO: 4134118 - RNA, 58 nt, Human
aggguuugugaagacuuggccagcucuccguugacaauggccaaggaauagaagcucu

SEQ ID NO: 4134119 - RNA, 62 nt, Human
agguaaacauggggacugcuaccaaccccaggagcuagggagguacacuucauguuucaccu

SEQ ID NO: 4134120 - RNA, 87 nt, Human
agguaaacuguguggauaguuuuuuaguaugagucucaugcaauauuugggacauauuuguacuagaaaauuauucuuuguucaccu

SEQ ID NO: 4134121 - RNA, 78 nt, Human
agguaaagcuggacaggucccaggucccagcacaucugucccccuuggcagcuggcauaccugggcccggcucuaccu

SEQ ID NO: 4134122 - RNA, 61 nt, Human
agguaacuagcauuagcuucuggacuucuuugugccagggcuguguuaggugcgguuaccu

SEQ ID NO: 4134123 - RNA, 65 nt, Human
agguaagaacauguuucuguccuacgagauaacuuuguugcuccuaguuacagaaacucuuaacu

SEQ ID NO: 4134124 - RNA, 106 nt, Human
agguaagaucgccacauggucccuggugcaaacuucugauaaagagcaugugcuuaaggaacaugccaacguuacgaaggcaccugggccugcagccuaauuaccu

SEQ ID NO: 4134125 - RNA, 70 nt, Human
agguaaggcuguaagcuaagccacaaaucaaacuuaccgccauugcagucuuggcuuuauaguuuugccu

SEQ ID NO: 4134126 - RNA, 71 nt, Human
agguaaguugcccugaagaacgucccagauuuugaaauuaucuguuugcuucuucaugguaucacuugucu

SEQ ID NO: 4134127 - RNA, 61 nt, Human
agguaauaggguucagaauuauaggauggaugcuagaaauuauucugucucucucuugccu

SEQ ID NO: 4134128 - RNA, 71 nt, Human
agguaaucauccugucucaaacuucauccaugccauugguaaaaauguugaaugagacagaagaugagccu

SEQ ID NO: 4134129 - RNA, 58 nt, Human
aguucuuuugugaacauaugcuuuccguucucuuggguauaugccuacaaguggaauu

SEQ ID NO: 4134130 - RNA, 86 nt, Human
aguugaaaggccagacuuuggccaaauccccaaagaccaagagucagccuuucuuccuggguuucuggcagagaucuggagcaacu

SEQ ID NO: 4134131 - RNA, 71 nt, Human
aguugaaggccacugccugcaugugacaaacuagagauucuaguuaacacagucaggaguaacccucaauu

SEQ ID NO: 4134132 - RNA, 90 nt, Human
aguugaaguguggagggggaagagaacaaugaacagacuuuaaaauauaaaaugaucucucauguucuuaucacuucgacacauuccucu

SEQ ID NO: 4134133 - RNA, 76 nt, Human
aguugagggugggagagaaaugaaucuuuauguucuccuguuagagaauagcuuuuuuccuuccagcuuucacacu

SEQ ID NO: 4134134 - RNA, 67 nt, Human
aguugaucaaaucagcuacugaggcuugugcauucaucacauaguucucgugccuugguuuucagcu

SEQ ID NO: 4134135 - RNA, 56 nt, Human
aguugaugguguuuugguuucccaugggaaauauugucacuggagcauuagcagcu

SEQ ID NO: 4134136 - RNA, 84 nt, Human
aguugcuaccgguaaguagaggaguugaaauuuguauccaggacaacugacccaaaagucuguccuuuaacuuccaugcacgcu

SEQ ID NO: 4134137 - RNA, 73 nt, Human
aguugcuauguuaugaaccuuaaccuuugcauauaccucuguuuuauucaugggaggucacaacuugguaauu

SEQ ID NO: 4134138 - RNA, 66 nt, Human
aguugcucuauguuuguaaacagacaaucucuaaugucugauuauuuguaucacagaucugcagcu

SEQ ID NO: 4134139 - RNA, 65 nt, Human
aguugcuguuucauuuuccucauccccagucucaaggggaagccaggccaaugagaacagccacu

SEQ ID NO: 4134140 - RNA, 125 nt, Human
aguugcuucacugaugaaucuauugaacaauuacuugauauuuuaaacauacagucauucuuuucuuuaggaggaaaguguguuaaaaauuuaggaauuguuuuguaaaaaauaacuaagcaacu

SEQ ID NO: 4134141 - RNA, 84 nt, Human
aguugcuuucuuucuuaauuuuuaaggacacugaaacaauaaucacauuuuaggguuccuguuguauuaagaguugaaacgauu

SEQ ID NO: 4134142 - RNA, 91 nt, Human
aguuggauuggcaaacggaaguauuauuguauacuuuucaauagaguuagggaaaauauacuauacuacuuucuggaagcucaacccuacu

SEQ ID NO: 4134143 - RNA, 55 nt, Human
aguuggggugagaucaaggaagcccucccugaggagguggcaucucauuccaccu

SEQ ID NO: 4134144 - RNA, 72 nt, Human
aguugguggcugugaacaaagagaauaauuuuuuacaagggaguauuucucagcauuuuacauccucuaauu

SEQ ID NO: 4134145 - RNA, 127 nt, Human
aguugguuuuuugagauggagucucacucugucacccaggcuggagugcaguggcacaauuucggcucacugcaaccuccgccuccuggguucaagcaauucuccugccucagccuaccaaguagcu

SEQ ID NO: 4134146 - RNA, 79 nt, Human
aguuguauaguuucugcuauauccauauuaugaaauaccauguggccauuaacaagaauauaguagaucuauauguacu

SEQ ID NO: 4134147 - RNA, 90 nt, Human
aguugucaggaggccugagccccagguuuguugucugcccauuccguaagccagguaaucucucugggguucaguccuuguuugucaauu

SEQ ID NO: 4134148 - RNA, 67 nt, Human
aguugucauggcauguuccauguuaagccuuuaaauacgguuugacaaaggaccuugcuauuuaauu

SEQ ID NO: 4134149 - RNA, 129 nt, Human
aguugugggaaugagauaguuuggaugcuguccaaaauagcaugaaaggccuuugauccaguuuucaguagauuugacauuauuauggcaguaacuuggaacuauuuuauuguguucagccaguuaacu

SEQ ID NO: 4134150 - RNA, 64 nt, Human
aguuguguaauuagcaaacaaaucuccuuucuuggaggggauauacugucuguauuacauaacu

SEQ ID NO: 4134151 - RNA, 92 nt, Human
aguuguucaucuauucauggaaguggccauacagauaguuauccuagagagaugauaacuagaauggcuauuuugaggaauaagaagcaucu

SEQ ID NO: 4134152 - RNA, 66 nt, Human
aguuguuucauagcauauacguguguauguauaaacacauacauauguauauuugucagauucacu

SEQ ID NO: 4134153 - RNA, 70 nt, Human
aguuguuuuccaaggcagacacauuuuuugucuuuucuaaaauaucguaagauaugugucuguuacaacu

SEQ ID NO: 4134154 - RNA, 71 nt, Human
aguuuaagcccuggauagagagaacugcaguaagauuucaacaugcuucuugaccuucaggguuuuugacu

SEQ ID NO: 4134155 - RNA, 67 nt, Human
aguuuacaguugagguucauuacuucugguucucuuaguccuagagcaacugauucaacuagaaacu

SEQ ID NO: 4134156 - RNA, 76 nt, Human
aguuuacuuuugauuaugaggaucuuauguaauaauuauggauauaugacaggcaugagauccuaaaaguauuacu

SEQ ID NO: 4134157 - RNA, 56 nt, Human
aguuuaugucuuuacuucagcuaaugcaguauguagaaaaaagugaagacaagacu

SEQ ID NO: 4134158 - RNA, 80 nt, Human
aguuuauuacaguaacgugagagcaucuaacugaaggcuaauuuuauuuggauuuagcuuaucaacguagcugucaaacu

SEQ ID NO: 4134159 - RNA, 62 nt, Human
aguuucacauagcucagugcucucggcaauaugaccuuguuaccacguuguugugugaaauu

SEQ ID NO: 4134160 - RNA, 127 nt, Human
aguuucacugguaguuugguguuucucuuaucaguacguuuauuccugcauuauuuuuaccuauucaccucaaaugaagcagcguuguagagugacugcuagaaccccauauguaaauaguaaaacu

SEQ ID NO: 4134161 - RNA, 77 nt, Human
aguuucagaaccgcuaaaauaaauagucacucauuauggauuccucggacucauuuuaaaggcaguucuguugaacu

SEQ ID NO: 4134162 - RNA, 55 nt, Human
aguuucaguuugaaggaaaggccaaaguuuuguuggguccuucaaagcugggucu

SEQ ID NO: 4134163 - RNA, 57 nt, Human
aguuucauaaccucaagcuacagucaguacuuucuagacucuguagguaaugagacu

SEQ ID NO: 4134164 - RNA, 58 nt, Human
aguuucauauuaccaugucaccagagaguucuuucgaggugcugagugaaaugagauu

SEQ ID NO: 4134165 - RNA, 89 nt, Human
aguuucauguauuuaaguauaagcuauucuucaugauguuugaguaaugucaguucacucuagccuuaugcacaaauauguggguaacu

SEQ ID NO: 4134166 - RNA, 77 nt, Human
aguuuccccagggagagaauggagaggugagggcuuucaaaagccagcaucccuucagucuccauuaugcggagacu

SEQ ID NO: 4134167 - RNA, 64 nt, Human
aguuuccuugggcauuuguuuagggaaaacaauaacauuugaacaaauauuuucaaggaaugcu

SEQ ID NO: 4134168 - RNA, 59 nt, Human
aguuucuaacuggugcagugcugcaacauuaauaguugcucugugaauaguuggugacu

SEQ ID NO: 4134169 - RNA, 66 nt, Human
aguuucucuuaaucuaguaucuauaguacauaaugcaggccugaaagugcuagauuuugaggagcu

SEQ ID NO: 4134170 - RNA, 95 nt, Human
aguuucuuuaugauguguagcaguaugacaagaaauacagagguaggugaacacaccuggccuuuacuuguuuauagugcaauaauaugggagcu

SEQ ID NO: 4134171 - RNA, 55 nt, Human
aguuugaaggaguugaaucaccuugcauugcugggaaguucaugaucuuucugcu

SEQ ID NO: 4134172 - RNA, 81 nt, Human
aguuugacuucugauuguuggaggaugcuugugauuauuucagaaaaaagcauaguauucuuuaaaauuauuugucaaauu

SEQ ID NO: 4134173 - RNA, 59 nt, Human
aguuuggggcaagaggacagauggacgccacaggccaucugucuaaauauuuccaaauu

SEQ ID NO: 4134174 - RNA, 79 nt, Human
aguuuggggccaugcauccuugccccuugucuuugggagaccuccacguaaaggcuggcaaggcagauguguggaaauu

SEQ ID NO: 4134175 - RNA, 130 nt, Human
aguuugggguggaaccaguaucauagauguaaauucuauguucuugaguaagaagaaccccucuuaccuucuuugccuuugaauaguagaaaaaauaaugauacuucucuccuagcuccaccuccagccu

SEQ ID NO: 4134176 - RNA, 70 nt, Human
aguuuguuguuguucaaaauaugcagugucagauaugaucugacacugcauauauugaaguuggcuaacu

SEQ ID NO: 4134177 - RNA, 60 nt, Human
aguuuuaccuaagcuaauugcucuagguuuugauuaccuaaaauaagcuuggguaaaacu

SEQ ID NO: 4134178 - RNA, 81 nt, Human
aguuuuacuauucuuccuaaugguggucauguaaauuauagcuggacauauggccacagucucuggaaggaugucugaacu

SEQ ID NO: 4134179 - RNA, 82 nt, Human
aguuuuaggguacauaugcacaacaugcagguuuguuacauauguauacaugugccauguuggugugcugcacccauuaacu

SEQ ID NO: 4134180 - RNA, 76 nt, Human
aguuuuauggauguugcuaagaccaagacugggcauggacuuguccagggucuucgaggcagcaaugacaaagacu

SEQ ID NO: 4134181 - RNA, 62 nt, Human
aguuuucaccauuuaggaucuugggggccuuugcaugucuggccuaggauguggagaaaauu

SEQ ID NO: 4134182 - RNA, 67 nt, Human
aguuuucuccucugcaggcucauguuucggauuaacgcaggcggugugcuuugcagagcagggggcu

SEQ ID NO: 4134183 - RNA, 58 nt, Human
aguuuugauacuuucucuucauguucuuaaauucuagacuagggaggguguuaauacu

SEQ ID NO: 4134184 - RNA, 123 nt, Human
aguuuuggguuauguuuuuauguggacuguuguuguuugguuuauuucaauugaaaggaaaagaucaauagauaaagcuacauaaacuacuguccaugcaccaaaagcaucauaugcaaaauu

SEQ ID NO: 4134185 - RNA, 68 nt, Human
aguuuuguuugaaagucucuacagcaacucuuacauaauaucuguugcugaagagaaagaacaauccu

SEQ ID NO: 4134186 - RNA, 97 nt, Human
aguuuuuaugggggccuuauuugugccauuucagugguacuuuuccuaagugccucuggcuucugcaucagugggggaaaaaaccgugacaugagcu

SEQ ID NO: 4134187 - RNA, 83 nt, Human
aguuuuugcaaaucacaaauucuacaaucauaugauacguauaugaccuaucauagauacugggaauuuagguuugcagagcu

SEQ ID NO: 4134188 - RNA, 55 nt, Human
auaaaaaugugcacaugaaagggccuuauauacugcucuuuagucacauuuuuau

SEQ ID NO: 4134189 - RNA, 61 nt, Human
auaaaaccaaagcagcaguguuaugguaggagaacuuucaagcauccaugcuuuguuuuau

SEQ ID NO: 4134190 - RNA, 87 nt, Human
auaaaagauugauauaauuagauggggcuugguaacaaauacuauuacauuaugucugaaucuuauuuaaauauauuggccuuuuau

SEQ ID NO: 4134191 - RNA, 69 nt, Human
agggucucaaagcagaccuuuacccuuuagugugaauuagggguggggcagucaugccuuggguacccu

SEQ ID NO: 4134192 - RNA, 89 nt, Human
agggugaaaugacacuggugaaaagguguggcgaugugaauguccuuuguccugccauuugcuuuuucuccaaugugauugugagcuuu

SEQ ID NO: 4134193 - RNA, 64 nt, Human
agggugaggaugggaagggcccaccuccuccaggugagaagcugggcugcccaaccucugaccu

SEQ ID NO: 4134194 - RNA, 101 nt, Human
agggugaguuuuagacuuaaauugcuuuuaacuaaucagggcaagaucauuugauguugcucuuaauuccauuagacuugaaaguuuggggucuuuaccuu

SEQ ID NO: 4134195 - RNA, 62 nt, Human
agggugauaugguuacagugguauguaaacagggguugauaucuaccauaaccauucgccuu

SEQ ID NO: 4134196 - RNA, 58 nt, Human
aggguguacauuuguuggugaaggauugauucaucucccaucaacaccuugucagccu

SEQ ID NO: 4134197 - RNA, 72 nt, Human
aggguuaagaagagaucaaccaguagaaauguguauuuuccaguuucuugcugaaaacaaaucucuuucccu

SEQ ID NO: 4134198 - RNA, 62 nt, Human
aggguucaguccagggccugggacaggaggguauuuguguacagggcuuggggcugaagccu

SEQ ID NO: 4134199 - RNA, 129 nt, Human
aggguuggauaagugaggcaccuaaggaggugcccacucucaggcacugacccugccuacauguccaugucccugagaguaggugucucuuuagauuuggugcuuuaggcucuugacuucccuugcccu

SEQ ID NO: 4134200 - RNA, 79 nt, Human
aggguuguagugaggaguaaguaauaugucacacggguuuucccagacaugucuaaguacucaacaaauggcagccacu

SEQ ID NO: 4134201 - RNA, 127 nt, Human
aggguuucaccauguuggcugggauggucuugaucucucgaccucgugaucugccggccuuggccucccaaagugcugggauuacaggugugagccaccaugcccgggccaacagccucuuaacuuu

SEQ ID NO: 4134202 - RNA, 77 nt, Human
aggguuuccucauuguuuuggaagaacuuacucugauaauccaagugauuauguccaggagaacgacuauaaacucu

SEQ ID NO: 4134203 - RNA, 77 nt, Human
aggguuuccuggaccccugcuggccacugcuccaccucacaugcagaggugaggcccaguagggccuggucugccuu

SEQ ID NO: 4134204 - RNA, 63 nt, Human
aggguuucucuccaguguggacccucugauggauaaggaggucggagcuguagaugaaacccu

SEQ ID NO: 4134205 - RNA, 110 nt, Human
aggguuugggccuggaggaugcuguccugauguccccuuagcugagccuuaaaucucccacaacgguccagaaugaggcacauccaggccagcuccuguggccaaacccu

SEQ ID NO: 4134206 - RNA, 75 nt, Human
agguaaacaagaguccagaacuucagcuaguuuuuuggacacauagaacuaucacuuuuugguuuuuguuugcuu

SEQ ID NO: 4134207 - RNA, 59 nt, Human
agguaaauuauguuccauguccuuuggggugacaagaaaguggguaauaugauuucccu

SEQ ID NO: 4134208 - RNA, 77 nt, Human
agguaaauuuccuacugaagcaccauuaaagacaaguguguaugugucugugugguuuucagaauugaaaacuaccu

SEQ ID NO: 4134209 - RNA, 80 nt, Human
agguaacaagaagaaugauccugggaaggaugacuuuucuauugguuaauucaugggcccagugauaucauuaauuaccu

SEQ ID NO: 4134210 - RNA, 61 nt, Human
agguaagaaugcuuccuugccucuuucaagcuucuggugguuuucauggcauuccuugccu

SEQ ID NO: 4134211 - RNA, 81 nt, Human
agguaagacugcugcaaaagucauugugguuuuugccauuacuuuuaauggcaaagacugcaaggacuuuugcaccaaccu

SEQ ID NO: 4134212 - RNA, 73 nt, Human
agguaaggaguacaaaugcagguuuguuacauagguaaacuugugucaugggguuguuuuguacagauuaucu

SEQ ID NO: 4134213 - RNA, 71 nt, Human
agguaauauauuugcauuuuaaacaggcaccuuauccuagaggacugccugaugcaggaguaucagagccu

SEQ ID NO: 4134214 - RNA, 81 nt, Human
agguaaugccuucgaucagagcccugaugacagacuguggagugcaaguuuuuucaggugcucuguuugcucaguaauccu

SEQ ID NO: 4134215 - RNA, 94 nt, Human
agguaaugcuaaacaaugccuguauuaagauacguaguuguaaauuuccugguuuaaaagcauaugucuuauauauuuaaauuguugcuuaucu

SEQ ID NO: 4134216 - RNA, 73 nt, Human
agguaauguuucacaagcaacggguaagggagucccuaauuucuggguuuggaaacugguagaaugauuaccu

SEQ ID NO: 4134217 - RNA, 60 nt, Human
agguaauguuuuagauuacugcuggguucuucugggccuggcaacauaaagaacaaaucu

SEQ ID NO: 4134218 - RNA, 74 nt, Human
agguacacguguguaccuuuguacaaacaugcauacacacacaugcacacauacacagguacacauauguaccu

SEQ ID NO: 4134219 - RNA, 70 nt, Human
agguaccagcagaaucagugucuggugagggcuuccugguucacagucggugacuucuugcugcgugcuu

SEQ ID NO: 4134220 - RNA, 105 nt, Human
agguacuaaucacuagaaagcccucugagaauaugagcucuuuguuucauaaauaagaccaguaugcauuuucacaggauuuauaaugcuuugguaauuagaccu

SEQ ID NO: 4134221 - RNA, 84 nt, Human
agguacugaggucccaucaaugacuaauaaaauagcccccacaugguggcuguuuuauuauucauuugagggacgucaguaccu

SEQ ID NO: 4134222 - RNA, 63 nt, Human
agguagcccuuggggccuaugcaagcugcuauuguacuuagaaugggacccaauggguagccu

SEQ ID NO: 4134223 - RNA, 57 nt, Human
agguagcuuaugaaaugugaggggccaccacacagugccccacacuauugagcacuu

SEQ ID NO: 4134224 - RNA, 85 nt, Human
agguaggaggaaaauggcagaccugggcuggagaagaaccuucuccguaucccaggugugccuggcaguaugguuuccucuuccu

SEQ ID NO: 4134225 - RNA, 92 nt, Human
agguagguggggcaagaguaccuacagauguaaaugaaacagaaaaagucugcuucauuucucucuguagaccaucuuuaucugaccuauuu

SEQ ID NO: 4134226 - RNA, 75 nt, Human
agguagguucgucugguuuggguugcuauggcugauagacuccaccaggcagcaccaaagccgguaaacuaaccu

SEQ ID NO: 4134227 - RNA, 76 nt, Human
agguaguauaauguagccauuaagcauuuggguuugagauacagugccagauacauuaguaguuacuuguugaccu

SEQ ID NO: 4134228 - RNA, 59 nt, Human
agguauacaggagcucauuauaguuuucuuucuagaaaacuguugcuucaauguauccu

SEQ ID NO: 4134229 - RNA, 71 nt, Human
agguauauugaaugcuuacuuaauauaucaaaaauuguaugauaugggcaaaaauaggcaucaaauuaccu

SEQ ID NO: 4134230 - RNA, 82 nt, Human
agguaucugagugucucuugagcucaguucugaugucucugacaucaagugguucuccagguugcacucacaacugaugcuu

SEQ ID NO: 4134231 - RNA, 65 nt, Human
agguaucuucuuugcgccagguuuuuccuagguucuuuggguagaauuguaaauagaauauaccu

SEQ ID NO: 4134232 - RNA, 59 nt, Human
agguaugauaguccaaguuuccuggccagugcgccuucgaggacacccuaucaauaccu

SEQ ID NO: 4134233 - RNA, 75 nt, Human
agguaugcuaauugccagggucaccacuggaacuucucaccaggcaccagggugaccagcuggccuaguuugccu

SEQ ID NO: 4134234 - RNA, 89 nt, Human
agguauuagguuggugcaaaggcaauugcaguuuuugccauugaaaguaaugccaagaccacaauugcuuuugcaccaaucuaauauuu

SEQ ID NO: 4134235 - RNA, 61 nt, Human
agguauuauuagcaucucuauuuugcaggugaagaaacaagcccagagagguuaaguaccu

SEQ ID NO: 4134236 - RNA, 75 nt, Human
agguauugagggcuuuacagaaagagaacucuggguuacaggacucagucucuuccugcagggaucucacgaucu

SEQ ID NO: 4134237 - RNA, 83 nt, Human
agguauugugcaucaauuucccaugugucagagaaaggaacaguuuagccuugacaccaagaggucugcacacacaaauaccu

SEQ ID NO: 4134238 - RNA, 81 nt, Human
agguauuuuaagauucacaucuuuuggccuauucugaggccaaaugguuuuaguaccaaccagaagaugcuuaaagcaccu

SEQ ID NO: 4134239 - RNA, 70 nt, Human
aggucaagucccuugucuaaguucacacagguggacccaggugacacuucaaagaccagggucuuaacuu

SEQ ID NO: 4134240 - RNA, 92 nt, Human
aggucacacagcuagucagaggcagggccaagguucaaacagauuggcuagacucaugagcccuggcuucuaacuacuaugcuaugcuaccu

SEQ ID NO: 4134241 - RNA, 58 nt, Human
aggucacauggauaaugaucagaggacaagaguuuccugacuccuaucacaguguucu

SEQ ID NO: 4134242 - RNA, 76 nt, Human
aggucacgcgccuaugguccuggcgagaacgucuccaaagugggcagcauguggccugggacugguagugugaccu

SEQ ID NO: 4134243 - RNA, 66 nt, Human
aggucagacaccgucuauuuugccuggucucugacccaucagguaacaggcauaggcuucugacuu

SEQ ID NO: 4134244 - RNA, 65 nt, Human
aggucagagcaauguauugcuucugguuuguuaagcaauguguagcagugcauugcuucugauuu

SEQ ID NO: 4134245 - RNA, 78 nt, Human
aggucaguggcaaggcuggaauggaaccuaggucuuuaguuucuggcacagcauuuguuccgcuuugucaucugucuu

SEQ ID NO: 4134246 - RNA, 79 nt, Human
aggucauagaaagacauaguugcaagaugggauuagaaaccauaugucucaucagcacccuauguccuuucucugcccu

SEQ ID NO: 4134247 - RNA, 76 nt, Human
aggucaucaguguuguugauuggauagaaagacaaaagucaauuaccugcuaaucaauaaaggucauuucugaucu

SEQ ID NO: 4134248 - RNA, 55 nt, Human
agguccagaucccagcuucagccuaucuuuaggagcugcauggauaccugguucu

SEQ ID NO: 4134249 - RNA, 57 nt, Human
agguccagcucuauugaaaagauauaauagacuaucuuuagaauauaguaggacucu

SEQ ID NO: 4134250 - RNA, 67 nt, Human
agguccgauuucagugcugucauuuguaugaagguuuuccuuguacauugaaagucauuuaaucccu

SEQ ID NO: 4134251 - RNA, 78 nt, Human
agguccuuauggccugcccacaguaguuugggccugagugucacauugaauugggcaggucauguaacuagaggaccu

SEQ ID NO: 4134252 - RNA, 73 nt, Human
aggucguggacaaccaggcugggacccagggccagcugaaggugcugggugccaaccucugguggccauaccu

SEQ ID NO: 4134253 - RNA, 74 nt, Human
aggucuaacaauaguugugaaucaggacuagacaauaccaguuuugaaguaccugguucugacuccaaagaccu

SEQ ID NO: 4134254 - RNA, 64 nt, Human
aggucuccccauuaaaacuuaaagaugguuacauauuuuauucugaguuaaaauggagagucuu

SEQ ID NO: 4134255 - RNA, 102 nt, Human
aggucuggagcaggaugaaacucugcaucuccaacgaguucccaggugaagcugauccugcuggucugggagcacucuuugggaagcaccuguucuagauuu

SEQ ID NO: 4134256 - RNA, 81 nt, Human
aggucuggccucuuuccccagcuguagaacaaaaggcugucugcaggcuucagccuagagcuggaggugaggaaggaaccu

SEQ ID NO: 4134257 - RNA, 74 nt, Human
auaaaguggaaggauccacuaaguucuuguucucgggcuagcuaugggacuuuugguggaucaagccauucugu

SEQ ID NO: 4134258 - RNA, 62 nt, Human
auaaaguuacucucacugagaaugguauauuauuugccauuaucuauguagaaugauuuuau

SEQ ID NO: 4134259 - RNA, 112 nt, Human
auaaauaauccaaacuaacccuaaaauuauaccaaaaaauuaaugugauuaggaugguaauucacagucacauaguguuuuggaaucuuuguggugaaaauaaauuguuugu

SEQ ID NO: 4134260 - RNA, 61 nt, Human
auaaaucagcauagcuguguuucaauaaaacuuuauugacaaaaacaggugguugaaguau

SEQ ID NO: 4134261 - RNA, 67 nt, Human
auaaauccucaguuuucuaguauggcauuucaccacugaugcugaaauuagaacauugagggcuugu

SEQ ID NO: 4134262 - RNA, 61 nt, Human
auaaaugaacauucacagagcuuuuaucacuugucacuguguucugugauuuuacauuugu

SEQ ID NO: 4134263 - RNA, 78 nt, Human
auaaauguuuguugaaugaauaaacgagccccauuugcagaaggguauccacuaugcauucauucaaucagcuuuuau

SEQ ID NO: 4134264 - RNA, 75 nt, Human
auaacaugauguuaacuugguagucuaaguguuuagcuaucaagccggauuccuuaguagaccaaaucuuguuau

SEQ ID NO: 4134265 - RNA, 78 nt, Human
aggcgcaggcaugucucugcugucauugccucccucucucuugcuccgggcccccucagcacaggccugucuuugucu

SEQ ID NO: 4134266 - RNA, 58 nt, Human
aggcgcagguggauaucaugugccuauggauagaggcgcagcuggauaucaugugccu

SEQ ID NO: 4134267 - RNA, 69 nt, Human
aggcggacuggacucucaggcucacaucucaaauauggcuugugggugugguuguccucucuagagccu

SEQ ID NO: 4134268 - RNA, 56 nt, Human
aggcggagcucaguguguccaauaaaacugucuugguagagcgccuguauccgcuu

SEQ ID NO: 4134269 - RNA, 95 nt, Human
aggcgggaggaaaaggcaggugcaggugggcguggcgagaaggcgcaccuuguagucuuccccggcgugcgcgccccgugacuccuuccccgccu

SEQ ID NO: 4134270 - RNA, 57 nt, Human
aggcgggagggauguuguagacuccucacuccaugagcauacaguauuuucucgccu

SEQ ID NO: 4134271 - RNA, 74 nt, Human
aggcggggaggggaaugcugaauaauaagauuacucagagcuacuaacgaucuugauucaguaauuuucugcuu

SEQ ID NO: 4134272 - RNA, 66 nt, Human
aggcggguggaucaccugaggccagaaguuggagaccagccuggccaacguggugaaaccccgucu

SEQ ID NO: 4134273 - RNA, 93 nt, Human
aggcgguuaagccaugggacagggccgcagauggagacugcucaaggucaaaggggucuccagcugggacccugcaccugguucguagccccu

SEQ ID NO: 4134274 - RNA, 84 nt, Human
aggcguggacaaaguuaaaggaaguuccagggaggggguuugauuuucuggucccugggacggccuuuuggagaguccugcacu

SEQ ID NO: 4134275 - RNA, 78 nt, Human
aggcuagagugcaguggcagauccuagcucacgacaaccuccaucuccugggcucaagcgauucuuccgccucagucu

SEQ ID NO: 4134276 - RNA, 85 nt, Human
aggcuaggauuacaaagguaguuuugucuauaaauuaucaagugguuguucauaugacauaaaaucauuuuuguucuccuguccu

SEQ ID NO: 4134277 - RNA, 74 nt, Human
aggcuagggccauggcuggugagcaauggauccagaugagaaccaaaggucgaugacaccaguugucugagccu

SEQ ID NO: 4134278 - RNA, 71 nt, Human
aggcuaugagcagagacuucaagggcagggccagggaacauuccugaacucugggucucugcucugggccu

SEQ ID NO: 4134279 - RNA, 78 nt, Human
aggcuaugguggggccagcggcauggaagucaucacugcuguaauggucaaccagagccugcugagccccauuaaccu

SEQ ID NO: 4134280 - RNA, 60 nt, Human
aggcuaugguggggccagcggcaugggaggcaucaccgccaucacguucaaccaaagccu

SEQ ID NO: 4134281 - RNA, 129 nt, Human
aggcucacaccucauguccuuuuacucaggucuugggacgacagagcccagcuugcacauggagccaggaggcagaauguccaagcugggccccccacgggaccaugaacaagggacccuugugugccu

SEQ ID NO: 4134282 - RNA, 129 nt, Human
aggcucagagcuagcccuucuggccccaccggucucaucuguccccacaucagucugaggcccugcuuggaaccucaggccagggggcggccagggacgcggggucccagccaggcgggcucccaugcu

SEQ ID NO: 4134283 - RNA, 56 nt, Human
aggcucagaggugagcaucugcuaacaaaugucagugcagucccauuucugagccu

SEQ ID NO: 4134284 - RNA, 77 nt, Human
aggcucagccugggccuagagcuggugaccucaaaucucggccuuuguuggcuccccuaggacuguaggcugcgcuu

SEQ ID NO: 4134285 - RNA, 59 nt, Human
aggcuccaagagguuaagucacuggcauuuaugcuuauagcuugugaguuuuggagcuu

SEQ ID NO: 4134286 - RNA, 65 nt, Human
aggcuccaggccucccugcaugcccucuacgccccauccaagggaccugacagaaccuggagccu

SEQ ID NO: 4134287 - RNA, 55 nt, Human
aggcucgcucaucucagccgccagaagugucaucccagggaaggugagcgaggcu

SEQ ID NO: 4134288 - RNA, 125 nt, Human
aggcucugcgucugugcccccaaguagucagagagcccagaucccacccuggagaaaugggaagugucccaucacauccacagggaugccugcggcuucuaguuucuggcccaagaccaggacuu

SEQ ID NO: 4134289 - RNA, 69 nt, Human
aggcugaaguguaguggcucacugcagccucaaccacccugggcucaagugauccuccuaccucagccu

SEQ ID NO: 4134290 - RNA, 77 nt, Human
aggcugaccucaagugauccacccgccucaaccucccaaagugcugggauuacaggcaugagucacugcaccggucu

SEQ ID NO: 4134291 - RNA, 82 nt, Human
aggcugaggcugagggaugggggcagcagguccucuuucagagggggcucugggucgugucuccauguccacaccaaagccu

SEQ ID NO: 4134292 - RNA, 58 nt, Human
aggcugccaggcauauggccucuuugugcccacacaauggaggcccugucugugcccu

SEQ ID NO: 4134293 - RNA, 62 nt, Human
aggcugccuagguucaacaccugguuccauuacuuaccaggugugugagcuugggcagaccu

SEQ ID NO: 4134294 - RNA, 78 nt, Human
aggcugcgcuccugccacucugggugggccuggcagccuaggcagccuaggcagccuggggugcgcuagaggcaggcu

SEQ ID NO: 4134295 - RNA, 100 nt, Human
aggcugcugggcggaggcugggugaccaaggaagaggggagccagggcugggccugagggcugucugaagcuugggagucacggucucagcucagcaccu

SEQ ID NO: 4134296 - RNA, 68 nt, Human
aggcuggaaagggaccagagugcguugugaauaagcguaucuuuuguauucuguuccuucuacugccu

SEQ ID NO: 4134297 - RNA, 78 nt, Human
aggcuggaaauaaaaguaggaaugaaacgcauggaaguacccaguguccaugcaccucaccucuacuuuauccagcuu

SEQ ID NO: 4134298 - RNA, 85 nt, Human
aggcuggagaaggaucagaggaucagggacaguuucaguagcaugcacuaaacugaauuccucuuucuuauccucucagcagcuu

SEQ ID NO: 4134299 - RNA, 66 nt, Human
aggcuggaguacaguggcuauucacaggugcaaucauaguacauuauaaccuugaacuccuggccu

SEQ ID NO: 4134300 - RNA, 73 nt, Human
aggcuggagugcaguggcgugaucucagcucacugcaaguuccgccuccuggguucacgccauucuccugccu

SEQ ID NO: 4134301 - RNA, 62 nt, Human
aggcuggagugcaguggcgugaucucagcucccggguucacaccauucuccugccucugccu

SEQ ID NO: 4134302 - RNA, 73 nt, Human
aggcuggagugcaguggcgugaucucagcucgcugcaagcuccgccuccuggguucacgccauucuccugccu

SEQ ID NO: 4134303 - RNA, 56 nt, Human
aggcugggcuccgcccaacuccacucacuggagcuuguccuuggagcccagagccu

SEQ ID NO: 4134304 - RNA, 99 nt, Human
aggcugucauaauuuggaauggaauagagauugcuaacucaaucuuagcuggcaauccucuuuuauaucagugacaugacaaaacaaaacuuucagcuu

SEQ ID NO: 4134305 - RNA, 82 nt, Human
aggcugugcuuccaggauggcagcuggguaaaagcauuccuacuuuuucagcagcauacacaucauguugauggcaaagccu

SEQ ID NO: 4134306 - RNA, 58 nt, Human
aggcuguguuuaagugguaauguuaauggaauuauccguugcugcuggagcacugucu

SEQ ID NO: 4134307 - RNA, 81 nt, Human
aggcuguugaggcaauuuacugcuucucaauaauuuagucucaugaaaaaguacaguggcaguaacauuccacaauagcuu

SEQ ID NO: 4134308 - RNA, 105 nt, Human
aggcuguuuugguuaugacagucuuauaguacaauuugaagucagguaauaugauaccuccagcuuuguucuuugugcuuaggauugucuuuggcuauucaguuu

SEQ ID NO: 4134309 - RNA, 55 nt, Human
aggcuuaacuacaauuuuugccaugaauuuaagcuggcauuuuuuaguugagcuu

SEQ ID NO: 4134310 - RNA, 119 nt, Human
aggcuuagcauuuuuauuucaucuucuguuucucuguccuugguuuuuuuaaaaaauguauagaacacuaaauauagacagaugacagggauacagaaaggaagaauuuaauguaguuu

SEQ ID NO: 4134311 - RNA, 68 nt, Human
aggcuucaggagacucagcauccaggaugggaaagaccaucaaagauaagauguggggucuccagucu

SEQ ID NO: 4134312 - RNA, 57 nt, Human
aggcuucuaggguuggcagcggcagguuuucauuagcacguccaggccugaagggcu

SEQ ID NO: 4134313 - RNA, 64 nt, Human
aggcuugcagaaugaaugcuucuucaggucggagugccuuaauaagcauucauucagcaagccu

SEQ ID NO: 4134314 - RNA, 75 nt, Human
aggcuugcugagccugcccagcccuguccacuucacacagcaaguuaguguucgcugggacaggcuucaaggucu

SEQ ID NO: 4134315 - RNA, 80 nt, Human
aggcuuggaaaacaggguuucacccacacacaccauguuguaaaaaggugccauguuuugcuucucuguuucccaacccu

SEQ ID NO: 4134316 - RNA, 64 nt, Human
agguggcagaccauccucccuauuggccgaucaauuuggucaacagagguaaugguaaccaccu

SEQ ID NO: 4134317 - RNA, 66 nt, Human
agguggcagagcagagugauuguucuggccucuguugccagaugggcuaacucugcucuguaacuu

SEQ ID NO: 4134318 - RNA, 57 nt, Human
agguggcucacaccgguaaucucagcacuuugggaggcugagguggguggaucaccu

SEQ ID NO: 4134319 - RNA, 57 nt, Human
agguggcucacgccuguaaucccagcacuuugggaggccaacgcaggcaggucaccu

SEQ ID NO: 4134320 - RNA, 76 nt, Human
agguggcugucuuauguauauuuggaacguacaucugucuugguguauuuuuauuaauccauguuuauugucaucu

SEQ ID NO: 4134321 - RNA, 59 nt, Human
aggugggaagugagcagcgggaugaaguugcaagggugucucugcugcgcaucccacuu

SEQ ID NO: 4134322 - RNA, 56 nt, Human
aggugggacgugggaggaugagacaaguaaggacucucugagcccagugucccccu

SEQ ID NO: 4134323 - RNA, 90 nt, Human
aggugggcgaggacugagccucgguguuuuuuugggugguggcuggaaacagccccucucccacguggcagaggcucagccuggcucccu

SEQ ID NO: 4134324 - RNA, 66 nt, Human
agguggguggaucguuugagcucaggaguucaagacaagacugggccacauggugaaacccuaucu

SEQ ID NO: 4134325 - RNA, 64 nt, Human
aggugguaucaucacaaugcaucuagcauccagccuucccagauguacaggauggugcucaucu

SEQ ID NO: 4134326 - RNA, 88 nt, Human
agguggugcuggaaguggacuggagcugagagcauggguaaagggaagucuuuccugcgcucucaguucacacaaccacuucucuccu

SEQ ID NO: 4134327 - RNA, 57 nt, Human
aggugguucaugccuguaaucccagcacuuugggaggcugagguggguggaucaccu

SEQ ID NO: 4134328 - RNA, 57 nt, Human
aggugguucaugccuguaauucuagcaguuugggagacugagguggguggaucaccu

SEQ ID NO: 4134329 - RNA, 61 nt, Human
aggugguuuuuguacuggguccaauugucuugauaaauaguggaacuggugaaaaccuccu

SEQ ID NO: 4134330 - RNA, 129 nt, Human
aggugucaguggcagguguuucguggugcuaccggacaggcagaaugaccgaccucgccgggcgaccgcucccagccgcgagaauccuguauucguuuaucugggagugaccauccucgcuacucagcu

SEQ ID NO: 4134331 - RNA, 85 nt, Human
aggugucgaagcaaaauuacagaauguaagguaguuaaucugguggacagugagcacuuugugcauuucugaagccacgauaccu

SEQ ID NO: 4134332 - RNA, 79 nt, Human
aggugucuaggcaauauuagacuuugucuuuuuaauuuucauauaaaaauuugaaguauaaguaauugcuuucaggccu

SEQ ID NO: 4134333 - RNA, 62 nt, Human
aggugucuggaacuuuuuaacaagcugcuggagaacccagagcaugaauaaaaguuacacuu

SEQ ID NO: 4134334 - RNA, 62 nt, Human
aggugugaagucacugaguaaauccaaaugccuuauuggauuauccagugcacuucacagcu

SEQ ID NO: 4134335 - RNA, 68 nt, Human
aggugugaauuuuccagauaagcccuguugcuccagaaaagccacaaauacuggaaauuucuccaccu

SEQ ID NO: 4134336 - RNA, 55 nt, Human
agguguggaagcugggauagaauagaguuaguacucucucacaguuuccuugccu

SEQ ID NO: 4134337 - RNA, 60 nt, Human
agguguggcuugaagucucuauggggacagccccuauaaauggagacucagcccaugccu

SEQ ID NO: 4134338 - RNA, 75 nt, Human
aggugugucugaaguucuuaaauuaguuucucaaucuggggaaguguuuuaguucuucagguuacaauuauaccu

SEQ ID NO: 4134339 - RNA, 66 nt, Human
aggugugugugugugugcauguguguguauguguguguguguaugcauacacacauagaagugccu

SEQ ID NO: 4134340 - RNA, 66 nt, Human
agucugucaugaggcaggagugcaguggcacgaucucaguucacugcaaccuccgccucccagauu

SEQ ID NO: 4134341 - RNA, 84 nt, Human
agucugugccacauggccuaauagagaagaauuuaauauaaaaauuccuaguaauuuaucuuuguuuccccauaaugguuugcu

SEQ ID NO: 4134342 - RNA, 62 nt, Human
agucuuaccgcaccucaugaacuggcugaaggcuuuguaguuggugagcgugugguaauccu

SEQ ID NO: 4134343 - RNA, 77 nt, Human
agucuuacucuguaccaguagugcccagggacauuuguuuuucagaauucuuggaaacauuacuggacagugagguu

SEQ ID NO: 4134344 - RNA, 55 nt, Human
agucuuccugggggaagaccacgggaguccacaagaggcugccuccugggagauu

SEQ ID NO: 4134345 - RNA, 84 nt, Human
agucuugcucugucaccgaggcuggagugcaguggcgugaucuuggcucacugcaaccuccgccucccagguucaagcaauucu

SEQ ID NO: 4134346 - RNA, 75 nt, Human
agucuugguaugguaaaaauauggacauguuuggaacauggaacuguuacuaaucuuuucugcuauuuuaaggcu

SEQ ID NO: 4134347 - RNA, 64 nt, Human
agucuuuacuaaacagaccaccauucuuuuuccuugcaaauguggcucuguugagguauggauu

SEQ ID NO: 4134348 - RNA, 56 nt, Human
agucuuuauugucgucacuagaagggccacagggccacagucaugacgauauggcu

SEQ ID NO: 4134349 - RNA, 56 nt, Human
auccacaggguguguuaagauguaauuuuaaugcuuuugucauucuuucuguggau

SEQ ID NO: 4134350 - RNA, 80 nt, Human
auccacgucccuuugcuggggcuggugaggcaggcuccagaggggccuugcccuacaaccaguagcccucggauuuggau

SEQ ID NO: 4134351 - RNA, 84 nt, Human
auccacucacuagagguagaucccugauucacugauaugaaaagaaguggauaacagguaaauaauucauagugagguuuggau

SEQ ID NO: 4134352 - RNA, 62 nt, Human
auccagaggcacagagcccuaggagcugguagccccagugccuaggcugugccucuagugau

SEQ ID NO: 4134353 - RNA, 57 nt, Human
auccagcagaaaccuccaucuagccucagagucagggaaagagggaaucaguuggau

SEQ ID NO: 4134354 - RNA, 64 nt, Human
auccagcauggcagccaugagccacauguuacuauugagagcuuuauauauggcuggucuggau

SEQ ID NO: 4134355 - RNA, 64 nt, Human
auccaggaguccugaaaucugaugacuuuuauccucacaagguuauguuaggauucaaugagau

SEQ ID NO: 4134356 - RNA, 124 nt, Human
auccagggaggauuugugaagggaagauggugaagcugaggauacaugaagccucccucaaccagguaggcuucauguguccugggugacccaggccuuugcuccccuccuuccucccucggau

SEQ ID NO: 4134357 - RNA, 128 nt, Human
auccaguggacacaauucagucauuaagucacacugcugggaacucuauaugccauuuuauuccauaucaaacaguuguuuccuguagguagacucaugcugcaagcuguccuaaauguuuuugguau

SEQ ID NO: 4134358 - RNA, 57 nt, Human
auccauuauugggccaauaaagaaauuagcacucaaauauuugcucaauaaguggau

SEQ ID NO: 4134359 - RNA, 61 nt, Human
auccauugguugacuugggcuuaugacuugguugggucaauagcauagcaauuaaugugau

SEQ ID NO: 4134360 - RNA, 86 nt, Human
aucccacagugaguagcagaguuggacuaugcaauagauuccugaaccucuuuguauaucacaagacugugcuaggugcuagggau

SEQ ID NO: 4134361 - RNA, 57 nt, Human
aucccacccacacuccugucccugcaguagggaggggcagcaggagauggguggggu

SEQ ID NO: 4134362 - RNA, 57 nt, Human
aucccaggaggcugcgcaguuaucagcaugaaaagcagcugcaggccucccagggau

SEQ ID NO: 4134363 - RNA, 91 nt, Human
aucccauccuaagggucugcuuucugggaacucuuuuggucucaacugacauucucugaaagcagagccuaaagaauaugauaucagggau

SEQ ID NO: 4134364 - RNA, 62 nt, Human
aucccuagagugauauuucucacaagauuguccuucagucuucugaauaagaaucacuggau

SEQ ID NO: 4134365 - RNA, 115 nt, Human
aucccucauggacaggcccaaacccaccucuuuuucagcaacuuccggaaguccaucagcuccuuccugaggucugaaaaaggagcaggaaugaggccucagucccaggugggau

SEQ ID NO: 4134366 - RNA, 92 nt, Human
aucccugaagaucuuguuagaaagcagauucugaugcaguaggucuaaggugagaccugagauucugucuuucugaugagcucccaggugau

SEQ ID NO: 4134367 - RNA, 55 nt, Human
aucccugaaugcuccugacuggucauacccaacacauaggucagcuucaugggau

SEQ ID NO: 4134368 - RNA, 63 nt, Human
aucccuguguguguguguguguguguguguguguguacuugcauaaaaaccacauacaaggau

SEQ ID NO: 4134369 - RNA, 87 nt, Human
auccgcacuggccaggcuggguggagggaggacuccagacagacccugcuaccugccgcccuccacacagccccuggccugcagggu

SEQ ID NO: 4134370 - RNA, 80 nt, Human
auccggaauucuuuuaauguucugaaguuucaugcuuuucccugcugagccuggaagcucucuacauaagaaugcuggau

SEQ ID NO: 4134371 - RNA, 112 nt, Human
auccuaaaagcaagcucgugugugauguuucauaauauccagagauuuuguagaaaaacaaauugucaguuaucugggauaaugaccaugaagcaugugcuuauuuaagggu

SEQ ID NO: 4134372 - RNA, 76 nt, Human
auccuagauggagaguucacuucuaaguuguguaauaacauuguuuucaaguuuaguggugguguuccauggggau

SEQ ID NO: 4134373 - RNA, 93 nt, Human
auccuauaaacuaguagugagugcaauaaacuguuuucuaguaauggcaguuccuagaggacguuguuagcucacaagauggaauuguaggau

SEQ ID NO: 4134374 - RNA, 73 nt, Human
auccuauguuauuauuuuucaguuaucuguaauauuuuggucagaugugcuuuauuaaguaaaaauauagggu

SEQ ID NO: 4134375 - RNA, 65 nt, Human
auccucuucucaaaucauggugaaauaaaauggauagacuucaucagaggagcaaaagaggggau

SEQ ID NO: 4134376 - RNA, 79 nt, Human
auccugacuuacuuuguuugcacuucaccuguagcgacagcaucagugagguggagaacagggauagaguccuagagau

SEQ ID NO: 4134377 - RNA, 88 nt, Human
auccugagcugcuucugaggcagagggcagaccagacuccucuggcaccucugcuucucugcuuuccucuugauuuagcagccaggau

SEQ ID NO: 4134378 - RNA, 113 nt, Human
auccugccauuugguccagaaagccagugcacaaguagaggaggggacauagcuuagccacaaagugauggagcuuccucugcuagcccuuugugagccaaugguaaaugggu

SEQ ID NO: 4134379 - RNA, 66 nt, Human
auccuggggaccuuccaggucucguggggacugagauaacacugaugcccuggaggucuucggggu

SEQ ID NO: 4134380 - RNA, 55 nt, Human
auccugucucuacccaucggcuccuacagcaggacagagaggcagaggcuggggu

SEQ ID NO: 4134381 - RNA, 72 nt, Human
auccugugaggauaagcccuugggaggcuccacuuuguccuccaguaacaaguggacuagucuuuacaggau

SEQ ID NO: 4134382 - RNA, 66 nt, Human
auccugugccacgucgcuucuucucuucugauuguagcagugaugagguuuugauuggcacaggau

SEQ ID NO: 4134383 - RNA, 69 nt, Human
auccuguguucugagagcgagagagcagcuuagccggcaaauccuuaaauccuucagagauuacaggau

SEQ ID NO: 4134384 - RNA, 56 nt, Human
auccuuaaaggaauucugauuucaaguuugaaauaagaaccauccuuuguguggau

SEQ ID NO: 4134385 - RNA, 74 nt, Human
auccuuagagcccuagagaaccagccugugccaaguaccuguguggcgcgggcugggucucuggccaacaggau

SEQ ID NO: 4134386 - RNA, 57 nt, Human
auccuugcucagagaaggucagucuuuuguucuauucuggccuucaacugauuggau

SEQ ID NO: 4134387 - RNA, 55 nt, Human
auccuuggaugugucuuuuugugauacauauuucuuuaggguacauaucaaggau

SEQ ID NO: 4134388 - RNA, 75 nt, Human
auccuugggcuaagcauuaccuuauauuaaaguuuugaauacauuaauccaauggcacaauguauggccaaggau

SEQ ID NO: 4134389 - RNA, 98 nt, Human
auccuuuuugcucuauuugaauaauuuugagagccuggaaaaucuggacauauuuucugaagguuaaggaauuaggaaagcaaaagagaaucugggau

SEQ ID NO: 4134390 - RNA, 74 nt, Human
aucgcauagagguccugcucaaaauguagauuucuggguccuaaauuaaucugcugagucagaccucuggggau

SEQ ID NO: 4134391 - RNA, 61 nt, Human
aucgcuggguggccgcggcggcgacagcguccugcgccucgccagccuguuuaccuguggu

SEQ ID NO: 4134392 - RNA, 61 nt, Human
aucgguuuaaguucuugcuuuuaaucauuuuggguauauaccuagaagcagaauugcugau

SEQ ID NO: 4134393 - RNA, 69 nt, Human
aucgucugaugauggggccauaacagccuggacacugaucacaggugugugccuuaucaaaugggugau

SEQ ID NO: 4134394 - RNA, 72 nt, Human
aucgugccuuagcaaacaucuucgugugagcuacuucgugagcccacauguauguguuuguugaggggcgau

SEQ ID NO: 4134395 - RNA, 82 nt, Human
aucuaagucuauuucauccuugaauaaaaugggaacaauaguaaucauaggauuguugcaaggguuaaaugagaaaauagau

SEQ ID NO: 4134396 - RNA, 84 nt, Human
aucuaauuucuccacuucauccagggucaccagggcccccauguuagcccugggacacagugugugaagugccagagcauagau

SEQ ID NO: 4134397 - RNA, 69 nt, Human
aucuacagaauucaacaaaugguuaaugacauuuucuacguaccagacacguuucugaauucugaagau

SEQ ID NO: 4134398 - RNA, 65 nt, Human
aucuaggcacuucaucaagccauggagucaggaaacaaggaagaauagaugaagcugcuggggau

SEQ ID NO: 4134399 - RNA, 85 nt, Human
aucuauguaauugucaaaaauugcaauugucauucaauacacauguuugagcacacaaugagcuaacuuuugggaauucaaagau

SEQ ID NO: 4134400 - RNA, 127 nt, Human
aucuauuuauauuuuuaucaucuuaaccauuuuuaaggguauaguucaguaguguuaaguauauucacauuguugugcaauuauaguuuuuuuaagaaaggaaucuaauuuaucaaugaauguagau

SEQ ID NO: 4134401 - RNA, 56 nt, Human
aucucaaaugauuacaccaagcagccggcaagacccgcuuugggucauuuagagau

SEQ ID NO: 4134402 - RNA, 69 nt, Human
aucucaccaaguuauuacgagaugcaaacuuuaaacuguaacuucuauguaaaugugaguuggugggau

SEQ ID NO: 4134403 - RNA, 78 nt, Human
aucucacuucuucucuccuggcuuccacagaggaugaaaccaggcauuccuuggccuaaggagaagagggagagggau

SEQ ID NO: 4134404 - RNA, 66 nt, Human
aucucagcacuuuggaaggcugaugcgggaggaaugcuuacucaguuacucuugagaggcugaggu

SEQ ID NO: 4134405 - RNA, 89 nt, Human
aucucaggccauuuguggcaagugcuuccccaaccacaguuguuauacaacacuacaacucugugugcacuuguuagaucucugagcau

SEQ ID NO: 4134406 - RNA, 58 nt, Human
aucucaggcccuagugaccucaccuauaaauuuggggugggcagugauaggccuggau

SEQ ID NO: 4134407 - RNA, 55 nt, Human
aucucagggcuggagcccuggaaucuguauuuuuucaaagccucgagaccuggau

SEQ ID NO: 4134408 - RNA, 104 nt, Human
aucucagggguuucaugaucucucugaaauuguuaguaaaaaugaauguguauauacguuuuuauaggaagaauuucccuagcuuucaacagaucccuuaagau

SEQ ID NO: 4134409 - RNA, 57 nt, Human
aucuccaggccuuucccaucuuacauaaaucugagauucauugugggucuuggagau

SEQ ID NO: 4134410 - RNA, 74 nt, Human
aucuccaggcuuuucucauggagucacuguaacagcuuucccauugaucuccugucuugagucuccuccgagau

SEQ ID NO: 4134411 - RNA, 79 nt, Human
aucuccaugcguguaggaacagugucuaucuuaucaguauauucccucugucuaguagaguguccaacacauaggagau

SEQ ID NO: 4134412 - RNA, 68 nt, Human
aucucccaaauuagccucuugauucugucacaaacuuucagaacucaaaggcuugugguucugggaau

SEQ ID NO: 4134413 - RNA, 64 nt, Human
aucucccaauucccugauaaauuauuuuccacacuucuucaaguugacaggaaagaggggagau

SEQ ID NO: 4134414 - RNA, 77 nt, Human
aucucccgugcccagcccacaagcccaucuggggucccgagugccaggaacaggcugaugggcaggaaguggggggu

SEQ ID NO: 4134415 - RNA, 75 nt, Human
aucuccucuggacgcuggggugggaggcacuccuucagggugaggccgcacgccccggagugcauguggggaggu

SEQ ID NO: 4134416 - RNA, 82 nt, Human
aucucuaaaauuagcaugauaauagcagguaaacugauacuaagauuaucuguuuauuguuacugucagaauuaaaugagau

SEQ ID NO: 4134417 - RNA, 112 nt, Human
aucucuagaaguguuaaaacugcagauuccugggcccugucucagagcuccuaaacgggaucucugggaacauggcuuggaauccacauguuugccaagcacuccaggugau

SEQ ID NO: 4134418 - RNA, 77 nt, Human
agucuuugagucuuguugcauuugcuuugauaaugaguaucuucucuauuaggguaaauuugacaugcauaaggauu

SEQ ID NO: 4134419 - RNA, 96 nt, Human
agucuuugcagucugggcuuguuuguaccuguuuuucuucagaaggccuuccaagaauuuaaaggagcgaauaagucuccuaagauggcaguuauu

SEQ ID NO: 4134420 - RNA, 57 nt, Human
agucuuugcugccuccucguauaauuucuaaaaauugaaauacaagcagcagagauu

SEQ ID NO: 4134421 - RNA, 99 nt, Human
agucuuuuguauccugcagcucaagcuggugagguggucugaaugugagggacuaucucacuaagagcaugaggcacucugauaaagauacggaagauu

SEQ ID NO: 4134422 - RNA, 58 nt, Human
agugaaagccauugcagagcaggauuucgcaaauuuucuucauguauuuggcuccacu

SEQ ID NO: 4134423 - RNA, 71 nt, Human
agugaaaggcuccuucucccaugaccuuugaaauaagaaggucacuaucugagaaaggagggucuguagcu

SEQ ID NO: 4134424 - RNA, 61 nt, Human
agugaaaggucagcugccaucguucugucgccagccugguagcagcucggccugguuaacu

SEQ ID NO: 4134425 - RNA, 96 nt, Human
agugaaaugauugccuugucucguccugggucugggaaggcauuacagaggaagagaugcuugagcugagucuaggcaagcaaauaacauuuuccu

SEQ ID NO: 4134426 - RNA, 61 nt, Human
agugaaaugugcagagaauuaggaauuggauauuucaucuuugaacucuguauaaaccacu

SEQ ID NO: 4134427 - RNA, 76 nt, Human
agugaacaucgggucccaugacugacacagcagggucaccuucucuccugaggucaccguggggcccggcugcacu

SEQ ID NO: 4134428 - RNA, 59 nt, Human
agugaacuugggaguucuggaagccugauaaaagcagguguuaaucacuuuuaagcacu

SEQ ID NO: 4134429 - RNA, 56 nt, Human
agugaagacuggguaucagggaaguaaaaacuacccaaaugaauucaaucugcacu

SEQ ID NO: 4134430 - RNA, 62 nt, Human
agugaaggaugaugccaagguuuuuggcccaaguaauuguuagaauaaugguaucauuugcu

SEQ ID NO: 4134431 - RNA, 72 nt, Human
agugaaggcuugccacuuguuagucuaugagaaggauuuaaguauagaggacacgguggucugcaaaacauu

SEQ ID NO: 4134432 - RNA, 77 nt, Human
agugaaguacuucuuaguucaacuaaaauuuaacauacauguuugaauugaguuugaguaagaacagaacuuacacu

SEQ ID NO: 4134433 - RNA, 80 nt, Human
agugaauuacugcaagaguugacagaauaguuaucucaaguaaacaagauuucugucaaagacuuuuucaggcaaucacu

SEQ ID NO: 4134434 - RNA, 87 nt, Human
agugaauuagaauaagaaugucaagcagaaggucuggaagcuaccuugaaccacccuugaaaucucuugcauuucauucaaaucacu

SEQ ID NO: 4134435 - RNA, 55 nt, Human
agugacaaagauucuccuuguugcaugauggacacaaggaugaaucuuuguuacu

SEQ ID NO: 4134436 - RNA, 130 nt, Human
agugacaagaaugaaguggcaagggugugaccccacugcaaaggggaaagaagcauuauuaaaauuacugcuaccuagugcuucucuuuauuuguagguuuucacauugaguguuauauucuuuguuauu

SEQ ID NO: 4134437 - RNA, 56 nt, Human
agugacagauuaccggcagagcacuaagcagcuuuuuacagcuggguucugugacu

SEQ ID NO: 4134438 - RNA, 56 nt, Human
agugacagucucagagaucaggcuacagacacccccagggucacugagaugcuacu

SEQ ID NO: 4134439 - RNA, 87 nt, Human
agugaccaauauacaaugcucucuuucacagagguaggauccauggauucagcaaagcugugugagaugggaguuauuccuuucacu

SEQ ID NO: 4134440 - RNA, 82 nt, Human
agugaccauucauuuagccugucugcugucuuaggaugggcucuucagcagucaggcaaaugggaggagccauuugaucacu

SEQ ID NO: 4134441 - RNA, 70 nt, Human
agugacuaugacugcaagaucacugugugcagaaaucucuagaaaugugugucuuguagcucaaguuauu

SEQ ID NO: 4134442 - RNA, 81 nt, Human
agugacuccagaugguguucuuauguggccuacuggugcccucugcauguggccaauaggagcagcuaucaauauuccacu

SEQ ID NO: 4134443 - RNA, 98 nt, Human
agugacuccuuaucucuuagaggcaugccaaauucuacuuucagcaguuuuauucucaucuuugaaaacuuaauuuggucguagcuacugguguuacu

SEQ ID NO: 4134444 - RNA, 84 nt, Human
agugacugagagucugguauucaauuauuauuuuauucauuuaacugcaccaguaaauagugauagaauucagaacucagagcu

SEQ ID NO: 4134445 - RNA, 61 nt, Human
agugagcauucguuuggaacccuguaagggcuuguggauggucuggacagaaugugacacu

SEQ ID NO: 4134446 - RNA, 82 nt, Human
agugagcucccaggguagggagagacuaagaguuaaauauucuuuaaggacacuagcuccuuccacuuuggguagcuccacu

SEQ ID NO: 4134447 - RNA, 57 nt, Human
agugaggaagggggcgaugcccgggagggcucugggagaguaaccaauuccuucacu

SEQ ID NO: 4134448 - RNA, 58 nt, Human
agugaggauggcaauggcaggaauuugauuuuauuuccucccaaauuucagccucauu

SEQ ID NO: 4134449 - RNA, 61 nt, Human
agugaggcuuccaacaugugagaacaaaaguaaacucauaauuuuggugggcacguucacu

SEQ ID NO: 4134450 - RNA, 56 nt, Human
agugaggguggccuuguguggacuguucuaacuuugcaguuggcuaaacucucacu

SEQ ID NO: 4134451 - RNA, 101 nt, Human
agugagucgauuaaagaaguaauuaaaguguaaaacagcaggaaaaggacuugcuuuuaaaagaugcuguaauacuuaagguuaagucaaaucagcuuacu

SEQ ID NO: 4134452 - RNA, 69 nt, Human
agugagugcaagagcgcucucuuucauuaccuuauuuccaggguuugguaacaguuuuuggcacuuacu

SEQ ID NO: 4134453 - RNA, 107 nt, Human
agugagugcagaauuaugugaacaugagacagcagaagugcauuugugauucucccaugggaucuuaguuccuuacuuuugcaguuuuaacaucucacugcacugcu

SEQ ID NO: 4134454 - RNA, 59 nt, Human
agugaguggguuacagaugggaaggaacagaucuccagcauuucaggauccacucuacu

SEQ ID NO: 4134455 - RNA, 66 nt, Human
agugaguucacaaaguacuguaugcaucuguuugaagaugggcagaaaucuugugaccaucucacu

SEQ ID NO: 4134456 - RNA, 61 nt, Human
agugauaauugcagagaaaggagaaagcagaaggcuuguucuacauacuguauuucucgcu

SEQ ID NO: 4134457 - RNA, 83 nt, Human
agugauagauuaaguguuuaguaagagauguuucaaaauagaaaaucuuuuuaaguuagacaccaacacucuuaaauauuacu

SEQ ID NO: 4134458 - RNA, 88 nt, Human
agugauauugaugaugaagaaggugaguaaaggaguuuuguuuggaagucccuuuaaucagugccuuuguagaauuaagcaaaucauu

SEQ ID NO: 4134459 - RNA, 71 nt, Human
agugaucccaccuuuugguguucacaucuuuaauuuccugugaguguggcauacacaugaggugguuugcu

SEQ ID NO: 4134460 - RNA, 58 nt, Human
agugauccgaugucagucgcagauuccuuuuggugucugccaaggguguggaguuauu

SEQ ID NO: 4134461 - RNA, 59 nt, Human
agugauggauguaaauugcacuguaggcuuucaggcucacaggcucacgauccauuucu

SEQ ID NO: 4134462 - RNA, 86 nt, Human
agugauuuccucagggucucacguagauuaagucuaugauucccgguaaucauaaacucacuaguuuaugugauguaggaagcacu

SEQ ID NO: 4134463 - RNA, 76 nt, Human
agugcaaaaugugaggcagcacggagauuauggagauaauaacacauaaucuaaguuaacuccccacuguugcucu

SEQ ID NO: 4134464 - RNA, 129 nt, Human
agugcaagcacucugcuugguguugguacaauguugaacaaaauugacauaaucucacaagcuccauaaaccagagauuauguuaguuuuguuuaacauuguaccaacaccucauagagucccuaugcu

SEQ ID NO: 4134465 - RNA, 62 nt, Human
agugcacagauuuaauuuuauucuuggagaagguugaagaugagaagcccugucugugcacu

SEQ ID NO: 4134466 - RNA, 84 nt, Human
agugcagagaacagguagggcuaugugggcaugugacuugugcagucacacaggguucuggucucauacuugcuuucaugugcu

SEQ ID NO: 4134467 - RNA, 92 nt, Human
agugcagaggcauaacagaagggugggcccuggcagccaucugggucucuuccuuccuaaccaugguggcaggugcauccuucuuugacacu

SEQ ID NO: 4134468 - RNA, 125 nt, Human
agugcagaugcagaagggcugucauccagcagagggguaggugacaacuggccuagcgagugacccuuaucauggcuacauuuguugaucacuuucuuuguaugaggcacugcugugauugcauu

SEQ ID NO: 4134469 - RNA, 55 nt, Human
agugcagcucugacaaugccuggaacaggcuuuccaacugcauuuagaguugccu

SEQ ID NO: 4134470 - RNA, 106 nt, Human
agugcagugguggaucacaacucacuguaaccucaaacucuugggcuuaaggaauccucccuccucagccuccgaaagugcugggauuacaugugccacccugccu

SEQ ID NO: 4134471 - RNA, 64 nt, Human
agugcaguuuuccuucaacauuguccugggcuuuauucugcuuugggaaggugagagcuguucu

SEQ ID NO: 4134472 - RNA, 80 nt, Human
agugcauacuuuuaaugacuguuuaaaaggagggaagcaaauaaacuuucaucaaugaagaaguuaccuaaaguuguacu

SEQ ID NO: 4134473 - RNA, 66 nt, Human
agugcaugccuuccuguggaugggcuggcugcaucaucucggaauacaggaaagcauguuauuacu

SEQ ID NO: 4134474 - RNA, 63 nt, Human
agugccacacuucugauuaacguagcuuuguaguaaguuuuaaaaucagaaagugugagcucu

SEQ ID NO: 4134475 - RNA, 91 nt, Human
agugccagugguacaaccuggcccuagcccugggauuagaaauuccauuccuuuuguggggucugggcgccuggauaggcucgcugcgccu

SEQ ID NO: 4134476 - RNA, 69 nt, Human
agugccauacuuagacucuaucuagagauguccacauuuuagauuagagaguuguaagcuuaugguauu

SEQ ID NO: 4134477 - RNA, 62 nt, Human
agugccauuuuugcugggaauuuaccuggauacagaugggccuccuggaagaauguggcauu

SEQ ID NO: 4134478 - RNA, 77 nt, Human
agugcccagcauuuaaguguuugauaaauguuaacucccauuuuuuaacaugccagcccauuuaaauggugaaaacu

SEQ ID NO: 4134479 - RNA, 61 nt, Human
agugcccauguaccugggguggcuggagccccugagccagccccucccagucaggagcacu

SEQ ID NO: 4134480 - RNA, 83 nt, Human
agugccuggcacaugguaagucucuauagcuggugcaauaacacaagcaaaugcuucuccaggacuucuaagugccagacacu

SEQ ID NO: 4134481 - RNA, 59 nt, Human
agugccugggacaugcuguggacucuugugaaugaguuugugagcauucccagagcccu

SEQ ID NO: 4134482 - RNA, 58 nt, Human
agugcuaggugugaacugugugaaugcuuuugaauaucacuaaguuacauuuaguauu

SEQ ID NO: 4134483 - RNA, 67 nt, Human
agugcuauaaagguagaccacagagcauuuguaagauaucuuuuggucguucuuaauacaaagcacu

SEQ ID NO: 4134484 - RNA, 68 nt, Human
agugcuaugcagcugacauuuucauguucugacuugauagaacuggauuauucaguugcugcuucacu

SEQ ID NO: 4134485 - RNA, 99 nt, Human
agugcuauuuaaaaugcagauucaugagccccauaccugaaacuccugauuuggaagauuugggcugaggcccagggaucuccacuuuuaacaggugcu

SEQ ID NO: 4134486 - RNA, 81 nt, Human
agugcucauaaaaaugugaaacccugcaauaacauuaaauccccauaugcagaggaaaacaauucacauuuuuguggcacu

SEQ ID NO: 4134487 - RNA, 83 nt, Human
aggguaggagaauuuaaguaauuugaagagacaggcuugugaaaauuagucuacaaagaaaaguuauugaauucucuuuuccu

SEQ ID NO: 4134488 - RNA, 80 nt, Human
aggguaguauacuaugugaaaauacuauagugccucauauaaaaaagcacagugauaaaauuucacauguaaaauagccu

SEQ ID NO: 4134489 - RNA, 61 nt, Human
aggguaugguuuacuaauuuguuggguaaaagaaaaucuccaacaaauaguuacauauccu

SEQ ID NO: 4134490 - RNA, 67 nt, Human
aggguauguuuuaggcugaguugaagagaaaaauagucuauuagaaauagucuaaugcauaagcccu

SEQ ID NO: 4134491 - RNA, 99 nt, Human
agggucaaguacugaaaucuguggugauaaaagcuuaauuccuauuacucugugaaaggcuacugucaucaauuacauuuuaaacuugcuguuaacccu

SEQ ID NO: 4134492 - RNA, 58 nt, Human
agggucagcuuuauuucacguguuuguugcuacgagggccucugguuaaggugauccu

SEQ ID NO: 4134493 - RNA, 61 nt, Human
agggucaguucugugagguguuggucaucacuuagguagaucuaauuuccagaguggcccu

SEQ ID NO: 4134494 - RNA, 71 nt, Human
agggucaguuuaggucauccuugcuuugcugcacaaagacaugguugggaacacacuacaaagcaggcccu

SEQ ID NO: 4134495 - RNA, 73 nt, Human
agggucauagaauguagggaucuauguagccauagaauguagcugggaaaggcaagauuccgcucuagagccu

SEQ ID NO: 4134496 - RNA, 62 nt, Human
agggucgggaaauguccugggccaccugcaagugucugcuggguccuggcaucuuccucccu

SEQ ID NO: 4134497 - RNA, 59 nt, Human
agggucucuggagagcugaggaggaaagucagaucucgucucuaucuccggaagacccu

SEQ ID NO: 4134498 - RNA, 74 nt, Human
agggucucuguggugagcaacugacugaaguuuccaguggaaaaguuccugacgauuguuuccgcagggaccuu

SEQ ID NO: 4134499 - RNA, 68 nt, Human
agggucuuguugagggugaugggacaucaagcuguaaagauggacuguagccagaagcagaaggcccu

SEQ ID NO: 4134500 - RNA, 65 nt, Human
agggucuuugagaggguagaugugaagacuuuauauguuuauauacauacagucuuacugacuuu

SEQ ID NO: 4134501 - RNA, 58 nt, Human
agggugaagcuugaucacuuuuaccacuucagagugaugccacacaaugcuuugcccu

SEQ ID NO: 4134502 - RNA, 83 nt, Human
agggugauacagugcaaauaggacugucuuuccuuuuguugagggaaaagucuccccguucuauuugagucuguucucaugcu

SEQ ID NO: 4134503 - RNA, 66 nt, Human
agggugcagaaggguugauacaacaggacuggucuugccuucuccucagcagcuuuugcagucccu

SEQ ID NO: 4134504 - RNA, 56 nt, Human
agggugccaggcuguagucagggucuugcugugcccacccacuagugccucaccuu

SEQ ID NO: 4134505 - RNA, 84 nt, Human
agggugcugggaguuaguucuagaccaguuaauaguguucacuugggcacuauuaacauuuugguuuggguaacucuuuacucu

SEQ ID NO: 4134506 - RNA, 56 nt, Human
aggguggagggccaugagaaguaucugaggaaacucagcaggucaggccccuuccu

SEQ ID NO: 4134507 - RNA, 60 nt, Human
aggguggccaugagggagagauugucauauaauuaauuuucucuucuauggcuuugcccu

SEQ ID NO: 4134508 - RNA, 71 nt, Human
aggguggucaugaaaagcacuuuaacaucaggacagauguuaaguucugagguucuguuuucaacugcucu

SEQ ID NO: 4134509 - RNA, 92 nt, Human
aggguguggaugaugaacauagggguggaguggauugcagccucugaguugaaggcacucagaguauuucauucuuaggugucuccugccuu

SEQ ID NO: 4134510 - RNA, 72 nt, Human
aggguuacugaauuauguaaaauauggugaaaaauaacuaguguuuauuaacauaauucuauuggaagcccu

SEQ ID NO: 4134511 - RNA, 89 nt, Human
aggguuagaagguggacaugaccucuauuccuccgcacaugucugguagaaugugaggaagaaagagguaagcuuucauuucauucccu

SEQ ID NO: 4134512 - RNA, 109 nt, Human
aggguugcgacuguucugauacagcugcucugugugugguuauuuccguaggugauuaccuaaggaaacacacccagagaagcagauccucagauuagccugcgaaacu

SEQ ID NO: 4134513 - RNA, 95 nt, Human
aggguuggagagugucaggauuuuaaaaucccaguuagaauaaacagauacuguaucuacuuggauuaauuuugagaugccaaauuuccagaacu

SEQ ID NO: 4134514 - RNA, 71 nt, Human
aggguuggugacuagguggcccacagggugaacacagugcaugccccucuggucaaccagucacacacccu

SEQ ID NO: 4134515 - RNA, 107 nt, Human
agguaaacguggacaugaaagaagccagggugaggcaggcagcuuccagaagcacacacugggcucagcuccuuccuuccuaaccucuauuuuagcuccacguaccu

SEQ ID NO: 4134516 - RNA, 79 nt, Human
agguaaaucaauuuggaggaugucggcauauuuaauccuucccaagggugaauuguggcuuuuuccaauuuguugaccu

SEQ ID NO: 4134517 - RNA, 78 nt, Human
agguaaauucgcacaggcucccucugugaaggucauugcuucuuucaaugucacagaaggaccuuguuucauuuaccu

SEQ ID NO: 4134518 - RNA, 95 nt, Human
agguaacacugugauauaguaggacacaucaugaaaaaacagucugcuuuucauauauuuucauggugauuuuugcugugcucacaguucucccu

SEQ ID NO: 4134519 - RNA, 89 nt, Human
agguaacauauuuauagguucuggagaggaggauguggacaucuuuggcggacguuauucugucuaccauucaccugaccagccugccu

SEQ ID NO: 4134520 - RNA, 69 nt, Human
agguaacguugguaaaagcauucagcuauguguaaagcacuguggaaugugcuuuuccuuaauguucuu

SEQ ID NO: 4134521 - RNA, 62 nt, Human
agguaacuguggcuagguaacugugcgugccccuugcacuuugcuauacucauuaguuauuu

SEQ ID NO: 4134522 - RNA, 72 nt, Human
agguaagagugagugagauaaaguagguucaaggugcacuuccaccccuggcuuucucauuuacaggcaccu

SEQ ID NO: 4134523 - RNA, 57 nt, Human
agguaagcaugguggcugcugugggugcccaccacuacacaucuuucacguuugccu

SEQ ID NO: 4134524 - RNA, 80 nt, Human
agguaauauggagguaugguuaauauauuauuuagucacaucuagaaguccuguuccucauacuuccucauugauugcuu

SEQ ID NO: 4134525 - RNA, 77 nt, Human
agguaauguuuagaggaaccuccugaaaaguauacccucuuugggugcuggagaaaguuuuucugaacucauuuccu

SEQ ID NO: 4134526 - RNA, 58 nt, Human
agguaauugcgucuucauggaggugucauuugaggggaggacugaagaugcaagaccu

SEQ ID NO: 4134527 - RNA, 60 nt, Human
agguacaaaagaguauaugagaaucuugaaggguuaauucauugucucuuuugccuaccu

SEQ ID NO: 4134528 - RNA, 86 nt, Human
agguacacaguaacuguuuuauauugcaaguguuugcaauccgcuaauguaauacagcaaugccugaaauaguaacucucaagccu

SEQ ID NO: 4134529 - RNA, 59 nt, Human
agguacagggugaaaguuuauggcugaaauaaagugauguaaacuucagcucucugccu

SEQ ID NO: 4134530 - RNA, 75 nt, Human
agguacaggugggcuuaagagucggcauuucucacaagcucccaggcaaugcugauucugcuggcccucugaccu

SEQ ID NO: 4134531 - RNA, 83 nt, Human
agguacccuuuugcccuuucaacauucugccuugugaguacacagcaacaagguaucaucuuggaagcacagagacuaggccu

SEQ ID NO: 4134532 - RNA, 61 nt, Human
agguaccgcagggguggagcaaugacccuagacuccugucaaugaagucauccuugugccu

SEQ ID NO: 4134533 - RNA, 57 nt, Human
agguaccgcggaccucgccccgggacagcgaggagcugagggacccugugaguaccu

SEQ ID NO: 4134534 - RNA, 60 nt, Human
agguacgcaugcccgccugcacuaacccccagaggucuguguauaggguugugcgcuccu

SEQ ID NO: 4134535 - RNA, 129 nt, Human
agguacucuuaccguacaagaugcucaaauauaaaacuucauguaauuuaaaacaguugcagaggagcugcuccuguuuuggugcaaggagccuguauuuaggaucugugcauuaggugaugguauuau

SEQ ID NO: 4134536 - RNA, 81 nt, Human
agguagaaucaggaggacuugauaacuuacugacuuugaagaaaagaagucaaagaugaccgaguuccuauccugaagccu

SEQ ID NO: 4134537 - RNA, 83 nt, Human
agguagacacuguuucccuaaagcucagggggcauguguucagguugaugcucugccaccaugcuuccugacuaguuauaccu

SEQ ID NO: 4134538 - RNA, 64 nt, Human
agguagauucuguaaauaaucaaggcauuuuauuuuaauuaauggccuuguuacaguucuguuu

SEQ ID NO: 4134539 - RNA, 82 nt, Human
agguagcguguuuucauggccaccgcaagugacuacucuagauaagagaucuguucuucagugagucaucaaauacacucuu

SEQ ID NO: 4134540 - RNA, 64 nt, Human
agguagcuauuacuguuuuuauuauuuauaauaauguaauugaacuuaacaguaaguggccccu

SEQ ID NO: 4134541 - RNA, 64 nt, Human
agguaggaaugagcuugucaagcagcagagcugggugaaccaagccugcuugagaguccuggcu

SEQ ID NO: 4134542 - RNA, 75 nt, Human
agguaggcugugacagggucauggagggugucggguucucggcucuggaguuuuucauuacccuuacggccacuu

SEQ ID NO: 4134543 - RNA, 55 nt, Human
agguaggggguuugggaacugcagucccauucugguuuuaggaacucccuugccu

SEQ ID NO: 4134544 - RNA, 98 nt, Human
agguauacuugacagugagcucugauuaguauaauuuaucacuguuuugcacagagaugauauuauucuagcccagagcaaacacauuuaaugugcuu

SEQ ID NO: 4134545 - RNA, 57 nt, Human
agguaucaacagcagagucugaggaaggacugaaccccagaauguuccuggaugccu

SEQ ID NO: 4134546 - RNA, 102 nt, Human
agguaugacauuuauuuugcaaucuccaggaaaauguaggucacuuuuugaauuaucaguuacaaauaugguacucggagaaauaaagcuaaauguagacuu

SEQ ID NO: 4134547 - RNA, 63 nt, Human
agguaugaggaaaaacuacugcacuuucuuugagacuugagaguuugugggcuuuuccucccu

SEQ ID NO: 4134548 - RNA, 67 nt, Human
agguauguuauguagucucuucucaacuagacuguagucccagaggcuaggaccauguaucauacuu

SEQ ID NO: 4134549 - RNA, 76 nt, Human
agguauguuuuauuccccacuguuaccccuguaccuagaauaguggguggcgcagaggaggaauuuauacauguuu

SEQ ID NO: 4134550 - RNA, 81 nt, Human
agguauuagagagcaaaguucugacaggagcacuacuaauuaacugauaauugucuuccuuuggcaagcucugcucuuccu

SEQ ID NO: 4134551 - RNA, 72 nt, Human
agguauuggucaggaaagaguaauguauacaaauuagaagcuguauuauggauuauuccugaauuuguaccu

SEQ ID NO: 4134552 - RNA, 76 nt, Human
aggucaaaucauaggaaauaaccaguauuuaacucuuucucaacuauacaaaugccaucuuccugugguuugaucu

SEQ ID NO: 4134553 - RNA, 98 nt, Human
aggucaacucugcuucccacaggaugagagcugagcgguuuacgugaauggccaucagacuuguuuucauuguuguguaggauaagguagaguugccu

SEQ ID NO: 4134554 - RNA, 120 nt, Human
aggucacacagccaguauguggcagaaccagaauucaaacccaggucucucaagccuguauuuggacucaaugguuugcugccuccauccacauugacaguuuuccuaguuguguucccu

SEQ ID NO: 4134555 - RNA, 100 nt, Human
aggucacacagcuaguaagugucagagcuggaauuugaaccaaggcagccugguuccagagucugguuccaugguuauucauugcugugauuugcugccu

SEQ ID NO: 4134556 - RNA, 119 nt, Human
aguaguggaugugaauuuggcuugugguguauaaagaugccauacuuacuguacuuacauuuauuagguaguauaaucuuuguuguuuugauaucauacccagguuuccguaggcuucu

SEQ ID NO: 4134557 - RNA, 108 nt, Human
aguaguuucucuucucuaagcccuuuucauggaauaucucauuucacagccucaauuacauuaugacauguaugcuuuaugaaguagguccagaaaagagaaauaacu

SEQ ID NO: 4134558 - RNA, 57 nt, Human
aguaguuugggcagugacagauggaagcccagaugaucccugauugccuugacuccu

SEQ ID NO: 4134559 - RNA, 55 nt, Human
aguaguuuuuaagagguauaaaggagucuugggcuucaaacccucagaaacugcu

SEQ ID NO: 4134560 - RNA, 72 nt, Human
aguaucacugauuaugaaaaugaaggcauguggaagucagauuuggccucauucauucaaaauagguguauu

SEQ ID NO: 4134561 - RNA, 75 nt, Human
aguaucaguauacaggggacauucaguuguugacugccugaugaauguuugccaguguaaguuuuuucugauauu

SEQ ID NO: 4134562 - RNA, 87 nt, Human
aguauccuaguuuuccccuggagagauccuccugaaaaagaggacuuuauuaguaggauaccuuuaaaaggaaaauucuaauguauu

SEQ ID NO: 4134563 - RNA, 106 nt, Human
aguaucuggaauucuauugugugugagucugugcaggaacacaaugagucucaaagugaaaaaaacuuuggauuccugguuccuacagcacuuuuguucagauacu

SEQ ID NO: 4134564 - RNA, 62 nt, Human
aguaugauauucaaccuuucauugaucaggcuggauguugugagguauauugaaaucaugcu

SEQ ID NO: 4134565 - RNA, 56 nt, Human
aguauggauuuucuguuacugggcuuuaaauauguuaaugagagaauguucaugcu

SEQ ID NO: 4134566 - RNA, 91 nt, Human
aguauggguggcauacugaggacauugaugaggcaauguuuuaaaaaacagcuaacauuuuugguguccucacuauaugccagcacauauu

SEQ ID NO: 4134567 - RNA, 129 nt, Human
aguaugguuauuucugaaugacagucuuauccacagagucaugguagucaaagguuauaaaggcaaagccccuuuucuugccacugacucggucagucaugauuucaaucacuucaauuuuuccauacu

SEQ ID NO: 4134568 - RNA, 129 nt, Human
aguaugguuugccaaagggaugcucugauucaggaggcugagguggggccugggaauguucauuucuaaccuuuucccaggugaugcugaggccacugguccaggggccaccuuuggcccuaagccgcu

SEQ ID NO: 4134569 - RNA, 77 nt, Human
aguaugguuuugucugauguucccucaugauuagacauauauaaucauuuagaguauacauuuuuggcaggaauacu

SEQ ID NO: 4134570 - RNA, 56 nt, Human
aguauguauuuuauacuuacagcacaucucaauuugaauguaaguggcuacauacu

SEQ ID NO: 4134571 - RNA, 86 nt, Human
aguauguuaagaaacaaagccagggaaguuaugggggccagguuauauggugccuugaugcuggcuucuguuuugagugagauauu

SEQ ID NO: 4134572 - RNA, 63 nt, Human
aguauuauuugaauguucccaggcuuuugaaagugaguuuagggcacagcuuagauaaaugcu

SEQ ID NO: 4134573 - RNA, 79 nt, Human
aguauuuaaacugcuccagagaauagagagggaagaaaaucauccaaacuauuuacaauggaaucaaaauuuagauacu

SEQ ID NO: 4134574 - RNA, 83 nt, Human
aguauuugagccauuuggaaacacggucaucuuccccacuggcucagggugaggcuggccgguuccagacauggaaugaugcu

SEQ ID NO: 4134575 - RNA, 114 nt, Human
agucaaaaaaaggauuagagggagggagaaaaaagaauuaagcaguaccaaagcugaacuagaugcuugugucugaacuaguugcucucucucuccuuucuccuuccagggauu

SEQ ID NO: 4134576 - RNA, 83 nt, Human
agucaacagaauggggaaauuguguacaggcuccuaaauauuucaccaaaagagacucaugacacuuccuaugaugauugacu

SEQ ID NO: 4134577 - RNA, 62 nt, Human
agucaacauaucauaucuaucgguuguuuuuauaagugauguuaauaaaugauguuuugacu

SEQ ID NO: 4134578 - RNA, 76 nt, Human
agucaagaucuauaucaugggguaagguaaaaauaugcaaauuuuuuacacucugacaauugauguaggucccacu

SEQ ID NO: 4134579 - RNA, 94 nt, Human
agucaagcacuuaaagcauuucaggcacuguucccaguuauccuuauuuuucagaugaggaaacagaggcuuggaaaggcuaagugacuugacu

SEQ ID NO: 4134580 - RNA, 96 nt, Human
agucaaucuccucagucuggugaauuucacaggaguccuuucuauaacacuuccuauaagaaacuuuccuaugaaugcuuauugaggaagguuacu

SEQ ID NO: 4134581 - RNA, 56 nt, Human
agucacaaauauucuccucuagcaccgauaagugcucuggagaacuccuugugucu

SEQ ID NO: 4134582 - RNA, 65 nt, Human
agucacacaagauaggcuuuugggcuuucagggaggugugggggcuucuugccugucuuggugcu

SEQ ID NO: 4134583 - RNA, 84 nt, Human
agucaccacuggguuaaugauguguuuggaagcuugcugacagugugaacagcuuugucuucucacauauccccuguguugauu

SEQ ID NO: 4134584 - RNA, 57 nt, Human
agucacugaauaccuuaauguucaagaaaacuuaagucauuaagaaguucaggaacu

SEQ ID NO: 4134585 - RNA, 71 nt, Human
agucacuuagucuaugauauuuuguuauagcagccccagcugaccaagauacagcaucauagauacuggcu

SEQ ID NO: 4134586 - RNA, 72 nt, Human
agucacuuuaugagagaaccauguaacacccaggguaguucacuauggaauggaucaucuuaagaagugauu

SEQ ID NO: 4134587 - RNA, 58 nt, Human
agucaggaagcuggagcuggggcgcaaggccaccaggaggaaagaccagcccaugacu

SEQ ID NO: 4134588 - RNA, 56 nt, Human
agucaggugguucugcuccacuuaguauuaaauauaaguggggucacuccuugacu

SEQ ID NO: 4134589 - RNA, 66 nt, Human
agucaggugucuugugggauuuuaauaaggucuacuguauaaaaucaccccgaggacacuaagacu

SEQ ID NO: 4134590 - RNA, 57 nt, Human
agucauagaaggugacccaggugcguguaacugcaccaguccauuccccucaugauu

SEQ ID NO: 4134591 - RNA, 97 nt, Human
agucauccuuacaucagcugguauuuguuagggaguugucaggugcaacuugcaaaaacaucuugucaaauguccacagcuuuccugugaggugacu

SEQ ID NO: 4134592 - RNA, 69 nt, Human
agucauuacaaauuauagaaaauugagcuauuugaaagcuuuuauuggcugucauuugacgcauugacu

SEQ ID NO: 4134593 - RNA, 59 nt, Human
agucauucaggaaugcaggcagaugcagauucagauucugucuuauuuaacacaugacu

SEQ ID NO: 4134594 - RNA, 63 nt, Human
aguccaauaaccucuuuccuucuuauuacucaucuguuuuugaggggaaguagaguuuugauu

SEQ ID NO: 4134595 - RNA, 78 nt, Human
aguccacagauuugucaggguaaauuauguaaaauguagcugcuguacagaauuaacauuugaugaauaugcuggucu

SEQ ID NO: 4134596 - RNA, 64 nt, Human
aguccauaacuucagagugucagcaacaggaaugcaagacaguugccaccuagaaguauggauu

SEQ ID NO: 4134597 - RNA, 57 nt, Human
aguccaugguuguaguucucuccauuaucauggcuggaaggaacucacccaugggcu

SEQ ID NO: 4134598 - RNA, 79 nt, Human
agucccaggacuguccuugguaugaccaagguuucugcaaggacggugaggccuuggaagccagggagcccuaggggcu

SEQ ID NO: 4134599 - RNA, 61 nt, Human
agucccaguucgguucuuccucuuggccccagauguggucccuggaaaccgggcagggccu

SEQ ID NO: 4134600 - RNA, 72 nt, Human
agucccucccaccucugauauucuuugagcugcuaagauuugaaauuucacucaaugguaucaggagguucu

SEQ ID NO: 4134601 - RNA, 56 nt, Human
agucccuccucccuacuucuccuucuuagagugagggacaugaggcaggagaggcu

SEQ ID NO: 4134602 - RNA, 72 nt, Human
aguccgcagcugagcagaagcccuccuggacucugaguuauggagucuccaagccucugugagcuggugacu

SEQ ID NO: 4134603 - RNA, 56 nt, Human
aguccggggucuggacaccuggucccucuggcuggccaggucuugguccuuggacu

SEQ ID NO: 4134604 - RNA, 89 nt, Human
aguccuagggaaaagcucgauugacuuuucuuggucacaugacucucauggguacuuuucagugaccagaggagugugguccuaugauu

SEQ ID NO: 4134605 - RNA, 75 nt, Human
aguccuagguuaagaaacuuuaaucuauggucaaguuaaccaaggaguuugguauuuuaggaagaggcuagggcu

SEQ ID NO: 4134606 - RNA, 57 nt, Human
aguccuaugagaguuuaaugcugccacugaucugacaggaggcagagcucagggacu

SEQ ID NO: 4134607 - RNA, 78 nt, Human
aguccugguccaaguaauuggcggggaguuuagacaauugugcaaccuggaugucuuugccaugcaugugucaggguu

SEQ ID NO: 4134608 - RNA, 55 nt, Human
aguccugucucucccagggccacugucuucagagccucuggguuggugacaggcu

SEQ ID NO: 4134609 - RNA, 60 nt, Human
aguccuuaugugguggagagagugaaagcaagucucuuucuccucuuuuuauaaggcacu

SEQ ID NO: 4134610 - RNA, 63 nt, Human
agucguggcguggagguuucugggaaacguagucuuaaauccgaauggcucgcgcgccacacu

SEQ ID NO: 4134611 - RNA, 79 nt, Human
agucuaaaacuucauuugugguuauuuacaaugggagccucauuucuaaacagauaaugcuauaaauggugguuagauu

SEQ ID NO: 4134612 - RNA, 66 nt, Human
agucuaacaggagguacauagauucagaugcaugcuugcagagggaauuuacugcucuccaggacu

SEQ ID NO: 4134613 - RNA, 71 nt, Human
agucuagcacaguugucugauuucuuccuuaggguaaauuaucaggauaaagccaggcacuguggugugcu

SEQ ID NO: 4134614 - RNA, 65 nt, Human
agucucaguuuccaugucuauaaaguggagaugccauuaaauuuccuauagauauggugaguauu

SEQ ID NO: 4134615 - RNA, 79 nt, Human
agucucauacuagaugcugcagggaugcuagagguaagacccacuucuucucucuuguucuuugccugguagggggauu

SEQ ID NO: 4134616 - RNA, 60 nt, Human
agucuccaacuccugggaucaagggauccucccacuucagcaucccaaggagcugggacu

SEQ ID NO: 4134617 - RNA, 55 nt, Human
agucuccucuuuccuuguuauuuagcaugagcaaaaaguagcuucuggggagacu

SEQ ID NO: 4134618 - RNA, 84 nt, Human
agucucgcucucucacccaggcuggagugcaguggggugaucucggcucacugcaaucuccaccugcuggguucaagcgauucu

SEQ ID NO: 4134619 - RNA, 130 nt, Human
agucucuagcuugauccaggaggcacuggggaggagguugcugauggcaagauuccaggcaggaggugacucagaaggcugggcugucaauggcccucugauccccaguauauuuuucaggccugaagcu

SEQ ID NO: 4134620 - RNA, 61 nt, Human
agucucugagguucagaugccuuguguauauaacaggcagauuagucuaaauccagagauu

SEQ ID NO: 4134621 - RNA, 76 nt, Human
agucucugggaacacuuugugagcuccuuagcccuggaacuguucuaagggggucuauaauguucucagcaggauu

SEQ ID NO: 4134622 - RNA, 61 nt, Human
agucucuuggcauucugaaacagacaaaaucacugauuuguaccaggaguuucagcagacu

SEQ ID NO: 4134623 - RNA, 64 nt, Human
agucucuuucuaaauaaggucauauuuuaaaguuccaagugacauaaauuuugggaagggcacu

SEQ ID NO: 4134624 - RNA, 76 nt, Human
agucugaauaggaucugggagucuguauuuucugaaguugcauagaaugcauucucuuagcaucuaguacagagcu

SEQ ID NO: 4134625 - RNA, 129 nt, Human
agucugcagagagaggagaauaggggcagagauguggagagaagcagagauaagauguagagacaaaauauucucuggagcauuucaccuacauucuagucacuuuuuguauuccuacuucugcauccu

SEQ ID NO: 4134626 - RNA, 76 nt, Human
aucucuccuccacuaggcaaaaugugguaagaucauuaauuaagaaaccaugugagccaugagguggagggaaggu

SEQ ID NO: 4134627 - RNA, 76 nt, Human
aucugaagaggauuauugaugagaucauuaugaagggcaugcugaaacuucuaauaugaauaguccagauuuagau

SEQ ID NO: 4134628 - RNA, 73 nt, Human
aucugaagcuuaagcauggugguaaaagagguuguuauaauuacuuccuaaaccucagcuuuagccuggagau

SEQ ID NO: 4134629 - RNA, 58 nt, Human
aucugaaguggagaaaaauauauuuuaacacuuaaugcauuuuucuguccacucagau

SEQ ID NO: 4134630 - RNA, 68 nt, Human
aucugaaucucuagggguaugaugaacaggaaauacaauuauuuuauaagcccucaugauauucagau

SEQ ID NO: 4134631 - RNA, 75 nt, Human
aucugaaugaacaauaggaaauguuuguaaguaaaaagauauggacaaaugugucuaauugugccuuuucaagau

SEQ ID NO: 4134632 - RNA, 70 nt, Human
aucugaggugguuuuucuuucuuucauuuguuuuucucuguugcagauggcuauagauagccuuucagau

SEQ ID NO: 4134633 - RNA, 66 nt, Human
aucugaguuauuugagggaagagauauuccuuugucagcuuuucauucccagcaccuagcacaggu

SEQ ID NO: 4134634 - RNA, 87 nt, Human
aucugauuccuuuucaaaucuucacucauucagaguuguuugaugaauaacucugugcaagggcgaggaaugcaaaaugaaaaagau

SEQ ID NO: 4134635 - RNA, 62 nt, Human
aucugcaguuuagugucaggugauuccuaaaucuugagaaccacugcauuaagucuguaggu

SEQ ID NO: 4134636 - RNA, 58 nt, Human
aucugcaucagacuuugcaugagcaagaaauacuuuuaucauguuagucugcugagau

SEQ ID NO: 4134637 - RNA, 74 nt, Human
aucugccuaaccuccagcuccuagaucggcgaaguggagucauccuacuuacuuccuaggacguagaagcaggu

SEQ ID NO: 4134638 - RNA, 68 nt, Human
aucugcuagcugugugugaauuuggccuaguuucaguuuuaacuggguuaguuugaccagcagcagau

SEQ ID NO: 4134639 - RNA, 68 nt, Human
aucugcugccuauggcuaauucuuuacugaccaaaccuuggugaugugguggugccaaugcagcagau

SEQ ID NO: 4134640 - RNA, 61 nt, Human
aucuggaucccugucucagauuggguuucccugaagcagagccugagacagggauuugggu

SEQ ID NO: 4134641 - RNA, 57 nt, Human
aucuggcuuaccuagggugccucugcuuucaaagaggcucuggugggaagguuagau

SEQ ID NO: 4134642 - RNA, 57 nt, Human
aucugguguccugaugaaauugagccuguaggcugggucagugcucaggcaccaggu

SEQ ID NO: 4134643 - RNA, 62 nt, Human
aucuguaacaucaguagcagaaacuucugauuuacaguauguucauaucugauguuauagau

SEQ ID NO: 4134644 - RNA, 60 nt, Human
aucugucaggagcaaggacuacuuuggcauuaaccaucacuguuugauuucuugacaggu

SEQ ID NO: 4134645 - RNA, 56 nt, Human
aucugucuaugauauagucuguguccucaggauacacacaguauaauagaagagau

SEQ ID NO: 4134646 - RNA, 73 nt, Human
aucugucugguuggagaaucacugcaagccaaggcauggcauuggccaauggugauucccggccuccucaggu

SEQ ID NO: 4134647 - RNA, 55 nt, Human
aucugugaauuguaacugguugaauuuuuuucaacuaauagagacaaacauagau

SEQ ID NO: 4134648 - RNA, 56 nt, Human
aucuguggccaaaagacuguugaaaaccugauucuaaggauccuuugguggcagau

SEQ ID NO: 4134649 - RNA, 93 nt, Human
aucuguguuaucucuucagcaacauuucaaggucuuuaggaucaaggacuuuuaugccuuccacaaagucuaugagaguugcaaggcacagau

SEQ ID NO: 4134650 - RNA, 76 nt, Human
aucuguuaucugucuauggauucugucagaguuuaaaauuuagcuuacaugaugauuucauaaacauaaaucagau

SEQ ID NO: 4134651 - RNA, 77 nt, Human
aucuguuguuaggaauuauaaaaagguauuauuacugaaguaaauuaagaaaauguuuuaugauuuuuaaccuaggu

SEQ ID NO: 4134652 - RNA, 102 nt, Human
aucuguuuuccuucccaucagucuagcucugcccauuggucauucgacuugauccagguaaugccaaugggcagaacuagacuaacgggaaggaaaacagau

SEQ ID NO: 4134653 - RNA, 73 nt, Human
aucuguuuuuuugguggagggaacuauuuccaggcugagaacaacuugaaaaugucucccccaccgugcagau

SEQ ID NO: 4134654 - RNA, 64 nt, Human
aucuuacauucccucaccauuucaccacguauuaauuugagucuuaggugcagggaugaaggau

SEQ ID NO: 4134655 - RNA, 55 nt, Human
aucuuagaaguuugauaaaauccuaguucucugggauuuuuuaagguucuaugau

SEQ ID NO: 4134656 - RNA, 99 nt, Human
aucuuaucucacaauaauucuacacugggggcuuugagcaugaagauucauccuggagauaauugcagugaacgagaguuauaccuuggaagauaagau

SEQ ID NO: 4134657 - RNA, 66 nt, Human
aucuuaucugaaagucuccagcuugucugcaacaucacagcugaauuuugggacucaagauggggu

SEQ ID NO: 4134658 - RNA, 61 nt, Human
aucuucaaagaauuucuuguccugugcauucuguccuauggggaaugagauucuuggagau

SEQ ID NO: 4134659 - RNA, 62 nt, Human
aucuucaaagcacaucguuuguacaagagauagacuaagaacaaaaauguguuuauggagau

SEQ ID NO: 4134660 - RNA, 81 nt, Human
aucuucagucauauacuacauuugaaaauugcaguauuauuugugguuugcaaaauucacaaugaguauaauggugaagau

SEQ ID NO: 4134661 - RNA, 102 nt, Human
aucuucauagugaagcuugcucucuuauauugucuuuagcccauauagacuucuagucuggaguauauuuugggagaagauggggagcacagauaugaagau

SEQ ID NO: 4134662 - RNA, 61 nt, Human
aucuucaucaaguucacagugggcuugcuuuguuugcuuucucuugaaugcuugauaagau

SEQ ID NO: 4134663 - RNA, 77 nt, Human
aucuucuaggcccuuuuucuccuguuguuucuuuguuucaacaaagagaaauauuuaggaaaggagucccuuaagau

SEQ ID NO: 4134664 - RNA, 70 nt, Human
aucuugaaaucaguaugucuuucucaauggcagagagcauuugaacugggaauuaguguugauucaggau

SEQ ID NO: 4134665 - RNA, 107 nt, Human
aucuugaaugcugcuuuuuggauuuggcacaauauuuauagaagacaaguggccuuuugugugucauuaauucagagaacagucaguacaguauuaauauucaagau

SEQ ID NO: 4134666 - RNA, 84 nt, Human
aucuugaauucgucacaaauauuuuaacaguaggagccugcccauaaaaauuccgauuuggggcuucuuuugaaauaucaggau

SEQ ID NO: 4134667 - RNA, 77 nt, Human
aucuugagguuuuaaguugaagggggagaaaaagacauuuccaaaggcccuaauaagcuugauaaagcccacaaggu

SEQ ID NO: 4134668 - RNA, 56 nt, Human
aucuuggggaauccucuguguaacacugguguauuacacaggcagugucccgaggu

SEQ ID NO: 4134669 - RNA, 125 nt, Human
aucuuggggguuggggaggguggacuuguucuuggaucuuggcagaagaaaucauuaucuggaccuuuauuggacuggauacccuuuucugcaucuugggccuuccuucucuaugcucccgaggu

SEQ ID NO: 4134670 - RNA, 85 nt, Human
aucuuguccucacuggagacucagaaggggaagcauugggaaaccauguauguuucauuucugguuuaaccaggcuuuucaggau

SEQ ID NO: 4134671 - RNA, 73 nt, Human
aucuuuauauaucuccucugaaacagagguguaaaaagucacugggaagucaucaggggauauauagauagau

SEQ ID NO: 4134672 - RNA, 126 nt, Human
aucuuuauggguccaaucuucugcuucuaggguaugcagugagcacuauuuauacuauaaucuugaugcuguuaaugcugguuacugacauuauuuagaaucaaucccugaucaaacuauagagau

SEQ ID NO: 4134673 - RNA, 99 nt, Human
aucuuuccguaauuacagcauuccagggcuagguaauggguaguugaugcucaggucauguauuuagcccugguuagggaauugguaaguugggaagau

SEQ ID NO: 4134674 - RNA, 56 nt, Human
aucuuucucagcuguaaucaaagagagaugacuugaugaaggcagguaagaaagau

SEQ ID NO: 4134675 - RNA, 87 nt, Human
aucuuucuuugguuguaugaaaugucuuuucuaauaaaagagccaaaaagugagagacagcauuucuagcaccaggcacagaagggu

SEQ ID NO: 4134676 - RNA, 60 nt, Human
aucuuugaugcagaaagcaacugucacugggaauugacuaagcuuuuuguugucaaaggu

SEQ ID NO: 4134677 - RNA, 78 nt, Human
aucuuugugucucaggccucagccugccaggccugggcuuucugcuuggcagugucuaggggucuggggcaaaaagau

SEQ ID NO: 4134678 - RNA, 120 nt, Human
aucuuuuaaauuuugggcagugguaucuugugcagauguauaugcauaaaaaguacauguauucaacaauuacuuauguaguaccucuuaugugcaaggcauuguuuuaaagaccaggau

SEQ ID NO: 4134679 - RNA, 69 nt, Human
aucuuuucauagaucagugagggaccacuaagccaaaaggcagggauuauuucacuggcuugauaaggu

SEQ ID NO: 4134680 - RNA, 61 nt, Human
aucuuuucaugccagcccaucacagagguugcaccuauggauuggcugcgcuuggguuggu

SEQ ID NO: 4134681 - RNA, 62 nt, Human
aucuuuucuucuucuccacacacaacaauccuucagcccugugugcuggaguuaggaaaggu

SEQ ID NO: 4134682 - RNA, 78 nt, Human
aucuuuucuugucacuuauacugcuuuggaggucaaaaguucuggcuuucucaaaagacagaagugaaaguaccaggu

SEQ ID NO: 4134683 - RNA, 72 nt, Human
aucuuuuggcaaauugaguuuucaguucuuugcuuucaauaaaauuggaaaaagacuuaauugccagccgau

SEQ ID NO: 4134684 - RNA, 92 nt, Human
aucuuuuuuugguucauagggagaagugucuaagagauuccuguuuuacuggcuuaacagcauuuuucuccacuucucuugccaacaaagau

SEQ ID NO: 4134685 - RNA, 95 nt, Human
augaaaaaguaaguuauaggccaguaaaauguuucaguaucuuguauaccuagaaggacugcugugacaauugugccuguauagaucucauuuau

SEQ ID NO: 4134686 - RNA, 77 nt, Human
augaaaaccuucuguguuauguucacugcccucucccuaacaccuagcacagugcugaacauagaauggacauucau

SEQ ID NO: 4134687 - RNA, 62 nt, Human
augaaacagaguacuuaauauauuguguauugugauuauguagcagaguaucucuguuuuau

SEQ ID NO: 4134688 - RNA, 73 nt, Human
augaaaccauucauucugaccucaagagaaccuucugaguguuuuuguggggggcggugugaaacagguucau

SEQ ID NO: 4134689 - RNA, 95 nt, Human
augaaagacuaagcugugcagagcuacauggagaagaaaauucuuagaaguaggaacuccacgaguguagguccugagacagaaaagucuguugu

SEQ ID NO: 4134690 - RNA, 76 nt, Human
augaaaguuucuucauuaagaugugaagucugaagugagaucaccuggguucauauccugguucugaaacuuucau

SEQ ID NO: 4134691 - RNA, 76 nt, Human
augaaauauuagccagaaaugaaugaugauagguacugauguucaaauuuauuuauucauucugucugucugucau

SEQ ID NO: 4134692 - RNA, 56 nt, Human
augaaaugagucaaugcgacuaggcugaaagauuguuuucugcuugacuauuucau

SEQ ID NO: 4134693 - RNA, 55 nt, Human
augaaaugucuggaucuuuuucuaauuguuugggaauaggguccauggauuucau

SEQ ID NO: 4134694 - RNA, 116 nt, Human
augaaauuuuagucuuuauaaccuuuccaaguaggcuggaguuuaacaucccaacaauucaggagacugauuuucuccauuguaaauucuguggaaguucuggagaauaauuucau

SEQ ID NO: 4134695 - RNA, 83 nt, Human
agugcucccacucaggugaugauauauuuaauccuagagccauugaaagcaguguucuuauaaauauauugaugggagacacu

SEQ ID NO: 4134696 - RNA, 78 nt, Human
agugcucuaggcacaggccaauacccucucucucgaaagcuccugaaagcagagaucauggcuuguaucugugagacu

SEQ ID NO: 4134697 - RNA, 101 nt, Human
agugcugagcaggcauggggcacuggugucuucagggacggcugcucccacgcaaggcugagacaaccugggacccagucacccacaucgccaucagcauu

SEQ ID NO: 4134698 - RNA, 67 nt, Human
agugcugggauuacaggagugagccaccgcgcccggccuuuuagcuuaucuugaaauccaccagccu

SEQ ID NO: 4134699 - RNA, 73 nt, Human
agugcugucucaagaaggauucuggaaucacaagagagaucagugaagaaagggcuccuuguugauuagcauu

SEQ ID NO: 4134700 - RNA, 62 nt, Human
agugcugugagggacuggauuacuuggucaguuuugguugcuggcuuccaguuuucagcacu

SEQ ID NO: 4134701 - RNA, 68 nt, Human
agugcuuuagcauccaacuguccuaacuaacauaccuaaauggcauugaagaugcagauuagggcacu

SEQ ID NO: 4134702 - RNA, 94 nt, Human
agugcuuuaggauguggauaaaaauuauguagucacuguggucuugauugcaucuguaauuuagauugauaacauuuuauacauucuaacuacu

SEQ ID NO: 4134703 - RNA, 62 nt, Human
agugcuuucuugcuccaucaguaagggcauacuuuaugauuguuggggucaggagcuagccu

SEQ ID NO: 4134704 - RNA, 102 nt, Human
agugcuuugucaagugccuggcacauaguaggugcacaguaaacuauaguuacuuuucugcguuauugaacaucugguauguguuaaauaacuugucugccu

SEQ ID NO: 4134705 - RNA, 71 nt, Human
agugcuuuuuaacaaacuuacuguguuuaaagaggaggaggaacccccagaugaaguaggugacgagcacu

SEQ ID NO: 4134706 - RNA, 75 nt, Human
aguggaagaagcugguguaaccuuagccuuugggaucucucagccaguuuguuuauuccggcucucacuucaacu

SEQ ID NO: 4134707 - RNA, 64 nt, Human
aguggaagauuuuucgguagcuaaaugagaauugcucaucaagucaucaaagaauucaucggcu

SEQ ID NO: 4134708 - RNA, 59 nt, Human
aguggaaggcugggaaaugcggcugguccagggcuuagcagucauccagccuuuccacu

SEQ ID NO: 4134709 - RNA, 69 nt, Human
aguggagguucuauguguaggaggucccaggauagugaguccucuuccuucucacuguggaaaagaacu

SEQ ID NO: 4134710 - RNA, 66 nt, Human
aguggaguuaauguccuugggguaaaucuaaucaaaacaagauggguccagcauauaaacuccucu

SEQ ID NO: 4134711 - RNA, 63 nt, Human
aguggauccugccuaguuauuugccaacaaaauacucggcaaauaccuuuccugccauucacu

SEQ ID NO: 4134712 - RNA, 62 nt, Human
aguggaugguauugggaccaggauaucagcauuuccuuauuccgguccuaacucucuccacu

SEQ ID NO: 4134713 - RNA, 70 nt, Human
aguggcagagccaaguagagcccagaccuucaaccuucuauuccuggggcucuuugcacagcucugcccu

SEQ ID NO: 4134714 - RNA, 72 nt, Human
aguggcagauguaggucuguaugugacauucuuguucaguuucauaaauguggcugccaccugccugaaauu

SEQ ID NO: 4134715 - RNA, 99 nt, Human
aguggcagguuuucugucagggagcucgaugccugagugucagacccaccaaagacguucauuccaucacgagcuagccccucaaaggaaucaaucacu

SEQ ID NO: 4134716 - RNA, 61 nt, Human
aguggcccucaggacaagguuacgcuagguacaccagugugcuguuuccagaagggcugcu

SEQ ID NO: 4134717 - RNA, 56 nt, Human
aguggcucauuccucuaaugccagcaguuuagggagguugagaugggugggucacu

SEQ ID NO: 4134718 - RNA, 71 nt, Human
aguggcuccuggcugggaaguagaguagguuucucuaaggaaaaugacaccugcucaccacccgccccacu

SEQ ID NO: 4134719 - RNA, 65 nt, Human
aguggcuguaggcuaugagagaaaaagaagucgagcaugauuucaugucuuuggccucagacacu

SEQ ID NO: 4134720 - RNA, 56 nt, Human
aguggcuuauguuuagaaucaugacucuggggccauguagaagaagcuaggucgcu

SEQ ID NO: 4134721 - RNA, 56 nt, Human
aguggcuucugcggugugcgcagggggccugcccccaugaagccccaugaagcucu

SEQ ID NO: 4134722 - RNA, 129 nt, Human
agugggagugccaauacuggguuagauguggacccucuuuuuuuauacgcucaauccuaucaucuuggcaauccaagaggaaaaggguagaagacagguuucauauuccuuaaggcaguuuccuuuacu

SEQ ID NO: 4134723 - RNA, 55 nt, Human
agugggauccucaccccagcaaugcuugaugauaguagggguagaguguccuauu

SEQ ID NO: 4134724 - RNA, 130 nt, Human
agugggcaaggccaugcucucaggaggcauucagugagaugguccuggcccagcccacgggaacggcugccuugguagugaccaucuugcccuguuccuguuccuuuucucauccccauccuugccuccu

SEQ ID NO: 4134725 - RNA, 61 nt, Human
agugggcaugaucuggugucuggaaagguggcuucggggacucauuguugugccuuucacu

SEQ ID NO: 4134726 - RNA, 94 nt, Human
aguggggacacgccuucuuuaaaguccuuugaauugaauugccggacucucacaaucagacagaaggacuauuugaauuucaggccuccccacu

SEQ ID NO: 4134727 - RNA, 76 nt, Human
aguggggguuuuccagcuuagagcaucauguuuaccugcucgcggggacauggaaugagauggaauguccucuccu

SEQ ID NO: 4134728 - RNA, 87 nt, Human
agugggguagcuuugcaaacuuuccucuggaccugaaauuccagcauccaguaaaguaggaacuuugcaucuccugcuaccugaacu

SEQ ID NO: 4134729 - RNA, 64 nt, Human
aguggguacaggguagggcaagggaaccugcguguuuaacacgugcccccucuacccacccacu

SEQ ID NO: 4134730 - RNA, 72 nt, Human
aguggguguggcuuaccuaaaaucauuccaaaauguaguguaggugggaugauagguaaguaauuaccuacu

SEQ ID NO: 4134731 - RNA, 57 nt, Human
agugguccauguucccagaagacaggaccuuuggccugcuuacuugcuuggaccacu

SEQ ID NO: 4134732 - RNA, 64 nt, Human
aguggugccauuaaaaucauugauuuuuagaacacauaaaugaauggauaguuuguggcccauu

SEQ ID NO: 4134733 - RNA, 58 nt, Human
aguggugucuuuuuugauuaggagaaacauuucuucuaguuauagaaaaagcauuauu

SEQ ID NO: 4134734 - RNA, 93 nt, Human
agugguuaggaacacacagaggcuccagagauagacugccuggauucagauuguacucauguccucuacgagcugugugacccuggaccaacu

SEQ ID NO: 4134735 - RNA, 55 nt, Human
agugguucacgccuguaaucccagcacuuugggaggccaaggcaggcggaucacu

SEQ ID NO: 4134736 - RNA, 55 nt, Human
agugguucagggugaagauacaaggucaggaagcugacugugcucgggaaccacu

SEQ ID NO: 4134737 - RNA, 68 nt, Human
agugguuuggggcuguguggguggagaaaaaugaauuucugagauguuccucagggccccagagcacu

SEQ ID NO: 4134738 - RNA, 55 nt, Human
aguguaaguagauacacuguccuucacaaaauuggcaguguguacugaaagcacu

SEQ ID NO: 4134739 - RNA, 68 nt, Human
aguguaauuacuuuuuagucaaagguuggcucuacaauguaggauuuugauuuuaaaauagugacacu

SEQ ID NO: 4134740 - RNA, 98 nt, Human
aguguagaaucaugucuuucaaaccacacaguaaaaucugaacuggaguuuugauauacaacucguauggcuugaaaugagaaccgugaaaauauauu

SEQ ID NO: 4134741 - RNA, 66 nt, Human
aguguaggguggucagagcagagcugcugggcauugcagccuuuaggucuucugcuucuuugcacu

SEQ ID NO: 4134742 - RNA, 65 nt, Human
aguguaggucgagagagguagccuuuguaugcauucagugcugggugaggugcccuccuuacacu

SEQ ID NO: 4134743 - RNA, 85 nt, Human
aguguauaugcaugcauacugugaacauacaugcaugcauucacaugcaugcauaaauguacacacacgcacagacauauacauu

SEQ ID NO: 4134744 - RNA, 63 nt, Human
aguguauuuuauuuucacaaaagaaaagugauuucacugaacuguguggaaaaaggagacauu

SEQ ID NO: 4134745 - RNA, 55 nt, Human
agugucaaaucagcaucugggucuugagaaaugccuagaaguggacauuugcauu

SEQ ID NO: 4134746 - RNA, 71 nt, Human
agugucagaugaagagcugcacauauuuauaucuggcuuuccagaaugcaguucauuucucuaugugcacu

SEQ ID NO: 4134747 - RNA, 75 nt, Human
agugucauguuuccaauuuuggggcugauguaagauauaagagucaaucuucaaacacuagaaacacaggauacu

SEQ ID NO: 4134748 - RNA, 103 nt, Human
agugucuaaaacaaacaaauacugauucaacuaacucuauuauuugaaaaaccuauucuuguuucagaugauuagaauaguauuuuaggaauuuguggauacu

SEQ ID NO: 4134749 - RNA, 57 nt, Human
agugucugcauguggugugcuaucucuuucaucuggucacaggaagcagcaggcacu

SEQ ID NO: 4134750 - RNA, 72 nt, Human
agugucugugaggggaauuccuguuccuggcccaaacccacaggccuugcucgugaaggccucucacacacu

SEQ ID NO: 4134751 - RNA, 76 nt, Human
agugucuuaaacacuuucacagguaagcaauacagggcugguauggcagcucuguucugugaguuguucgggaacu

SEQ ID NO: 4134752 - RNA, 64 nt, Human
agugucuuacaagaccaaagaaaggauacagcaagucaaugaagcugugugcuggucuguuacu

SEQ ID NO: 4134753 - RNA, 67 nt, Human
agugugaugucuugugaaaguuaaaggagauacaaaaucccugagaacuaaaccaugacauuauauu

SEQ ID NO: 4134754 - RNA, 127 nt, Human
aguguggauguauggauagaugggaaaggauuuagggcaaaagauucagucucaacagugcaagaaggaaucuacuacuuugguugaauauguaaugaauccccugucucuggagguaucaagcacu

SEQ ID NO: 4134755 - RNA, 55 nt, Human
aguguggucuucgagcagagguguucauauuuuauaucucuggaugacagacacu

SEQ ID NO: 4134756 - RNA, 58 nt, Human
agugugguucucaagguguggucacugaugcagcaucagcaucaccugggaacuuacu

SEQ ID NO: 4134757 - RNA, 57 nt, Human
aguguguauaugagucugaguguacaugccuggguauguaccagagcauauaugacu

SEQ ID NO: 4134758 - RNA, 71 nt, Human
agugugucauguagaaauugaugaagaagcgauaauuauagcagauucauugauaguuuuauguauguacu

SEQ ID NO: 4134759 - RNA, 61 nt, Human
aguguguguuugugguauuuaauuucauuaguacuggagaaaaaugcuuuugacacauauu

SEQ ID NO: 4134760 - RNA, 66 nt, Human
aguguucaucaauguguuuaauaaugccuggggaggcuuugguucuggcauugaauaaugaacauu

SEQ ID NO: 4134761 - RNA, 56 nt, Human
aguguucuaacaacugcuuucauggauucauaccaugucagagcuuguaggacauu

SEQ ID NO: 4134762 - RNA, 130 nt, Human
aguguugaugugugguuuucauuccuggugccucucgccuuuccaucuuccuuccuuaccuauuaagggcuuaagggcauucugcagcucugggguaagggguggggagcaggcgcccacacuucggccu

SEQ ID NO: 4134763 - RNA, 57 nt, Human
aguguugggcauuguagcagaccacccaggccuaguugcuaaaaagugccuaacauu

SEQ ID NO: 4134764 - RNA, 116 nt, Human
aguguuguaauugcaguuuuguugaaguucggguaucuguagaagagugugugugcucacucaguagccagacauuugacuguagauacuugcuauuaacucaguuaccucucgcu

SEQ ID NO: 4134765 - RNA, 130 nt, Human
aguguugucaauuauuuagcuaacaggcagaaaacuaggcuuuuauugacauccaaagggacucuccugaguguaauaaugaaggcaguuuauugaaugccugugagguugcuuucuaauuguacgcauu

SEQ ID NO: 4134766 - RNA, 57 nt, Human
agucugccuuuccaaucccgugagauaaagcucaugcuccauacuuggguggugacu

SEQ ID NO: 4134767 - RNA, 101 nt, Human
agucuggagcucacuucccacaggacgggcuaaagaguggugguccaacaggcaaagaucugaacucuaguccucguucugccuuagggagcugugugacu

SEQ ID NO: 4134768 - RNA, 59 nt, Human
agucuuacuuuggguugucuacucugagaucgauggaguacauuugacccaaauaagcu

SEQ ID NO: 4134769 - RNA, 81 nt, Human
agucuuauaccuuaugauaugcacuuuaucagaaucuaucuguuguuaguuuuggaagguuguguauuuuuuaauugggcu

SEQ ID NO: 4134770 - RNA, 61 nt, Human
agucuuauguuugugaagaacuuccaucauucaaaaggcaagccucuucauuguuaagacu

SEQ ID NO: 4134771 - RNA, 80 nt, Human
agucuucaacauuucugagaauaucaguuugaauaagauaggccugggagcuaaauaaucuuagaaaaugcuggaagauu

SEQ ID NO: 4134772 - RNA, 64 nt, Human
agucuucaauacuugacugugcucauuccuuguuagaggaguuauacacuaaguaugaagugcu

SEQ ID NO: 4134773 - RNA, 75 nt, Human
agucuucggagcagccaaacucggcguucacaacauagauguguuugacucuugcccaguuuggccauggagacu

SEQ ID NO: 4134774 - RNA, 55 nt, Human
agucuucuugggucagagaaucauuuacuuugagugaaugagauucaaggacacu

SEQ ID NO: 4134775 - RNA, 63 nt, Human
agucuugguuggguuauuacuagaggugugaccucugauaucgcacuaaacucugccaagccu

SEQ ID NO: 4134776 - RNA, 83 nt, Human
agucuuucaguuuucaauuucaucagaggugaugcuucauaauuugaacuuuugaugcugaaaauugaacugaaaaugagacu

SEQ ID NO: 4134777 - RNA, 70 nt, Human
agucuuuugcuccaggacaugacuuucuugcuauaggguaggguagaucagcucccugggacaaaaagcu

SEQ ID NO: 4134778 - RNA, 130 nt, Human
agugaaaagugugcuaagcacaggguuucagcagauaaucaugaugcaaugugcacaagggacagccucuuugcugccuugucucagggucuuuguaaugcaaacccuccauugagcccacauuuugacu

SEQ ID NO: 4134779 - RNA, 85 nt, Human
agugaaagaaaugagagaaaauuagauuuuacuguguuaaugaggcacacaggaaaugguuuaguuuugcuuuuacuuuuucauu

SEQ ID NO: 4134780 - RNA, 86 nt, Human
agugaagaauggaaugcaauggaauaggcugcucuuuaaagucagacaggucugaguuugaauccuuguucuaccauucucuaacu

SEQ ID NO: 4134781 - RNA, 58 nt, Human
agugaagagagaaaauggcaguucuuagggcccuagacugcccacaucucuuuccgcu

SEQ ID NO: 4134782 - RNA, 122 nt, Human
agugaagggaaaaaggcucuggaaccuuggaugucaguuccacgagagauaaauuuauaguuuuaacaaucugucuuuuauaacugacauauaaggucccagaggucuuuuuuccuaucacu

SEQ ID NO: 4134783 - RNA, 61 nt, Human
agugaaguagcucuguuugcaaguuagccaaaggcuuuugacagauagauguuauguuccu

SEQ ID NO: 4134784 - RNA, 63 nt, Human
agugaagucugcuggagccucuccuagucucuuagcagaggcacuguucuuagcgacuuuucu

SEQ ID NO: 4134785 - RNA, 82 nt, Human
agugaagugguagucacugcuauauuggauacugaggcuuuacaacugcaucaugucuguuaguaauggucaucucuuagcu

SEQ ID NO: 4134786 - RNA, 66 nt, Human
agugaaucguuaauacaggcuuccauugucuauaaacaaugaucacuugagaauuaacuguucauu

SEQ ID NO: 4134787 - RNA, 81 nt, Human
agugaaugugaggguggggaauagacugcuaugggagggauggaccugguggcagugagauuucucuucugggcagacacu

SEQ ID NO: 4134788 - RNA, 58 nt, Human
agugaauucuccacccaguaggaaagaagagacugucugucuuacuggagaauccauu

SEQ ID NO: 4134789 - RNA, 55 nt, Human
agugacaacaaguugacuagaauugcuggaaaguuuugguuggucuugaugcauu

SEQ ID NO: 4134790 - RNA, 55 nt, Human
agugacagaaacuuugcuuuuaaagacaaguaaggaggcaagguagaugucugcu

SEQ ID NO: 4134791 - RNA, 73 nt, Human
agugacagaauguaauauugcauuuuggguaaaaaucucauaucccagauuguaacuucuuaaauucuucacu

SEQ ID NO: 4134792 - RNA, 61 nt, Human
agugacaggaccaggucuggaaccuagguuuccauacuccuaguucaggucuccuuucacu

SEQ ID NO: 4134793 - RNA, 60 nt, Human
agugacaggggaggcagguguggcaagacagcgaugugagcauuuggugcccugucugcu

SEQ ID NO: 4134794 - RNA, 65 nt, Human
agugaccaucuaacgccugugauggugggaagcacgcuguaagguacaguaaguugggugguccu

SEQ ID NO: 4134795 - RNA, 66 nt, Human
agugaccauuuucagcuagaggaauugagcauuucagcuuagaagggucagcuuagaagggucauu

SEQ ID NO: 4134796 - RNA, 85 nt, Human
agugacuaaucgccaauggggaggaaagaagguccugugggagucaaagccagggucuuccucuaccccauucgugagaaacacu

SEQ ID NO: 4134797 - RNA, 71 nt, Human
agugacucugacagcucuggcuaguagaauaaugcugauuuuauauuuaucuuuggauguugucugucacu

SEQ ID NO: 4134798 - RNA, 55 nt, Human
agugacugacaccuguaaucccagcacuuugggaggccgaggcgggcagauuacu

SEQ ID NO: 4134799 - RNA, 62 nt, Human
agugagagggguucaucaggauauuugaauuuugaaaauaguuccugaauuuccuuucugcu

SEQ ID NO: 4134800 - RNA, 65 nt, Human
agugagaguucuguuacgugucaccaacaacauucuguauguuugccaugaacagaauucuaacu

SEQ ID NO: 4134801 - RNA, 61 nt, Human
agugagaucaugcaauauuugucuuucugucccugacugauuucaaauagcaugauguccu

SEQ ID NO: 4134802 - RNA, 61 nt, Human
agugagcugagcuuaacuccuugaauuccuguaugacuuuuucuguugugcucggcugacu

SEQ ID NO: 4134803 - RNA, 129 nt, Human
agugaggcaaguuauuuauauuuauuauuuauacccugcccacuuccagaaaugauuuaauuuggccuaggcaagugucuucugauggggugugugugugugugugugugugugugugaugauaauucu

SEQ ID NO: 4134804 - RNA, 78 nt, Human
agugaggcgaaggugcuggcgccccaggagacgcgcccccuccucucccucccugcggcgcggugacucagccucgcu

SEQ ID NO: 4134805 - RNA, 69 nt, Human
agugagggugagagaggccagagugccauguggugaccugaggccaggugcuuccccuguuaccucacu

SEQ ID NO: 4134806 - RNA, 70 nt, Human
agugagucagagccuuguuccuugccugucacgcggauauagcagcuuugaaacauggcucuagacuccu

SEQ ID NO: 4134807 - RNA, 64 nt, Human
agugaguggcagugaaggucauagcauucucacaaaggaaagugauagccacauuguagcaacu

SEQ ID NO: 4134808 - RNA, 57 nt, Human
agugauaccugcaaauccucauggaaccugaaaguccaugauaaugaagguguuauu

SEQ ID NO: 4134809 - RNA, 93 nt, Human
agugauaugaacuggucugccacaagauuuuugagauacuggaaauaagguuuuugaaaacauuuauggcaauuagaguaaguuuauguugcu

SEQ ID NO: 4134810 - RNA, 115 nt, Human
agugauaugcuuuaucguuguuguagugagugguaauuaggaauaaaaugggaaacaauucccauaaaagauugugauuagcauugauuaugcagacaacccgagguuuuccacu

SEQ ID NO: 4134811 - RNA, 61 nt, Human
agugaugaauaaaaauaaagcauguacugaauaccuagcccaugcuuaaguguucauuauu

SEQ ID NO: 4134812 - RNA, 69 nt, Human
agugaugcuagcucugggcacacaugagcucagcuuaauccucaugacaaccugugagcugguaugauu

SEQ ID NO: 4134813 - RNA, 96 nt, Human
agugauuaagggcuccaaaggugagugucuuaagagagccaggagaaaccuucauggccucuuacgacauagccuuggaaguuaccuggugucacu

SEQ ID NO: 4134814 - RNA, 79 nt, Human
agugauuaauaaaacagcgugguaguagucugaucaccuuuauggugaaucuggcuauugacauguuauagcaauugcu

SEQ ID NO: 4134815 - RNA, 107 nt, Human
agugauuauuuuugcuguacagcaguaugaggcaaggaucaucacugaucugggugguguuuccagagguauguucacuucccuuucuguaugguuaaaaaguuacu

SEQ ID NO: 4134816 - RNA, 81 nt, Human
agugauuuggugccuaccuuucaaaauauugugcaaagauaguucacacuagauaauuauaaaagguaggaacuccucauu

SEQ ID NO: 4134817 - RNA, 87 nt, Human
agugcaaauauucaacaugcaaacauguuuguguaucuguagacauaaaaauaaauagauauguauguauguguguguguguguacu

SEQ ID NO: 4134818 - RNA, 55 nt, Human
agugcacaaucuucauauggcguuuuaauuaaacugccuaugauuauuguguguu

SEQ ID NO: 4134819 - RNA, 61 nt, Human
agugcacaugcaggcacccagagcccacugcgugccggagggaaugaaagcugcguggccu

SEQ ID NO: 4134820 - RNA, 80 nt, Human
agugcacuacugugauacauagccagugcacuauggcaauacauagccagugcacuacugugauacacagccagugcacu

SEQ ID NO: 4134821 - RNA, 80 nt, Human
agugcagagaaugguuguaggugagaucuugaugcauaacacaaaaaaagcuauccaaauauauuuuauucacugucgcu

SEQ ID NO: 4134822 - RNA, 57 nt, Human
agugcagcuaaguggcucugugagguucucccaggucuccuucuuuagcugcucgcu

SEQ ID NO: 4134823 - RNA, 57 nt, Human
agugcaugcucuguagaaagcaggguuaaauaccaugggcuacagaagcaugcugcu

SEQ ID NO: 4134824 - RNA, 64 nt, Human
agugcauguaucuacagucacaaagcaacuucuugggcuuuaucuguugucuuuuacauguauu

SEQ ID NO: 4134825 - RNA, 80 nt, Human
agugcauuucucuuguggcuaaguagccuuuggauuuaucuuuucaaagguuucacaguagcccaucaaguggauauacu

SEQ ID NO: 4134826 - RNA, 79 nt, Human
agugccacuucaccugcuuuagacaacugcugggacaugcagugauccacagaccaguaucugcagcaggacagugccu

SEQ ID NO: 4134827 - RNA, 78 nt, Human
agugccaucuucaauugaaaacuagccuuugccuaacuuaucaacuagaaaacaagguuaauucagugaagaucaacu

SEQ ID NO: 4134828 - RNA, 103 nt, Human
agugcccacgccuagauuguaaguuccuggaaggcaaggauuugugucccacacuuguuuuguacccuccaggaucuugcacagcacuuggcgaauggguauu

SEQ ID NO: 4134829 - RNA, 76 nt, Human
agugcccacugcagggugcuuaggggguuuggcaggcaaugggaugcucuccuucuccucugcaaugacuggcacu

SEQ ID NO: 4134830 - RNA, 110 nt, Human
agugcccagagaaaggcuccauucaccgggcgggcugcucuccauggccgugagugucccgcgcucucugccgaccgcgggccccuaggaggagccuuugcuccaggccu

SEQ ID NO: 4134831 - RNA, 55 nt, Human
agugcccugucacuggaacugacaauacuugcuccagccauccaguggaggcacu

SEQ ID NO: 4134832 - RNA, 74 nt, Human
agugcccuucacaauucugaugguuucccaguuucuucuugaacuaaagcucacagaguugaacuuuaugcacu

SEQ ID NO: 4134833 - RNA, 91 nt, Human
agugccuccuucuacuuuguguuuauauguguguguguguuuguguguggugacaggugaccugcucauaugaaagucuucaggggguauu

SEQ ID NO: 4134834 - RNA, 56 nt, Human
agugccucuuuuuccgucuguuuguuucccaugugcccacggaaugaugaggcacu

SEQ ID NO: 4134835 - RNA, 80 nt, Human
agugccuguucucugcuccaggaacagagcugcugcucuacaagcagccuugugacuccggggucucugggagcaggacu

SEQ ID NO: 4134836 - RNA, 129 nt, Human
augaagacacaaaugauguucuuugaagccauugggucaaugugauauuucaagaguggggcagcuggcccagcugcugguauggagaucaugaugcagcuucguuacugucauuuguaaaacuuggcu

SEQ ID NO: 4134837 - RNA, 65 nt, Human
augaagcaggcaaggacaggcagcaaauacaagguguugagcugcuguguuggccacugcuucau

SEQ ID NO: 4134838 - RNA, 64 nt, Human
augaagcccuauccucuccugggauagaaauaccaucuccuauuaguaggacaaagggcaucau

SEQ ID NO: 4134839 - RNA, 112 nt, Human
augaagcuugcugacaaauacacuucacacaauuaugugugcacaaugggcuaaacaccuguuuauuaaugucuaccaguugugugccagagugggcuuguauaagcuugau

SEQ ID NO: 4134840 - RNA, 85 nt, Human
augaaguauauauuggauuaggcaccuauagguacauuacccauuuccuaaauuguaccuuuauguuugauuacaauuacuuugu

SEQ ID NO: 4134841 - RNA, 56 nt, Human
augaagucugccaaggaaaggcacuauaguguuuugacaccuaacagcagcuuuau

SEQ ID NO: 4134842 - RNA, 109 nt, Human
augaauaaagcaagcauaccauuaaguggaauuaaaucagacuuguuuucaguuaaaauagcgggauuucuggguaauuccauauuggaaacuagcugguuucuuucau

SEQ ID NO: 4134843 - RNA, 87 nt, Human
augaauaccugugcguaugggucugugauguguaugacaccuccguguguguguacacaugacaggcacccacgcguggguguguau

SEQ ID NO: 4134844 - RNA, 80 nt, Human
augaaucaugacccauuuucuagauguucuacuggggaaagcagaauuguuuuaagguggacaucuaagucaugaauuau

SEQ ID NO: 4134845 - RNA, 61 nt, Human
augaauccauuccugccacagacuucgauugcgggccuacugugugcucggauggacucgu

SEQ ID NO: 4134846 - RNA, 88 nt, Human
augaaugaguaaucacccagcaauuuagucaaagauauuuucuauccuuugucccugacaaguuuccuggugauuuuuccauauucau

SEQ ID NO: 4134847 - RNA, 71 nt, Human
augaaugcaugaagguugggugaauagaaugucguugauuaggauaaguagcuccuagccuccaagcucau

SEQ ID NO: 4134848 - RNA, 76 nt, Human
augaauguggugguaacggcaauagcucccuccuuggcacuccccgucggggcuggcucuuaccgacagcguuugu

SEQ ID NO: 4134849 - RNA, 81 nt, Human
augaauguuuuggaaccuugccucagaaaaauguauguacacacauauauacaacuuuacaugcaauuccaggguauccau

SEQ ID NO: 4134850 - RNA, 113 nt, Human
augacaaauaagcaggugaaaagagucuuagccucauuagucauuaaggaaaugcaaauuaaaaccacaauaauucagugcugguuaagaugugggucaccuggaacugucau

SEQ ID NO: 4134851 - RNA, 81 nt, Human
augacaaaugaugcagcugcucuuccucuauuggacacauguacaaaacaggaagagaggagcaguugcuacauaugccau

SEQ ID NO: 4134852 - RNA, 64 nt, Human
augacaaggcccuggcccccagagauucugguucaguggucuggggucaggccugagaauucau

SEQ ID NO: 4134853 - RNA, 64 nt, Human
augacacaagagcagaagccaucuuggugaccacacuccucaacacggcugucucuugagucau

SEQ ID NO: 4134854 - RNA, 77 nt, Human
augacagaaucucacaggacugaaacguaacauaaucuuuauguguauguuuucucguuguaguuguuauuugucau

SEQ ID NO: 4134855 - RNA, 71 nt, Human
augacagauuuagucucccuuaucaaggaauuuacuugaaacucuuugauacgagggacugaauauuuuau

SEQ ID NO: 4134856 - RNA, 56 nt, Human
augacaguuucacguccuccaggguuuaaaccucauggagacuuugagccuguugu

SEQ ID NO: 4134857 - RNA, 73 nt, Human
augacauauauguguguguguguauauauaaaauauaugcauguguauguacacauacacuuguaauuuucau

SEQ ID NO: 4134858 - RNA, 60 nt, Human
augacauccagugacagugugggagcaggcuacucuccagggacauguuucuggaggcau

SEQ ID NO: 4134859 - RNA, 70 nt, Human
augacccauuugcuuuuccuguaaaacuugauuuuauuuucauuaucucuuacaggugaagagagggcau

SEQ ID NO: 4134860 - RNA, 100 nt, Human
augaccggcaaccacugaagacaagaaaacacuggggaagcacugaaacccacagccuucucagcauuuauuuuucuucaaauuggaaucagcucaccau

SEQ ID NO: 4134861 - RNA, 95 nt, Human
augacuaaaacacuuuuccugcccucgaggagcucacagucuaguaugucucauccccuacuagacugaagcuccuugaggacagggauggucau

SEQ ID NO: 4134862 - RNA, 70 nt, Human
augacuauuguaauagaggcuaacauguauuaaacucucacaauaugacaggcucugucauaagugucau

SEQ ID NO: 4134863 - RNA, 57 nt, Human
augacugguuucauuaagguuauuuuaguaaaguagauuugauguaagcauagucau

SEQ ID NO: 4134864 - RNA, 76 nt, Human
augacuuagcuggguggugcuuguucaaggucucucaugaggcugcaggcaggguauccacuggggcuacagucau

SEQ ID NO: 4134865 - RNA, 81 nt, Human
augagaagauugagucaggccuccagguuaccauuuguuagcuguguggcuuuuaguggcuuugagcuucaguuuucucau

SEQ ID NO: 4134866 - RNA, 126 nt, Human
augagaaggaagagucgagguguaggguuagagguguaugaguacagguuugaggguuuccuuucaacauauaccauaaugcccccauccccaaacccaaaacacguucuccaugauccuuagcgu

SEQ ID NO: 4134867 - RNA, 126 nt, Human
augagacaagacaggagaggagaugcuggcgcgacacuguggccaggacugcagggggcgaggagccgggccgguccagucccgcgcagccugggcacugugcgucugggguccuucugacaacau

SEQ ID NO: 4134868 - RNA, 73 nt, Human
augagacucauggccagucuguuggacagcacuugucuggagugauuguccuuuagauggcuauauuacucau

SEQ ID NO: 4134869 - RNA, 92 nt, Human
augagauagauggcucgagaauggggccucuuagacucugccucuuacagugguccugggauuugcccuuuucucuuaacauaauuuuacau

SEQ ID NO: 4134870 - RNA, 76 nt, Human
augagauauguuaaaaguuaaaaauacagcuguugguaauguguuguaaugaaacuaacuuuugugccuaucuugu

SEQ ID NO: 4134871 - RNA, 61 nt, Human
augagauuuuauagugucuugaagccuggggacucuccucccccaaauacuguugucuuau

SEQ ID NO: 4134872 - RNA, 60 nt, Human
augagcaagagcuauguacagacuggcauagaaaaagaaaugcaaauagcucuugaucau

SEQ ID NO: 4134873 - RNA, 56 nt, Human
augagcaauuuuagcaucuccaagccagcacuaaaggaaauacugaaguuguucau

SEQ ID NO: 4134874 - RNA, 58 nt, Human
augagcaucugagccagugacugaggagguggcaccugaccuggcuucagauguacau

SEQ ID NO: 4134875 - RNA, 84 nt, Human
augagcggaggaggugacgaaaagaaauuguccugagaggaagccaagggcaaaacuuuacucuuguagccuuuacuccguagu

SEQ ID NO: 4134876 - RNA, 79 nt, Human
augagcugugaggguacagauauuugcugaacuauuuacaugauuaauguuccuauaauguuugcauucuuauuaucgu

SEQ ID NO: 4134877 - RNA, 67 nt, Human
augaggaauguugaauauaccugcauuuguguaacuaaucuacauaaauguuaaauauuuuccugau

SEQ ID NO: 4134878 - RNA, 127 nt, Human
augaggagucauugaguuggugcguuuugcaugauuugauacauguuaugugguuagagcagugcuuggcacauaguaagcuuuacauaaacauuuauuauucguauucacuaaguccacuuuccau

SEQ ID NO: 4134879 - RNA, 61 nt, Human
augaggagucugagaccgagggaugcucgaugaaucaccccaggucuccaggcucuggcau

SEQ ID NO: 4134880 - RNA, 73 nt, Human
augaggauuucucugagccugggacaugcuuuuguagucuacaaagguggaccauguggcuuuuuaucuucau

SEQ ID NO: 4134881 - RNA, 55 nt, Human
augaggcauuccacucaaacucauuuuuccuugacagugggugggucagucucau

SEQ ID NO: 4134882 - RNA, 56 nt, Human
augaggcugacucccauguacugugagucagacuuccaggcuuggaacagccuuau

SEQ ID NO: 4134883 - RNA, 107 nt, Human
augagggaaauuacagcaaaucugagacugaguuuggauuuuagugcuuaagaaauacccaaagggaaugaaauaaaugccuaguuacagauuuuguguuuuugcau

SEQ ID NO: 4134884 - RNA, 78 nt, Human
augaggggaggcacagaguaggugcacacaguaggugccgaaucugagugguuuuauucguuccucuguagaccucgu

SEQ ID NO: 4134885 - RNA, 62 nt, Human
augagguugcucugugccuuccaacauuugagaccuggaugugugcacagagcaaguuucau

SEQ ID NO: 4134886 - RNA, 56 nt, Human
augaguaagugaaucuccaaagguuucccagcccauaauggagauaaacuucucau

SEQ ID NO: 4134887 - RNA, 68 nt, Human
augagucauuugauuuugcauauaugagcccugcuuggagcuaaguaacugcauaauuaaauuuucau

SEQ ID NO: 4134888 - RNA, 77 nt, Human
augagugacugguuuugacaggaauuuaauccuucaauuggauuucccuuuguucuugugaguaaucaguaucucau

SEQ ID NO: 4134889 - RNA, 94 nt, Human
augaguguauguauauaucacuacacuaagauacagaucuagcccuauggguguguguguguguuugugugugugugugugugcaugcauuugu

SEQ ID NO: 4134890 - RNA, 129 nt, Human
augagugugcuuuaaaaccaaaaauuguuuuugucauugguuugguuuguuuuuaaaucaucgguuuggaauuacuuacucaagccuuguaacaucaagcaggacuaucuuuuuuauuguguaucucuu

SEQ ID NO: 4134891 - RNA, 63 nt, Human
augaguuauuuaaaaugauuguccuuggaggccuuugggaccaagucauuuaaauggacugau

SEQ ID NO: 4134892 - RNA, 63 nt, Human
augaguucaggccugccuugcuuacgagacuauuauguccucaaggcaggaagccugucuuau

SEQ ID NO: 4134893 - RNA, 114 nt, Human
augaguuucuguuccgugcagugaguugcauccuaacugauaguggguuucacugaaggucucagcaaggaugugagcgcagacugcauaacuuugggggaaugagaggcuggu

SEQ ID NO: 4134894 - RNA, 78 nt, Human
augaguuuuuuaauccucuugguaucuuaauuucuccaucuacccaguaaggcuguuaggaggauuaaaugugcucgu

SEQ ID NO: 4134895 - RNA, 73 nt, Human
augauaccagggcagcagaauuggggcacauuagagacacaggcucugcccacauucugaagcucccugucau

SEQ ID NO: 4134896 - RNA, 122 nt, Human
augauagggacaauagaaaccaaaaccaaaacauagaaggaagaguaguaggaucucuucacagauuuuuauucuuuugauucuguuccuaaaauuuggcuuuucaccuuuguaacuauggu

SEQ ID NO: 4134897 - RNA, 82 nt, Human
augauauggacauuuuugaagagucuagauugguuauuuagcaaaaugucccuugauuuagacuuuuugaguguuucuucau

SEQ ID NO: 4134898 - RNA, 66 nt, Human
augauauuuuaguaaagugauauuuuauuacuaauguagguauuacuaaagauuacugaagaucau

SEQ ID NO: 4134899 - RNA, 70 nt, Human
augaucuguggggccugugggcucugaccucacucugcagcagcaaagcccagaggccucacuuuuucau

SEQ ID NO: 4134900 - RNA, 75 nt, Human
augaugacaucgcccuggggaagagaagcugagaggaacuccucacucagcuagcuucaggagccaugacaucau

SEQ ID NO: 4134901 - RNA, 55 nt, Human
augaugccaaaucuagagaaagcacaaucaauggccucucagaauuggcaaucau

SEQ ID NO: 4134902 - RNA, 58 nt, Human
augauggugagguugagcacagagcuggugagaaguucacagucacuucgccugucgu

SEQ ID NO: 4134903 - RNA, 94 nt, Human
aggucacaggggaaggaaguugcagaguaagauuugaacugaagcaaucagccuucagugucccgucucuuaacucuuucucucuauuuaaccu

SEQ ID NO: 4134904 - RNA, 68 nt, Human
aggucaccuucuccucuuucggugaugguuuaaauuuucuugaaagcaugagauggacauaaugacuu

SEQ ID NO: 4134905 - RNA, 60 nt, Human
aggucacuuuggccucuacagccaugccauuccaugacugcuaacacgccaaaguuucuu

SEQ ID NO: 4134906 - RNA, 56 nt, Human
aggucagagaugaggucuaaagucuauccaagcacuuuauccuauaucuuuguucu

SEQ ID NO: 4134907 - RNA, 76 nt, Human
aggucagaguuggcuacucucugaggcuuucugucaugaaucugcuggcggccucucagggcagagacccugaccu

SEQ ID NO: 4134908 - RNA, 57 nt, Human
aggucagaugggagaugggauggggcuuugcccauaucuaagagucuauucuaaccu

SEQ ID NO: 4134909 - RNA, 65 nt, Human
aggucaggagguuaagagucuuuugccaacuggccuuagguaagucucuuuaccucuccaggcuu

SEQ ID NO: 4134910 - RNA, 73 nt, Human
aggucaggaguggugugagggacucccaugcccauauauuccauggccucucauuuccaucacuuucuuaucu

SEQ ID NO: 4134911 - RNA, 57 nt, Human
aggucauaaaauuaagauaauggcagaaaugaaaggagucuuuauguuuuaugaccu

SEQ ID NO: 4134912 - RNA, 71 nt, Human
aggucauagguagauuuaaagauuuucugauuagcaauugguugaaagaguuaagcuuugccuaaagacuu

SEQ ID NO: 4134913 - RNA, 70 nt, Human
aggucaucuuugcuugacacugugauugucagagcccugaugguguuuauaggcaaagaucaaugacacu

SEQ ID NO: 4134914 - RNA, 97 nt, Human
aggucaugacauuugagcaacaauggagguuuggagggaguggcucuuaggcuaggucuaccuggaguccguuguuaaguucaauuuuguuuguucu

SEQ ID NO: 4134915 - RNA, 75 nt, Human
aggucauggguaaauuucuuaagagggccaguuaauuugguucuggaacauagcaagaaguuguacuccugaccu

SEQ ID NO: 4134916 - RNA, 81 nt, Human
aggucccgaggggcgggaggccaggguggguggccugcuuggccaccccaaaugaagaccucuccucucccccuuuuuccu

SEQ ID NO: 4134917 - RNA, 127 nt, Human
agguccguggugcucucagugccccgaggagggugggggucggccugacccgcuuccgcccgugcuucucagguggcagggcagugucuggcccccaggcugcucuaggucuggguuccucgcuccu

SEQ ID NO: 4134918 - RNA, 67 nt, Human
agguccucagccaucugaauuagcuuuguuuuuguguggaacuguaaagguugagugguaagggcuu

SEQ ID NO: 4134919 - RNA, 127 nt, Human
agguccuugugaaguugagucgaccacugguuacagaaguggauauuagaguaauacacuaccagugaaaaucauucagugaccacuucccaucagagccgaucacaguucaucuugacauggaccu

SEQ ID NO: 4134920 - RNA, 79 nt, Human
aggucgguguccacucauugcccugcgggcuccuuaccucauugaaguccauuuaggagccaugagugacaucacaccu

SEQ ID NO: 4134921 - RNA, 57 nt, Human
aggucucucaaguuuccauagcugauucugaaucccagauaggaagcgagcuggccu

SEQ ID NO: 4134922 - RNA, 72 nt, Human
aggucucugaaaugcuuagaugaggcagcaggaguuugaauuacuggcugagucagcaggucacagagaccu

SEQ ID NO: 4134923 - RNA, 129 nt, Human
aggucugaaacauuuuucuugccccauucacuggcuacaguucagaaaugucuuugcaaaauccuaggacuuugugaaacacauuugaaagccacugagcuggaacaucucuugauaauaucagagccu

SEQ ID NO: 4134924 - RNA, 69 nt, Human
aggucugaucaugagauuauaugauuccaucaauuaaaagagaaucaguucuacaucuuauccagacuu

SEQ ID NO: 4134925 - RNA, 64 nt, Human
aggucugggaguucauucccuggagaggggaacagaaaucucuggaggaaaagcugccaggccu

SEQ ID NO: 4134926 - RNA, 64 nt, Human
aggucugggcuccuggcaggcagccuucuccacagggcgcucugucucagggguccagcagccu

SEQ ID NO: 4134927 - RNA, 58 nt, Human
aggucugguauuuuucuauacugagaagcucuuacagcuguaaaaauauaccagaucu

SEQ ID NO: 4134928 - RNA, 55 nt, Human
aggucuguuugcuguuuucuccaaugaaaugguucuggguaaacagcagacgccu

SEQ ID NO: 4134929 - RNA, 126 nt, Human
aggucuucaaguaucaggcuaagaaauguggacuucauccaguagguaaugugaugucacuggauaucugugcaguaucuaugugauggguugggaguggagaagccuggggauacuuaagggucu

SEQ ID NO: 4134930 - RNA, 69 nt, Human
aggucuuuuuugugcauucaaguaggagccacacaccauguuggcuaacugcccccugugugaagaccu

SEQ ID NO: 4134931 - RNA, 60 nt, Human
aggugaaccuauaaucccugggcaagaaaggagagcuaguccaggaaugucuguucaucu

SEQ ID NO: 4134932 - RNA, 79 nt, Human
aggugaauuugcaccuagaggucccggcaggacuucguuaaugagcgugcuccugccucaggacucugcauauucuccu

SEQ ID NO: 4134933 - RNA, 68 nt, Human
aggugacagcagggucacauucccucugguggcuccagaggagaauccguuuccuugccuuuucagcu

SEQ ID NO: 4134934 - RNA, 57 nt, Human
aguugaguucuuugucauucacagacaaaagcguccugacugaaauagaauuuagcu

SEQ ID NO: 4134935 - RNA, 80 nt, Human
aguugauuguaaaugaccuuuucuaauuagggaguaauuaugacugugugauuugaaaagguaauuuugaacuuguaacu

SEQ ID NO: 4134936 - RNA, 66 nt, Human
aguugcagcacuugccaaacuaacucaggucagaugcccaaaggagggguggagguggcugcagcu

SEQ ID NO: 4134937 - RNA, 121 nt, Human
aguugcauccuguccuuaaagcaggaacucuuauucuggaguuugaggacaagcuucugcaaaucugugaagcuccugaauuuugaauguagagcacauuuuggagagaggaugcauagcu

SEQ ID NO: 4134938 - RNA, 83 nt, Human
aguugcauggugugauggaaggagaauggucuuugaaagcagacagacauaauuucaaauaccagcuuuuccagaauguaacu

SEQ ID NO: 4134939 - RNA, 56 nt, Human
aguugcauguccaaggggguagauuuucaucacccuacuaaaugugguaugucacu

SEQ ID NO: 4134940 - RNA, 79 nt, Human
aguugcugaaauuauuguguaaaaugaggcuuuugcuuuaaagguuucauuugucagugaauaauucauuccagcaauu

SEQ ID NO: 4134941 - RNA, 60 nt, Human
aguuggacacguuuugcuauaaaagaaauauuuuaugugugaaaugcugucuucaagacu

SEQ ID NO: 4134942 - RNA, 58 nt, Human
aguuggauggaucaagcugaccucuccuggugagccaguucuucagauccauccagcu

SEQ ID NO: 4134943 - RNA, 56 nt, Human
aguuggcuucaguguauaguggggcuucuugaccuccaucaucacaugagccaauu

SEQ ID NO: 4134944 - RNA, 69 nt, Human
aguugggaagaauggaggugguuagaauuauuacuauauuuuuuuauaccaucccccuucaaccaaacu

SEQ ID NO: 4134945 - RNA, 62 nt, Human
aguugggacuguauguguauacacacaauuacacaaacaaauauacacauauucuugcaacu

SEQ ID NO: 4134946 - RNA, 74 nt, Human
aguugggauaugggucaguucaguggccaacagucucuguucccaccaugcugcacccaucucuuaccccagcu

SEQ ID NO: 4134947 - RNA, 79 nt, Human
aguuggggagguggcugucagcuucacuugaaccugaaggucugggaguggaaggcaugacagccgcccaccuccaauu

SEQ ID NO: 4134948 - RNA, 79 nt, Human
aguuggguaccucaaggguaauuagggcucauuauugcuuagaauacagugcuaaacacuucuugaaauuauucaaacu

SEQ ID NO: 4134949 - RNA, 106 nt, Human
aguugguaguucgcucccgggcugaucucagaguguggaacuugaggagcugcggugacauccugcagccacacgggagguggcuccucaggggcgauugcuggcu

SEQ ID NO: 4134950 - RNA, 69 nt, Human
aguuguaaaauaauguaggcauuagccucuaguaaaauauuaagaaggcucauuugacugcauucagcu

SEQ ID NO: 4134951 - RNA, 81 nt, Human
aguuguaaauaauuaaaagcuucccaagaguuaaaugaagguuaugaugacucuugauaacuuguuaaucuguugcugacu

SEQ ID NO: 4134952 - RNA, 78 nt, Human
aguugugaauauauuauucagcuuuucacucaugguuuauaaauauguugaauaugcauuuggguaauguauauaacu

SEQ ID NO: 4134953 - RNA, 72 nt, Human
aguugugagacugugccauguauuuggggucaucuggcuagauuuauuucauugcacauggcaguucacgcu

SEQ ID NO: 4134954 - RNA, 61 nt, Human
aguuguuaagaggauggacuuuggagacagacacuucaguuuccacuuacauuuaauggcu

SEQ ID NO: 4134955 - RNA, 71 nt, Human
aguuguuauaugugaaacuuuguuuauccugucuagggauaggauacacggggauuuauguagacauaauu

SEQ ID NO: 4134956 - RNA, 91 nt, Human
aguuguucaguguucauuccgucuguccuuuaucuugucugcuccuugggaaagcugggugaaggcagauggcuuuggcgcaggcucagcu

SEQ ID NO: 4134957 - RNA, 92 nt, Human
aguuguucugagaagggcuuggagauguggcccuaaagccccgauggaugaggagguucauauuugucaucugccuuaguucagagaagacu

SEQ ID NO: 4134958 - RNA, 67 nt, Human
aguuguuuaccuucugagcugcagacagaaguucacaucuguuauacagacacgaugguauccaacu

SEQ ID NO: 4134959 - RNA, 88 nt, Human
aguuuaauuaaauguuuaguuuuauuuuaguaauacuuuggccuuuguaguugccgagugguaaaguguacugaauaugaauaaagcu

SEQ ID NO: 4134960 - RNA, 74 nt, Human
aguuuagguacagcaauauaagaggucaggggucaagcaauauaaacugccuccgagaaggcuguaauuaaauu

SEQ ID NO: 4134961 - RNA, 79 nt, Human
aguuuaucagauaucuuguauauguagggaugaggcagcuguauaacaaguuguagaguauagaaggaucuggugaauu

SEQ ID NO: 4134962 - RNA, 88 nt, Human
aguuucagguagcaucucuccaggaagcccucccugacucauucaggcugagcuaggugauagcuuccugggagcuauccuagggauu

SEQ ID NO: 4134963 - RNA, 55 nt, Human
aguuucauaugagccugugguugccagagauguaaacauugguucaaauaaaacu

SEQ ID NO: 4134964 - RNA, 80 nt, Human
aguuucauguuuauguuccucagggaggcuagcaguaagcacucggaacguauauucuaguacccugaaaaccuggaacu

SEQ ID NO: 4134965 - RNA, 57 nt, Human
aguuuccaaagcauguucacacacuauuuccugugggcuccauuggcaauggagacu

SEQ ID NO: 4134966 - RNA, 87 nt, Human
aguuuccuuggcagcaguguagagaauggccuugaaguaguccuggggcuaaacaggaauccucucuccugcccauguuaggaaacu

SEQ ID NO: 4134967 - RNA, 76 nt, Human
aguuucugggaaaauggaggcagugauuugcugaaggccacacagcaaauauuucuguagcuauguucuuuccacu

SEQ ID NO: 4134968 - RNA, 55 nt, Human
aguuucuugcauggggcaaugugauuccugccacagggccuuugcacaagcagcu

SEQ ID NO: 4134969 - RNA, 78 nt, Human
aguuucuuucugucuuuguucaggcugcuauagcaaaguagcauacacuaaguggcuuacaaacaacagaaauuaauu

SEQ ID NO: 4134970 - RNA, 68 nt, Human
aguuugaaagcuuaacaguacaaauguucucuccaugguacuguuacauagcuuuucuuaaccagacu

SEQ ID NO: 4134971 - RNA, 64 nt, Human
aguuugaccauccugaauaccugauggggaaucacuucccauuauuauaggaggcucauuagcu

SEQ ID NO: 4134972 - RNA, 78 nt, Human
aguuugaggagaacugguguuaguccuucuugggaauuuugguagaauucagcagugcagacacccaguccucagauu

SEQ ID NO: 4134973 - RNA, 75 nt, Human
aguuugcaaaauaaggaagaagaagaugaggagaugcagucuucauuucauuucuuuucccaauauuuugcugcu

SEQ ID NO: 4134974 - RNA, 99 nt, Human
aguuuggguguuugaagcugugccuuguggagggccuugcacagaggaugacucaguuagugucugcccauucaugggcacaggccaagcuacccugcu

SEQ ID NO: 4134975 - RNA, 84 nt, Human
aguuugucugucuuaagcaaggcagccuuuguuugauugauuuuacccuuucugucuaacggggcuggccugaccugacucucu

SEQ ID NO: 4134976 - RNA, 64 nt, Human
aguuugucugucuucaaagccugcacucuuuccagaauauugugcuacuucuagaaggcaaacu

SEQ ID NO: 4134977 - RNA, 74 nt, Human
aguuuguguguauauacugauguaaaacucuccauggcuccauggcugggcuuuuagucagauuucaccaaauu

SEQ ID NO: 4134978 - RNA, 71 nt, Human
aguuuuacccuggagcaaguuuccucagucauguuaaauucauggggaaaauccuccuaggauuuagaacu

SEQ ID NO: 4134979 - RNA, 67 nt, Human
aguuuuagacauuguaacgguggcucuucuuucauaauuuuaugucacugugaagaugcuauaaacu

SEQ ID NO: 4134980 - RNA, 82 nt, Human
aguuuuaggguacaugcgcacaacaugcagguuaguuacauauguauacaugugccauguuggugugcugcacccgucaacu

SEQ ID NO: 4134981 - RNA, 82 nt, Human
aguuuuaggguacaugcgcacaaugugcaggucaguuacauauguauacaugugccauguuggugugcugcacccauuaacu

SEQ ID NO: 4134982 - RNA, 82 nt, Human
aguuuuaggguacguaugcacaacaugcagguuuguuacauauguauacaugugccauguuggugugcugcacccauuaacu

SEQ ID NO: 4134983 - RNA, 82 nt, Human
aguuuuaggguucaugugcacaacaugcagguuuguuacauauguauacgugugccauguuggugugcugcacccauuaacu

SEQ ID NO: 4134984 - RNA, 56 nt, Human
aguuuuaucuguaagcuguucagggcccugcuuggccuugccuuuuggauggaacu

SEQ ID NO: 4134985 - RNA, 83 nt, Human
aguuuucaggagagcacaacauugcccuuagacuagauucaaaauuuuguuaaggauguugugauuuauuauuccggaugacu

SEQ ID NO: 4134986 - RNA, 103 nt, Human
aguuuucccccuuauucuuuuguuaaauucuggcugccacauuuucuacuaugaaauaaaacuagucuguggagucagagaauaaagaaugcauaagaaaacu

SEQ ID NO: 4134987 - RNA, 68 nt, Human
aguuuuccuaugauauucuauguguccugcauuugaaaguggggcaccauuaaucauccauaggagcu

SEQ ID NO: 4134988 - RNA, 58 nt, Human
aguuuucuaccagggaagagagucccacuucaugggauuaagaucauuguagaagauu

SEQ ID NO: 4134989 - RNA, 61 nt, Human
aguuuucucacaucaaaaaugaggauaauaguucugaccucauuagguuguugagagaauu

SEQ ID NO: 4134990 - RNA, 59 nt, Human
aguuuucugccucuggaugcguaaagcuucaaccugcuggcuuuuagagggagaggacu

SEQ ID NO: 4134991 - RNA, 88 nt, Human
aguuuucuuggaggccugcaaacaaggacuucugagccaaaaccauggcuaaguccuggcugguuugaagcagccucuuagacaaacu

SEQ ID NO: 4134992 - RNA, 70 nt, Human
aguuuugccacggugccgagcgcaggacgaugacccggcccaaugcccuggaucgaugccgagggaaacu

SEQ ID NO: 4134993 - RNA, 61 nt, Human
aguuuuguauaagcaacugucaccauuggaaggggacaguuuaugguguuuuauauagacu

SEQ ID NO: 4134994 - RNA, 72 nt, Human
aguuuugucugcuccucccagccucauucagaguuccaagggaguaaggccugagagagagcagauauuucu

SEQ ID NO: 4134995 - RNA, 94 nt, Human
aguuuuguuauccacuugggcuuagaagguaagugagcuuuuuacccuuguagucauuuuuacuuauuuuuauaaguacaauaccuaacauacu

SEQ ID NO: 4134996 - RNA, 63 nt, Human
aguuuuuaaaauguuaggugauucagaucuuaauuuucugacugaaauugcauuuuaaaaauu

SEQ ID NO: 4134997 - RNA, 88 nt, Human
aguuuuugaugucugugauucuaaauuaaggccugaaagggcagguuuucuuacaggagagauuuaguaaucaucacaucagaaaacu

SEQ ID NO: 4134998 - RNA, 76 nt, Human
aguuuuugugugagccuagguuuccgauucucuuggguauauaucuaggaauagaauugcugggucacaugauacu

SEQ ID NO: 4134999 - RNA, 117 nt, Human
aguuuuuuaucacaucuccaaaaaaggaagaucaaugugucagaagagaugcuaguagucaacuuuuauccauuuguaaauguuagagucuucauuuuuucuucuguguaaaauacu

SEQ ID NO: 4135000 - RNA, 92 nt, Human
aguuuuuucuucauauuucaauuguucaaaaauaucuucugcaaagcugaugucuguuuuguaaagggcauuugcacagugaggaaggagcu

SEQ ID NO: 4135001 - RNA, 76 nt, Human
auagauguauggauaggugauaaugaagcagccagaauuaaagagcuuauauaucuguucauguuuauaugucuau

SEQ ID NO: 4135002 - RNA, 84 nt, Human
auagauguuaguggauugacuguuaaacgaauuaaucauucucuuucaauucguacugcuggcagaaguucacuaguagcuuau

SEQ ID NO: 4135003 - RNA, 62 nt, Human
auagauuaggcuuagaagucuguagugaaaguuacauuacauucuuucgaugucugauuugu

SEQ ID NO: 4135004 - RNA, 56 nt, Human
auagcaaccaccuaugugcacuuaagucuguaaguugcugacaucaggucugcuau

SEQ ID NO: 4135005 - RNA, 112 nt, Human
auagcagccagugggaggcucugauggaagagggagguagugggaagaagggagaaaccaggauauuucucccucuuugucugcuuuggguggagucuccaguagcugcuau

SEQ ID NO: 4135006 - RNA, 125 nt, Human
auagcagguuuaauuuucuuauucccaaucucagaaugaaagcuuuuaacaauuuaccuugaauuaugauuuugcuuaaggcuuagaagcuaucugcuauugcaguaagaaaguuucccuucuau

SEQ ID NO: 4135007 - RNA, 75 nt, Human
auagcaucaccuggcagaugggaccaagacugcauucuuggugcauuacucaaucugugguacaaggucugcuau

SEQ ID NO: 4135008 - RNA, 94 nt, Human
auagcccuccaauguagucgugucuuuguauucauccguaauaauuucuuuagaaaaaaauugcugagaacggaauugcugcauuggagguugu

SEQ ID NO: 4135009 - RNA, 68 nt, Human
auagcuaaaaaggaaguaaaguccuguugagaaaggaggaacacuuuaacauuccuuuucauugcuau

SEQ ID NO: 4135010 - RNA, 71 nt, Human
auagcuucuuuccccuagucuggacuucuuagugucagaaaaaucugacaucagaaaggggaagaagcugu

SEQ ID NO: 4135011 - RNA, 56 nt, Human
auagcuuucuauauaugaguugcuggggaccuucacauucucuuuuagaaagcugu

SEQ ID NO: 4135012 - RNA, 125 nt, Human
auaggaaaacugugguuagaaaaauaggaggaaagggaggaaauauuguguugagcaucaucucuccaugcuuauacacccucuucccaggccucuuguguauuucuuuuaaugguuuucacuau

SEQ ID NO: 4135013 - RNA, 64 nt, Human
auaggaaagauaaugaaggguuggcuguugacauuagucaauagacaacacuuauuauuccugu

SEQ ID NO: 4135014 - RNA, 63 nt, Human
auaggaaagggaguuuugcuuaugaaaugcaugugccucacaacagucacucccuaagccugu

SEQ ID NO: 4135015 - RNA, 65 nt, Human
auaggaacauuguucauuguucagcucagcuucuccuguugauucagugcacugaacaauccugu

SEQ ID NO: 4135016 - RNA, 64 nt, Human
auaggacuagggguucagaagaauucuuagugaagcugagaagucagucaucuccugucucuau

SEQ ID NO: 4135017 - RNA, 68 nt, Human
auaggacuuggugacucucaaugcucaagaaagucauuuucuaauugcaucauugucacagucacuau

SEQ ID NO: 4135018 - RNA, 64 nt, Human
auaggacuuuacaguagauacaaugaguaaaauaguuuauucgguggugcuacuguugucuuau

SEQ ID NO: 4135019 - RNA, 70 nt, Human
auaggaucuggggaccuguuguugcuaaguauauguaggaaugugccaaauuagaguucccaggcuuugu

SEQ ID NO: 4135020 - RNA, 59 nt, Human
auagggcagcaagcccaaguuaggggcuuuucuucacccacugggcauaccuguccugu

SEQ ID NO: 4135021 - RNA, 103 nt, Human
auaggggaugacagcuucaucuguguuauugucucugaagaccuucaagugggacaagauguggagcuggaagacagugauauugaugaacuugauucuuugu

SEQ ID NO: 4135022 - RNA, 62 nt, Human
auagggguugguccaaggcuagcuaaaacccuggaugggaugagucuggcaccuauuccugu

SEQ ID NO: 4135023 - RNA, 88 nt, Human
auaggguaugauugcaaaagacuuuucugaaagcuuagcuuuggauaaaucuucagcuagccuaggcagagugcauauucuauccugu

SEQ ID NO: 4135024 - RNA, 130 nt, Human
auagguaaagaaucgaauacauaaggaugcucuguaauuuggacaaacagaauagagcuaaaagccagagacaggauucuauugcaguuuuuuucugaguccgaauucauucuucuuaaauuuuacauau

SEQ ID NO: 4135025 - RNA, 67 nt, Human
auaggucaacucucauuggaaguccaugaguaaccccagcuccuuccacugauuuugguugaccuau

SEQ ID NO: 4135026 - RNA, 60 nt, Human
auagguccugugagauucaugcucaaagagguucuguuuugauguguuuccaggauuugu

SEQ ID NO: 4135027 - RNA, 79 nt, Human
auagguuggugcuaaaauaacugaguuuuugccauuacuuucaguggcacaaacugcaauuacuuuugcaaaauccuau

SEQ ID NO: 4135028 - RNA, 77 nt, Human
auaguacaguggaggucuguguucaaaucccagauucuccacuuaauucuugggugagcaagugaccaacugucugu

SEQ ID NO: 4135029 - RNA, 55 nt, Human
auaguagcgguacugauaauaauaaguagcuguaugacuuaucuacugcuacugu

SEQ ID NO: 4135030 - RNA, 62 nt, Human
auaguagguuggagaguccagaggugaaagugcugguucucacugugcuccuaacuagcugu

SEQ ID NO: 4135031 - RNA, 129 nt, Human
auaguauggcuuuucugugcaugauauuugacaagcugggcauguaccucuucuggccucaguuuucccuuuuauuaaauugagacacuuugggcaucacuucaccuuguccaggacaaguugcauuau

SEQ ID NO: 4135032 - RNA, 56 nt, Human
auagugcuggagcuaggauuugaauccauccaggucaucugccuccaaagcacuau

SEQ ID NO: 4135033 - RNA, 66 nt, Human
auaguguauggaagguccuacagagcgcauuauacugaugcguuccagugcccauccagucacuau

SEQ ID NO: 4135034 - RNA, 79 nt, Human
auagugugaaaaugucaaagccuggaauacacaauuuaaaguugcuuucuagaaaguuuguacugauuuucacuucuau

SEQ ID NO: 4135035 - RNA, 84 nt, Human
auagugugaaagacaaggcaggauauuaaccggaccagggccugggccaggugugagcauucugucuucugucugucacuuuau

SEQ ID NO: 4135036 - RNA, 62 nt, Human
auaguuaccuggaugaucuuucauauucuguagauucuguaggacacaccagguccagcugu

SEQ ID NO: 4135037 - RNA, 79 nt, Human
auaguuauuucaucucuggaacauaacuggucugcuggcauuacacccacguuacucgaagagaugaaaauaaaauuau

SEQ ID NO: 4135038 - RNA, 78 nt, Human
auaguucuacaaaggguuagacugugacaggugaaauuccagucaacugaaacggugaucuuuuaacucaggaacugu

SEQ ID NO: 4135039 - RNA, 88 nt, Human
auaguuguaagcccaauucuucucuguauagaaaggaaacauuguguacuuaaugaauuauuuauacagagcauuuguugccaacugu

SEQ ID NO: 4135040 - RNA, 82 nt, Human
auaguuguuguuuuuugucuacaacuaaguuuagggugauuuguacacaucuauagacaagcguaacaagaagcaauaguau

SEQ ID NO: 4135041 - RNA, 78 nt, Human
auaguuuauuuauccaucaucugcugaaggacaucuuugucacuuccaaguucuggcaauuaugaauagagcugcugu

SEQ ID NO: 4135042 - RNA, 59 nt, Human
auaguuuuagccuuucuuggcaaucuggugccccagccaauuuccugagguaaagcugu

SEQ ID NO: 4135043 - RNA, 71 nt, Human
auauaaauuagaaugcaggguucauugugccugguuuucuuuuaucaugaaucuuguguucuauguuauau

SEQ ID NO: 4135044 - RNA, 62 nt, Human
auauaacucuccauuaagggccccauuagcaacacaagggccucauugucaaggaguuaugu

SEQ ID NO: 4135045 - RNA, 95 nt, Human
auauacauuacacacacagucacauaucuauguguguagauguuuauguauguguguauauauauaccuguguguguguguguguguguguguau

SEQ ID NO: 4135046 - RNA, 72 nt, Human
auauacguuuuaugcauaagauuaagcugguuaacuuuauguugauauauuuuuuaugcauaggaaauauau

SEQ ID NO: 4135047 - RNA, 83 nt, Human
auauacuguagugguuuagagcaaaaacucuggugccuggaugccuggguucaaaaaccagcucugccacuuaauagcugugu

SEQ ID NO: 4135048 - RNA, 64 nt, Human
auauacugugcacaauucuaaguccuggcuauauagcagggagcuuaauccugugcacuuauau

SEQ ID NO: 4135049 - RNA, 72 nt, Human
auauagauuccaugguuccuuuacaggccuauagaaacagaauguguagggcuugaacccuggaaucuguau

SEQ ID NO: 4135050 - RNA, 110 nt, Human
auauaggagcaaucaggcauuggauggauguuuggacuauauacauuacaaaguaauucuacucuugaagucuuaugguuuaaauucugugugcauauguguaccugugu

SEQ ID NO: 4135051 - RNA, 87 nt, Human
auauaguacacuauggggauucaaaguuaucauuugaguuuuugacuacuuaugaacaacuugaagcuccaugacuuguguguguau

SEQ ID NO: 4135052 - RNA, 85 nt, Human
auauauagacauuauauauauggggauuauauauauuaagaaaauauauuuauauauagucaaacauauauguguguguguauau

SEQ ID NO: 4135053 - RNA, 118 nt, Human
auauauauacacauauauaugcauauacagguauguauauguguauauauguguguauauacacacacaugcauacacguacauaccuguauaugcauauauauauguguguauauau

SEQ ID NO: 4135054 - RNA, 74 nt, Human
auauauaucacuuugccaaaguauauaaagaucuguauggugaaaguuaagugcuuaggucaaaggacauauau

SEQ ID NO: 4135055 - RNA, 67 nt, Human
auauaugauugcauuauuugcaugugccuguauauauaugcaugcaucuagauaugcagacauguau

SEQ ID NO: 4135056 - RNA, 67 nt, Human
auauaugugucuguuucuagacucuguucuguucccugggucaacaagcauuaacaggcauuuauau

SEQ ID NO: 4135057 - RNA, 67 nt, Human
auauauucuggguauaagucccuuugcagaucuaugauuugcaaauauuguuuaccuuucuguaugu

SEQ ID NO: 4135058 - RNA, 83 nt, Human
auaucaaaggcgaaauagaucucugggaugcaaguggcucauggaccacuuguaaccuuugauccauuuuucaucuucugugu

SEQ ID NO: 4135059 - RNA, 59 nt, Human
auaucacagguguuuaccugaucuugccuacaucauuucauuguaauuaucugugguau

SEQ ID NO: 4135060 - RNA, 73 nt, Human
auauccagagaagauaugcauauauuuauacauuuauguacauaacaucacuguguauguauaugcagggugu

SEQ ID NO: 4135061 - RNA, 58 nt, Human
auauccagcagcaggugaguauacaaaaagcugaguaugaacugcauugcuggugugu

SEQ ID NO: 4135062 - RNA, 129 nt, Human
auaucguuuguugcauaucuucuuaaauccaucuuccuuguaagggcuuuagaacuaaaacuuacuuauauuguuuuuccuuaacagagggagaaaaauaguggauuauuauuucuaaaauaaaaggau

SEQ ID NO: 4135063 - RNA, 56 nt, Human
auaucuaauagauacaguaaugugugcauaagcacucacacuguagauauagcuau

SEQ ID NO: 4135064 - RNA, 70 nt, Human
auaucuugauuuuguuaaaauuagagugguaauauuucccucucuaaaaugaguagaaaaucaaagauau

SEQ ID NO: 4135065 - RNA, 55 nt, Human
auaucuuuguuuuugccaagaugccaaauuccaagcucuauaagagcaaagaugu

SEQ ID NO: 4135066 - RNA, 56 nt, Human
auaugaacaugacgaugaugguagcuuucauugcuaccaucuuccaugcauuauau

SEQ ID NO: 4135067 - RNA, 70 nt, Human
auaugagaguaaaugccgaucuaggccuauaacuagucuuccaguuucuuggccaguauuucuuuuauau

SEQ ID NO: 4135068 - RNA, 96 nt, Human
auaugagauaccccagaugugacuguaauuaccuuagcaaugcuuuuccacaguauuuuauaguuuuuaaaguaguuccacacuuggucuacauau

SEQ ID NO: 4135069 - RNA, 69 nt, Human
auggucuaauagcauuuuagagcauaauaagaaugauagaguuacugucucugguuugcauuggauuau

SEQ ID NO: 4135070 - RNA, 65 nt, Human
auggucugcagaucccuuuagugaggaaggcauuauccccucacagcaaggauuucagugaccgu

SEQ ID NO: 4135071 - RNA, 63 nt, Human
auggugauauuccuuuggcaugcgagacuauuaauaugacucgugcuggaaaaagucacucau

SEQ ID NO: 4135072 - RNA, 65 nt, Human
auggugccuguuggcauugaguggauggaggcagaaguggccaucuguguguggguagggaugau

SEQ ID NO: 4135073 - RNA, 58 nt, Human
auggugcugccuuugcacacagcuuggccugcuaagccuguggccuggcuagcaccgu

SEQ ID NO: 4135074 - RNA, 80 nt, Human
augguguauaucaagugacuaucacagaacuaggaauauaucagcuguuuugcucaaugguggucauuauuauuaaccau

SEQ ID NO: 4135075 - RNA, 111 nt, Human
augguucaauucauaguuaauauuuugaaacagcuaaguacauucaagggcuuauuccaguuuuagauucgagauuugguuguaagcaaguuguuaaugaaauuggagcau

SEQ ID NO: 4135076 - RNA, 62 nt, Human
augguucauauuaugcaucugaauuuuuugaaacacuucagaugauuccaaugugcagccau

SEQ ID NO: 4135077 - RNA, 70 nt, Human
augguucuguagauauuaauuauuccuuugaggcucccucagaguguaccaaauauccuacaggaaucau

SEQ ID NO: 4135078 - RNA, 76 nt, Human
augguugcgucccaguaucauguaaaugaccccauccuuaaggcuuuauauuaaaaugauacugaagcacaacuau

SEQ ID NO: 4135079 - RNA, 79 nt, Human
augguuuauacaugcaaauguggccuaguauagaaaugaauggaaauucgugguuugcagcaaggccacauucuaccau

SEQ ID NO: 4135080 - RNA, 77 nt, Human
auguaaagggaguuacaauguucuucaguucuguguagguauagaaggacccucgacuugugcugaacccuuuauau

SEQ ID NO: 4135081 - RNA, 78 nt, Human
auguaacagaaacauaguugagacacugcuucucacaaaucauuaaugaccagugaugucacaaacuaugguguucau

SEQ ID NO: 4135082 - RNA, 60 nt, Human
auguaacauaugugaucgcauuuuuguaaaagaaccauguguguuuauauguguuuauau

SEQ ID NO: 4135083 - RNA, 77 nt, Human
auguaacugcuauugaugucacacuuugugaaguagucuuuguugcuuaaaaagggugacaucuaguggcuaaacau

SEQ ID NO: 4135084 - RNA, 60 nt, Human
auguaaggcugccuaugacacuggcuuucccuugagcuucuucauguggaguccuugcau

SEQ ID NO: 4135085 - RNA, 82 nt, Human
auguaaguaguuuauauucaaugauuaguaucaguuggccaagccagucugugcuugauuauaugagugugugugugugcgu

SEQ ID NO: 4135086 - RNA, 62 nt, Human
auguaauuuacgaccugcuaaaucucugucagcucauaguucacagauggcaguuauuacau

SEQ ID NO: 4135087 - RNA, 85 nt, Human
auguacaaacuucuggauuuuagcauguaacuguguguaacugcauucaugucaauggcuacaaaucacugggaagcuucuacau

SEQ ID NO: 4135088 - RNA, 59 nt, Human
auguacacacaaguuugcacgcauacugggcaugcuugugugugaacauguguuuaugu

SEQ ID NO: 4135089 - RNA, 70 nt, Human
auguacacacacagaguauuuagaaggggugggaagaucuacuguccucgaaguaccugugcaggaacau

SEQ ID NO: 4135090 - RNA, 60 nt, Human
auguacauauauguauguacgcaugugcaaauauguuugugugcauauauaucugugugu

SEQ ID NO: 4135091 - RNA, 72 nt, Human
auguaccacuaagcucagggaaaucagaauuauuuuacauauucauuucccaauacgcuaaguggagaacau

SEQ ID NO: 4135092 - RNA, 55 nt, Human
auguagagcaguguuguccaauagaacucccugaaaugauaacacuguuuuauau

SEQ ID NO: 4135093 - RNA, 76 nt, Human
auguagagcuccuugauccucccuugacaaaggagacccuccugcacuuuagacaggguuaaggaggcaccugcau

SEQ ID NO: 4135094 - RNA, 81 nt, Human
auguagaguggcuuuaaaguguggucguucauuuuguauuaauagacguuuuagagaguuguaccacacucauaacugcau

SEQ ID NO: 4135095 - RNA, 94 nt, Human
auguagcauuuuuagaugagguaugaagugugggauauaaauguaaacugaauguucuuaggccccuucgacuuguagguauaaaggugaccau

SEQ ID NO: 4135096 - RNA, 80 nt, Human
auguaggaaggccuagaggaauggccagggagccuauaacugcuauucuaaccaugccucugaggucaacauuuccucau

SEQ ID NO: 4135097 - RNA, 58 nt, Human
auguaggcagaaguaauguguaccacugccaggcugggacacuacaaucugccugcau

SEQ ID NO: 4135098 - RNA, 93 nt, Human
auguaguucauaucucuugagaaauaagcaugucuagaauaaguaguuuuugcucagaccacauaaauuucuucaaaggugacugaacaacau

SEQ ID NO: 4135099 - RNA, 66 nt, Human
auguaguucugcagauauaaagaauuuaugugugccauuuuauucuucacuguuucagaaugacgu

SEQ ID NO: 4135100 - RNA, 129 nt, Human
auguauaaaaucaccggaaacgcuuguuaaagauuuuuaggcucuacccucagagcuuucucauucugcaggucuugggguagaccugagaauuugcaucuuaaacagguagugcugcugcuaauguau

SEQ ID NO: 4135101 - RNA, 99 nt, Human
auguauacaucaaccauggggauggcucugagaaccugagcuaguaugugugauugcaucugggcuccagucagaccguagauggugggucuugugcau

SEQ ID NO: 4135102 - RNA, 75 nt, Human
auguaucaacaguuuguuccuuuucauugcugaggacuauuccacaguacagauuaauaauauacugaugagcgu

SEQ ID NO: 4135103 - RNA, 62 nt, Human
auguaucaacugcaggcaaguucagguaaaguucuccauuugcuuuuucaguugacuuacau

SEQ ID NO: 4135104 - RNA, 66 nt, Human
auguaucuuugaaauggcagcagcugaccuuuaaaacagaggcaagccgugccugucucaaaacau

SEQ ID NO: 4135105 - RNA, 59 nt, Human
auguaugcuccuauuggaaugauaguauguuacuauugcuguuaggaaggaguacauau

SEQ ID NO: 4135106 - RNA, 87 nt, Human
auguauggaaguuuaguagggacagauggaagauugggcucaguugagcccuucuuuuucuccauucagucucuggaacccugacau

SEQ ID NO: 4135107 - RNA, 79 nt, Human
auguauuagguuugaauaguguuaugauucugucugaagugaaaaaauuagaaucagucauuagcucugaccucagcau

SEQ ID NO: 4135108 - RNA, 76 nt, Human
auguauuaucuaugccauggaaucaccuccagcuaguaagggcaggcuggaaaggauuccgugauacagauaacau

SEQ ID NO: 4135109 - RNA, 62 nt, Human
auguauuaugguuuuccuuaagucugggcuggguuuuuacaaaaaggaagaccaucagauau

SEQ ID NO: 4135110 - RNA, 75 nt, Human
auguauugggaaagccacaaauuggaguguauaaaaacugaaguguuauauuuuauuuuaguggccuuaauuuau

SEQ ID NO: 4135111 - RNA, 57 nt, Human
augucagcccaagcccugugcccaauucaaaaauggucacagggcuuggccugacau

SEQ ID NO: 4135112 - RNA, 76 nt, Human
augucaggauuuaccgucauuuagucuuuugcucugauuuuugcaggagaaaaguguuggaaguuuuuaaugacau

SEQ ID NO: 4135113 - RNA, 128 nt, Human
augucagguaaauccuuuucaccuuccuucaagggaggaauuaagucagggaaacuguuuugcuccuuggaguaguuguucuuuaaaaugaaguuauugauuaggcaaugucuauaaaauuaagaugu

SEQ ID NO: 4135114 - RNA, 57 nt, Human
augucauagaagccugugaacccagcuuuaguuaugcacuggaauuuucugugacau

SEQ ID NO: 4135115 - RNA, 75 nt, Human
augucauuacaguggacagcuaugcacacguuggagauuaugugaugugugcaugugcauccauguguacaacau

SEQ ID NO: 4135116 - RNA, 100 nt, Human
auguccaccuaaaucuguguaugugaccuuaucuggaauuaggguccuugaaaaaugcaaucucauuaagaugaggucugacuggauuaggguaggucau

SEQ ID NO: 4135117 - RNA, 72 nt, Human
augucuaaaagaaggcaucuaugugaccuggauuuauucaguaauccaagggaaacugcacuucuaagauau

SEQ ID NO: 4135118 - RNA, 82 nt, Human
augucuccaaaaauuuuggcuaaaacguggagaguacacaaauucuuacauaguuaaauaguacagcuauuauuggaaucau

SEQ ID NO: 4135119 - RNA, 60 nt, Human
augucuccaugcgguaauuuaucuaaaggcccgcuauaaauugucguaagguggagaugu

SEQ ID NO: 4135120 - RNA, 64 nt, Human
augucuggcauucacagaaaacaugauccuaauggauauaauuauuucuauggggccagcacau

SEQ ID NO: 4135121 - RNA, 61 nt, Human
augucuguuuauccuucaagauacagcucaaguauuaucucuguaaggaagaauuagaugu

SEQ ID NO: 4135122 - RNA, 71 nt, Human
augucuuaguauguugucacacuggguagaacuggaaugcaacacccauagucauuacagugcuaagaugu

SEQ ID NO: 4135123 - RNA, 61 nt, Human
augucuuucgcaucaguagcuagggcacaaauauuucugccuucugauuucgagaagauau

SEQ ID NO: 4135124 - RNA, 105 nt, Human
augucuuuuaguccuaucugaaaaaugucauuauggaacugaggucacaccccacccugcaguuucaucaugcauuuccuuuuaucuuagauaauucuaugacau

SEQ ID NO: 4135125 - RNA, 64 nt, Human
augugaaaaauuucuuauuacaauguguaaaaauauugugaggacauaggacauuuuuugacau

SEQ ID NO: 4135126 - RNA, 102 nt, Human
augugaaauaauuucuggggcuguccuuagucugagagcggcuucagcauuacugucucucuuaggcugcagacaguucugaaaacugaacuaacuucacau

SEQ ID NO: 4135127 - RNA, 123 nt, Human
augugaauguuaaaauugaacaagagaaagcaggaaaauaagugguauuugggaaauuaaaggaagauugaaccagagucuuuauauuccugaauuuaauuggauuaaugggaaauuuaucau

SEQ ID NO: 4135128 - RNA, 68 nt, Human
augugaccaucugugaauaauuggcuccugcuuacguguagcucucauuacuuuacagauguaugcau

SEQ ID NO: 4135129 - RNA, 91 nt, Human
augugaggacaugagauuugggaggguccaggggcgaaaugauaugguuuggcucugugucuucacccaaaucucaucuugcagcucacau

SEQ ID NO: 4135130 - RNA, 100 nt, Human
augugauauacuuagagagagagcuaaauuaagggugagaagaguuggaacuuaugucuaauuucaaguuuagggcucuauaauauuggguaaauuacau

SEQ ID NO: 4135131 - RNA, 88 nt, Human
augugcaaggucauucuuggguauaagcaagguuuguaaugagguaucucacaucagauuaugcuuugcuuaugaccguaagccacau

SEQ ID NO: 4135132 - RNA, 71 nt, Human
augugcagauauauuuuacauuuuuagcacauuaccuaauaugcaguagugcuggaaauauauuuguuuau

SEQ ID NO: 4135133 - RNA, 58 nt, Human
augugcagccuuucuucaucaugucugucaccuuauagucacaagauggcugcagcau

SEQ ID NO: 4135134 - RNA, 68 nt, Human
augugcaugcacuuacauguguggauauuugcauguguagugacuuguacauaugagugugugugcau

SEQ ID NO: 4135135 - RNA, 56 nt, Human
augugcaugugugugcuugcauauaugugcauguaugugugcauaugcauguacau

SEQ ID NO: 4135136 - RNA, 61 nt, Human
augugcauuuaggucacaugaugucauuccuaugaaugaugcagguaaucuaagggcagau

SEQ ID NO: 4135137 - RNA, 81 nt, Human
augugcccaaggucacacuagggccaaguggagaguggaauucuuccugacucaccuggcucugugucuccaggggcaggu

SEQ ID NO: 4135138 - RNA, 55 nt, Human
aguagagguaggucuucgagucucagggacaucccuggccugcccaaugucugcu

SEQ ID NO: 4135139 - RNA, 78 nt, Human
aguagaugagauucggaagucaucuguuucguacacacacuaguauuagcaacguaaccucugaacuugccauuuacu

SEQ ID NO: 4135140 - RNA, 85 nt, Human
aguagauuaaauaaaauauuauuagagguuguuuuguaaagagcuauucgcuuuuucuuggugcaaccucuggaugaaaucuauu

SEQ ID NO: 4135141 - RNA, 86 nt, Human
aguagcaaaaacuuuagagauguuggacccauagaguuaguggacaaacaagcacugugguggaagcaucaagaaguuuggccacu

SEQ ID NO: 4135142 - RNA, 87 nt, Human
aguagcagucacggagcagcccuagggcauaagcacuggagugggaguccuguuuugcuucguggccuugggcaacucucuucuacu

SEQ ID NO: 4135143 - RNA, 68 nt, Human
aguagcauugauaaauucuaguuuuaggcuuacuuuccauaggccagcaaagcaaguugucagcuacu

SEQ ID NO: 4135144 - RNA, 55 nt, Human
aguagcccgggcggcugcuguaguaacuggguguuaagaaagcugccugggugcu

SEQ ID NO: 4135145 - RNA, 66 nt, Human
aguagcuaaagcagcuguuugacuuuccauuugaugcaaguggagguguauaagguagcuucuacu

SEQ ID NO: 4135146 - RNA, 102 nt, Human
aguagcugggacuauaggugugcgccaccaugccgggauaauuuuuguauuuuuaauagagaugggguuucaucauguuggccaaacuggucucaagcugcu

SEQ ID NO: 4135147 - RNA, 85 nt, Human
aguaggagaauauugcaaaugaccauugccacaucugacccuauuugugucuauguggcauucuuggucauuucugucucuuauu

SEQ ID NO: 4135148 - RNA, 107 nt, Human
aguaggaggcagaaggaaucaaugguucugguauuuuccacuccuaauuuuauugagaaguggcaaagucuucagaaguuuauuggcuacucugcacauuuccugcu

SEQ ID NO: 4135149 - RNA, 63 nt, Human
aguaggcagaguguuauaaaucuuucauuauccaguaaugggaagguuagcaguuugucaacu

SEQ ID NO: 4135150 - RNA, 78 nt, Human
aguaggcuuugcacagauuagguuauuggaaaguauaguuauuugcuuguaaaguggcaguucugugucaaaauugcu

SEQ ID NO: 4135151 - RNA, 78 nt, Human
aguagggcccaccacuguagagauuugaaugccauacaaggaugguguauuuuauccuaucagagagacaguccuauu

SEQ ID NO: 4135152 - RNA, 89 nt, Human
aguaggguaaguacuagaacuucuaacuaaggucagagaaguaaaguaacucuccuaaggccacauagcaaguuuuaggcuuccuagcu

SEQ ID NO: 4135153 - RNA, 63 nt, Human
aguagguucucaaauaauugcuggauuaauuauuaaauaacaaguauuuauugagcaucuacu

SEQ ID NO: 4135154 - RNA, 85 nt, Human
aguaguacauggcagauguggcauagagcauacauagauaauuaaagcaaauguauacuucaugcuucaugucuguauuuuugcu

SEQ ID NO: 4135155 - RNA, 88 nt, Human
aguaguaccuuuggcuuauuauggcaaauaaguaaauaauuaauuuuguaaauguguuagucaugguuuuaagaaaaaugguaauacu

SEQ ID NO: 4135156 - RNA, 88 nt, Human
aguaguaucugugaaaacauuuuguccacagugggcugacaugaaauaauaucaaaucucauugccuaaaacuuuuguagauguuacu

SEQ ID NO: 4135157 - RNA, 79 nt, Human
aguagucagauaaucuuaagcugaauucucuccccugaguuaaaguuaguggaaguaaugucuuaagauucugaaaacu

SEQ ID NO: 4135158 - RNA, 91 nt, Human
aguagugccucuguuuuaccugcuuaguuaucagguguuuucauggaacauuguuccaggaacugaagccagguguuuucagaggcaugcu

SEQ ID NO: 4135159 - RNA, 119 nt, Human
aguaguuuucauuguucacuguuauucuccaucccuguauaucacaagggcuaucuuguaguacuuuuugauaauauuggguaggugauaacucaaagaugcacaagguucuaacuacu

SEQ ID NO: 4135160 - RNA, 80 nt, Human
aguauagaauaauggcuaagagcacaggugcuggagcccagaugccuggguucagaucccagcucuguccauuucuagcu

SEQ ID NO: 4135161 - RNA, 77 nt, Human
aguaucauuaucuaguaaaauuagggaagaaguuaaagaaagaauucucuaaacauauuggaucugagaugguaacu

SEQ ID NO: 4135162 - RNA, 68 nt, Human
aguauccacccaucucgcccaacguuuccaccacuggguguucaaauuuucuaggugggugguuugcu

SEQ ID NO: 4135163 - RNA, 89 nt, Human
aguauccuccucuguggaauucuguagcucuuccucugguaacugcuuucacuaaagguuugcauggaauuuaccuagacaagggcccu

SEQ ID NO: 4135164 - RNA, 79 nt, Human
aguauccugauuccuuagaguccucuggcccagccugcagucugcagggccucuggccuggagccucuggguggaugcu

SEQ ID NO: 4135165 - RNA, 85 nt, Human
aguaucucacaggaucaagacuuuuaugcugcccugcucuuauguuugaagcaucagagucauugcaaguagaagguuggguauu

SEQ ID NO: 4135166 - RNA, 84 nt, Human
aguauggaugcuuuaauuaauccggggugaauuuaauugcuuuaguuaaguggaaaucggguuaaaaaugaugcagagcaugcu

SEQ ID NO: 4135167 - RNA, 55 nt, Human
aguauggcugguuucauggguguauggcuugugugggcucagagggcccugugcu

SEQ ID NO: 4135168 - RNA, 76 nt, Human
aguauggugacuuugcacuaaguuacucauuuauucacauaauuaaugaguuucuauuaguguuaggcaccguucu

SEQ ID NO: 4135169 - RNA, 80 nt, Human
aguaugugaggugauggauauguuaaauagcuugacugaaccauuucacaaugcguacauauaucaaaacgucauguauu

SEQ ID NO: 4135170 - RNA, 65 nt, Human
aguauguguguagaccuuugcccauacauucucguuugucugagguuaauccugcugcaucugcu

SEQ ID NO: 4135171 - RNA, 58 nt, Human
aguauguuacucauggauuguuugggaaaacuaaauacacguacauguguaaaauacu

SEQ ID NO: 4135172 - RNA, 79 nt, Human
aguauguugaacaaaguacuuuucagugcuuaaaagcuaauugaguagguauggaucaguaguuuguaauuaacauauu

SEQ ID NO: 4135173 - RNA, 82 nt, Human
aguauuaacaugaacugacuuuucauuuccugcaaaucuuaaaaucacccaagggaagagacaguaaacaugugucuaugcu

SEQ ID NO: 4135174 - RNA, 77 nt, Human
aguauucuuugaagugcccuguucacuucaugguucuguagagaauuagaaaacuuccaggaguuuccaagaaugcu

SEQ ID NO: 4135175 - RNA, 57 nt, Human
aguauugcauuucccacguucacuccugaagguagugagacagguaaggugaauacu

SEQ ID NO: 4135176 - RNA, 75 nt, Human
aguauugugcaugugugaaucuugugaucaugaucuuaauuaggaucauauuuagauucagacucaaauugaacu

SEQ ID NO: 4135177 - RNA, 64 nt, Human
aguauuuggaguaaguaugccuuggugggguccucauuuggauguaauuacucugaucugugcu

SEQ ID NO: 4135178 - RNA, 63 nt, Human
aguauuuucgccaucacaagaaagccaacuagaagugcgugauuugugaaugugugaagugcu

SEQ ID NO: 4135179 - RNA, 79 nt, Human
agucaaauaaaagugcauuucuaaauggaacugauuagacuagguucuuuguagcaaaacguguauucaguguuuggcu

SEQ ID NO: 4135180 - RNA, 74 nt, Human
agucaacuaaaacaugacagugacuuuauaagagcuuuccuuuuaaaagguugcuguuauaaaaaaguaugacu

SEQ ID NO: 4135181 - RNA, 56 nt, Human
agucaauuuaguuuccacagggggacucuaaccugccuaggaggcuuaauuaggcu

SEQ ID NO: 4135182 - RNA, 79 nt, Human
agucacacaguguaagcaugcaauguaucagugauagcaacaaauuuguucuaauacacccuauugcuuguuugugacu

SEQ ID NO: 4135183 - RNA, 71 nt, Human
agucacacucuguguuaaauuggguuuuugugggcacaccacaaacucuaaucaaauauagcauuguuucu

SEQ ID NO: 4135184 - RNA, 64 nt, Human
agucacauuucagugagcuauugaagauuaagaagaguuauguagcuuaucugaaauggcaacu

SEQ ID NO: 4135185 - RNA, 62 nt, Human
agucacuguuuaaucuagcuaaacacagugacuaaaguuuagcuggauuaaucacagugacu

SEQ ID NO: 4135186 - RNA, 86 nt, Human
agucagagaggagcugagagaugacugauguugaggucaagucauccuucuguucucacagccauuucucccucucuuuccugacu

SEQ ID NO: 4135187 - RNA, 65 nt, Human
agucagagcaaacuggacagacuggauccacccuccuuucuguucuaguugugcuuuuguagauu

SEQ ID NO: 4135188 - RNA, 96 nt, Human
agucagaggaucacuugagcucgggaggucgaggcugcagugaaccaugguggcaccacugcacuccagcccgagcaacagagugagacccugucu

SEQ ID NO: 4135189 - RNA, 83 nt, Human
agucagaggcuuugugagccacaggguuucuuguguugugcccaacacaggacggcccuguggcuuccacagguagcagggcu

SEQ ID NO: 4135190 - RNA, 81 nt, Human
agucagccgggaggugaacaggcuucuucugggcuccuuaguagaggggcacuucucaggcuguggacacuucugcugacu

SEQ ID NO: 4135191 - RNA, 66 nt, Human
agucagcuccagggucagcucagaacugcccuggcugggcaguguugugugggcccggagcaggcu

SEQ ID NO: 4135192 - RNA, 62 nt, Human
agucagcugcugcacacagcagagauguguugcuucaucuaagagcugguuaacaguuggcu

SEQ ID NO: 4135193 - RNA, 68 nt, Human
agucaggaaccucagcaagucuacucacacuaagcucucuaggauugucaacuuguuggggccugucu

SEQ ID NO: 4135194 - RNA, 63 nt, Human
agucagggacaaggaauaagauuaguuuaaaacuaaauugacuuuaaagcuuugucucuuauu

SEQ ID NO: 4135195 - RNA, 77 nt, Human
agucagggagaggcaucauagggaaagcuaauauuuccaagagucucuauuaaccuuugguguuuuuuccuguaacu

SEQ ID NO: 4135196 - RNA, 77 nt, Human
agucagggcaaagagagcacaugcuuugaaggagaauauucaucaaauccuaauagcuguuaucuucuguccuuucu

SEQ ID NO: 4135197 - RNA, 71 nt, Human
agucagggcccuggcaggaaacagcugacgcacugaagcuguuuuuuugagaagggcuuaacaaagagacu

SEQ ID NO: 4135198 - RNA, 59 nt, Human
agucaguguagaaagcccaggcauugucccauagcuggcccuguguguuugcacugauu

SEQ ID NO: 4135199 - RNA, 117 nt, Human
agucaguuccauguagauugagagacucuugggauaugguuauuggccagaugccauauauguuguauaugaaacugggauaacuauagcagagguuguuuugaaaaugaauuggcu

SEQ ID NO: 4135200 - RNA, 71 nt, Human
agucaguugggugcugcggucgguggccgagcacccgcucagcagggcagaggcugcaggacucauuggcu

SEQ ID NO: 4135201 - RNA, 69 nt, Human
agucaguuuaagcugagccaguggcaagugcuaggaaacugcauuaucccaggcuggcuagcucugucu

SEQ ID NO: 4135202 - RNA, 55 nt, Human
agucauaucugaggaggaauccuugggucaucaacuucuuccuaacaaugugacu

SEQ ID NO: 4135203 - RNA, 92 nt, Human
agucaugagcaaucuagacaaaaauaacuugguuucaucagaggcuauuuccacugcuccuuuucaaguuguauugucauauuguuuugauu

SEQ ID NO: 4135204 - RNA, 70 nt, Human
agucauggagauuuuauguaaaauauuuaaaauaauuuuuugagguacaaacaugagguuuccaaugucu

SEQ ID NO: 4135205 - RNA, 70 nt, Human
agucauuaaauauucuuccaaaacaucauuugggaaggcugcagaguguuuuagaauaugguuugugacu

SEQ ID NO: 4135206 - RNA, 70 nt, Human
agucauucagagaugcagguagacauaaaccaaauaguccuuggcugacucuuccucaucugugaauacu

SEQ ID NO: 4135207 - RNA, 125 nt, Human
auaugcaaauaugcccuagugagguuuuucugaaaugcaucauuuuaaaauuauguagcauggcauuaguguucaaaauacugaauuguaagaugaugccugaauagcuuacuaacauaucauau

SEQ ID NO: 4135208 - RNA, 62 nt, Human
auaugcucacuuacagaacugccaugcugccccacaagcugagagccugccagugaguguau

SEQ ID NO: 4135209 - RNA, 93 nt, Human
auaugcuuuccauuuuuguaugaucaaaagaaauguacuuauauuuuaaaaguaacauuuuauuuuaauuaugugguauguggggggguguau

SEQ ID NO: 4135210 - RNA, 100 nt, Human
auauguacacauacauauguauguauauauguguguacaugugaauaggucuauauauacacauacauacguauguauacauguguguauguguaugugu

SEQ ID NO: 4135211 - RNA, 56 nt, Human
auauguaugugcaugcgugcauguauacauauuugugaauguauguacauauuuau

SEQ ID NO: 4135212 - RNA, 84 nt, Human
auaugugugauuuccugugcgcccuuaggcagggcagggaaggggagcauggcccaggcguaugggagaucauggacugcauau

SEQ ID NO: 4135213 - RNA, 90 nt, Human
auauguguuuugguauuuggcaauguguaccugugugugugucugugugagugcagaagccaugguaugcaacuacauccaugcauauau

SEQ ID NO: 4135214 - RNA, 83 nt, Human
auauuaagcuggugcaauaguaauugcaguuugccauuacuuuaauggcaaagaccgcaauuacuuuugcaccaaccuaauau

SEQ ID NO: 4135215 - RNA, 97 nt, Human
auauuaauaagugcaugcuuaaacaacuguuuuuuaagucugucccuagcauauagggcagcauuugaaaaacagauguuaagaaggcaauuaauau

SEQ ID NO: 4135216 - RNA, 85 nt, Human
auauuaauggucaaaauuuaauuauguuuuauugauuugauugaucuuaauuuauaucagacagaaagcauugacccgugaauau

SEQ ID NO: 4135217 - RNA, 128 nt, Human
auauuagaaucauucgggaaucaaauuuuaagugccagugcucccucaggccacaccauaaacuacaaugccugagcugggagccuggcaccaguauguuuuaaaguucucccaagugaugccaaugu

SEQ ID NO: 4135218 - RNA, 61 nt, Human
auauuaugauccaguaaugguaugacauucuuuuuuaugacuauagcucggguuauaaugu

SEQ ID NO: 4135219 - RNA, 88 nt, Human
auauugaugaucacuguguguauaugcacacacacgucauacuuucaguaugauauauauaauguauguauacacugaucaucaguau

SEQ ID NO: 4135220 - RNA, 80 nt, Human
auauuguaagcuauuuuugugccuuucuagccuuuaaauaccuacuuuacuggaagguaauccauaauaguuacuagugu

SEQ ID NO: 4135221 - RNA, 85 nt, Human
auauuguggguguguacauaauggacaauaaugcaucuguuacaguggauuaacuauguuacauugacauuauaccccaggauau

SEQ ID NO: 4135222 - RNA, 58 nt, Human
auauuuccuauacaguuguccauagcuagaauaaaagcuguaugcuauuaggaaguau

SEQ ID NO: 4135223 - RNA, 55 nt, Human
auauuuggccuguuuggaugcaaauuuuucuuuccuauuugaaauggccaagugu

SEQ ID NO: 4135224 - RNA, 78 nt, Human
auauuuguauguucacugacaugucugagagugagcaccacugugugugucugggcaugucugugaacacgucagugu

SEQ ID NO: 4135225 - RNA, 57 nt, Human
auauuuguuagcugcuuuggaggcauaaugauaguauguuucugcggugacagauau

SEQ ID NO: 4135226 - RNA, 92 nt, Human
auauuuuaaagauuuaugguaugaauaauuuaagagaaauaaagaaagcuucuaaacucucuuugaauuauguaaugggagcuuugaaauau

SEQ ID NO: 4135227 - RNA, 72 nt, Human
auauuuuaacauguguauaauuuuuguuuguuggcuaagacaaggccaaguaucaauacauuguuaaaguau

SEQ ID NO: 4135228 - RNA, 106 nt, Human
auauuuuauugugugauaaaaauagaaauugugcuauuguugaccacuuuguucccagagaugacagguagacagaggaagcauauagcacaaacgguaagagcau

SEQ ID NO: 4135229 - RNA, 57 nt, Human
auauuuugcaauuaauucauccugacaaguucaucaggaaggcaaauugcaugauau

SEQ ID NO: 4135230 - RNA, 76 nt, Human
auauuuuugcuuucauugccugcgguuuuggggucauaucaaaagaaaucauagcccagaccaaugucaagaauau

SEQ ID NO: 4135231 - RNA, 63 nt, Human
auauuuuuguguguuuagguuuguguauauauuuuacauguguguauaaauacacaaggguau

SEQ ID NO: 4135232 - RNA, 95 nt, Human
aucaaagagaaguagugagaaagagcaaggauaaguugauuaagauggcuuaugagaacugcaacuuguuugauucuuggacauuuauuuuugau

SEQ ID NO: 4135233 - RNA, 79 nt, Human
aucaaagguggggagcagccuuagccccuagcagaaugcuggacaggggcuuccccugcuuacucccacuguuuuuggu

SEQ ID NO: 4135234 - RNA, 63 nt, Human
aucaaaguaguagguuuuggacucauaaagaccuggguuccuucccaaaucuacuccuuugau

SEQ ID NO: 4135235 - RNA, 60 nt, Human
aucaaauauuuuccuuuucaucagcacucccaggguugcugaggaaagaggauaaaagau

SEQ ID NO: 4135236 - RNA, 61 nt, Human
aucaacagaaguaucuuuuuagcuccaucuaaaauagagagccaggaugucuucuggggau

SEQ ID NO: 4135237 - RNA, 126 nt, Human
aucaacauccaucaaagcagaaauaaguggaaggaggccuagaaaagugguucuggaaggcuggugaccaucccaggaugacucagagcuauccuuuuaacuucuuagccuuugauuccauguggu

SEQ ID NO: 4135238 - RNA, 58 nt, Human
aucaagcagcauuguggcuuuuuucuacaaucagaaacauagcagcuuugugcuugau

SEQ ID NO: 4135239 - RNA, 70 nt, Human
aucaaguacaggucuuaucuccuaggaauccucucaucucauuccuguaaguaugugaucugugguuggu

SEQ ID NO: 4135240 - RNA, 130 nt, Human
aucaauagcaggucccuacuguauugacugaucuuuaaauuuggccgccuuauuauucuaggagcucuauucuaaacucaaggaguucagaaaggcugugccagccaguaaguaaaguuggaccuuuggu

SEQ ID NO: 4135241 - RNA, 130 nt, Human
aucaaucagaacaaguacuuuaugaguuugaacauauggggagaauuuagcaaaugaacuuuuuaucuuaaaaguuaauagauucuccacauguagcaaugcauuagugaagcuauuaucucggaaagau

SEQ ID NO: 4135242 - RNA, 64 nt, Human
aucaaugcucuguacccagaauaaucccauuucggagggugcauggauggggcagaugcaugau

SEQ ID NO: 4135243 - RNA, 72 nt, Human
aucacacaugcccuccuucugcagauaucaagugugucuuggcaguccugcacauggagggcaaugccugau

SEQ ID NO: 4135244 - RNA, 73 nt, Human
aucacagauaaaugucacauaggcaaaauguuuuagagauacuguaaucacuggcuuaugggagauuugugau

SEQ ID NO: 4135245 - RNA, 61 nt, Human
aucacagauuugauacuuuugugccaauuagcuucaugcacacaaaauucugaucuguggu

SEQ ID NO: 4135246 - RNA, 63 nt, Human
aucacagggugaggauuagaccccuaguuucuugacacuuaauuuuauccucugcuuggugau

SEQ ID NO: 4135247 - RNA, 106 nt, Human
aucacauggccaagauguagcuaacaagaucaugguuuaucugggagacgaguugugucuucacagaauaaacucauuaucucaucauagaugguguuggccugau

SEQ ID NO: 4135248 - RNA, 70 nt, Human
aucacccaagcuggagugcaguggcaccaucauagcucacugcagccucaaacuccccagcucgggugau

SEQ ID NO: 4135249 - RNA, 70 nt, Human
aucacccaagcuggagugcaguggugcaaucucagcuaacugcaaccucugccuccuggguugaagugau

SEQ ID NO: 4135250 - RNA, 64 nt, Human
aucaccggaaacuucacaucucccuaaaacagcuuaggcugucuugagaaaugugaaaggugau

SEQ ID NO: 4135251 - RNA, 76 nt, Human
aucaccuagaggaaaugcuaaaacacagauuuuuggauucuacuccaagaguuccugauucaguagauccagggau

SEQ ID NO: 4135252 - RNA, 114 nt, Human
aucaccuggaggccuuguugaaacacagauugcugggcuucacccccacaguuucugauucaguacuuggaguggggccucagaauuucuauuucugaaaaguucccaggugau

SEQ ID NO: 4135253 - RNA, 64 nt, Human
aucaccuggccauuggguuaacagaccaauuuggagucuauuguaauaauccagggcaggugau

SEQ ID NO: 4135254 - RNA, 64 nt, Human
aucacucugcauuuuugacccuuaaaaacaacacugacuuggggucacaggggagaagagugau

SEQ ID NO: 4135255 - RNA, 78 nt, Human
aucacucugucucucaggcuggagugcaguggcuggaucuuggcucacugcaaccucugccucuuggguucaagugau

SEQ ID NO: 4135256 - RNA, 73 nt, Human
aucacuggcuaaugacugaguuuuuagcagaggcauccugucuuuguucaagcacaggucuuagucuugugau

SEQ ID NO: 4135257 - RNA, 83 nt, Human
aucacuggggaagcaggacuuacaguaucccagauuguuuucccuaguacauuaugauacacugaguccuuuucucauuugau

SEQ ID NO: 4135258 - RNA, 62 nt, Human
aucacuuacacugguucugcaucuuugaucaaacccugaaugauacagaauuauguagugau

SEQ ID NO: 4135259 - RNA, 71 nt, Human
aucacuucucugcuaccugcaaagauacuaauuagcaaguagugauucuaaguaaguguaguggagguggu

SEQ ID NO: 4135260 - RNA, 125 nt, Human
aucagaaucaccuggagggcuuguugaaguacagcuugcugggccucaagcucagauuucugauucaguagauuugguacaggcuaggaauuugcuuuucuaagaaguuuccaagugaggcugau

SEQ ID NO: 4135261 - RNA, 127 nt, Human
aucagaaucacuuggaggacuuguuaaaacacagauugcugggcgucacucccagaguuucugauucaguaggucugggaaggagccugagaauuugguuucuaacaaguucccaggugguguugau

SEQ ID NO: 4135262 - RNA, 116 nt, Human
aucagaaucugggccagagugagaccuuucuagccugccccagugucacccugauccaagggccuucaggugcugccaggcuaggcucuaggugucugauucucaugggaucuggu

SEQ ID NO: 4135263 - RNA, 66 nt, Human
aucagaauuugcucuguaauaaucuggggugauuuaaauacacucuauuguuucagaggcacuggu

SEQ ID NO: 4135264 - RNA, 67 nt, Human
aucagaguuuuuaguucugccucucacagucuacggaaucacaggcagguuacaaaaacuuuaugau

SEQ ID NO: 4135265 - RNA, 59 nt, Human
aucagcagaggucuagcaccaagaaucucuaaaauaggagaccugguuccucuuuugau

SEQ ID NO: 4135266 - RNA, 75 nt, Human
aucagcucacauuaaugggaugagguggaaaguuggacacacuaccucacagucugccuuucccuugugcuaggu

SEQ ID NO: 4135267 - RNA, 57 nt, Human
aucaggaugaagcuguagcgaagauuuuaacaagucacauuacugucauauccugau

SEQ ID NO: 4135268 - RNA, 62 nt, Human
aucaggcaguauauacucuuugaggggaguugacuucuuucaguuaguauaauuguuuugau

SEQ ID NO: 4135269 - RNA, 95 nt, Human
aucagguguugugcuuccuucuuugugguagaaaguacaagaggcaauaacuuauuuuuaacuuuagggaagggaugccccaacauguccuugau

SEQ ID NO: 4135270 - RNA, 74 nt, Human
aucaguauuaaaggaggacuuugucugggaugaacugcuaaauuccagcaauccaagcuuucuuuaaaguugau

SEQ ID NO: 4135271 - RNA, 85 nt, Human
aucagugagucccauuauaugacacugcuuccugagaaaucaacauuucuagauguuuucaauaaagcaguaugggaguucuggu

SEQ ID NO: 4135272 - RNA, 59 nt, Human
aucagugaugagguggcuuucaaaugugucuucuacauugauaccuaaacaucccugau

SEQ ID NO: 4135273 - RNA, 81 nt, Human
auaaaaauaaagcuaaggguguuuaagcaggcaaaauguuuggaauuuuguuucuuaaaugucuuuaagguuuguuuuugu

SEQ ID NO: 4135274 - RNA, 88 nt, Human
auaaaacacguggacagguaacugggaauacaucuguaucauauaggugacagguguccaacauuuaccuuuaaaacauguguuuugu

SEQ ID NO: 4135275 - RNA, 66 nt, Human
auaaaacuuggccuuuauaacacucugacacucucagagcaugcaggacauaaaggcaaguauuau

SEQ ID NO: 4135276 - RNA, 87 nt, Human
auaaaagcuagggaugaugauagguuauuuuguguugugugguauguuuauaugaugccaaauaaccuguuuaacuuacguuuuugu

SEQ ID NO: 4135277 - RNA, 58 nt, Human
auaaaaucagaguuggauuggaugaccucuaaggucuguucugauucuaugauuuuau

SEQ ID NO: 4135278 - RNA, 79 nt, Human
auaaaauugcuccagugcauucucuaauuacagguaacccauuauucaguacccaggaaugucgcgagaguagauuugu

SEQ ID NO: 4135279 - RNA, 66 nt, Human
auaaacaucaagaauugggagcuauugaacagaugguuuauuaguguccuaauucuugaucuuuau

SEQ ID NO: 4135280 - RNA, 95 nt, Human
auaaaccagggaacauaaguauuucccugaguucugugagcugcuguagcaaguucaugaaacccaaggaagggauugugggaacccugauuuau

SEQ ID NO: 4135281 - RNA, 55 nt, Human
auaaagauugaaagccuagguuaccaaguugguuuuagcuuucuagaaucuuugu

SEQ ID NO: 4135282 - RNA, 71 nt, Human
auaaaguaaugcauauaaugugcuuagaacaggaugguauguagguuacagugcauuguacaaugcuuuau

SEQ ID NO: 4135283 - RNA, 96 nt, Human
auaaauacugauuuuucuacugcauuuugugcucccuagggaaagacaucugaacaucuuucuaucucuagcgcacagaagaaauuacguauuugu

SEQ ID NO: 4135284 - RNA, 67 nt, Human
auaaauaucacuguugucccucagcguguacaaccuugggcuggaagggacacaugugauuauuuau

SEQ ID NO: 4135285 - RNA, 75 nt, Human
auaaauauugcuugauuugauuuggcacagccaucauucuuaugcucugcugguuccgaauuaggccauagauau

SEQ ID NO: 4135286 - RNA, 66 nt, Human
auaaauggcuucucaguuucauaaugaaaggaauauuucauuuugcagagcugaggaacuguuuau

SEQ ID NO: 4135287 - RNA, 68 nt, Human
auaacaauagugguagugcuggucauagugaugaagaagaaacaagagcagcagcuaccacuuguuau

SEQ ID NO: 4135288 - RNA, 127 nt, Human
auaacaguuuguuauaagauauuuuaagucuuuugaaaugguuucaaacacacuaaguaaagaguaacuuucauucugcuguuguuuuugugcugucgaggacuugggaugcaugacaaagauuugu

SEQ ID NO: 4135289 - RNA, 115 nt, Human
auaaccugcugaccaguacugaagacagcuuauucugguguuuguccccaaaucuucauuuugccccauuagaauuagguuguuuaccacguauacccucugugguuuugguugu

SEQ ID NO: 4135290 - RNA, 64 nt, Human
auaaccuuaucuugauuccucuuuuguuacuucugaugugaaaacugaggcagguaagaguuau

SEQ ID NO: 4135291 - RNA, 65 nt, Human
auaacugguuaaacuaucuguguuugaaguuuucuuucuggaaaauauauagaaguacccguugu

SEQ ID NO: 4135292 - RNA, 75 nt, Human
auaacuucagggcugugacagaagggcuggugccuagaaaggucccuucaggaucuguuaugggauggaaguugu

SEQ ID NO: 4135293 - RNA, 57 nt, Human
auaagaacaagauguuccuguuuugugguaaggaaaacaggauguucuuguuuuugu

SEQ ID NO: 4135294 - RNA, 65 nt, Human
auaagaagggagagaaaguugguuacugcuacagucugaauguuugugucucccaaaauucuuau

SEQ ID NO: 4135295 - RNA, 129 nt, Human
auaagaccaauauaaacagaaauauaaaacugcacuaaugagcagaauuucuguaugaauagagaaacauaccauguuuccguguagaaauuccugauauuguauuuugucauuucuuccuuaauuuau

SEQ ID NO: 4135296 - RNA, 56 nt, Human
auaagagcaggcuucuggccagagugagugcagcucugccuugaagcaacucuugu

SEQ ID NO: 4135297 - RNA, 59 nt, Human
auaagcaggagaugcaggaauguauuaauagauauauuccaguucaucucuugauuuau

SEQ ID NO: 4135298 - RNA, 78 nt, Human
auaaggauauuuuguugagugcuuaaaaacugaccaugugucaaguuuugucuaagaacuuugcaaauauuaacuuau

SEQ ID NO: 4135299 - RNA, 60 nt, Human
auaaggcuguguuugccuggaugagagauugcagauuccgucagcagauccagcacuugu

SEQ ID NO: 4135300 - RNA, 66 nt, Human
auaagggauggguguugggcuuuaucugaauuauuaucuuaaaugcccacaccauuuauucuuugu

SEQ ID NO: 4135301 - RNA, 85 nt, Human
auaagguagaggaagggaggauuugauggcuuucucccugaaggcuugagcugggacaucaauauucuuuugcccucaacucugu

SEQ ID NO: 4135302 - RNA, 104 nt, Human
auaaguauaauaccaucucuaucaugcagggauguugcaaagaauaugcaauuccacauauucuuugcaacaucccugcaugauagagaugguauuaggcuuau

SEQ ID NO: 4135303 - RNA, 71 nt, Human
auaaguucugaagaggcgagguaagugugcugaaagaugguugagaugcacuuguguuuucagaaucuuau

SEQ ID NO: 4135304 - RNA, 79 nt, Human
auaaguugguuggagagaaaauuaguagagagcaauuugucaaugccuuuacaaagcaauuuugucucuagguauuuau

SEQ ID NO: 4135305 - RNA, 63 nt, Human
auaauaaccucucggagccucaccauuuuuagaauaaaauucaggaaaauugaggguuguugu

SEQ ID NO: 4135306 - RNA, 73 nt, Human
auaauaacuucauaccaguaaaucaaucagaaauaaaaugaaacugaaugaguuauuagguguaagugauuau

SEQ ID NO: 4135307 - RNA, 92 nt, Human
auaauaagcuauaugucagugaauacuucaggaaaauaaaauaaccuccaaagaaaaggaucugagguauaugacuggcuauaguuugauau

SEQ ID NO: 4135308 - RNA, 60 nt, Human
auaauacaugcauuggauggcaauagggcugcuuguuacauggacaacuguauguauugu

SEQ ID NO: 4135309 - RNA, 68 nt, Human
auaauauguuaagucuuuagggauauagaauacaauagucucuguccuuaaggagcuuaaugucuuau

SEQ ID NO: 4135310 - RNA, 60 nt, Human
auaauauugagucaggaccugaaagaccuuccaccucuucagguccugacucaauauuau

SEQ ID NO: 4135311 - RNA, 114 nt, Human
auaaucaaacugaaggugaggucagugguggguuuuguguauaugcuuaugcauaguuuuaacaaaaaacuacagcaucuauacaaauaaugucggccucauuuuugugauuau

SEQ ID NO: 4135312 - RNA, 96 nt, Human
auaauccaaacuuguuaacuuuucugccaggcucugucccugcagggaacaguggagcagguggcagcagccuggugaaauguauauuuggauugu

SEQ ID NO: 4135313 - RNA, 91 nt, Human
auaaucuuggagucaauauauggagguaagaauauuuuuuugaaauuaaaauauuucaaagucaauaucauuaccauguguuguagauuau

SEQ ID NO: 4135314 - RNA, 102 nt, Human
auaaugaguauuucaauguuuugcagucaaauuugcuaaauuugugaaggaagaaauguaaauauauuugguagugauugaaauuauggaaauauacauuau

SEQ ID NO: 4135315 - RNA, 75 nt, Human
auaaugcucccuuacuccuggggaagccaagcagagaagacuccaaugcuuuaaaccauggaugugaggcauugu

SEQ ID NO: 4135316 - RNA, 56 nt, Human
auaaugcugggagaaauuguuaucuuuaugggauaauaaaucuccauagauauuau

SEQ ID NO: 4135317 - RNA, 92 nt, Human
auaauuaacuaaugcauacacaguguauaaaaucuuaaagauacuaaagaguaucugauauuaaaaacauuggacugagcauggugguuuau

SEQ ID NO: 4135318 - RNA, 84 nt, Human
auaauugaugaaugcaauauuuuaugacagauuaugcauuuccuuagacagguaacuguuacagaaauauugcuucuugauuau

SEQ ID NO: 4135319 - RNA, 65 nt, Human
auaauugcucaaaaauuauugaguguuuugaauugggaaugaagugauaggguuugggcaauuau

SEQ ID NO: 4135320 - RNA, 74 nt, Human
auacaaguagauuucugcugaagcuuuucugucaaaaucagcaagugaaaaagagugcagagauaugcuugugu

SEQ ID NO: 4135321 - RNA, 71 nt, Human
auacaauagaauauacaacaccaacaguguacccuacuguacacuaugggcuuuguguaauaaugaugugu

SEQ ID NO: 4135322 - RNA, 70 nt, Human
auacacagcucacaacgugugcauuugugugaccuugucucugugugugugugugugugugugugugugu

SEQ ID NO: 4135323 - RNA, 59 nt, Human
auacacaggcaugcuucugauucaucaauaaucugaaauuguagcauguguuugugugu

SEQ ID NO: 4135324 - RNA, 80 nt, Human
auacaccaucuuaucucguuuauuccuuuaagccacaucaaaucauuuauaggaauaaagugggguauaaauaagugaau

SEQ ID NO: 4135325 - RNA, 130 nt, Human
auacaccugugucuguguguguguaugcgugaguguucuaaaugccauucguuucauacaccugugucuguguguguguaugcgugaguguucuaaaugccauucguuucauacaccugugucugugugu

SEQ ID NO: 4135326 - RNA, 60 nt, Human
auacacguguguguacaugcacguguguguacguacacguguguguacguacacgugugu

SEQ ID NO: 4135327 - RNA, 70 nt, Human
auacacuacaguucuuaauuaaguaguaacauaguagauacuugauuauuugacuugagaacagguguau

SEQ ID NO: 4135328 - RNA, 76 nt, Human
auacacucagcucauccacuaaaucccuuuucagguagacaggguuauaugggaagaugagcuagaaugagucuau

SEQ ID NO: 4135329 - RNA, 65 nt, Human
auacacuguguguguaugugugugcaugcacaugcacacauucaugagugcaugcacaugugugu

SEQ ID NO: 4135330 - RNA, 75 nt, Human
auacagccagucggcgggcgccuuggaaaguuuccggcccuccaggaggcuuccuggcucuugauuggccagugu

SEQ ID NO: 4135331 - RNA, 59 nt, Human
auacaggcagagaacucauccgugacauugucuagcauuucacagucuacugccuuuau

SEQ ID NO: 4135332 - RNA, 76 nt, Human
auacauaccaucuccuggaaagcugaaagaagaagauauauucuuaaugagguuuuaagagagaaggucaucguau

SEQ ID NO: 4135333 - RNA, 63 nt, Human
auacaucaauuucuuaguuaucaugaaguauuuuauuugcuggauacaaagagauugauguau

SEQ ID NO: 4135334 - RNA, 72 nt, Human
auacaugacagcauagcauccuuucccccucgcugccaggaaagaaauaucacaauguuagcaaucaugugu

SEQ ID NO: 4135335 - RNA, 60 nt, Human
auacauguuugcuggauaaacagaugcaagcaaaacaucuagguuuuugugaacaugugu

SEQ ID NO: 4135336 - RNA, 86 nt, Human
auaccaaauaagacuccauaguacacauccuacaauguuugguuacuugugagugaacagguguguguguguguguaugugugugu

SEQ ID NO: 4135337 - RNA, 63 nt, Human
auaccaccaucuaugaaagguaauagccaccgcuauugacacaucuggccauuuggugaguau

SEQ ID NO: 4135338 - RNA, 68 nt, Human
auaccccagagcugacucuggccucugguccucucuccagaggaagaaggcgagagugagcugggugu

SEQ ID NO: 4135339 - RNA, 87 nt, Human
auaccugcuggucugccucagucuccucuauaucugaaaucaacuucagaggcagaauggagauuugguuagguaaauaguggguau

SEQ ID NO: 4135340 - RNA, 116 nt, Human
auacgugugugcuggugcucugagccugccuguauucaauuuugugugauguguggcccacaugcaccugcuguauauagggacucucaggcuccagggaggagacauacaugugu

SEQ ID NO: 4135341 - RNA, 126 nt, Human
augugccuuaaucguuauauucuuuacauuguacaucagucuuuugcauacauauucguauuccccgcaagaauauguguugcuagggaguuggugucuaugccugguuuagcuuuuuguccgcau

SEQ ID NO: 4135342 - RNA, 115 nt, Human
augugcgcauuuauucuggaguuauaaucgggaugggguguggcuuauggcuauuacgugaaggcaaauaagcaauuccauucuucaagcaugaccucagaucacacaugcacau

SEQ ID NO: 4135343 - RNA, 72 nt, Human
augugcuaaaagccauguuucagauacauaaauggggaaggaauuccguaacugaggcagcuuuuaagacau

SEQ ID NO: 4135344 - RNA, 61 nt, Human
augugcucuaggaccuuagaagugggagcaguugcuuucauuuguaaggauuagggugcgu

SEQ ID NO: 4135345 - RNA, 63 nt, Human
auguggaggggauggugaagccggcccugcccgcuggauuuuaucagcaugcuccucagacau

SEQ ID NO: 4135346 - RNA, 62 nt, Human
auguggcccagguucugaaaaacagccucuuauuuaaaaggcuuguacagcagccuucgcau

SEQ ID NO: 4135347 - RNA, 61 nt, Human
auguggcucacauagcuggaaauaauuauuuuguguucaaauccagggcuagggagcucau

SEQ ID NO: 4135348 - RNA, 76 nt, Human
auguggcuguggagcugcagaguuggccuuuuuggggccacccuccagacccagacugcuugcuucccagccccgu

SEQ ID NO: 4135349 - RNA, 67 nt, Human
augugguccaggauacaucacuuuuuuugggcccacccaagggagaguuugauguuuccucuuacgu

SEQ ID NO: 4135350 - RNA, 61 nt, Human
auguguaaugugguauuuuaauaaccauugcaauuggcuauuaaaaugcagcuuugcacau

SEQ ID NO: 4135351 - RNA, 66 nt, Human
auguguacauacauauucauacaggugguacaaucuaugucuccacuugcauguguauguauauau

SEQ ID NO: 4135352 - RNA, 83 nt, Human
auguguaugaaaaguauuuuaugacucuaugaaucuguauaauaacugcucugaucauggauaaaauauugguuaauacacau

SEQ ID NO: 4135353 - RNA, 91 nt, Human
augugucaggaaaguucgcucugggguggcagagaaguugucuuucuuguuuguaacugagugcucagagccugaaagacuucuggcacau

SEQ ID NO: 4135354 - RNA, 59 nt, Human
augugucauuauuguguaggcugcugagguuucaaaucucuauaacuauagugacagau

SEQ ID NO: 4135355 - RNA, 66 nt, Human
auguguccuuaugaaaauacugucuucugauagcuucagcauacaggguuuuuuaugagaacagau

SEQ ID NO: 4135356 - RNA, 67 nt, Human
augugucucuaaaauuuaguaauaagauguucuugugaauaaugcagugcugauuuaggagauauau

SEQ ID NO: 4135357 - RNA, 130 nt, Human
auguguguauauauacacauauguguguguauauguguauauauacacauauguguguguauauguguauauauacacauauguguguauauguguauauauacacauauguguguauauguguauauau

SEQ ID NO: 4135358 - RNA, 83 nt, Human
augugugugugugcaugugugugugcauguguauacauggugugcguguguauacauguguucaugcauguaugugcauguau

SEQ ID NO: 4135359 - RNA, 74 nt, Human
auguguuaauggggucaggaggagaacugaacuugcagcuugcagcacuucaaucucugccuccaucaucacau

SEQ ID NO: 4135360 - RNA, 69 nt, Human
auguguucauguuuuucccuuugaagacugccugggaaaggcuaacagucauggaaguaacaaacauau

SEQ ID NO: 4135361 - RNA, 64 nt, Human
auguguucauucuguauaugcuguaugcauaucaugcuacaugcaugucacagaaugaacacau

SEQ ID NO: 4135362 - RNA, 105 nt, Human
auguuaaggacccauuguuuggguccuuauugauaccaauggccauaauaaucucuaaauuuauuuauucauuaacagggaccaaagucaauagggccuuaauau

SEQ ID NO: 4135363 - RNA, 56 nt, Human
auguuacagggagagaaggccaagcccuagagggaaggccauccugcccuugacau

SEQ ID NO: 4135364 - RNA, 122 nt, Human
auguuacagguuaauuuauaauuuuauuucaugcacuacuuggcuuuacugauuaauaugccccauggcauucaauaaagucaggcaguggaggaaauaagagugguauuaauuucuaacau

SEQ ID NO: 4135365 - RNA, 57 nt, Human
auguuaguuauauuuacugcugucaguuuuuuagacaguuauagcugugaauaacau

SEQ ID NO: 4135366 - RNA, 93 nt, Human
auguuauugacagagcugaaaucugaacucuguauccuucagcguagaagaucaauguucauuaagaugcuucaguucuggaaauuucaacau

SEQ ID NO: 4135367 - RNA, 89 nt, Human
auguucacuugcuaauuaaccacccauucagaaacacugagaauucuuuauuguuaucaugggugagugaauauuagcaguguguucau

SEQ ID NO: 4135368 - RNA, 81 nt, Human
auguucagggucauauagucagugaucaguggaguugggauuccaacccagauguuuuugacuucaaaugacucugaucau

SEQ ID NO: 4135369 - RNA, 66 nt, Human
auguucauccaugucguagcaguuccuuuccuuuuauuacuguguaguauuccaugguauggaugu

SEQ ID NO: 4135370 - RNA, 94 nt, Human
auguuccacaguggggauuccugcaagaucuuuaaggaggcagcucuuccugcuucccagaauuguugggaacugcaugagugagugagagcau

SEQ ID NO: 4135371 - RNA, 73 nt, Human
auguuccacucacuuaagcucuuuaagggagaaaaucagccuuguguccuuggagccugguauaguguugcau

SEQ ID NO: 4135372 - RNA, 66 nt, Human
auguucccagcacugaguaacaccaaagaaauauacgacaggaguugucucagcuuuggagaagau

SEQ ID NO: 4135373 - RNA, 75 nt, Human
auguucccauggcaguauuucugaaaggcugguaccaucucuccaagcugacauuggauauugcuauuuaaacau

SEQ ID NO: 4135374 - RNA, 56 nt, Human
auguuccucauucuugcaaccccagcacuuuaggggaagccagaaagugagaauau

SEQ ID NO: 4135375 - RNA, 76 nt, Human
auguucugaauaaugugcauuacaaaugacugauaauaauucaugcaaagaggaucgcauauugaauucagaaugu

SEQ ID NO: 4135376 - RNA, 65 nt, Human
auguucugccuccauuuugaguggaacuccuuuuccacuuucaaacucugagguaauagaaacau

SEQ ID NO: 4135377 - RNA, 64 nt, Human
auguucuuugccuuauuuuaaacuuuauuguaauaaauucacuaaugaagcaggcagagaagau

SEQ ID NO: 4135378 - RNA, 74 nt, Human
auguugaguccuucgagggaauacuggaaugucuucuaaagugacuagacauuuugcauucccugaagcagcgu

SEQ ID NO: 4135379 - RNA, 91 nt, Human
auguugcaauacuuuuucagaguacacagagaucuucuauccccaguggaacaauugaacugugauauucugugccaaaguggguugauau

SEQ ID NO: 4135380 - RNA, 77 nt, Human
auguugcuucacuggcuccacauaggauacaggcacagcccccaguguguagaacccuaaaggaguguggggcacau

SEQ ID NO: 4135381 - RNA, 60 nt, Human
auguuggacuuaacaaagggugaugaugaucauuauuaaucuuugcuaagccaccuacau

SEQ ID NO: 4135382 - RNA, 119 nt, Human
auguuguagaaguaagugugcuuuagcauuuauggucauguguccacuuaugaucaugugaaugaacacaugauuauaaaugcuagggcacacauacuuuaaugagcacaauacaacgu

SEQ ID NO: 4135383 - RNA, 74 nt, Human
auguugugguguguauuuaaaggauaguuggggacccaaauaccacuauaugccuuugaaauacaaaauaaugu

SEQ ID NO: 4135384 - RNA, 85 nt, Human
auguuguuaaaggguacaaacuuucaguuauaacaugaaaguacaaacuuucaguuguaaguucugagggucuaccguacagcau

SEQ ID NO: 4135385 - RNA, 129 nt, Human
auguuuauuaauucacucauggacuccaucauucagcuagcauuugccaaugcuuacggguggccagaugcugugguaggcacuggggaggcagcauggaacaggacaaauggaguuuacaguagauuu

SEQ ID NO: 4135386 - RNA, 60 nt, Human
auguuucagggugauagaagguuaugccaaucaaacgagccuucauuacucugacaacau

SEQ ID NO: 4135387 - RNA, 58 nt, Human
auguuucccauaagauuuucugugcaguuggugaagccagauuugcucugggaaacau

SEQ ID NO: 4135388 - RNA, 62 nt, Human
auguuuccucuuaugcaaauugggagcuagaagaguuguacaguguaaauaaguggaugcau

SEQ ID NO: 4135389 - RNA, 78 nt, Human
auguuucuacuuucaguuuaaugaugcccugcuguauacaacaccagugcagucugggauguauaaacugaacaacau

SEQ ID NO: 4135390 - RNA, 74 nt, Human
auguuucugggaaaaaaauucauuguggaauaaccugacauucugauaacagugauauuuuuacucaaaugcau

SEQ ID NO: 4135391 - RNA, 60 nt, Human
auguuugucaggauuguaauuaaggugguguguauaccaggguugcaagaggacagagau

SEQ ID NO: 4135392 - RNA, 64 nt, Human
auguuuguugaacaucuacugcaaugggccaagcccugggcuugaaaggugcuuuugcaggcau

SEQ ID NO: 4135393 - RNA, 67 nt, Human
auguuuucuuacagauuuggugaaugacuguccacagaagggaggucucaccaucugaagaaggugu

SEQ ID NO: 4135394 - RNA, 93 nt, Human
auguuuuuuuacauguugauccccagaaaauaggugccuaaaaaaaguuacuuuaggauaaugauuucaggggaguagaaggugaaaaaucau

SEQ ID NO: 4135395 - RNA, 80 nt, Human
auuaaaauuguaaugcugcuuuucacagagacaagauuucaacccaaucuuccguaacuggaguagcaaacaauguugau

SEQ ID NO: 4135396 - RNA, 68 nt, Human
auuaaaguaugauuggggauuauuuacucccuuugaauucuguagaaauauccacaucauacuauagu

SEQ ID NO: 4135397 - RNA, 83 nt, Human
auuaaauagaaacaggcuggcuuucccuggacaacagcgauaacuugcugauguguuuggaggucagccuguggcugugaagu

SEQ ID NO: 4135398 - RNA, 71 nt, Human
auuaacaagggcucugggaugcucuuagagcaugaauugcagagcagaagagguccuagaugccagcuagu

SEQ ID NO: 4135399 - RNA, 130 nt, Human
auuaaguuucaacauaugaauuuuggaugacaaauucagaccauagcauauacaguugguggguuguggucugcuauggacugaauguuuguauccccuucccccuaauuuuauauauugaagugcuaau

SEQ ID NO: 4135400 - RNA, 58 nt, Human
auuaauagccucauuuugcaaguuucauggcaacauuagagcaaguuaaggcauuaau

SEQ ID NO: 4135401 - RNA, 102 nt, Human
auuaauaguaucugucagaaauuagaagucaugcucccaucuugcucagccaugaguuuucaaaaagcaaaaugggacaugggauuuugacauacuauuagu

SEQ ID NO: 4135402 - RNA, 93 nt, Human
auuacagauuugucucaugguaagagggauaauauguauuguaaccucauauuuacaucaugcuuaucccuuucauggagacgaggguguaau

SEQ ID NO: 4135403 - RNA, 78 nt, Human
auuacaggcaugagccacugcacccagccuuuuaaaaaacuuuuuggccagguuguuuuauaggcucaugccuauaau

SEQ ID NO: 4135404 - RNA, 76 nt, Human
auuacagugaaugaauggcugugcauaaguccuagaaugccaaucuggaugggcacauuguuacucuuacugugau

SEQ ID NO: 4135405 - RNA, 58 nt, Human
auuacaugggccauuuagacaugcauguaaguagaauuaucauuuggcccuaugugau

SEQ ID NO: 4135406 - RNA, 83 nt, Human
auuacccaaggacauuuauacuauuuugaagguuaauuccaaccucacucauucagcauauguuuggaguguccuugccuaau

SEQ ID NO: 4135407 - RNA, 55 nt, Human
auuacucuucuagagguccuagaaggaagauuuucucuccucuagucaggguggu

SEQ ID NO: 4135408 - RNA, 69 nt, Human
auuacuguagaccuuaauauauagagcugugacacuguuaggaaacgcuuuuguuaaggauccaguagu

SEQ ID NO: 4135409 - RNA, 59 nt, Human
auacuacaaucauaauuguacauuuagaaauaauuaaaguguauaauuggauugugugu

SEQ ID NO: 4135410 - RNA, 57 nt, Human
auacuacauuauuagagccuggguuuuagguccauggagcugggaacuauguaguau

SEQ ID NO: 4135411 - RNA, 129 nt, Human
auacuauuggucccgagggaaagaucauugcucuuaguugccuuaauuuuguuucuauuauagggccuuuucucaaagcuuugcagacaaaauuccagcugagguuuuuccuucaaggcagcauuguau

SEQ ID NO: 4135412 - RNA, 57 nt, Human
auacucugggcuguuaggagcugucuugucauagauguucuagcagcuccagggagu

SEQ ID NO: 4135413 - RNA, 103 nt, Human
auacugagaauacauuuccuagagaugcugaaaucugaguguagauuuaaaugaauuucaguuuguuuuagaucucuaauaaggagaaauauagucuuuguau

SEQ ID NO: 4135414 - RNA, 55 nt, Human
auacugagggucaacuugauuguauugaaagauacaaaguauugauccugagugu

SEQ ID NO: 4135415 - RNA, 55 nt, Human
auacugauugccggguugccuaccagcuagcuucacagaccugacaguacagugu

SEQ ID NO: 4135416 - RNA, 85 nt, Human
auacuguuuugaaaagugaugcugaagucagauuacuuaugaaucugggcuuuauuuugcaugaaugcuuucucaaggcaaguau

SEQ ID NO: 4135417 - RNA, 63 nt, Human
auacuguuuugugacuuaucuuugaccccacaacaugucuuggauaucuuuccacagcaguau

SEQ ID NO: 4135418 - RNA, 76 nt, Human
auacuuaaucaagaaucucugaucaggcuuuauuaacaugagagucaggccaccaaaggauucuauggaccagugu

SEQ ID NO: 4135419 - RNA, 60 nt, Human
auacuuccuguugcucugucucaugcucuguuuaugcugagacacucauucauggaguau

SEQ ID NO: 4135420 - RNA, 67 nt, Human
auacuucuggaaccugcucccccaccaaaaaaagucuuaauucuggugggagauuauccagaauuau

SEQ ID NO: 4135421 - RNA, 66 nt, Human
auagaaacagggaagcaaagcagcuuaguuuuuagaaugacuucaacuuuguucucugcuuucugu

SEQ ID NO: 4135422 - RNA, 80 nt, Human
auagaaacugauuugguuaauuuaggcuugcauuuccuuaguguuggaaauguacuuccucugacuuauucaguguuugu

SEQ ID NO: 4135423 - RNA, 64 nt, Human
auagaaauuuuguuuuauaugagcuaacagauggauccugaaagcuauggaacagaguggcugu

SEQ ID NO: 4135424 - RNA, 79 nt, Human
auagaacaaaguaaaugucuggaaagacaguguaaaccagauagucaugguuuaaaugucaauagauugcuuggguuau

SEQ ID NO: 4135425 - RNA, 72 nt, Human
auagaagcaauguguuuucaacauucagcaugugaaaaauguggaguuaguuggugaaauucauuguucuau

SEQ ID NO: 4135426 - RNA, 75 nt, Human
auagaauuacacagugcaguaggcacguggcugugauugggugauggcuguugccugcugcuagugauguucuau

SEQ ID NO: 4135427 - RNA, 103 nt, Human
auagaccaaagugauguuugcuuuucuaugguucccuucuaaaauuccacaaagucuuucaaaguaacaaccacgaggagucguaagcacaugcuucaucuau

SEQ ID NO: 4135428 - RNA, 69 nt, Human
auagagaugcccaggcuucaucccagauguacaaaauucaacucucagggacagggucugggacucugu

SEQ ID NO: 4135429 - RNA, 72 nt, Human
auagaggggacuggggggagccugcaagccuagagggaaagaaggacuugcuuccuccuagccacuugcuau

SEQ ID NO: 4135430 - RNA, 56 nt, Human
auagaguacagucuuugauuauggucaauuuaccauguuauaaggcauuacucuau

SEQ ID NO: 4135431 - RNA, 71 nt, Human
auagauaacccugcacuuccuggauuuuaaacaaucgguaguuggauggcagggaguugcaggauuucugu

SEQ ID NO: 4135432 - RNA, 68 nt, Human
auagaugagggaaaauaaaauugcaguagauuaagauuuauaggcaaguaauuuucuaccugauuugu

SEQ ID NO: 4135433 - RNA, 102 nt, Human
auagaugcaguguguuucuguuuuuuccuuaugcaaucugaaaauaacuucaugaagccgagaaggaagaugugaacagucaagcauccuaaucacauuuau

SEQ ID NO: 4135434 - RNA, 56 nt, Human
auagaugugccgcugggucccgggagccgucaugcccaccuggcuggcgcacuugu

SEQ ID NO: 4135435 - RNA, 67 nt, Human
auagcaaauuucuaagucaagaagaaccagacuauuccuuguuaggcuuaucuuuucuuagggcuau

SEQ ID NO: 4135436 - RNA, 61 nt, Human
auagcagggagacagugcagcauuaaacugguggcauaauguuguaaauauucuuugagau

SEQ ID NO: 4135437 - RNA, 101 nt, Human
auagccacacauauauacuuuuguuacuuuuuauuccuuuugauuuuaacuagccuggcugaauaugaaugaugggaaggagaaaagcaaaaggggguuau

SEQ ID NO: 4135438 - RNA, 96 nt, Human
auagccgacugccggcuccauggaggggccugugccggagaacgcacauguugacuuauuucuucagucuaggccuuucuuggcccccuugguuau

SEQ ID NO: 4135439 - RNA, 77 nt, Human
auagccugaugagggcuuuaauuagagaauucuuguuauuguagaauuuuagaucuaggaaagccuuucacaacugu

SEQ ID NO: 4135440 - RNA, 70 nt, Human
auagccuggguuuuuauuaaggagugggaagguguccucaguuucguuagugaagagcccucuagguugu

SEQ ID NO: 4135441 - RNA, 56 nt, Human
auagcuguagcugcaaaaauucuguuuucuggaauuacaugagcaaauauagcuau

SEQ ID NO: 4135442 - RNA, 62 nt, Human
auagcuuucuuaaauauauaaaaaccugaggaauggcaggggaugugaaguaggaagggugu

SEQ ID NO: 4135443 - RNA, 62 nt, Human
auaggaaauuacagaucaccaaugcauaagguuuuaugcuaggugcucugugaucugcuuau

SEQ ID NO: 4135444 - RNA, 70 nt, Human
auaggaacuauuucugccaaaguggggaccuuguccauagcaacgucccuguccugcagaaaguuugcau

SEQ ID NO: 4135445 - RNA, 70 nt, Human
auaggaggaggaaaggaguugaaaugggcaagccaauuuaugcuuuuucuuauucuuuuugucuuuuuau

SEQ ID NO: 4135446 - RNA, 65 nt, Human
auaggaucucacauacgaauauacauaugcauaaaaccccauuguguauuuucguggaggccuau

SEQ ID NO: 4135447 - RNA, 84 nt, Human
auaggaugaaauuguucauucaucaaauauuuacugugugcauagacuaugcaaaaaguaagauacuugauaaugagcuccugu

SEQ ID NO: 4135448 - RNA, 59 nt, Human
auaggcccugcuuugcacccaggcuggcucucugagccagccggcaagggagugccuau

SEQ ID NO: 4135449 - RNA, 75 nt, Human
auaggccuuaacauaugguaguguaacugcuuuagcugcuccaaauagguuuugugcucccaaauguaggucuau

SEQ ID NO: 4135450 - RNA, 76 nt, Human
auaggcuccaagggggugaaugucugucuacauaucaaccuaucuaguuaauaggauucacucuuuugcugucugu

SEQ ID NO: 4135451 - RNA, 93 nt, Human
auagggaaacaggcagagaaagacuugcccuuagucugguuggggacagugcuggaacuagaaugcaggauuggucucuggccucucaccugu

SEQ ID NO: 4135452 - RNA, 80 nt, Human
auaggggagaaaaaggcaagauuaggaccagaagaauaaugacuuuuuguaaagaauucauaaaccuuuuuuucuacuau

SEQ ID NO: 4135453 - RNA, 91 nt, Human
auaggguucugcauaaaacaugauuucugcuagguuuauauuaaauaugguuguugaacaaagcuuucuugauuuugccuguaaacccuau

SEQ ID NO: 4135454 - RNA, 88 nt, Human
auagguagugagugagccagcugggaucagaaccugugugguuuggccccacagucuccucucuuagccugucuacugccacuccugu

SEQ ID NO: 4135455 - RNA, 66 nt, Human
auagguugaguaguaaggauauuaucuuuguuggaggaaaaacagucuuuauuauuuuaggccuau

SEQ ID NO: 4135456 - RNA, 80 nt, Human
auaguaaacacacccaugucacuggagauacacacaauucugcuugauggugacaguauacuugugaugggauuuauuau

SEQ ID NO: 4135457 - RNA, 95 nt, Human
auaguaauacacaauuuaaaugguuuaauuauguuuaauguuccacagaacaaugaaacuguauauagacuguaugcuugauauugguauucuau

SEQ ID NO: 4135458 - RNA, 61 nt, Human
auagugcugaauuugagaaacucugcuagacagcaguggguucucaaauguuagcaucugu

SEQ ID NO: 4135459 - RNA, 67 nt, Human
auaguuaccauuuaaggaaaauguaucacaguccugguacugugccaaguccugaauguguuucuau

SEQ ID NO: 4135460 - RNA, 129 nt, Human
auaguuauagauguauagguaguuugaucauuugggaagaaguugcaaauuuauauaacccuaaaacuucaguguauauuuuggguacucuuuuucacaauuagaauaaaauuaucaaaaucaauaugu

SEQ ID NO: 4135461 - RNA, 59 nt, Human
auaguuccagcaucuuugguaaccugaaacugagagucauuaaaguaagcuggcacugu

SEQ ID NO: 4135462 - RNA, 59 nt, Human
auaguuccuauccuagagccauuugaggaucugacaucgguuauaggagagggaauuau

SEQ ID NO: 4135463 - RNA, 70 nt, Human
auaguuucaaguuuuuguuuguuuguuuuaccuaauuaccugaaagcaaauaccaaaggcugaugucugu

SEQ ID NO: 4135464 - RNA, 68 nt, Human
auaguuuggacaaaagacuccuuagauauucaaauauguagaggccugucaagucauguucagauuau

SEQ ID NO: 4135465 - RNA, 69 nt, Human
auauaaacuaaaugacuuccagugguuauaucuguggaauaagauuauggagaagucauuuguuuuugu

SEQ ID NO: 4135466 - RNA, 58 nt, Human
auauacacucaccaugguauuucugaugcuuuuugaugguacugucuugagugugugu

SEQ ID NO: 4135467 - RNA, 56 nt, Human
auauacagaagaacuauagccacuuuucuagugaaguguccaagucuucuguuugu

SEQ ID NO: 4135468 - RNA, 106 nt, Human
auauacuacauuuucuuuauccauucauuugucaacaggcauuuagguuguuuucauaucuuugcuauuguaaaucacguggcaauaaacaugggaauguggauau

SEQ ID NO: 4135469 - RNA, 83 nt, Human
auauagggaauguuaacuaauggucuaacauuucuuaaucuuuacuuuguaucaaauggggcuauuacuuaaauucuuuguau

SEQ ID NO: 4135470 - RNA, 77 nt, Human
auauaguguauuaugagguauuuggacuuuaucaaagggacuuuuguuguccaaagcccaggugucuuucacuaugu

SEQ ID NO: 4135471 - RNA, 73 nt, Human
auauaguuggauccacuggcaauaguagaaaaaacaagaauagcaacugcuaggugucuaguguccacuaugu

SEQ ID NO: 4135472 - RNA, 55 nt, Human
auauauaucgaguucaugucucuuguuuucaugaggagacacacuugauaugugu

SEQ ID NO: 4135473 - RNA, 100 nt, Human
auauauauguauguaauauauauguuauauaugauguauguauguauauguaauauauguauguuucuauauaugacaugaguauguguuauauguauau

SEQ ID NO: 4135474 - RNA, 110 nt, Human
auauaugcagaaaaguugaagaauugugaagguagcaaucguguauaugccaucuaaauccuaccauuaacacuuugcuacauuucauauucuugcuuuuuuucauuuau

SEQ ID NO: 4135475 - RNA, 66 nt, Human
auauaugcccaguuagaaccagaguggggauucagacccaagucucugugucacugaggccugugu

SEQ ID NO: 4135476 - RNA, 71 nt, Human
auauauggguauauagaaguaaauacagauguaaaauguacacauguauaugcuuguguguguguaugugu

SEQ ID NO: 4135477 - RNA, 75 nt, Human
auauauuggcaggcuuuaauagugacugguuuuucacuggagaucugcaguuuucuaaagucucuuuaaauguau

SEQ ID NO: 4135478 - RNA, 83 nt, Human
auaucaggaaaguaaugagauguaggaaacaaagacuuaaaaauuaaagcuguugguuaucuucuauuucucauacuugguau

SEQ ID NO: 4135479 - RNA, 76 nt, Human
agucauucuagucauugcagcugagguuauccuagauuagcugagcugcagaugacuguaagauccaugagugagu

SEQ ID NO: 4135480 - RNA, 64 nt, Human
aguccaagcauagaaaucaggugagaaucuggucagccaggcaugcugugucuaugcgggggcu

SEQ ID NO: 4135481 - RNA, 57 nt, Human
aguccacagagucucuccugaaagaagaaaauuggcaaggagacugcuuuguagacu

SEQ ID NO: 4135482 - RNA, 130 nt, Human
aguccaggacuguuuuccuacagcgugccucaaaaguguuguagagggcaggauucuacauucacagccuguuccaucuacgagauuuuccagaugcuacuugugguagacauuccuaacucaugguacu

SEQ ID NO: 4135483 - RNA, 59 nt, Human
aguccagggaaauagcgacaggggaguucaagacugccccugcuaguccuuccuuggcu

SEQ ID NO: 4135484 - RNA, 56 nt, Human
aguccagugaacuguaaauaggcaaguuggaucucguuuaggcagaaaauugggcu

SEQ ID NO: 4135485 - RNA, 56 nt, Human
aguccaugcugucuacagaaucaguguauauggguuccacauaggacaguuggacu

SEQ ID NO: 4135486 - RNA, 61 nt, Human
agucccagaucuccauucggucauuucugaaaccaccucagggagaaggggaugugugacu

SEQ ID NO: 4135487 - RNA, 84 nt, Human
agucccaguagaagggagaucuguuuuuucuuagacagugaaaauuguuccuggaaaagaacaggauucucaaucucugauacu

SEQ ID NO: 4135488 - RNA, 60 nt, Human
aguccccuuguauucuuguaccuuucaaugccuugaaaagaucuggggugaaggaggacu

SEQ ID NO: 4135489 - RNA, 61 nt, Human
agucccguagcaggaaaccuguguugagggaggcucuuuucauucuuuucuugcuggggcu

SEQ ID NO: 4135490 - RNA, 89 nt, Human
aguccuaggguggugaucaaggcuuuagauccacagaauguagaagcucugauaucuggagcuugaagcuuugguugcauccacuggcu

SEQ ID NO: 4135491 - RNA, 84 nt, Human
aguccucacacagccugcccagggaggcugucuuaugccugcuuuacagaugaggaaacaggacccccagggaggugaaggacu

SEQ ID NO: 4135492 - RNA, 108 nt, Human
aguccuccagcuuuauugaugggugguaaagcuggagcuggaagcuuccacaccagauuuccagccuaauguucuucccaccucaucauuuaguucaacccaaugacu

SEQ ID NO: 4135493 - RNA, 61 nt, Human
aguccuggugacacuccucuucauugccuccauuuggcaaguggauccucaacugugggcu

SEQ ID NO: 4135494 - RNA, 56 nt, Human
aguccuuccugcacccuccuggggaaccauauacacuccaggaaugguagaggacu

SEQ ID NO: 4135495 - RNA, 57 nt, Human
aguccuucuuuuaguugcuugggccauaguucauguuggcuagcacaaagcaggauu

SEQ ID NO: 4135496 - RNA, 67 nt, Human
agucguguucgauaucaggguguuggaugcccucagauggguucuaaacauugguauggagcagauu

SEQ ID NO: 4135497 - RNA, 78 nt, Human
agucuacaaauugauggaugggaggaauauauacuuuuuaauuuuucuccagcucaauauuuauuaauuuguaaggcu

SEQ ID NO: 4135498 - RNA, 82 nt, Human
agucuagcuagugaaaccugacagaucaugugaaagcucuguauucuucuagucauugaugucaguauuaugaguuuagacu

SEQ ID NO: 4135499 - RNA, 87 nt, Human
agucuauugcaguugccuaggcaagaguugguguggacuugaacuaaacaauuucaucacuuucaugccugaaaauauuaauagauu

SEQ ID NO: 4135500 - RNA, 58 nt, Human
agucucauugccuuaguaucauucuacgaauuagaauguguuacuguguaagagcacu

SEQ ID NO: 4135501 - RNA, 63 nt, Human
agucuccccugcagccuggcaauagcuuguagauccuauacccagccccagcugcaggaagcu

SEQ ID NO: 4135502 - RNA, 130 nt, Human
agucucccuucaguggcuggaggagguguggcacagugggagagccccagacucagaggcagucagagaucugcuacugggacucuaucacccuggaccuucauuuccucuuugcaaaaugaggggcucu

SEQ ID NO: 4135503 - RNA, 130 nt, Human
agucuccuggagacugaaggaagcaucaagaucaaaccagagaggcaaaguuacugguauggagacucucacagguaaccagcagagcucaaacuuccugccucucuuuaugguguugucuccauuaucu

SEQ ID NO: 4135504 - RNA, 77 nt, Human
agucucguuuugucacccaggcuggauugcaguggcgcgaucucggcucacugcaaucgcuggguuccagcgagucu

SEQ ID NO: 4135505 - RNA, 74 nt, Human
agucucuccacggggcacuuugaauucugccaggcacagccucccaaguucacguugcuuuuugaggaaugacu

SEQ ID NO: 4135506 - RNA, 61 nt, Human
agucucucuccaguauugagaaguauaguccuccaguacugccucuuggugcugagagacu

SEQ ID NO: 4135507 - RNA, 56 nt, Human
agucucugugagcucccaauggaagguauagaagcuacugggagcuaacggagauu

SEQ ID NO: 4135508 - RNA, 98 nt, Human
agucugacacuucuaagcccauuuagaguauaagagagagacacuaauucugaaucuuuucuggacucugcauggagcuuaagauuuacuagucagcu

SEQ ID NO: 4135509 - RNA, 64 nt, Human
agucuggaguguuuuguagcaauccugggauauuguauucuuuugcuugcagaacuuucaggcu

SEQ ID NO: 4135510 - RNA, 59 nt, Human
agucugggaacauuuugagggcaaagauuguguuuuuguccaucuguauuucccaugcu

SEQ ID NO: 4135511 - RNA, 77 nt, Human
agucuggugcaaauaucauggugcgcacaaacuaggcuacucacuguuuccugcacacguguuauauucacccaacu

SEQ ID NO: 4135512 - RNA, 55 nt, Human
agucuguugcagauuuucaggccuuaggugaggaaggccugggaugggcagaacu

SEQ ID NO: 4135513 - RNA, 88 nt, Human
agucuuaaagcacugcccacauuuccaaagaugccagucacugaacuccgaguggagcuggcuuguggaaguugggcuugccaggacu

SEQ ID NO: 4135514 - RNA, 65 nt, Human
agucuuaggcuccauuaguagauccaucagggagacucuuauucugcauauggaguguugagacu

SEQ ID NO: 4135515 - RNA, 65 nt, Human
agucuuccugcccagcaggagguagguggcggucacuucguuguacuucuggcuggucaaggacu

SEQ ID NO: 4135516 - RNA, 81 nt, Human
agucuugcuuugucacccaggcuggagugcaguggugcuguauuggcucauugcaaccuccuccuggguucaagcgauucu

SEQ ID NO: 4135517 - RNA, 66 nt, Human
agucuugucuggaugcuuuauagguauuaacucguuuaaugccuuuaaccagucuagacagguacu

SEQ ID NO: 4135518 - RNA, 67 nt, Human
agucuuguggcugaaagucaagcugugucuaugaaaugaaauggcuucaaagguagcauacaacacu

SEQ ID NO: 4135519 - RNA, 57 nt, Human
agucuuuccuuuuggaagaaaaaagcucacuucuuucagucacauaaggaaaagacu

SEQ ID NO: 4135520 - RNA, 129 nt, Human
aucuuuuaccccuguuggcuuucacuuuuauuacaacauuuuuacuaagauuggcaaaguuggcaaacagcuauuccagugugaucuuuguagggaauggugauauaaaugauaacagcuguaacugau

SEQ ID NO: 4135521 - RNA, 67 nt, Human
augaaagaaugagcaucaugacuuaagaucugagauauuagagaaguuacuaugacucuucuuuugu

SEQ ID NO: 4135522 - RNA, 75 nt, Human
augaaauggugcauaggaaugugauuuauaaaugcuaaaggguggcauaaauggacguuuuuguuaucauuacau

SEQ ID NO: 4135523 - RNA, 58 nt, Human
augaaauucugauauuguuaaggaucacacaagggugucaagacaagacagaauucau

SEQ ID NO: 4135524 - RNA, 122 nt, Human
augaacacugccuuucaaaugugaaaaaacguuuaagguauaaaaagaagaagaagcaaaugugcuucuuuagcuagaaauacucuaaaguacauuuuacauuuuuucagcaguaguuucau

SEQ ID NO: 4135525 - RNA, 57 nt, Human
augaacagaggcacuaggagggaauaaguaugggaucaucucugugucucuguuuau

SEQ ID NO: 4135526 - RNA, 56 nt, Human
augaacaucucugauccaagcauuugcccaaagacaugccuggauuagaaugucau

SEQ ID NO: 4135527 - RNA, 67 nt, Human
augaacuaucaucaguuccaccuccacuguuaacacucuggagaacuugggauagagagauuuucau

SEQ ID NO: 4135528 - RNA, 85 nt, Human
augaacuccgaagagucccaaaaugauucuuagaggaccagccuccugggacugugacugcuuuugagagcucuucagagaucau

SEQ ID NO: 4135529 - RNA, 57 nt, Human
augaagacaggucucaucaccaguaagaaauuuaaaggugauuaaucaugucuccau

SEQ ID NO: 4135530 - RNA, 83 nt, Human
augaagauucuauuuaucacuuggaaaaauauccaucacuuauuaugcuuaugggagcugggugaggaguacagagucuucau

SEQ ID NO: 4135531 - RNA, 120 nt, Human
augaaguaaggguguguauguccagcaacacagcuaauuucugucaauuggccaaugcucaacaauugacaaauuaguagacugugcuugaguugacacuuuuacaauccagugcuucau

SEQ ID NO: 4135532 - RNA, 130 nt, Human
augaagucagggagaaaauaugugucacgauguuuaggcuuuccaaugucacuaugaauccuuuacucugagagauacggggaaccauuggaggguuuuaagcaaauaagucaugugaccugacuuucau

SEQ ID NO: 4135533 - RNA, 61 nt, Human
augaauccauuccugccacagaauuugauugcgggccuacugugugcucggauggacucgu

SEQ ID NO: 4135534 - RNA, 63 nt, Human
augaaucugcuuucugucuccaugaaucugccuauucuagauacaucauguaagcagaaucau

SEQ ID NO: 4135535 - RNA, 87 nt, Human
augaaugaaaccuacaauguauuuaagucuacauaauucuaagugggaucugaagauaugaaauauuugauugugguugccauacau

SEQ ID NO: 4135536 - RNA, 116 nt, Human
augaaugaauggucugccucuugucuuugauaacagugaauaucaugcuaggaaaacaggggcauguaacuuuuacuuaucaaacucuacgaguugcacugagaauacucaaucau

SEQ ID NO: 4135537 - RNA, 88 nt, Human
augaaugcucugaucuggagaggucuucacaaagaacagcaggugccuguggguuuuugugaagaucucuccagaucagagcauucau

SEQ ID NO: 4135538 - RNA, 72 nt, Human
augaaugugaugauucuguuacagcccuggaauugcacaagacgaaagcuuaaggagagucaugauauuuau

SEQ ID NO: 4135539 - RNA, 63 nt, Human
augacaaggguugacacaugucacccggcccuaucaggaguguuauuuguuugccacuugcau

SEQ ID NO: 4135540 - RNA, 61 nt, Human
augacacaagcagaggcucuaaaagcacuugcuuauugagaaucuucccucucuuguucau

SEQ ID NO: 4135541 - RNA, 92 nt, Human
augacacauaucuggaaugauggucauaugcuaauucaggauuuccuaauucuaauguucauauggcuaugcuauacuuagaguaguggagu

SEQ ID NO: 4135542 - RNA, 57 nt, Human
augacacccaaaaccagugcagagcauaguuguguauuauaaggaauggguagucau

SEQ ID NO: 4135543 - RNA, 74 nt, Human
augacauuauucaauucuaguggagagaguuuauggagcuccgguuccauaaacucucuccccuagaauuucau

SEQ ID NO: 4135544 - RNA, 70 nt, Human
augacccacaaaccuauuggcaagaauaauaaauguuuguuguggcaggucaaugggauuuguguguugu

SEQ ID NO: 4135545 - RNA, 113 nt, Human
augaccgaauauggcagaagugagaggaugucacuuuugagacuagguuauaaaaauacuguggcuucugucuuggugugaucucucucuuucccucugucuuucucucucau

SEQ ID NO: 4135546 - RNA, 68 nt, Human
augaccgggaaccucuuugaaguguguugccccaugaagguuuugcuugaaagggguuucccagugau

SEQ ID NO: 4135547 - RNA, 94 nt, Human
augacuaaugguauugagcaucuuuuuacagguuuaagggccacuugaauaucuucucuugugaaguguuugaauuauuuugccuauuauuuau

SEQ ID NO: 4135548 - RNA, 62 nt, Human
augacuccaguuuaugugaauguuugagggaccccaaacauugcaaauaagcuugcagugau

SEQ ID NO: 4135549 - RNA, 130 nt, Human
augacuccuccccaacuucuccuaguuauuuucaguuagcuuguuucuccugaucuuucaaaaagaaggaaucaggagaugagcacgguggauagaagggggaaauuuaagugggagaggauuuauauuu

SEQ ID NO: 4135550 - RNA, 76 nt, Human
augacuggggguagguugcuuaacuucuguuuccuuaucuaugaaauauccauaagcacaucuauguccuagugau

SEQ ID NO: 4135551 - RNA, 89 nt, Human
augacugugaaucugcuugcaggcuggcccuuccuagauucugaaccguuuguagagaguccuuaguuugcagguagccccaaaguuau

SEQ ID NO: 4135552 - RNA, 57 nt, Human
augagaaaguuguuugagucccuuuugaaaccaaaugucuuauacagauuuucucau

SEQ ID NO: 4135553 - RNA, 74 nt, Human
augagaacauucuggaugucugaugagagcuuuugaaauuucugcucuuauucaaauauaagaauaagaaacau

SEQ ID NO: 4135554 - RNA, 69 nt, Human
augagaaggacauaaauuauagaggucuaggaacagaaugcaauggacugaacauuugugucccuccau

SEQ ID NO: 4135555 - RNA, 95 nt, Human
augagaaggaggucuucuuugaaucauagugaccaauaggcugaaaggaauugacaugcccaggagcaccccagaucagagaaccuccuuguuau

SEQ ID NO: 4135556 - RNA, 100 nt, Human
augagacuauuuugaaagauaaacaggauuacuggauuaugacauauaugauagauauguugauuaauuugauugugguaaucauuucaaaauguaucau

SEQ ID NO: 4135557 - RNA, 82 nt, Human
augagagagaucaauucuccuggagaaaugccuuauucucaucucuagaaagaagagcauuuggugagauuugacuccucau

SEQ ID NO: 4135558 - RNA, 73 nt, Human
augagagcaacaccuucacuugaaaacugguaagaguuuggugauaguguguugggggagguauuguuuucau

SEQ ID NO: 4135559 - RNA, 58 nt, Human
augagagcucuaugaucuguuugugacucacuucucacagacagauguagcucuacau

SEQ ID NO: 4135560 - RNA, 64 nt, Human
augagagugauagagcaggcccugucacaaacaguuuucaaggcucugcuucuaucacauccgu

SEQ ID NO: 4135561 - RNA, 63 nt, Human
augagaguuuaaaaccagacacuguuucugggaccccugggguucgggagucuggaacuccau

SEQ ID NO: 4135562 - RNA, 64 nt, Human
augagauuuggugggggcagggguagaaugauaugguuuggcuguguccccaccaaaauuucau

SEQ ID NO: 4135563 - RNA, 60 nt, Human
augagcagcauugcuccucuuagaacuccugacuuuugauuugaggaugugauuguucgu

SEQ ID NO: 4135564 - RNA, 65 nt, Human
augagcagccaaguuugagaagcagagcccuacuggagcaaugcuucugcaacuugaauguacau

SEQ ID NO: 4135565 - RNA, 86 nt, Human
augagcauuucauaaaggcuggcugcugugagcauacuaaugugcuaucccagcucccacuuugaugaguaccacguaauguucau

SEQ ID NO: 4135566 - RNA, 61 nt, Human
augagcccuuugcuauucuaauaucucacaacaagacaucucaagaggaagcagggcucau

SEQ ID NO: 4135567 - RNA, 77 nt, Human
augagcuaguuuguccuagguucagaauagagcuauacugauuuauggcucuggauuaaucuaggaacauuagccau

SEQ ID NO: 4135568 - RNA, 86 nt, Human
augagcuuggccaauccucuuucucucccugaaauuugaacuuuaagcagaacuucagggacagaaaagagcuggagccacuucau

SEQ ID NO: 4135569 - RNA, 63 nt, Human
augaggaauggaaugccacuucugauauuagguuacaaagacuguggcuuccaucucucucau

SEQ ID NO: 4135570 - RNA, 89 nt, Human
augaggaauuuggagguuaugcauucucgcagucuggggaucugugauagucacucuguuagguguuuuugagccaccagguuccucau

SEQ ID NO: 4135571 - RNA, 56 nt, Human
augagggaagcucacguguccaccuggcaauugguaggagcaucugguuuccccau

SEQ ID NO: 4135572 - RNA, 55 nt, Human
augagggagucggacuagaugauuccuaagaguccuucccaucugacacccugau

SEQ ID NO: 4135573 - RNA, 67 nt, Human
augaggucaucuugaaguagggugugccccaauccaauaugggguccuccuaagaggauggccacgu

SEQ ID NO: 4135574 - RNA, 90 nt, Human
augaguagaaagaggucuugguuacacagacucuucaauucagagggcaggccccaucgaggggagcugugugcaaaccuugaugcucau

SEQ ID NO: 4135575 - RNA, 85 nt, Human
augaguauuugaugaaauuugggcagguuaaaaauuagaauaagaauauuuaguuuaagccagauuucagcaaaauaucuaccau

SEQ ID NO: 4135576 - RNA, 109 nt, Human
auuccugcauuucucuggaguuuugaccauuugaaaugagaaaccugucagaugaugcugaguauucugaauuucaaacucuauuagauuuccaggggagugcaguaau

SEQ ID NO: 4135577 - RNA, 61 nt, Human
auuccuuggcauucuggacuugccugaucuucagcagagcagguuccagcagccagagaau

SEQ ID NO: 4135578 - RNA, 77 nt, Human
auucggccugggcaccaggcaugacagggcaggugccgaaucacccuccgugugauaguguggugcccuggcuuagu

SEQ ID NO: 4135579 - RNA, 72 nt, Human
auucguuuacuuaucuguucugccauuggacccuaagcuuuauaauggcagaauccauaguaggugccgaau

SEQ ID NO: 4135580 - RNA, 56 nt, Human
auucuacgguagaacgugggguacugugugugcacauagacacacuuacguggaau

SEQ ID NO: 4135581 - RNA, 75 nt, Human
auucuacuugauacuacaaugauuccuuaguagaauuuucucacuuuagaggaaacauugaguugauaaaggaau

SEQ ID NO: 4135582 - RNA, 61 nt, Human
auucuagaugcuguaaguagcaauaauaaaagaggaagcaaacacgugcagcuucuggaau

SEQ ID NO: 4135583 - RNA, 68 nt, Human
auucuagccauuguauucuuccuguuuugccugaaacaauaauucaaggagaauacaugugcugugau

SEQ ID NO: 4135584 - RNA, 74 nt, Human
auucuaucucuauauuucugcaaaaaauuucuacaugacaaaaaaguggacucuaggaguguggaagguggaau

SEQ ID NO: 4135585 - RNA, 87 nt, Human
auucucagaaagucccagucuuagacagaagaguuauuuuauaauauaaaauaaugacauucuuagacuggauuuuauuuugggagu

SEQ ID NO: 4135586 - RNA, 85 nt, Human
auucucaguaaucaaucuguuuaacagauuucuguuuauuuucaaauguaccuaacagaaauugggcaaauggaaggaugagaau

SEQ ID NO: 4135587 - RNA, 61 nt, Human
auucuccauauuugcaauguagaaauaacuguagcuaccuugugcaaaugcuguugagaau

SEQ ID NO: 4135588 - RNA, 76 nt, Human
auucucucacagugagcugggcaucaguuuccucauaugagaagucugucuggauagccacagugaaucugggaau

SEQ ID NO: 4135589 - RNA, 58 nt, Human
auucugaagauuggguuuguuuuguauauuuuuguacaguaaucccguucuucugagu

SEQ ID NO: 4135590 - RNA, 77 nt, Human
auucugagucacuguccaccugcauacagaacagagagccaucucaguagcaggauuugggauuauugauucugaau

SEQ ID NO: 4135591 - RNA, 77 nt, Human
auucugauauauuccauuuuuauugguuccccucaaaaauaaauuaggaugagcuauauagaugguguguuuggaau

SEQ ID NO: 4135592 - RNA, 84 nt, Human
auucugaugcaggcucugggacccucucgcuguuccguagaggggagcuguugucucagagcuucagaaagcacccaucagaau

SEQ ID NO: 4135593 - RNA, 57 nt, Human
auucugcagagaucuugaaucuggaaggaagaguagaaagcaaguugacugcagaau

SEQ ID NO: 4135594 - RNA, 71 nt, Human
auucuggccuuuuugcuuuuaggaaauuagaaagucuccuucuuuuccuauaugcaaagaaugcaaaggau

SEQ ID NO: 4135595 - RNA, 57 nt, Human
auucuggcuuccucaggggcugaacuugucuaccucagccugagcuauugccaggau

SEQ ID NO: 4135596 - RNA, 79 nt, Human
auucuguccaagaagauuaaugagaaaccugcuggggcucucaggaagaguuucuucauugauuuacaaaaggcaugau

SEQ ID NO: 4135597 - RNA, 109 nt, Human
auucuguguauagaaugccgagcacagugcucaugugacauggugggaggcaaguaacauuuacuggcugucuaugauacuguugggcccugcaugagaugcacaggau

SEQ ID NO: 4135598 - RNA, 129 nt, Human
auucuuaacuggccaccugugucacaggucaccuauguggcaugcagggcuagguggacugcaggccugucugcccucugccuccucugcagauggguggguggccugugacuguaguccuucccucgu

SEQ ID NO: 4135599 - RNA, 65 nt, Human
auucuuaagcaccuaaaaaguggcaggcguacauggggucuccauuuuuaaagagcuuaaguaau

SEQ ID NO: 4135600 - RNA, 65 nt, Human
auucuuaaguguuuuugggcuagugcccauuccauuguuuuugcccagagaggcucaccaggaau

SEQ ID NO: 4135601 - RNA, 60 nt, Human
auucuuauucuugaaaugugggacucuaaaauuaaggguccuaguuuuuaaggugggaau

SEQ ID NO: 4135602 - RNA, 112 nt, Human
auucuuguuccuuuaacagccuuagacacugauguucagcucaauggacagcuucuucacacagccuacugagcugaacaucggugucuaaggcuguuaagguaacaagaau

SEQ ID NO: 4135603 - RNA, 57 nt, Human
auucuuuaaauuagccuuugaggauugguuuuccaagagagggcucauuugaacaau

SEQ ID NO: 4135604 - RNA, 81 nt, Human
auucuuuaaugcuagucuaaugaugacacuguuuuguuuauuagaacauguauuuuccuuggcaacuaguuuuuguugggu

SEQ ID NO: 4135605 - RNA, 61 nt, Human
auucuuuuguccuagcuugauaguuuagcaaacuggagcagcaggaaaugggccaaagagu

SEQ ID NO: 4135606 - RNA, 55 nt, Human
auugaaaaaugacuauugcuuaaguuuguuuucuuaagcugaguguuuuuuuaau

SEQ ID NO: 4135607 - RNA, 61 nt, Human
auugaaauggggauguugcggauggagguaacucaugccacagguguuucaucuucucagu

SEQ ID NO: 4135608 - RNA, 80 nt, Human
auugaagguggguaggcaaagcaaugacguucagcagguuaggagucuuaaacgcauuuuugacuuacgauauuuucaau

SEQ ID NO: 4135609 - RNA, 74 nt, Human
auugaauaguagcucuguuuuaaguuauuugagaaaucuuuaaacugcuuuccacaguggcuaaacuaauugau

SEQ ID NO: 4135610 - RNA, 56 nt, Human
auugacacaaugggauguaagggaguuucuagcuguaccauccuauugugcacaau

SEQ ID NO: 4135611 - RNA, 66 nt, Human
auugacagcaggggcugucacugcuggggucucagugccaggggugucagugcugcggacgucaau

SEQ ID NO: 4135612 - RNA, 63 nt, Human
auugagagacaccuugaccuuuuuacacaucuguccuagacaaugucaaggugaucauccagu

SEQ ID NO: 4135613 - RNA, 65 nt, Human
auugagcuaaauagaucaagggacucuaauacuacuuagaguaauggguugaaauuuaguucaau

SEQ ID NO: 4135614 - RNA, 77 nt, Human
auugaguauacacguacuugugaaaccugcaucuguucauaaagcaccugccugugucacagugauguuugcugagu

SEQ ID NO: 4135615 - RNA, 79 nt, Human
auugaucagauuggcugcuauuuccauauuuauuacaaggagacaagaguagaaauggggaaguaguuaggagagaggu

SEQ ID NO: 4135616 - RNA, 130 nt, Human
auugaucuuacuuggagaaugcuucuuaggauuuuugcuugcauuggaguagauaguucaagauauggauaugaauucauuuuuccaauuaggauaaagaucaagaaaaacaauucugggaagucaaauu

SEQ ID NO: 4135617 - RNA, 70 nt, Human
auugauggaaggaagcagcagaaauugccugagaauucuucauggauaaugucucuguuucccccacaau

SEQ ID NO: 4135618 - RNA, 72 nt, Human
auugauuucaaguagugacaugcugaaguuguugaaucauauagaaaaguuaaaguucuacuugagaugaau

SEQ ID NO: 4135619 - RNA, 82 nt, Human
auugauuuguagcuaaaauauguuuacauguauucuauccauaugagcaaaauacaguaauugcauaggcuucaaagguaau

SEQ ID NO: 4135620 - RNA, 79 nt, Human
auugcaaugcauugcaaaucucuuguguuugguugcaaacuuucaacugaaacacugagugaauuguugccucugcaau

SEQ ID NO: 4135621 - RNA, 64 nt, Human
auugcaccuuggguuuugaaaggauucuuauauccuaaaucuauuugaaaaugcauugugcagu

SEQ ID NO: 4135622 - RNA, 86 nt, Human
auugcauuuuauaauuaucucuacucuuagggucauaugucuauuguguguguaugugugguggaaauaauauauacucuugcaau

SEQ ID NO: 4135623 - RNA, 61 nt, Human
auugccaaggguaugggcaagauagcuugaguccagcuacuuugcauuacaaccuggugau

SEQ ID NO: 4135624 - RNA, 65 nt, Human
auugccaaggucucuaaauuguuaagaaauaauaaagaauuaauaguuggaggcaguuuggcaau

SEQ ID NO: 4135625 - RNA, 67 nt, Human
auugccaauuaacacugaguauuaugugauaacacacacagcaaaaugcuuagguuaaauuuguaau

SEQ ID NO: 4135626 - RNA, 91 nt, Human
auugccauuauuguuguuguuauuuuaaaugaggaaauugaaguucagaaaaauuguauagcuucuuaaagauuacacaaugaaaggcaau

SEQ ID NO: 4135627 - RNA, 76 nt, Human
auugcguggcuggucccugugacccuguuaagccuuauguuuuacuuaacucggaagcacgaaccaaccacccagu

SEQ ID NO: 4135628 - RNA, 77 nt, Human
auugcuagaaaagauaacauucugugccuucauuugucauguucauuugagcaauaauguuacuuuuuuaaggcagu

SEQ ID NO: 4135629 - RNA, 74 nt, Human
auugcucucaggaaaauauugaagaagugguauuuauauuauacauuucauaaaaacuuuaccugagguguaau

SEQ ID NO: 4135630 - RNA, 108 nt, Human
auugcuggcgggacuauaaauugauauaggcuucaugacagaggggcaauuugguguuccucucaaaaagcauguauccuuugacccagggguucugauucuagcaau

SEQ ID NO: 4135631 - RNA, 67 nt, Human
auugcugugucuggggcagaugcacaccccugaccuugacgcgugucugacagcuccaggcagcaau

SEQ ID NO: 4135632 - RNA, 65 nt, Human
auugcuuagacacuuguuaguuucaccugcauauguaagguggaguuggcuguaguucaagcaau

SEQ ID NO: 4135633 - RNA, 75 nt, Human
auugcuugagcccaggaggucaaggcugcaguggguuaugacugugccacugcacuccaaccugggcaaugcagu

SEQ ID NO: 4135634 - RNA, 70 nt, Human
auuggaacagaaacagacaaauagaaugaaaaagauaaugaguucuguuugggaccuguuguguuucaau

SEQ ID NO: 4135635 - RNA, 55 nt, Human
auuggcaaacucuggccugugugccaaaucuggcccacuacuuguuuuugucaau

SEQ ID NO: 4135636 - RNA, 57 nt, Human
auuggcagggccagcaucucccugcagcugagaggguuagcucaggcccuagucagu

SEQ ID NO: 4135637 - RNA, 59 nt, Human
auuggcauccuagugagagaugcuaguuuuuggaacugagcaaugcagugggagcgaau

SEQ ID NO: 4135638 - RNA, 61 nt, Human
auuggcuuaucaucuaaggcccuuucaugauuaaugagagagggaaagaaaaugagcuaau

SEQ ID NO: 4135639 - RNA, 58 nt, Human
auugggagaggggugagagaugggaagagggugcuuuccccucaccauucugcccaau

SEQ ID NO: 4135640 - RNA, 76 nt, Human
auugggcagaucaaucaacuucuuagugccucagcuuuuuccucuguaaauuagaagauagugauuucugcuugau

SEQ ID NO: 4135641 - RNA, 130 nt, Human
auuggggcauguuauugggaggagguuggggggauuuuugguuauguuaaauguuugauguuuaaauuguugcauguugaauucaaacuuuuuaacaaguccuugauguuucaauuugaaagugaccaau

SEQ ID NO: 4135642 - RNA, 80 nt, Human
auuggucuuuucuggccuucagacucggacugaaacacugacucuucuugggugugaagucuguuggccuugggacuggu

SEQ ID NO: 4135643 - RNA, 69 nt, Human
auuggugugccagagcugacauguaaaggcuugcaagagccaauuguguacaucucuucucacauuggu

SEQ ID NO: 4135644 - RNA, 99 nt, Human
auuguaaucuauauguauguaugugugguuauaguuuuuuauaugugugugcaguucuuggcacguguaaugaucaccacaaucagaauauagaacagu

SEQ ID NO: 4135645 - RNA, 61 nt, Human
auuguauauauacauguuccuucauagcauuaggcugugaaggaauguguauauauacaau

SEQ ID NO: 4135646 - RNA, 65 nt, Human
aguucuuacaucuauaaaguuggggauaauaacaaugccuucuucauagagagauggugagaauu

SEQ ID NO: 4135647 - RNA, 59 nt, Human
aguucuucauaaccuuacugugcauguccuucugagauaagggagguaaugaagcaacu

SEQ ID NO: 4135648 - RNA, 97 nt, Human
aguucuuguuuuguugcucaaugggaauaagaaugaugcaguagaguagaaaaauggauuauucaggagccaauuggcaacagagacacaaauaacu

SEQ ID NO: 4135649 - RNA, 127 nt, Human
aguucuuuuuaaaaaacacuguucaaggcaagcacagauagacucagcccauagauacccaagcugcaacuucuggcuuauagucauucuguuuuuaauuugucaguuaguuucaauuauuaggacu

SEQ ID NO: 4135650 - RNA, 120 nt, Human
aguugaaaaccacaccuuuuuaagaaguucagaaauugaggaugcgguauucugaauuaucuaauuugauuuuucugcaucucuacaguuguuucauuacuuaguaaagcguuuccaacu

SEQ ID NO: 4135651 - RNA, 72 nt, Human
aguugaaagccuuauuucucugagcacauuucccuuuaaucacugugcuuuccagagacccaggcuucagcu

SEQ ID NO: 4135652 - RNA, 72 nt, Human
aguugaaauugucuuuaucacaguucaaaaauaguuaaauaguugaggcugcugauggugaggacaaaaacu

SEQ ID NO: 4135653 - RNA, 66 nt, Human
aguugaacacuaaguuuccaggcugaguuucacccauggggcuuuugguguaguugucauucaacu

SEQ ID NO: 4135654 - RNA, 65 nt, Human
aguugaagcuuggugggaaauggaacuccugugugaggaccauugaaccccucuaggccacaccu

SEQ ID NO: 4135655 - RNA, 56 nt, Human
aguugacaauaaauuuaauuggccauuuauuugggccaauuaaauaaaugucagcu

SEQ ID NO: 4135656 - RNA, 73 nt, Human
aguugaguuacagaugguuaacucccacuuguaugucccgugcuggugaaguaauaccagguguacaucaacu

SEQ ID NO: 4135657 - RNA, 83 nt, Human
aguugaugacugcuugucuagaauaucccagccuuuccuggauaacuccucccuguuauucaagacaaaggcagucaucaucu

SEQ ID NO: 4135658 - RNA, 73 nt, Human
aguugauuuucauagugacccacaguauacagagaaaaagguauauacacaggaaucugugaaaauuauggcu

SEQ ID NO: 4135659 - RNA, 67 nt, Human
aguugcaagcaggugggcagauauuacaauaggagcuuguagaauuauucucucaauugcuucaauu

SEQ ID NO: 4135660 - RNA, 82 nt, Human
aguugccuguguacuuuggguugggugggaagguauugugaaaacaaaacuucauuuucaacugcaaaauuuauggguaauu

SEQ ID NO: 4135661 - RNA, 130 nt, Human
aguugcgaacagcuguaucagagaucaggcggggucacugcacgcucaggcaggccgcguggauuugucugcuggucccugcagugugcugggcgggacacuccuugaucucuccaugcugucaccgggu

SEQ ID NO: 4135662 - RNA, 88 nt, Human
aguugcuguguuauuacuucagaucuuuguuaauagaugcucaugcaaucgaguguaugcaucuuugauaaauaguugcaaagccucu

SEQ ID NO: 4135663 - RNA, 61 nt, Human
aguugcuuuggauauaacuucuccugaggagaaaccugaaguuaguuucaauaaagcaauu

SEQ ID NO: 4135664 - RNA, 124 nt, Human
aguuggacauauuucaaaguaguacaaacauuaggaacuagggaguaugcuuucuguggaggcagagagcaacuucaauaguacuauuuuuuugucccacuaaguaacugaaauuauguucacu

SEQ ID NO: 4135665 - RNA, 78 nt, Human
aguuggauuuggacugugaacaauuugcugaaauuaugacauuauuuuuuaaaaaauuagaccaguucagguccaauu

SEQ ID NO: 4135666 - RNA, 58 nt, Human
aguuggcaggcugcaccaaccagccucuuagggcagaaugggccugagccugugggcu

SEQ ID NO: 4135667 - RNA, 63 nt, Human
aguuggucuggggaccuucccaagagacaucuuguucucccaggagggcagcccagacuggcu

SEQ ID NO: 4135668 - RNA, 62 nt, Human
aguuggugcuuuagcugaguuggucaaauaccaauauuaugacuuuagguaaagaaccaacu

SEQ ID NO: 4135669 - RNA, 82 nt, Human
aguuguaucaguccuugaagaaugauucuuggaaauguuaucaaauuaucugggaagauguuucaaagguccuaugccaauu

SEQ ID NO: 4135670 - RNA, 90 nt, Human
aguuguggagaaagcuuacauuaaguaagagauugaacugaaugaccucuaaauuucauuucagugcuaauguaauaugcuucuaugacu

SEQ ID NO: 4135671 - RNA, 57 nt, Human
aguugugucugacuaucugagaaaggaugaauuuacacauucagcagcagacacacu

SEQ ID NO: 4135672 - RNA, 130 nt, Human
aguuguguuugauucccaagcccaagauauugccgucugucaacauuaucaugcuucuuuacuuuaauaagaguaaacaggcaugauaguguugaaugacaaagcucccuaguggcuuccuuacaccccu

SEQ ID NO: 4135673 - RNA, 74 nt, Human
aguuguuaaaauuacaaauuuacaaguaagcuacaaaaaguaugcuugucuucaggauuaugguuuuaauaauu

SEQ ID NO: 4135674 - RNA, 72 nt, Human
aguuguugcuucugcugguguuuugugaggcugcaaagaaacccucacaaaauaucagcagaagcaacaacu

SEQ ID NO: 4135675 - RNA, 80 nt, Human
aguuguugugccauugagagguuucagaucuccuagcauaauuugauugcuguuucugcccuacuuaggugauagcaucu

SEQ ID NO: 4135676 - RNA, 92 nt, Human
aguuuaaauugauuuuaguuuuacuugcgaugauaauuucugccugagcaaggaauaucuucuaaggauagaacuggaugcuaauuuaaauu

SEQ ID NO: 4135677 - RNA, 58 nt, Human
aguuuaacuggccaugcccucaauuuucaguauagaagcaugguucacaguuaguacu

SEQ ID NO: 4135678 - RNA, 76 nt, Human
aguuuaccuacauaguuaaguaacaaacucaagaaaugaauuuggcaauuugacuguauaggccauugaaugaacu

SEQ ID NO: 4135679 - RNA, 68 nt, Human
aguuuacuuguaaacauagagauuuagguuggaguuccauuuauuguccucuguguuuacaguuuucu

SEQ ID NO: 4135680 - RNA, 59 nt, Human
aguuuagccuuccauuucacuggauaagcauaugacccuagaugagauggaagaagacu

SEQ ID NO: 4135681 - RNA, 66 nt, Human
aguuuaggaaggaugaacugaguuugccuugcacugagucacuagacaguuuaucuuuccggagcu

SEQ ID NO: 4135682 - RNA, 65 nt, Human
aguuuauaggagggagaaaucaaaaguacaaccuuacuuuuugcuggucucuuccauccucugcu

SEQ ID NO: 4135683 - RNA, 101 nt, Human
aguuuaucaaugaaaaugaacuugaugccugagcuauaauugaaaucuuuauagcgucucugcuguuuguccauuguguuacagagcauucauugaaaacu

SEQ ID NO: 4135684 - RNA, 58 nt, Human
aguuuauguuguuuauaagccauccaguuuacaguguuugguuauagcagccugaacu

SEQ ID NO: 4135685 - RNA, 70 nt, Human
aguuuauuuauaucauauuuuauauagaugcuuuggcauuuugcuuuaaaguguggauaugauuaguauu

SEQ ID NO: 4135686 - RNA, 81 nt, Human
aguuucuagugcugaggccaaugucagggugucucaucuucauaucucucaggcacugauccuuccucaccaucagacacu

SEQ ID NO: 4135687 - RNA, 130 nt, Human
aguuugaaagaaucagaaugcuauugguaaugaugaaauguugaggcagugacuuggacuuggauaaagcuucuucauuuuuucaacauauuuaagauuaagugguuguagaauauugucuuucuuugcu

SEQ ID NO: 4135688 - RNA, 83 nt, Human
aguuugagcuaggcagaggcuauggaaauggcaggacauccagcagagaugaccugcagccauagugcugucagaggcaugcu

SEQ ID NO: 4135689 - RNA, 89 nt, Human
aguuugccuuaauuuuucuucugcuuucuuacuaaaaaugaagacauucaauacuaaucuugcuggaagaagccuuaaccaagcaaacu

SEQ ID NO: 4135690 - RNA, 81 nt, Human
aguuuguuagcaacaagucucaaugacucuuucacauaagaaagaaaugcaaugucuuugaaacauuguaugcuucugacu

SEQ ID NO: 4135691 - RNA, 127 nt, Human
aguuuuacuugaaauauuuguaaauugguuuguuacaagucuugagguacuuucacagcuugaguggaagccuugccuauuugaugacauacuaacguuaccaacugaacaugucccaaauagaacu

SEQ ID NO: 4135692 - RNA, 65 nt, Human
aguuuuagaucauuguggauguuauacuagggccauggaaaaugccuguucacagaucuguaacu

SEQ ID NO: 4135693 - RNA, 71 nt, Human
aguuuuaugcaguguucugauauguuauacucauuuugcuucuaaaaccuucuagaauccuguauaagacu

SEQ ID NO: 4135694 - RNA, 71 nt, Human
aguuuuaugcaguguucugauauguuauauucauuuugcuucuaaaaccuucuagaauccuguauaagacu

SEQ ID NO: 4135695 - RNA, 67 nt, Human
aguuuuauuggaagagagccacaguuaauuauuuacacauuggcaguguuuucuguuccauaacacu

SEQ ID NO: 4135696 - RNA, 79 nt, Human
aguuuucagaaucuuaagacauuacuuccacuaacuuuaacucaggggagagaauucagcuuaagauuaucugacuacu

SEQ ID NO: 4135697 - RNA, 67 nt, Human
aguuuuccaguacuuuuauguuuuuauugaugaaacaguaggaacauaugcagugcuuuuuaauacu

SEQ ID NO: 4135698 - RNA, 59 nt, Human
aguuuugauugcccuaagcuaucuacuacgcugagauugagacuuaggcaauuuaggcu

SEQ ID NO: 4135699 - RNA, 66 nt, Human
aguuuuuaugucugugaauuggcaagcauuuucuucugcucugcuuucauugugggcauuugaauu

SEQ ID NO: 4135700 - RNA, 95 nt, Human
aguuuuuauuagguugaugcaaaaguaauugcaguuucugccauuacuuuuaguggcaaaaaacagcaauuacuuuugcaccaacuuaaauagcu

SEQ ID NO: 4135701 - RNA, 76 nt, Human
aguuuuugccuggguagacuuugaagcauucuguaaaccuuuuaaagaaaggagugccuuugaaaccucaaaaacu

SEQ ID NO: 4135702 - RNA, 63 nt, Human
aguuuuuuucccuaacuuuccugauuguuuuggaagggagcagggaauagcggaaagaauacu

SEQ ID NO: 4135703 - RNA, 122 nt, Human
auaaaauaguaauuugauaaggcaagcuuuucauuuugugaaguaauuuguucauuauauauuuggcuuaaagauagaauuacauaauaaaaugagagcuagaucagaaauuaacauuuuau

SEQ ID NO: 4135704 - RNA, 71 nt, Human
auaaaaugguagguuuucuuaagaaaaaggauguuauuccugguucucagauggaaaaccuuucagauugu

SEQ ID NO: 4135705 - RNA, 129 nt, Human
auaaacagcuguggcuagagcaagaaggugaccgggagggagggauaggauacagauaggucaagaaagagacagugaauccaaauuccuaccagaugcuuauuuuuuccucaaaguuaagcuguuucu

SEQ ID NO: 4135706 - RNA, 56 nt, Human
auaaaggcagauuuuggaccucugguuguuuccugaacucuagaaauugucuuugu

SEQ ID NO: 4135707 - RNA, 96 nt, Human
auaaauacaguuucugcauugcaccacauugcaucccuggggggcuacagggauguucauuuuguggcugaaauaggauaaaaggguuguauuuau

SEQ ID NO: 4135708 - RNA, 88 nt, Human
auaaaugaaacauauaaugauagauauaguuugccucacacuuucuuuauauuggggaauuguacuuuuauuacauguaguuauaugu

SEQ ID NO: 4135709 - RNA, 102 nt, Human
auaaauggaacagguggauuucaucacauacauugugcaucucaugguucuaaggugcuaaaaugauugccugugugugagaaaugccuugcuaagauuuau

SEQ ID NO: 4135710 - RNA, 67 nt, Human
auaaauugcuucuacacaucccucuugcuuuuuaauggaaagaaaagggguggaguagaucucuuau

SEQ ID NO: 4135711 - RNA, 69 nt, Human
auaacuacuacaugcuagacucaguuaacaaucucuauuaacagaguaacagguauguaaaaugguugu

SEQ ID NO: 4135712 - RNA, 76 nt, Human
auuguaucuugucauuaugcauaaaaggccauauuuuucccuaguucuugaugcagaucugugaaaggaauacaau

SEQ ID NO: 4135713 - RNA, 73 nt, Human
auuguaugauuuuuuugucccagagagccuggauuaauagaaguccaguuucuaucaggcaauuaucaacagu

SEQ ID NO: 4135714 - RNA, 82 nt, Human
auugucacuauuucucauaagacuuucccucaucagaacgaacgccucuuugcuaggugaaagucuuuuggguucugucagu

SEQ ID NO: 4135715 - RNA, 71 nt, Human
auugucauccaagaaaugcagugacauuucauuuccagaggaaagaaaccucacagcaauucugaagcaau

SEQ ID NO: 4135716 - RNA, 85 nt, Human
auugucuaaauugacuuucuagacuguccagaugaucgcucaagccucugaauuauugacaguuuagaugugaguuuaugauaau

SEQ ID NO: 4135717 - RNA, 60 nt, Human
auugucugauuccauuuaugugaaauguccacaauaggcacaucuauggagacagagagu

SEQ ID NO: 4135718 - RNA, 87 nt, Human
auugucuguuggcauuuuucugagaauaugagaggaaaacaagauucccuugaaaacauaguucagaaaaaguccguacuugacaau

SEQ ID NO: 4135719 - RNA, 61 nt, Human
auugucuuagucagcucggacugcuauaacaaaauaucauagacuggguggcugaaacaau

SEQ ID NO: 4135720 - RNA, 55 nt, Human
auugucuuggaaccaaggucuuugucaguauggugaugaacgauuucaggacaau

SEQ ID NO: 4135721 - RNA, 64 nt, Human
auugugaauaaugccgcaauaaacauacgugugcaugugucuuuauagcagcaugauuuauagu

SEQ ID NO: 4135722 - RNA, 69 nt, Human
auugugaauuuaacugagaguacuuuuaaaacuauaacuaagcagugaaaggaaaguugaauugacagu

SEQ ID NO: 4135723 - RNA, 64 nt, Human
auugugaguagugccacaauaaacauaugugugcaugugucuuuauagcagcaugauuuacaau

SEQ ID NO: 4135724 - RNA, 78 nt, Human
auuguggcugucuaggaaaguuuaguacuuuuucucuuuaaggcaaaaacugguaacuauuccccagauuaacacaau

SEQ ID NO: 4135725 - RNA, 75 nt, Human
auuguguaucaaucauguaauuuggugguggugggaagacugacccuacacuaaacugcacagaugggucauaau

SEQ ID NO: 4135726 - RNA, 113 nt, Human
auuguguuucaggagagaaggcauucaagagucucccugugggguccgccuguccggccccaucagcgggguggccaggccccacagggcuguguucucuuuccuaagccaau

SEQ ID NO: 4135727 - RNA, 78 nt, Human
auuguuagaaagauccuucuggcugccuccuuguggagaguggcuuggagggggccagauggggacugaucagacagu

SEQ ID NO: 4135728 - RNA, 93 nt, Human
auuguuagguuguuccacccacugccgauguuccaucuugucccaggaaugcucaggauggcaggauaggcagggaacagccauucauacagu

SEQ ID NO: 4135729 - RNA, 81 nt, Human
auuguucaagaaugauacucuaugccaaauuggaguaugaaccauccauuugggaauaggguaucaucgucuuguaauggu

SEQ ID NO: 4135730 - RNA, 74 nt, Human
auuguucagagaagggaagaauaaaaagccucauuaagccaucauuuugggguagaauucucuuccuggauagu

SEQ ID NO: 4135731 - RNA, 72 nt, Human
auuguugaucuucugguaagccugugugaagauacaaaagcaaaggguccaacauaugagaagauuagcaau

SEQ ID NO: 4135732 - RNA, 57 nt, Human
auuguugcuaggauucaaugaguuaacacacacauagaacagcuccuagcacauaau

SEQ ID NO: 4135733 - RNA, 63 nt, Human
auuguuuuuggagagggcuuggcacuagguagaaauuuaauaaaaguuuucuccaaauacagu

SEQ ID NO: 4135734 - RNA, 91 nt, Human
auuuaaacaaaaagaguuuggugaagcaauuugaaaaacauguaaauauuuuuauuaguguuaaauuugccuagauucuaguugauuaaau

SEQ ID NO: 4135735 - RNA, 130 nt, Human
auuuaauguguauauuuaucacucugggaucuuguucaaugaaagauugugauucaauauguuuggaguagcgucugaaaugcuguguuucuaacaggcucccagguauacugauacugcgcuauuaaau

SEQ ID NO: 4135736 - RNA, 71 nt, Human
auuuaauguucaguaucugguccaccugcugcugugcaugagcugcggugaucugacacugaucaugaaau

SEQ ID NO: 4135737 - RNA, 84 nt, Human
auuuaauucauggguguguguguguguacguguguguguguguguguguguguguuuucaugcacacaagcuuauguauuagau

SEQ ID NO: 4135738 - RNA, 72 nt, Human
auuuaauuuucucaacagugcuaccaggugaguacucuuuucccauacauuuuacugaugagaaaauugagu

SEQ ID NO: 4135739 - RNA, 68 nt, Human
auuuaccugaaagguuaauuuccaguuagccuucaggagcuaguuggaaacuagccuuuuagguugau

SEQ ID NO: 4135740 - RNA, 91 nt, Human
auuuacuuagauuguugcauaucugguugauuuaaauaaacauggucuuucuucauuuaaaugaacgagauaugcaacaaucuaaguaaau

SEQ ID NO: 4135741 - RNA, 57 nt, Human
auuuagacaaucuguugguaagguguaaacuauggaccugccaugaaugucauaaau

SEQ ID NO: 4135742 - RNA, 69 nt, Human
auuuagcagcagugguguauuuagauacuuccccacuuguggaagucugauuagcuccauuugcuaagu

SEQ ID NO: 4135743 - RNA, 64 nt, Human
auuuagccaaaaaguagcaauuauuagaaaaauuacuuguaaaauuguacuuuuguggcuuugu

SEQ ID NO: 4135744 - RNA, 90 nt, Human
auuuagccgcauauggagugcugguuaauuucugguacuugauaaaugacuacugaaggaauuaauaaccaguaagccaacugguuauuu

SEQ ID NO: 4135745 - RNA, 116 nt, Human
auuuagcuucugucuucccuugggagguacaaaaggagaaagauaaaugacaucagacuuccuggaaaaauauaccucauucuuugagugcuuuuuaggugagaaguuaguugaau

SEQ ID NO: 4135746 - RNA, 64 nt, Human
auuuaguaaguacuuguugaauagaugaaugaagucauaugauuaacucaaguauuuacugagu

SEQ ID NO: 4135747 - RNA, 100 nt, Human
auuuauauuguaagcagcaguucaauuguuuuguaaaaguaauuucaauuuuaaucacugaacuaaagaaaugggcaaggcugacuuccguaauauaggu

SEQ ID NO: 4135748 - RNA, 98 nt, Human
auuuaucagcaccagauauugucuucaaaguguaggauuggaauuucugucuuuauuccaauuuuauacuuugaagacaauaucuggagcugauaaau

SEQ ID NO: 4135749 - RNA, 55 nt, Human
auuuaucucuggaaacuaagcaaacaggaauuccugauucugauccagaaugaau

SEQ ID NO: 4135750 - RNA, 129 nt, Human
auuuauguuuauguuaaaauuuagaauuugcuucauguaguuuuaaauacuguagauaauagaguuccgaugugucaaacuuugauuuuaguguuuuuagcgaaauguuuucuuugacuugcauaauau

SEQ ID NO: 4135751 - RNA, 60 nt, Human
auuuauucuacagauaaguuaguuugcagaaugcccacugauacaucuguggaaguggau

SEQ ID NO: 4135752 - RNA, 79 nt, Human
auuucacacauacuuuuugugaguagcuguaaaugaugaagcauggaaauuucacagaacucacuaaggagugugaaau

SEQ ID NO: 4135753 - RNA, 79 nt, Human
auuucagagcaguuauuucucuuuugagggauugaauuucuuucugguuugucuugggaggauguauguguucagaaau

SEQ ID NO: 4135754 - RNA, 55 nt, Human
auuucaguaguccuuacuuguacccuacuuggucuugaguaagugcugcuggagu

SEQ ID NO: 4135755 - RNA, 59 nt, Human
auuucauuauucagcaaacgcagaaacuuaagauuuucugcuguuuguaguaauguagu

SEQ ID NO: 4135756 - RNA, 58 nt, Human
auuucauuggcccaaacuagucuuauggcucugccuaacuggaagugggucaggaagu

SEQ ID NO: 4135757 - RNA, 60 nt, Human
auuucauuguuagcucuguccucuccacuugcauuucaggccagagcaguacaaugaggu

SEQ ID NO: 4135758 - RNA, 73 nt, Human
auuucauuuaauccucauggugaccccugauggaggacuguuaucuacccuucacagaugaggaaaaugaagu

SEQ ID NO: 4135759 - RNA, 55 nt, Human
auuuccgggauuuuaucaaguaguccauagacauuuuggcaguuucccaggaaau

SEQ ID NO: 4135760 - RNA, 69 nt, Human
auuuccuaacagaggcaacagucuauauaaacacucugaagugagagauugaacugucuuugaagaaau

SEQ ID NO: 4135761 - RNA, 91 nt, Human
auuuccuacaauguugcaucuuccucagagacaguaacuggaauuguuuacaauacuguagauaaacuguaacugaagggugcagggaaau

SEQ ID NO: 4135762 - RNA, 65 nt, Human
auuuccucucuuaucucucugaagagucuccccugauuucccucuuuucagaauugggaggugau

SEQ ID NO: 4135763 - RNA, 69 nt, Human
auuuccugcuuucucuucacugauguucaagugcuggcuuggaaagaccccaaagaggaggaaggaaau

SEQ ID NO: 4135764 - RNA, 58 nt, Human
auuuccuuggaaagagacgucgcuuucauccccaagugcaccgucccuccgaggggau

SEQ ID NO: 4135765 - RNA, 64 nt, Human
auuucgauaggaagugaagaauuagaaaacaccaaaaccuauggcuucauucucuuauuguugu

SEQ ID NO: 4135766 - RNA, 75 nt, Human
auuucuaacauaauuggccaaggaaguagcaacggacacuuugcccugcuuuccuuaggccgaacaccugggaau

SEQ ID NO: 4135767 - RNA, 59 nt, Human
auuucucacccuaccucacuccccaggaauaaggggaaagcagaaguagugugggaaau

SEQ ID NO: 4135768 - RNA, 78 nt, Human
auuucucauuguuagcagagcagcugacagaauaugaucacaaauguugcugaugcuguucuguuaggagguagaaau

SEQ ID NO: 4135769 - RNA, 56 nt, Human
auuucuccuuguugcaaugcaguucaaguacaagaggguucggugcaaggagagau

SEQ ID NO: 4135770 - RNA, 82 nt, Human
auuucucuaagcauccguuugcucaucuacauuggaugauccaucauccaauguagaugagcaaacggaugcuuagagaaau

SEQ ID NO: 4135771 - RNA, 81 nt, Human
auuucucuguuguauucuuuaugacuucccuccagguugagcugugaaagggugaggggaaaggagccaugucggagaagu

SEQ ID NO: 4135772 - RNA, 71 nt, Human
auuucuggcccggacccacucggaucccagccgucguccggcugcauuuccagugcguucgggcuucgagu

SEQ ID NO: 4135773 - RNA, 60 nt, Human
auuucuuccuaucuaguuccuauucauaucaagauagccugagcccaaguagggagaaau

SEQ ID NO: 4135774 - RNA, 57 nt, Human
auuucuuccucugucaguaacuaccucaagcagcuuuggacuacagggggaagaagu

SEQ ID NO: 4135775 - RNA, 81 nt, Human
auuucuucuaaugauucuggcaaauuuauuaugaaaaaacucauggaauuugcaauaacaggaugacaaacugggagaaau

SEQ ID NO: 4135776 - RNA, 79 nt, Human
auuucuucugacaggaaacaugcagugauuaauaaaagcgccuccuugagcacugauuuauuuuugucucugaaggaau

SEQ ID NO: 4135777 - RNA, 55 nt, Human
auuucuuggccaaaggaacagcagaacucucuuaaguaacucuggcuaaguaaau

SEQ ID NO: 4135778 - RNA, 129 nt, Human
auuugaauuacaugggaaccucuuuaaaauacugaugccaggcccucccacagauuaauugcauuugauucucuggggauggggucaggcccccaguauuucuuucaaaguucuccaggugauucuagu

SEQ ID NO: 4135779 - RNA, 90 nt, Human
auuugaccccaauauuucuuacccuuuggcuggccuuguucugugugguaucagagaaccagcugcaggggagcaguggaggaggcagau

SEQ ID NO: 4135780 - RNA, 128 nt, Human
auuugagaugauucuauggcaacagaaaugugcuugagggaaaucaguugcggcaucuucuauaauugugucaccuagauuuugccuuaggaauuucuagauuuccauagaacauugugaccucaaau

SEQ ID NO: 4135781 - RNA, 102 nt, Human
aucuuaguuauugggaauaaaguuggagugaacaugagauugucgaugucuguuugauguaccaauuuucaauuccuucagauauauacccaaaacugagau

SEQ ID NO: 4135782 - RNA, 88 nt, Human
aucuuaguuuaagaugaugauuuaaguggccaaaguagacauauuuaauucuacuuauguaacuaaaaaucaguuuuuaaaugaagau

SEQ ID NO: 4135783 - RNA, 78 nt, Human
aucuuauaugcaaaggcccugaggcaagagagaacuuguccaguucuaggagcuuaaaggaggccaguguguugagau

SEQ ID NO: 4135784 - RNA, 84 nt, Human
aucuucaguacacacagagcagcaggguguaauugggcaggagugcacugcacaaaggcucccugcugaggugguaaaugagau

SEQ ID NO: 4135785 - RNA, 58 nt, Human
aucuuccauauuagacuaugugggggcccacguggccccccagaguugauauaaagau

SEQ ID NO: 4135786 - RNA, 128 nt, Human
aucuuccuucaucgucuucuauucagacaacuugcugcuuucagauucugacauaagauauaccuacaguauguguccagggcuggaagugagguggcuguguucuuagggaaaauggaagaggagau

SEQ ID NO: 4135787 - RNA, 86 nt, Human
aucuucuaaucucaguuguuucugucaaaugccaguagagaacaaucacaucuguuuugacugacagcauagcugacaaggaagau

SEQ ID NO: 4135788 - RNA, 64 nt, Human
aucuugaaugaaugacucuuuauaaaauauggaauuggaacaagggucauucauguuuuaggau

SEQ ID NO: 4135789 - RNA, 64 nt, Human
aucuugcugagacuggcaaguuugaugcuuuccagcuguuccaaaugccuccuucuagcaggau

SEQ ID NO: 4135790 - RNA, 57 nt, Human
aucuugggccccuguaagauggauacaagaaugugcauuuccaaggguaccuaagau

SEQ ID NO: 4135791 - RNA, 94 nt, Human
aucuuuaaucuuaaauaaucauuaguuuagcaaauauuucuguugaugguuuucacuggaacagagcuugcugauaugauuguaaguguaggau

SEQ ID NO: 4135792 - RNA, 73 nt, Human
aucuuuacaaguaaagcuaucaucaaugcaacuuuucuaaaaggagguugaguagauaguucuuuguuuagau

SEQ ID NO: 4135793 - RNA, 61 nt, Human
aucuuuagcaguuuguuucuacugauguguuugauccagugggucccaaacuccuagaggu

SEQ ID NO: 4135794 - RNA, 122 nt, Human
aucuuucucaugcugacuuuaauccagccuaugcuaguuucuuguuggcagagauguuauggcuucuggccaacaaaaacuaagucaguucuagcugguuagugucaugaugucauaaagau

SEQ ID NO: 4135795 - RNA, 104 nt, Human
aucuuucuuucaaauacuuaaugauauuggcauuauauucuguguacaaaauacuuaguugacacaaacaagauauuugcccaguaagaguuagaauggaugau

SEQ ID NO: 4135796 - RNA, 77 nt, Human
aucuuuugcaagaaaaacagcuccacugaaaacuucuuuuuaaguaagccagaauucauugagcuguucuugaggau

SEQ ID NO: 4135797 - RNA, 93 nt, Human
aucuuuuggugagccgguuccucuggacugggaacuucccacacgcuucucagaauuuuccccuuccuaggugggacaggaugaccagaaggu

SEQ ID NO: 4135798 - RNA, 65 nt, Human
augaaaacagacagccaguguagagacaguccguauccuguuucuacuguaugacucugauucau

SEQ ID NO: 4135799 - RNA, 83 nt, Human
augaaaaguccuaacuugagcucucagugcuauuuaugaucucgggaggagggucugaagcugggguucagaaucuuuuacau

SEQ ID NO: 4135800 - RNA, 76 nt, Human
augaaaauauguccucccucuggcuucaguuauaucacugcuaugagacugaauaggaaagagggaauguuuucau

SEQ ID NO: 4135801 - RNA, 84 nt, Human
augaaaauguuccucaaaaauucuaguccacagucuucucucucuguuucgaacaucuguggcauuuagagguugcguuuguau

SEQ ID NO: 4135802 - RNA, 95 nt, Human
augaaagagauguuacccaaaacaagaauaaaaacuguuuaccuagaugcuugguaaacauuuguuauucuuguuuugggaaccauuucuuucau

SEQ ID NO: 4135803 - RNA, 129 nt, Human
augaaagccuuaaaaagucucaaaccauuagcaguuuucauuauauuaugcucaagaaacuuuauucugagggaauauugauagauccgcuaauggauuaugcaaagauacaguuauacgaauguucau

SEQ ID NO: 4135804 - RNA, 61 nt, Human
augaaauucaucugagaaugcugucaacaaacugauaaccuauuucucugguggauguuau

SEQ ID NO: 4135805 - RNA, 60 nt, Human
augaacaaauggaaauaaccagugggaaugaaugauccaucugauuagauccuuugucau

SEQ ID NO: 4135806 - RNA, 61 nt, Human
augaacaagagagggaagauucucaauaagcaagugcuuuuagagccucugcuugugucau

SEQ ID NO: 4135807 - RNA, 61 nt, Human
augaaccuuugggagggugacagucauuaggauggacagauguuacaguccaaauguuugu

SEQ ID NO: 4135808 - RNA, 58 nt, Human
augaacggcucuucacacagugaugucaguuuuugacagauuauugaagggucuuuau

SEQ ID NO: 4135809 - RNA, 76 nt, Human
augaagaccggugguucucuaacuuugacuggaggcuaguggcuaacaguggauuagaggccaaagucucccucau

SEQ ID NO: 4135810 - RNA, 101 nt, Human
augaagauaugaaauuauugaucuuuuauguuauggguaggaucaauguuaaugaacuuuguauccugaugccuggcauguagcaaggauuuuauauucau

SEQ ID NO: 4135811 - RNA, 76 nt, Human
augaagaucuaagaggcaucaagacaagcuucauauuuauaucuugcuucucuuaaugccuggcuuuaaguuucau

SEQ ID NO: 4135812 - RNA, 78 nt, Human
augaagcacaguccugcaggagcaaacugcaguguggacaaaguuuacuucaauaguuugauccugacugugacucau

SEQ ID NO: 4135813 - RNA, 78 nt, Human
augaagcucugagguuuugauggguguagauauagacauccaaagcugucauuucacacuagucagaauaccagucau

SEQ ID NO: 4135814 - RNA, 61 nt, Human
augaagcuucucaacugguggaaugcugccagaggauuucaacagaguuugaaggcaacau

SEQ ID NO: 4135815 - RNA, 67 nt, Human
augaaggacuaucuagggcuucccaaaagaaggggaauuucaaacucuugcccucagaauuuuucau

SEQ ID NO: 4135816 - RNA, 93 nt, Human
augaaggauuauuuguuucauacacugucagauuucgauugcuaauauuuguccugguauucacauuuaugacagugaacgagaauccuuuau

SEQ ID NO: 4135817 - RNA, 74 nt, Human
augaagggauguuaaauauuaucaaaagcuuuuucagugcacauugaaaugauuauaugguguuugcccuuuau

SEQ ID NO: 4135818 - RNA, 96 nt, Human
augaaguugcgugugugcauguuaaugagaaaaagagagcagaccuaaaccucuccccugugugauuuucucaugaacaugccauguaccuuucau

SEQ ID NO: 4135819 - RNA, 106 nt, Human
augaaugaaccaugaggacauuaugcuaaguggaauaagccagucauaaaaagacaaacacugugugauuccacuuauaugggguaccuagaauggucaaguucau

SEQ ID NO: 4135820 - RNA, 82 nt, Human
augaauggugcugucuggaaugcaguacauagucugcaugcaacccugugugcuaaacauauuagauuuguaaaguguucau

SEQ ID NO: 4135821 - RNA, 77 nt, Human
augaauguccauucuauguucagcacugugcuagguguuagggagagggcagugaacauaacacagaagguuuucau

SEQ ID NO: 4135822 - RNA, 55 nt, Human
augacaugaggcaucuuuggagagaagaagcugccacaauccgaugccuccucgu

SEQ ID NO: 4135823 - RNA, 67 nt, Human
augacauuuaaucccuaaauauuugagugugugcuuuuuaccaaguguuguauugaaugaauguuau

SEQ ID NO: 4135824 - RNA, 55 nt, Human
augacauuuauacagugagcuuuuucuaaaugacaagcagauuguuagauguuau

SEQ ID NO: 4135825 - RNA, 63 nt, Human
augaccagacucucagugggguucaugcucuuuaucagcuuucaccaacugcagggcuggcau

SEQ ID NO: 4135826 - RNA, 68 nt, Human
augacccucugaggagaaagguacugacaauccuuuggguacaaagugcucugaucuccuuggguugu

SEQ ID NO: 4135827 - RNA, 111 nt, Human
augaccuauuauaacaauaaucuguuauaauaccuaggcucuuaaucuagcucuaagaugauuguggcuugagccagcuauguagcaagaggaauuguaaaaaugggucau

SEQ ID NO: 4135828 - RNA, 78 nt, Human
augaccuggcaccaucugugugaccaaaaccucugugccugccuagauccuggagcagagaugguggccuucugucau

SEQ ID NO: 4135829 - RNA, 94 nt, Human
augacuauuuuuagcugcauaugagaauaggagaaaguccauacagaaauuuuauacuuucucucuccuccaugugcaagagcaaagaucccau

SEQ ID NO: 4135830 - RNA, 74 nt, Human
augacucugcugaggcacccggaauauggcaccaaacucccuugcuuacgugugcucuucaguuuuagggucau

SEQ ID NO: 4135831 - RNA, 91 nt, Human
augacugaggggugaugcucaacuaucaauaacagcaacaaugucagcuguccuuucuauguguauugagcauuguuaccacuaaugucau

SEQ ID NO: 4135832 - RNA, 73 nt, Human
augacugcauuauuggaacggcugaacuuugacuuauguaucauguuucagcaguuuuaagaauaaaaggaau

SEQ ID NO: 4135833 - RNA, 84 nt, Human
augacugggccuaugaauaacagguggacacagcagcagucuccuucagcacugcuuggugugucccuugauacggcucuucau

SEQ ID NO: 4135834 - RNA, 78 nt, Human
augacuuagucaaaucauucuguuucucucugcuuccaaucaaaacauagagaaauagaaugacuugacuaaggccau

SEQ ID NO: 4135835 - RNA, 88 nt, Human
augagaauucaaaguauguaugugugugguagugauggugggggcacccauuacuuuccaauauaucaguauaacuccuuauucuuau

SEQ ID NO: 4135836 - RNA, 56 nt, Human
augagagucucagagucucuuccugcuggagguuuccguggcucugggugucacau

SEQ ID NO: 4135837 - RNA, 85 nt, Human
augagauaagggaucugccccuagaagcugucuggcugcuuuuugguagagcaggcaugcugcauugaggggcucucuuccucau

SEQ ID NO: 4135838 - RNA, 59 nt, Human
augagauacuacaaaugaguuuccgguuuccggauccaaucaccuuuguugguauucau

SEQ ID NO: 4135839 - RNA, 59 nt, Human
augagauaggggauaccuuaguaucuauuaccauuauacuaaaguaucuccuauuucau

SEQ ID NO: 4135840 - RNA, 61 nt, Human
augagaugugucuaauggaaccuuggaacaugcuguccccaucucacagacaucgucucau

SEQ ID NO: 4135841 - RNA, 66 nt, Human
augagauuuaggaggggccagggaagaaugauauggucuggcuccguguccgcucccaaaucucau

SEQ ID NO: 4135842 - RNA, 60 nt, Human
augagcaaaugaaacagaagugacuguuuugaaagcaacagcccuguuucauuaguuuau

SEQ ID NO: 4135843 - RNA, 59 nt, Human
augagcaagaugaucugccaacacagcuugucaguuaccuuauggcaucuuuugcucau

SEQ ID NO: 4135844 - RNA, 55 nt, Human
augagcacacugauaagccccuuccacaucuggcuucuacuugucuguugcucau

SEQ ID NO: 4135845 - RNA, 69 nt, Human
augagcacuacuaauuaguuuccauaauauuuucuagaaauuugggaguugcuagugaguuaaguucau

SEQ ID NO: 4135846 - RNA, 58 nt, Human
augagcagguuuaagagaggccuggagaaaaugcugccucucuugagaguugcaucau

SEQ ID NO: 4135847 - RNA, 127 nt, Human
augagccauauuuacggugaacggcggcaacuccaugcccaggaacagggcucagacccgcacugagacuuuagcggguuucuuaaccuuuucugugccacggaccccuuugccagucuggugaagu

SEQ ID NO: 4135848 - RNA, 78 nt, Human
auaacuagaagaggagaauuugcguaguauagugauaugguuuggcuguguccccacccaaaucucaucuugaguuau

SEQ ID NO: 4135849 - RNA, 59 nt, Human
auaacucaguuggaauaauuagagggugacuggcucuuuauuuauuuaggcugagggau

SEQ ID NO: 4135850 - RNA, 104 nt, Human
auaacugcccaguaaauacucauuuuaccauccucuuuuagaauuguguaccgcuaauuccccaagagaaggauggauccaaaagagauuguguuggcauuuau

SEQ ID NO: 4135851 - RNA, 75 nt, Human
auaacuuuacuuugcaacuuuuacuuucccgaaagugccuggauaaguaauguguaaaguguaaggcaaaguugu

SEQ ID NO: 4135852 - RNA, 129 nt, Human
auaagaauuccguagggaguuuuaggaauacagaagacuagucuuuaccuucagagauuuggauucaguaggucucagguagggccuaggaaucuguguuuagaaaaucacucuaaguaaugcuaauau

SEQ ID NO: 4135853 - RNA, 99 nt, Human
auaagacugaaacauugucuaacuuagggaauacuuuaguguauguuggaugaauauguuuaaaugauucucagauuuggacagguaaaucauuuuuau

SEQ ID NO: 4135854 - RNA, 130 nt, Human
auaagacuuacucagagaaugcuaauuaaaaauucagauucuugauccuguagccugucuuuaugauuuacuagaacagaaauggagcccaggaaucugaauuuuuagcaguuucccugggugauccuau

SEQ ID NO: 4135855 - RNA, 60 nt, Human
auaagagcuaccucauagaugagagggcauaggaauuccuuaauaaaugguagcuguuau

SEQ ID NO: 4135856 - RNA, 77 nt, Human
auaagcugguaaaauuugugagauuuucagaaggcaaaauccauguuuuuugucuauucacugauucagccacuuau

SEQ ID NO: 4135857 - RNA, 79 nt, Human
auaagcuugugagugcuuauauguuaaauugagguauuuagguuucucuuuagcaacgaagcacucgacagaagguugu

SEQ ID NO: 4135858 - RNA, 58 nt, Human
auaaggaaauugagacaaaggagauuaaguauuuuuccugaggucacaacuugcuuau

SEQ ID NO: 4135859 - RNA, 86 nt, Human
auaagguugccuugagcagaguuguaagaaaucugaucugaaaauccaaguuaauaaucuucacaauucuaacagggcaauguugu

SEQ ID NO: 4135860 - RNA, 78 nt, Human
auaaguagaaaauauggugcuaaugacuaguauuugguauaaguagauaaauguuuuguaucacauuugcaugcuuau

SEQ ID NO: 4135861 - RNA, 84 nt, Human
auaaguaguaguaguauuucuguagaggcuaucaagauuagcuuugaaagaacucuucagagauaaauucuaaaagccauuuau

SEQ ID NO: 4135862 - RNA, 66 nt, Human
auaagugagaacaaaaauuagaggcuauaaagauagacuggaaucugaauuacuguuuucauuugu

SEQ ID NO: 4135863 - RNA, 60 nt, Human
auaaguggcuuuucuuucgugaggguacucaauuuucacauuuauuucaaaguuacuuau

SEQ ID NO: 4135864 - RNA, 89 nt, Human
auaaguugaguugucaaguuuggaggucacuggucuuugaggcucaagguucagaugacuuuuaugcugaugacaugaaccaaauuuau

SEQ ID NO: 4135865 - RNA, 83 nt, Human
auaauaucacagggagugugcacacaugguauacagucccugcgacaugguguacacaugguguacacucccugugauauugu

SEQ ID NO: 4135866 - RNA, 126 nt, Human
auaauaugucauucuucugaaaauaguuacaguucugauauuagugcaaguaaguguauguuuuucauucugaauguaucuacacuauaacagaaugcuucacuguuuuauuuuccuuugacuuuu

SEQ ID NO: 4135867 - RNA, 77 nt, Human
auaauggcuugauuaguuaaugugaggcaccuaguccagagcuggcacauuguaagcauauuagcugauguaauuau

SEQ ID NO: 4135868 - RNA, 125 nt, Human
auaauguaaauauucauagguuccauggccauuuacagcagacugaugaaacaaccaaaugaagccaucuccagguuuucaucuguuuugugcauggcuauuccaucaaagaauuacuauauuau

SEQ ID NO: 4135869 - RNA, 129 nt, Human
auaaugucuaauuaagacaucuguuaaaugucuacaauauuaauagaagggguucuaauagaacuguauuggaauuguccauuuaauuaaccucgugagccuuuaauggaugucuuaaauagacaucau

SEQ ID NO: 4135870 - RNA, 79 nt, Human
auaauuaggucuuauaacgucuugcaaugacauuugcaagauguaaaugucauugcaagauguuauaggaccuaauuau

SEQ ID NO: 4135871 - RNA, 112 nt, Human
auaauuuacagggcauccauccaugauggaauauuauucaggcauuagaaaggaugaugcaggaaugagguucucaguuagaguucaugguucaggaaaucucugaaauuau

SEQ ID NO: 4135872 - RNA, 89 nt, Human
auacaacaacuuauucauuuuauuaugauggacaccuucgcuguuuucaauugggggcuauuauaguguuuccaugaauauccuuguau

SEQ ID NO: 4135873 - RNA, 55 nt, Human
auacaacugccuuagaaggaaauaauuuauauuaccugggcauggcaaguugugu

SEQ ID NO: 4135874 - RNA, 72 nt, Human
auacaacuuccugcagcaguacucagcagccaggcuucugggcugcccgcuacuguugcaacuugucugugu

SEQ ID NO: 4135875 - RNA, 56 nt, Human
auacaaguggccacuugaauucucaaaaaguccauugugaauucaguuauuugugu

SEQ ID NO: 4135876 - RNA, 101 nt, Human
auacaaucuuuucugcauuauucauguucucuuaauguuaacuaguuuauacaugguuaauaaaguagagaaugacauagaauuuguuggaauuuauguau

SEQ ID NO: 4135877 - RNA, 130 nt, Human
auacacaauggaacuuggcagucuagauuguuuuggcuuuauuuccauucacuuaaaacaaguaugugugggaaggagcuugugggaaaugggaguggaagagauauaauuuauuuuggguauuguguau

SEQ ID NO: 4135878 - RNA, 78 nt, Human
auacacacauauaugcacauucacacaaaaauguaugcuuauauauguguguguguguguguguauguaugugugugu

SEQ ID NO: 4135879 - RNA, 66 nt, Human
auacacacuucacccuugagcuaaggcuuggguagcaguugguuuaccagagggaacgugggguau

SEQ ID NO: 4135880 - RNA, 59 nt, Human
auacacugugguaaacucaaaguauauugucuuugaacuuagaguuuaguauagucugu

SEQ ID NO: 4135881 - RNA, 70 nt, Human
auacaggcauaaaucuauuggacaugugugugcauauguguacguguguguguggguugugugugugugu

SEQ ID NO: 4135882 - RNA, 56 nt, Human
auacaguaauuuguaacucaucauuuaggaugaguugggcagaaacuuacuaguau

SEQ ID NO: 4135883 - RNA, 81 nt, Human
auacaguagaaguccuuugugacauguauuuaggcuugagacuaauacuugucauaaaggcauuauaaguguuuauuguau

SEQ ID NO: 4135884 - RNA, 77 nt, Human
auacaguagucgucuuauuuugacagaagagaauaaaaagaggauuuuuauggucaagucagggcagaaaacuguau

SEQ ID NO: 4135885 - RNA, 83 nt, Human
auacauagaaguucuaccauugggaaaacagccugcauccuuugggcuauuuacuuauguggaaaagcucauucuucuuguau

SEQ ID NO: 4135886 - RNA, 56 nt, Human
auacaucuuccuuuuaaaaugcauuuacaaaaguaaaauuuaagaaggaggggugu

SEQ ID NO: 4135887 - RNA, 106 nt, Human
auacaugugguaagauugcuugauacccagucaaucuccauucuccccuuccuccuuacuaaaagaaccugauuguuggugguaucaauauaucugacuaaaguau

SEQ ID NO: 4135888 - RNA, 71 nt, Human
auacauuggauguaaagcuucagagccggcagccugcagcggaugccaccucucucuugacucgagugugu

SEQ ID NO: 4135889 - RNA, 73 nt, Human
auaccaaagcaaagagcuaacauugccgagauacuauguacuugauuuugugcuagcucuuugcauucaguau

SEQ ID NO: 4135890 - RNA, 57 nt, Human
auaccacucucccagcuaaagagccuucacaggagggugcucaggauggagaggugu

SEQ ID NO: 4135891 - RNA, 61 nt, Human
auacccugccauguuaccugcacagguccaggaccacaggacccaugagucagugagguau

SEQ ID NO: 4135892 - RNA, 87 nt, Human
auaccucuugugauguuagguguuauugacugaauuauguucucccaaaauucacauguugaagcccuaaccccaacacacugguau

SEQ ID NO: 4135893 - RNA, 79 nt, Human
auaccuuguguacugaugcugagagcaauuucauaagaaauuucaaaaaugcuuuagcagugauuagugcuuguggugu

SEQ ID NO: 4135894 - RNA, 73 nt, Human
auacguguaucaguaacuguggacaguagagaagaugcgcuuuuuauuuguuuguuguuguugguauuaguau

SEQ ID NO: 4135895 - RNA, 71 nt, Human
auacucaaaucaggacugugccaaaccuaucaguguaaugauucugggugucaucaaagucuugggaguau

SEQ ID NO: 4135896 - RNA, 62 nt, Human
auacucaugacugaugaauaccugcucugugccugaccaggacaacagcagcucaugagugu

SEQ ID NO: 4135897 - RNA, 69 nt, Human
auacucgacucuuugacgugcccaugucccuacagccaggagacaggcugcaugugaggugcugauugu

SEQ ID NO: 4135898 - RNA, 57 nt, Human
auacugaaaggguguuaccuaauuguuuaagguuagcaagacaacuuuucucagugu

SEQ ID NO: 4135899 - RNA, 129 nt, Human
auacugauguaggggauguaccaggagugaagcuggaagcaugcagacucgaagaucccucuccccuugaccuaucuucaggugagucugucaggcuuuccauuuccaauucuggcucuucgucaaaau

SEQ ID NO: 4135900 - RNA, 76 nt, Human
auacuggcuacuggcccauugucaacaugaugcucuauugaauuaugguggaucccaguggguccuuuaucaguau

SEQ ID NO: 4135901 - RNA, 72 nt, Human
auacuguaccagacacaguguucuugccauucuugagcaaacaucagugaugucugugacauguuacagugu

SEQ ID NO: 4135902 - RNA, 75 nt, Human
auacuguugaaaauuacagcuuguuuaccagcuauauaaccucaagcaggccugagcuuuaauuuucuugugugu

SEQ ID NO: 4135903 - RNA, 84 nt, Human
auacuuauauaggcuugacuuugauuaaaucaagcaaacuaucaguuugucuuuagugaaugaagucuucuuuuauauaugugu

SEQ ID NO: 4135904 - RNA, 70 nt, Human
auacuuauggcccucaagcugcauaaggaccuucuguugaaguucauuguaacuugauggaaugagcuau

SEQ ID NO: 4135905 - RNA, 88 nt, Human
auacuuggagaaagagaugugcugauaaguuugagcucuaauuaagcagcuucuuuuacagcucaugcuuuaauucaauuccagguau

SEQ ID NO: 4135906 - RNA, 103 nt, Human
auacuugugaauaggacugaaauuuauauuuugggcacucuuuaccucagauucagaguucuuaggauuauuuaaaauucauuugcuggauguuuucaaguau

SEQ ID NO: 4135907 - RNA, 62 nt, Human
auacuuugcuaaaaugugcagaacuugguucaagcuuucuagaaaacaauuuagcaagguau

SEQ ID NO: 4135908 - RNA, 101 nt, Human
auagaaacuauuagauugcugcaaaagucauugugguuuuugacauugaaauuaaaggcaaaaaccacaaugacuuuugcaccaaccuaaugguuuacugu

SEQ ID NO: 4135909 - RNA, 62 nt, Human
auagaagugggccauggugagaguuuggcaugacccaaaguuuaugauuaauccaauucugu

SEQ ID NO: 4135910 - RNA, 65 nt, Human
auagaaguuuguaacuugugcuuccuggagaucuagguaauaacaacuuuacagauacauuuugu

SEQ ID NO: 4135911 - RNA, 81 nt, Human
auagaauaauauaauccuacuucccaugaugcuaauuuaucucucacuguaacaugaagguuaaggaucauauugugauau

SEQ ID NO: 4135912 - RNA, 89 nt, Human
auagaaugauauaagaaguaguauggauuaaacuaggggucaagaacuuuuccuauaaagguccagauagcaaauauguuugguuuugu

SEQ ID NO: 4135913 - RNA, 69 nt, Human
augaguccucagauagaaagugcguuuccaacagcaaacagcauaaaauaaaucuacaugaggacacau

SEQ ID NO: 4135914 - RNA, 65 nt, Human
augaguggggcuuagggaggcucagaagguccacucuuucucagagccuaacuaaccuaacgcau

SEQ ID NO: 4135915 - RNA, 130 nt, Human
augaguguguguguguguguguauuuguguggguguguguguuuuccagaaugguguuuugggucauccaaacaguuucuuuuuggagaacagaucaccaaauacuagucuucuucauagaaacauguau

SEQ ID NO: 4135916 - RNA, 82 nt, Human
augaguucucaacuauagaucaaaugaguuuacugaagaauucagaagauuaaaaaacaugugacuguaugauaggauuuau

SEQ ID NO: 4135917 - RNA, 96 nt, Human
augaguucugcuguggacaugcuaaaucugagaugcuuauagaaaauuuagguggagaaguccagaaggcaauuggaauauagaugcaaaauucau

SEQ ID NO: 4135918 - RNA, 72 nt, Human
augaguugggacagggaaucugauccccuguugauuucucucaagggaggaaggggcccugccuuuacucau

SEQ ID NO: 4135919 - RNA, 72 nt, Human
augaguuuguagaacuauacuuacauuuuccaaccuuggaggaucuaucuuuggauaguuuuauaaacacau

SEQ ID NO: 4135920 - RNA, 97 nt, Human
augaguuuuguuauauugguuccaauauuucucauauauggaaaaugucauuuucccugggaauuaauauuuggaacugguguuuaagaaaaaccau

SEQ ID NO: 4135921 - RNA, 102 nt, Human
augauaauuucuauuucuugcuugacuuauuauuugguguuuuguguuuuaucccaauauggaacaucagucauaauuuaacgaagaguagaauuuuauuau

SEQ ID NO: 4135922 - RNA, 56 nt, Human
augauacaccuaggagugggaggggaggccucuuuggauauuaccugguuuaucau

SEQ ID NO: 4135923 - RNA, 72 nt, Human
augauaccaagauaucaaugacauaguaucaccccucaguauagugcaguguucuugaucaucuuuguucau

SEQ ID NO: 4135924 - RNA, 130 nt, Human
augauaguagugucuacuugauaguguuguuuuaaggauuauaugauauaaugaauguaaaaugauucccaccauaucuaucacauaguguuuaguaaauguuaccuauucauaguagaagcacuuuaau

SEQ ID NO: 4135925 - RNA, 75 nt, Human
augauaguuacugggaaauugcccuaguucuucagucacuccucaguaggacgcaauuuccuuagugcuagucau

SEQ ID NO: 4135926 - RNA, 96 nt, Human
augaucauauggcauauucugaaugacccagcuuaagucacauguucaacauugaacuguggccagggacuggaguauaguucaugucuaggucau

SEQ ID NO: 4135927 - RNA, 65 nt, Human
augaucccucaggacagugugaugaaguuuuuggcucccuucucagaacaaugccuuaggggcau

SEQ ID NO: 4135928 - RNA, 109 nt, Human
augaucgccauucuaacuggugugagacgguaucucauugugguuuugauuugcauuucucugauggccagugaugaugagcauuguuucauguguuuuuuggcugcau

SEQ ID NO: 4135929 - RNA, 114 nt, Human
augaugaaaauauucuauaucuuguuuugaauggugguugcaugaguguauaaaguugucaaaacccauuuaacugaacaucucaaaucaaggcuuuuauugaauauacauuau

SEQ ID NO: 4135930 - RNA, 78 nt, Human
augaugaagcaaacauagugaagcaaugacagaauuuaggugaugugcaaaaauuagcuucgcuguagguuucaacau

SEQ ID NO: 4135931 - RNA, 112 nt, Human
augaugaggaaggagcaugaguaugaguagcccccaccucuuaaaaagaauguaguuuauauagagcuuugaagaauguggcauuuauuuauaacagccucuuuuuuauugu

SEQ ID NO: 4135932 - RNA, 96 nt, Human
augaugcagcaauaccacauguggauauauguccaauggaaauaaaauuaguauuucuaagagauaucuguacuucuguguucauuguagcauuau

SEQ ID NO: 4135933 - RNA, 60 nt, Human
augaugcuuccacuguucugcucucccugggaaagcggaggcagaacggugaagcagagu

SEQ ID NO: 4135934 - RNA, 65 nt, Human
augaugguaaauucaguauccgugggcugugcccaccaaauaacagggacuagguuugccuucau

SEQ ID NO: 4135935 - RNA, 61 nt, Human
augauguaaggguaauugucuauccaugugggaaaaagauaaagcuguaccuuuacaucau

SEQ ID NO: 4135936 - RNA, 73 nt, Human
augaugucaguucuacaaguccaguuuuugcaagggcaaauuaacuuuguuucucagcuguggagccuaucau

SEQ ID NO: 4135937 - RNA, 103 nt, Human
augaugugaaaggauucggucauaguggcugguaguuacugagcacucacuaugugcugacacuuauaauugccagguauauauugacuuauuuaaucaucau

SEQ ID NO: 4135938 - RNA, 55 nt, Human
augaugugcccuaaguauccagagcagagucuggcauacaguaggugcucaauau

SEQ ID NO: 4135939 - RNA, 79 nt, Human
augauguuuuugagaucugugcauguuaguuaauguagaucaguccauccucuguaauugcuguauagauugucaucau

SEQ ID NO: 4135940 - RNA, 118 nt, Human
augauuaggcuuuuugguauuuauucagaaaaaacuucaauaagugggaaaaagugagaaggccccaaugauuacuuguuaguuuuaucugcaugauacccacacugccaaagauuau

SEQ ID NO: 4135941 - RNA, 82 nt, Human
augauugcucugccuuugagguuagcuagcagaucagcccaguucugguugaucuagguuggcuucaacugggacagcucau

SEQ ID NO: 4135942 - RNA, 65 nt, Human
augauuucuucuagccugccuuugaugugucuugcacauuuuuaagaagugguuggaagaagcau

SEQ ID NO: 4135943 - RNA, 57 nt, Human
augauuugcugaauaucuuggaugucagaaagacauccaggcagagcaacaaaauau

SEQ ID NO: 4135944 - RNA, 63 nt, Human
augcaaaugucaccacuucuaaacgucugaauucaucuaguuuguugaagugugacuuugcau

SEQ ID NO: 4135945 - RNA, 69 nt, Human
augcaaauguuuaaguuacuauugucauugcccucaucuuagcuaauagugauugaaaacauucuguau

SEQ ID NO: 4135946 - RNA, 83 nt, Human
augcaacaacuuggauggaucucaagggaauuaugcugagucaaaaagcuaaucccuaaagguugcauaagguaugauugcau

SEQ ID NO: 4135947 - RNA, 85 nt, Human
augcaaguuuuuacagauugagguuuuuaauauccaguuuugcuuuguguauggauguuuuagagcauaguuuguaaucauguau

SEQ ID NO: 4135948 - RNA, 74 nt, Human
augcaauguccaauuucagagucucauuugccugugaauugagagaguucaguggacucauggaagacuugggu

SEQ ID NO: 4135949 - RNA, 75 nt, Human
augcaauugcacuuuuaaauggguccguguuuuauuaaccucaaacacuuauccacauuugaaagauaguuguau

SEQ ID NO: 4135950 - RNA, 97 nt, Human
augcacaaauggcucaggguccccaaaugguuucuguguccucaacuuucuauguaauaagagccauggauauuucugagcacaguuugaccugcau

SEQ ID NO: 4135951 - RNA, 89 nt, Human
augcacaagccccacacauuuuucacuuaccguaggaagauuuaaaaagaaacccuuuugugugugugugugugugugugugugugugu

SEQ ID NO: 4135952 - RNA, 57 nt, Human
augcacuuucuagagauucugauucagccuagagucuauauuuucugaaagaugcau

SEQ ID NO: 4135953 - RNA, 77 nt, Human
augcagacauuucaaauagaaucuuuccaaaguacugcuuuuuuuggauuuuuuuuggcuuugauuuuguauuguau

SEQ ID NO: 4135954 - RNA, 66 nt, Human
augcagccuaugcauauguguucauuggagugugcacacuuguguacauauaugcauguguaccau

SEQ ID NO: 4135955 - RNA, 77 nt, Human
augcagccuguccagcugaccagagcagcagagauggcucaguuuucagcugccucuccugaguugacaggaggcau

SEQ ID NO: 4135956 - RNA, 94 nt, Human
augcagggaucuucccauacuuccugcuucccugaucugaaccaagauuggaaagaggcaggcagcagagaagaugcccaagaaacucugacau

SEQ ID NO: 4135957 - RNA, 65 nt, Human
augcaguaaauguuaagaaaaagaagauagcaauuaugaguuguauuucuuagcuuuugcugcgu

SEQ ID NO: 4135958 - RNA, 79 nt, Human
augcaguguuauguagcagaaagauguuuggcagaaugcuauuuguccaacuuuuaacucugcugaugacuggcugcau

SEQ ID NO: 4135959 - RNA, 78 nt, Human
augcauaugcacacaauagauaugcauacauaugauauacauugguagauauguguauaucuguaugugcauguguau

SEQ ID NO: 4135960 - RNA, 57 nt, Human
augcauauuucuugggcuuaccauauaaaugcugagggugaggcuaauaaucugcau

SEQ ID NO: 4135961 - RNA, 129 nt, Human
augcaucuccagauaaguuucaaaauuugcaucauaacuguaauucaucuaccauugggacaauaauggcuaggaggauagacagcuuauuaaguaaaauguugguacuaguuuuaauaaucuuggcau

SEQ ID NO: 4135962 - RNA, 88 nt, Human
augcaugaauuugggcgaggagggaggcaugguucaaccuacaacaaacuuuaaaccaguguuucccaaauuucagccauuuauguau

SEQ ID NO: 4135963 - RNA, 69 nt, Human
augcaugggagaaggcaaggggaggugaccucauggaacaggucauccagacuuugccucugccagugu

SEQ ID NO: 4135964 - RNA, 63 nt, Human
augcaugucagcugugcccauguugccuucacaccccuugccaacgcagggcugcacacgcau

SEQ ID NO: 4135965 - RNA, 70 nt, Human
augcauuugacagcuguacagaguaacuuccuuuagagggaaggauuaaaauuugacagaguuugagcau

SEQ ID NO: 4135966 - RNA, 101 nt, Human
augccauuaaaaaugagcugugggcagauccauagaguucuggagaaugccaugccuucuucagcagagaauuaugauguuugcaaaacagcuccuggcau

SEQ ID NO: 4135967 - RNA, 78 nt, Human
augccauuaucucaguugaacuuaugacguggacauuauuaauauccccauauuuuguaugagaaaacugaggugcau

SEQ ID NO: 4135968 - RNA, 73 nt, Human
augcccaucaaugccuguggaaaggcuggugcuuucuggacugagagcuggccuuggacaugaggaaggguau

SEQ ID NO: 4135969 - RNA, 90 nt, Human
augccccaccucuggucuggaugcccacuaucugcuggcugaccuccucuugcacauggagccugcuggugggugccccuggugaaguau

SEQ ID NO: 4135970 - RNA, 78 nt, Human
augcccccagaacacaggcuaaacugagauaguuaaucaaagacaacuguaaaucucagacuguguuuuucacagcau

SEQ ID NO: 4135971 - RNA, 59 nt, Human
augcccgauaccuaguuaacucucuacauguuauuguuguuuugcugguaucuggggau

SEQ ID NO: 4135972 - RNA, 61 nt, Human
augcccuuuucauaucucaaccucucaucauaggugagguccaguuuucugacaagggcau

SEQ ID NO: 4135973 - RNA, 65 nt, Human
augccuagacuauagacucugcagaggaugcugcuacacaagggucuguggaugcaucuggggau

SEQ ID NO: 4135974 - RNA, 59 nt, Human
augccuauguauuauauacugugugugaauacauauauuugugugugauuuaugaguau

SEQ ID NO: 4135975 - RNA, 68 nt, Human
augccucacuugcaagauuauucaauuugugauaaaauagaugaaaggucuagcacagugccuggcau

SEQ ID NO: 4135976 - RNA, 64 nt, Human
augccuccaaaacauaugcccuacuuaugccgccguaguaugagcaccagggcuuuugagacau

SEQ ID NO: 4135977 - RNA, 99 nt, Human
augccuccaucuuccccuucccuuuguucugcugggacauuacaauauucaguagugacagccucaugaggagcaaaagaauggagagauuuuuuguau

SEQ ID NO: 4135978 - RNA, 59 nt, Human
augccugggccucaucuucaaugagucugauucaguaggucaagguggggcccgagcau

SEQ ID NO: 4135979 - RNA, 85 nt, Human
auuugaggguggcucagcugcacuguucugacccaggguuucucaugagacugagucaacauguuggccgggacuacccucagau

SEQ ID NO: 4135980 - RNA, 84 nt, Human
auuugaggguugugaggguuaaguaagaagaauaugaaaauacuuuguggucucuaaagcacuuuaaccacagaacuuuuaagu

SEQ ID NO: 4135981 - RNA, 83 nt, Human
auuugaguauaguuuggggaacuauucaagaacauauuaaaaugucacuguaaugcucucugccauagcuaacuaacucaagu

SEQ ID NO: 4135982 - RNA, 93 nt, Human
auuugauccuugauccagaggagggaaaggaccaaucaccuucacucuacugugaggcaauguccuucauccuugguucugcuucagucaaau

SEQ ID NO: 4135983 - RNA, 58 nt, Human
auuugauguaugugagugauuggcguaauaacauaguaagucacaugcauacacaagu

SEQ ID NO: 4135984 - RNA, 76 nt, Human
auuugauuuagaaugacauugagccauaacaucaaguagugaaaauuuaagaugcugguucaauuucccaucagau

SEQ ID NO: 4135985 - RNA, 69 nt, Human
auuugcauucauauggaaggaaacuaugguauuagaggguuuugugguccuugcuauagagugauaaau

SEQ ID NO: 4135986 - RNA, 63 nt, Human
auuugcuuccuaauacucauauggguucaugcuauucaucuguaugcuuauuagggacuaaau

SEQ ID NO: 4135987 - RNA, 56 nt, Human
auuugcuucugaguguuuaggaagccccuuguuucugaggaugaaggauagcaagu

SEQ ID NO: 4135988 - RNA, 76 nt, Human
auuuggaauagggaggcuggcauagucucuguucaagucacacugaucugcucuaucccguuucccucuuccagau

SEQ ID NO: 4135989 - RNA, 71 nt, Human
auuuggaccucuuccauugaauaggcugugcaaccuccuuggaugccaggcuaaguggaggacuuccgggu

SEQ ID NO: 4135990 - RNA, 98 nt, Human
auuuggagagguuauaguaggaauugcuaaccaauucaaaaugugccauuuugaaucagaaguuggcaguguuauuuauaauagugacccauuugaau

SEQ ID NO: 4135991 - RNA, 91 nt, Human
auuuggauggaauggucuaauaaucugaagaaacaggacuugaacacauuuuaaguaugguagucucagaauuggcccagagcauaagaau

SEQ ID NO: 4135992 - RNA, 58 nt, Human
auuuggaugggcauuaggaaagucagggauauccuuuggcaccaauccuacuccaagu

SEQ ID NO: 4135993 - RNA, 94 nt, Human
auuuggcaaugccuggaucuaugauuugguugucacaauuguggggaaggcacuccugacaucuaguagguagagaccaggaauguugcuaaau

SEQ ID NO: 4135994 - RNA, 72 nt, Human
auuugggaguugucagagugucuguuggugcuacauacuaguauuacaacuaugugcucugcaagccuuuau

SEQ ID NO: 4135995 - RNA, 65 nt, Human
auuuggggaagggagucauuugauuagggaaucauccaccucaaucacaugcuuauuccuggaau

SEQ ID NO: 4135996 - RNA, 60 nt, Human
auuuggggcuuauagcauuguauggagaagacaaugcaguguuaaauuucgcaccuaaau

SEQ ID NO: 4135997 - RNA, 67 nt, Human
auuugguauucaguuggauuuggauauauuaggauuaccugucagucacaguucaacuaguucagau

SEQ ID NO: 4135998 - RNA, 61 nt, Human
auuuguaaagugcuuaaaaguaugccuugcaaaggaaaugcuauguaagcauuuauuaaau

SEQ ID NO: 4135999 - RNA, 57 nt, Human
auuuguacucaggaauucugcucacgcaucacaugcagucuuucuugguguacaaau

SEQ ID NO: 4136000 - RNA, 130 nt, Human
auuuguacucuguaauuuugccaggagacauaacaugcauauacuuaaauaugucagaggugaauaguuacacauuauauauucaugaguauugcauuccuguguuggcaacaaugguauuguacauaau

SEQ ID NO: 4136001 - RNA, 60 nt, Human
auuuguagugaagugaaaauaagaccgucaaauccuuaauguguuuccuuugcuacaaau

SEQ ID NO: 4136002 - RNA, 86 nt, Human
auuugucauacuucuuaaaaguaugccaauuggagaacaagacacuugcuuccaaaaugagaauaccuuugugaaaauugacaaau

SEQ ID NO: 4136003 - RNA, 56 nt, Human
auuugucugagcagggagugacgaaaugacagucaugccaguuugugcaggcagau

SEQ ID NO: 4136004 - RNA, 75 nt, Human
auuuguggaauuugaacuucauaaagaaauguuaugauuauagucaucuucacauuuuaagaaguucuugcagau

SEQ ID NO: 4136005 - RNA, 79 nt, Human
auuuguguggcaugggagggacugcauucgauuuggaauugaucucuguguugaacucuccuacauuucauucacaaau

SEQ ID NO: 4136006 - RNA, 62 nt, Human
auuuguucacugcuuuauuuucagcauuuaucacagugccuggcacauugcaguggauuaau

SEQ ID NO: 4136007 - RNA, 80 nt, Human
auuuuaaugucuuagauuucaccgauaaugaggaaauuguccucguuuucauggguagagguucuuaaagguuuuaaaau

SEQ ID NO: 4136008 - RNA, 60 nt, Human
auuuuacaaagugggaaacgaagguuccucuuaggaaccuaguugucaccuuuguauaau

SEQ ID NO: 4136009 - RNA, 82 nt, Human
auuuuaccaagucacuuaugugcagauauccucaaauacaaaggccuugggauuaaguauauuugcaagugauugguaaaau

SEQ ID NO: 4136010 - RNA, 92 nt, Human
auuuuagaggauucauguucaccuguggcacuagugguuaaaauaauaauuaacaugacuguugccauaugggggcacguaaacccugagau

SEQ ID NO: 4136011 - RNA, 114 nt, Human
auuuuaggaaagaaagaggccuagaguguucccggcagaggaauauagcccugcgcagagauaaaaagacagggcauguguugggaacagcaugagguuuaauuuggcugaaau

SEQ ID NO: 4136012 - RNA, 86 nt, Human
auuuuaguaauaauuuuagcuuuuauuucaucauauauaauaauuuguagugacuggugugaaguuaaauagaauuaaccuagaau

SEQ ID NO: 4136013 - RNA, 95 nt, Human
auuuuagucuuucuucucuuuagacaucucauuguguaacaccugaacaaucaguuuuuguauuuuuagauggaagagauagcagagcauagagu

SEQ ID NO: 4136014 - RNA, 125 nt, Human
auuuuaguuccucaguuuaaccuacaacuagucucuauuacuuugaccacuggauuauuacguaagaauuuuaauuuacaguguuacuugauguccacuaggggggaccaaaccacgaacagaau

SEQ ID NO: 4136015 - RNA, 82 nt, Human
auuuuauauuuauuaugcagugaaaaagugcacccuguguagaauuacaaggcucuaauuucauugaaaguuucuguaaggu

SEQ ID NO: 4136016 - RNA, 57 nt, Human
auuuucaaagucuuuaucuuuuuucguuugauaggaaugggucgggaaguugagaau

SEQ ID NO: 4136017 - RNA, 91 nt, Human
auuuucaucaccuagggaucuuguuaaaaagcagauucugauucagggaccaagauucugcauuuuuagcaaguucucaagugaugcuaau

SEQ ID NO: 4136018 - RNA, 63 nt, Human
auuuuccacaauguaugaauaagauuaccuuuuccuaauuuuaaaaaaagcauuguggugagu

SEQ ID NO: 4136019 - RNA, 63 nt, Human
auuuuccugguaguaagaugacccuauuguuauguacauucaggucuucuauucccagaaagu

SEQ ID NO: 4136020 - RNA, 111 nt, Human
auuuucucuguucaaguaguacaguaggcacagauuaacauuuaaauuuuucacauaugguauauuucagaaauuugaaguuaagcaaaaauuuuaaugaguagagaaagu

SEQ ID NO: 4136021 - RNA, 130 nt, Human
auuuucugacauaaacuugaucuguguggcucaaggcuucagugugacaaaacaauaaagcacuuuuuuuuccguuuaaauuauacuugagccuuggucuggcuacucuucuuauaaauguaaguuugau

SEQ ID NO: 4136022 - RNA, 70 nt, Human
auuuucugucaaacucacaggccgaguaguguaauugaaagaaugcuaggccaggagucagacagauuau

SEQ ID NO: 4136023 - RNA, 129 nt, Human
auuuucugucucuauggauuugccuauuugggacauuucauauaaauggaauuaugcaauauauggucuuuuguuauuccauuauuucacuuaggauaauguuuccaagguuuacccauguugcagcau

SEQ ID NO: 4136024 - RNA, 89 nt, Human
auuuugcagagaugaacugugccaguuuaaaccuugugaauacaguuaaugcuauauuuauauuaguaaaugcacaguauuuacaaagu

SEQ ID NO: 4136025 - RNA, 90 nt, Human
auuuugcauauuuugcaucuuucuuagaacuuucagugcauccagguuuuauugcauugauccuaaagagaggaaagaaguaugcagggu

SEQ ID NO: 4136026 - RNA, 61 nt, Human
auuuugcuucucauuucucugugcaaaaccuacuaagaugcacaauagauuugagcaaagu

SEQ ID NO: 4136027 - RNA, 76 nt, Human
auuuugcuuuagucuauugauuuggauuuuucccccuacccugggaguaaucaauuuuucgguggaugggcagaau

SEQ ID NO: 4136028 - RNA, 64 nt, Human
auuuuggggagacauggccagcugacuucacaauuacuuagucugcuccaggcucucccaaagu

SEQ ID NO: 4136029 - RNA, 61 nt, Human
auuuugguagugggagguugaggauuuucauaucugauugcuucuauuacuacuuugagau

SEQ ID NO: 4136030 - RNA, 64 nt, Human
auuuuuaagcuuccaauuucuccaagagaguuguuuagcucuguugucuguggaagcaaaaaau

SEQ ID NO: 4136031 - RNA, 71 nt, Human
auuuuuaugacaaaccauccucccacauccaacccuuuaucuggguguaaagaagggauugugguaaagau

SEQ ID NO: 4136032 - RNA, 80 nt, Human
auuuuucaaaaugaaauaauuuaugacauucaaguggccuaauggcacacuugaagugaauugcucaccuuuuggaagau

SEQ ID NO: 4136033 - RNA, 77 nt, Human
auuuuugcugugucagucuaagaaugguguuucuuaaaugcaaaggagaaaucauuuuaggcuugauguaagaaaau

SEQ ID NO: 4136034 - RNA, 98 nt, Human
auuuuuggauugugucccugcaauuugaucauaagguccucaagaucaugaaaguuuuugagaaggugacaaauucuacaaggaccacucaggaagau

SEQ ID NO: 4136035 - RNA, 79 nt, Human
auuuuuggguugcuagaaggagucuccaaaggauuugcugagaaggccucugggucuccucugacaucaacuuaaaaau

SEQ ID NO: 4136036 - RNA, 129 nt, Human
auuuuugguguaucugagaugcuaauggccuuucauuuucaaguuuuuauuucccaguuggcaguaccacuuuuacacuuugaagauggaaacuuggcaggaaaauuguaugucaggguguauuucugu

SEQ ID NO: 4136037 - RNA, 92 nt, Human
auuuuuguguggagacaaggucucacuauguggcccaggcuggucucgaacuccugggcucaagugauccuccugccucggccuccaggagu

SEQ ID NO: 4136038 - RNA, 62 nt, Human
auuuuuuaccuguggcuccccagacaagcaucugauuuaagggacuuacauagguaaggggu

SEQ ID NO: 4136039 - RNA, 80 nt, Human
caaaaaauucgauugaugugcugcugacuucuguuugguuuagcagauguuuguugagcagcuguuuguugaauugguug

SEQ ID NO: 4136040 - RNA, 80 nt, Human
caaaaagaucugaaagacgcuauuuugaggggucuauuucuagaaugggacaccucagauagugucuugugaucauuuug

SEQ ID NO: 4136041 - RNA, 61 nt, Human
caaaaaguauuggccaugguugaagaccuucauuacauuucaggagugccaguaccuuuug

SEQ ID NO: 4136042 - RNA, 69 nt, Human
caaaaagugucugcaaaaugaaagagccacugugacaagguggcucugucauuuugcagacacuuuuug

SEQ ID NO: 4136043 - RNA, 84 nt, Human
caaaaaguucauucuuugaguuugauuucuguuauuuuauaauauaucagaaauagucacauuggaggaaaucagaacuguuug

SEQ ID NO: 4136044 - RNA, 111 nt, Human
caaaaauaacaguuguuauaauuauacaaaaaggcaugcagcuccaugugcuucuagaaguuucuuuguuuugcaggucuauuuaaaugauugaaucacuuuauauuuuug

SEQ ID NO: 4136045 - RNA, 55 nt, Human
augagccuucucuugucaggaagacagcuaaguuugcccuggcacacuggcucau

SEQ ID NO: 4136046 - RNA, 94 nt, Human
augagccuuuuggggaaggauaaaaaccacuucuaaucugacaaguauaaggcugaaguagcauugaugauuuuucucuuccccaaguccucau

SEQ ID NO: 4136047 - RNA, 128 nt, Human
augagcucugggguguucuguaauggaaagagauggaaggcaauggcaagagaaagcaccuacucugugcuacuuuuacauaugcuauuguauuuaauccucaaaacaagccaaagauguggguacau

SEQ ID NO: 4136048 - RNA, 97 nt, Human
augaggaaaagagaaaggacuugggaaagaaguuucaccgauacugguuuaugguucuugagacauuguuuuccaaguuguuuauauacaguuucau

SEQ ID NO: 4136049 - RNA, 79 nt, Human
augaggaagauaucaggagagaaagaauacaauuaguuugcuaauguguaaaagguuuucuucaggaauucuuacucau

SEQ ID NO: 4136050 - RNA, 86 nt, Human
augaggccucccaucuauccuuaucugucugguugagucauucugggcugacugggcaccaucaugagaugggcaggaggucucau

SEQ ID NO: 4136051 - RNA, 61 nt, Human
augaggccuuucuucacccuuucuugguggcuugccuugaggguguuaggagaugguccau

SEQ ID NO: 4136052 - RNA, 82 nt, Human
augagggacaggccacagcucacguuccccauuuuccagaccaggaaaacugggacgcucggcugaguuccugguccagcau

SEQ ID NO: 4136053 - RNA, 56 nt, Human
augaggucauccuggaguaaggugggcucuuauuccaguaugucugguguccuuau

SEQ ID NO: 4136054 - RNA, 76 nt, Human
augaguaaaaaacuagaagccaacauuccaaguagaauggccuggguucugucuuguguugagcauucuggcucau

SEQ ID NO: 4136055 - RNA, 94 nt, Human
augaguacugagcacagagcuuuggguuccagccacuucuguuauguagacaaguggcaucaaaucaagguuuggcaucauuucuagugcucau

SEQ ID NO: 4136056 - RNA, 60 nt, Human
augaguccacauuauuauaugucugugacugaaauuacagaauucuaguauguggcuuau

SEQ ID NO: 4136057 - RNA, 79 nt, Human
augaguucagacuacaggaguaaaauaauuucaauuuguuuugaaaagugcuuuauuuccugucuaaauguugaaccau

SEQ ID NO: 4136058 - RNA, 55 nt, Human
augaguugaagcuacaagaggcacaagacagaaagugccuaugucuucaaaucau

SEQ ID NO: 4136059 - RNA, 76 nt, Human
augaguugacagacucaccucacuugcugaaggacuagcccagcagguucuacgggugagaucacugcuagcucau

SEQ ID NO: 4136060 - RNA, 67 nt, Human
augaguuggcaaguguuccuuccucuucuguuuuuuggaagacuucaugaagaauuuguuaauuuau

SEQ ID NO: 4136061 - RNA, 58 nt, Human
augauaagaacacaguauggggagcaaggcaaucuguuuccuuuccugcucuuauuau

SEQ ID NO: 4136062 - RNA, 66 nt, Human
augauacucuaggugauuuacaguuuaguuucauauuaucugcuacaaauacgcugggagugucau

SEQ ID NO: 4136063 - RNA, 72 nt, Human
augauaucugccaggccauuuuguuacuugugguauuuuagguaucuucugguuaguggucuguuauaucau

SEQ ID NO: 4136064 - RNA, 74 nt, Human
augauaugggaaaauuuugucucugaacagcuuacuaaauaguuuuagagccucuuuagggacuucccugugau

SEQ ID NO: 4136065 - RNA, 57 nt, Human
augaucauggaagugcacccauugggguuauauaaggguugugugcuucaugaucau

SEQ ID NO: 4136066 - RNA, 65 nt, Human
augaucucuuuugauucuguucucuucauuuuacagaggagacaauggaggccaaaagaagugau

SEQ ID NO: 4136067 - RNA, 77 nt, Human
augaucugucugccuuucugcugcugcuuuuccaacacccuccucaccuggaagcugggcaguuaaggcacagucau

SEQ ID NO: 4136068 - RNA, 88 nt, Human
augaugacaaagcccuuuccauuuaaaaaucacaguucaucaacaucaucgaaucaauggcuggaaaugaauggagagguggucucau

SEQ ID NO: 4136069 - RNA, 84 nt, Human
augaugaguuaacacauaguuggaguaaaaugacugcaguggagugcuggagcaggcuugucccagcuuuugagaacugauuau

SEQ ID NO: 4136070 - RNA, 91 nt, Human
augaugccaggacugcagcuucagggacuuguggcagaugcacagggugccucuggcucccuggagcuccacacugcagucccagcucugu

SEQ ID NO: 4136071 - RNA, 55 nt, Human
augauggagguguccuggauuugaaagaucucaguuucugggaugauuuucacau

SEQ ID NO: 4136072 - RNA, 97 nt, Human
augaugugugaugcuaccuggaugaaagccaggcucauauggaugaaugaaauauucaaaaugauauccugacuuuuauuaaaguaaaauauguugu

SEQ ID NO: 4136073 - RNA, 92 nt, Human
augauuccuuuguucuuuacaugcugucuauaagggcaaucauuuuuaaaagcuuuuauuggauagcuugugcagaaucacgcccuaauuau

SEQ ID NO: 4136074 - RNA, 104 nt, Human
augauugaguuuguacugugugccaggcacuugcccaggcuugaaggaaagagugauguuugagacaggguacgggcuaggcacaaaacaagcugguugguuau

SEQ ID NO: 4136075 - RNA, 101 nt, Human
augauuggcaaaauaauuagucuagucaugcuucaaagaauguuaguuuagcuaugggguuuucuaauacuuugaaugagagcuaaaaaugucaaauucau

SEQ ID NO: 4136076 - RNA, 101 nt, Human
augauuggcugauuauauuaauguaguuuuaguggauucuuagauuuugcugguuaaagcccucuguaaaucuacuaagagcucauauaagugccaauugu

SEQ ID NO: 4136077 - RNA, 61 nt, Human
augauuuaaagucauugugaacauccauuuagacagguauguucagagauuauugagucau

SEQ ID NO: 4136078 - RNA, 57 nt, Human
augauuugaggggaaauacugcauagagugggauccuacaacugcccccucaaacau

SEQ ID NO: 4136079 - RNA, 80 nt, Human
augauuuguugccccauuuaaguaaugauaaacugaaauaaaaucagugauuaaaauugaaguggggaagaaaaauucau

SEQ ID NO: 4136080 - RNA, 61 nt, Human
augauuuuuaguacauucuugggggauggcauaagucuucuaggucuugauugaaugucau

SEQ ID NO: 4136081 - RNA, 55 nt, Human
augcaaaaugcaucccagaauuggagagaaacaacauguggguuuuauuuugcau

SEQ ID NO: 4136082 - RNA, 92 nt, Human
augcacacaauuuaauacaccugcucaccugauguggcaacucagccugugcuugcuguggguugccacaggaugagacauggucugugcau

SEQ ID NO: 4136083 - RNA, 58 nt, Human
augcacacugggauucaacuggucuacacagagauagcagagggaucccaggugacgu

SEQ ID NO: 4136084 - RNA, 62 nt, Human
augcaccaggacuuaacacauucccauuaaagaaguguggacuugcuguccuggacuuguau

SEQ ID NO: 4136085 - RNA, 66 nt, Human
augcacgccccacacuggugugccucaccugccuuuauacagccaggcuucagugugugugugugu

SEQ ID NO: 4136086 - RNA, 99 nt, Human
augcacuucaccauaaaaccuaagaucugguaugugacagcuggcuguagcugcagucccaugagcccagaacauucuauguuuguggugugugugugu

SEQ ID NO: 4136087 - RNA, 66 nt, Human
augcagaagcagaggagccuaugaguagaaaugacacuacucagaagcaagcuucuacuucugcau

SEQ ID NO: 4136088 - RNA, 56 nt, Human
augcagaaugaguucacgaucuccuagagguggaauauuguucuuucguuuugcau

SEQ ID NO: 4136089 - RNA, 111 nt, Human
augcagaguuaaaguuagaggagauugcuguuugugauaaugacauuuccuucacuucuguugaaagcuauucaacacgaacaugugacucuuuuacuaauuguaaugcau

SEQ ID NO: 4136090 - RNA, 56 nt, Human
augcaggagcccucuugagggccauuaugacuggccacucuugggguuuccuggau

SEQ ID NO: 4136091 - RNA, 88 nt, Human
augcaggcaauaagcguauauuuucaaauguguccauauccucaaguaggauucacaugugggaaauggugcuuauaugccagugcau

SEQ ID NO: 4136092 - RNA, 74 nt, Human
augcaggccugguggugcuauuccuucucucuuguucacggcucaaggccaggggcuggcgccuccuucugcau

SEQ ID NO: 4136093 - RNA, 58 nt, Human
augcagucuugcaggaacugaaggauguuugauguagcuacaggaaucaagacugcau

SEQ ID NO: 4136094 - RNA, 62 nt, Human
augcaguuccacaggcgcaugggccacguuuccagugcuugguggccauguggggcugacgu

SEQ ID NO: 4136095 - RNA, 77 nt, Human
augcauagugcaguggacugaguuaauacuuggguucuauuucuacucugcuuuugaccuagucauugaucaugcau

SEQ ID NO: 4136096 - RNA, 62 nt, Human
augcauauuucaugaaucuuugagguauucuugccauuugaggaauuccugaaaugagucau

SEQ ID NO: 4136097 - RNA, 103 nt, Human
augcaucaggguuagcuguaugagaaguaugagaaaaucugcuuauauuauuuuuggcuacagacagguguuuccaauuucucauguuuagucuuaaaugcau

SEQ ID NO: 4136098 - RNA, 59 nt, Human
caaggcuaagcuuuggcuuucuuugggauguaccuuaacgagguaaucaauuggucuug

SEQ ID NO: 4136099 - RNA, 60 nt, Human
caaggcuuaucagccaggagccaaguacagggaaggguauuuccuggcuggaggacuuug

SEQ ID NO: 4136100 - RNA, 70 nt, Human
caaggcuucacguccccagugcccccaccuuuaccagauggggaccugagcuggggaugucacagucuug

SEQ ID NO: 4136101 - RNA, 63 nt, Human
caaggcuuugugggcugcaggcagaaacuuggacuuuuucccugagagcacuggggagccaug

SEQ ID NO: 4136102 - RNA, 63 nt, Human
caagggaagaggacagggaccugccagcaucaccagucgccacuccuuuccuccuucuaaaug

SEQ ID NO: 4136103 - RNA, 59 nt, Human
caagggcaagguauuuggaacuggaccagucaagcucaaaauuucagcacuagcccuug

SEQ ID NO: 4136104 - RNA, 77 nt, Human
caagggcacuugggacuuaacaauccagucccacguguggggcuucuuuguaacgugccagccaacagugcuccuug

SEQ ID NO: 4136105 - RNA, 96 nt, Human
caagggcaggucacugcaggcugcucaagacuuagugaggagaccagccagugcucacuaaggacuguggcgccugccguuugugccugucccuug

SEQ ID NO: 4136106 - RNA, 56 nt, Human
caagggcuaugcauuugugcacuuucagaaccagagugcugcagacagggccauug

SEQ ID NO: 4136107 - RNA, 96 nt, Human
caaggguagaacgcacacugagaugguuucucugaacucuacgacccugagauuaagguuuggggaaagaaggcgucuuaaauguuauuacuuuug

SEQ ID NO: 4136108 - RNA, 86 nt, Human
caagguacaaaggaggugcauagaacauccccgaauucuuagaaagaaaagcuccacguguuuuugccuuccccuuuuguucuuug

SEQ ID NO: 4136109 - RNA, 98 nt, Human
caaggucaagaggaggagguggagggaaagccucucgacuuucuuuuggggaaggcuucccuguaccuaacagcaaaaauccuucaaaaugacuauug

SEQ ID NO: 4136110 - RNA, 76 nt, Human
caagguguauauucugccuaaaagcuuuuccgcacucuuuacacuuaaaaggcuuuucuccagaauguacucuuug

SEQ ID NO: 4136111 - RNA, 58 nt, Human
caagguuuacauugggcuaucaggaguggcuucauggguagcugagaaguaaauguug

SEQ ID NO: 4136112 - RNA, 62 nt, Human
caagguuucuaugcucaaaggaccacauggcccaauguuccugcugaggcaugaggccauug

SEQ ID NO: 4136113 - RNA, 111 nt, Human
caaguagcugggaccacaggcauguggugucucucgcuuucuuaaaaggauagcauacccuuuuacacaaaagauagcacaccauaugcacuguucuauaccuugcuuuug

SEQ ID NO: 4136114 - RNA, 91 nt, Human
caaguaucaaaauguuaaaaugcugugcuauaucucugaguguauaauggaaacaacauucagcaaauauauauagauguucuacugcuug

SEQ ID NO: 4136115 - RNA, 81 nt, Human
caaguauuauggcucuauuuccuugucuagauacugauauaacuguaauuguggauggguugaaaugugagccaaugcuug

SEQ ID NO: 4136116 - RNA, 61 nt, Human
caaguauuuccugauggccuguuuugugcaaggugauguaacagguauucgggaggauuug

SEQ ID NO: 4136117 - RNA, 61 nt, Human
caagucagucaaaauauaaauuguuagccuuauuugccagguacaaaauuugacugauuug

SEQ ID NO: 4136118 - RNA, 65 nt, Human
caaguccuaaauguauuuguugcugaaacauguucucuuuguaucaagugcauuaaugggaguug

SEQ ID NO: 4136119 - RNA, 58 nt, Human
caaguccuuagaugguucuuugguuuggguggucagagaaagcuucucuaaggaugug

SEQ ID NO: 4136120 - RNA, 77 nt, Human
caagugcauucagguaguugacagaacuuaguuccugcagcuguaggucuagggaccucagcuccuggaggcaccug

SEQ ID NO: 4136121 - RNA, 82 nt, Human
caagugcucacauaaacucucuguaccaauauacuauauguaauauuguguguacaaguaguuaguaucuaaggagcauaug

SEQ ID NO: 4136122 - RNA, 61 nt, Human
caaguggggccuggugguacagucaagugagaguaagccauggcuggccacgccccaguug

SEQ ID NO: 4136123 - RNA, 67 nt, Human
caaguggguggguccgcuugguuccgguggcuuugugccugccagagaaaaguggaucuugaauuug

SEQ ID NO: 4136124 - RNA, 72 nt, Human
caaguguacuauauauucuauuguaccucuccuuaaaagcucagcaaaggagagagaaagaauaaacacuug

SEQ ID NO: 4136125 - RNA, 115 nt, Human
caaguguauugugccuuguucuagaacuuuuauuaaguagguacacuugacaguauugaggucauuugucauggugcuauuuaauuagucuagguuuaggcccuuguacuuauug

SEQ ID NO: 4136126 - RNA, 55 nt, Human
caaguguccaugauagucuuagacuaaguuuucugugcuauaugcuggacauaug

SEQ ID NO: 4136127 - RNA, 59 nt, Human
caaguuaugugcuggagcccagagucagugugaaagggacuccauaagcacauggauug

SEQ ID NO: 4136128 - RNA, 104 nt, Human
caaguucacaugcauccuuaauucuccacucuagaauuucaaauggaaguuuuaaacaauguuuuggcuucuugugaaaucugagaauccaguguauguccuug

SEQ ID NO: 4136129 - RNA, 66 nt, Human
caaguucugcagagauuuuuaugcacaccaauuuauugguaggcuuggaaaacuuugcuaaaaaug

SEQ ID NO: 4136130 - RNA, 80 nt, Human
caaguuggagucgauucaagguauugguucuuggucagucugcugaauucaaaacacuauuaccuuuaaucagcaacuug

SEQ ID NO: 4136131 - RNA, 62 nt, Human
caaguuuaaagugagguuugaacuugaaacacaagagcuucaaaccuucacuugcagaguug

SEQ ID NO: 4136132 - RNA, 104 nt, Human
caaguuugaccucccggucccugugccauucucccugcacuuugcgguuagccaggucaggcuggcucgggaagcaggggaucugggaaggaggcacuaacuug

SEQ ID NO: 4136133 - RNA, 122 nt, Human
caaguuuuuuuagcagaggagugacacguucagauuugcauucuagaaaaauuucuguggucuuagcaggagaaagguuuuagaagcagauggaucaguuaaaagauugcuauagaaauuug

SEQ ID NO: 4136134 - RNA, 106 nt, Human
caauagaagaaaccuugcaauuugggccuuggugccauggccaguuaccauguaagauguuguaacaccgugagaccaccagaucauaaggaaauauaaguuguug

SEQ ID NO: 4136135 - RNA, 74 nt, Human
caauagcagaccuagaaagcaaccaucuuucuucucuccuaaggauuccuggugcuuaucugucccugcaguug

SEQ ID NO: 4136136 - RNA, 64 nt, Human
caauauauucaguggaaaauguguugaagagaggauguaguucuucaaaaacacugaauauaug

SEQ ID NO: 4136137 - RNA, 55 nt, Human
caauaucuuuggcauuucuggugucaagaccuagccagagcuguuauggaugaug

SEQ ID NO: 4136138 - RNA, 75 nt, Human
caauauuucucucagacauggaagagagaguugaccauaaaauuuggugguccuuuuauuuuggagaaauaggug

SEQ ID NO: 4136139 - RNA, 72 nt, Human
caaucauucaagggagauaugaucguggcugagaccagguugagucacaguucugcugucugagagagauug

SEQ ID NO: 4136140 - RNA, 82 nt, Human
caauccaaguaaugauuguugccuggcuuugaccuucagcacaaccccuggaggcaguuuaggcagcgauuuaucaccauug

SEQ ID NO: 4136141 - RNA, 73 nt, Human
caauccauugcugcuucuugcaugaagucugacacauaugucuuauugcucagcacaagcagcagaaggaaug

SEQ ID NO: 4136142 - RNA, 65 nt, Human
caaucugccugugauuuuucucuaguagucuaaacacgagcauggagaaggccacaggugguuug

SEQ ID NO: 4136143 - RNA, 85 nt, Human
auggcauauuagcaaaaaugacaccagcagaggccugaaaagcauuuucauauuuucugcuugcucacucuugcuccuuugccau

SEQ ID NO: 4136144 - RNA, 79 nt, Human
auggcaucucguccacacuuaaguuuucaauacccuaaaaaauuuaucgaagggagauuuuaguuuggggaggugcugu

SEQ ID NO: 4136145 - RNA, 66 nt, Human
auggcauuuauguugacaauggacuccuacacagaggaugaucauggucuaggacauaauagucau

SEQ ID NO: 4136146 - RNA, 57 nt, Human
auggcauuuguacaauuuaggaauaaggucuuaaccaaaagcuauugugcaugccau

SEQ ID NO: 4136147 - RNA, 73 nt, Human
auggcccugccaggcagagugcuccagaaagcaaagucuuuuucuucauuuggagaacugugcuuugggcuau

SEQ ID NO: 4136148 - RNA, 58 nt, Human
auggcuacagauuugcugacaaucucugggccuauggagagaagccccuguuagccau

SEQ ID NO: 4136149 - RNA, 95 nt, Human
auggcuagcagcaaaacaauguuccuauauuagagacacauacaucuauaaauuucuaugcaggaaguaaugucauauaugcugcuauaacccau

SEQ ID NO: 4136150 - RNA, 77 nt, Human
auggcucaguggccaauuuccaucuguaaggcuucaaaccauuagguccaaagauggcugaauuaggccuguaccau

SEQ ID NO: 4136151 - RNA, 126 nt, Human
auggcucuggagaagacaagaggauagacaguuguaggggagaggagucacugauguguggugggaacauuccucucucuggcuuucucccccagcuucucucaucuuguccagcucuuggaacau

SEQ ID NO: 4136152 - RNA, 61 nt, Human
auggcuggucucccauggaaaacugaccuuuuccauuuucaguaacuccaagaccagcugu

SEQ ID NO: 4136153 - RNA, 88 nt, Human
auggcuucugcaccucuuaauaacuuucuaaagucaaauugguauaagagcaguuguaucuggaaaggguuagggggaaaaaggcuau

SEQ ID NO: 4136154 - RNA, 86 nt, Human
augggaacacauaacauugucaguucaacugcuuuaggaaguaauuuacugaucuuuagcaaagcugaagguguuauuuauuuuau

SEQ ID NO: 4136155 - RNA, 72 nt, Human
augggaaggugauuuuccaaaagcucaccuuuuuaaaggcaauuuuuaaaaggaaauccucacuuucuccau

SEQ ID NO: 4136156 - RNA, 55 nt, Human
augggaggcagacacuaaguucuggggucuccaguuuuaguggguggccacugau

SEQ ID NO: 4136157 - RNA, 101 nt, Human
augggagguaauaaauggaaaugcuguuauaagguacuugugugcuauucauaaagugguauaguauuauuugaaagagaauuuggauuaguuauaaacgu

SEQ ID NO: 4136158 - RNA, 84 nt, Human
augggauuguaacuagaagaaugcaccaagaaaucuuuugagacaccgcuuaucuuguaugucuucaucugguugugauuacau

SEQ ID NO: 4136159 - RNA, 82 nt, Human
augggccacagugaaguuuaaaguguagauguuuuccaauuauucagggcauuuaugcuaauuguacugacaaagagucuau

SEQ ID NO: 4136160 - RNA, 55 nt, Human
augggcccugugugcacguguguacgccugcacguguguuggucagggggcccgu

SEQ ID NO: 4136161 - RNA, 71 nt, Human
augggcccuuguaacgggcugacccaagugcccaggggcuagcugcccugggccagcucggaaggucccau

SEQ ID NO: 4136162 - RNA, 58 nt, Human
auggggaguuccaggcucugaugugagaucuaacucccagagcugggaagcucccuau

SEQ ID NO: 4136163 - RNA, 127 nt, Human
auggggcagguuaggugaauuuguggucccucuccuguuucugcuccacucucuccaggaugguggucuguccaggaguggggcagaggucucaggaacaaugcagauaccucuccccuagccccau

SEQ ID NO: 4136164 - RNA, 113 nt, Human
auggguaacaaaaugauuuguuucucuccaucucucucugcucccugguggagcuucuauaaaagauaggcuucagaggagaagaggguggaaaaagucuccagauaucccau

SEQ ID NO: 4136165 - RNA, 103 nt, Human
auggguaaccguggauggcacauuuuucugauuugacuugaaguauccauaacuaugauggacuuugccugacucagaaaucagcugccuuucagucucccau

SEQ ID NO: 4136166 - RNA, 75 nt, Human
auggguccaggaaucaaaagauggaaguaggaauagccccuuucaacuugaagaauugauacuuccugucccuau

SEQ ID NO: 4136167 - RNA, 91 nt, Human
auggguggaaggaagagaguguuuguuuccguggcugucucccugcaagggggcccagaggaggcaaagcucuguuaguugucccauccau

SEQ ID NO: 4136168 - RNA, 78 nt, Human
auggguggccaaugugagcugucaucuaggaccucagauaaggccuguggccagaacagccuauaguggccuuuccau

SEQ ID NO: 4136169 - RNA, 56 nt, Human
auggguggucugcuggaggcugugagagaauucucucuccugcagaccagaccugu

SEQ ID NO: 4136170 - RNA, 102 nt, Human
auggguucuggggcuuggggugguggaggagaggcgccuugcggaaagcccucuucaggcacucgaaggccucuugcuccucgacuccccaguagaacuggu

SEQ ID NO: 4136171 - RNA, 74 nt, Human
augguaccuacugaugugagaaugaaaugaaauaauauauguaaaacauuuagagauuggcacagaggugcuau

SEQ ID NO: 4136172 - RNA, 56 nt, Human
augguacuacauaaauauucaaguaggcagcuauuuggaaauacgaguaguaucau

SEQ ID NO: 4136173 - RNA, 77 nt, Human
augguagcugcagggaugaacaucuggccuccucaacgaacugcuugaggccagaugucaugucuuaugcuucucau

SEQ ID NO: 4136174 - RNA, 70 nt, Human
augguaugguccuuuucuugaagaaggccagagucauaucugcaauaaucagaacaggacuggcugccau

SEQ ID NO: 4136175 - RNA, 62 nt, Human
auggucaguugcagcuaauguugaugagagauuaaggaagauggaguuguagcagugacuau

SEQ ID NO: 4136176 - RNA, 57 nt, Human
auggucauaauccuugauucaaauaauucuaauuaaaggaaauaaggauaugauugu

SEQ ID NO: 4136177 - RNA, 59 nt, Human
augguccaaggaaaauggucguguaucuucugucaccaucaggaacguucauggacugu

SEQ ID NO: 4136178 - RNA, 69 nt, Human
auggucccaggaagacaacugggggcaagcuaucauggaaaagcuccaccuguuuucaagugggauuau

SEQ ID NO: 4136179 - RNA, 56 nt, Human
auggugagacaggaucaaccccucuaucuccaaauauagggggauuaucuuaccau

SEQ ID NO: 4136180 - RNA, 83 nt, Human
auggugagugauguuuauaucuaacuuaagugacaccagucuaaguuauacuugauuagaguuuuaugaauaagaaccaucau

SEQ ID NO: 4136181 - RNA, 60 nt, Human
auggugggauauucaugcaaugauguggucugcaucagugaaagugaauguucuagccau

SEQ ID NO: 4136182 - RNA, 75 nt, Human
augguggguacaguuuacaugagaggaagccuggcuuuacacaccuguuuccucuuucuaagcucuggccccuau

SEQ ID NO: 4136183 - RNA, 79 nt, Human
auggugucuuuugacagacaaauguuuuuaacuuugauuaaauccaacguauuaauuuuuguuuggcaguuuacgcuau

SEQ ID NO: 4136184 - RNA, 55 nt, Human
augguuggugccucuagagguagccauuaagcauaugguccuuggcaucagcugu

SEQ ID NO: 4136185 - RNA, 75 nt, Human
augguuuacugaucuuuuuggucaucaagaucaggaguuuaaaagaugguggucagggugaggaguggaauccau

SEQ ID NO: 4136186 - RNA, 87 nt, Human
augguuucaauuccugaugaugcaaagaaguuauuuggacuuuugaguaaaaauguguaugauaccuuugcugaggaauguagcuau

SEQ ID NO: 4136187 - RNA, 61 nt, Human
augguuugcagagacauuuccauuucaggcacuccucuaaaggcuuguuauugcauuucau

SEQ ID NO: 4136188 - RNA, 81 nt, Human
augguuuuauuguuuucauuucuuugaguuggauuugcugcucucuuaucuugauuauugaaauggaagcuauaacauugu

SEQ ID NO: 4136189 - RNA, 66 nt, Human
auguaaaguaucugaaaugcugccugacacauaguuagcacacaguaaaugcagauauagauacau

SEQ ID NO: 4136190 - RNA, 127 nt, Human
auguaacacuuauucuccuacagaaguaguguuuguggaauauucuuuaagaaacguuguucuagagaggucuuuuaaucuauucccuaaacaccuaaagucuuauuagcuuuuuacuguguugcau

SEQ ID NO: 4136191 - RNA, 65 nt, Human
auguaacaugcuugcuuugggcuuauguuguaaaagaauugcuaagaacagacaagcauuuacau

SEQ ID NO: 4136192 - RNA, 110 nt, Human
auguaacugaaguuaaucuuucauaagcucuugaaauuaugaaucuuguuuagagaaaaacuauaguuucaugagcuuuuuaaagcaggauauuguuauuuuaguuauau

SEQ ID NO: 4136193 - RNA, 71 nt, Human
auguaagaggacauucuggacaaggcaagcuccuggcauuugacagaugcuaaugcugcuucuuuuugcau

SEQ ID NO: 4136194 - RNA, 63 nt, Human
auguaagaugcucuauucuggacaaauauagacaauuucuuccugaggaauggcaucucacau

SEQ ID NO: 4136195 - RNA, 69 nt, Human
auguaagccgcgucuuuguuccacaguccuugcucugcugcauucuguggccagagcgccguugaccau

SEQ ID NO: 4136196 - RNA, 86 nt, Human
auguaauaagugaacuuuucuucuuguaaauauggucuuucuuuagagaucuuugaacaaucuggaaaaguuaacuauugugacgu

SEQ ID NO: 4136197 - RNA, 92 nt, Human
auguaauagguuaaaguauugguucauuuguucuucccucuucugaaagaaaaaguucaaaaauguaaucaguguuuaucuaguaguuacgu

SEQ ID NO: 4136198 - RNA, 73 nt, Human
auguaaucacuuccuguguuuaaacugucugugaauagaucauguauuuagcuuugcaaaggaaguuuuacau

SEQ ID NO: 4136199 - RNA, 111 nt, Human
auguaaucuuacuuuaggagaaacugcuucuaauuuuaggcauuuguucauagcaggugcuacaugaaccaaugccaaauuagcauuguuuuuaggguaauaaaucuacau

SEQ ID NO: 4136200 - RNA, 129 nt, Human
auguaauuccugucuucagagagcuugcagacugauggggaggugcaaucugaauguaaugcaguuuauguuuacauaguagcugcccuguauuaggccuugagcuaagcacauuuaugcagguuaucu

SEQ ID NO: 4136201 - RNA, 62 nt, Human
auguacaccaggugaagaugaauaugccaaccaaucacaguacaucuccacuggggguacau

SEQ ID NO: 4136202 - RNA, 68 nt, Human
auguacacguguccucacacguagggaguaauuuuuuuaaauucucucaaaaguagaggacaugacau

SEQ ID NO: 4136203 - RNA, 63 nt, Human
auguacccagugauuccuucuucaccacugauuggugagaaacacaggcaugaauaggugcau

SEQ ID NO: 4136204 - RNA, 58 nt, Human
auguagaaaguuauugucacugaucuggcaugucagagccugcaauagcuuucuucau

SEQ ID NO: 4136205 - RNA, 114 nt, Human
auguagaaauaagcauuguuaauauuauguuguauuuccuugcagucuuuguucuaaaugcucauaguugcacagaaugacaauauguacauguuuuuaauguuguauuuauau

SEQ ID NO: 4136206 - RNA, 129 nt, Human
auguaguaaaaaucauuuguauucucugauuauauaugucagauuccuaaauaucuugaucauguuauuuugcuaaagauauucugaugguggaucuguauaugauuuacauaaaugaggcauuugcau

SEQ ID NO: 4136207 - RNA, 80 nt, Human
auguaguaaagccaagauucuaauucaagauugucaccaaaauccauccaccaaucuagaagucauggcuuucuuuacau

SEQ ID NO: 4136208 - RNA, 56 nt, Human
auguaguaagugcgcaauaaauacugccaguaguaguauuugaugucuuuuuacau

SEQ ID NO: 4136209 - RNA, 68 nt, Human
auguauaaauuccuccucugcgccacccacuauucuagguacagggguaacaguggggaauaaaacau

SEQ ID NO: 4136210 - RNA, 76 nt, Human
auccuuggcuuuaagaagacugacagcucagcucaaacuccaguuggcguuagagaagcuuuuuaguuagcagggu

SEQ ID NO: 4136211 - RNA, 84 nt, Human
auccuuucaaucagcguuuaaagauagcuaauaagcaaacaauucuguuuucuuuaguuuugcuuuuaaugaaggacaagggau

SEQ ID NO: 4136212 - RNA, 78 nt, Human
auccuuugcaauagcaguuaaaaaucagcccuggagacauugagggcuguuugguaaaugcauguucguuuuuaggau

SEQ ID NO: 4136213 - RNA, 63 nt, Human
aucgagcuacucgcuaggaggagcagacugugaaguugcagcccugcagggugagugggcgau

SEQ ID NO: 4136214 - RNA, 68 nt, Human
aucgagcuguguuuccagaugguagcuuccaugccaucuuggcugcauaccaugaagcacaccuggau

SEQ ID NO: 4136215 - RNA, 74 nt, Human
aucgagggacauuaaucauuucugcauuaucucacucaccaguagaauauguaaaugugauuccugucaaugau

SEQ ID NO: 4136216 - RNA, 63 nt, Human
aucgcagaguggaaauugaugagcucuugucucuugaggcaugcaaauucuuuacucugugau

SEQ ID NO: 4136217 - RNA, 56 nt, Human
aucgggcauguccaugcuuucaucaaugaaaugggagcagaggggacauguuugau

SEQ ID NO: 4136218 - RNA, 94 nt, Human
aucgggugccugaaccgaucuuggucaaggcuuggagauaguagcaacucuguuucuucuuccugccuuagacuuggcucuccaugcaccugau

SEQ ID NO: 4136219 - RNA, 63 nt, Human
aucgguggguuuucacauuugggucuggacuguuuguucagcuucagugucaggcccguggau

SEQ ID NO: 4136220 - RNA, 63 nt, Human
aucuaaacuguuuacucucugccuccucagggagguuuuaugagaaguuagcucuguuuaggu

SEQ ID NO: 4136221 - RNA, 118 nt, Human
aucuaaauaaguuuaugucuuguagggaaggcacuuugucaugcuucuuuguaccuaagcauaugcuuugcaaaucauaaacaauaguguugauuuuauuugauauaaaaacuuggau

SEQ ID NO: 4136222 - RNA, 74 nt, Human
aucuaaugaugugaacaagcagcuuuuaaagucuuugcagggacugggcuuauuucuugugaacauugugagau

SEQ ID NO: 4136223 - RNA, 83 nt, Human
aucuacuuaaagaugucaaggcuguuucugcuuuauucugcaagagacaauuuuugguuuugcaaguucuaguaugggugggu

SEQ ID NO: 4136224 - RNA, 76 nt, Human
aucuagaugaaaaguaaaaggguuaauuaucuauacauaaagacaauugacuguauuuuuagcuuguguucuagau

SEQ ID NO: 4136225 - RNA, 79 nt, Human
aucuagauuggcaggaguauuacauuuucagacugaauauuuucauggaaagccaguguuccaucagccauuuuaagau

SEQ ID NO: 4136226 - RNA, 70 nt, Human
aucuagcuccuaugcaccuucagucucaaagaaaacugaugagcauccugcaagguacaagaugcuggau

SEQ ID NO: 4136227 - RNA, 71 nt, Human
aucuaguuuauuuugugucuuuuaugaggaaaagaaacauuacuuuucuggaauauuugacacaauuaggu

SEQ ID NO: 4136228 - RNA, 86 nt, Human
aucuaugaaaacacaauugucuugaaagcaacacuuuccuuuauaggaaccagguuuuauuuugugauaaaaauggauuuauggau

SEQ ID NO: 4136229 - RNA, 81 nt, Human
aucuauggccaauuuagucacucaagcagugcucaaaaucucuggguuagggcugcaaugggagauaacuugccauaagau

SEQ ID NO: 4136230 - RNA, 62 nt, Human
aucuaugucagacgcugugcuagucaguagcacaagacugaacaacacaugucuacauggau

SEQ ID NO: 4136231 - RNA, 99 nt, Human
aucuauugcguuuauauggcagccugagcagaggaauguaagcauguauaccgcugucuccauacugugcugagagcuccaugagagcagugaucagau

SEQ ID NO: 4136232 - RNA, 66 nt, Human
aucuauuguggugguuguggugauggucuagagcucugaauacacuaaaaaucacuuuaaaugggu

SEQ ID NO: 4136233 - RNA, 88 nt, Human
aucuauuuaggaaacauucgcaguguacaucagaacauaucaauagcaccuuuggugagugcuauguaccacauguucagagguugau

SEQ ID NO: 4136234 - RNA, 122 nt, Human
aucucacacccaaacucuuuagcuaacuuucucuacuccuucauauuuuaauugaaggcuucccugaucaagugauacuuuaggaagaucugaaggaagaaauaguuaacaguuugggagau

SEQ ID NO: 4136235 - RNA, 62 nt, Human
aucucagccuggauucgugcauccacauguugaaugagaugagagaaagucaaggugaagau

SEQ ID NO: 4136236 - RNA, 56 nt, Human
aucucagcuuuguggaaauggcugauggagucuucacccagaugagcagcugagau

SEQ ID NO: 4136237 - RNA, 84 nt, Human
aucucagggcugagaauuuagagacauagcucagaagguaauucaauaugugauugucucuaaauaggagucuuaccuagaggu

SEQ ID NO: 4136238 - RNA, 127 nt, Human
aucucagucaaauuguucccucucuuaucauucuauuuucauuuuuauuagcucuuguuuauacucaaaagaugggguuauaaaggugauaauggucagaucuagaagugaacucucuuacugcaau

SEQ ID NO: 4136239 - RNA, 77 nt, Human
aucuccagguccuggucuugagucuuaaccaccgcuucaguggcuugagccaaccaccaggaacacagucuggggau

SEQ ID NO: 4136240 - RNA, 77 nt, Human
aucucuagcuagaauauugaucugaaauuuguuuaaucagagggaauauauuuacagaagcauguaauagcuaaggu

SEQ ID NO: 4136241 - RNA, 128 nt, Human
aucucuaugccucaguuuggguauagccaaagaggauauuuugagaaauccuaugaauacucauaauuauguuuggugagauuuuucaaaauaccuuaauucugacucuuuaggaggcucagagagau

SEQ ID NO: 4136242 - RNA, 66 nt, Human
aucucucugcccaggggcuguggaugucauccauccuggccuaacuagccuacugagcugagagau

SEQ ID NO: 4136243 - RNA, 129 nt, Human
aucucugaaggaagguggaucuucuugaguccaggcuuggguucucugaguuauucuccugucucuugguuucaugggucagaggaccucguggccaaaggucugacaaggucauuuucuuuuucuuuu

SEQ ID NO: 4136244 - RNA, 62 nt, Human
aucucuggcaaugcagcaucgucugcccugcuuggcucucacauugguguugcugccuggau

SEQ ID NO: 4136245 - RNA, 78 nt, Human
aucucuuaagucuuauuuggucagccaggaaaacauaugagguaauauggcuuggacuaaauggaccguauaauagau

SEQ ID NO: 4136246 - RNA, 59 nt, Human
aucucuucugaaaccugucuuuagaauaaggaaucuagggcaagcaagcagaaagaggu

SEQ ID NO: 4136247 - RNA, 79 nt, Human
aucucuuucagauaagcagcgugguuuggugcagacacaaacaguagcacugaaucacaugcugcucuuuugaagagau

SEQ ID NO: 4136248 - RNA, 72 nt, Human
aucucuuucaggcccauauuuuucaaauccaucauuauucaauugaagauuuugauguuccugaggagaggu

SEQ ID NO: 4136249 - RNA, 57 nt, Human
aucugaaagaugagugguccauuaucaguugagaaugggucaaagaauauuucagau

SEQ ID NO: 4136250 - RNA, 58 nt, Human
aucugaaguccuuauaaucugauuuucacuauauuagauuuguguaggggcuacagau

SEQ ID NO: 4136251 - RNA, 101 nt, Human
aucugacuacagccuguguuacccuuaucagaacuuucuaacagcuccucuucuccgcucaggagaugagggguagaaaggacuuaggcuaaguggcaggu

SEQ ID NO: 4136252 - RNA, 58 nt, Human
aucugacuuuugcaccugugaaaauaaccacagcaccucgcaggucauuaggcuaggu

SEQ ID NO: 4136253 - RNA, 86 nt, Human
aucugagcuccauguucuauucauugcuccacgagguaacacaugauuuucuacuguacugggcacugaaaagaaggcugccaggu

SEQ ID NO: 4136254 - RNA, 57 nt, Human
aucugcaggugggugucucagagaagaaagccaucucucugugcauugccugcuggu

SEQ ID NO: 4136255 - RNA, 126 nt, Human
aucugcaucaucagcaucacauaggcgcuugcuagaaaugcaaauucucucucgcucuagaggcuugugguagggucuagaauuuguauuucuaguaagcucccagaugaugcugauucugcuggu

SEQ ID NO: 4136256 - RNA, 60 nt, Human
aucugccuggccugcaagcuaaaaaucuaagauugcuuggaugacugacaggcuggagau

SEQ ID NO: 4136257 - RNA, 79 nt, Human
aucugcugcuccugagguuggagauccaucaaguugaucuuaccuuuuguugcgauuuucuccucuggauguuuuagau

SEQ ID NO: 4136258 - RNA, 128 nt, Human
aucugcuuuucauguaacccauguccuuugugucugagcaagcaaaaugggagauucccugaauacaugggcccucuguacauuuuguuuugaugcuucucaaggaaaggguuuccauugggguggau

SEQ ID NO: 4136259 - RNA, 62 nt, Human
aucuggaggcauuacucugucuugcuacauagccuuucaggacuuucuaaugcucuguagau

SEQ ID NO: 4136260 - RNA, 130 nt, Human
aucuggcaguagggucaggugucuaaggcacaacauuuaaggaggcacugacucacaaugucuuauucucagugcacucgcucucagugccuccuuaaauuuugccuccuaaaagcccugcuugccucau

SEQ ID NO: 4136261 - RNA, 127 nt, Human
aucuggguggaggcagggagguggauagagugagugaguuucuccuguagucuggaggaaauccccagggcaggagaaagacucaccauacucacuuuucuauucuaaccuugaaaaucucccagau

SEQ ID NO: 4136262 - RNA, 128 nt, Human
aucugguacuuaauaguaauuggcauuauaagagucuguauauaacaaauauccauccaaacaacugcgguauucaguuagccacagcuauucuugcaugcuuagucuucauuguuaacuguucguau

SEQ ID NO: 4136263 - RNA, 61 nt, Human
aucugguccauugugcgcccgugaaccugcuaaugauuacauguguacacuuggccauggu

SEQ ID NO: 4136264 - RNA, 58 nt, Human
aucugguguagccuccuuugcuggcaguaaaccagcaaagcaguggcuaagcugagau

SEQ ID NO: 4136265 - RNA, 95 nt, Human
aucugguucggauuuugaucuguacuuagaauuaaauauuuuugguuaguauugaaaugguaguucccugaguauuuacagucaagauuccagau

SEQ ID NO: 4136266 - RNA, 88 nt, Human
aucuguaauauccauacuuuuagugauguuaagguuauguucauauguaagaauaaugauuucuaagaaccagugaggauauuuaggu

SEQ ID NO: 4136267 - RNA, 56 nt, Human
aucuguaauuuugaaugcaaauauaguaauuauauuugcauggccggauuauggau

SEQ ID NO: 4136268 - RNA, 73 nt, Human
aucuguagagaagaagaguauuuguaguagauacuguugccugcauauuauuaugguugcucuuuucccagau

SEQ ID NO: 4136269 - RNA, 125 nt, Human
aucuguagaugcagagagacuggagaccagaagacaaagacagccucaugugcaugaacuuagccaaguugcacacuggcuugcugacuaaucugucuuaucuccuuaucucugugaaugcagau

SEQ ID NO: 4136270 - RNA, 82 nt, Human
aucugucagauuuuuuaugaccuaaaacuauucuauggcauacaguaaugguuuauaaucuaggugugaagcccugcuagau

SEQ ID NO: 4136271 - RNA, 81 nt, Human
aucuguccaacagugucugaaauaacaccggauggccggcaaaaggguauccauugucacaggcguauugguaccgcaggu

SEQ ID NO: 4136272 - RNA, 62 nt, Human
aucuguggcgcaaacaaaggcucuacuuuauuuggaggcugaccuuuuugcuguuacaagau

SEQ ID NO: 4136273 - RNA, 57 nt, Human
aucuguucuugugucaguaauuguuaucuccuuaaggagaacugaguaagaacaggu

SEQ ID NO: 4136274 - RNA, 87 nt, Human
aucuuaacuguacuuagugauuggaaggugcuuaaggugaaaggcuauguugacacuaagauuuccaaacaucuaguauauuuagau

SEQ ID NO: 4136275 - RNA, 89 nt, Human
auguaauaauuguugcagacucaagaaaauaaauggauuagucauaaaauccccugccauuugugcacuucuguagcugccuauuacau

SEQ ID NO: 4136276 - RNA, 72 nt, Human
auguacauauagccuggugagacgguugacaggagcaaccugcccacgucauguuucauuugugcuguacau

SEQ ID NO: 4136277 - RNA, 106 nt, Human
auguacugucguguuacugagcucgguggaaggugcuagaacaaggacugcucuccagggcucucuguguuucucaccuuaccucgaggucaugccugcaguuugu

SEQ ID NO: 4136278 - RNA, 86 nt, Human
auguagacuccuuuuucaggcaugcauucugcagguuagaauuugucucuccuaaccacauugugguugugucccuggaacuacau

SEQ ID NO: 4136279 - RNA, 82 nt, Human
auguaggauguaagaauuuuauguauuuacugauuaauuuauacuucaugucaauacagaaaggauauuuugcaaccagcau

SEQ ID NO: 4136280 - RNA, 65 nt, Human
auguaugaguuucuucauucucuuguggugcccucuuucaguaacaaggagaagaaauuggucau

SEQ ID NO: 4136281 - RNA, 60 nt, Human
auguauguguacacaaguauauauacauguguauauauguauaugaguguauacuuacau

SEQ ID NO: 4136282 - RNA, 78 nt, Human
auguauuaugguguauauugcugggccaaaggcuauguaagucuucaacuucccuagaugucauaccaacucauacau

SEQ ID NO: 4136283 - RNA, 56 nt, Human
auguauuucuccaugacacucauaaaaacaagaaaugagguauuugggagauauau

SEQ ID NO: 4136284 - RNA, 71 nt, Human
augucaauguguacaggagcucagagacuauaauuauuagcuaugggcuaagaaccuggcauacaucacau

SEQ ID NO: 4136285 - RNA, 57 nt, Human
augucacauguuuaauguggacuugcuggaagucagggggucuuuagcgugugauau

SEQ ID NO: 4136286 - RNA, 79 nt, Human
augucacauuuucacaguauucaugaacauggaaugggagccuccaauuucuguaaucaagauauuugagaguugaugu

SEQ ID NO: 4136287 - RNA, 83 nt, Human
augucacugauaaucccacuagggagaaaaguccuuggucaacacuuugggguuuuuuucucccugguauuuacuuaguacau

SEQ ID NO: 4136288 - RNA, 90 nt, Human
augucacuguuuacccaaaagucacucaggagcaaguuuuuacuuuucauguaauugugugguuuugagagaucuuuuugguauugacau

SEQ ID NO: 4136289 - RNA, 56 nt, Human
augucagagcuuccacaauagucuguugucaauuuagaguauggguagcuuugcau

SEQ ID NO: 4136290 - RNA, 73 nt, Human
augucagccucugaggucacagauuucaagagaagcuuuagauauuuugccaucugacuucaugggcaggugu

SEQ ID NO: 4136291 - RNA, 66 nt, Human
augucaggccugcucaaacagauuccugggcccaagcccagagguuugaucgaguaggucugggau

SEQ ID NO: 4136292 - RNA, 76 nt, Human
augucagucuuugcuuaugacaauagaaaugaucaaaugaaccuguuuuuuauauuccuuuuggcagggacugcau

SEQ ID NO: 4136293 - RNA, 60 nt, Human
augucauuuuauuaauaauggagagagucugcauggucuaucuccagaugcagaugacau

SEQ ID NO: 4136294 - RNA, 62 nt, Human
auguccauuuuuauaagugaagcugaaagagguagagaaguuuuauuaacaacuguggacgu

SEQ ID NO: 4136295 - RNA, 85 nt, Human
auguccccuuagcuacacugaggcugcuuaauuuugauacagguuggacagaauuuaucuucagugaggaaaucugacaggacau

SEQ ID NO: 4136296 - RNA, 101 nt, Human
auguccuaugcaaguauacaccaaauguggcaggaaaguauuuuaaaauuuuauauauuuuacuuuugcagccauuauugcugcauuguuugcagaaacau

SEQ ID NO: 4136297 - RNA, 89 nt, Human
auguccuuaaguaccucuugaaagcuccauauuguagagaagacccuaugacuucuagauccgcagguuuucagugggguaggguacgu

SEQ ID NO: 4136298 - RNA, 74 nt, Human
augucggaggaugcacuuugucaguaaguuaggcauucagucuucacugucaacacaaaugcauucugugacau

SEQ ID NO: 4136299 - RNA, 97 nt, Human
augucuaaaauuugagaaguaugaaaacgugcaaaguagaauuaaccacuggccaugcccguucauucauacuuaaccucuauuaacauuuaggcau

SEQ ID NO: 4136300 - RNA, 85 nt, Human
augucuaagauacacaugcauuuggaguuuucaaguccuucagugaacaaauuggacuaaaggcucucagugacacaucagauau

SEQ ID NO: 4136301 - RNA, 77 nt, Human
augucuaauuacucaguggcacuuuggaauuuuuaugaguaaauagccaaugaagcaauugaaauuuaguuagauau

SEQ ID NO: 4136302 - RNA, 64 nt, Human
augucuagguaaucguugaggcccagcuccaccacggcgucuccucgaagcaaccugcaggcau

SEQ ID NO: 4136303 - RNA, 80 nt, Human
augucuauauugagcguauauguacacauauauuuaugcauauguggauguguguuuauacauauauucuauguauauau

SEQ ID NO: 4136304 - RNA, 69 nt, Human
augucuccaagcagcugaccuuuaaaggguccaauucuucuuuuaagaggaggcuguuugaagagaugu

SEQ ID NO: 4136305 - RNA, 70 nt, Human
augucugagacaaaugauuugcuaaaaauuugccauagcaauggcauauagaaacauauguuugagacau

SEQ ID NO: 4136306 - RNA, 63 nt, Human
augucuggagguguggggugucuaacuggaucagauuucuacaaccuggcuuccucuuggcau

SEQ ID NO: 4136307 - RNA, 57 nt, Human
augucuucauucuguauguccaguuguauaccaaaaacuggaagaagggaaggacau

SEQ ID NO: 4136308 - RNA, 56 nt, Human
augucuuugccauaguucauauugaauaaaacaguagauaaaagggcaaagggcau

SEQ ID NO: 4136309 - RNA, 70 nt, Human
augugaacauacauuuucauaucucuuaggaguagaauuacugggucauauggcuguuguguguuaacau

SEQ ID NO: 4136310 - RNA, 74 nt, Human
augugaacauucuucacaccuguuccuguucauagggcaaugggcuucgacauacgugaggaauacagucauau

SEQ ID NO: 4136311 - RNA, 103 nt, Human
augugaagaaaaagggacaggaaucagcauaucuugagcuucaugcccagccacgggcuagaaacauuacauguguuaauucaaguuccugcaaucaucauau

SEQ ID NO: 4136312 - RNA, 71 nt, Human
augugaaguaaugcauguauucauuguggaaugguuuggccauuccaaaaugugcauguguuucagaauau

SEQ ID NO: 4136313 - RNA, 59 nt, Human
augugacccacuggugugguguuagguuggacauaugacacucuuucugugggucacau

SEQ ID NO: 4136314 - RNA, 65 nt, Human
augugacccuuggucagagugcccuagagaagcuagagccaaacuguggcaaggccagucuucau

SEQ ID NO: 4136315 - RNA, 75 nt, Human
augugagggucauuuggaaguggaaucuugaaaguugacuggauaguccacucuugaugaucugugaauuuacau

SEQ ID NO: 4136316 - RNA, 81 nt, Human
augugaguauuccuucugccuccuucaugcugaauuccuuggaaauagaagaggaaaggggcauguagggaucacucagau

SEQ ID NO: 4136317 - RNA, 78 nt, Human
augugaucaaaaaccugaaggaugauacaacagugauaauuuguuucauucuugcaucauccuucuaggugauuccau

SEQ ID NO: 4136318 - RNA, 96 nt, Human
augugauuauuaacuucuugagacuauauuguuaguaauauuuugaaaguaauauuguuaguaauauuucgaaagaauaaagugccauaaagacau

SEQ ID NO: 4136319 - RNA, 75 nt, Human
augugauuguccuuuuccuuaucugugucuccaacuacuggacuauacacagugucagggcaggggccaguccau

SEQ ID NO: 4136320 - RNA, 81 nt, Human
augugcaaauggaggcaaaauugguuucuuucauaguaggggagagaagucgauugaaccuacuagacaaaauuugcaugu

SEQ ID NO: 4136321 - RNA, 90 nt, Human
augugcaaucaguaucaggagcugcauuauccugugcauggagcucagaacagaccacaagauuaugcagcucccuuuguuacuugucau

SEQ ID NO: 4136322 - RNA, 64 nt, Human
augugcacuguaauagcauuauaagugacucacuggagugcaauuaucaguauaguugccacau

SEQ ID NO: 4136323 - RNA, 64 nt, Human
augugcagguuuuacuugcagucaucuccuaauacagagaaaggacacacagagacaugcgcau

SEQ ID NO: 4136324 - RNA, 87 nt, Human
augugcauugauuaguauugcauuuuaauaugugcauugauuuuagugccuauucaauauaugcauuuacuauauaucgaugagcau

SEQ ID NO: 4136325 - RNA, 71 nt, Human
augugccuaagcucuguucauuaaucugugauaauuagacuuauuugcaaagguuaacagcaguggcacau

SEQ ID NO: 4136326 - RNA, 65 nt, Human
augugccuggcuuagagguugccuuucagguuuaccaggaggggcaguugaaaggcaagcaucgu

SEQ ID NO: 4136327 - RNA, 55 nt, Human
auguggcagaaagcauguggacagauaauaacuguuuguaugacuuuguauauau

SEQ ID NO: 4136328 - RNA, 61 nt, Human
auguggcagugggaggugaauuagaggguaaccaaguaauguuagcuuucuauggcugugu

SEQ ID NO: 4136329 - RNA, 88 nt, Human
auguggccuguggggcagaugucuggacaccucaugcuuuccuugccuuagcugaaagguuauuuaggucugcuuguucaggccacau

SEQ ID NO: 4136330 - RNA, 56 nt, Human
auguggcucagcaggcucccguuucacuuuuuugccaugggauuucugaggcacau

SEQ ID NO: 4136331 - RNA, 55 nt, Human
augugguaagggacuugugaaugcugaagaagcauuuauugaacacugacuaugu

SEQ ID NO: 4136332 - RNA, 130 nt, Human
augugguaggagcuggccuggggaugauuuaucaggcucucuucagugguccuccggcccaaauaggacccuucauagaggagaagcuguaggugccuuuugacccaggcuuggaaauagcccuuugcgu

SEQ ID NO: 4136333 - RNA, 86 nt, Human
auguggugauggugggaacagaauuagaguuuaauaaaguuuaucuaguuuaucugucauuucccauauccaaaacuucaccauau

SEQ ID NO: 4136334 - RNA, 57 nt, Human
augugugcaaugcuauuuuggcuuuuaaaauuaagucaggaaagaaaacguacauau

SEQ ID NO: 4136335 - RNA, 60 nt, Human
auguguggauauguguguguauauauuuguaccuauguauauguaugcguauacacacau

SEQ ID NO: 4136336 - RNA, 57 nt, Human
auguguguaugagucuguggagaccuggagauaggaagauacagauuauagauacau

SEQ ID NO: 4136337 - RNA, 84 nt, Human
augugugucagguuuuguggaagaagggaauuauuuauacuuauauuaaauaguuaggaaaguccagggagcuuggacaggcau

SEQ ID NO: 4136338 - RNA, 76 nt, Human
augugugugugugcgcguguauauauguauacaucuauguguguguauauguguauauauguguguguauauauau

SEQ ID NO: 4136339 - RNA, 123 nt, Human
auguguuaaaaauggcauuuguuaucaguccuccagguguuacauaugacucccagucacacuuagaugacaguauaugugaaagaugcuuaggagaggcaagagucugaaaggccaacauau

SEQ ID NO: 4136340 - RNA, 57 nt, Human
auguguuaguggaaaccaaaaugucuguggaccagcacagauucuccacuaacauau

SEQ ID NO: 4136341 - RNA, 104 nt, Human
auguguuggcaauagaaacagauuuaagaagccaaggugaagaauuuuaccaguuuuuaaauuguguuaguuuuagaucuuuuuccuuguuggguccuccauau

SEQ ID NO: 4136342 - RNA, 65 nt, Human
auguguuguauagaugagcuucuauacaugggaacagacaucuggcauuauuuguuacagcacau

SEQ ID NO: 4136343 - RNA, 63 nt, Human
auguguuucagaggguguagacuacaaaaugaaagagacuguagauuacaaaaugaaaugcau

SEQ ID NO: 4136344 - RNA, 129 nt, Human
auguauaaucauuugcuuccuguuccuugugguuuuaaaguuguuuuguauguuuaaauuugauuuuacucaaauuucagaacccaaauuagcgcaagaaucagacaaagcauaacuuucuauaaauau

SEQ ID NO: 4136345 - RNA, 88 nt, Human
auguauagguuggugcaaaaguaacugugguuuugccauuacauuccauggcaaaaaccgcaauaacuuuuguaccaaccaaguacau

SEQ ID NO: 4136346 - RNA, 68 nt, Human
auguauauuacaaguagacuaacuuucagguagauugguuccuggaggaauaucuguguaaauuacau

SEQ ID NO: 4136347 - RNA, 73 nt, Human
auguauauugauaaaaugcagacauguauuagguuuaaauaacuuugacaugucugcguuauaucaauaucau

SEQ ID NO: 4136348 - RNA, 74 nt, Human
auguauguagaauaaugcuggagauugaguguuguauacuuuugcauuuagaaccagcauuuguccuggaucau

SEQ ID NO: 4136349 - RNA, 58 nt, Human
auguauguaguguacauauacaguguguauaugcacacacauauguacacauauauau

SEQ ID NO: 4136350 - RNA, 57 nt, Human
auguauguguguguacuuaugucauuuaaauguuuguauauguguacguguauacau

SEQ ID NO: 4136351 - RNA, 63 nt, Human
auguauuauucagucuuguaaggaguuaagucucuuuguuuucacuccugcugagugaaacau

SEQ ID NO: 4136352 - RNA, 76 nt, Human
auguauuauugacaguagagcauuuguuuugaugaggcaucaaugacaguugaauucuacauuugacauuuuacau

SEQ ID NO: 4136353 - RNA, 79 nt, Human
auguauuuuguggcuugguugcucuugauucuaugcuauuaaugcuuugcaggcccaucaagucaucagcaaaauacau

SEQ ID NO: 4136354 - RNA, 95 nt, Human
augucaauuuucuaucauuaacucaacagacauuuuuaagcacuuacugagugucuuuggcuaagugcugugagagauaaaaauagaagauacau

SEQ ID NO: 4136355 - RNA, 69 nt, Human
augucacuccagggacacaggugcagcaaauuuauggaggaagcaccuuguguuucuccugagucacau

SEQ ID NO: 4136356 - RNA, 107 nt, Human
augucacuugcauuugagcaaagcccccuaucucuugucuguuuugcaaagccacugcuguguucuccuacagauaaggagggcagcuuaaguagucuguaaaacgu

SEQ ID NO: 4136357 - RNA, 65 nt, Human
augucacuuuacacuccuacuaaaucuuucucgggauccgggcuuugggggaggguggggugcau

SEQ ID NO: 4136358 - RNA, 129 nt, Human
augucaguagaguucauuugagccaaauuugaggacugcaagcugggaguaucuauuuaaguugcccggaauauacacuccuggguugcaguccucaaacuuggcccaaaauaaacucuauacuuauau

SEQ ID NO: 4136359 - RNA, 55 nt, Human
augucagugguagacccagagguugagaaaaggcuuccagaagacucauugacau

SEQ ID NO: 4136360 - RNA, 72 nt, Human
augucaugcuaguuaagaacacaauguauuuauagcucaauuauacauuuucugaugaauuuggcauggcau

SEQ ID NO: 4136361 - RNA, 86 nt, Human
augucauguucuguaaggagaacuacauuauuccuacaaggauucaaauuggaucccauguaggagaauguuacagaucagcacau

SEQ ID NO: 4136362 - RNA, 69 nt, Human
auguccauucucuuccuagugaugggcuuugcuacaggaggagggccaggauaggagugagauagacau

SEQ ID NO: 4136363 - RNA, 108 nt, Human
auguccuuuaagacuauccaagccuguuuagaaaauagugaagcaaguaucaacuacauugacuucugucacuuuguuuucugagaacuugauacacuuacuugacau

SEQ ID NO: 4136364 - RNA, 78 nt, Human
augucuauuagauacccaaguggaucugucuaauggguauuuagacagauccacuuggauaucugucucaauggacau

SEQ ID NO: 4136365 - RNA, 71 nt, Human
augucuccagucuguguccauaugcuucuggacaauuaacuuccaguuuaaggcaggacaugggaaugcau

SEQ ID NO: 4136366 - RNA, 105 nt, Human
augucugaauuuuuaccugucacuuuucucccuccugccuucaucuauaucuauaugaagaugaaggcaggaagggagaaaacuuuacaggaaauucauagauau

SEQ ID NO: 4136367 - RNA, 59 nt, Human
augucugcgaaggcaagggcauguauagcuugaaaaauauccuuugguuuccaugacau

SEQ ID NO: 4136368 - RNA, 70 nt, Human
augucugcuuuccuuuuaaucacaaucuaagaucaggucuucauuucacagugguagaggaaguugacau

SEQ ID NO: 4136369 - RNA, 69 nt, Human
augucuggaggaaaagguuaaaugaaauggccuuacuuugccaucccaggaaaucaauucuuccagcau

SEQ ID NO: 4136370 - RNA, 59 nt, Human
augucugugggggaguccuuugacugaauccuguggucagagaggcccccugcagagau

SEQ ID NO: 4136371 - RNA, 66 nt, Human
augucuguuaaucgacccuaauccaucaugcuguuaguaguuacugggaguccuguugacagauau

SEQ ID NO: 4136372 - RNA, 63 nt, Human
augucuuauuaagaccagugacucuugugacuaauucacaagucauguuuuuuggaaagauau

SEQ ID NO: 4136373 - RNA, 69 nt, Human
augucuugaaaugucucacuuagacuuucuuauguucagagaaauacagagagaacauuuccuagauau

SEQ ID NO: 4136374 - RNA, 77 nt, Human
augucuuuaugacuuauucagaaggagaaauggaacuaaagcucaguccucuaauucuugaaugagaagugaagcau

SEQ ID NO: 4136375 - RNA, 63 nt, Human
augucuuuauuaauaucaugccaagggaugacauuaugagccuugcagaauugauuaggacau

SEQ ID NO: 4136376 - RNA, 55 nt, Human
augucuuuggcuuugacauggccuuugaaaugaguccaugcgagguugaaggcau

SEQ ID NO: 4136377 - RNA, 57 nt, Human
augugacaugggucaucaaaagugucuguucagggacagcagauccaaaagucacau

SEQ ID NO: 4136378 - RNA, 71 nt, Human
augugacuguggguuucugguuccugacccauaaauggaaaaggcagggcugaaagcucucacagucucau

SEQ ID NO: 4136379 - RNA, 66 nt, Human
augugagcaaggccagggccgugaauuaaaugagagacccauggcugcuuucccuuagcaccacau

SEQ ID NO: 4136380 - RNA, 56 nt, Human
augugagcaucuuggcagauaugaacacacuguguucagauucaggguguuuacau

SEQ ID NO: 4136381 - RNA, 88 nt, Human
augugaugaaaagggucacagggaaaauagugcguccacauucaacaauucugauuucagcauucuuguuuuuccuacccucauacau

SEQ ID NO: 4136382 - RNA, 64 nt, Human
augugauuaggcuucaggaacuugagauggagagauaauccaggugaacccagucuaaucauau

SEQ ID NO: 4136383 - RNA, 82 nt, Human
augugauugacuaaaaucccaucggagaggaggauuguguuguagcaucccccucuuggauggcggcaagaugaaauuacau

SEQ ID NO: 4136384 - RNA, 83 nt, Human
augugauuuggggaguuucuguaauucccuguaacaauguuuucaucuguuaaaaguggaauaauaguugcuaccuuacacgu

SEQ ID NO: 4136385 - RNA, 63 nt, Human
augugcaguugaagcauggggagaaauauaggcucaugggucuuccugaacuaucaggcacau

SEQ ID NO: 4136386 - RNA, 57 nt, Human
augugccugcuaccugacuuguuucuaggcagauacgaguauauuguggagguucau

SEQ ID NO: 4136387 - RNA, 76 nt, Human
augugcuccauucauucaucucuaaaaugccugucaaucaaagucaggcaaauugugagaaaaugaaacuguaugu

SEQ ID NO: 4136388 - RNA, 62 nt, Human
augugcugaauccacucuuaggaaaaugacuggucuuuuuccuugcuguguauucagagcau

SEQ ID NO: 4136389 - RNA, 92 nt, Human
augugcuuucugcaugguuauauacuacuagugauuuuaucaaaacuucuaaaauuuaaauuacgugguaaaagaucuguaaaaggcugcau

SEQ ID NO: 4136390 - RNA, 72 nt, Human
auguggacaagauugcugcaaucaacaaguauggggcacacccaugcuggguagugcaggaauagaccauau

SEQ ID NO: 4136391 - RNA, 55 nt, Human
auguggacacugcuggacggucaaagaugcacuuuagaauguccaguguucauau

SEQ ID NO: 4136392 - RNA, 66 nt, Human
auguggauuauacuuacagaagcuguuuggaaaccuucuuagcaguuugaaaguaugaguccauau

SEQ ID NO: 4136393 - RNA, 62 nt, Human
auguggcuagugcaacugagaaacuaaaucuuuuauuuuagcuuaaauguaaauagccacau

SEQ ID NO: 4136394 - RNA, 63 nt, Human
augugggaauuuguaaguguucagcaugguggaagcauggaggucacagggcaggucucaugu

SEQ ID NO: 4136395 - RNA, 74 nt, Human
augugguagucuccagcauuccuuccaucccucacccauuguguaggauguggauuguaggaaacugaucucau

SEQ ID NO: 4136396 - RNA, 55 nt, Human
auguggugaaucuaugugugacuaauugaaguugcacacagugaucuauccacau

SEQ ID NO: 4136397 - RNA, 65 nt, Human
augugguugcuucaucuguaaauaaggauaaauuauuuccucauuuacaggugaagcaacuauau

SEQ ID NO: 4136398 - RNA, 59 nt, Human
auguguaaaaaaaugccuuugacaacaagcauagugggucaaagcacauauuugcacau

SEQ ID NO: 4136399 - RNA, 73 nt, Human
auguguaucuuuacuuagugacuuauggagucguaacuauuaggacacauacagcaguaagucuaaggcauau

SEQ ID NO: 4136400 - RNA, 55 nt, Human
auguguauugagcaccuacugcaugccagcccugugcugaggacucaauauacau

SEQ ID NO: 4136401 - RNA, 71 nt, Human
augugucuuacauaauuacaugugugaguugagagguccaggcuggagaugugaaugugagaccuaagcgu

SEQ ID NO: 4136402 - RNA, 112 nt, Human
augugugaguacauuuauaaauagcuuugacgugguuucaguuuucuguuuugacaacauagaaacagauugaaauucguaguauuuucuccuuccugcucccauuccacau

SEQ ID NO: 4136403 - RNA, 81 nt, Human
auguguguguguauauauguaaauaagucuaauguauacuuauaaucuauauauuuguauuucguguguguauauguauau

SEQ ID NO: 4136404 - RNA, 58 nt, Human
augugugugugugugcauguguguguguguacacacauauaugugcguguauauguau

SEQ ID NO: 4136405 - RNA, 65 nt, Human
auguguuaacauuuguaagauaagcauagcucagugagccaauauuuuccaaaugaugacuacau

SEQ ID NO: 4136406 - RNA, 88 nt, Human
auguguuaaggaaugcaaguuguaaauguagccagaagauccuaauucuucuagggcaucaugacaaauuacagaaauuuaacuucau

SEQ ID NO: 4136407 - RNA, 56 nt, Human
auguguuaauuggagcagcagggagaaggcucagcagcugcuuucaaaugacacgu

SEQ ID NO: 4136408 - RNA, 69 nt, Human
auguguuagauauauuuaugugggcuuucuugggcagaugucauuguguacaugaguguaugagcauau

SEQ ID NO: 4136409 - RNA, 76 nt, Human
auguguuaucuuauuaucacuuaugagcuuuuugcaugacaccaguagaguugaguagugguaacagagaccacau

SEQ ID NO: 4136410 - RNA, 68 nt, Human
auguuaagauucugaauauuaugguggccuaaaguaggcuucuugguacaccagauuauuuauaacau

SEQ ID NO: 4136411 - RNA, 81 nt, Human
auguuagcuauaagaagagcucuuaugacuuaaugggcaaccuugauccauauguguuacuucuccugguauagcucacau

SEQ ID NO: 4136412 - RNA, 67 nt, Human
auguuauguaugagggaaugauuaaauacaauaaugaaaguuugguuaggaaacuucuauaugacgu

SEQ ID NO: 4136413 - RNA, 90 nt, Human
auguuauuccuaccauuugguauagugaaaaggaacuuuucaggaguucucuuaaauacuucacaucuccaggcagugguacuuuaauau

SEQ ID NO: 4136414 - RNA, 127 nt, Human
auguucaauauaaaugagaucaacugaagaagcagaaaagggcacuuuuggcaccauccaacacgccuuaggaagugcugccuucucugccuacuuugggugaauauccagagauguuuuagaacgu

SEQ ID NO: 4136415 - RNA, 59 nt, Human
aucuuagaauauacacuacagcuuaauucauggaauauaagauguguauauauugggau

SEQ ID NO: 4136416 - RNA, 61 nt, Human
aucuuaggaguaccauggaugccuagaaucuugucaaaggcucuccaggggcucccaggau

SEQ ID NO: 4136417 - RNA, 117 nt, Human
aucuucaaggcagagcuggggaaaggguauuuuaucauuucugcaaacaacauagcauggcuccaguguugcaguaaaaauggagaggaauccaguagucuucggcaagguggagau

SEQ ID NO: 4136418 - RNA, 63 nt, Human
aucuucaauuagauuuaccaauuguuaguauuuugugacauuugcugaaaguuaguuggagau

SEQ ID NO: 4136419 - RNA, 68 nt, Human
aucuucacuguuaugaagcucugggaguuauuuaaaucucucagcaugcuuccucugacggugcuggu

SEQ ID NO: 4136420 - RNA, 96 nt, Human
aucuucaggccgacaaccucaucuuuggugagcugcgagugaggacugcggugcggcuccuuagccggagcagcucaucuaguaguuccugaaggu

SEQ ID NO: 4136421 - RNA, 81 nt, Human
aucuucaucccaauggaauguuggcagaagugauauacaccauuucuagaucaaacuuuuauauacaugggcaugugagau

SEQ ID NO: 4136422 - RNA, 90 nt, Human
aucuucauuuauguauauguuauuuauguuuguugugagaguugaugucuacagcuaggcaaaaaugacauuucaugcauuugugcugau

SEQ ID NO: 4136423 - RNA, 59 nt, Human
aucuucuaacgaaauaccucagacuuucacuugaaagauaaagaaguuuuguugaggau

SEQ ID NO: 4136424 - RNA, 86 nt, Human
aucuucugggaccaucugugucuacuuuuucaaaaagcagauugugugaaaugacagguggguaggacacagaagguaauagagau

SEQ ID NO: 4136425 - RNA, 82 nt, Human
aucuugacugagaauggcauaugauuuuguuuuaucuuauuuuagagagaaacauuuagauuauaugucuuuuaucuaugau

SEQ ID NO: 4136426 - RNA, 70 nt, Human
aucuugagaguuaauguaucuucuacauaauaggcauucagcuuacaugugauaaauugauuaaaaggau

SEQ ID NO: 4136427 - RNA, 75 nt, Human
aucuugggaccuuggaggucagcuggcccaccuuuaccugaggucuggcucuucuccacagaauucuugcaaggu

SEQ ID NO: 4136428 - RNA, 64 nt, Human
aucuuguucucccuuguucuuagaacaauauaugacaccuaagagcaaucaacagaggcaggau

SEQ ID NO: 4136429 - RNA, 63 nt, Human
aucuuuacaguguaagugcagacucuaaauaucacuaaagagaugaaaaugugcuguaaagau

SEQ ID NO: 4136430 - RNA, 67 nt, Human
aucuuuacuuucagugcugagccgugauuguucagggacggcuaaaccucagacugaaaguuuagau

SEQ ID NO: 4136431 - RNA, 70 nt, Human
aucuuuagccuggaagaaccugaagucuccacugcuucccaagagacucagauauuaaaggacuuaggau

SEQ ID NO: 4136432 - RNA, 66 nt, Human
aucuuuguugcucucauuucugcuucuguaguguuucuauucuucugaacugcagagagcaaagau

SEQ ID NO: 4136433 - RNA, 74 nt, Human
aucuuuucuauuauuaucuuugagugggacucauuauugucugagcuauuuauuaaaauggugaaggaaaagau

SEQ ID NO: 4136434 - RNA, 74 nt, Human
aucuuuucuuuuauuaucuuugaaugggacucauuauugucugagcuauuuauuaaaauggugaaggaaaagau

SEQ ID NO: 4136435 - RNA, 59 nt, Human
aucuuuuguuuauguagauuauauguauuaauauguaauuuagaaaugaacacaaggau

SEQ ID NO: 4136436 - RNA, 77 nt, Human
augaaaagauauuuuaucugccagaguggagacaugcuuugaaugucuguuauuucugccaggugaguuucuaucau

SEQ ID NO: 4136437 - RNA, 75 nt, Human
augaaaccucugaauacuguuggcagagcugugaauugggaagagucauuauggaaaacaguacagagguuccau

SEQ ID NO: 4136438 - RNA, 61 nt, Human
augaaaccuuugcagugaauccauaaauauuuguguguuuagguuagcuccaaagguucau

SEQ ID NO: 4136439 - RNA, 68 nt, Human
augaaagcaaggugagcccaucauuccuuaaaaguugaggccaugacuuaaucauacuugcauuuuau

SEQ ID NO: 4136440 - RNA, 69 nt, Human
augaaaguaccuguaauauguuguaguucuccaauacccuugagaugaacaugugagcagguuuuuuau

SEQ ID NO: 4136441 - RNA, 130 nt, Human
augaaauauuauugugauguucaauaauaguaccaugauguucaacaaguacauauuuaacgaauaacugcacuuguugaaugccaugacaguugugggcuauaauuaaaugagucucaaaauauuuugu

SEQ ID NO: 4136442 - RNA, 61 nt, Human
augaaaucauguaguuauugcaagauugcaauuugucuuugcauauauuucaugguuuugu

SEQ ID NO: 4136443 - RNA, 65 nt, Human
augaaaugcuguagagacuguauuugacacacaaagucugaaauauuuacucuuuggcucuucau

SEQ ID NO: 4136444 - RNA, 61 nt, Human
augaaauguuucugaguguauauacauacauauguauguguaugcaugugaaacugauuau

SEQ ID NO: 4136445 - RNA, 70 nt, Human
augaacagcauugaaauccagccacaggaauuuaacaucauaauccuauugcauauuuuagugcugucau

SEQ ID NO: 4136446 - RNA, 61 nt, Human
augaacugcuuagugauggaugacccugcaggucuauaggguuuucaaagaggcauuucau

SEQ ID NO: 4136447 - RNA, 110 nt, Human
augaacuucaaauaaauaaaaacuaugguauguacucuuuuaugucuggcuuaauuuguccaguauguuugggagacaugacccuuguguugugugugucaguaguucau

SEQ ID NO: 4136448 - RNA, 100 nt, Human
augaacuuugaagacauuaugguaagucaaauaagacugucauaagagacaaauguccuauggcugcacuuaucugaggcccuagagucaucaaauucau

SEQ ID NO: 4136449 - RNA, 82 nt, Human
augaagaaccacucuucuaggcgaucuucuauguuguucucauuauaaaacacaugaagauucaacuggaugugguuuucau

SEQ ID NO: 4136450 - RNA, 71 nt, Human
augaagauagauaggcagauggaaggacagacggauagauagagucaguguguaauucuuuguuucuucau

SEQ ID NO: 4136451 - RNA, 58 nt, Human
augaagcacauccuguugaaucagccuagaggagaagcagcaggaaugaugcuuucau

SEQ ID NO: 4136452 - RNA, 58 nt, Human
augaagcuaaacccugcagccacugcucaggaccugcuggcugcacuguggcuuucau

SEQ ID NO: 4136453 - RNA, 88 nt, Human
augaagcugcuuccaucagugaaauauuuaacguccaggucccugaggggccuaucugucaaauuucucuggccugagaacacuucau

SEQ ID NO: 4136454 - RNA, 85 nt, Human
augaaggcaccaacaauauuuaugacaggaaguagcauuuauuuuucaugcauuuucuuuuauauauguggcaaaucauuuucau

SEQ ID NO: 4136455 - RNA, 86 nt, Human
augaagggagacgcccacccccugcagcaugacacugccauccugcucaucagguacugcagcugcaggagggugggagccugcau

SEQ ID NO: 4136456 - RNA, 56 nt, Human
augaagggaugacugagacagcuguguuuauuggcugcccucagucuugucuuuau

SEQ ID NO: 4136457 - RNA, 78 nt, Human
augaagggauuuugaugcuaucuaaugaaugcuugcaauacauuuuauuuaguauaguauauaaaaauugccuuucau

SEQ ID NO: 4136458 - RNA, 104 nt, Human
augaagggcuaccauugcuugagugcucagagcucuggugcagguguuucuccuacagucuccacaacagcccugauaaguagguaguacuguuacccuauuau

SEQ ID NO: 4136459 - RNA, 74 nt, Human
augaaggucaguguaaguuauguagaugugcauaagauuuuauacauuuaaauaugccuuauauuuuacuucau

SEQ ID NO: 4136460 - RNA, 66 nt, Human
augaauagagaaagaugaagaguggcguuuacaugaagugacacuugaacguuuugucucuuuuau

SEQ ID NO: 4136461 - RNA, 84 nt, Human
augaaucauggcuggcaugugcauaacgggcuauuaagggaaauaggguuguucagaaugcauugcuagccuuguguguuucau

SEQ ID NO: 4136462 - RNA, 72 nt, Human
augaaugaaauacagaguacuucucucauaaaguaagcaccagagagcaaguauucaguuuguuucauucau

SEQ ID NO: 4136463 - RNA, 74 nt, Human
augaauggaugauugguuggauggauaagagaagaauguaaaauucuauuacuuaccacuaauucagaauucau

SEQ ID NO: 4136464 - RNA, 130 nt, Human
augaauggguggacucaguaaaguagauugcccuccccauugugaccucauccaaucuguugagggucuggauaaaacaaaaggugaaggaaggagggauuuacuuuuuuugcuuccugucugccugcau

SEQ ID NO: 4136465 - RNA, 64 nt, Human
augaauuagcaacaguuuuauaaagaaagagcuuucugagcuuuuagaaucuguucugauucau

SEQ ID NO: 4136466 - RNA, 87 nt, Human
augaauuauaggacaguuauggguuuuauuuaugcuauuguugcauacuugaguagggccuuuaaaauuuguaccugcuauccucau

SEQ ID NO: 4136467 - RNA, 81 nt, Human
augaauuggaacaugaagcaagaaagaugcuagacacuucugguacauucuacuuguuuuacaagaauugcuuacauucau

SEQ ID NO: 4136468 - RNA, 72 nt, Human
augacaaugugacagaccaaugauacaaugggaaaagccugaaacaguacguugaguuugauuaaaagucau

SEQ ID NO: 4136469 - RNA, 75 nt, Human
augacacauguuucaccaagguaaccuuugaucuguuuucuuaucuguuaaagucuacuuggugauucaguucau

SEQ ID NO: 4136470 - RNA, 57 nt, Human
augacacugagaauaacagguaugcugaguggcagcuuuaucuggggauagugucau

SEQ ID NO: 4136471 - RNA, 61 nt, Human
augacacuguccuaguaaggaaguggaacucaguaggggacacugcugcgacagcuguuau

SEQ ID NO: 4136472 - RNA, 57 nt, Human
augacagacccucuaaagacaaacccuccuguugagucguuagaguaguuugugcau

SEQ ID NO: 4136473 - RNA, 78 nt, Human
augacaggacuguggcaggcucagcacugcuggcauccaaccuucagagcagggcacuggcacucuucuuccuguuau

SEQ ID NO: 4136474 - RNA, 75 nt, Human
augacaggucaguaucuacuaucuugaugagguaauacagcacucacaaacugagaaaggucuugauuuguacau

SEQ ID NO: 4136475 - RNA, 55 nt, Human
augaccgcagccguaacagccugcauucagcaaaugcuggccaugugcugggcau

SEQ ID NO: 4136476 - RNA, 70 nt, Human
augaccuggacagccuccaucgccccgggggcucugacaugcucagaucccaggauggggcugcaguuau

SEQ ID NO: 4136477 - RNA, 71 nt, Human
augacuaauggguaucgguuuauuuuugggauaaugaaaauguccuggaauuagauggugaugaugguuau

SEQ ID NO: 4136478 - RNA, 84 nt, Human
augacugccucuuuuagagaugaaaauugguaaaacgaccuuuuugauccaaugucuccuagaagagaaucacuucuaagucau

SEQ ID NO: 4136479 - RNA, 90 nt, Human
augacugcuaaaaugguaugaaaagagauuucaacucccuauggcacugcuaauguaccugaaauuuuuaaagugcauuuuaguaguuau

SEQ ID NO: 4136480 - RNA, 128 nt, Human
augacuggcaucacuucugaguugccucugcaccuccagagcucugggcauagcugaagaguacaaacaucaacagucuuguccccaggcucuccagaggcagcaucugaaaagugugaucugguagu

SEQ ID NO: 4136481 - RNA, 56 nt, Human
augacuggcuuuaucccccuugaaaccaugaacacuucaaggguugggucugucau

SEQ ID NO: 4136482 - RNA, 58 nt, Human
augacuuauuacaagucauauuuuuacuaaugugugaaacuggcuugcaguuagucau

SEQ ID NO: 4136483 - RNA, 78 nt, Human
augagaaacgaggauguugaauaggugaaauacaaaaguaggccacauuuuugccauuucuuucaauauucuucuuau

SEQ ID NO: 4136484 - RNA, 65 nt, Human
caaugaacaguuacuuuguagaagaggcauuucuugcuugcuucuuugcagugacuuguucuuug

SEQ ID NO: 4136485 - RNA, 58 nt, Human
caaugacuuuacaguguucucagaaucaauuccugagagagcucacuauauagcauug

SEQ ID NO: 4136486 - RNA, 66 nt, Human
caaugaggaguccaggacucauucagcuuuccuaucauaagcaacaguccuugaaacucuuucuug

SEQ ID NO: 4136487 - RNA, 63 nt, Human
caaugaguucugacacuucacgagguagaauaaugaccuaagugaugauugggaugcucauug

SEQ ID NO: 4136488 - RNA, 130 nt, Human
caaugauaguucccacauagcccuggcaggucugaaccaguuaugccugccuacugaguuuuauauuucaugagucaugagccaugggcagguacugggggauguagcugguaaagugggacaugcauug

SEQ ID NO: 4136489 - RNA, 85 nt, Human
caaugaugcaauaugcaaacaaauacuuacugaaccugugcucuguuccaggcacggugcuaaguguuucauguugcuaucucug

SEQ ID NO: 4136490 - RNA, 57 nt, Human
caaugauggcuaggcagcugcuacauaagaaaguucugccccgaucugucaucauug

SEQ ID NO: 4136491 - RNA, 82 nt, Human
caaugcaagcccuucuauucagauuucucagcucuagggggcaaugguaagagcuggugagauguauggaggguugacuuug

SEQ ID NO: 4136492 - RNA, 129 nt, Human
caaugcacaaugguugaugaguuaguucuggaggcuucugaauuuuaaugaugcuggagaugauauuguguguccuucagcuuguuagagugacaccagcacuccauaaaucauaauaccuguguauug

SEQ ID NO: 4136493 - RNA, 80 nt, Human
caaugcccuaggcagcugcaaacuucgguccccuagagcuucucccuaggggcugcccacagcggguguuucgggaguug

SEQ ID NO: 4136494 - RNA, 69 nt, Human
caaugccucaguggcacuagccacuuccuugguccucaauggacacauguggccagugacuacuuauug

SEQ ID NO: 4136495 - RNA, 64 nt, Human
caauggaacacccuuuggaaaauggcaaagagaacgaugucuucacauaaacaaagggccauug

SEQ ID NO: 4136496 - RNA, 76 nt, Human
caauggagacaggacacaagcugcauaagggauaaaaacugcuucccuccuuuguucgggugugcugucaccauug

SEQ ID NO: 4136497 - RNA, 87 nt, Human
caauggagggaaauucccaggacucugggugucuuggaaguuuccaaggccugcaacugaucacagauccugguuuuccucccauug

SEQ ID NO: 4136498 - RNA, 69 nt, Human
caauggcuuauguaaugcuguuuacuuuuccugcuaugucuagcuuaaacaguauuucaaggaccauug

SEQ ID NO: 4136499 - RNA, 59 nt, Human
caaugggacaggcaugggacuuagagucagagacacugagcuccaagucuuuccuuaug

SEQ ID NO: 4136500 - RNA, 55 nt, Human
caauggucgcuauuuucucacagcagccaacuguggaaugaaaauggagaucuug

SEQ ID NO: 4136501 - RNA, 55 nt, Human
caauguacuacaaagauugucaaacccggguggagugugaucuuugaguauaaug

SEQ ID NO: 4136502 - RNA, 66 nt, Human
caaugugaacaugagcucuguguuuggcacauaguaagugcucaacauacauacauggucagguug

SEQ ID NO: 4136503 - RNA, 93 nt, Human
caauguugcuaggcuauuauuuugcuuaauguugauuuuaaagguaagcauuauaauuuaucuuuggauuuuuaucaggcaauggcaauuuug

SEQ ID NO: 4136504 - RNA, 85 nt, Human
caauuaauuuauuuuucaaguacagaaauacugggggguucuuacaaaggggauugucccauuucugucuaauuuaaguuuauug

SEQ ID NO: 4136505 - RNA, 125 nt, Human
caauuaguaucugggcaaaaauauuuuuaacuguauuuaggauaauuuccuuggaauauuauucccagaagugaaauuucuagaccaaaagguaugaaaguuuuugagguuccugauacaaauug

SEQ ID NO: 4136506 - RNA, 68 nt, Human
caauuaucacaggagauuaugugugcuaguguguuuacauggcaugcugucuucuccuggagcauuug

SEQ ID NO: 4136507 - RNA, 117 nt, Human
caauuaucuguauaaugaaagaagagaaacaagacugcauaggaccaaauaguaaaggcaaaagccauguauacuauguucuguagcagguuuuacuugugauuuuacaauuaauug

SEQ ID NO: 4136508 - RNA, 60 nt, Human
caauucaaaccagucugucucuucuugugcacaaggugacagacagaaggcuuugaauug

SEQ ID NO: 4136509 - RNA, 72 nt, Human
caauucagcaugguuaugugauuuuucugcagcauuggaaggcacagagggagaaaagaaucaguuggauug

SEQ ID NO: 4136510 - RNA, 99 nt, Human
caauuccuucaugcagauuacguaaucaggauguaugauuuuccaagcaguucaugaauccugaaaacuuacgaaguggguaugggaagaggggaguug

SEQ ID NO: 4136511 - RNA, 130 nt, Human
caauucucucuccuucauccucagauuuggcaguagaagcuuguuuuucagaacagggcuggaguggccucuuugaaacucugaacauguuucaacuguagaauagagccauaaugggugaucuuggaag

SEQ ID NO: 4136512 - RNA, 71 nt, Human
caauucuucuggucuggauugggcuugguaauuucaugcaucugcaucagcuucagaucagcuagagauug

SEQ ID NO: 4136513 - RNA, 130 nt, Human
caauugccuagcauugaaucugauauacaaacuuccuuggauacaaguaacuuuauaccuuggccugagaacgcugaaucaggcaaaaugaaaguuuuugaugcaggaaagauuuauacuuauguaauug

SEQ ID NO: 4136514 - RNA, 93 nt, Human
caauuuagagagaauagagcacacaguuguuaaggucacggugacagaaagaaaguguuucugaccugcaacaguuuacuuuucuccaaauug

SEQ ID NO: 4136515 - RNA, 55 nt, Human
caauuuauagauuggugccaaaguggcuuacauauugguaucaauuacuagauug

SEQ ID NO: 4136516 - RNA, 68 nt, Human
caauuucacuguggagcacauuuuccaacacuaaaaaugauggcaaauguguauacauaaugauuuug

SEQ ID NO: 4136517 - RNA, 59 nt, Human
caauuucagugcuguggagagggaagugcauucucaaaaagaccaacacauugagauug

SEQ ID NO: 4136518 - RNA, 59 nt, Human
caauuuccauagagcgucucacagaacuaguguuuuguggaauaaaauuuaggaaaaug

SEQ ID NO: 4136519 - RNA, 74 nt, Human
caauuuccuaaucugugaaauagguaugauaauuguagaagcuaccucauuagccuauuuugaagauugaguug

SEQ ID NO: 4136520 - RNA, 83 nt, Human
caauuuggcugccuuagcuuugcaaaucuaaaaccaacuggucacagaauuuaagauucaguaaggcaaacccaguuaaguug

SEQ ID NO: 4136521 - RNA, 74 nt, Human
caauuugguaugucaugaguuauuucauaggacaaaguuuguuaaaugaacacucacuggcagugucauuagug

SEQ ID NO: 4136522 - RNA, 62 nt, Human
caauuugugacuggguucgugccuucaggaauucucuguagggcauguaagucaccauauug

SEQ ID NO: 4136523 - RNA, 57 nt, Human
caauuuuaucaguaguuguucccuggcaccuuacugcuaaagcugcagaugaaguug

SEQ ID NO: 4136524 - RNA, 59 nt, Human
cacaaaaauauucuguaguauguuuuaguuaagaugacauagaacagaauauauuugug

SEQ ID NO: 4136525 - RNA, 69 nt, Human
cacaaaauuagccgggugugguggaacuccugaggucaggaguuccagaccagacuggccaacauggug

SEQ ID NO: 4136526 - RNA, 103 nt, Human
cacaaacccccgcagcccggccuggccagaggcgugccugugcaucccggcaagugagcgcccagggacucucggccagagaggcugugaggguggcuuugug

SEQ ID NO: 4136527 - RNA, 79 nt, Human
cacaaagacuccuguuuauuacacuggauagcagagacacucuucugcugucuuugaaaaaguaaacugucauguugug

SEQ ID NO: 4136528 - RNA, 74 nt, Human
cacaaagcccugcugacucauuuucaacacuucuccacaggacuagugcuaugcgucagcagacgcugccugug

SEQ ID NO: 4136529 - RNA, 73 nt, Human
cacaaaguagcaguaguuuuaugggcugguauuaacaccuauuaugaccagccaggcauugcaaacugaugug

SEQ ID NO: 4136530 - RNA, 93 nt, Human
cacaaagugaaguuugggcugaaaugcuguggacuagugcuuuauacuggguguacuggauaauuaccagcauucagcacacuucacuuugug

SEQ ID NO: 4136531 - RNA, 60 nt, Human
cacaaauccaauuuaauucuggcucaaaaaagcaauaaguguuuaaauuggauuucugug

SEQ ID NO: 4136532 - RNA, 58 nt, Human
cacaaaugugcagaaaugugagggaggauaugcucucgcacacuucggcauuuugaug

SEQ ID NO: 4136533 - RNA, 63 nt, Human
cacaacacacauuaauaucaaaggcucauuauagcagugacugugaaccugggugugugugug

SEQ ID NO: 4136534 - RNA, 84 nt, Human
cacaacugcaggggacacuguucacauuuuagucuaugcagccucugguggccaaagauuaaaugagaacaccuuugcugugug

SEQ ID NO: 4136535 - RNA, 80 nt, Human
cacaacuuguuuauccaugcucccguugauggauauccauguuacuccugucuucaacuauuaugaauaaaauuguugug

SEQ ID NO: 4136536 - RNA, 64 nt, Human
cacaagcugggcaaguguauauucaccuccauuucauaacagaauaaacaaaugcugagcugug

SEQ ID NO: 4136537 - RNA, 58 nt, Human
cacaaggacuggauggagugggcuuccccuguuuugcccuuccaccuucugccaugug

SEQ ID NO: 4136538 - RNA, 65 nt, Human
cacaaggccuuaucuccaaauacagucacauucugagguacucgggguuagggcuucaacuugug

SEQ ID NO: 4136539 - RNA, 63 nt, Human
cacaagguggcaggacugagggaaucucuaaggcaugucuuccaggcccugccacagcuugug

SEQ ID NO: 4136540 - RNA, 55 nt, Human
cacaagucuguggucuccaacauaaacuucaugcucugaggaaacaggcucugug

SEQ ID NO: 4136541 - RNA, 57 nt, Human
cacaaguuuuuacugcauuccucugaccucuucuggggugucaguaaauauuaugug

SEQ ID NO: 4136542 - RNA, 72 nt, Human
cacaauauuaaaaggaggacaugguuacagagaaguaaaugaguucuuagugauucucuuuugaauuuugug

SEQ ID NO: 4136543 - RNA, 77 nt, Human
cacaaucuauuuugcuuaaaguucuuucuggugugugagauauuauacuugaagaaaauaggacaagaaaaauugug

SEQ ID NO: 4136544 - RNA, 63 nt, Human
cacacaaacuacagugagaauugcuauaaaacuacaaugcauagcuagcuugucauuugugug

SEQ ID NO: 4136545 - RNA, 77 nt, Human
cacacacaggccuuaguaggugcucccuucccccaucaugcagccaucugccagggggcacuuucuucuugauggug

SEQ ID NO: 4136546 - RNA, 64 nt, Human
cacacaguaggcacucauuaauaaugguaauaucaacuaacauuuauugaauguuuaccgugug

SEQ ID NO: 4136547 - RNA, 56 nt, Human
cacacaguaguaugaggcaaaauaucugauuacagagucuaaaacugcuuugugug

SEQ ID NO: 4136548 - RNA, 56 nt, Human
cacacaguuuacagggauuugagcuuacuuaauuguagagcugguuaaacugugug

SEQ ID NO: 4136549 - RNA, 94 nt, Human
cacacauaugcucaucuaguuuucguuuuaagucauucuaaagaucaaaugucuuuacacuccuggaaaugauauuguguugugugugugugug

SEQ ID NO: 4136550 - RNA, 87 nt, Human
cacacaugaaugcaaaagacacacagugcuucaguuggcaugucuaguaacugauguaaugucuguguguaugcaugugcgugugug

SEQ ID NO: 4136551 - RNA, 82 nt, Human
cacaccuguagucacagcuacuugggagacugaggugggaggauugcuugagcccaggaguugguggcugcagagaggugug

SEQ ID NO: 4136552 - RNA, 70 nt, Human
cacaccuuuguauagugcugcuuuguaguaugugggcauacugcuuugaggggcucuguauauauuugug

SEQ ID NO: 4136553 - RNA, 71 nt, Human
auguucaccagucuuucuuaccauugugguaucuauagauagaguucaaagguaugagaaaggguguuuau

SEQ ID NO: 4136554 - RNA, 64 nt, Human
auguucagaauaaagguacaauugaguaagcagaugcagcuccgugguaccuuauuuauuacau

SEQ ID NO: 4136555 - RNA, 73 nt, Human
auguucauuaugacuagauuuagauguguauuuuguauaauguagaggcauaggacaucuaugucaugaacau

SEQ ID NO: 4136556 - RNA, 85 nt, Human
auguuccugggcugaagucaagugugggauauucugcuucuuauaaauaugugcccacauccacgaauuucaguuuaauaugcau

SEQ ID NO: 4136557 - RNA, 67 nt, Human
auguuccuuuucauagauuuggauaugugaauuaacauauauucacuccuggugagacuagcagcau

SEQ ID NO: 4136558 - RNA, 95 nt, Human
auguucugaaguacugaggguuagggcuucaacuuacgaauuuggugaguucacaguucagccuguaacacauuucuucaggauuuccagagcgu

SEQ ID NO: 4136559 - RNA, 69 nt, Human
auguucuuggauguuguguauaaguguguguuuuagaaaaacaaaguaauaauuuagcaucaagaacau

SEQ ID NO: 4136560 - RNA, 92 nt, Human
auguugaaugggauugaauucaggcuauagaccaauuugggaauaauguauuuaaauucuucaaaguaucgagucuuccaauccaugaacau

SEQ ID NO: 4136561 - RNA, 64 nt, Human
auguugccuccuuuuaaggaaaucauuuuuuucuaaugaaaugaucucucuugggaggcaauau

SEQ ID NO: 4136562 - RNA, 70 nt, Human
auguuggcauauauauuaugaggaaauacguugauagaaauucaagaaacccucaaauaagugccagcau

SEQ ID NO: 4136563 - RNA, 66 nt, Human
auguuggcucaggcugcuuucaugcuuagaaauugagauucucugugacugcagcuuugcaaacau

SEQ ID NO: 4136564 - RNA, 101 nt, Human
auguuggucaggcuggucucaaacuccugaccucgugauccgcccgcuuuggccucccaaagugcugggaacaggcaugagugaccacgcccggcugauau

SEQ ID NO: 4136565 - RNA, 77 nt, Human
auguuggugaaguuugauuguauggguuuuaauuuaauugaguugaauuuuuuauaucaagcauuccucaucaacau

SEQ ID NO: 4136566 - RNA, 87 nt, Human
auguugguggcuugccuucuuuuccuauagaaagaggaagacagagcucuuacuagggggaggcagagauggcacagcaagagacau

SEQ ID NO: 4136567 - RNA, 130 nt, Human
auguuguuugggucuauuaaaugugaugcagaaguaaaugugacuccaccugaguuguucucauugaaugugacacaggcucauccugaguguauuuauuucgaguaccaccaacugacagggaggaaau

SEQ ID NO: 4136568 - RNA, 71 nt, Human
auguuucaaaagucaggcuauucucagacaugcuauacgcaagagaauguguccagauuuuugauuugcau

SEQ ID NO: 4136569 - RNA, 71 nt, Human
auguuucaacuguugucauauggucuuaauuauguuaaauuagaggaucuggcugacaacacuagaaacau

SEQ ID NO: 4136570 - RNA, 71 nt, Human
auguuucaaugcacuuuagccuuagggauuuuugucaaacauggcaggaaggccaaauguguauaaaacau

SEQ ID NO: 4136571 - RNA, 100 nt, Human
auguuugaaggaaucaaaauuggaagaugaugagaagaaaguagaagacauuucuaugaaucaauuuuaacauccuuguugauucuguguuuucaaacau

SEQ ID NO: 4136572 - RNA, 79 nt, Human
auguuuguuauauuaguuagacuugcugugcagcaguaaaccaaauugccacauuucuaauuuaauguaacaaagacau

SEQ ID NO: 4136573 - RNA, 68 nt, Human
auguuuuauauuuuuugcauguccccuggggcuaggugccagagacaccccagaaaauaagagagcgu

SEQ ID NO: 4136574 - RNA, 58 nt, Human
auguuuucuuucagacuucccuuccacccugagaagggaagagcuugcaagaaaccau

SEQ ID NO: 4136575 - RNA, 85 nt, Human
auuaaaaaaagcacaguaaggaaugaaucaggcaaguccuccugcacaguugccuuauuuccuugcuguuguugagaaauuuaau

SEQ ID NO: 4136576 - RNA, 127 nt, Human
auuaaaaaauacuuucaugcauaaagagugguacaugaccacaaccugggaaagccguggaaagggcauaggcuuugaaauccacgucccaguucuggcuccaucucuuuuuuaauggaaggguaau

SEQ ID NO: 4136577 - RNA, 74 nt, Human
auuaaaaucugugccuggggaauaaucagaugcuuuaaaagcaauuuaauuguucuucuggcuauagagauaau

SEQ ID NO: 4136578 - RNA, 75 nt, Human
auuaaaugcuucaucauucuacugugcaaauuguuuucaagcugccuguaaaaugugugaugccagcaauuuggu

SEQ ID NO: 4136579 - RNA, 64 nt, Human
auuaacaaguguuuguguguguccugcagacccugcaaggagggauagaaaaauacuugugaau

SEQ ID NO: 4136580 - RNA, 76 nt, Human
auuaacagggugggaggaaaucagucucuucugguggaaacaaguuccuauuggucaccucccucagcucuuuaau

SEQ ID NO: 4136581 - RNA, 78 nt, Human
auuaacuuaaauacaccuuuuuuugcugcuauucguaauggauacaucaaggaugaugguguaaguauaagccuuaau

SEQ ID NO: 4136582 - RNA, 130 nt, Human
auuaauaauugcuagaggcucccugagcacauuaacaauuuccauguccaaaaauuaguuuuaaccuguaacaguacuuuuggauuugugaaagauugugugugguagaagcauugagguuuguuauuuu

SEQ ID NO: 4136583 - RNA, 59 nt, Human
auuaauauuugcaccuucugucuuuugucagcuggcagauuugggugaggguaguuaau

SEQ ID NO: 4136584 - RNA, 86 nt, Human
auuaaugcacagaucacagcauuuaaugcagugcuuccagcagagaugggcagcaucuuauuauguguaaugauaaagcauuuaau

SEQ ID NO: 4136585 - RNA, 84 nt, Human
auuacaagccuaugaaaauuucuguuuacucuaucuugaaaacuaagaguuuaaaacagcagaacauuuucagggcugugugau

SEQ ID NO: 4136586 - RNA, 113 nt, Human
auuacaagccugcugccugcagucauuugucuggcacagggaauaucaggauggauuagauauggucuugggcuuaggcagaguguugacugguggugcugcggguugcugau

SEQ ID NO: 4136587 - RNA, 71 nt, Human
auuacaguaggauuggaaaggaaaacuugaacgugcacugcaaguugauucuuugauuucuaaucugugau

SEQ ID NO: 4136588 - RNA, 92 nt, Human
auuaccugggaucuuguuuaaaugcagacguugauucaggaggucuggaguggcaccugagacucugcauuucuaauaacauuucaagugau

SEQ ID NO: 4136589 - RNA, 94 nt, Human
auuaccugggggauguuauuaaaguacagauucugauugaauaagguugaaacagagccugagagucugcauuucuaacaagcucccaggugau

SEQ ID NO: 4136590 - RNA, 75 nt, Human
auuaccuuccgaaggucggucuggaguugucgaagaauuaauuccagcugauugacuuucccggucaguggugau

SEQ ID NO: 4136591 - RNA, 76 nt, Human
auuacuagcaauuuccagagcuucagagaugaaagaugucaucaagacauguucugaggucugcaauucuaguagu

SEQ ID NO: 4136592 - RNA, 56 nt, Human
auuacugagaaagcugggucagaagcucccuucagccuggcuuggggcucaguggu

SEQ ID NO: 4136593 - RNA, 55 nt, Human
auuagaacaaagccaccaggugaaaggaacuauccaucccggacuuuguucuaau

SEQ ID NO: 4136594 - RNA, 76 nt, Human
auuagaaccauuguaauacuuguugcagggaaugccaaacaagcuuccuuuguuguacaauuauuuuggcgcuaau

SEQ ID NO: 4136595 - RNA, 130 nt, Human
auuagaaucauguggggagcuuaaaaauacagauuccugggcuccacuccaagagcacaggaaugaugauugcugggagaggaccuagagcucuguaccuuuaucgagucuuccccuuggugguucugau

SEQ ID NO: 4136596 - RNA, 98 nt, Human
auuagacucccacaggaggcuccuuggagcaugguccagcuaguuuaugucuugaaggggcagccaugcuccaggugcagucuugggagccaucugau

SEQ ID NO: 4136597 - RNA, 68 nt, Human
auuagaggagcugggacccugucaucugaucuuaguucaguguccagagcccauggcccaaaacuaau

SEQ ID NO: 4136598 - RNA, 70 nt, Human
auuagaguaauauuuucugagacaggaugaauuugcuauucuaaacuguuauuugagaguguugaauaau

SEQ ID NO: 4136599 - RNA, 66 nt, Human
auuagcuuaguguuuccguaauggcccaaaacagacugaggucuucugcaaacacugauggcuagu

SEQ ID NO: 4136600 - RNA, 70 nt, Human
auuagcuucauuaaccaaaaugcaauaugacugucuccauuguugcucucagauguugacugacgcuaau

SEQ ID NO: 4136601 - RNA, 58 nt, Human
auuaggcaauucugggcaucucagucuagaaugaaauguccaaagggauucgucugau

SEQ ID NO: 4136602 - RNA, 83 nt, Human
auuagguugaaccauauggaauugacauuuuuugcaugucaaagaagguauaaauuugucaacuucauauguuucaaucuaau

SEQ ID NO: 4136603 - RNA, 82 nt, Human
auuagguuggaccauaugaaguugcccauauuugacuguuucaaccuacaaaaaaagucaaguucaugugguuuaacuuaau

SEQ ID NO: 4136604 - RNA, 79 nt, Human
auuagguuggugcaaaaguuauugcgguuuuugccauuaaaauauggcaaaacugcaauaauuuuugcaccaaccuaau

SEQ ID NO: 4136605 - RNA, 56 nt, Human
auuagucaguauuuguuugccaucccuugaagucauggcauaacacacuggcucau

SEQ ID NO: 4136606 - RNA, 77 nt, Human
auuagucugaguuaaauuucuuguggccaauccuggagguuuggcucauuaaagaugauaauuaacccauugcuaau

SEQ ID NO: 4136607 - RNA, 70 nt, Human
auuagugagcugcacagaacagucauuggcccuuuauaagcaggggcuacuucugcugguagccacuggu

SEQ ID NO: 4136608 - RNA, 87 nt, Human
auuauaaagcauaacaguacauccuuuucucuugcaguccuuuauuaaaagaaagaggaagaggaaguauuggaccaugccuauaau

SEQ ID NO: 4136609 - RNA, 130 nt, Human
auuauaagaauccgauaggagguguguguuaaaaauucagauucccugucuacucuggaucugauccagagaucuaggguggagcugggaauccguauuuuuaacaagcaccccuagcgauuuauauaau

SEQ ID NO: 4136610 - RNA, 71 nt, Human
auuauaauccacagaaggaacuugaaaggacgcccaagugucuuuaauguauucuuuggaaccauuauagu

SEQ ID NO: 4136611 - RNA, 119 nt, Human
auuauaaugaugaugaucuauaccauuuauuaagugcguacuguaugccaggugcucuucuuggcccuucauauaacagcagcaguggcaguuaauauuuguggaaauuacauuauagu

SEQ ID NO: 4136612 - RNA, 57 nt, Human
auuauagcaaccagaacagcacucuaguccucuagagagcaauguuucugcuaaaau

SEQ ID NO: 4136613 - RNA, 106 nt, Human
auuauauuuuuagggagauuuuaguuguucauuuuuguuuccauaucuuauucagauuugucaauaagaugaacauauauuugcugcuaaaucaauaaaaaguaau

SEQ ID NO: 4136614 - RNA, 62 nt, Human
auuauccucagaaaacaugugauaagcauaaaccuuucacugcuaugauugcuggggauaau

SEQ ID NO: 4136615 - RNA, 98 nt, Human
auuaucuuuucuuggauggaaucgguucauuggguccugauaccucugcaaaaccuguaaaaugggcuucagauccagggaccucuaccauuggugau

SEQ ID NO: 4136616 - RNA, 67 nt, Human
auuaugcagaggaauugguuccugaaaggauccugaauccaaucaacccuguuuucuuugcaaugau

SEQ ID NO: 4136617 - RNA, 68 nt, Human
auuaugcugguuuacacauuuuuaauugagugugcauaugugcauuugugugugugagaggacauggu

SEQ ID NO: 4136618 - RNA, 57 nt, Human
auuaugucuuuagauauuuggucuucccugcaagaguccaagcuucuuaagcauagu

SEQ ID NO: 4136619 - RNA, 65 nt, Human
auguguuugguuauaugguauugccccuggucccacugggggcuuaggucauauacuauauauau

SEQ ID NO: 4136620 - RNA, 68 nt, Human
auguguuuuaguuguaaaauggaauuuguguaauaaauagcacuuccaggaacugccgcuaaccacau

SEQ ID NO: 4136621 - RNA, 93 nt, Human
auguuaaacugcugccuuaguaaccagggaaaugcuuuuuaaaauuuuguauuucauuauguuccuggaagagcaaccuugucaguuuaauau

SEQ ID NO: 4136622 - RNA, 58 nt, Human
auguuacaacccugaggagccgguuucugagucauauuugcucugccagugguaacau

SEQ ID NO: 4136623 - RNA, 60 nt, Human
auguucagcuugcagugggggaagauagaaaaucgaaauucacaugacagggugaagcau

SEQ ID NO: 4136624 - RNA, 100 nt, Human
auguucuaauuugguaaaacgucauugauugaugguaguacacauuucucaaacuugacugcucuuaggaagugacaaaaauauugaauuucagggacgu

SEQ ID NO: 4136625 - RNA, 90 nt, Human
auguucuacuguuuccaugaagggcagccucucagugcaaaaagacgucucugaguugguuacuguuccugaauaaauccaagugaauau

SEQ ID NO: 4136626 - RNA, 71 nt, Human
auguucuccugaagaccaugugcacuuaggucuacgggaccccucagagccaaucuucagagcagagacau

SEQ ID NO: 4136627 - RNA, 100 nt, Human
auguucugggaaaacuuuuucugcuguuauaguauguauguauucaggaagugcaacauuauuaaacuaagcauaauucagaagcuaaguuuccuuucau

SEQ ID NO: 4136628 - RNA, 55 nt, Human
auguucuucuaucuuuauuaaacuguuucuaaaggaacaagagaaagaaggaugu

SEQ ID NO: 4136629 - RNA, 84 nt, Human
auguugaauguauaauauuuaaugcuuuuggcaucccugaaaauugagagcaaaagaguauuggaauauauuacuguuuaauau

SEQ ID NO: 4136630 - RNA, 66 nt, Human
auguugagauacuuugccucuaugcuugucagcucaugaccaguccuagaagaggagucgagacau

SEQ ID NO: 4136631 - RNA, 129 nt, Human
auguugagggugaggacgaauccaguggugguggcgguagggauggccacugucauuacagagaccucucagacagcagcuaaccccugggccacauccuggguuucugucgucauucucuccuggcgu

SEQ ID NO: 4136632 - RNA, 63 nt, Human
auguugccgaagcuguugaacauuuaguaaaaaugcaaaauguucuggcaccuuuaaaaacau

SEQ ID NO: 4136633 - RNA, 72 nt, Human
auguugcggcaugcagugguaaaaagucagggguaaggucccugauugcgaagcuacuaguauacuagauau

SEQ ID NO: 4136634 - RNA, 95 nt, Human
auguuguguccuuccuucuguaggcuuagcuagaagugaugccuuaguaauuuucaacuaguucaggcuuuagauuggaaggauuaaaauggcau

SEQ ID NO: 4136635 - RNA, 67 nt, Human
auguuuaaauuuauagacagugaaauggacuuccauguaguguacaguucuaugaguuuuaagacau

SEQ ID NO: 4136636 - RNA, 57 nt, Human
auguuuaagagccuguacaaauauuuuauguuagugaaguguuggcuguuuaaacau

SEQ ID NO: 4136637 - RNA, 77 nt, Human
auguuuaauuugccuucaggcuaguuucuggacugaacacaauuuccuucaggcucugagcugaugcuaauuugcau

SEQ ID NO: 4136638 - RNA, 58 nt, Human
auguuuaucccaaaugccaggaguggacgaggcggacgaguggcagugagguaggcau

SEQ ID NO: 4136639 - RNA, 68 nt, Human
auguuucacuuuuaagagucaguguauuaaugcauacacggggaauacaucucuuugaagugcuuuau

SEQ ID NO: 4136640 - RNA, 62 nt, Human
auguuucauccacuggccuuucccacccuaaauguugggaaaaggccaccaacaugaagcau

SEQ ID NO: 4136641 - RNA, 68 nt, Human
auguuuccauagaagucacaguuguaaggggagacacaccguaaugggcaguggcuucuguggaauau

SEQ ID NO: 4136642 - RNA, 58 nt, Human
auguuucccagagcaaaucuggcuucaccaacugcacagaaaaucuuaugggaaacau

SEQ ID NO: 4136643 - RNA, 86 nt, Human
auguuucuauggaucuuucugcuuuugaauuacauggccugaaaaugaaguaaucugaaagcuaggaguucucaugcauaaaacau

SEQ ID NO: 4136644 - RNA, 65 nt, Human
auguuugggucuacuuggcucugagaaaacacauucucuuucaagaaucugguagaaccaaggau

SEQ ID NO: 4136645 - RNA, 56 nt, Human
auguuuguugaucauuuaugaaacagcagacuguauuaaaaaugcuuggcaaauau

SEQ ID NO: 4136646 - RNA, 87 nt, Human
auguuuguuuaccaguaguaacagguguacagacuaucaggugucauuaugacagauagcacacuuguugcuucugcugucaagcau

SEQ ID NO: 4136647 - RNA, 111 nt, Human
auguuuuaaaauuccaaacuccugugggaaugaaauguguuucuuugugaauggguaucuguuacugucacaugccgcgcaaauucucauggagguagggauagcagacau

SEQ ID NO: 4136648 - RNA, 91 nt, Human
auguuuuagaggaaguaguuaaccuggagggagauucaaaggaggcuggauaagagaaugucuauuuuucuccuucccuaucaccuuacau

SEQ ID NO: 4136649 - RNA, 79 nt, Human
auguuuucaaaguaaacuuguauucauaaagucaaaaguuuugaaagugguuuuuaaacagguugaacugugagaacau

SEQ ID NO: 4136650 - RNA, 95 nt, Human
auguuuuccaagggaacagaucucuaauguggcauuuacuaaaaaauauugagaaaaugucuuucaauagagaaaucugcuuugcaggaaaacau

SEQ ID NO: 4136651 - RNA, 65 nt, Human
auguuuucuugggcucuuaggucguguccgacuuggcauaucacuaucugaggguccagaugcau

SEQ ID NO: 4136652 - RNA, 107 nt, Human
auguuuuuucuuuccuccuacucaaaaaguuaugaaucauaggaaugaguuaauguuucaaagauguuuauugcuuuuuuuguggggggaggugcaugaugaaauau

SEQ ID NO: 4136653 - RNA, 59 nt, Human
auuaaaaagccacucgucaggaaauugaagcucagaauucuaacaaguggcuuguuagu

SEQ ID NO: 4136654 - RNA, 71 nt, Human
auuaaaagagauaauguguguugcugaggcuaaagugugauuacggucccacauauuauuugcauuuuaau

SEQ ID NO: 4136655 - RNA, 74 nt, Human
auuaaaaguauauuuuuugaagcauauauguauuaaacacauugcuuggugugcuuaaugaaauguuuuuuaau

SEQ ID NO: 4136656 - RNA, 72 nt, Human
auuaaaauguucaagcaugcugguuuauuuuaccguucagaugaaauggcauuuauuugaauauuacuuagu

SEQ ID NO: 4136657 - RNA, 74 nt, Human
auuaaauggauaauucuuguugauuuugagcuggcaaucucaggcuucuaaaucacaaggaaacuccauuugau

SEQ ID NO: 4136658 - RNA, 65 nt, Human
auuaacacuucccaucagagggacauugcagcuuauaagaaugucacuuugugagaagugggagu

SEQ ID NO: 4136659 - RNA, 56 nt, Human
auuaaccagcauucuucacaacuugcuccccaagcaaugaggagcagcugguugau

SEQ ID NO: 4136660 - RNA, 80 nt, Human
auuaacggaugugauagaagcagagccuugaaaacuguuugugacagggccugcucuaucacucucaugccuuuguuaau

SEQ ID NO: 4136661 - RNA, 62 nt, Human
auuaagauaguaaacauuuucugcuuugaaggccagacagucucuguugcugcuguuuuaau

SEQ ID NO: 4136662 - RNA, 69 nt, Human
auuaaucuguauuuugaguccaaucuccucucaugggagagugagaaaaaggcugaaaauaagcuugau

SEQ ID NO: 4136663 - RNA, 68 nt, Human
auuacaacaagaaaaggguaaggacguuuacgugaguauauucagucuugcucauuugcuuuuguaau

SEQ ID NO: 4136664 - RNA, 67 nt, Human
auuacacaaaacuuagucuuucaauuugauauauguuugcaugucuuugggggacuuagugugugau

SEQ ID NO: 4136665 - RNA, 74 nt, Human
auuacacaaccacauucucagcauacaagcuggcucccucuuggcugcugaaauauguucugggguucaguagu

SEQ ID NO: 4136666 - RNA, 68 nt, Human
auuacacagcgguuacuacuagagccaggacuagaaucuugauucuuuauuuagugcuuuuguguaau

SEQ ID NO: 4136667 - RNA, 58 nt, Human
auuacacuuguucaucaucaccaugagagacauuccagggagaugaacguggugggau

SEQ ID NO: 4136668 - RNA, 60 nt, Human
auuacagggaaccaauccagugucauccgaacaggcagcauucugaugguucucugugau

SEQ ID NO: 4136669 - RNA, 75 nt, Human
auuacauuacauuagugaagcaauauuggcacuucauuauuaaugaaguacaugcuuuauucagaguucuguagu

SEQ ID NO: 4136670 - RNA, 75 nt, Human
auuacauuggacccaugauuuauuaccccuuugguauaaaaaaggcuaaaguaaacuguggguacagaugucaau

SEQ ID NO: 4136671 - RNA, 103 nt, Human
auuaccauagcagugaaauuuauaugcaacagcauuauuacaauuuucggcuacuaaugaaauuauuguuucuguuugcgauguguuuuggcgcuauaaugau

SEQ ID NO: 4136672 - RNA, 62 nt, Human
auuacccuuacuguuuucacugugucacucugagaggucucgccugaagacaugagguuagu

SEQ ID NO: 4136673 - RNA, 88 nt, Human
auuaccugggaacuuguuagaaaugcagauucucaagccccagaaauaaugaauuagaaucugcauuuuaacaagauccccaggugau

SEQ ID NO: 4136674 - RNA, 77 nt, Human
auuaccuuguuugaugucuuauuuaaggcuuauacaaguucaauaacuuguccaaaguaacacaucuaguagguagu

SEQ ID NO: 4136675 - RNA, 64 nt, Human
auuacuaaggcaguuuugccugagauauuugguaaucaucuuaauuucaaggcugucuggugau

SEQ ID NO: 4136676 - RNA, 78 nt, Human
auuacuauucagguuuaaguagucuucuuuaagcagcccagguaugaggaagaaacugagcucugacagacuaguaau

SEQ ID NO: 4136677 - RNA, 64 nt, Human
auuacucugaaugaguuagguauagauucguugguguggguguauaccuacacauuuuugugau

SEQ ID NO: 4136678 - RNA, 69 nt, Human
auuagaaaaucuggagguggggccuaggaaaucugcaucuuuaaacuauccacuccaggugauucugau

SEQ ID NO: 4136679 - RNA, 63 nt, Human
auuagaauccuggccaaguuuuuaagacaguaauguacagacuucacucccagagauucugau

SEQ ID NO: 4136680 - RNA, 85 nt, Human
auuagagugccuuuuaagagcaguguuaggaauaaaaaugauggaaaauauauacauuauccugacaacuaaggucgacuagaau

SEQ ID NO: 4136681 - RNA, 86 nt, Human
auuagauuuagcucauuugaugcaucucuacuuuguuccugcuucugggaagagagggacuuauuaaagucuagcauaaaucuggu

SEQ ID NO: 4136682 - RNA, 89 nt, Human
auuagcacaguuuacaugcaaauaaagcaacuauacagguuuaugugugaaucugcuuguauuugucccuguaaaugacugcagcuaau

SEQ ID NO: 4136683 - RNA, 58 nt, Human
auuagcuagaaaguuucagcugugaguggcaacuuacaagaauuucuuucugguugau

SEQ ID NO: 4136684 - RNA, 60 nt, Human
auuagcugccugcuuaugagcuccaugacuaaaauuccuuggugucaacaggcagcuaau

SEQ ID NO: 4136685 - RNA, 68 nt, Human
cagaggaagacaugcgccuugucagugaucccugcaucccuaggggugggcagcacgucauuccugug

SEQ ID NO: 4136686 - RNA, 78 nt, Human
cagaggaagagcaacuuggaaacacucagucugcaucagaacuaauaguggaguccaaguucucccauccaugaucug

SEQ ID NO: 4136687 - RNA, 58 nt, Human
cagaggaagcuggguguggaguauauggaaacuccguacuaucuucacagcuauucug

SEQ ID NO: 4136688 - RNA, 102 nt, Human
cagaggacugggauggacagagaaccagcagcacaguaucccaggagugacguagcccagccagcucacagcacccugaggugcuggccccacccaccucug

SEQ ID NO: 4136689 - RNA, 82 nt, Human
cagaggaguauaauucauguuccugcaagcaugcacccgcaaaugucugcucugcaagcaggagcaagaucugugcucccug

SEQ ID NO: 4136690 - RNA, 73 nt, Human
cagaggaguucaguacacagccccuggaggaagggcuggggcuggguuugcacugaaguucuagcucuuacug

SEQ ID NO: 4136691 - RNA, 100 nt, Human
cagaggaucacauggaaggggccuugcagucguuaagcucaauccuucuuuucacaauagcauggacugcagggcauccuggccaagugacauccuacug

SEQ ID NO: 4136692 - RNA, 93 nt, Human
cagaggaugguggcuuggcccagguguuuguggcagagguggugaggauaucagcuuuuaaauacauuugggcaguagagccaauaggauuug

SEQ ID NO: 4136693 - RNA, 83 nt, Human
cagaggcaucauggcgagccccgacugaguguucagugaagagggaaaacagagacaguggggcaucccgagaagauccucug

SEQ ID NO: 4136694 - RNA, 88 nt, Human
cagaggccaauuugugguaucuggccuaauucuauagaaaguuccucucauguaguguuucucagauauuugcauuccuugacuucug

SEQ ID NO: 4136695 - RNA, 64 nt, Human
cagaggcuagacugugcuuccuggcuuucccacgaaucauggagcauuuuggucacagccuuug

SEQ ID NO: 4136696 - RNA, 80 nt, Human
cagaggcugcagagaagagaaaaagucucuggaggaagcaaagaacuccugcacgugggcucucugcucuucagccuuug

SEQ ID NO: 4136697 - RNA, 78 nt, Human
cagagggcaaggugagaguuuggguucuggagaaauuugcuacaauuggcagcugaaacccaggccucagcucuucug

SEQ ID NO: 4136698 - RNA, 58 nt, Human
cagagggcguccggguuaacuucccucaagaaaaaggcaguuaacccaagcccuucug

SEQ ID NO: 4136699 - RNA, 95 nt, Human
cagagggcugaaggcauuuggguuacuuguaugagcacuuaggguagagaauguaucugucaguucucauuucacaggcagugcucagcccuuug

SEQ ID NO: 4136700 - RNA, 80 nt, Human
cagaggggauggugcauacuggcagaacgggcccucugggccugagucuuucccauugcgcugggucucaguucccccug

SEQ ID NO: 4136701 - RNA, 71 nt, Human
cagaguaggcuugcucuaaucaggugagccccgaaaaagagauacucuccugcaaagaaacaagccaccug

SEQ ID NO: 4136702 - RNA, 65 nt, Human
cagagucccagaugccccuccuaaauaaucuaauucaguaggccugguagagggcaccuggucug

SEQ ID NO: 4136703 - RNA, 75 nt, Human
cagagucuagaccacaggcaugcacagagcauuuguggcgucaaggcucaggcauguaugugguugcagagauug

SEQ ID NO: 4136704 - RNA, 58 nt, Human
cagagucuuguguguucagccccagacugagaagggcugaaaacacacaaggacucug

SEQ ID NO: 4136705 - RNA, 92 nt, Human
cagagugagccaggguccaguggcaggcggugaggucagggaaggcccggagggccucaugggccauggagaggacuuuggcuuuuucucug

SEQ ID NO: 4136706 - RNA, 55 nt, Human
caauagcagcuucugaaugcaaauaauuuuuuugaguugcauggcugcugcuuug

SEQ ID NO: 4136707 - RNA, 93 nt, Human
caauaugaagaaaaagucaagaaucucagcaucuuuggcucugacaucauagauggaaaaggcuugguucuuugaugacauuuuugaguauug

SEQ ID NO: 4136708 - RNA, 86 nt, Human
caauaugugaggacuggacuggugugcuuuuguuacauauaaucauccuauagauucaaguauucaguuuggauaauuacauguug

SEQ ID NO: 4136709 - RNA, 85 nt, Human
caauauuuaacaaugaauaucaugaaguacuagugcaaccuuauaacuuggacaguauuauagaguuuauuguuuaugaaaauug

SEQ ID NO: 4136710 - RNA, 81 nt, Human
caaucaacauccagagacuggggcugggauagggugaggaauccuguaauaucuuagcccaggcucucugaagguuuauug

SEQ ID NO: 4136711 - RNA, 57 nt, Human
caaucaauaggugacuucauaugcagaagugucuuuuuugcaaauaucuauugauug

SEQ ID NO: 4136712 - RNA, 62 nt, Human
caaucacuucagacuaaggaagcuccuggaaaagagagcaaauauuuuguugaagugcauug

SEQ ID NO: 4136713 - RNA, 78 nt, Human
caaucagucaccuugacuauagcuguaguuggagaaaaacaagcucuagacuaguucuacucaaagugugauccauug

SEQ ID NO: 4136714 - RNA, 63 nt, Human
caauccaucaauuacacaggcugccucacccaaaucugcuuuguccugguuuuuguuggauug

SEQ ID NO: 4136715 - RNA, 124 nt, Human
caaucuucagugacuuucuuuccagacugaaucuucagugucuaaaaagcaaccuguagcaguuaugauuuggggaagcugugguguaguuaggaaaacaaugacauggucaacugaaauguug

SEQ ID NO: 4136716 - RNA, 100 nt, Human
caaucuugaagccugguucuccuguguaagauguaaaggcaauauaaaggcaauauucuuuccuuacauacauuuugaaugaguacuaugugcaaaauug

SEQ ID NO: 4136717 - RNA, 80 nt, Human
caaugaccaguuuuauggagcagacagcuggucaguuguacucuggcacagaaaaaugcuccauuccuauuguucaguug

SEQ ID NO: 4136718 - RNA, 88 nt, Human
caaugagaacauauacuugaaagcacuuaguaaauuagaaaugugggucacaaauaauacugcugugcuugaguuguuguuguuguug

SEQ ID NO: 4136719 - RNA, 66 nt, Human
caaugagcuaauguauguugaaagcacuuugugaauuguaaagugcuacacaaauguuaguuguug

SEQ ID NO: 4136720 - RNA, 80 nt, Human
caaugcagucagugguauuuuguuauggcagcccaagcagacuaauacagcugucauuauuugccuacugacuugcacug

SEQ ID NO: 4136721 - RNA, 84 nt, Human
caaugcccugcccaaauugcuuacuguuuuucaccuuguucccaagguugaggaacagaaaguagccugugguuggaggaagug

SEQ ID NO: 4136722 - RNA, 59 nt, Human
caaugcuaggcagauccugcguguuacccauauugucaugcagccucugcccagcagug

SEQ ID NO: 4136723 - RNA, 56 nt, Human
caaugcugugaauccacaagccucacuuucagugacaaggcucuggcacaggauug

SEQ ID NO: 4136724 - RNA, 57 nt, Human
caauggggaagcaauuggauuuccucugaaagagaggagaacauaucucccacauug

SEQ ID NO: 4136725 - RNA, 62 nt, Human
caaugguccccauuggcaggaacugaacccuucucuccucuccuuucuccgggggacuguug

SEQ ID NO: 4136726 - RNA, 62 nt, Human
caauggugcagcucaguugaaaugcaggguuguacacaggcccugcucagagcuguccauug

SEQ ID NO: 4136727 - RNA, 61 nt, Human
caaugguucucaaacuaucauggggaagaagcaccaggaagguuuguuaaagaacagauug

SEQ ID NO: 4136728 - RNA, 115 nt, Human
caauguaaaauuauggguuucacuguaggacucugucauuugaacuaguaaucaguccauaacacuauagauugcuguaguuaaaaugaugcuuucccccauuaacaaaacauug

SEQ ID NO: 4136729 - RNA, 60 nt, Human
caaugucagagaagcucauaucagugguucugaugaaaaacgaguauuucucugauguug

SEQ ID NO: 4136730 - RNA, 122 nt, Human
caauguccacauggagauccaaagccuucugucuguucuaggcuugcugagccucgggguggaccugggccugcuaaccugaaacggagcaugagccuggcuugauuuucacaagggcguug

SEQ ID NO: 4136731 - RNA, 77 nt, Human
caaugucuucucuuguugaauuuaaaugacugugacauuauuuuucauaccuuggcaaauuuugcaaggagauauug

SEQ ID NO: 4136732 - RNA, 65 nt, Human
caauuaacaugcagccagacacacacagugacuacacauuuuggugugguuggcggcauuaguug

SEQ ID NO: 4136733 - RNA, 59 nt, Human
caauuagaacuuuuaucaaacuaugggaaacaucuguagucaguauguaagucuaauug

SEQ ID NO: 4136734 - RNA, 80 nt, Human
caauuaucaccuugguugacugucuugcaacuccaccacucacacgcaggaauaggcagccauuaccaagggcaugguug

SEQ ID NO: 4136735 - RNA, 61 nt, Human
caauuauugugcaccuacugugugcaggcccugccuggacacuggggaugcgcaguggaug

SEQ ID NO: 4136736 - RNA, 60 nt, Human
caauucauuacauugcaaagacugagcucagaauggcuugucugaugcuugaugcaguug

SEQ ID NO: 4136737 - RNA, 96 nt, Human
caauucuauacuaagugcaagcaggacuuaguuucaaacaacaccauuuaucauguaaaauuaagguuauuagcuugccuuguuuuuguaguuuug

SEQ ID NO: 4136738 - RNA, 82 nt, Human
caauuggcuuauagaucacucgauuuugcuuggaauuucuagaauuccuugauacaggcuugaugugucuauacuuugguug

SEQ ID NO: 4136739 - RNA, 72 nt, Human
caauuguuucauuuugacugccuugauauacaaggacauaacuuuguaaaucauggucagaauaaauuuuug

SEQ ID NO: 4136740 - RNA, 76 nt, Human
caauuuaauaaaaguuccuuuuauagacaugacugagaccagagagucugucuauguuaagagagcugcgaaauug

SEQ ID NO: 4136741 - RNA, 75 nt, Human
caauuucaagaucucaguggguuaaaagagaaggagcuugucucuuucccacacaguccacugcaggucuaguug

SEQ ID NO: 4136742 - RNA, 61 nt, Human
caauuucacugacacccuggaaugaugcccaggucuaauucuagucucuggucaguaguug

SEQ ID NO: 4136743 - RNA, 59 nt, Human
cacaaaaucuuucucgauuauuuuauguuauguaaugugauugucauguggauuuugug

SEQ ID NO: 4136744 - RNA, 127 nt, Human
cacaaaccacccucaauacacuuuaaauacucuucccaggguuuugugcucaggaguuguuugaaaggcacaggcaccugggugguuuuaugggguaauaaaaagauguggaauggaggugggugug

SEQ ID NO: 4136745 - RNA, 59 nt, Human
cacaaaccucacagcuccuccucauuaacccgauccuguuauaggagcuggggguggug

SEQ ID NO: 4136746 - RNA, 130 nt, Human
cacaaacgccaucuuguuuauuucuguuuuccagaagcugguacaaggccuagagccuaguugguucuggauaaauguuugcuuuagauagcugacuggauggguggaugagugaauggauggaugggug

SEQ ID NO: 4136747 - RNA, 82 nt, Human
cacaaacucuaguagccuggcugcaaaaucuauucacucucaucaggaacugucauguauugcucauggcuaucugugugug

SEQ ID NO: 4136748 - RNA, 77 nt, Human
cacaaagcuuuuuaggaaaugcuccauugcauaaagagagauguucuugugcuagcuaauuuccucucagcuuuaug

SEQ ID NO: 4136749 - RNA, 75 nt, Human
cacaaauauauugccaaugagcuucuauaaucuugucaacaauggcaauuuuuuaagaaguuuaggggauuugug

SEQ ID NO: 4136750 - RNA, 79 nt, Human
cacaaauguuagaggcaggccugcuucuuacccuucaggccaacccuggacaguauugugaagcaggcagauguuugug

SEQ ID NO: 4136751 - RNA, 102 nt, Human
cacaaauuuguauuuggggaagcaguauccugacagcaccacaaucugaauuuaaaaauuggcggugcguaggagauaccuuucccacagcagcuuucugug

SEQ ID NO: 4136752 - RNA, 84 nt, Human
cacaacucauuauugcccuccugaggggcagggaagcugggauauuuauccaccaauuccuucccucaguggcugaaguuugug

SEQ ID NO: 4136753 - RNA, 88 nt, Human
cacaacuuggucaucagucuguauuucaaauuguuagucauauacauuuguuauuuuuuaaugcagucugagacauagugaaaaugug

SEQ ID NO: 4136754 - RNA, 81 nt, Human
cacaagagcaacaacaguaaugauaaccagcauuuauuuugcacuuaacaaaugccaguuauugcugucaguguucaugug

SEQ ID NO: 4136755 - RNA, 63 nt, Human
cacaagcuggauccuagggcuuugaccuccacugcucacugccacaugggauccgucucugug

SEQ ID NO: 4136756 - RNA, 59 nt, Human
cacaaggucagaaucagacugaguccagaugauacuccucuaauaaacuugaccuugug

SEQ ID NO: 4136757 - RNA, 59 nt, Human
auuguaaaugguugaaccccagagaauuuuccugucucacugggccauccuuuuacaau

SEQ ID NO: 4136758 - RNA, 71 nt, Human
auuguaagcaguuacuaguuaaaugcauguuuuggucuuuuacaugcuguuuguuagaauuguucaucaau

SEQ ID NO: 4136759 - RNA, 88 nt, Human
auuguacaaaguagauucauggauguuucguuaacuguagagcauugggcaacaguaauuaaacauucugauuuuauuuugcuagaau

SEQ ID NO: 4136760 - RNA, 78 nt, Human
auuguauacaaaauguuuucucugugaacacauucccaugugcagcuuuucuagagaaggcccaugcuuuuauacaau

SEQ ID NO: 4136761 - RNA, 82 nt, Human
auuguaugacagauuuugauggcuaauagaaauuuugaaauauggaguuaguuauauaggcuauuaaagacugugaaauaau

SEQ ID NO: 4136762 - RNA, 81 nt, Human
auugucaaacugccaacagagaagcauuauucaggguucuugguuuucugagugucaaggcucucuuuggcauuugguaau

SEQ ID NO: 4136763 - RNA, 73 nt, Human
auugucacaaggauuuuuggaaugagauggcgugugaaagcaccuggcacaggauccgagaccuuguggcgau

SEQ ID NO: 4136764 - RNA, 77 nt, Human
cacaccuggaucagagcccugagucaguucuggagaccaacaucucucuguucuuauucagaggccuuucaggugug

SEQ ID NO: 4136765 - RNA, 112 nt, Human
cacacgcccggggagggcgagacugucugguuugggcgcuggagcaaggcucggaccuccggcuccuugcucucccaagcccgcagacaguggcuccuuccccagggcugug

SEQ ID NO: 4136766 - RNA, 61 nt, Human
cacacucauuaccucauuuaaucuucucaacagccaggagcaaugggcuuugaugagugug

SEQ ID NO: 4136767 - RNA, 58 nt, Human
cacacugcuuacacaaaaugauucgauagccugauucauuauguauuuaguaagugug

SEQ ID NO: 4136768 - RNA, 59 nt, Human
cacacuuuuguuugaagucuccacacuagaaccuguguguuggaaucuguaaaugugug

SEQ ID NO: 4136769 - RNA, 76 nt, Human
cacagacagggugguggacacacaguaaggugacccccagggaguccugcccuuguguagucccuuccccugagug

SEQ ID NO: 4136770 - RNA, 59 nt, Human
cacagacccagcauacaggaccuuccccgggaggggcaggcugaugacuggaguuggug

SEQ ID NO: 4136771 - RNA, 101 nt, Human
cacagacccauggcucccuccaggcuucaagggccggcccugagcaguccagcagcccagcgaggggucggcagccucugaggggagagagcgucacugug

SEQ ID NO: 4136772 - RNA, 81 nt, Human
cacagagagaagcuaaugucuuggagugucaagacugucaaacaucaguugaaauacauugaaagcauauuaucuccugug

SEQ ID NO: 4136773 - RNA, 72 nt, Human
cacagagccucuucccaauagucggacugggaaaacucauaauuacugagguauugggaaguggacucggug

SEQ ID NO: 4136774 - RNA, 72 nt, Human
cacagagcgagggagagccaagaugugagcucuucucugacuccacauuucgugcucuguuuuguugcugug

SEQ ID NO: 4136775 - RNA, 79 nt, Human
cacagagcuggguuugggaaaccucgugugacacuucagagguuuccagcaggccauagauuuauuuacuuuuucugug

SEQ ID NO: 4136776 - RNA, 98 nt, Human
cacagagcugguuuccaaacugucuuccuccaucccgcggagcaggcaugggagcaucugccugcaguggaggugggcuggacaguguccuuucugug

SEQ ID NO: 4136777 - RNA, 57 nt, Human
cacagaggugauaguggucaaggcaggaacggccuugcccccgcugauccuuuugug

SEQ ID NO: 4136778 - RNA, 65 nt, Human
cacagauaucguaacugaacugcuggggauaccuagaaguauacaguaaugacauaucucuagug

SEQ ID NO: 4136779 - RNA, 66 nt, Human
cacagauuaugagacgagauacuggguauaaacugaugaacaaacucucaugguuucugguuugug

SEQ ID NO: 4136780 - RNA, 65 nt, Human
cacagcaccuauagaaguuguguucacagagcacucaacaauuucuaggcuugaauaaugcugug

SEQ ID NO: 4136781 - RNA, 98 nt, Human
cacagcaccuuuccacaucuaucuuuugggucccagaucaagugcucuaccccucagcaugcaugaagauucagcaagauucagugggagguggugug

SEQ ID NO: 4136782 - RNA, 58 nt, Human
cacagcagagggagccauugaaaguugagugaucuguuuggaugcaccuucugaagug

SEQ ID NO: 4136783 - RNA, 72 nt, Human
cacagccaucuucucaagcagcauccugugcaacuaacguccgcagaagguuguuugggaaaggucccugug

SEQ ID NO: 4136784 - RNA, 66 nt, Human
cacagccuugaaaauaaauaaaaaucauugccugcauaaaauccagguauauauuuugggguugug

SEQ ID NO: 4136785 - RNA, 66 nt, Human
cacagcuaaucagagucagaggcuagagcugagccagcagcuagacuucagaaucuguguccugug

SEQ ID NO: 4136786 - RNA, 59 nt, Human
cacagcuaauggaaguggaaucaguucucagagcuggguuuuccauuccaguggcugug

SEQ ID NO: 4136787 - RNA, 64 nt, Human
cacagcucagcauuuguuuauucuguuaugaaauggaggugaauauacacuugcccagcuugug

SEQ ID NO: 4136788 - RNA, 68 nt, Human
cacagcucgucucuugccuuagugugcugcugugagagucacaguggaaacugcagggaggaggugug

SEQ ID NO: 4136789 - RNA, 59 nt, Human
cacagcugugagaagggagccuuaauuccaagucuccugaauugucccucacagcuuug

SEQ ID NO: 4136790 - RNA, 55 nt, Human
cacagcuucccgugcauggagaguuccuguuucuggccaugcagagggaucugug

SEQ ID NO: 4136791 - RNA, 84 nt, Human
cacaggaaauugucuuaaauggauggacaaugaaauuagaauaggcuuaaauuauuuccauuucauuuaucauaggguucagug

SEQ ID NO: 4136792 - RNA, 100 nt, Human
cacaggaauccaggagcccuuuacugugaugccgaccacuccaguagcguauaacucgcugggugcagugauuggcauugcagugcuggggucccuugug

SEQ ID NO: 4136793 - RNA, 79 nt, Human
cacaggacuagaugauaaaauguuguaaugggaagcuaauuguuucauuggcuuuauacguuugucuuuuauuucugug

SEQ ID NO: 4136794 - RNA, 85 nt, Human
cacaggaucucuacuuauuugucaaucccuugaaaaccucccauaaaacaaaggugagggcucugggguggcagagaucucugug

SEQ ID NO: 4136795 - RNA, 125 nt, Human
cacaggauuauaaaggaaaucaaucauugaaauguaguuucaucugucuucucaggacucugauguagaccuacauuaucagcacuucauggaugauuucuaaauuguaguagaagacuccucug

SEQ ID NO: 4136796 - RNA, 56 nt, Human
cacaggccgccuuggcagaagugucgagucugcagcugcugcccagagcacuugug

SEQ ID NO: 4136797 - RNA, 100 nt, Human
cacaggccuagccggccccuguuagcauugcuguggugcuuucuguuaacgagaggccacugaagcugggcgaugccucccagcaggggacgggcuugug

SEQ ID NO: 4136798 - RNA, 77 nt, Human
cacaggccucaguuucuccaucgcuccagugacgggcuggauccaacaccugugggccaggaggcugagucucugug

SEQ ID NO: 4136799 - RNA, 130 nt, Human
cacaggccuggaggcccaggaggaaaaagugguuuuguggauggggcccaggguccccaugcucugugcauccuagggccuuggugcucuguguugcagccacuccagccacggcugaaacgggccagug

SEQ ID NO: 4136800 - RNA, 68 nt, Human
cacagggaagcaggaauagcucugagcuacaaauagucauguuuccuucagaauuuuccgccucugug

SEQ ID NO: 4136801 - RNA, 82 nt, Human
cacagggagcaucuuggccagcgacgaccuucuuaguaccccucugagguggucguucuguugugcuugaugacuuccagug

SEQ ID NO: 4136802 - RNA, 55 nt, Human
cacagggaggcggucacuggcuugaggaggucucaauugacccuuucucccugug

SEQ ID NO: 4136803 - RNA, 55 nt, Human
cacagggccagcccuauuuuugguaaaguuaaauuggaaacuggcuuggccugug

SEQ ID NO: 4136804 - RNA, 61 nt, Human
cacagguagaugccaugcagcagccuccagcgcccucccugugccuggcauguaaccugug

SEQ ID NO: 4136805 - RNA, 79 nt, Human
cacaggugcuuuggggagguugccacauuccacucucaggggccacuccuguggguggcaaggccccacggcacaugug

SEQ ID NO: 4136806 - RNA, 63 nt, Human
cacaggugucaugccaccguuucccagagugucuucugggugguaguauuggcauggaaugug

SEQ ID NO: 4136807 - RNA, 63 nt, Human
cacaguacgcacccgauacaugugguugacuugaacuucauguggguacaggguguguaggug

SEQ ID NO: 4136808 - RNA, 77 nt, Human
cacaguagcuuugguugccaugaucugaggacagcagcacuuuaggucacaucggugaccaaagacaucagacuuug

SEQ ID NO: 4136809 - RNA, 56 nt, Human
cacaguauucacugggcagauuacuccaaaccuuuaaaaugccaguguguauugug

SEQ ID NO: 4136810 - RNA, 62 nt, Human
cacaguccuccugggccugccuuccugcuuguuguauuaggaaagcucccaguagggcucug

SEQ ID NO: 4136811 - RNA, 56 nt, Human
cacaguccugccagagggccuuugcacaugcuuugcccucaucuggaaccccugug

SEQ ID NO: 4136812 - RNA, 105 nt, Human
cacagugccacuguguuacauaaaagcuugagccauguaggagcuuucuugucauucagaacacugcagcucuagcuuuugaccucagauacuuuguuuucugug

SEQ ID NO: 4136813 - RNA, 91 nt, Human
cacagugcgggcacucagcaggugcucauuaaauauuagcugcuauugucaguugcuaucgugaagcacguggcaagugccugauacugug

SEQ ID NO: 4136814 - RNA, 55 nt, Human
cacagugcuuuaugagagaucuagggaaauccacuucuauuuguaaagggcugug

SEQ ID NO: 4136815 - RNA, 55 nt, Human
cacaguggcaguguagaaaaaccuauuucugucuggguuacauugucuacaugug

SEQ ID NO: 4136816 - RNA, 103 nt, Human
cacaguuguggaggcuggcagugcaagaucacgguguugagagggcugguuucuucucaggccucucuccuuggcuuuuggguggccgcguccucucccugug

SEQ ID NO: 4136817 - RNA, 72 nt, Human
cacaguuucaauaauuauucuuccaguguaaugaaguaaaugacuaacugaauagaugaagauugaacugug

SEQ ID NO: 4136818 - RNA, 85 nt, Human
cacauaacacuuuucucuuagcuuagcugccaggaaaauaauuuaauaccacuguugcuacuaagucauggaaagugugugugug

SEQ ID NO: 4136819 - RNA, 68 nt, Human
cacauaagaugugcauggguaugcaauuuuuaaauguaaaagugcuacuauuugacauguuuuauuug

SEQ ID NO: 4136820 - RNA, 62 nt, Human
cacauaaguggguuccauugcauaaccauggaauucucagcaucuuaaaaccuacauaugug

SEQ ID NO: 4136821 - RNA, 79 nt, Human
cacauacaaagauuuucacagcaacacugucugcaagagucaaagcuguagacagccugcuguggacugaagguuugug

SEQ ID NO: 4136822 - RNA, 70 nt, Human
cacauaccugaucaagcuacuugucuucguuuccuucuauuuaggaaagaaggaccagagcugaucugug

SEQ ID NO: 4136823 - RNA, 77 nt, Human
cacauacuugcucauuugccuuuagguuuucuguuuucuuaaacauacaaacauacaaaggaaaguaggaaguugug

SEQ ID NO: 4136824 - RNA, 61 nt, Human
cacauauaccagccgcgguacgugaauucuccacagccuucagagcagcugggagugugug

SEQ ID NO: 4136825 - RNA, 58 nt, Human
cacauauccaucuuugaaacuuuaaguuuagauaaugcagcucaaagauggguaaaug

SEQ ID NO: 4136826 - RNA, 59 nt, Human
cacaucaagcauccaugaguuuuguccugguucuggccuugcucuggauuguugaugug

SEQ ID NO: 4136827 - RNA, 86 nt, Human
cacaucauucacaucauucagggccucguuggcauguccaggcauguucagugggaggccauugaaugguuugaaacaggaaagug

SEQ ID NO: 4136828 - RNA, 104 nt, Human
cacaucgcccucucugcagagcucacacacgaagcccuuggccuggcaccgcucgcguuccagcuugaugugcuuggugaagagcgugugagucucggugagug

SEQ ID NO: 4136829 - RNA, 68 nt, Human
cacaugaaacagggaguaguaauuuacagaaacauuuuccaguaaacauaaacccuguugacauugug

SEQ ID NO: 4136830 - RNA, 70 nt, Human
cacaugacacccaggcauagcaccgcagaccucuggggagcugcuucuugcuguggguucuuggaaugug

SEQ ID NO: 4136831 - RNA, 57 nt, Human
cacaugagguggagaugaaugagucuucuuuugacaaaacauuuuaucccuuaugug

SEQ ID NO: 4136832 - RNA, 127 nt, Human
auuguccuaagccauccauacacaaaacguuuaauguguuauggaaggcuaacaguuuuucagcuuuucucaauacuuucagccauccauacauaaaauguuuaauguguuauggaaggcuaacagu

SEQ ID NO: 4136833 - RNA, 58 nt, Human
auugucgcuuauuuaggugcuucaaauuuuuugcuguuauuagcacugaagugauaau

SEQ ID NO: 4136834 - RNA, 88 nt, Human
auugugaaggaagauggaacaugauuugacaccauauugacaacuaaaagugauucuagucaugauucuaguugucuugcuuuggaau

SEQ ID NO: 4136835 - RNA, 57 nt, Human
auugugaugggacccucguuuaucuggcugcaggagaugaaagcuucccaucacagu

SEQ ID NO: 4136836 - RNA, 85 nt, Human
auugugcaucagaaauugcuaccaguggagaauuaaauuaauuagaauccuauuaaauaacugguugcaguuaagcugguacggu

SEQ ID NO: 4136837 - RNA, 68 nt, Human
auuguguucugaagcaccagaaguccccccuuccccuccaaacuggggcagccacugccuucaacaau

SEQ ID NO: 4136838 - RNA, 69 nt, Human
auuguugauuucauaguauauacaugaaagauauucauuucauggagaaaauuaagaagucacagcaau

SEQ ID NO: 4136839 - RNA, 80 nt, Human
auuguuuuguagaaugacccuugguuuaagcuugucugucaguuuucuuguggucauaucuaauaucauuucaaagcaau

SEQ ID NO: 4136840 - RNA, 120 nt, Human
auuguuuuguuugauuaaaugugggagcauuaguucuuguauuuuaauguguuuagcuuuuaaacauguuuucugaauauuuuuaguagcugaugccuggucucccaaccacaaaauaau

SEQ ID NO: 4136841 - RNA, 85 nt, Human
auuuaaacuugucugaauacauuucuguuacuugcaaguaaauaauuacaacauaugauaggagucuaaagggcauaggauagau

SEQ ID NO: 4136842 - RNA, 66 nt, Human
auuuaaagaagagaaggcauuuaugaguaauaugcugugguaguuaaauccuuaucuucuuugaau

SEQ ID NO: 4136843 - RNA, 93 nt, Human
auuuaaagcuaauuugcacuuggcuucaagguuaagguccacagcauaagcugaagaccuuuaaaucagaagucagacugaaaagccuuaggu

SEQ ID NO: 4136844 - RNA, 85 nt, Human
auuuaagcauuugguaauugagaugucuuuucugacaguuuggggaaacuauaagaaugagauaaucucagccuacauguuagau

SEQ ID NO: 4136845 - RNA, 78 nt, Human
auuuaagggggcacuuacucucagggcaagugccgacucuacauuuacaccacccugagagugcgugccuccuuaaau

SEQ ID NO: 4136846 - RNA, 79 nt, Human
auuuaauguagaccaaagaaaacacaucugggccaauauccagcucuuagggcaccagugugcaaucucuggcuuaaau

SEQ ID NO: 4136847 - RNA, 62 nt, Human
auuuacagaaacuuaaucauagcagaaauaugcaaaaugcuguuuguugaguacuugugaau

SEQ ID NO: 4136848 - RNA, 61 nt, Human
auuuacauagcagcauagucacaggcuguccuguggaagacagugacugguuguguuagau

SEQ ID NO: 4136849 - RNA, 84 nt, Human
auuuacuuuagcugagaaccucaugaagucauuucaaaguuggucauucauugagggauuuacagaggugggucguaaagagau

SEQ ID NO: 4136850 - RNA, 59 nt, Human
auuuacuuuugguaaggucauuucagaacuggguuuugaggugguuccaauaaguaggu

SEQ ID NO: 4136851 - RNA, 56 nt, Human
auuuagcaaaaaaugaugaagcauccauuagaugcuauaauugcaaauugcuaagu

SEQ ID NO: 4136852 - RNA, 76 nt, Human
auuuagucacaacuaggagcuucugccauagaaagcaaaaacagucuucugggacauucucuccauaguacugagu

SEQ ID NO: 4136853 - RNA, 74 nt, Human
auuuagucaucacucauguguuccuaauagauacuugguaagagcugguugaaugaauggauggaugacugaau

SEQ ID NO: 4136854 - RNA, 66 nt, Human
auuuauaauucuguuuuccauggcaguuauucuguuaugcuaaauucagacaggguuaauguagau

SEQ ID NO: 4136855 - RNA, 124 nt, Human
auuuaucaaauuacuaucauuaaugucuuaguaugaacucauuuauuuuccucuuucuauggaaaagaugaccaaaacagggaaguacauaggguucuucuuagagaaggugguuuugguagau

SEQ ID NO: 4136856 - RNA, 68 nt, Human
auuuaugcauucagagguugggugugcuuauguuuccagagagacaacagcuauugaauagcauaaau

SEQ ID NO: 4136857 - RNA, 66 nt, Human
auuuauggccagguucuggggagguacaaaguaugauucuugcuuccagggacuuggaauuuaaau

SEQ ID NO: 4136858 - RNA, 103 nt, Human
auuuauuaaccagaucucagaggggaaaauguaacauugaauuauauaguuuauaaauuugggcuauauacauguucauuacucuuuaacucugcauuuaaau

SEQ ID NO: 4136859 - RNA, 70 nt, Human
auuuauucauuuaacuacaagugucaaaccaaugaacaauggauagaaacuuucuguuagaugaauggau

SEQ ID NO: 4136860 - RNA, 62 nt, Human
auuuauuccuuuuguguuagcugcuuugaacaugauuagggaaguuugugggaggaauauau

SEQ ID NO: 4136861 - RNA, 61 nt, Human
auuuauugagacuuaacaacccaguuauguguguugugugguuguuaaggucucaauaaau

SEQ ID NO: 4136862 - RNA, 89 nt, Human
auuuauuuuucauuagugguguuauuagagcauuaauuuuccaaaagaaaauuuguagaauguuaaugaagcuacaguaggaaauaaau

SEQ ID NO: 4136863 - RNA, 58 nt, Human
auuucaaagguuuugucaugucuggcagugaugcaaagguaagcaaauuuuuuggaau

SEQ ID NO: 4136864 - RNA, 64 nt, Human
auuucaaggucauuuuugccuucuauuuucuuaggacucugaggagaaagaugauuuaugaaau

SEQ ID NO: 4136865 - RNA, 83 nt, Human
auuucagaggauugccuccuuuuuaaacucucaaucggccugcucaaaggaccagaauucagaaagggcauaaaaucuggaau

SEQ ID NO: 4136866 - RNA, 68 nt, Human
auuucaggcuuagacuaccuggucuguaauuuaggauauuaaugaccuaggugguuugagcucuaggu

SEQ ID NO: 4136867 - RNA, 57 nt, Human
auuucaguguugguuagcaagcuguacuggugagaguuaugggacagacacugaaau

SEQ ID NO: 4136868 - RNA, 75 nt, Human
auuucaucuggucuaguuuuuaguacucuuucuggauuacuggcugaggauuaagaaacauggaccagaugaagu

SEQ ID NO: 4136869 - RNA, 58 nt, Human
auuucaugagcuaauggaucucugaaaagccaauuuaaauuuccaggguuuaugaaau

SEQ ID NO: 4136870 - RNA, 80 nt, Human
auuucauuauggaaggguuuauaaaauguuggauaauucuguguaauucucacaauugagauccucccacccaaugaggu

SEQ ID NO: 4136871 - RNA, 74 nt, Human
auuuccacuaaaaguauuuauggcuauguaaaaugaauuuguaguuuuaagccauuuguaugcuucagggaagu

SEQ ID NO: 4136872 - RNA, 112 nt, Human
auuuccagggacaauuuuugcauccucaggggcuagcacuuaauguuucuugaauaaacaaauaguaaagugguagccaucauuuugggauucaauuguuuugaauggagau

SEQ ID NO: 4136873 - RNA, 56 nt, Human
auuucccaaguguaaacauggcaaaagacugcuggccugccuuuauucugggaaau

SEQ ID NO: 4136874 - RNA, 128 nt, Human
auuuccccuggagucaaaagccuacuuuuggagccgccacacccucgugcucccucccgcaucucggggguuccgggggaugcacguggggguggccccaggagcccugggugggaucucggggaaau

SEQ ID NO: 4136875 - RNA, 130 nt, Human
auuucguucauauguauuuaauagguuugugaguaacaauacuauuuucaguauccuagguaagucuaagugauucuuuaaagugguauuuauucacucaguuugaaaugaguaaaauguuuaaugggau

SEQ ID NO: 4136876 - RNA, 59 nt, Human
auuucuaaagagggugguuuggcagacagcuuacuuucaugagcuauccucacugaaau

SEQ ID NO: 4136877 - RNA, 86 nt, Human
auuucuauaucuguaaaacggggauaauagaauccuuaucccacuggauuguaaugaggauuaacuguugucauagguguugaagu

SEQ ID NO: 4136878 - RNA, 57 nt, Human
auuucucaguaggugcacagugguuuggaaaauuuccagcucugcauuuauggaagu

SEQ ID NO: 4136879 - RNA, 70 nt, Human
auuucucauuuagaguggcagggaagagugaagugaaaucaaaugcauccuccgauucuuaaauggaaau

SEQ ID NO: 4136880 - RNA, 60 nt, Human
auuucuccaagguucuuugucauguguuacauguuacaacucccugaaccucggagcaau

SEQ ID NO: 4136881 - RNA, 82 nt, Human
auuucucuaagcauccguuugcucaucuacauuggaugauggaucauccaauguagaugagcaaacggaugcuuagagaaau

SEQ ID NO: 4136882 - RNA, 63 nt, Human
auuucucuggacugcaguaagccucaugacucuuuaaaagacaugggaaaugcaaagagaagu

SEQ ID NO: 4136883 - RNA, 59 nt, Human
auuucugccauagccaggggauucacuuuaugacggauuguuuucuggaugguugaagu

SEQ ID NO: 4136884 - RNA, 56 nt, Human
auuucuguugcuuauaaauuacccagucuaagguauuuuguuauagcagcaggaau

SEQ ID NO: 4136885 - RNA, 79 nt, Human
auuucuuccccagugcucuuaaaggucauaagaucauuaugauuauuaauuaugggccuuuagaaguaccaguagaagu

SEQ ID NO: 4136886 - RNA, 120 nt, Human
auuucuuuccaucucaugggcuacaccuugaucuaacauuuuaauacuugugcuuacuuuaagaccuuuuuagcugaagaugaugguauauaggguauguggcaagagauggaagggaau

SEQ ID NO: 4136887 - RNA, 66 nt, Human
auuucuuugugcuucucaagaaaagugaagggugaaugaaaaucucuucacuugaaguucagaaau

SEQ ID NO: 4136888 - RNA, 90 nt, Human
auuucuuuuucuuuguauuuuuguugauuacuguguugcugacauuaguuauggaagcacuuuaagcaacagaucaacagaaaaaggagu

SEQ ID NO: 4136889 - RNA, 76 nt, Human
auuugaagguuuaugaaggauagggcaaaauuuucuaaggaaaguugcauccuaugaccucaggcugacuucaagu

SEQ ID NO: 4136890 - RNA, 87 nt, Human
auuugacugguuuuguauacaauucacacuucccaguggaugcauaauggagaggugguuguauugccacuaagggauuagucaaau

SEQ ID NO: 4136891 - RNA, 57 nt, Human
auuugaugggcccgugggacaaccacauugagauguugucuuuaggaccuguuaaau

SEQ ID NO: 4136892 - RNA, 58 nt, Human
auuugauugcaguuaguuggauccccaagcuuuuaacuacauuucacugcaauuaagu

SEQ ID NO: 4136893 - RNA, 59 nt, Human
auuugccaguguaaaacaaauuauuugguauuuauuguauuuggauauugcuggcaaau

SEQ ID NO: 4136894 - RNA, 79 nt, Human
auuugccuagaauaugugguguauacuuuuggcugauaagauauaguugucaaaaguauauaccacauauuugccagau

SEQ ID NO: 4136895 - RNA, 98 nt, Human
auuugcugggaggcuggaaacccuaguucugucauuggcuggcuagaugaccuugaaccuagcugugggccugggagagcuguuagccucuggcaaau

SEQ ID NO: 4136896 - RNA, 61 nt, Human
auuuggcucgauggacuuugaauccuuuguauuugaaauucacucuccauugaguauaaau

SEQ ID NO: 4136897 - RNA, 124 nt, Human
auuugggcuuugaaaggauccugcuugucugugugccagcauccugguggugguugggggagucugcaucaauccugggugcuguuaccugaaaaaauagcagguguuagacgaaagaacagau

SEQ ID NO: 4136898 - RNA, 55 nt, Human
cacaugcaugaaauccauaaacacaggggcauggcugugugugcgcgugugugug

SEQ ID NO: 4136899 - RNA, 55 nt, Human
cacaugccaggguagcauugugacaugugacuguccagacugcccugcacaugug

SEQ ID NO: 4136900 - RNA, 56 nt, Human
cacauggcagcugaugauuggaaaccaugcugguucacuguuacggcugucauuug

SEQ ID NO: 4136901 - RNA, 78 nt, Human
cacaugggaugauugauuugcacugucacacggcucugcugggugucauaacuuagugacaaaucaaggauuacagug

SEQ ID NO: 4136902 - RNA, 62 nt, Human
cacaugggcugugaacccaggcugucugaguuugaauuccagcugcggucauuagcugugug

SEQ ID NO: 4136903 - RNA, 69 nt, Human
cacauuaaaaugauggagaacaaagaaaaucuggcccaguuuuucuagaaaucuccuccuuaaggugug

SEQ ID NO: 4136904 - RNA, 62 nt, Human
cacauuaaugggaugagguggaaaguuggacacacuaccucacagucugccuuucccuugug

SEQ ID NO: 4136905 - RNA, 87 nt, Human
cacauuacgggcuaucgcuucauccgugaagccaaagaaauguguuuauuugguuugguuuggggugugugugugugugugugugug

SEQ ID NO: 4136906 - RNA, 55 nt, Human
auuuuagugaaauuuggccuuugugucuaggcacagaagucaauugaacugaaau

SEQ ID NO: 4136907 - RNA, 98 nt, Human
auuuuauuuuugacauaaugguuagaaagguuuugcucugaaauaucugaaauugaaauuugagagggcuuuuuuggcucuauaagguuaaaugaaau

SEQ ID NO: 4136908 - RNA, 99 nt, Human
auuuucagauauguuucaaugucuauguacauuuuauuguguugucucuaagaaaguuagcaguugaaauguagauuaggcauucucauuucugaagau

SEQ ID NO: 4136909 - RNA, 78 nt, Human
auuuuccaauguagaugucucugggauugccagcagcuuaucgaaucuggaccagugaaacuuucuauguugugaaau

SEQ ID NO: 4136910 - RNA, 66 nt, Human
auuuuccagccuuucuagaacucgagguuauauauaacccuacugacuuuugagaagcuggaagau

SEQ ID NO: 4136911 - RNA, 87 nt, Human
auuuucccccuuuuuuguagcuaaaaaucacccaggcuuguccagacgagagggcagaaaauuaugcggugaaagagaagggaagau

SEQ ID NO: 4136912 - RNA, 58 nt, Human
auuuuccuaaaagagcaaaguggaccauucccccuccucucagcucuucagggcaagu

SEQ ID NO: 4136913 - RNA, 80 nt, Human
auuuuccuaggaugacacagcaaguauaguaaaucugaaaucagagccagcuacauaaucugugagguccuauggaaaau

SEQ ID NO: 4136914 - RNA, 75 nt, Human
auuuuccuuucauguucucccuucacuuuauugugagcaacauagugauuuggcggcagaguuagaaauaagaau

SEQ ID NO: 4136915 - RNA, 57 nt, Human
auuuucuagauagaugaugcauaaguuuuuaaucuucugcuugcacaucuagaaagu

SEQ ID NO: 4136916 - RNA, 58 nt, Human
auuuucuauucugcugguuuaggguuaccaucacagacucauccuguagauagaaaau

SEQ ID NO: 4136917 - RNA, 69 nt, Human
auuuucucuuucauggagaaaagcuauagcuuucacuauucauggcuucuuaaucaugagagugaaaau

SEQ ID NO: 4136918 - RNA, 108 nt, Human
auuuugacuauuuaaaucaacauuugauuccauccucuacuacagaucuauauaugaaagauaucggaguagaggaugggguuaaauauugacuuaccaagucaaaau

SEQ ID NO: 4136919 - RNA, 58 nt, Human
auuuuggcaguuugugcugaggucuuugcugacacucaaacuguuauauugccagagu

SEQ ID NO: 4136920 - RNA, 103 nt, Human
auuuuguccuggggcccauaggucacucacagcagacuaugagggauauaaacaugaauaaauggaguccuuagcugucugugcuggaaguccuaggcugaau

SEQ ID NO: 4136921 - RNA, 55 nt, Human
auuuugugaauuaucuacaggacuucuucauucucauguggaggguucucagaau

SEQ ID NO: 4136922 - RNA, 77 nt, Human
auuuuguuuaagauaugguaggaaguuuggcaguguugacaggaaggcacaaaucauuccaucauucuuagcaaaau

SEQ ID NO: 4136923 - RNA, 79 nt, Human
auuuuguuuuauagguccugugagauuuaugcuuuaaagagguucuguuuggauguguuuccaggauuuguuucaagau

SEQ ID NO: 4136924 - RNA, 98 nt, Human
auuuuuaaaaacauggaaacaaaccaggagacuguacugauauuuggauuuaaguuagagaucacaguuuuuuggccaacuucuuugauuuuaaaaau

SEQ ID NO: 4136925 - RNA, 70 nt, Human
auuuuuaauauuccugucaagaucuuacaagaagaaauuacuuugugagguauguagggaugcuaacagu

SEQ ID NO: 4136926 - RNA, 101 nt, Human
auuuuuaugacuucuauuugguguugucauaggaaacucagccagagccuaagucuggcuuuagcugccuagacagcuauagcaaaagaagcuguagggau

SEQ ID NO: 4136927 - RNA, 65 nt, Human
auuuuucaaaucaaauuuguuucugauuacucaaguagguagaaauagauauugguaagaaaaau

SEQ ID NO: 4136928 - RNA, 73 nt, Human
auuuuucauauggaaauaauuagacaagugcccaaaguuauagguauauguuuuguguuugccacugaagagu

SEQ ID NO: 4136929 - RNA, 87 nt, Human
auuuuucuuuuaggcuuuucuauguauuucagauuuaccacaaugaauguguguuuguuuagugcagagagaaaaauaaggaaaaau

SEQ ID NO: 4136930 - RNA, 114 nt, Human
auuuuugaacuggacuuugacagaugcguaggaguuugcuggauggaguaacagcuucaggcccaacgcacagcuucugacagauccccauguuaagggucuauucucaaaggu

SEQ ID NO: 4136931 - RNA, 75 nt, Human
auuuuuggguagcucaauagagccacaaagugaagaaagcaauaauuauguggccaccagagcugcuauuagagu

SEQ ID NO: 4136932 - RNA, 82 nt, Human
auuuuugguucaagggcuguaguuuguugaucaccauccuaggagggugguucucaaaguauacucccagggaacuagcagu

SEQ ID NO: 4136933 - RNA, 68 nt, Human
auuuuuguauuauuauaaucagggcacaguguuuccaaggcugugcauaaguauaauaaaccaaagau

SEQ ID NO: 4136934 - RNA, 82 nt, Human
auuuuuguauucuuugcccuuaaugaaauaauuguuauaugcuggaaguuagugauugccguuuuggguagaaugagggagu

SEQ ID NO: 4136935 - RNA, 80 nt, Human
auuuuuguggccuuucaaggauggaaucuuuuucugaccugauccacaaauucuggaaaggccccucuguugacagaaau

SEQ ID NO: 4136936 - RNA, 112 nt, Human
auuuuuuauaucuaaguuguuaugguuugucuaaaugaguaauacuuuauaauuuguugcuuucuguuacauauuuggauagguucugucaaacuuuagguuuuauuugagu

SEQ ID NO: 4136937 - RNA, 90 nt, Human
auuuuuuauuuuugauacuuugugcaauuucucuagaauaugaggauuaagaaccuuagggauuguauuagugucacagcaguagaaaau

SEQ ID NO: 4136938 - RNA, 85 nt, Human
auuuuuuccaucagacauuuuuauauuugugcugagauaaugcuucaaauguuucaacacaacagagaaaugcuguggaaaaaau

SEQ ID NO: 4136939 - RNA, 78 nt, Human
auuuuuugaacaguuucuauguuagugguucuuaauccuaacugcaagccagaaccacccaagaggcuuuuauagaau

SEQ ID NO: 4136940 - RNA, 76 nt, Human
auuuuuugcucuaucuuaaagacugcggaauuugaauggaaaauucaacaggaaagcacuuuacagagcagagagu

SEQ ID NO: 4136941 - RNA, 79 nt, Human
caaaaaauaagauugacacaaguaccugggaggaugugugugcauacauacaggucuuguuuaguaauuuauaaauuug

SEQ ID NO: 4136942 - RNA, 70 nt, Human
caaaaacuggaaauagcccagguguccuaguuuuagaaauggagaacugauuagcauuugccaggguuug

SEQ ID NO: 4136943 - RNA, 121 nt, Human
caaaaagaaccaccaccccaaagauagugucauuauuucuucucuuucacggucagccuguuuaaucugaaguuuguagauagaaaaaugauuauaucuugcaagggucauaaauuuuuug

SEQ ID NO: 4136944 - RNA, 82 nt, Human
caaaaagacuucauuauucacucagaaauagaaugaaccagaagaaaaugguuuuucugguuugaguuaguguucuuuauug

SEQ ID NO: 4136945 - RNA, 81 nt, Human
caaaaagcaagaaucuccauuccuguuuuaccuuauguaagaagguugggcacggacagguggggaugaagcuugauuuug

SEQ ID NO: 4136946 - RNA, 72 nt, Human
caaaagaccugaaauauaaucuaguacccuuuuuaccuggggauccuuggauggauuucagagauucuguug

SEQ ID NO: 4136947 - RNA, 55 nt, Human
caaaagacuuucaccuagcaaagaggcguucguucugaugagggaaagucuuaug

SEQ ID NO: 4136948 - RNA, 83 nt, Human
caaaaucaggaucuacauugaccuuuguuagguugaaaugauggcucaaaucuaccaacauacggucaguagucuugaucuug

SEQ ID NO: 4136949 - RNA, 77 nt, Human
caaaaugaaaacaaaacccagccgcuggugcagagucccuugaaagcucuggauccggcugggucuguuagcuguug

SEQ ID NO: 4136950 - RNA, 122 nt, Human
caaaaugauaccgaauauaaggagcaauagucacgugcaucuuuccauaugugguugcagaaacacaauucagaugucagcaagagguguuaauauugcucuuuaucuaaaaucucauuuug

SEQ ID NO: 4136951 - RNA, 55 nt, Human
caaaaugcaucugagaccaggcacggugacucaugccugucaucccagcauuuug

SEQ ID NO: 4136952 - RNA, 81 nt, Human
caaaauguugucucaagggaggcuggaguacaugauucuucugauguggacuguguuuccccuccuggagaaggcaggcug

SEQ ID NO: 4136953 - RNA, 61 nt, Human
caaaauuggguuagcucucagcagcccgcucuugagcucugaaaaagcuugccuucuuuug

SEQ ID NO: 4136954 - RNA, 90 nt, Human
caaaauuuugcguguggucuguguagauacauauguauauccguauauacauauguauauguacacagucauuauuauguauauauuuug

SEQ ID NO: 4136955 - RNA, 75 nt, Human
caaacaaaaugacauacuuuuagauagaugggcuuugaagagaauaaccauccucuacagguucaagaguguuug

SEQ ID NO: 4136956 - RNA, 72 nt, Human
caaacaaauuuagcucugagugcuggggucucuuuucuaauuacucagcuuuuaguacguuaaaauuggaug

SEQ ID NO: 4136957 - RNA, 60 nt, Human
caaacacagacauagugauuacaggagccagguaggcaacugaaaucagucuagugggug

SEQ ID NO: 4136958 - RNA, 88 nt, Human
caaacagaaagagaacaugagaaccaggucuguguuuugccucugggaaaagcauaccauguguucaucuuguuuccucuuuuguuug

SEQ ID NO: 4136959 - RNA, 55 nt, Human
caaacagcaucugccaacucuacuuucacaguacagccccaugcagguguguuug

SEQ ID NO: 4136960 - RNA, 55 nt, Human
cacauguguauaugugaggggguggucugggugucucuauaggugugugugugug

SEQ ID NO: 4136961 - RNA, 58 nt, Human
cacauguuuggcaugucaccaaggguuuugacccaccggcuggcacuccaagcuagug

SEQ ID NO: 4136962 - RNA, 69 nt, Human
cacauguuuuuggccaucauggauaauauuuauuuucuaaacuucuggauggcuuuuuuaaagcuugug

SEQ ID NO: 4136963 - RNA, 78 nt, Human
cacauucacauuuuucccucuaaacaccaauuaaaauucagaacuucuggugaaauggaaggaaggaaguccaaugug

SEQ ID NO: 4136964 - RNA, 57 nt, Human
cacauucaggauuuuccaugucuuagugauggcauuucuggaauauuccuggaucug

SEQ ID NO: 4136965 - RNA, 78 nt, Human
cacauuccagaaaccuuugucuuaaucaaccugagagaauccagcuuucagccagagggggcaaaggaagggugugug

SEQ ID NO: 4136966 - RNA, 69 nt, Human
cacauuccagguagggaauaaaugucaugugagugccacacgugagugaaaaauuugccuggagcugug

SEQ ID NO: 4136967 - RNA, 74 nt, Human
cacauucuaaagcaugcucaggauauuaucauuuauuuuugcacauauucuuucugaguaugauuuugucugug

SEQ ID NO: 4136968 - RNA, 60 nt, Human
cacauugaacuugucuggugggcagccucaacaauuccauccaccaacauaggaaaugug

SEQ ID NO: 4136969 - RNA, 56 nt, Human
cacauugccacacaaguaaagaaacaacuucuguuucaacuagguguggucaugug

SEQ ID NO: 4136970 - RNA, 88 nt, Human
cacauugccucuugguccuagccagggcucugcuguuccuggaggagcggcugugggccagcuagacccuuguccacagaggcgagug

SEQ ID NO: 4136971 - RNA, 66 nt, Human
cacauugcuucuguugcaaugauccagcgcugccauuguagugugaaaggagccauagacagugug

SEQ ID NO: 4136972 - RNA, 130 nt, Human
cacauuggaaugaccucaggagcuuuaaaaacuacgaaugcuuggguuucagccccagagauuugcguuuaaucggucugagguguagcugggcuucaagcuuuuaaaagcuccucaggugaugucacug

SEQ ID NO: 4136973 - RNA, 55 nt, Human
cacauuuacauauaaaacuuuccccagugggccacagaggauuuauguggaugug

SEQ ID NO: 4136974 - RNA, 55 nt, Human
cacauuuagaguucuuuacuccaguaugguaccguauggaauggauuuaaaugug

SEQ ID NO: 4136975 - RNA, 81 nt, Human
cacauuucuucagaguaguuggauuuggggaacagggaguaauauuuuuuccacaaaucaauucugcugaaggauggugug

SEQ ID NO: 4136976 - RNA, 60 nt, Human
cacauuugaugcucuauuuaaaaggacauccaacaugucuuuagaagaacaucagaaaug

SEQ ID NO: 4136977 - RNA, 69 nt, Human
cacauuugcuggcugaauguuggacacuuacguuuauuaaaggcaugagguucaccauucagagaugug

SEQ ID NO: 4136978 - RNA, 89 nt, Human
cacauuuuguuuaucuauucaucagcuaauggacauuuggauuguuucaauuuuuuggcuguuaugaguaucauguacaaguuuaugug

SEQ ID NO: 4136979 - RNA, 57 nt, Human
cagacaggguuuuggucuuugguuucugugaucccaguuguucccaugacccugcug

SEQ ID NO: 4136980 - RNA, 58 nt, Human
cagacagguugcaaaacuucaaacagaagagaguuguuggaguuaugugauaugugug

SEQ ID NO: 4136981 - RNA, 57 nt, Human
cagacaguauuuaacuaguucauucgccucaggccuaauggccuagaagugcugcug

SEQ ID NO: 4136982 - RNA, 73 nt, Human
cagacauacaguaagugucccugaaaccuuagaccuugucucucuggcuuuaaauacuguacuguuuugacug

SEQ ID NO: 4136983 - RNA, 58 nt, Human
cagacauccagguacgagcuuuacaggguuaaacuucugaucguugccuggaagucug

SEQ ID NO: 4136984 - RNA, 60 nt, Human
cagacaugagauacagcugcuacaaaacaacaccgauuaauaguuguauuuuaugugcug

SEQ ID NO: 4136985 - RNA, 60 nt, Human
cacugaaguuucuuauuucaacuggaacauucuucuugaaugugugugauaggaucagug

SEQ ID NO: 4136986 - RNA, 58 nt, Human
cacugacacucuugauccuauaguaggguuggguuccacaauagaauagaguguggug

SEQ ID NO: 4136987 - RNA, 65 nt, Human
cacugacuaggucggugaccuccaccagccaguccgggccuaacauggugaccaccuggucagug

SEQ ID NO: 4136988 - RNA, 57 nt, Human
cacugagcaagucaguacagcacaauccacgcuagcuacaaauggcauuguuuagug

SEQ ID NO: 4136989 - RNA, 79 nt, Human
cacugagcagaucucaggccuucuguugcugggugguaaaggaggucuuuguggccacgggagggcuguuugcuuggug

SEQ ID NO: 4136990 - RNA, 65 nt, Human
cacugagcaugcacccaggaaggguuaacccucacccuaucccuucccuaaagcgucgcuuagug

SEQ ID NO: 4136991 - RNA, 79 nt, Human
cacugagcuauguuucagggaaguguugaaaaggcccagccugcgcauauucuugaaauuuugaaauaauggcucagug

SEQ ID NO: 4136992 - RNA, 69 nt, Human
cacugagggacucccaccuggcagcagucaccuccgcaccuucaccgaccacugcagggagccccggug

SEQ ID NO: 4136993 - RNA, 59 nt, Human
cacugagguaucugucucuccuacuauaguguaaacaccuuggaggcaggucucaugug

SEQ ID NO: 4136994 - RNA, 101 nt, Human
cacugaugaacacuuucuuccuugcucaggccuggaagagugguaggcccuuagcaaaugagccagauugaagagaugaaugaauuuguguacucacagug

SEQ ID NO: 4136995 - RNA, 55 nt, Human
cacugauuaagucugcuagagggcuaacagaggucacugauaggcuuuaucauug

SEQ ID NO: 4136996 - RNA, 56 nt, Human
cacugauugcuuuuggccucugaggagcuacagcaggcugagacugugcauuagug

SEQ ID NO: 4136997 - RNA, 56 nt, Human
cacugcacaaaaagcugcaacugucuguccaguggagaguagcagaaagugcagug

SEQ ID NO: 4136998 - RNA, 67 nt, Human
cacugcacacuccaagaccuacuuucucuggagcucuagaaaaagucaaggaauuggacaggcagug

SEQ ID NO: 4136999 - RNA, 71 nt, Human
cacugcagaaggaggaggaaauccauuuaucucaacaagagaagcuuggcuuugucuucugucugcuugug

SEQ ID NO: 4137000 - RNA, 62 nt, Human
cacugcagccacauagaugacguucccuuuguuggaauugcaaaguuuuguggcuaguagug

SEQ ID NO: 4137001 - RNA, 60 nt, Human
cacugcaggggaccaaagucugacuccaaaaggaggcagaaugccaggucuucugcagug

SEQ ID NO: 4137002 - RNA, 87 nt, Human
cacugccaccagcaccaguacuugcuaccucaauugaguauuuuuaugaaacacauugcagguugcacagugcagcuucaggccaug

SEQ ID NO: 4137003 - RNA, 62 nt, Human
cacugccagguaagugcuccugccaaugcaucaguguagagcaagccugccaccugguggug

SEQ ID NO: 4137004 - RNA, 65 nt, Human
cacugcccaccaaguggcugguaugggcacuuacauugccgcccucauggucacuguggauagug

SEQ ID NO: 4137005 - RNA, 84 nt, Human
cacugccccacuggacccgucgccccccugggaggggccgccaguucggcuggcccugugggccaugugucuacagggguugug

SEQ ID NO: 4137006 - RNA, 61 nt, Human
cacugcuugcaguaugaguggaaguuuaaacaagguuucuuguauucauaagugaacagug

SEQ ID NO: 4137007 - RNA, 74 nt, Human
cacugcuuucugaggauaacaguuuaagauauuucuucugaaaaauaauagcuguuuucuucuaggaagacaug

SEQ ID NO: 4137008 - RNA, 70 nt, Human
cacuggaaccuggcagcccuauaucugcagugcacuucucagggggacuuguuagguuuuauauauagug

SEQ ID NO: 4137009 - RNA, 65 nt, Human
cacuggacugaccacccuucccccuugugcaguugcgcccaaagggguggucaguacccgcagug

SEQ ID NO: 4137010 - RNA, 55 nt, Human
cacuggccuaauccaauggacauuuauuguuacuucauuaugguugggcacagug

SEQ ID NO: 4137011 - RNA, 130 nt, Human
cacugggaauuucuggagucugggaguucugucuuggggugccucugcaugcucagcacccacauuugagaaaugcuggugagugaagagaugagaggucccuggccuuagaagucuuccagucuaguag

SEQ ID NO: 4137012 - RNA, 55 nt, Human
cacugggcugauaccaggcuucgugagggucggagccuugugcuguuguccagug

SEQ ID NO: 4137013 - RNA, 88 nt, Human
cacuggggaugcuuauugaaaugcagaaucucaggccccacccuagaccuagugaauuggaaucugcaauuuaacaaaaucccuugug

SEQ ID NO: 4137014 - RNA, 107 nt, Human
cacuggggugauguuaccauaauaauuauggaauuauggcuuaaaaucaaaucacuauuguggacauuuaagucaugauucuguguuacuaggaaaccaaacuagug

SEQ ID NO: 4137015 - RNA, 87 nt, Human
cacuggguggugugugaauuagagagggaauacagccugggcaggauggagaaaccccaucucuacaaaaauuagcaugcaccugug

SEQ ID NO: 4137016 - RNA, 63 nt, Human
cacuggguuuccuggcacuacccucccuguggaaccuggccggcugccaggagaagcucagug

SEQ ID NO: 4137017 - RNA, 75 nt, Human
cacugguaugucugagucugcuccaguugaaaaucaugccuugaaaaugcaaccugagacuccaggcaccuaaug

SEQ ID NO: 4137018 - RNA, 60 nt, Human
cacuggugaguccagaagucauaagagcagaugcugcaguagcaguuuggaucauuagug

SEQ ID NO: 4137019 - RNA, 61 nt, Human
cacuguauuauuaggaaugacaucuuggcaaagaaaaugccaauucucuaguggugcaaug

SEQ ID NO: 4137020 - RNA, 79 nt, Human
cacugucugacccuuuagagaaaguuugucaaccccuggccuagaacauggguggcuucuuacuagggcucaguaagug

SEQ ID NO: 4137021 - RNA, 62 nt, Human
cacugucuguagacauuuuugguugucacaacugggugggaggcaaggugcuacagacagug

SEQ ID NO: 4137022 - RNA, 58 nt, Human
cacugucuuuugugaagacaaugaggaagcacguacucuuuuguagcaaauggcagug

SEQ ID NO: 4137023 - RNA, 69 nt, Human
cacugugggccugucguggguggggccagcagcacaugcaugccuggcucacagagcagccuuugggug

SEQ ID NO: 4137024 - RNA, 82 nt, Human
cacuguuagauuaaaugcuuugcaagaucugccaugaugcacuguaucaucucauucauccaaggauuuauuucaaccugug

SEQ ID NO: 4137025 - RNA, 61 nt, Human
cacuguucagcuugaaucuggcuuugacaaaaguuaugccaaucccaggcuggacacagug

SEQ ID NO: 4137026 - RNA, 67 nt, Human
cacuguugaagauacuuccucuagcaauuaaacaccugaaaaagaugaugugugucuucagcuagug

SEQ ID NO: 4137027 - RNA, 92 nt, Human
cacuuaauaagaaugccaccuucugcuugagcucuaucucagugugccacaacaaacugggaagcacgcucagcagaaaaaccaguuaagug

SEQ ID NO: 4137028 - RNA, 57 nt, Human
cacuuacacuucugaaagccuagguccaacuauagggcugauaccgggagagaagug

SEQ ID NO: 4137029 - RNA, 57 nt, Human
cacuuacauacugagaaaauauccugccuugucagggugugugugugugugugugug

SEQ ID NO: 4137030 - RNA, 96 nt, Human
cacuuacauguucaggagagcuucuuccaaggacgcaccuuguguauccaaggcuuaugugcauucuuggaagaagcucucccaaacauguaagug

SEQ ID NO: 4137031 - RNA, 69 nt, Human
cacuuaccagagaugucuaauaggggcagccugagaauuguccagacggccucaggcauccugcaggug

SEQ ID NO: 4137032 - RNA, 69 nt, Human
cacuuacugagagccuccuguuggcuaggcauaguucuaggcacuagcgacaccaaggcaggggaagug

SEQ ID NO: 4137033 - RNA, 71 nt, Human
cacuuacuuugauacugugaagccuaacuuauacauuuuuauagaaggcagaucaguacaggguuaagaug

SEQ ID NO: 4137034 - RNA, 99 nt, Human
cacuuaguuuucuagacauuucuauguacaugaucuuauuagacccucuuaaugacugagguaggacuguaucagaugugaucuagaguauguuaagug

SEQ ID NO: 4137035 - RNA, 102 nt, Human
cacuuaugaguaaacaauuaguuuggggauugaaauguaaauaggacuagaauucaugaauuuguucucaacauuuuuccucucugacaaaacucauguuug

SEQ ID NO: 4137036 - RNA, 82 nt, Human
cacuuauuuuaaagauugaauauagagauucuuguggcaaaccuaagcuacugguagccacucuuuacuaucaaaauaagug

SEQ ID NO: 4137037 - RNA, 61 nt, Human
cacuucagcuacaaucacaugauggagaaaauuaagaguuaugugaauuaugugcuaagug

SEQ ID NO: 4137038 - RNA, 79 nt, Human
cacuucccaacuguuggaggauuauuuugcuccacacgaagacaggagagcaaaguauuaaccaacaggauguggagug

SEQ ID NO: 4137039 - RNA, 69 nt, Human
cacuucccacugcaccagcugcuagaacaucacaggaagaaaugccuuggagcagcuggagguggagug

SEQ ID NO: 4137040 - RNA, 60 nt, Human
cacuuccguauaauaauguuaacauauaaauugauguguggccuuauuuguaugggggug

SEQ ID NO: 4137041 - RNA, 90 nt, Human
cacuuccuuugucagucaugucugcuuuucuucaaauggagccuuaagaggcccuuaugcaaaggcagaaauagauuuauaaauuaagug

SEQ ID NO: 4137042 - RNA, 56 nt, Human
cacuugaaugagaauuuccuggggaugguccugggaauguguauuuuuaacaagug

SEQ ID NO: 4137043 - RNA, 61 nt, Human
cacuugaggaaauggaagccaagagacuugaucaaggucacacagcuccuuuccuuaguug

SEQ ID NO: 4137044 - RNA, 84 nt, Human
cacuugcaacaaagagaaggcaagcuuuggauaugaguaaagacaauuacauauauuuauuuucuucuuauugaguagcaagug

SEQ ID NO: 4137045 - RNA, 73 nt, Human
cacuugcauuuucagccucacaauuggcaacuuuaccagaaaaaaguagcuauuuugcuuggaaauacaggug

SEQ ID NO: 4137046 - RNA, 70 nt, Human
cacuugcccaagauccuacauccugaaagucugaauuuuggcuugucagggacaguucuuagggugggug

SEQ ID NO: 4137047 - RNA, 88 nt, Human
cacuugucccaggagaggaggcucccucaacucugggugcucacugugggcacccacagacaggcagcccuucagcagggugcaggug

SEQ ID NO: 4137048 - RNA, 84 nt, Human
cacuuguuuaauggaauacuuuuuagccuguaggucaacagaucaauaugcuggcacgaaaggguguccaugauagauuaagug

SEQ ID NO: 4137049 - RNA, 63 nt, Human
cacuuguuuugugaauuacagaaaugguaagugcccacauuucugugaauuauaaaauuugug

SEQ ID NO: 4137050 - RNA, 65 nt, Human
cacuuuaauuucuuuucccuagugucagcugcucaagccugaccaggguagaggugagaggagug

SEQ ID NO: 4137051 - RNA, 57 nt, Human
cacuuuacccuuguuacucauggcuucccgucaagccauggguauuaggugacagug

SEQ ID NO: 4137052 - RNA, 75 nt, Human
cacuuucauucauuuacaauccauaacuuccaguucaagaaucuaauuuggaguucagaguaaauguugaaggug

SEQ ID NO: 4137053 - RNA, 65 nt, Human
cacuuugaguggccaggccuauguauauucugggaucuugcagaggcacugugucaguuggggug

SEQ ID NO: 4137054 - RNA, 71 nt, Human
cacuuugccuuuagauaagccuucugcaaauuagaauguaaugaaagaccuuguaacuagaggcccaagug

SEQ ID NO: 4137055 - RNA, 70 nt, Human
cacuuugggaggccaaggcggguggaucagcugacuucaggaguucaagaccagccuggccaacauagug

SEQ ID NO: 4137056 - RNA, 70 nt, Human
cacuuugggaggccacggcggguggauuacuugaggucaagaguuugagaccagccuggccaacauggug

SEQ ID NO: 4137057 - RNA, 88 nt, Human
cagcuuacucugccuguugcauuuucccuccagagguccaaauauuaucacguauggauauggaaauagcaauaugguuggaagguug

SEQ ID NO: 4137058 - RNA, 56 nt, Human
cagcuuagcagcuggagguaccauggacauucauuccuucuucaucuccugagcug

SEQ ID NO: 4137059 - RNA, 59 nt, Human
cagcuuaugguauagacagaguacuuuacccacuucuauauucugcuguuccuaggcug

SEQ ID NO: 4137060 - RNA, 64 nt, Human
cagcuuccaagccucaguccucaggcuacaaugagucaaaaauaggaagaaagguuggagguug

SEQ ID NO: 4137061 - RNA, 71 nt, Human
cagcuugacaacugugcuuugaggccgggugugguggcucacgccuguaaucccagcacuuugggaggcug

SEQ ID NO: 4137062 - RNA, 71 nt, Human
cagcuugcuaauuuuagauacaauuuccagggugaccuacccugaagagcacucuagaguugacugaguug

SEQ ID NO: 4137063 - RNA, 130 nt, Human
cagcuuuaauuaccaagcucuuauggaagcugagggaauuggcauuaacucuguuucaauuuguacuuuugcaaaugagauguaguuacaugacaaugauucacuucugugaggugucaaaaauaaacug

SEQ ID NO: 4137064 - RNA, 58 nt, Human
cagcuuuaccaauauuuggaaaguuugacagcaaccuguuuaagugcugguaggguug

SEQ ID NO: 4137065 - RNA, 57 nt, Human
cagcuuucacugauaugcuuugacuccccucuuagagaucaugcaaucagugaacug

SEQ ID NO: 4137066 - RNA, 63 nt, Human
cagcuuuccagagaccugcccccuuuucuagcuggggugcugauucuacuccuggaauagcug

SEQ ID NO: 4137067 - RNA, 83 nt, Human
cagcuuucuuauagucuuccacauuucaagaggcugccgccaaaguguaugguuuucugugggaagacagggagaggaggcug

SEQ ID NO: 4137068 - RNA, 76 nt, Human
cagcuuuugcauguuguguacaucaugcagggccugacugcagccagguaugcugccuacgaacaugcagaggcug

SEQ ID NO: 4137069 - RNA, 87 nt, Human
caggaaaagggauauuuagaagagaacaaugcauucaagcuuuuugaaaguauuugauuucuauuaccacauuucccuuucauucug

SEQ ID NO: 4137070 - RNA, 130 nt, Human
caggaaaagugccccacccaggggagggaccgguaugauaaaaggcaagcagcuugagggacagauccucccugcauccaaaggccuccucagucugcaguuccagcuccagguaagugcaccuucucug

SEQ ID NO: 4137071 - RNA, 63 nt, Human
caggaaacaaaccacucaugguggugcucuuuuugccuucacuaugaaguguuugucugccug

SEQ ID NO: 4137072 - RNA, 67 nt, Human
caggaaagggcagaugcuggaggagcuauuauagaaccuuccaucacucccuacacgaaucuuccug

SEQ ID NO: 4137073 - RNA, 71 nt, Human
caggaaauggggugacagugcaguggucauugaccugccaguguguccaggcccugugaccuugucucuug

SEQ ID NO: 4137074 - RNA, 62 nt, Human
caggaacaacucccagcaucucagaaucaaaucuccacuccuggaugcucuagucuuuccug

SEQ ID NO: 4137075 - RNA, 66 nt, Human
caggaacaggggagugaaccugaauuggacgacuaggaagaauuucaggcucugccauugucccug

SEQ ID NO: 4137076 - RNA, 61 nt, Human
caggaacccccacucucagcucugccaugucaaggcucagggcagagagggagggaucuug

SEQ ID NO: 4137077 - RNA, 60 nt, Human
caggaacccugacagguguccgaagcaggaaagccaugcuggcccuggcucagggaacug

SEQ ID NO: 4137078 - RNA, 58 nt, Human
caggaaccuaaagagacauuacaacuaaacgcaaugugguaucuuggaugggauccug

SEQ ID NO: 4137079 - RNA, 55 nt, Human
caggaaccugcuccaagaggcaagaaugaggcgauguuuugugaggagguuccug

SEQ ID NO: 4137080 - RNA, 57 nt, Human
caggaaccuugucuguguuguucauggcuauauccccagcacucagaacagggccug

SEQ ID NO: 4137081 - RNA, 94 nt, Human
caggaacuagauccaguuuuugccaggugucuuggcugacugucagagacagucaucugguuuugcauggcagcaucugguuuuacaguuucug

SEQ ID NO: 4137082 - RNA, 62 nt, Human
caggaagagguggggcuaaaguugguaauaugccaggggagugguaccacaucuugucccug

SEQ ID NO: 4137083 - RNA, 66 nt, Human
caggaaggagcugggagggacacaugcauuccuaggaugagcaugacagcugcccagcuccuccug

SEQ ID NO: 4137084 - RNA, 73 nt, Human
caggaaggcuagggacacagcucugcuccaucacacaggaaggcugggggcacugcuuugcucugucacacug

SEQ ID NO: 4137085 - RNA, 89 nt, Human
caggaagggguugucuaaacacgucucuuugaauauauucaacaaauaaaugcuuguaucuaaaggccuguugagaaacuacuuucuug

SEQ ID NO: 4137086 - RNA, 72 nt, Human
caggaagugaaauccuggucaacagguagguuccggcuuccuacuguucauuuggauuucucuguaaaccug

SEQ ID NO: 4137087 - RNA, 61 nt, Human
caggaaguucagagguuaauuuauuugccucaauggcacaaugaauuuuuuuggaggacug

SEQ ID NO: 4137088 - RNA, 83 nt, Human
caggaauauuacuuuuacccagugugguuuauagcauacauuuguacugaagcauauagggauguuaaugugaucuuuuccug

SEQ ID NO: 4137089 - RNA, 57 nt, Human
caggaauguccuugucauuucaguucagcgugaaaugcuuuuacaggauauuaucug

SEQ ID NO: 4137090 - RNA, 74 nt, Human
caggaauuggcugaaucccaauaagcagggaguagcauguuuggccacuuccuuugggaaaucacuaaggccug

SEQ ID NO: 4137091 - RNA, 84 nt, Human
caggacaaguuuaagaacugaguacguuaauaaauaagguccaguuuucaguuuggggaugucugaguuguugauaagguccug

SEQ ID NO: 4137092 - RNA, 61 nt, Human
caggacaucuucuguguuuuuacuguuggagucucagaaaaacaaaucuuuagguauccug

SEQ ID NO: 4137093 - RNA, 66 nt, Human
caggaccagcuggucaguugaagauuauagcaauaauccuccagcagaugauuagacccuggacug

SEQ ID NO: 4137094 - RNA, 65 nt, Human
caggaccuggggcuccaucuugcagaacagcucguggcucuuccaggaccuggggcuccaucuug

SEQ ID NO: 4137095 - RNA, 62 nt, Human
caggacuggcaccuagauccaaaggcaccaacuaggugcuugggaauguggagucagaccug

SEQ ID NO: 4137096 - RNA, 65 nt, Human
caggacuguguuuacagagaaacacgacugucucuuguugaagccgcugugaacacauuuuucug

SEQ ID NO: 4137097 - RNA, 78 nt, Human
caggacuuugggacuggggaguugaagcacuuucccaagggaggacggccaggagcucucccacccccacuuggccug

SEQ ID NO: 4137098 - RNA, 100 nt, Human
caggagaaauguccuaucaaggccuucuaccaaggcugggggcgguggcugacgacugcaaucucagcacuuugggaggcugaggcgggacgaucucuug

SEQ ID NO: 4137099 - RNA, 68 nt, Human
caggagaagcagggagucggggcugcggaucuuugccucugagcccucuguuuucccucugcuuccug

SEQ ID NO: 4137100 - RNA, 93 nt, Human
caggagaagguggaggcaggacuugaauccaggcaguuuggucauuuugcuuuacuguccggcacaagugccaccucugucugaggucuucug

SEQ ID NO: 4137101 - RNA, 55 nt, Human
caggagaagucucuagggggugccucucaacuggcccuauggagacccuuuccug

SEQ ID NO: 4137102 - RNA, 66 nt, Human
caggagagaagcacacugauuuuauuucugugggaccccagguuggagugcaguggcucaaucuug

SEQ ID NO: 4137103 - RNA, 65 nt, Human
caggagagauaugaguccccaccugcagaaucacugaagcagcuacucuggggauaucuuaccug

SEQ ID NO: 4137104 - RNA, 57 nt, Human
caggagaggagagacagccuaccuauucggucuugcuguccccaugcuccaucccug

SEQ ID NO: 4137105 - RNA, 55 nt, Human
caggagaggcuguacguuucucuuggcacagugcucuagaacugcaccucuccug

SEQ ID NO: 4137106 - RNA, 62 nt, Human
caggagaguucaguuguagccauauugguugggcaccaguuuuguggucugaacuuauucug

SEQ ID NO: 4137107 - RNA, 81 nt, Human
caggagaucagaguuagaauuguacugcaaucaggggaauauuuugccuugacuacgguucaguuaaaaguucauuuccug

SEQ ID NO: 4137108 - RNA, 67 nt, Human
caggagaugaaaguggcagcucuaccucaggggcggugccugaagcagcuucuuucugucaauccug

SEQ ID NO: 4137109 - RNA, 67 nt, Human
caggagaugacagggaagaaccaggaagcaccuccucucccagccuggggcuucccaccaucuccug

SEQ ID NO: 4137110 - RNA, 59 nt, Human
caggagcaaauccaaaagaauuuuaguaaaagacaaaucucuuuuucugguugcuucug

SEQ ID NO: 4137111 - RNA, 62 nt, Human
caggagccaggccccauggggcugccacucugcagccccucuccccugaggccuggcuugug

SEQ ID NO: 4137112 - RNA, 66 nt, Human
caggaggagaggcuggaguuagggcuugacugucugaguuugccuugggccagcugcucuggacug

SEQ ID NO: 4137113 - RNA, 79 nt, Human
caggaggagcugaggcugaggccucacugucaccuucugugagguccaugacauccucacuccugagcucaccuuccug

SEQ ID NO: 4137114 - RNA, 59 nt, Human
caggaggagggcagccgccuccucuccaaacaacuagcgagcgccgcucaccuccccug

SEQ ID NO: 4137115 - RNA, 85 nt, Human
caggaggccagcagguggaucucuaaggacugauguaaagaaugcuuccagguucugagaaauuggcaucccaggcaggcuccug

SEQ ID NO: 4137116 - RNA, 55 nt, Human
caggaggguguggaaaacuggggacaacaauccacucuauccacacucccuccug

SEQ ID NO: 4137117 - RNA, 64 nt, Human
caggaggugcugguccccucgagcagaaaaauaguucaguuccagaggccugggcacacuccug

SEQ ID NO: 4137118 - RNA, 117 nt, Human
caggagguggggccuggugggcggggccucagcguaggccuuaggucucaggggagcagcacgccugagcaccccaggaccugcgcucaggugagaugcgcuaugccuuccuuccug

SEQ ID NO: 4137119 - RNA, 96 nt, Human
caggaguacgacgcugugguagcuaugaucaugccacugcacuccagccugggugacagagcaagaucuagauaauuacagucuguccugcuccug

SEQ ID NO: 4137120 - RNA, 69 nt, Human
caggaguguggcaggaaugacuagaacuaaagccaaggugcuacucaauucaccugccacucuauccug

SEQ ID NO: 4137121 - RNA, 72 nt, Human
caggaguguugauugcucaggaaugaaaucauagggagucgaagcugucuucuugagcugagucaguuccug

SEQ ID NO: 4137122 - RNA, 95 nt, Human
caggaguguuggcugggcauagaggccugugugcuccaguggugauaucugucccacagacaaggcuuuugacccacgugguggccauacucuug

SEQ ID NO: 4137123 - RNA, 81 nt, Human
caggaguuucaaaaugccaguaaaucugaggauaucaaagauuucugagccagcaaguuaauugguauuuugauccuuuug

SEQ ID NO: 4137124 - RNA, 92 nt, Human
cacuuugggcauucucagaugcuuuguauguggugggacucuagaugcugagcuauguuucucuuaacacauaaaguaggaagcuuaauuug

SEQ ID NO: 4137125 - RNA, 93 nt, Human
cagaaaaccugacucaaaugggcuuuggccaguaggagcuguauuggcucauauugcugguggucuaaggugggguggcuuccggguugauug

SEQ ID NO: 4137126 - RNA, 130 nt, Human
cagaaaagaauugagaaaguuugaguuuuaaucuuacuacaucaggaaaaaacuggagccagaauaucuuaguucuugcauuuucuugagguagagaauucuuuguaauuuuuuuuucuuauuuccauug

SEQ ID NO: 4137127 - RNA, 71 nt, Human
cagaaaagcgaagagaacugaaguuugauggucguuuagauaaggaacuuucagaauccuaugcauuucug

SEQ ID NO: 4137128 - RNA, 79 nt, Human
cagaaaauaacaguguggagcauauucuggagcuugguaucugauugcuguaguuuccauaauugcccugcauuuucug

SEQ ID NO: 4137129 - RNA, 87 nt, Human
cagaaaauaacugagagcuugaguaucacuggcaaagaauuuagcugugauuccauuagcacaguugucucaaagcuucuuuuucug

SEQ ID NO: 4137130 - RNA, 92 nt, Human
cagaaagaccuauacugauauacugauagcugcacuucuagcuauggaaagccaagggguguaguucuuauggacuagauaaagguuucaug

SEQ ID NO: 4137131 - RNA, 63 nt, Human
cagaaagaccugauuggcaguuucacugagaguugcgucaucugggcugucgacaggugucug

SEQ ID NO: 4137132 - RNA, 75 nt, Human
cacaucaaagggccuguggugcagccucuucaaauaccaggauucuugcacuuaacacaggcacucuuugucuug

SEQ ID NO: 4137133 - RNA, 59 nt, Human
cacaucauagagacucaauccaugcuuuuugaauugaguucuguauuucugugacugug

SEQ ID NO: 4137134 - RNA, 109 nt, Human
cacaucauagcuuacccaaaaacuuugccuguuuuuuauucagaccuaugugcaugcaaauauauacacauaggucugaauaaaaaacaggcaaaguuaagcagaagug

SEQ ID NO: 4137135 - RNA, 129 nt, Human
cacaucucugcccguuaacaaaauuaaaggcuuuacuuuuccugggagagugugauuuaagggcuaaucagcaccaugguccuugcacauuaucugggaaaguagaaauuacuggcuacugaaucugug

SEQ ID NO: 4137136 - RNA, 85 nt, Human
cacaucugcaacaugggaauauacuaguccucugcuucccuccuuggguugccugaggacagugugaccauggaugcgaagagug

SEQ ID NO: 4137137 - RNA, 65 nt, Human
cacaucuggagaucagcugguggcaggcucaucccacccuucccugcaauggcucuuuagaagug

SEQ ID NO: 4137138 - RNA, 83 nt, Human
cacaugcaucacgacuuccuuugucuaucauaaacgucuacccucaugguuuauaaaauccaggaagucggccaggugcagug

SEQ ID NO: 4137139 - RNA, 57 nt, Human
cacaugccaggcacccgcuggacuuucccucuuuccucucaguggugcugggaugug

SEQ ID NO: 4137140 - RNA, 57 nt, Human
cacaugcugugaaaagaauuucaacacuaaacagugccugugccucuauagcaugug

SEQ ID NO: 4137141 - RNA, 61 nt, Human
cacauggcuugguuuuguuugcugugguuuuuuuaaacgaacaaucuccaagaccaaugug

SEQ ID NO: 4137142 - RNA, 92 nt, Human
cacaugggaauuuuaaagaauuggaguugugaaacagaaaugaaagcacaagaagcauuuccucuguacagccucuuuauuguucauuggug

SEQ ID NO: 4137143 - RNA, 59 nt, Human
cacauguagacaucaccaaggguaucaauagacacaaccacagaggugucugcagugug

SEQ ID NO: 4137144 - RNA, 57 nt, Human
cacauguccccucuaggggcuuuauuuucacuuaaauucuucugcagggugacagug

SEQ ID NO: 4137145 - RNA, 62 nt, Human
cacaugugcaguuacaugaauuagaaacaugcaucuaggauuaugagaugucuguucaugug

SEQ ID NO: 4137146 - RNA, 63 nt, Human
cacauuccuuacauucauagaguuuuucaccagaaugaagucucugaugucgaguaaggugug

SEQ ID NO: 4137147 - RNA, 83 nt, Human
cacauugcaggaauuuuuugcagaaagggaaaaaacuaaaaaccuucauccuuuggccucugggagaauauuccuuuuaugug

SEQ ID NO: 4137148 - RNA, 67 nt, Human
cacauuuaagugcuuguucagagcucgcuauucacucaaagcuuuaggggcagagacacuuaaagug

SEQ ID NO: 4137149 - RNA, 59 nt, Human
cacauuuccuuggccuuuaauuuucaucugggcuuggcccuuaagggcccugggaugug

SEQ ID NO: 4137150 - RNA, 91 nt, Human
cacauuucuccugucuuucuaggcuuggacuugcucucugccaaagcagaugacucccagagcagccacagucugggacagggcaaaugug

SEQ ID NO: 4137151 - RNA, 89 nt, Human
caccaaacucuuacuuagcauucagcagucacucaaaaacuucaauuccaaauuuugcaugugggccuguugggguugaguuaguggug

SEQ ID NO: 4137152 - RNA, 93 nt, Human
caccaaagaaagugacuaacgaggcauuucuguauuuggguaggaggagaauacucuaagugcuaccuggaaauggcuuuaguuacuuuggug

SEQ ID NO: 4137153 - RNA, 69 nt, Human
caccaaaugaaagagaaauuuggagcuauauucaggcucuaaagaagaggguucugcggucaauuggug

SEQ ID NO: 4137154 - RNA, 82 nt, Human
caccaauaauauucccaguuguggugaguagacucaaaagugaccccaaugacccuacaaaguaccacagacuggguggcug

SEQ ID NO: 4137155 - RNA, 73 nt, Human
caccaauggacuuacuuaacuagacgcucugggagggggauacagaaaucugguucaguaaguccuccaggug

SEQ ID NO: 4137156 - RNA, 83 nt, Human
caccaccauagccuguaggucccuaacuuccagacccugcucaggguuaaacaagcuggacacugaacagccucuggggggug

SEQ ID NO: 4137157 - RNA, 73 nt, Human
caccaccaugccuggcuaauuuuuguauccuuaguagagacgggguuucaccauguuggccaggcuggucuug

SEQ ID NO: 4137158 - RNA, 57 nt, Human
caccacguagcucuggacuacaaagacaaaggcagguaguccagagcuacuguggug

SEQ ID NO: 4137159 - RNA, 71 nt, Human
caccacugcccacgaugccggccgccugccugccugaagaccuuugcacaggcuguuggccuucagaggug

SEQ ID NO: 4137160 - RNA, 62 nt, Human
caccagaguuguccaaaugauucuacagugugauguaauuaguuuauuuggggacuuugcug

SEQ ID NO: 4137161 - RNA, 59 nt, Human
caccagcuaauuaaaacagcagucucaugacuauuagugagguguuugguugauuggug

SEQ ID NO: 4137162 - RNA, 61 nt, Human
caccagcuucucauugcgggucuugaucuucuucacaaccacgacccugguggagcuggug

SEQ ID NO: 4137163 - RNA, 56 nt, Human
caccaggaaccccagacccacacuucaugguugcagguagggaagguucgcuggug

SEQ ID NO: 4137164 - RNA, 60 nt, Human
caccaggcagcugggggugauguggagacacaggcacaggugugccccaccugccugcug

SEQ ID NO: 4137165 - RNA, 61 nt, Human
caccaggcugcccaggacagggggagaggcccaccccaccuguuccuuuaugagcuuggug

SEQ ID NO: 4137166 - RNA, 56 nt, Human
caccaggguacaauuucgcagauucuugcuucugagcucuaaauaguacccuugug

SEQ ID NO: 4137167 - RNA, 58 nt, Human
caccagguggaaaugucacagccugacccagaggcuggccccagaguuucacuuggug

SEQ ID NO: 4137168 - RNA, 64 nt, Human
caccauacauucucuauaagugcauguguguuuacauaaaugcacagaaaggauguggaaggug

SEQ ID NO: 4137169 - RNA, 64 nt, Human
caccaucagcagcaggugucaacccccaggacuggaguugucacaucacugcuggugauaugug

SEQ ID NO: 4137170 - RNA, 56 nt, Human
caccaucugguaggcauuagugucaccagaacacgggagcacuuaucagauuggug

SEQ ID NO: 4137171 - RNA, 111 nt, Human
caccaucuucuuugaaucuacccuuagaggugacaugccaucacuuucauuccuuggagaccgaugaauaaguccuggccacccucaagggaagcagagaguacuagggug

SEQ ID NO: 4137172 - RNA, 130 nt, Human
caccaugaaccgcuuccuaacucccccagacagaaaugccgccuguuucuucuuuucugagcaauacacuguucuagaaacuggagcaaacagacacugccccugcucuccuggagcacauauucuggug

SEQ ID NO: 4137173 - RNA, 60 nt, Human
caccaugccuggcuaauuuuuuuguagggauagaguuuugccauguugcccaggcuggug

SEQ ID NO: 4137174 - RNA, 64 nt, Human
caccaugggcaagugccugggcucugguggcagaagaauccauggcucagguuugggcuuugug

SEQ ID NO: 4137175 - RNA, 75 nt, Human
cacccagcugcauccuauucacugccucccuuccucucagcuggguggcaguguuggcaggauggggcugaggug

SEQ ID NO: 4137176 - RNA, 73 nt, Human
cacccauuuuuacuaggguguaaguucugucuugagcauccuuccuacccuuaaggagcuugcacucugggug

SEQ ID NO: 4137177 - RNA, 57 nt, Human
caccccuaguguuugugggcccccuccaggaagcgccuccaaaccucuaggcuggug

SEQ ID NO: 4137178 - RNA, 85 nt, Human
caccccuucccugggcacucagauggcaccgagucccucaaggcucugagggcagcuaaggugcugacuggaggcugaaggacug

SEQ ID NO: 4137179 - RNA, 106 nt, Human
cacccggcccggcuuggggccagcacccugcccucgggcccucccauagcugagacugguggcuguggcuguggcucugggccugcuccccaggccacccugggug

SEQ ID NO: 4137180 - RNA, 80 nt, Human
cacccugcaccagcuccuccucagucaggucuaggguccugccucugucccaguggccaccuggcugugggggcagggug

SEQ ID NO: 4137181 - RNA, 69 nt, Human
cacccugccacuggggugaugccgccucauguuccacaugauuagagccuccuccagaagggcagggug

SEQ ID NO: 4137182 - RNA, 76 nt, Human
cacccugccaggcuuucagguuugguuggauuauacaucuuuuuuucccccuccagauccuugcuuggcaguugug

SEQ ID NO: 4137183 - RNA, 70 nt, Human
cacccuguggaggaggagagcagucuccauauaaaaguucuaaagaugaggacucuuuuucccuugggug

SEQ ID NO: 4137184 - RNA, 70 nt, Human
cacccuguugcugcagccaaauucauugucauagcaggaaaugagcuugacaaaguggucguucaaggug

SEQ ID NO: 4137185 - RNA, 61 nt, Human
caccgcaugcauuucacuagguauguagcuuauuaaaaccagugugugaaaugcaucagug

SEQ ID NO: 4137186 - RNA, 109 nt, Human
caccgcucauuaugaugacagagucaugggccgucaggcaggggcauuuguuuuuggacgcacuuggcugcccauaguccuugacucuagugugcuuaguguggcggug

SEQ ID NO: 4137187 - RNA, 60 nt, Human
caccguggaggagcuggagggcucuccacugucccgaucccuggagcugcuugcauguug

SEQ ID NO: 4137188 - RNA, 76 nt, Human
caccgugguaaguuuuuccuuaugugcucuucauuuuaauucuuauuggaaucucugguaucuggggaccauggug

SEQ ID NO: 4137189 - RNA, 70 nt, Human
cagagacaucgagaauuggcagcuaaagcuggaggauuuaaugacuuugcaacuuuagcugucaucuuug

SEQ ID NO: 4137190 - RNA, 59 nt, Human
cagagacccuaggcaggugacagagcccagccuggcaugcaucggccuugagggcucug

SEQ ID NO: 4137191 - RNA, 56 nt, Human
cagagacugagggacagggcaguggaaaacuccaaagccaagguuuuuuauuacug

SEQ ID NO: 4137192 - RNA, 77 nt, Human
cagagagagagaggcagaaagagagagagagaguaauauauauaguucuguugguucuguuucucugaagaacucug

SEQ ID NO: 4137193 - RNA, 62 nt, Human
cagagagcuccauuagcuaagaggucauacucucaaaagauucagcuaauggaaguuuacug

SEQ ID NO: 4137194 - RNA, 58 nt, Human
cagagaggaggcuauaugcaaaccccuguaugacuugcaaugucccuuugccucucug

SEQ ID NO: 4137195 - RNA, 62 nt, Human
cagagaggauggauuccauagcauaggguauagucuucagcuggggaugaccauguucagug

SEQ ID NO: 4137196 - RNA, 85 nt, Human
cagagauagaagcccagcuuugaaccauaucaauccagguaacuggauuaagaugaucaccaaaugcuggugccucuggcugcug

SEQ ID NO: 4137197 - RNA, 64 nt, Human
cagagaucaacaugugucacagacucccagccuguccgccucuaagacacaguugguuccuuug

SEQ ID NO: 4137198 - RNA, 55 nt, Human
cagagaucugagagcagucagggagucuguccuggacuuucuuaccagauuuuug

SEQ ID NO: 4137199 - RNA, 88 nt, Human
cagagcaacuacaugaaguugucuaaacuggccuguuuuaaccuaauauucccucaagccagaccuaaccagcuuuuguacaagccug

SEQ ID NO: 4137200 - RNA, 60 nt, Human
cagagcacaggcucaccauuguuuccggagacccccacgggaacacccugagcuggccug

SEQ ID NO: 4137201 - RNA, 57 nt, Human
cagagcagggugcaccuugggcucggccgacccagccugugccuaugcccagcucug

SEQ ID NO: 4137202 - RNA, 89 nt, Human
cagagcauacaaauuacucagagaauucgauuaaaugcauauucuuguucauuuaaucagaaucucuaaguaauuuggaguguggccug

SEQ ID NO: 4137203 - RNA, 71 nt, Human
cagagcauuccuauuacuuugacccugcuagugaaccuggaggucuugucugauagggaaaagugucucug

SEQ ID NO: 4137204 - RNA, 56 nt, Human
cagagccaacgccaccugcccauugcugcccaaugggcagaccacacuggcuucug

SEQ ID NO: 4137205 - RNA, 106 nt, Human
cagagccgaggggcccuguccccagcucuccagcaacccagucauccugagagggcugcuuccuggggaaugcucggaggacucgguguccccucagaggucucug

SEQ ID NO: 4137206 - RNA, 57 nt, Human
cagagccugcugccuucugaaguagauccuuauuucauuuuaacaaguaaggcucug

SEQ ID NO: 4137207 - RNA, 99 nt, Human
cagagcgagagauuuauugugguuuuuagggggcguuuaggagccgacgugauaaugucugugaacgcacuuuguaaacuguaacgggggagugcugug

SEQ ID NO: 4137208 - RNA, 59 nt, Human
cagagaguuuauucuagaacucugagauuccacucccaggucagcuagacagcucucug

SEQ ID NO: 4137209 - RNA, 74 nt, Human
cagagauaagcagccacuuguccagggacauguggggccaccuggcaucccugucgucaagucucugcccucug

SEQ ID NO: 4137210 - RNA, 73 nt, Human
cagagauaguaagugauggugcugaauuugaauccaggcagucuggcuccagagcccauccuauacucuccug

SEQ ID NO: 4137211 - RNA, 64 nt, Human
cagagaugucucuccacauggcugaggccugcaacccaggcucugagcagggagaaacaggcug

SEQ ID NO: 4137212 - RNA, 71 nt, Human
cagagcaauaagccagguguuuguguugcgggacaugaggaguaacaacacacugagucuugggugcuuug

SEQ ID NO: 4137213 - RNA, 64 nt, Human
cagagcaauacuuggaaagucacauacauaucagcaagaaaugugucaauuuucaaaugcuuug

SEQ ID NO: 4137214 - RNA, 59 nt, Human
cagagcagagccagugaccugggacacagcuucacugacacucagucuggcucugccug

SEQ ID NO: 4137215 - RNA, 121 nt, Human
cagagcaucuccucccuguucuuggggcugggagaagagaaggauucugagccugggucauccccuaaccuguccucaacccauccuucuccccaacccuucaucaggucuccugagccug

SEQ ID NO: 4137216 - RNA, 81 nt, Human
cagagccagcuacaucuccccucucuagucucauccaugaggcccugcuguuuagagagcuacagaggugggcuggaaaug

SEQ ID NO: 4137217 - RNA, 60 nt, Human
cagagccaggugguguuggggcgaagcccagcucuuccacccaacagccccaugguccug

SEQ ID NO: 4137218 - RNA, 55 nt, Human
cagagcccagauuggaauuucccaccuaacagguggguaagaauugggggcucug

SEQ ID NO: 4137219 - RNA, 74 nt, Human
cagagccgucuguggcugccucaccuacaggauccaguuuaaacucagccugugagugcuggccucagaaucug

SEQ ID NO: 4137220 - RNA, 92 nt, Human
cagagcuagacauuuccaaguccacuuguauuuauuguguuaccaugacguagccagugacauacgauugggaaaaaauguguccuguucug

SEQ ID NO: 4137221 - RNA, 79 nt, Human
cagagcuauacauccauuugcuuuauuugcugaucuuuugaagauguuacuaguuguggagaagugauguauuguuuug

SEQ ID NO: 4137222 - RNA, 64 nt, Human
cagagcugcaaaugccccuccgcucauuagagcaggaguuagucucggcauuguacagucucug

SEQ ID NO: 4137223 - RNA, 64 nt, Human
cagagcuggacuuaaauauauuugggagaggucacauugcuuuaaugucuuuguccaugcucug

SEQ ID NO: 4137224 - RNA, 64 nt, Human
cagagcugggaucccaugggcgcagcagcacacccagcucccauggcgucacucccuagcucug

SEQ ID NO: 4137225 - RNA, 57 nt, Human
cagagcugggcauggugaaaggcggcaaguuacugcuuccuuccccuucagccucug

SEQ ID NO: 4137226 - RNA, 56 nt, Human
cagagcuggggacuguuggaugggaagaugcccagccgcgguggucccaggcucug

SEQ ID NO: 4137227 - RNA, 62 nt, Human
cagagcugucauuugccagugagagccuccgacagggcagguacugugccagggcagcucug

SEQ ID NO: 4137228 - RNA, 86 nt, Human
cagaggagauguagcauuuagaacaccuugagacaugacauuguaaaauagcuuguuuuauguuccugaagcuaucuuguucucug

SEQ ID NO: 4137229 - RNA, 77 nt, Human
cagaggaggaugggacuaaguguccuguuggguuccauaacucuccaggacuuuggcccaauuacuuaccgccucug

SEQ ID NO: 4137230 - RNA, 57 nt, Human
cagaggaggcuugggcugcaaggaugccaaacuagcgcugcccccagcaccucccug

SEQ ID NO: 4137231 - RNA, 59 nt, Human
cagaggaucgcuacaucuuguuccuauguauauauguggaauggccaugggauccuuug

SEQ ID NO: 4137232 - RNA, 63 nt, Human
cagaggcacagugcgggccacuuccacggcgccucugccccaccuugggcugccuggccucug

SEQ ID NO: 4137233 - RNA, 62 nt, Human
cagaggcaggcggggcccagguggcguggaccgcccgucaccagcucugccucgccagucug

SEQ ID NO: 4137234 - RNA, 56 nt, Human
cagaggcagugggguugcuccuguugucugugcagacuggaguuccucugccucug

SEQ ID NO: 4137235 - RNA, 83 nt, Human
cagaggccaguuucuuauucuuaguuauguagccaaguuaauagggucacgugacacaaagauugggcaaagaacugcuucug

SEQ ID NO: 4137236 - RNA, 55 nt, Human
cagaggccccagaacuagcucuuuguuuucaaaagcuucaacaggauggcuucug

SEQ ID NO: 4137237 - RNA, 79 nt, Human
cagaggcucuagcagcaggcauggccgcccuggcaggagccccgaucaggcguggacgccgcauucacuggagacccug

SEQ ID NO: 4137238 - RNA, 71 nt, Human
cagaggcugcucuggguggcaugcugcagcucaaaaccaacagagaggccucacuccagagacggccucug

SEQ ID NO: 4137239 - RNA, 93 nt, Human
cagagggcaggugcagcuggaagugacacucuguguuucccugcaucccccugaggucacagguccucaagucagcugggaagccguucucug

SEQ ID NO: 4137240 - RNA, 89 nt, Human
cagagggcuaaagccagcucccuguaucccaucagcucacugggaauggagagcuccuggacgaacagggaguuuguguugccuuccug

SEQ ID NO: 4137241 - RNA, 55 nt, Human
cagagggcucaguccugcuggaacccaagggucaucucgccaggcuugcccucug

SEQ ID NO: 4137242 - RNA, 77 nt, Human
cagagggcuccagcccacugccucugugguagccgcuggcucucagaaguagcacgugggcaggagucucuccucug

SEQ ID NO: 4137243 - RNA, 66 nt, Human
cagaggguagacugucaaacacuagccagggcacaaugcugugacuacaaaagguucuaccugaug

SEQ ID NO: 4137244 - RNA, 127 nt, Human
cagaggguuaaccaagcgugaugccaugacuuucucaaggucagagugaggguugggagguaguacccauguauccugaccucuugcucugaccuuuaagcaggcggcguccuuggaacacaucggg

SEQ ID NO: 4137245 - RNA, 55 nt, Human
cagagguacagccauugaagauacucaaaaggcaaucucggucacugugccucug

SEQ ID NO: 4137246 - RNA, 74 nt, Human
cagaggugacucagaggcccugcucacacagcccagcugcugcuguggcaggaagagcuucugagcuacaccug

SEQ ID NO: 4137247 - RNA, 78 nt, Human
cagagguggcaaagugacaaccauuuauuaaguaccuacugugugcuagagccuguguugugcacuguacgcacuuug

SEQ ID NO: 4137248 - RNA, 74 nt, Human
cagagguggcuguaagugacucauuaacucccucucccauguuuccaucaccgugaauuacaacgucaucucug

SEQ ID NO: 4137249 - RNA, 58 nt, Human
cagaggugggguuuuguucuugaacucaugugagaacacauucgugcccuacauucug

SEQ ID NO: 4137250 - RNA, 72 nt, Human
cagagguuccuggcuccaucuuugcuuccugaugcucaucuguacagguauccacaggugggccuuccucug

SEQ ID NO: 4137251 - RNA, 83 nt, Human
cagagguuggaaacauugccuagaguugcacaucugggauccaauuucaggcuugucucuagagcaauggcuauagcucucug

SEQ ID NO: 4137252 - RNA, 88 nt, Human
cagaguaaaacaguagucacacuggucugcaaggccauauagagacucgucuccauuugccucgcagaucauauuugcuuuuucuuug

SEQ ID NO: 4137253 - RNA, 58 nt, Human
cagaguaaggagcugucaaacgggaauaaauucugccuucuaacagccuucuucuuug

SEQ ID NO: 4137254 - RNA, 81 nt, Human
cagaguagcagguucugggugccaccuaagacaucugauuuaaggugaagagugauguauuuagaauuggccagugcuuug

SEQ ID NO: 4137255 - RNA, 101 nt, Human
cagaguaguacauuugcgaaugagauuuuuuggcuuuuuucacuuaguaggaacccuuguguguggaaaacugagaaaauugcuuucugcuguacacucug

SEQ ID NO: 4137256 - RNA, 86 nt, Human
cagaguaguggagugauauacuuuauaaaagcauuuucccaaaauuacagaaacaggcugaaguuuaugucuucuuuucugcucug

SEQ ID NO: 4137257 - RNA, 70 nt, Human
cagaguaugaaagcaucauuccugcugcuucuccucuaggcugauucaacaggaugugcuucaucuuuug

SEQ ID NO: 4137258 - RNA, 57 nt, Human
cagaguccucaccuguauucguuuauuucuccagagaugugugcuagaggacuacug

SEQ ID NO: 4137259 - RNA, 88 nt, Human
cagagugaguaugaagcaaauuucaaguguaaguuaaagugaucagugaugcauugguagaguuuguuuuauaaauuuuauuucucug

SEQ ID NO: 4137260 - RNA, 55 nt, Human
cagagugauaaauauagaaauuucaucaaggaaaagacuauauccugucauucug

SEQ ID NO: 4137261 - RNA, 127 nt, Human
cagagugcccuugcugccuucaaguguguaccccuggcuauccuugagccaaugacugauugauguggagucaaucagucauuagccaagguagcccagcccuugcuuacagacagguggaacucug

SEQ ID NO: 4137262 - RNA, 82 nt, Human
cagaguggagugucucuuagcuaagaaguuugugcugcucaaggguuugcacaaauacaaaguugagaaauacuccuugcug

SEQ ID NO: 4137263 - RNA, 73 nt, Human
cagaguugccuggcuaguuagugucagguucauuagacuagaugcaucucuccuggcuugccagagucucuag

SEQ ID NO: 4137264 - RNA, 89 nt, Human
cagauaauuuuucuucauauuccuugcacaucagauaguugcugaauuggcgaaacuaguaaagaauauccuaauuagagaagugucug

SEQ ID NO: 4137265 - RNA, 67 nt, Human
cagauaggguuacaauguggucucauuuucaucuugccccauugugaucacagaguagccuugucug

SEQ ID NO: 4137266 - RNA, 84 nt, Human
cagauaucuuuauagcaaugccccacuccuugguuccaauuuucuguauuaggcuguucuuguguuguuauaaagaaauaucug

SEQ ID NO: 4137267 - RNA, 99 nt, Human
cagauauggcaagacuucacaacuugaagcugauuuaagggucuuauagccuguuaaaccacuuuguugcaaguaaagucuuuuaaaaaccauaaucug

SEQ ID NO: 4137268 - RNA, 78 nt, Human
cagauauuucauugugaugcuuuuaucacuuugaaucuuuaaauuaugauuauugguagaagcaugcaugcagcucug

SEQ ID NO: 4137269 - RNA, 110 nt, Human
cagaucaauagguauuagacucucauuaaggacagcgcaaccuagaucccucacaugcacgguucacaacagggugcguucuaugagaaucuaaugcugcugcugaucug

SEQ ID NO: 4137270 - RNA, 76 nt, Human
cagauccugggcuccugaugcucagauuucagcugcuaacauauguaaaugaucccauccaggggcccagcuguug

SEQ ID NO: 4137271 - RNA, 112 nt, Human
cagaucuagcuccauucuccuucauucccuaaagacaauaggaaaguuguuguacacagcagauuuuacugaggguuuugaugauggaggagagugccauuauccuagucug

SEQ ID NO: 4137272 - RNA, 79 nt, Human
cagaucuggccuagaaaaacauccuccugaccccucagagagagggagagacacaggaauguguuucuaggcuguucug

SEQ ID NO: 4137273 - RNA, 65 nt, Human
cagaugaagccugccaucuguucaucaaacuuguaguuggagggagcagcugcaguuucuaucug

SEQ ID NO: 4137274 - RNA, 70 nt, Human
cagaugacaaaacuuuugccagcagauaggaagugacaggguggucuguggggaauucauuugucaguug

SEQ ID NO: 4137275 - RNA, 65 nt, Human
cagaugagaguggccaggguucauggucaugcucacauccucccuggacacacacuuuuauucug

SEQ ID NO: 4137276 - RNA, 83 nt, Human
cagaugaucucaugugcuguuagaggaaguguaaauuagucaacacuuucuggagcugcacauauucugauuuauccaaucug

SEQ ID NO: 4137277 - RNA, 66 nt, Human
cagaugcaaaugggaaacccagcaguaaaucaauagacccugagcuucugaucccaguugcaacug

SEQ ID NO: 4137278 - RNA, 69 nt, Human
cagauggcagaggucagugucuuguguauucaauguagucaauaauaaagucaggacuuaugcuaccug

SEQ ID NO: 4137279 - RNA, 63 nt, Human
cagaugggggaagcguggcauucaauauuuagacagaugccaccuccuuauuccaccugucug

SEQ ID NO: 4137280 - RNA, 56 nt, Human
cagauggugaaaugugauucccuagaauugcuagggagaggagcguuucacaucug

SEQ ID NO: 4137281 - RNA, 61 nt, Human
cagaugguuaucuuuucuuuguauucucacaugggagagaguacagagagcuagcucucug

SEQ ID NO: 4137282 - RNA, 74 nt, Human
cagauguacuucucugugucuuagugaagggagcacauucuuuggucucuuuuggccaacacggaaggugaaug

SEQ ID NO: 4137283 - RNA, 67 nt, Human
cagccuucagucugguucuugaccccgauagggcaugcccacagggugucaucagcuugaagaccug

SEQ ID NO: 4137284 - RNA, 80 nt, Human
cagccuuccagaaauacuugccuuuuagaagucauguuccaagcaggccucgacaggcuucaugauggcaggaagagcug

SEQ ID NO: 4137285 - RNA, 63 nt, Human
cagccuuuagcauuaauuccaaauuaauaauaauaaagauggaaaauuaguagugaaaggcug

SEQ ID NO: 4137286 - RNA, 79 nt, Human
cagccuuugacuuuuagaaccuucagauuaggagguggucuuggggccccuuaggagugcgggugaaaguguagagcug

SEQ ID NO: 4137287 - RNA, 96 nt, Human
cagccuuuguucucagugucacguuuugccuuaguaggagaugauguccccacaaucacguccauucaugaggcaagagcacuggggucugcacug

SEQ ID NO: 4137288 - RNA, 79 nt, Human
cagcgacuccaaagcauagguggagauuaguguuuucagccaacuaacgaagcauuuauugaccugcugcugaguacug

SEQ ID NO: 4137289 - RNA, 58 nt, Human
cagcgccauuauugucuccauuuuacagauugaaaaauggaggcacgcagugguuaug

SEQ ID NO: 4137290 - RNA, 87 nt, Human
cagcgggcucagagugugccacugccugaggacccugaagagugagugguggcccgggcgguggcugccugcacccugugcuuucug

SEQ ID NO: 4137291 - RNA, 118 nt, Human
cagcguagaaacaagccagcagacaugaggccagggugccaugaaaugaaggaacagguucauuugauacaacucaggcaucaccugagccuuuggaagaugggugggauuuacacug

SEQ ID NO: 4137292 - RNA, 64 nt, Human
cagcgugauugugacugguauggcugcauggaagcuucccuguggcauuaaucauaaaaugcug

SEQ ID NO: 4137293 - RNA, 97 nt, Human
cagcguggaggggacuggccccagagagcccuucugugucacugugggagcaggcacaaggguggucucuggagcuggcucaauggaagaccaccug

SEQ ID NO: 4137294 - RNA, 59 nt, Human
cagcguucgaaucauuggccuguaacccugugggcugcuucacaagaauucaggaccug

SEQ ID NO: 4137295 - RNA, 71 nt, Human
cagcuaaacuauguuuuguggaugaaaaaggaauuaacuauuuacaaucauaaacaaaacaguuuaugcug

SEQ ID NO: 4137296 - RNA, 57 nt, Human
cagcuaauccucucuauccaaguugaguacauuucuaaaauagaggaggguagcgug

SEQ ID NO: 4137297 - RNA, 65 nt, Human
cagcuacagucugauugguucagaggagagcagauucuagccaugaacgaauggggcugugguug

SEQ ID NO: 4137298 - RNA, 74 nt, Human
cagcuacauggcaugccuugucagacagugaauccuugcucacauaugcacuggaugaaaaggugccugaguug

SEQ ID NO: 4137299 - RNA, 86 nt, Human
cagcuaccguucuuuuguaaagugcuuguuguaucucacaacuaguggguuggcaagguguuuuaacaggaaaacugaaauagcug

SEQ ID NO: 4137300 - RNA, 63 nt, Human
cagcuauaccuuuuacucauuauccauguaaaauuccacagggaucagcagagggugugguug

SEQ ID NO: 4137301 - RNA, 59 nt, Human
cagcuccagccugacaccaagauauuucauucucaguggcguuccugggcuggaagcug

SEQ ID NO: 4137302 - RNA, 112 nt, Human
cagcucccaggccaugccuuucccucugugguugguucuguccuucguggccccccucagugcaggguucauggacugggcuccaagagggagaggggagggcagggagcug

SEQ ID NO: 4137303 - RNA, 55 nt, Human
cagcuccucuguuagcccuggggacagagccuccuagggagcaaggugggggcug

SEQ ID NO: 4137304 - RNA, 63 nt, Human
cagcuccugggccaucuccuagaggagaggcugccucccuggaggagugaggcuccagggcug

SEQ ID NO: 4137305 - RNA, 71 nt, Human
cagcucgaggccaggacccugcaaacccuguugcuugcaaaugagcaucaggauggguuuggcuuaggcug

SEQ ID NO: 4137306 - RNA, 59 nt, Human
cagcucgggagcuugggguagcuuugugaaugcguggcucccuggaaaucccgaggcug

SEQ ID NO: 4137307 - RNA, 60 nt, Human
cagcucgugguucagggaugugggugaugcugucgcagcccaggacccuggacagagcug

SEQ ID NO: 4137308 - RNA, 58 nt, Human
cagcucuacugggcaccauucguacagacugcagugugaauugugccccuugguguug

SEQ ID NO: 4137309 - RNA, 57 nt, Human
cagcucuggccagaucuauccucucuuuucuacaggacaggcuacaugcaggagcug

SEQ ID NO: 4137310 - RNA, 55 nt, Human
cagcucuguugccaaagugggcauucagaaaacacuguugcuaggcaacaggcug

SEQ ID NO: 4137311 - RNA, 64 nt, Human
cagcucuuccuagccaugccacauuuccagugguuccacuugggagcguggcaggacagaguug

SEQ ID NO: 4137312 - RNA, 55 nt, Human
cagcucuuggagccuccaguaaguguuuugcuggccaacaaggcuccaagaggug

SEQ ID NO: 4137313 - RNA, 80 nt, Human
cagcugaaacaaauauugacuuuuaaagugauauauuugacauucaaguguguacucaauugagccauuuauuucaguug

SEQ ID NO: 4137314 - RNA, 75 nt, Human
cagcugaaugcuucaaccucccacaugugcuuuuuuuaguuuuguaacaugacagggaaugaggugaaugagcug

SEQ ID NO: 4137315 - RNA, 83 nt, Human
cagcugacccacaaacauucuuucacacuggguuucucugaauuagaauccaaaggaugucccuguguuuuauuuggucacug

SEQ ID NO: 4137316 - RNA, 58 nt, Human
cagcugagaaggucugaucagguugcauuguuuccucuugguuggauuucucuggcug

SEQ ID NO: 4137317 - RNA, 55 nt, Human
cagcugaggucaaagaagcagguuuauuuugaagggucuuguaagccucgagcug

SEQ ID NO: 4137318 - RNA, 103 nt, Human
cagcugauggauaaggcagccagacuguggauacaauugcugcaggaguagcucaaugccaucuggaguaugucccuggugaaucaugcccuauauguagcug

SEQ ID NO: 4137319 - RNA, 68 nt, Human
cagcugauucuucagugacuccacuucuacugacagagguaaaagaaaaugcugaaguugucagucug

SEQ ID NO: 4137320 - RNA, 76 nt, Human
cagcugcacugaagcagguuuggagggcccuaggaaggcaugggcagaaacugaccugcucucuaggggcaugcug

SEQ ID NO: 4137321 - RNA, 92 nt, Human
cagcugcaugagcuuguacaaauuacuuaacucucugggccucaauuuuuugaaccagagaaauggagugauaacaguacacucugcaacug

SEQ ID NO: 4137322 - RNA, 69 nt, Human
cagcugcauggagggugcccaggaggggacgguggcugcaccucaauccagcucccuucaauggcacug

SEQ ID NO: 4137323 - RNA, 55 nt, Human
cagcugcauuaauuuuagugaauggagaacaagugcucuagauuuaguguagcug

SEQ ID NO: 4137324 - RNA, 60 nt, Human
cagcugccaugugugaaaggggaggucagaaggccuucagcccacucauauauggcucug

SEQ ID NO: 4137325 - RNA, 63 nt, Human
cagcugccauguugugaggacacucaagcagccucauggagagguucacacggcaggcaacug

SEQ ID NO: 4137326 - RNA, 72 nt, Human
cagcugccuggccacaacccagggucucucagggauccugccgaucauugcccuggcugugcuaagcuguug

SEQ ID NO: 4137327 - RNA, 130 nt, Human
cagcugcuaauggguggagacccccucacucccaccccacuuccugccugcugaugcugccugagagcuuccuggcaguuucucaggcagggguauggggaaggaggggggcccuacucaccuuuagcug

SEQ ID NO: 4137328 - RNA, 72 nt, Human
cagcugcucugaaaaugacuguuggccuuccuuauauuccuacaugguagcagaagaaauucagaguugcug

SEQ ID NO: 4137329 - RNA, 84 nt, Human
cagcugcuucugggucacaagugaucccaggccaggugagaaacgaaugcagguggcuucugggacuugugagcaauguggcug

SEQ ID NO: 4137330 - RNA, 69 nt, Human
cagcuggacuccaaccuucaucuuaugauucugaagcuaagguggaggacaggacuggacagccaguug

SEQ ID NO: 4137331 - RNA, 74 nt, Human
cagcuggauaaggaucaguuucuuucacuuugggucaugggcccuccaagaaugaaaugauacuuuauucacug

SEQ ID NO: 4137332 - RNA, 65 nt, Human
cagcuggcuccaccucugggcucaccuaagcagggacucacacgcccggagcuggggugaggcug

SEQ ID NO: 4137333 - RNA, 58 nt, Human
cagcuggguccuuuugucccccaccuacagcuucagguaggggcuggggcuccagcug

SEQ ID NO: 4137334 - RNA, 55 nt, Human
cagcuggguggcucuucugcuccauuugacuuuggcugggucacucaggcagcug

SEQ ID NO: 4137335 - RNA, 65 nt, Human
cagcuggugcucugggcccugaggagagugaaagcccuugguggugcagcccugggcaccagaug

SEQ ID NO: 4137336 - RNA, 84 nt, Human
cagcugucagaaaccccaacaauggagacuuaaugucuacuuuuccagagcaguuucuccaaguuauuguggguaucuuggcug

SEQ ID NO: 4137337 - RNA, 58 nt, Human
cagcugucagccggugcaggcucagcacaucuccugggucuggcaggugaacgagcug

SEQ ID NO: 4137338 - RNA, 69 nt, Human
cagcugucuagccccuuuauuuuacagacgaucuccucgucugaggccuagagaggggcuugauacuug

SEQ ID NO: 4137339 - RNA, 58 nt, Human
cagcuguguaaacacauguguauaugugcauauacuuuauauauaugauacacaggug

SEQ ID NO: 4137340 - RNA, 60 nt, Human
cagcuguguagaugcagggucagguuuuguuucauccucucugucugaucugcauggcug

SEQ ID NO: 4137341 - RNA, 62 nt, Human
cagcugugucauccuggaaaaugaaggacagugauuuauuuuguaguguguagacacaggug

SEQ ID NO: 4137342 - RNA, 107 nt, Human
cagcuuaaacaacaaaauggugcgggcucccucaucaugagcugguauguguugugaugguguacacaucagaaccagcugggugaggaguagccauuagggggcug

SEQ ID NO: 4137343 - RNA, 76 nt, Human
cagcuuaauuaacacugcagcccaguuacuguuuaguucauugcauaguacaguacugggcucuaguucuggguug

SEQ ID NO: 4137344 - RNA, 89 nt, Human
cagcuucaguucugggaaugaaaagcaacaauuucagguguugauaaaugcuuggcagaguucuuuuucucuuuucagagcugauccug

SEQ ID NO: 4137345 - RNA, 58 nt, Human
cagcuucauugccugaugucuucgggaaguauuuugaagucaucguggcuguggauug

SEQ ID NO: 4137346 - RNA, 63 nt, Human
cagcuucugcuaucgaacaucucaggggaauaacaggucagaaguguugaguacagaaagcug

SEQ ID NO: 4137347 - RNA, 57 nt, Human
cagcuucuucaguccuggagcugaaguccaccugcuucaugauuuuacuuggggcug

SEQ ID NO: 4137348 - RNA, 77 nt, Human
cagcuuuauauuuaaugaauucuaauagaugguaggaaguaaagcgccaugagaaaagaauuuuuaaaaauaagcug

SEQ ID NO: 4137349 - RNA, 61 nt, Human
cagcuuuaucacaauauuggcuacuggcuuagugguuggaaaaauuguuuuguuaaaguug

SEQ ID NO: 4137350 - RNA, 56 nt, Human
cagcaguguggcucucucagaauguguagcucuagcuacauguggcuaagcugcug

SEQ ID NO: 4137351 - RNA, 127 nt, Human
cagcaucaccugggauccuaugagaaaugcagauucucaggcuccaccccgccagaccuuguaaaucagggucucugggaguagggcacagcaaucuguguuuucagaauucauccaggugauucug

SEQ ID NO: 4137352 - RNA, 55 nt, Human
cagcaucucugggagaagcaucugugcaaagacacugcuuaaggccagagagcug

SEQ ID NO: 4137353 - RNA, 61 nt, Human
cagcaugcauuuuuggacugugcacagcuuagguaaaagauggcagagucaagagcugcug

SEQ ID NO: 4137354 - RNA, 64 nt, Human
cagcauggacccaucgcugagucggcacaaagugcccugccgagccaugccucuauccauguug

SEQ ID NO: 4137355 - RNA, 82 nt, Human
cagcauguaauuuuagccaagauauguccuguuacuaaguaucucccaaugcuuuaguaaaacguauuuaggagaaauguug

SEQ ID NO: 4137356 - RNA, 61 nt, Human
cagcauucacugaggcuuccuuaggcaaugggauauuuuuucaccagggacuucagggcug

SEQ ID NO: 4137357 - RNA, 86 nt, Human
cagcauucagagcuucagaucuccuggacgucuuguuaaauugcagauucugauuuaauagguguagggaggggcuccagauccug

SEQ ID NO: 4137358 - RNA, 63 nt, Human
cagcauuccugagaaugcagagugucagcuggggagacacagcgcagcaucagagagcugcug

SEQ ID NO: 4137359 - RNA, 78 nt, Human
cagcauugaagguguggcaggcauucugaggcugggucuguccaguuuggggauauccuccagggcugucuuuugcug

SEQ ID NO: 4137360 - RNA, 74 nt, Human
caguguuagcacagagcuuuuaaacuuccgcacugcugaugagggagugugauuguucucuguuaccagcacug

SEQ ID NO: 4137361 - RNA, 56 nt, Human
caguguugcuaaugaauucauuaugcugcaaaugcaagugauuuguuaguacauug

SEQ ID NO: 4137362 - RNA, 67 nt, Human
caguguugcuagacagguagauacagaaaggcaauuugggcagcuguagcugucugagcagacacug

SEQ ID NO: 4137363 - RNA, 59 nt, Human
caguguuucaagugaugcuuuggcaguuguaaaaaucuagucuauuauuugagacauug

SEQ ID NO: 4137364 - RNA, 61 nt, Human
caguuaaauacauuaaggaggaauuccagcaugguaaagcucacuuauaauguauuugcug

SEQ ID NO: 4137365 - RNA, 68 nt, Human
caguuaaugaugugugucaacuagacugagccauaggauacucagauaacugguuuacauuauugcug

SEQ ID NO: 4137366 - RNA, 129 nt, Human
caguuacauuugaauuucagauaaauaacaaauagugauuuaguguuaaguauguuccaaauauugcaugggacauaguuauacuuaaaacaaaguauuuguuuucauucugaaauucaaauguaacug

SEQ ID NO: 4137367 - RNA, 89 nt, Human
caguuaccacaguuuaguccaaugacaccagucccccaacaacacaguucugguaucaguugcuauggucuauuaacugugaauaauug

SEQ ID NO: 4137368 - RNA, 107 nt, Human
caguuacuggggcagagggucugacacacaggaugaagcagcagaaauccugucacuaaguucgcuucuccaaauuccugcagucuugccccuguuugaucucacug

SEQ ID NO: 4137369 - RNA, 65 nt, Human
caguuauuucacucuucggcaucucuguaacugucccagauacaggagcacaaaagaguugacug

SEQ ID NO: 4137370 - RNA, 73 nt, Human
caguucacauccuugugaggauuuucauuucuguuuugcugaugaagaacccaaggcccagggaugugaagug

SEQ ID NO: 4137371 - RNA, 59 nt, Human
caguucacucacuuaacaaguguuuacugacagcuuauaugugcaggagagugaggcug

SEQ ID NO: 4137372 - RNA, 62 nt, Human
caguucauugccucuguggauauacuugcuuucacagguaaggaaauugaggcaauuaacug

SEQ ID NO: 4137373 - RNA, 81 nt, Human
caguuccacaagguacuggcacaagaagagucguggaagacugaccuggccauggcuucucaugucccagcucaggaccug

SEQ ID NO: 4137374 - RNA, 66 nt, Human
caguuccggugccgccgcugcggccgcugaggugucgggcugcugcugccgcggccgcugggacug

SEQ ID NO: 4137375 - RNA, 65 nt, Human
caguucuacauggguagguuaagucauauguuauuugguguuacuccuucccuacucauguccug

SEQ ID NO: 4137376 - RNA, 68 nt, Human
caguucucuaugaagucuauugucuuauuuuauuaguuuucucuuuaggacaauccuauagugaacug

SEQ ID NO: 4137377 - RNA, 64 nt, Human
caguucugacuuucauaaugucuagcaucagaggcuaguuucuucuugaagugucugagaacug

SEQ ID NO: 4137378 - RNA, 92 nt, Human
caguucugggguccaaaauuaaggguggcaggguugguuccuucuguaggcucugagggagaagccaauccuugucucucucccagcuucug

SEQ ID NO: 4137379 - RNA, 101 nt, Human
caguucugucuugcugggguaagucugugcuagcacgcagcaagggcagcaaagaaggaaccccaagcugacgagcucagcuacauagccccaagaagcug

SEQ ID NO: 4137380 - RNA, 124 nt, Human
caguucuucugcccuaaaauggccacguuuugccuuucuucccuccccuacacccagguuugggccccagggguagagcuggggguuggauaaggguaagacugcacaggggccagaugggcug

SEQ ID NO: 4137381 - RNA, 56 nt, Human
caguucuuucacuuguucaguccuuucgcuagcggggaagagcagggaaagaauug

SEQ ID NO: 4137382 - RNA, 58 nt, Human
caguugaacagaugcauuuauagguucugggcccuguaacacucaaucuguuuaacug

SEQ ID NO: 4137383 - RNA, 129 nt, Human
caguugaagggaaaagcgggauggguuucgugccucuggcagcgaagcguguacuuggucuaagaucuugagcagaagguaagagcguguugccaaagcagagcucagugcucccgauauaucuucugg

SEQ ID NO: 4137384 - RNA, 75 nt, Human
caguugaggauuuagugguccauguggcaggcuacugcucaguagcuucagggaaaccacugcuugccuccccug

SEQ ID NO: 4137385 - RNA, 57 nt, Human
caguugccgggaguguccuuaucccccaugcagggcaggaucaggagccgacaacug

SEQ ID NO: 4137386 - RNA, 58 nt, Human
caguugccuacuacuugaauaaauggguuguuucuggauucugggaauuggguagcug

SEQ ID NO: 4137387 - RNA, 90 nt, Human
caguugcucagaagccugggauuugcgccagaccuuguuugaguggggaaggacuggcacaugcggaugccagagcugagggagaaucug

SEQ ID NO: 4137388 - RNA, 87 nt, Human
caguuggaaaccucggagucuuuguaaguuucugcagcagagcuguggagcacagcagggcucugggugugguucuguguucagcug

SEQ ID NO: 4137389 - RNA, 68 nt, Human
caguuggaaaggagggugcuauuggcaucugcuggguagaggccagggacacugcucaacauccucug

SEQ ID NO: 4137390 - RNA, 56 nt, Human
caguuggcucaccuuaucuguagguucuacauccauggccaagaaauugccgacug

SEQ ID NO: 4137391 - RNA, 60 nt, Human
caguugucauccugaauuuuccaacagggaauuccuuuccuguguuuagauaugaugcug

SEQ ID NO: 4137392 - RNA, 66 nt, Human
caguugucucaacaccacuugcugaagaggcuguucucucuccauugaguggucuuggcacucuug

SEQ ID NO: 4137393 - RNA, 71 nt, Human
caguugugcaguccauugacagaggucuuuuggagagagaggaggccguucguuuguugacuaagcaagug

SEQ ID NO: 4137394 - RNA, 121 nt, Human
caguuuaauuggauuugaggaagacaguaauuuuuuuaguguaaguauaucccaugcaauauuagggauaugcuuacacuacaagaugauuuguuguuuaugugagauccaaauuuaacug

SEQ ID NO: 4137395 - RNA, 58 nt, Human
caguuuauagcucuagcagcuucugcuccagauuaucagagguuggucgcugugacug

SEQ ID NO: 4137396 - RNA, 59 nt, Human
caguuuauaugucagagcuguagugccaaaugcuuuacaagccuuuuacauguguucug

SEQ ID NO: 4137397 - RNA, 69 nt, Human
caguuucagucaguuucagucggaaagaaagacaaguguuugguuaguaacuggaucuggcuggagcug

SEQ ID NO: 4137398 - RNA, 55 nt, Human
caguuuccaggguauuucugggaagucagaccaugaaguuugccccaggaaauug

SEQ ID NO: 4137399 - RNA, 80 nt, Human
caguuuccuacaacuuaguguaaugcaguacaguaugucaagagaccugggcugcaggcacuaauuggcaagugacgcug

SEQ ID NO: 4137400 - RNA, 67 nt, Human
caguuuccuaggaaugguaccucuuacaaggcucaggccuaucugagguucauucuuauaguaacug

SEQ ID NO: 4137401 - RNA, 65 nt, Human
caguuuccuauuuaagguguuguucuuuuuaauggacaucacauuauguagugaaaagggaacug

SEQ ID NO: 4137402 - RNA, 90 nt, Human
caguuuccucuccucugucugcauguuuacauuuuugagaaguuauaccaauaucugugaaugaaagacauguauggaggcauuaaacug

SEQ ID NO: 4137403 - RNA, 73 nt, Human
caguuucguuguacuuccauucggaggcaacagccucauuggcugcugucuuuuccuggcaguaaaauagcug

SEQ ID NO: 4137404 - RNA, 55 nt, Human
caguuucucagacuucccuuguuuuuuaauaaccuugguagguuugaggauacug

SEQ ID NO: 4137405 - RNA, 58 nt, Human
caguuucucaggccucucccagggcccuguggcuccaugggacacaguuuggaagcug

SEQ ID NO: 4137406 - RNA, 70 nt, Human
caguuucugguguuuuuaccuaggucaucucaacucuagaugacauccggccacuagacuccaggagcug

SEQ ID NO: 4137407 - RNA, 88 nt, Human
caguuucuuccuuuguuuaauaggugguuuaagcaaggucugagcaucccucaaguccugcuguggaccacacaaaggcaaggagcug

SEQ ID NO: 4137408 - RNA, 60 nt, Human
caguuugacgguaucugacuccaaaagguugcuuauggucacaguguauugaucaggcug

SEQ ID NO: 4137409 - RNA, 72 nt, Human
caguuuggaagacagguacuuaauggacuauagccuccucggcaaugucugggagaccugugauauaaagug

SEQ ID NO: 4137410 - RNA, 76 nt, Human
caguuuggacuuuauaguaaucuguacaauuucagacuuuugaaauguacugauacuuauuuuaugguuccaauug

SEQ ID NO: 4137411 - RNA, 80 nt, Human
caguuuggagagaaacaucuguggguggcaagagcaggcugucacuauugcaagccuuccccagugauucucucagccug

SEQ ID NO: 4137412 - RNA, 121 nt, Human
caguuugguuucacuuuccucaguucuaaaaugaaaauaacaaguucuaccucacaagguuuuucugggaaucuaugagggaagggaugugauguuauauuuuguaaacugaaaagcccug

SEQ ID NO: 4137413 - RNA, 81 nt, Human
caguuuuggcagggacaggggagaaaagaugaaaucacucccugcagcaucauuucccacuguccgugugugugagaauug

SEQ ID NO: 4137414 - RNA, 116 nt, Human
cagcgggacugggaagauuuaggcugaccaggucuucuucagcacuuggaaggcacaaaacuucguaaaggccuuaagaagccugcucugggcagaaaccuuucugguuguuguug

SEQ ID NO: 4137415 - RNA, 71 nt, Human
cagcgggcagggccucgaagccucugggcagcacauuggccuggcgggcuugggggcccgggcugcugcug

SEQ ID NO: 4137416 - RNA, 59 nt, Human
cagcguccauuguucccuuuucccagagccaagagcuggguagagcugcaaggacacug

SEQ ID NO: 4137417 - RNA, 91 nt, Human
cagcguggcguaccuugggcacacugaaucugcuauuggguacaacuucaaaaccaaagccagggacagugugcaugcgugugaaaugcug

SEQ ID NO: 4137418 - RNA, 70 nt, Human
cagcuaaauuuuuccaugacugcuuuaaaagugauuuccauuuaaagcuagguggaacaaauuccugcug

SEQ ID NO: 4137419 - RNA, 68 nt, Human
cagcuaauucuuccuuucauucauguguuaaagaugaaauuauaacagaaagagagaagacaaagcug

SEQ ID NO: 4137420 - RNA, 66 nt, Human
cagcuacaggaccugaugcaccauugcuaucagaaaaucuugcuugguguuaguuuucuguauuug

SEQ ID NO: 4137421 - RNA, 58 nt, Human
cagcuaugggcagacgcuguuggaaggcacuccuugugccgucuauuucugccagcug

SEQ ID NO: 4137422 - RNA, 57 nt, Human
cagcuauucucugaaaugaauaacucugcauuugaaagagguuuuugagagaagcug

SEQ ID NO: 4137423 - RNA, 72 nt, Human
cagcuauuguucuguauaaugaagcccuggcuguugacccucagaacugcaucuuauacagcaauagaucug

SEQ ID NO: 4137424 - RNA, 130 nt, Human
cagcucaauguggcacauaggcacucacuagagggagcaagguggccuucugcugggggugaggggucuccccaggagaugggagcaucuaaaaagcagucccaguguugccugcugccaagaggacagg

SEQ ID NO: 4137425 - RNA, 62 nt, Human
cagcucacagccacgccauuccccucuacaacccgcccugggaggcuggcugggaugggcug

SEQ ID NO: 4137426 - RNA, 78 nt, Human
cagcucagauacuaguuucuugacgauguuuuccauggaccuuaucugaauacaccaaggaaucagaauuuugaacug

SEQ ID NO: 4137427 - RNA, 59 nt, Human
cagcucagccucucuuuaaggccacacaccgaugcugagcugaagaguggccugaucug

SEQ ID NO: 4137428 - RNA, 55 nt, Human
cagcuccagccugcagugccagaauuccucggugagguggccagggcaggggcug

SEQ ID NO: 4137429 - RNA, 62 nt, Human
cagcuccaucuugcuuauaccagagcugggguugacaguggguucaaagccugaugggguug

SEQ ID NO: 4137430 - RNA, 61 nt, Human
cagcuccuaugaguaugauucccucccuucuccaggaacuguccucagcugaugggagcug

SEQ ID NO: 4137431 - RNA, 55 nt, Human
cagcuccucuggccagcccugcaccugcucuguggggcuagggccuggggaggug

SEQ ID NO: 4137432 - RNA, 107 nt, Human
cagcucucgaaaucuucaauagggugcuuuaccuugcagggaauauuaucauuggcuuuugauacaauuucugcugcagggaaagacuuucaaagcucagaaugcug

SEQ ID NO: 4137433 - RNA, 75 nt, Human
cagcucugaccugcgggcugugcugaagccugggccucucucuauaccaggccgucugcaggccugcaggggcug

SEQ ID NO: 4137434 - RNA, 90 nt, Human
cagcucugcugcucucagcugcuguguuguuuccuacaaguuguuugcuaguguagaaacuacacaugcaacagauuagccuuaggguug

SEQ ID NO: 4137435 - RNA, 57 nt, Human
cagagaugggucgcagagauggccuguguggaagguuggauucucaccccaccucug

SEQ ID NO: 4137436 - RNA, 75 nt, Human
cagagaugugauccagcugucuucuccaguacccuaagaaagaagagaaaccccgccaucuggaugauucuccug

SEQ ID NO: 4137437 - RNA, 61 nt, Human
cagagauucucagaaguacuaggaaugaguagaugggacuuccugggagucugagauccug

SEQ ID NO: 4137438 - RNA, 79 nt, Human
cagagcacaagaccaauuugaauuaaccagagcagaagugaccucucauugaagcauuuuguguauuuccuugguucug

SEQ ID NO: 4137439 - RNA, 59 nt, Human
cagagcagaaaccugggugauucuuuuacucccagagagagaugcccaacucuguuuug

SEQ ID NO: 4137440 - RNA, 59 nt, Human
cagagcagaagcgguccucacagcacccauucucugcuugagcucccgcuucuucuuug

SEQ ID NO: 4137441 - RNA, 62 nt, Human
cagagcagacuggagccucuacggggcaucuccccauauuggagaauucagucuuuguuuug

SEQ ID NO: 4137442 - RNA, 65 nt, Human
cagagcagauguaagagccaggucuuuggucacggcgccagcaucugaaaagcauuugcaguuug

SEQ ID NO: 4137443 - RNA, 66 nt, Human
cagagcaggcuggacauagacauagccauuccaagggacagugggucaguguccagcuuacaucug

SEQ ID NO: 4137444 - RNA, 70 nt, Human
cagagcaggucuccugagguggcccguggagccuguggacccgguggcauuucagagaaaaucugcuuug

SEQ ID NO: 4137445 - RNA, 74 nt, Human
cagagcagugggguuggucagaugccauaugaugcacacacuuaagcagggcaaaggacuacacauugacucug

SEQ ID NO: 4137446 - RNA, 83 nt, Human
cagagccaccagaucacugcauguaugaaaguaaauauugugaauugugcuuucauugugauaggaagccauggaauguucug

SEQ ID NO: 4137447 - RNA, 71 nt, Human
cagagccagaagcaagggccaaagucuucucugaguugucaagauggacuuggacucuggcucuggcucug

SEQ ID NO: 4137448 - RNA, 74 nt, Human
cagagccagggugggaggcugaaggcguugcugcccucugccugcuucagacauccucaccggcccuuccucug

SEQ ID NO: 4137449 - RNA, 62 nt, Human
cagagcccauggcacauguggaaaauccucugcuggaugaggugacugugcgauggucucug

SEQ ID NO: 4137450 - RNA, 70 nt, Human
cagagcccgggauggacugacgguagcgcgggguucgaaucccagcucuguaaauuccuucaucguucug

SEQ ID NO: 4137451 - RNA, 69 nt, Human
cagagcccuuggcuggagcccagauaauucuccuccuaaaucuuccagggcuucucccuaaggacucug

SEQ ID NO: 4137452 - RNA, 69 nt, Human
cagagcgugcagucuggagcaguaggagguagauguagguuaauaccuugaugcucacacugaccucug

SEQ ID NO: 4137453 - RNA, 86 nt, Human
cagagcuaaugaaugagaaagcugaaaucuaaacccaguucugccuggcuccagaaaaaucaguguucuuuuucaugugaguucug

SEQ ID NO: 4137454 - RNA, 64 nt, Human
cagagcuaguuagugucggagucaggauuugagucucggguuucugacaauuagccuaguccug

SEQ ID NO: 4137455 - RNA, 60 nt, Human
cagagcucaaagcaaguguggauugggguuguuuauaggugcaguuuugcuugaucucug

SEQ ID NO: 4137456 - RNA, 100 nt, Human
cagagcugagguuagauacuagagucccuucuggccucucaggccucacaguccuugaugggaggcagguaggugaugauggugguuccuggaagcccug

SEQ ID NO: 4137457 - RNA, 77 nt, Human
cagagcuggagagauagucauucuagagccuggcccuaguggugccuuuucagaacugucuguccuuuucagaacug

SEQ ID NO: 4137458 - RNA, 59 nt, Human
cagagcuggagggaacccuggcuguccccacggucacugcaucccaucuccagccacug

SEQ ID NO: 4137459 - RNA, 64 nt, Human
cagagcugugauaaauagauaugguuuuaagaugcuaaauuugugauaauuuguuacagcagug

SEQ ID NO: 4137460 - RNA, 63 nt, Human
cagagcuguguccugugcacuaggccuucugcaguuaaagaaacucacagucaugcagcucug

SEQ ID NO: 4137461 - RNA, 72 nt, Human
cagagcuuucuuacuugggugguggggagaaagauauuuugaguucuuuucaucauuuaauagguagcccug

SEQ ID NO: 4137462 - RNA, 80 nt, Human
cagaggaaacacuaggcggguacccuggcucgaaaccuucugguuucccauucccacguccugcuccagcacuuccucug

SEQ ID NO: 4137463 - RNA, 69 nt, Human
cagaggaacuucucuccacccaagucccuggguuugguucaaggacuauuggaggaggggagggcucug

SEQ ID NO: 4137464 - RNA, 61 nt, Human
cagaggaagagauacaagcccucugugaaauacaaaccagggggcuuaguauugauccuug

SEQ ID NO: 4137465 - RNA, 64 nt, Human
cagaggagauacuguuucucuucuacaugaaacucauuucaugcagauucagcagaucccugug

SEQ ID NO: 4137466 - RNA, 86 nt, Human
cagaggauacagcuagggcugaaggaugaaagcugcagauuaacuugauuucagcuuuucacuuuagcacaaguuugugcuuucug

SEQ ID NO: 4137467 - RNA, 72 nt, Human
cagaggccauggaggcagagucgaggcucucugcugaccacagacggagccuguggcugcuugaagccucug

SEQ ID NO: 4137468 - RNA, 58 nt, Human
cagaggccccugggguuguacuggcuugggaggcuggcagcugcaggcaggcuugcug

SEQ ID NO: 4137469 - RNA, 107 nt, Human
cagaggcccugugcccccauauuauccuacccaggcagccugcagggaaggggauuuguucccuaugccugucacucugcgcuguguggagggcaauagggcuuuug

SEQ ID NO: 4137470 - RNA, 60 nt, Human
cagaggccuggcuuggacaccucccccagcuggccguggagggucacaaccuggccucug

SEQ ID NO: 4137471 - RNA, 78 nt, Human
cagaggcugggcugccagcucuccagaugcugucacagugaucucaucucaacuaggaggcuggcacucagucuucug

SEQ ID NO: 4137472 - RNA, 66 nt, Human
cagagggcaccuucaguaauagcuaguuuuaacugauuuccugagcauugaugcaaggugccccug

SEQ ID NO: 4137473 - RNA, 64 nt, Human
cagagggugcaggaggaugguaguuacagccugacauuacugccauagacucugccaccuacug

SEQ ID NO: 4137474 - RNA, 62 nt, Human
cagagguaaagcuagccaaccacugucuuccacuauagggaggggcaagcugcuuaucacug

SEQ ID NO: 4137475 - RNA, 56 nt, Human
cagaggucuccaucacccuccuccucacugguugaagguugucccuggaacuucug

SEQ ID NO: 4137476 - RNA, 69 nt, Human
cagaggugaggccuggagggaggaguuucugccccagcaggugaauuuaaaggccagaccugagcccug

SEQ ID NO: 4137477 - RNA, 55 nt, Human
cagaggugcauacaggucauuagugacaggacuggaaucugaccuguguccucug

SEQ ID NO: 4137478 - RNA, 130 nt, Human
cagaggugucuaccacagcuggaaacuccuguucaaauuucuuaggucaugacccuccauaagguucuggagcaugacaguccugaagagaacggggaagguuucuauacaccuagcugcuucaucucag

SEQ ID NO: 4137479 - RNA, 69 nt, Human
cagagguugagcugacaccacaugguccguggccucccaccauaaaucacauuguuagcauagacugug

SEQ ID NO: 4137480 - RNA, 73 nt, Human
cagaguaaaacuguaauuugcugucucauuuguguucuaugggcacuggugugaaacaguagauuuuauucug

SEQ ID NO: 4137481 - RNA, 87 nt, Human
cagcuuucagagcaacuuguggguguccaugauuaaguacugguuagugauucauccuggcauucauuuaugggcuuaugauggcug

SEQ ID NO: 4137482 - RNA, 118 nt, Human
cagcuuucuauuccuaugugcucacugugccuacugugggagcgucaguugguaggagagaguuccaguuagaggcuuucagcgguaggucccaggaagcaaugaaagagauacguug

SEQ ID NO: 4137483 - RNA, 56 nt, Human
cagcuuuggcaucugacuagccguaagagcuucuggguggcagugauguuaaguug

SEQ ID NO: 4137484 - RNA, 72 nt, Human
caggaaauaucucaacacuuuacaucccaagaauugucauuuguaagggacacugaugagaaauucuuccug

SEQ ID NO: 4137485 - RNA, 61 nt, Human
caggaaaugggguuuaguuauuaagcuugcguagauugcuugauauacugaauauuucuug

SEQ ID NO: 4137486 - RNA, 60 nt, Human
caggaaauuagucucucuguuggaagugagaguaugggauagagagagaugaugccacug

SEQ ID NO: 4137487 - RNA, 65 nt, Human
caggaacaauguaagucucauuagauuugugcugaauauacuaaugaggcauugcauugauucug

SEQ ID NO: 4137488 - RNA, 99 nt, Human
caggaacaggccauuuucacuucuuuugugauuccucaguuacuucaggccaucuggauguauacgugcaagucacaggggauaugauggcuuagcuug

SEQ ID NO: 4137489 - RNA, 99 nt, Human
caggaacuggccauuuucacuucuuuugugauucuucacuugcuucaggccaucuggauguauacgugcaggucacaggggauaugauggcuuagcuug

SEQ ID NO: 4137490 - RNA, 69 nt, Human
caggaagaaagaggugagguguaauccaaaaagcaaucagcucacugacauuuuauuuauuuuuaccug

SEQ ID NO: 4137491 - RNA, 73 nt, Human
caggaagaaucuuaauccagaaaccuaagaucucucucucacacuuggguucaucaaaggacagacucuccug

SEQ ID NO: 4137492 - RNA, 56 nt, Human
caggaagaccagggcuguggcuccagcucccccgaccacccccugagucacuccug

SEQ ID NO: 4137493 - RNA, 68 nt, Human
caggaagaggacaggcuuccccugcaagugcaacuuguguucccuggaguggccugucucauuuccug

SEQ ID NO: 4137494 - RNA, 76 nt, Human
caggaagcacauaguaaauaaugcagaugaucauuauuaauagaaauuauuauuauuauuacuagggagcuuccug

SEQ ID NO: 4137495 - RNA, 55 nt, Human
caggaagcugccggugagcgaggccacugugccauugagcaccugcagcuugcug

SEQ ID NO: 4137496 - RNA, 97 nt, Human
caggaagggcuguguagggagugcgugagaucuauguggcaagguccugggaccaggacccugaggucuccugugagcuagacugccucccuuucug

SEQ ID NO: 4137497 - RNA, 62 nt, Human
caggaaggggaggagggggugggauauuaugaugcagcucacauugaacacucucuuuccug

SEQ ID NO: 4137498 - RNA, 68 nt, Human
caggaaucccaggccuggucugggccaguaagguuucugccauuggcaccaaggcaggccuuuaccug

SEQ ID NO: 4137499 - RNA, 56 nt, Human
caggaaugccuucuucagccauguaagaggaagcugggguuaggaaggaguuugug

SEQ ID NO: 4137500 - RNA, 59 nt, Human
caggacaagcugccagcaucccggaagggguuaaucccccucugguggcucagcuccug

SEQ ID NO: 4137501 - RNA, 60 nt, Human
caggacacauuguggcugcuuuccucaacacaggccuguggcuguggcaagugcucacug

SEQ ID NO: 4137502 - RNA, 100 nt, Human
caggacacuaagguuguauuauuaacacaaagaacuggauauuuggacucucaaagaguucaggagaaaguucaguacuuucacuguaaugauugucgug

SEQ ID NO: 4137503 - RNA, 55 nt, Human
caggacacuacagaugggagggccgacaggcagacauuuacuucucacuguccug

SEQ ID NO: 4137504 - RNA, 83 nt, Human
caggacagaccugcagcugaggggagcccgcccuggacgcggcagggaugaccggcguccgcccccuccugcaggaugaccug

SEQ ID NO: 4137505 - RNA, 64 nt, Human
caggacaggaguggggucaaaguccaagauuaaaaaggacccuuugcauacccucccugugcug

SEQ ID NO: 4137506 - RNA, 56 nt, Human
caggacaggcugcagaggcagaugaugcuguccaucucuggccccuuccuguccug

SEQ ID NO: 4137507 - RNA, 59 nt, Human
caggacaguuggcaucugcugcuucaugaauuguuuguagcagaguggcagcucuuuug

SEQ ID NO: 4137508 - RNA, 55 nt, Human
caggacauugauccauuggcacugcuucgagacagaacaguggacaaaugaccug

SEQ ID NO: 4137509 - RNA, 75 nt, Human
caggaccagaguacauaggagcaaaucagucaucgccuacucaggcuuguuugcaguuguguguuugugguccug

SEQ ID NO: 4137510 - RNA, 55 nt, Human
caggacucacuucucacauccccuugccagguagguaaugguagaugagucucug

SEQ ID NO: 4137511 - RNA, 87 nt, Human
caggacucuggggacccugggcagucugcacuucaggugcugauccugcggugggcugggcugucccgagucagccccuccguccug

SEQ ID NO: 4137512 - RNA, 58 nt, Human
caggacuggcucgcaguggguguuguggacugccgugccccacugugcagcaguucug

SEQ ID NO: 4137513 - RNA, 55 nt, Human
cauaggagccacacaaguugaacagcuuugaagcugguuaauguggcuuacuaug

SEQ ID NO: 4137514 - RNA, 85 nt, Human
cauaguacauucagagaaaguuuccauccuggggggcuuaaaauaaagcaucuaauugagugaaacuuuuccuguaaugauugug

SEQ ID NO: 4137515 - RNA, 85 nt, Human
cauagucuggccuccucucuucugcacacucugccccuucuucagaucacgcucaugggcagagugaagggagaggugugcugug

SEQ ID NO: 4137516 - RNA, 77 nt, Human
cauagugggucauuagguuggaaauguagagccaugcuagaauuagcuguggcucuccagagccuaugguaacuaug

SEQ ID NO: 4137517 - RNA, 74 nt, Human
cauaguguaaguccucaagucaaaaccguguguguauuagguacaaaucagucccucuuggaauuuacauuaug

SEQ ID NO: 4137518 - RNA, 72 nt, Human
cauaguguugugagucguaaaugagaccaugccuguaaggcaccuggcugaguuccuggcacacggcacuug

SEQ ID NO: 4137519 - RNA, 80 nt, Human
cauaguuagugguucagagcaaggacccuggagccagacuaaccagcuugaaucuugauucugauccuuugcuagcugug

SEQ ID NO: 4137520 - RNA, 58 nt, Human
cauauacacuuccaccucugugcuaucuuccuggaaaacacagaguagaagugccaug

SEQ ID NO: 4137521 - RNA, 64 nt, Human
cauauaguuuuauagauauuguguauguucauuguacauauguaauagacauuaagacugaaug

SEQ ID NO: 4137522 - RNA, 86 nt, Human
cauauaguuuugcaagauguuaccacugggggaaacugguuaaagggcacacaggaugucucuguaauaucuuuuacaacuauaug

SEQ ID NO: 4137523 - RNA, 86 nt, Human
cauauauaucuugauucuuauugauuccugcuuucugcucucuuucauagagaagaagacauggaacaauaguuaaggaauauaug

SEQ ID NO: 4137524 - RNA, 62 nt, Human
cauauaucacagcaguggaguggggugacauuuaagacacugauacucugugauuagauaug

SEQ ID NO: 4137525 - RNA, 67 nt, Human
cauauauuuggagguggaguauacaauuugacccaucaucugaguauacauacuucuagauuaaaug

SEQ ID NO: 4137526 - RNA, 56 nt, Human
cauaucauaguagcuugcacgugugccuuauguuuggguacaguaacuauguuaug

SEQ ID NO: 4137527 - RNA, 55 nt, Human
cauaucuguuuccuaugcaugugaauuuguuuucauaaggcauguaacagaaaug

SEQ ID NO: 4137528 - RNA, 79 nt, Human
cauaucuuguaaguguauaggcuuugggacagcuuuuucucucuccuguuauuuaaaagcuucuauucacuuacuugug

SEQ ID NO: 4137529 - RNA, 68 nt, Human
cauaucuuuccauggccacacagucuuguuaacacacggugggcagaguggccuggagguggucagug

SEQ ID NO: 4137530 - RNA, 56 nt, Human
cauaugacaguguucaaaguuguuucagugacagcugaacaagauagugucaugug

SEQ ID NO: 4137531 - RNA, 58 nt, Human
cauaugagauugcuuccuuuccuccuugcugaggaaguggcugagaguguuucauaug

SEQ ID NO: 4137532 - RNA, 63 nt, Human
cauaugcagugaccaaucaugguuagauuuuggaagaaguacugugauugggcacugaucaug

SEQ ID NO: 4137533 - RNA, 60 nt, Human
cauaugucagcugugccuauuugaagaaaauucauccccaggcagcaucugauuuauaug

SEQ ID NO: 4137534 - RNA, 90 nt, Human
cauaugugauaaauuauuuauuauuaauuugcagcagaugaaaccacauaagcaucuguucagaaaacagauaacuaauuuggacaugug

SEQ ID NO: 4137535 - RNA, 83 nt, Human
cauaugugugccugugcaugacagcauacaaacgugcauaguguguauguguguaugcaugugugcaugagugugcacaugug

SEQ ID NO: 4137536 - RNA, 56 nt, Human
cauauguguguguguguguguaauauccuacugugggauccacauauauuuauaug

SEQ ID NO: 4137537 - RNA, 73 nt, Human
cauauguugaaguccucuccccucaguuccucaguguacgacuguauuugaagacagggucuuuaacgaggug

SEQ ID NO: 4137538 - RNA, 111 nt, Human
cauauuaacuuuuuuuguugcuauguguucagcuuauaucuuaguuuuagguuuccuuuauuccuuuagcagauauuuguugagcacuugcuauguaauaggccaaaugug

SEQ ID NO: 4137539 - RNA, 69 nt, Human
cauauucagcucuuggaugugaacucuuagccaagaaacuauucaaauauuauucaggggcugaaugug

SEQ ID NO: 4137540 - RNA, 80 nt, Human
cauauucuaacagccaggaauucuggagaagaaaaauuggguaauaaaucuuaucagauuaucugggcuguccugauaug

SEQ ID NO: 4137541 - RNA, 61 nt, Human
cauauugucuauugcuguuuuucugccauaaaaguuagaguccaguaguuaggacagagug

SEQ ID NO: 4137542 - RNA, 79 nt, Human
cauauuucauauacuuguagcagguggcauuuauugguuuauucuauuaaacgcuacacaugccacguuaggaaaugug

SEQ ID NO: 4137543 - RNA, 56 nt, Human
caucaaaaucacuugugccauuagugaacauuaacuagcaggagcgaauuuugaug

SEQ ID NO: 4137544 - RNA, 62 nt, Human
caucaaaaugaaagacaucucauagacaauaguacaguaggucagauucucucauuuugaug

SEQ ID NO: 4137545 - RNA, 85 nt, Human
caucaaagguuauuuagggggaagguaguggccaaaaaucuacugagaaauucuuucuuucacucuagguguauacccaaaugug

SEQ ID NO: 4137546 - RNA, 106 nt, Human
caucaaauccuuacucugugcaaauggcuuagaagauauaagaucuagaaguaacaucuaucugagugucuuaauaggcucuucaauaugaauaaguucuaugaug

SEQ ID NO: 4137547 - RNA, 66 nt, Human
caucaagauauuuuagaacauucacucuggcuacagagggagaaauggaucagaggggucagggug

SEQ ID NO: 4137548 - RNA, 103 nt, Human
cagaguaggcugaggcugagguggcagccacagaaguuucauagucucgauuuaggaaucaggggcugcuucaguccucuucugcucucuagccccuucucug

SEQ ID NO: 4137549 - RNA, 86 nt, Human
cagaguauugccagccagggaagcucacccaaguuucaguguccagucuccgggucgcgggugguuuuuacuggggcucuauuuug

SEQ ID NO: 4137550 - RNA, 60 nt, Human
cagagucagagcaccugggauuggaucccagcccuaacccuuccuaggugugcaauuuug

SEQ ID NO: 4137551 - RNA, 63 nt, Human
cagagucaucuucaaacugugcaagcugaaaaucagcucauaaagugagaauaugaccaacug

SEQ ID NO: 4137552 - RNA, 82 nt, Human
cagaguccggacaccaccugugagacugucccucugccuggggaugcggagggacuccgugcacagugguucagggggucug

SEQ ID NO: 4137553 - RNA, 62 nt, Human
cagagucuuucugggcuuguucuuugaucacccucaucugaagaggaagcaggaaagaacug

SEQ ID NO: 4137554 - RNA, 62 nt, Human
cagagucuuuuuuucuaaugaaguccuaccuggagcuccaauauggauaaaaggggccucug

SEQ ID NO: 4137555 - RNA, 73 nt, Human
cagagugaaacucgguucccagugauaucagcuucuaaaauguugccaaagcuauuucauugugcugagucug

SEQ ID NO: 4137556 - RNA, 60 nt, Human
cagagugaguguaagguuggauuauguauauaaauagugagccuguuaauacuggcucug

SEQ ID NO: 4137557 - RNA, 65 nt, Human
cagagugauggccaguaauuccaaaagccuaagguuuucugaaugaucuacucucauuaucucug

SEQ ID NO: 4137558 - RNA, 55 nt, Human
cagagugauuugaugaguugcauauuuaauggcaucaucguggaaugcacgucug

SEQ ID NO: 4137559 - RNA, 58 nt, Human
cagaguggcacucugcuggaugcuguacaucagucagaagagcagcugugccacacug

SEQ ID NO: 4137560 - RNA, 105 nt, Human
cagagugguuaagcugugagcuuuggaguuaaacaaaacuagauauggacccagcccugucucuuacuuugauucuugguucaacauuugcuuuaugccauacug

SEQ ID NO: 4137561 - RNA, 61 nt, Human
cagagugucugaauuagagcacaaaggcaaauacuaccuuucugccuugcucagcacacug

SEQ ID NO: 4137562 - RNA, 55 nt, Human
cagaguguucguggggacuuggccacguacauguggcugaccauaaaucacacug

SEQ ID NO: 4137563 - RNA, 82 nt, Human
cagaguuacagaagcuauacaaugcacaaaugaugaaaucaugaguggauuaauauggcucaaggaagcauuguugauucug

SEQ ID NO: 4137564 - RNA, 71 nt, Human
cagaguuacauucauuguuacgcuggguuccaagucuagaaucaaaaagucagggcaggaauuuagcucug

SEQ ID NO: 4137565 - RNA, 82 nt, Human
cagaguuggugguggagccagcugggagugaagcggucugcuuccagagacugagcucuucaccacaacacuacugccucug

SEQ ID NO: 4137566 - RNA, 86 nt, Human
cagaguuucucaaacaauugguuaagacgcaucaugcuuuaugcaaagagcaugaggguguuaaaaccagauucuugcugacucug

SEQ ID NO: 4137567 - RNA, 78 nt, Human
cagauacuaauccaacugguggcucuugagcccugucgccuaugcauagggcucugcucaucaguugugcuggugcug

SEQ ID NO: 4137568 - RNA, 79 nt, Human
cagauagggagcuaugacacuagcaccaaagagagauuuuucuucugguuggguggugcuggugccacgccccuuucug

SEQ ID NO: 4137569 - RNA, 105 nt, Human
cagauauauacaguaucacccugaaucagcuuuucucaucagaaauggagcuacuguacuuuauugugaugucagagauugaacuggggugagaaugcacuucug

SEQ ID NO: 4137570 - RNA, 62 nt, Human
cagauauauuuuccuuauuagggagaagguuacuaauuuucuaauacugaaagugacaucug

SEQ ID NO: 4137571 - RNA, 80 nt, Human
cagauaucuaaacaagggauuauaauugauggugacaaguaacucagauuugucuuuuguaugcuuuguuuggccauuug

SEQ ID NO: 4137572 - RNA, 59 nt, Human
cagauauuuuuaguauuucugccuuaguuuguuaaaugauucaggucugagaguaucug

SEQ ID NO: 4137573 - RNA, 60 nt, Human
cagaucucaccucuguguauuauuugagaagguaggaaaugucggacagauugagaucug

SEQ ID NO: 4137574 - RNA, 67 nt, Human
cagaucuuuacuacugccuucucuaugaaaagauauagugugggggcuuuggugucacauagaucug

SEQ ID NO: 4137575 - RNA, 77 nt, Human
cagaugaacagcgcuucagggaggagcauggguucagguacauguggcaccugcccucccuggccgcccuuucacug

SEQ ID NO: 4137576 - RNA, 64 nt, Human
cagaugaacucuauccuguggcuuuaaguaggaaacucuccuuauauucagaugggguucucug

SEQ ID NO: 4137577 - RNA, 122 nt, Human
cagaugaaguacccagccuaaggugaccacaauagcagaggguagugccggggcagaucauggguccucugacugccacuccucucuagcaaaggucucuuugcaauguuuucuuuuaccug

SEQ ID NO: 4137578 - RNA, 55 nt, Human
cagaugaggcaaccucauugcugagacugagcugagagugagcauggcuugacug

SEQ ID NO: 4137579 - RNA, 72 nt, Human
cagaugauuuuuuuuccuggcuuugcuucccuuuuagaggauguggauugagccagaaaggggcauuaucug

SEQ ID NO: 4137580 - RNA, 76 nt, Human
cagaugcacugaguuauuauugaugacaguaaaaugaacacauuuaaauuguucaauguaauaauuuugauaucug

SEQ ID NO: 4137581 - RNA, 59 nt, Human
cagaugcugcacagcuggagcggcuguuggggaggcugacgccagcccugcagcaccug

SEQ ID NO: 4137582 - RNA, 73 nt, Human
cagaugcuuaaaugucauuggucuguuuuaaaguaauucuauuugaucucugugaaacagauggaaguauuug

SEQ ID NO: 4137583 - RNA, 76 nt, Human
cagauggaaacugguuucugagauggaacuuggcagugguaccuauguucccucucagaaauccagguuuuaucug

SEQ ID NO: 4137584 - RNA, 66 nt, Human
cagauggagaaaauugggggaagcugaaauaugugcugaaguuagaguccacaagauuuuccagug

SEQ ID NO: 4137585 - RNA, 67 nt, Human
cagaugggcuacagccauugauugguuagucuugcuuucaacauuuaugaagcuguggcccaauuug

SEQ ID NO: 4137586 - RNA, 64 nt, Human
cagaugguauuucaaauuuggcaagugcuaagaaagaacuuacccaaauuagaguuaccagcug

SEQ ID NO: 4137587 - RNA, 85 nt, Human
cagaugguuucugcggcucuaagccgaaaucuccagugcgucccagggucacgugggugguguauuagagcugcaggaaugucug

SEQ ID NO: 4137588 - RNA, 66 nt, Human
cagauguauguaugcugugcuugcacauacacacugugaauugugagacacacguauguauaccug

SEQ ID NO: 4137589 - RNA, 70 nt, Human
cauagccuccuguaguucuguccccuugguccgccucuuuggugcuccaggaaaugaauccaggaggaug

SEQ ID NO: 4137590 - RNA, 89 nt, Human
cauagcucccauaagauucuaaaauaguuccauaguucaaaaacaauagcuaaggacaguugauuuagagcaucuaaugauuaccuaug

SEQ ID NO: 4137591 - RNA, 74 nt, Human
cauagguuccagcuugacaaaugauuuuaugauauuaaguaugaaaauauuucuaacaguugguuaugccugug

SEQ ID NO: 4137592 - RNA, 69 nt, Human
cauaguccacagugagguguuuaaauuguuucaguaguuaugaaaugaagaacauugauauugucuaug

SEQ ID NO: 4137593 - RNA, 121 nt, Human
cauagugaugaaaaaagaacagacuccaaagccagauacuuggguucaaaucccagcucaguuccauaagaacaguguaauuuuggacaaguuacugguuuccuguguuuucguuauuaug

SEQ ID NO: 4137594 - RNA, 55 nt, Human
cauaguggcaaugacccugauagaguggcaacaguccagcccucuuaccacugug

SEQ ID NO: 4137595 - RNA, 85 nt, Human
cauaguugcauucaauguaucaaccagaaaguucagggaaauacgauucuggacuagggaugacauguuuucuccuguaacuuug

SEQ ID NO: 4137596 - RNA, 61 nt, Human
cauauaauguuugaagauguggguuuuaaauaaaaaugagaugcaucucaaauuuuauaug

SEQ ID NO: 4137597 - RNA, 55 nt, Human
cauauauauuuagauuucacugucucugagaguucaguuauucuugaugugugug

SEQ ID NO: 4137598 - RNA, 80 nt, Human
cauaucacgugaucacagaucccagcuuaggugcagucauucgagccacugagccugcuguucuguuuagugaacauaug

SEQ ID NO: 4137599 - RNA, 68 nt, Human
cauaucuagaauccauuccuccagugaggacacgcagugccccuucaugauggaaaggguucagugug

SEQ ID NO: 4137600 - RNA, 90 nt, Human
cauaugauuugggaguugacuuuauguguauguuuacuuguuuauagcauaaguugaggguaaauacuaaacucacuuuuggauuauuug

SEQ ID NO: 4137601 - RNA, 55 nt, Human
cauaugcaggcucagguccggcccgacggggcuccagaggccuuaccugcaucug

SEQ ID NO: 4137602 - RNA, 62 nt, Human
cauaugcauguauauucacauguguauguauguauguauguguauaccuauacaugugugug

SEQ ID NO: 4137603 - RNA, 98 nt, Human
cauaugccaucaacaaugucaacacuugguaugucaggguuauuuuuuaguuuuagccauucugguggccauguggugauaucuuauugugguuuuug

SEQ ID NO: 4137604 - RNA, 55 nt, Human
cauaugcucuaacuauaaaacauucaaaagguugcuuuuauauguaggguauaug

SEQ ID NO: 4137605 - RNA, 75 nt, Human
cauauguggcuagugacuaccauaauggauaguacauuaugcacugcccauuaugguagucacuagccacauaug

SEQ ID NO: 4137606 - RNA, 69 nt, Human
cauauuaaauggaaaggauuguggcccaacuuuuuuagcccuuggucacaacucuuuccauuuaauaug

SEQ ID NO: 4137607 - RNA, 75 nt, Human
cauauuauaaauuacugauauuuggaaauuucuaagaguaugucacuuagaaaugaauauguagugguuaaugug

SEQ ID NO: 4137608 - RNA, 70 nt, Human
cauauucaguccugagccaaucaugauggcuggaaaagauggcccucugguugcccaggacuaggucaug

SEQ ID NO: 4137609 - RNA, 59 nt, Human
cauauucccucccucuucagcccuauagguggggaaacugaggcuggggaagggaagug

SEQ ID NO: 4137610 - RNA, 70 nt, Human
cauauuguuguagagaugggaucauaguauacauaguguucuguacccaacauuuuuacuccauaaugug

SEQ ID NO: 4137611 - RNA, 66 nt, Human
cauauuuauucuucugccagugcuugaaaucaagcuugaucagccauggcaguaggaugggaggug

SEQ ID NO: 4137612 - RNA, 112 nt, Human
cauauuuuaaagaugagaaugguagauauauggauagugaucauaagaauuauguuaguggucuucacuaucuguauguauuuauucacugccuugcuuuccuuuaaaauug

SEQ ID NO: 4137613 - RNA, 64 nt, Human
caucaaaucugacuuuucuuccauucuaauguuuauaaccuggaagauuaaagccaguuuggug

SEQ ID NO: 4137614 - RNA, 55 nt, Human
caucaaccugguauggaugcuaccagcugaaacagguagaguccagggugaggug

SEQ ID NO: 4137615 - RNA, 69 nt, Human
cagguucuggagaugcagagauaaaaggcaggccccugcucaggcaucaugcggucuccaggguaccug

SEQ ID NO: 4137616 - RNA, 65 nt, Human
cagguugagguuuauggagggcugcccuugaggguccucaguguccuucauuggaaucucuccug

SEQ ID NO: 4137617 - RNA, 59 nt, Human
cagguuggucggcaaguacacagaggaaaucuggacacucuguggguguuaugggcuug

SEQ ID NO: 4137618 - RNA, 67 nt, Human
cagguugguugcugucacgugccucugaggucaaauacugcuaucaggaguugacaguugcuauuug

SEQ ID NO: 4137619 - RNA, 91 nt, Human
cagguuguuguugcaucuggagaaggaagagucuuugaacaugauguggcccgaacccucccuuucgacaggucaauuccauaacagucug

SEQ ID NO: 4137620 - RNA, 129 nt, Human
cagguuguuucucagagaccauuuaaagucugugcuauagaguaggcauggcuccaguuccagaaggaagacuugggucaaguagcucacaggcaaaugacuuaaaugcuucuuauaagauacuaccug

SEQ ID NO: 4137621 - RNA, 79 nt, Human
cagguuuccgggcaucggggcaucuggcagaagauggaagcucuggccucacugcuggcuggccuggccuggacuccug

SEQ ID NO: 4137622 - RNA, 63 nt, Human
cagguuuuuucuguguuugguuguuugcacacguaugagcaauagccaauacagcaaaauuug

SEQ ID NO: 4137623 - RNA, 90 nt, Human
caguaaaaaugcucuauguacacgguggcucugaaggacacauuucaucucuuuuucagaccugcugugcuaucuauugcuguuuuggug

SEQ ID NO: 4137624 - RNA, 96 nt, Human
caguaaaacugaucaaugcaggcagcuaaaccauguaauucaaucccugaaguggguuuuguucaguuuggcugucuguagucaucacauaaauug

SEQ ID NO: 4137625 - RNA, 73 nt, Human
caguaaaucagaccucaccggagcggauuagugauaaaaaugcaucuuguuccgaccgugggguuugauccug

SEQ ID NO: 4137626 - RNA, 118 nt, Human
caguaaaucauguguucaaaguugugguuccauauagugauggguuuauguggaaacagacauccucaucuugcuucaucugcuguguaaucauuaacucaugaagauaacaggacug

SEQ ID NO: 4137627 - RNA, 55 nt, Human
caguaaauuugagggaucuaauuaugggguuucaguagauccuggggauuuauug

SEQ ID NO: 4137628 - RNA, 87 nt, Human
caguaacagaaaagcuacaauguguuuuugaaacuauaaagugaaugguuucuugggaaaaauuguggauuuguauaucuguuguug

SEQ ID NO: 4137629 - RNA, 59 nt, Human
caguaauaaagcuaaguauuuccuuggucucucugaccgcuauacuggguuuuauuuug

SEQ ID NO: 4137630 - RNA, 66 nt, Human
caguacauaauaggugcucaauaaugacuucuugaauuuggaagugucuagcaccuggaugcacug

SEQ ID NO: 4137631 - RNA, 66 nt, Human
caguaccacacagucuugguugcauagcuuuguggucaguuuuaaaaucaggaaguguguguccug

SEQ ID NO: 4137632 - RNA, 60 nt, Human
caguaccagucaccacauugauggccugaauuuauuccauugaccuggcagacuggacug

SEQ ID NO: 4137633 - RNA, 78 nt, Human
caguagaucagaaguuaauuccugaaauucuccuguugcuuucagguugcagaauugcuggaauuugcuuuauccaug

SEQ ID NO: 4137634 - RNA, 130 nt, Human
caguagauuguauaagauucaagccugugauugauuaaguaugaaaguuaaucaauuuaauuuaugugauugauguugauucuuucauuuugaaauugccuguuuguaucuuauuuuuaucaagauacug

SEQ ID NO: 4137635 - RNA, 70 nt, Human
caguagcaagauucuuuaucaguuacucauagggagaaaacacuaccagagugacgugaagugugaacug

SEQ ID NO: 4137636 - RNA, 55 nt, Human
caguagcaggcaggugcuuuuguaguucagggaugcugccaucuuucuguaauug

SEQ ID NO: 4137637 - RNA, 60 nt, Human
caguagcuacuagccacauguuaauguuacugaguacuugaaauguggcuagugcaacug

SEQ ID NO: 4137638 - RNA, 56 nt, Human
caguagcuuacuuuucuugaucacccgagcuugugauccgaaagucaaagcuacug

SEQ ID NO: 4137639 - RNA, 72 nt, Human
caguaggucuaaggcaccgaggcaggagcgucccccgcggccucgcucccugcucucugggccccaccgcug

SEQ ID NO: 4137640 - RNA, 61 nt, Human
caguagucuuuuuccuccuagagaacucggugaaucuuuuccagggaguuaggcucugcug

SEQ ID NO: 4137641 - RNA, 62 nt, Human
caguaguggaagggagagaaaaaagcaaagauaaccuccuuuggagcucuuuuuuacaacug

SEQ ID NO: 4137642 - RNA, 67 nt, Human
caguaguggucuaucacuggagugcaguggggagaaacaaagcaaaacacagcugaggaccaaacug

SEQ ID NO: 4137643 - RNA, 67 nt, Human
caguaguuuuuccacaugaagacaaggcuuguuuguuugaagaagucucugcugguugugccuauug

SEQ ID NO: 4137644 - RNA, 79 nt, Human
caguauaacuaugacccuucuggaacugcuucuccacaaaccacuacagagcaggcaauuuuggaaggucaguaugcug

SEQ ID NO: 4137645 - RNA, 62 nt, Human
caguauauucugcagagccuuaaggaacauaagagccaggcugaggaguugcugaaauacug

SEQ ID NO: 4137646 - RNA, 85 nt, Human
caguaucuguccuuugugacuggcugacuucaccuaacaugauguccucaugccuucauccauguuauaguguggaucagaauug

SEQ ID NO: 4137647 - RNA, 64 nt, Human
caguaucuguuaggaucagagcugggucaugggaugugcacccacucugguguuguagaugcug

SEQ ID NO: 4137648 - RNA, 62 nt, Human
caguaugcaguugaaaauaagcuuauuauuaaacuaugcauuuauuuuuagcaaacaugcug

SEQ ID NO: 4137649 - RNA, 91 nt, Human
caguauguauuuuguaugccauguguucauguuuuucccuuugaagacugccugggaaaggcuaacagucauggaaguaacaaacauauug

SEQ ID NO: 4137650 - RNA, 83 nt, Human
caguauucaacauauggucaugaugugggucauucuuugugauuacagaaugcuuccuaaccauggccgugugccgauuacug

SEQ ID NO: 4137651 - RNA, 84 nt, Human
caguauucauaacuauccaaauuagagccaggauguuuaugcucaaaucuugucuuggcucuguguugaugggacugaauaaug

SEQ ID NO: 4137652 - RNA, 82 nt, Human
caguauucuucuagcacuccugcccguaaguuagaaaagcauauuguucucaguguuugugggugaggcuggaaggguagug

SEQ ID NO: 4137653 - RNA, 65 nt, Human
cagucaaagaaacgcaccuuacaugcagucauuauuaguccaucugcaugugcacucuucagcug

SEQ ID NO: 4137654 - RNA, 80 nt, Human
cagucaaucagaacagaagcuggcuauaaacagugaguauaucacacaguuguaucagcugcuaaguucuacuaagacug

SEQ ID NO: 4137655 - RNA, 61 nt, Human
cagucaaugguaaacaaagugauggauggaugccaucagaucacaaaaguuucuauuacug

SEQ ID NO: 4137656 - RNA, 58 nt, Human
cagucacugguucuauaggccccucugagcagagguaggcaucccaggccagugacug

SEQ ID NO: 4137657 - RNA, 57 nt, Human
cagucagggaggcugggacgggugcugacccuagcccuggagcacucucccuggcug

SEQ ID NO: 4137658 - RNA, 98 nt, Human
cagucaugcuauaggggaucagugauggugauggggcauggcauuuucacagccacuauuuauacuuccugaucccucuagcuaaaaaaugguggcug

SEQ ID NO: 4137659 - RNA, 64 nt, Human
cagucauucauuuuugcauugucuguggccacuuucacacuacaacagcagaggugagcagcug

SEQ ID NO: 4137660 - RNA, 69 nt, Human
caguccaggcauguugggaagaugaacauccaucagggaucguuauccaccccgaugcuguguguuuug

SEQ ID NO: 4137661 - RNA, 58 nt, Human
caguccaucugguuucaagaugaccccaauggucacugcugcugccaugauggagcug

SEQ ID NO: 4137662 - RNA, 76 nt, Human
cagucccuggguacuauaauuugcauugcaauaugaggcuuccauuuaaugcuugcaaauuaugggaccagggcug

SEQ ID NO: 4137663 - RNA, 75 nt, Human
caguccgugagugccuucagauuugccccagugccccugccugaggugugaaaugguggcaacuucuggcaccug

SEQ ID NO: 4137664 - RNA, 91 nt, Human
cauucuuggcaaaacagaaagcuuaugggaaauauucauugacuucuucuuguagcaauguuauuucugcauaguagucaggcuaaggaug

SEQ ID NO: 4137665 - RNA, 130 nt, Human
cauucuuucauuaaaguggcuguucauaggauauagcuaagaaagugugauacuuugucauuguggugucaaaauggcaggguggcaacuuuuggugguaacuuuaucuguuuucuaguuagagggaaug

SEQ ID NO: 4137666 - RNA, 62 nt, Human
cauucuuuggaugcuguauuuaagaugcuaugucagacaucucuaugcaggaucucaccaug

SEQ ID NO: 4137667 - RNA, 73 nt, Human
cauugaaacuggcuagggaaaaugauuggauagaaacuauuauucuauucauuuauccccagccuacaaaaug

SEQ ID NO: 4137668 - RNA, 105 nt, Human
cauugaaccugcaucugagacugugggucuugaaauaaaaauccuguuuauggagaaauguucaagaugguuauuucaucaccuauaaacuauuagggguuuaug

SEQ ID NO: 4137669 - RNA, 111 nt, Human
cauugaggggaggaugcagagcucuaugccauaugauuggcaucccuguggcaucauaugcaaucauauggcauacagcucuucaaaccuguauguguuuuccuaucaaug

SEQ ID NO: 4137670 - RNA, 79 nt, Human
cauugaguaaacaagucuaccauuagaagcaggacuuccuucuugauauacuuggauggagacgauuuguuugaaaaug

SEQ ID NO: 4137671 - RNA, 59 nt, Human
cauugaguccugacccccaggaccucagaaugugcugucuuggagauagggucuuaaug

SEQ ID NO: 4137672 - RNA, 65 nt, Human
cauugaguguauuacagaacugacauuucaacuacuaguguacaguuuguaguacuacaaaagug

SEQ ID NO: 4137673 - RNA, 77 nt, Human
cauugaugaucacaauguuucaggaaaucagcuagaguuaaaguauacucugaaugaccaugaaauaaucaugaaug

SEQ ID NO: 4137674 - RNA, 65 nt, Human
cauugauuaucaucugaaggcgccgcucaaauguucacugaaguuguguuucaugugauacaaug

SEQ ID NO: 4137675 - RNA, 66 nt, Human
cauugauuuuuccaccguacuuccugagggaggacucuccggggacuuaaagugaaggaaacaaug

SEQ ID NO: 4137676 - RNA, 109 nt, Human
cauugcacaauucuaagaagcaccauucaugucucaucauauuucuaugcucugggaguugccuuucacauagaauaugugugauuguuaucccuagaauugugcagug

SEQ ID NO: 4137677 - RNA, 78 nt, Human
cauugcacagcuucccagacaauuauauggacgcacugugacuaagaucuggccaaaugaaaucugagcaaugcaaug

SEQ ID NO: 4137678 - RNA, 74 nt, Human
cauugcuaaguuguacuccauuuuguagguaugcuacaguuuaucuguuuaccuauugauggacauuugcauug

SEQ ID NO: 4137679 - RNA, 65 nt, Human
cauugcucucauaagugugcugaaagaagacaaagacaagcuccucagaggcacugagagcaaug

SEQ ID NO: 4137680 - RNA, 96 nt, Human
cauuggaaauaaugcuauauuugacaugauuaugauucucuauuugugccaucagaaucagcaagcaugguuagguguaugucauuucauuugaug

SEQ ID NO: 4137681 - RNA, 130 nt, Human
cauuggaaucaccuaggaagcguaaacaacauacuagugccugggacuugcuccggauuaauuaaaucagaauaacuggaagugaagccuagguaugagugucucuuaauauccccaggugauucuaaug

SEQ ID NO: 4137682 - RNA, 65 nt, Human
cauuggaguuuggggucagacuugagcuuggauaggcuuggcucugaaacccaagcucuuucuug

SEQ ID NO: 4137683 - RNA, 60 nt, Human
cauuggccugucuuuguauaccacuggucauauugguucuauguaguagcagagccaaug

SEQ ID NO: 4137684 - RNA, 57 nt, Human
cauuggucuucuaacagagagauauuucuuucuuuugucucucugagaauauuaaug

SEQ ID NO: 4137685 - RNA, 72 nt, Human
cauugguucaguuaugugaccucaaaaggaauauucaauaauaaaguuuugaauuccauuacugagucacug

SEQ ID NO: 4137686 - RNA, 56 nt, Human
cauuguaagcuguugaauccuccugcuaagacuagauugauucucaguguacagug

SEQ ID NO: 4137687 - RNA, 75 nt, Human
cauuguagccaaugaauauauuucauaugauuuugauccuuuuaaauucauugagacuuguuuuguggcccagug

SEQ ID NO: 4137688 - RNA, 79 nt, Human
cauugugacuguggacacuacgauaggggaaaaguuucuuuuuaaaaaaauuuuaauuguuguggguacauaguauaug

SEQ ID NO: 4137689 - RNA, 128 nt, Human
cauuguucaauugcuucuuguuccaggaaaauucucucugcuacauuuugaacaagauguauucagugcaugaacuucacuuguaaaugcagccuugggggucuucuuuuaaccuggcaccuacuuug

SEQ ID NO: 4137690 - RNA, 59 nt, Human
cauuguuggcagagggacagaggcccagaggggagacugagagccuucuagccacaaug

SEQ ID NO: 4137691 - RNA, 60 nt, Human
cauuuaaauaggacuccuggggguuaccaguggaugacccccaggaauucuacuuaaaug

SEQ ID NO: 4137692 - RNA, 72 nt, Human
cauuuaacacugagcagcaacuguccauggcaggcuacugcuuguuauucucagcugccagacgaaggaaug

SEQ ID NO: 4137693 - RNA, 80 nt, Human
cauuuaaccuucccaagcuuuaguuauuuucaucuguaagauggaaauaauaucugcuugaguacuaaaggagguaagug

SEQ ID NO: 4137694 - RNA, 58 nt, Human
cauuuaauagaugcuguuucaggcuacugaggaaagacagaacagugucuaugaaaug

SEQ ID NO: 4137695 - RNA, 80 nt, Human
cauuuaauguaugcacaguacaaacuggaaaccuuugaguacaaagguuuccagucaacuuguguguguguaugugugug

SEQ ID NO: 4137696 - RNA, 58 nt, Human
cauuuaauuuggucccauauuaguuaagccucaggcuugacuagcacccagguaaaug

SEQ ID NO: 4137697 - RNA, 57 nt, Human
cauuuacuacuaggugcaguaauaauccaggugacugcauguccacugguguaaaug

SEQ ID NO: 4137698 - RNA, 66 nt, Human
cauuuacuguugaaucccuagcaccugugguaauguagggauccuaguagguucagcacguauuug

SEQ ID NO: 4137699 - RNA, 128 nt, Human
ccacguggugggagcggggaugaucugggaacugcccggcuccagggggcauccacacagccuacggcucggauggugccccuggaugugugcuguucggcuuccaggccugggacucccccaaaugg

SEQ ID NO: 4137700 - RNA, 81 nt, Human
ccacguugugucacacguaucacacuagaaugcauucagcgucacacauuguugaauucauacaguggauaccacacgugg

SEQ ID NO: 4137701 - RNA, 102 nt, Human
ccacuacaagcacugcaugauuccauuuuuaugagcuaucaaaaauagucaaacucgaagaagcaaagaauagaauaaugguugucaggagcuugugggagg

SEQ ID NO: 4137702 - RNA, 78 nt, Human
ccacuacuguugggagcccuggaagcacaaagauggaucaaacaugccccuggcaucaagggacuuccagacaggugg

SEQ ID NO: 4137703 - RNA, 88 nt, Human
ccacuagaggaagaguaacaggagguggaacccagggauggccacaugcaaccuguuugucccaccucaugccucuucccagcuaugg

SEQ ID NO: 4137704 - RNA, 56 nt, Human
ccacuaggaagggaucagccucagccucacaucacugggccugucccucuuggagg

SEQ ID NO: 4137705 - RNA, 64 nt, Human
ccacuaggggcucaggcccagggauauccagguucugucccugagccccugagccucuggcugg

SEQ ID NO: 4137706 - RNA, 63 nt, Human
ccacuauugcuacauacuguaugggauuuagggauacugucaggagagugugugaaauggugg

SEQ ID NO: 4137707 - RNA, 111 nt, Human
ccacucaccccaucccccaguucacuuugcuugugggaucucccuguugcuccugccccuggguggaguggcgggccauccuacaaguacccagacacuugacaugagugg

SEQ ID NO: 4137708 - RNA, 77 nt, Human
ccacucagaugcugagcuguauggcugguccucagggagacuugaaagcuuagcucuaaggugucaggaucugaagg

SEQ ID NO: 4137709 - RNA, 58 nt, Human
ccacucccuuccgguccagggcaugucugcucugcuguaaaaugggaagggaaagugg

SEQ ID NO: 4137710 - RNA, 55 nt, Human
ccacucuuuacuguuggguuuuaggcuacuugccgaggucucagcuaaggagagg

SEQ ID NO: 4137711 - RNA, 73 nt, Human
ccacugaagggcccugcgggcuccuggaacucuugccuuugggaugggggccugcgagguucaacuucggugg

SEQ ID NO: 4137712 - RNA, 72 nt, Human
ccacugagcugaggcugugcugauggcaauacucuugcucuuccaaggugcagaucuucuugaagcucaggg

SEQ ID NO: 4137713 - RNA, 59 nt, Human
ccacugagggcggagcccagggaggacaucucucccuuccacuaucccccuacuggugg

SEQ ID NO: 4137714 - RNA, 65 nt, Human
ccacugcaaggcauuaccauggcuagagucacagaagucauugcaguccuauugccuuguuuugg

SEQ ID NO: 4137715 - RNA, 56 nt, Human
ccacugccgugggccuuggggacagaaguucuuaaaggcacugccaugguaagagg

SEQ ID NO: 4137716 - RNA, 61 nt, Human
ccacugcuccugaccaaggucacucccagcccccucugaagugaccgcaggcagggagugg

SEQ ID NO: 4137717 - RNA, 79 nt, Human
ccacugcugaaacaggcugagcguccaucuucacuccuuccugagucuuaagucaggacucucagcucauucuuuaugg

SEQ ID NO: 4137718 - RNA, 70 nt, Human
ccacugcuucuuaauaccuauuuucuaccaguaccaugaaaguacaauggugaacuguugagaagcaugg

SEQ ID NO: 4137719 - RNA, 75 nt, Human
ccacuggaugaggaaugauaguaaaagagaaugguaaucucagcaauuuuugaguaucaucauuucguccacugg

SEQ ID NO: 4137720 - RNA, 94 nt, Human
ccacuggcagaggaaacagauggagcagagcugaugggccucagaguagguuucagacaaggcuuuugcucuggcuccucuuccucuuccaugg

SEQ ID NO: 4137721 - RNA, 64 nt, Human
ccacugggagagacacuucugauuaucugugaccuauacaaauuaucaugauucuccccacugg

SEQ ID NO: 4137722 - RNA, 106 nt, Human
ccacuggggcuggggcuaggggaucuggcaggcggcagagcccaggcugagcagacucugagcagcucccgucagucagagcugaccugccaaucagcuucagugg

SEQ ID NO: 4137723 - RNA, 57 nt, Human
ccacuguauuuuggaagcagauaacuuaucuuuuagcuucacagaaucaauaguugg

SEQ ID NO: 4137724 - RNA, 93 nt, Human
ccacugucccuccuguguucacuucaccuuaucacaguucucaggagggccugggguaaugaacagguggcagagacagcaggaagagucugg

SEQ ID NO: 4137725 - RNA, 60 nt, Human
ccacugucgcuuucacacagguuagcuuggaagacaaaagagcuuugguuaagccagugg

SEQ ID NO: 4137726 - RNA, 81 nt, Human
ccacuguuugaggcccagaggaggggggucuuucugccauuugcggcagcagccuggccccuccucggguagcacuggugg

SEQ ID NO: 4137727 - RNA, 75 nt, Human
ccacuuacuagcuguguaagcuugguaagagccauuucuucucucugaucuuugguuugcacauguguaaagugg

SEQ ID NO: 4137728 - RNA, 84 nt, Human
ccacuuagaauacuagugaagucaucgaaaaaagugaugggcauuaacauuaacugguggcugcuuauaugguagauuaaaugg

SEQ ID NO: 4137729 - RNA, 58 nt, Human
ccacuucacauacuuaugauaaauaauugcuguucguagccacuaaguuguggagugg

SEQ ID NO: 4137730 - RNA, 68 nt, Human
ccacuucccagucugucaccugggccugaagagacauuuuaaagcccucugaucacacuggcuggugg

SEQ ID NO: 4137731 - RNA, 56 nt, Human
ccacuucuccuugcugcuauuggucauguggaccaggaaaugcuuggaggggcugg

SEQ ID NO: 4137732 - RNA, 59 nt, Human
ccacuucuugaugaaaaugguacuuguauacaaagacuagaugaguaucaagauagugg

SEQ ID NO: 4137733 - RNA, 79 nt, Human
ccacuugccccaggagcugcucagagccagucccaagggacccccagggagacugcagcugggagggcugggugagugg

SEQ ID NO: 4137734 - RNA, 65 nt, Human
ccacuuuucugucuccaucacaccgguuuucuagcuggucagaguggggauagagucuaaagggg

SEQ ID NO: 4137735 - RNA, 92 nt, Human
ccagaaaauauuauuagcaucauuaucaguccaguaaauuguuuuaaaaaccaaaaagacacuaguggaaauugauuugugguguuuccugg

SEQ ID NO: 4137736 - RNA, 127 nt, Human
ccagaaacccauuuuagacuucugacugcaaaacuguaagagaauaaauguguggugccuugagccaccaaauccaugguaaucuguuacagcagccauaggaaacuaacaugggccucauuccugg

SEQ ID NO: 4137737 - RNA, 78 nt, Human
caguggugccuuucaggcagagcuaccugggaacuucacccaagggccccagaaggcuugccaggaagcccaccacug

SEQ ID NO: 4137738 - RNA, 63 nt, Human
cagugguugguagauacuugagaauguaaucauugggcaugucucagggccaucuugccacug

SEQ ID NO: 4137739 - RNA, 60 nt, Human
caguguagacgguuauguauuuaggucuuuuaugggccacauuuccuaacguauacacug

SEQ ID NO: 4137740 - RNA, 92 nt, Human
caguguaggaagugguggguaggcagugcguccugccuccagucccugggaaggucccaggccgcucugccucuucugucccucucaugcug

SEQ ID NO: 4137741 - RNA, 66 nt, Human
cagugucaugguuuguuagcagcccgggaucguccaggaugggcccaggcuacaaauuaugcucug

SEQ ID NO: 4137742 - RNA, 76 nt, Human
cagugucauuucccuccuacaaagaggcacugcaaacucagcagguaugggugggcucagggaaugguuuucacug

SEQ ID NO: 4137743 - RNA, 58 nt, Human
cagugucugggacagaaagucacagcagccuguaugcugucacuugugccaggcacug

SEQ ID NO: 4137744 - RNA, 62 nt, Human
cagugucuguuucuaucucuguguuucccccccagcaccucagauaguugggcaugcagcug

SEQ ID NO: 4137745 - RNA, 71 nt, Human
cagugucuuuuccacaagcucuuuuccuauggccuuuaggggcacaugacuuugaggaaaccagacagcug

SEQ ID NO: 4137746 - RNA, 104 nt, Human
cagugugcagcuccccagguuucuccagacauccaguucucaagggguccugcugugauugggagaaaccgaggcuggggagagacuaaaagcuucugugccug

SEQ ID NO: 4137747 - RNA, 63 nt, Human
cagugugguagccacaagccacacacacuuuuugagcaauggaaauguggcugguccacacug

SEQ ID NO: 4137748 - RNA, 58 nt, Human
caguguguggauugcccuugcaagcuccuuggcccugcgcucuggcauuccggcauug

SEQ ID NO: 4137749 - RNA, 77 nt, Human
caguguucagagauggaguuagcagugacaucuggauaaaaaagauucacaauucuguuuuucaucucuuccccuug

SEQ ID NO: 4137750 - RNA, 76 nt, Human
caguguucccauggcacccagggcuggcgccgggcacauaacaggcacccucuggguaucuguggaaguaacgaug

SEQ ID NO: 4137751 - RNA, 65 nt, Human
caguguugaggucuucaggaucaggcucugggucuucagaaaccggguccagaucuucaggauug

SEQ ID NO: 4137752 - RNA, 73 nt, Human
caguguugggucuuuagaauuuauuuaaaagguaacacgguaccugcucuugguuugugaagacuuucaccug

SEQ ID NO: 4137753 - RNA, 69 nt, Human
caguguuguugauuuuuucugguugauuuggaaacgagagauggcaaucaggaaacuaucaacacauug

SEQ ID NO: 4137754 - RNA, 85 nt, Human
caguguuugaaggaaaaguuaaaguugagauguucauugaauaagaauaauguaucucagaaaguuuaauuuuucuugaacucug

SEQ ID NO: 4137755 - RNA, 82 nt, Human
caguuaacacuagcuguggccaauaguggaaaaggaaguauuacuuagaaaauuccaacuaggcacacagcugguaaagcug

SEQ ID NO: 4137756 - RNA, 71 nt, Human
caguuacagauauagggcgagcuuaggguaaacauaaauguugaaacugcagccaccuauauauugugcug

SEQ ID NO: 4137757 - RNA, 56 nt, Human
caguuaccaucuucagugaugaagccucguuuuucagugugaguuugugguaacug

SEQ ID NO: 4137758 - RNA, 71 nt, Human
cauuuaguaugcauuugacgggauauauuuuaugguucuaugaaguccugccagcaaauguauaagcaaug

SEQ ID NO: 4137759 - RNA, 61 nt, Human
cauuuauugaguggccacagugugucagguacuaggauacauuugggagcaaaaauagaug

SEQ ID NO: 4137760 - RNA, 77 nt, Human
cauuuauugcugcaaaauuguucuuugcuccagcauuuagccauaguugugagcauauuaguauugcacucuaaaug

SEQ ID NO: 4137761 - RNA, 98 nt, Human
cauuucacaggcuccaagugcuucguucuguauugggaacuugggagaaauucaaugccugucagaugaaguaauuguggaguaauugcugugagcug

SEQ ID NO: 4137762 - RNA, 111 nt, Human
cauuucacagugcugguugaauuauuugggcuagguugccacaugguguuccauguacaauucuccuugguaggcuggguuaaaaaauguggcuagguaaaaugugagaug

SEQ ID NO: 4137763 - RNA, 66 nt, Human
cauuucccccucauguugcagcgguuccccaucauuccaaaagcaagauuugacagggguggaaug

SEQ ID NO: 4137764 - RNA, 57 nt, Human
cauuuccucugagugagcugggagccaacagacgguuuugagcaaaggagggacaug

SEQ ID NO: 4137765 - RNA, 82 nt, Human
cauuuccuuuuaggauaugcauuuuuauacaucugacuuuaacugauaaaugacuguaaagagguguaucuuuauggaauug

SEQ ID NO: 4137766 - RNA, 56 nt, Human
cauuucgguagcuugaacuuuacaagguuaagccaugauuucaagauauugaaaug

SEQ ID NO: 4137767 - RNA, 67 nt, Human
cauuucuagacaaguccuggagcucccugcaggccggaaaaaggggccuccgggaaugucugacgug

SEQ ID NO: 4137768 - RNA, 97 nt, Human
cauuucugguuuucaugucuguuguaucugacauucuaaagaauucaaaauagauuguucuugaaggggauauaaauagaagugaugggccggcaug

SEQ ID NO: 4137769 - RNA, 113 nt, Human
cauuucuucaucccuuuuuucgaaguccuguauguuuucuccuuugguuggaggcuugaugugaacuaaagaacuggaaaacauacagucagacuuugaauggauguuaaaug

SEQ ID NO: 4137770 - RNA, 130 nt, Human
cauuucuuuaaauucucaauuuuaauuuguaauaugguaaauacagauagauuuaacccauguaaauaaaauuuauuuggggucuucugauuuauuagaguauaaauggauacugagaccaaaaguuaug

SEQ ID NO: 4137771 - RNA, 60 nt, Human
cauuugaaccuggauguucuuagcauggaagagcuuaacugguaacucuaggauuaaaug

SEQ ID NO: 4137772 - RNA, 110 nt, Human
cauuugacucaucacuggagugugcagauuacuuaaggaacuacaaugcgugcauucauucaguguauauuuuuugaguaccuguuauguuccaggcacuguguuaggug

SEQ ID NO: 4137773 - RNA, 76 nt, Human
cauuugacugugaacuuuuuggccuggauucuggagaacagauuuccaggauugucagccagaaggcagacagaug

SEQ ID NO: 4137774 - RNA, 80 nt, Human
cauuugagaagcuauuucuuucauuaguuucuggaaagccaaggugaauaguuauauuaugaaaguggcuugauuaaaug

SEQ ID NO: 4137775 - RNA, 111 nt, Human
cauuugaugcgcaauucucauuauccuuuagaaaauucauuccucagacugccaagaggcugcuggcagauguaguuuauauuaaacagaugguuagucugcaauuaaaug

SEQ ID NO: 4137776 - RNA, 79 nt, Human
cauuugauggagggacauaguuagcuuagagauacuugacaagguaucuccuucuuaucuguuucuaaacuaucaccug

SEQ ID NO: 4137777 - RNA, 56 nt, Human
cauuugauuccuuuacucuuauuuuuuaggaucucaagaguuagaggagacaaaug

SEQ ID NO: 4137778 - RNA, 62 nt, Human
cauuugccuuucgaaucaacaggaagucacuucuuccucuugaaugccaggaaggacaggug

SEQ ID NO: 4137779 - RNA, 58 nt, Human
cauuugggaaauaaaccuagaggaagauuuauaauuccagguuguguuuccaugagug

SEQ ID NO: 4137780 - RNA, 61 nt, Human
cauuugggcacagugaguugccuuuaguccagcuugguugucucacuuccugcccaccaug

SEQ ID NO: 4137781 - RNA, 83 nt, Human
cauuugguuggauuaauauauguacucuaauuugucucauugaucuccugucaauagauauuugaguuguuuccaauuuugug

SEQ ID NO: 4137782 - RNA, 63 nt, Human
cauuuguccugugauuucagggccugcucccucagccucaggcucugcaguccgggauagcug

SEQ ID NO: 4137783 - RNA, 68 nt, Human
cauuugucuucaauagagccucaauuugaaagaaagcuuucaaauuggcccugaugaagagucaacug

SEQ ID NO: 4137784 - RNA, 60 nt, Human
cauuuguuaauuacuauuaucuaugacugcuuugcaguaauaugacagaguugauaagug

SEQ ID NO: 4137785 - RNA, 129 nt, Human
cauuuuaaccaguuccccugacuccagccuuucugcucauuuuauugcauacacaaaugucagguuaaccugcagcacaguuguaguaaacagacaaaggcuugcgaugucuccacacugcccaggaug

SEQ ID NO: 4137786 - RNA, 79 nt, Human
cauuuuacuccugacugauuacauuacauauugauauuagugagcaucaguauguagugcaaucagucaggagaaaaug

SEQ ID NO: 4137787 - RNA, 77 nt, Human
cauuuuagccauucugauagguauguagugauaucucauuguaguuuaaauauacuuuucacuaauggcuaaugaug

SEQ ID NO: 4137788 - RNA, 91 nt, Human
cauuuuagucuuuuuaugguuuuauuuauguugagucagugagacaauucgcaugauucagauuauaaaaaguaugaaaggacuuagagug

SEQ ID NO: 4137789 - RNA, 80 nt, Human
cauuuuaguugggagaggccugggagaacuguuuuugccuuuaggcagacacacagauccugagguggcccagccugaug

SEQ ID NO: 4137790 - RNA, 94 nt, Human
cauuuucacaggcccacuugaaauggagcucaaucuuauaaguauagaagucuggggugagcgucuaggaauuucaacaggcacugagaaaaug

SEQ ID NO: 4137791 - RNA, 72 nt, Human
cauuuuccaggcucccugggcaguggcaggcuuccggcuaguuucuaccaaggggagcgcugaugggagaug

SEQ ID NO: 4137792 - RNA, 70 nt, Human
cauuuucugaguuuuuaagagugaaaugucaugauaucuaugauucaaauuaaguuaauucagcaaaaug

SEQ ID NO: 4137793 - RNA, 81 nt, Human
cauuuucuugguuugcauguggaaaagacugaugaauuauuaguuacaucaaaucuuuaacaugugcaaauuagucaaaug

SEQ ID NO: 4137794 - RNA, 77 nt, Human
cauuuugaauucugaugauacugcauuguaauuuaugauaguuauagugucagaaaaucauaagaaaaaacaagaug

SEQ ID NO: 4137795 - RNA, 101 nt, Human
cauuuugggaacaacugcuguggacuaacaccacaccauugcacuggauguagucugauguguggcaguuaaacuguuugcuaugguuuuuuccuggagug

SEQ ID NO: 4137796 - RNA, 77 nt, Human
cauuuuggguggucauguuaauuaugaucccuucccagccccaggggacaaagguugauaagacuaacccaagcaug

SEQ ID NO: 4137797 - RNA, 65 nt, Human
cauuuuuaggucauguuuuucuucucuguauauuuaucugugaagaauaaaugacauuaaaggug

SEQ ID NO: 4137798 - RNA, 64 nt, Human
cauuuuuuauagcaaugaacccacauugaucuaauagggagugagugcaaugcuauuaaaggug

SEQ ID NO: 4137799 - RNA, 57 nt, Human
cauuuuuuggaggcacuuugcagaauuaggguucuuuguuaugugcuucaagaagug

SEQ ID NO: 4137800 - RNA, 57 nt, Human
ccaaaacaauguaaugauucccagggaacgauggaaguccucaaugcauugucuugg

SEQ ID NO: 4137801 - RNA, 72 nt, Human
ccaaaagugaaguuaucuggugauauuuagaaaaugaaauguuuuucuguuuauuccuaggagcucaaaugg

SEQ ID NO: 4137802 - RNA, 64 nt, Human
ccaaaaugaaaauacucaaagcaguguaauuccaaccugaaugaguggauuuuucauuucuugg

SEQ ID NO: 4137803 - RNA, 128 nt, Human
ccaaaauucguucuucauauuucaaacaaagaugggaaagaguuguagucaaagcuauguuagcucgcuuguuuaaccaguacuuuacacagcucuugaacauuugcucuaugaacaacugauguugg

SEQ ID NO: 4137804 - RNA, 65 nt, Human
ccaaacagacugucggaaacacuguggguuaauuuacugccauguggccugcagcucugguuugg

SEQ ID NO: 4137805 - RNA, 74 nt, Human
ccaaacaguaguaugaaguuaccugugaugacgcuuucuugugauggcuauuuaauuuuaacugugcuguuugg

SEQ ID NO: 4137806 - RNA, 65 nt, Human
ccaaacauuuucacuucaggugguuucugaaagagggaaagacugaggggaaagugaugaugugg

SEQ ID NO: 4137807 - RNA, 89 nt, Human
ccaaacucaaaacuauucucuuacagagauaaacuguaagugcucuaaagaaagugaaaacagcucucuggggaaugcuugggauuugg

SEQ ID NO: 4137808 - RNA, 61 nt, Human
ccaaacuugaggagaugcugagaacagauuuucuaaaauuuguuagcauacucuaguuugg

SEQ ID NO: 4137809 - RNA, 55 nt, Human
ccaaacuuggggugcuggaugcagaauggacugcaagcagcugugcccuguuugg

SEQ ID NO: 4137810 - RNA, 63 nt, Human
ccaaacuuucaagauaauaggaaugaaaaauguagcauuuagauuccugugucuugaccuugg

SEQ ID NO: 4137811 - RNA, 65 nt, Human
caucuugugaauuucugauucuaccacaucacauaccucaguggcucaucagaacuucagaggug

SEQ ID NO: 4137812 - RNA, 87 nt, Human
caucuuuacugcccgucccuuugcucucgcgcugcuacaacgaggagagacugcagccugagucggggcuggggauggggggagaug

SEQ ID NO: 4137813 - RNA, 56 nt, Human
caucuuuauguguguguguaugugugucuacccacauacacauacacauaaaugug

SEQ ID NO: 4137814 - RNA, 77 nt, Human
caucuuucauguaauaggauguguuaauugaggauuuuuccuuuugacugaagccucauuagugagaauaauagaug

SEQ ID NO: 4137815 - RNA, 67 nt, Human
caucuuucauuugcagacucuuuggcggguaguuuuccccaaacugguaaucggcaagugagacaug

SEQ ID NO: 4137816 - RNA, 86 nt, Human
caucuuucucguugacauuuccugucuggaggucaaaggccuuguugccuuugaguuucacacagcgaaccacacagcuggagaug

SEQ ID NO: 4137817 - RNA, 59 nt, Human
caucuuugagacagcauuacccauggauacuaacuggaugauguuuggucacaagggug

SEQ ID NO: 4137818 - RNA, 73 nt, Human
caugaaacagcugugauuucuaucaugauuuguuauuuuuauauguuaugguagaauuuauaguuuugucuug

SEQ ID NO: 4137819 - RNA, 68 nt, Human
caugaaaucaaccauauauuugauggggguagggucagccuucauagauuaacuggaugagguucgug

SEQ ID NO: 4137820 - RNA, 79 nt, Human
caugaaaucuauuauguucccuuaagagaacaguuuucaaugagaaauugcugcauuuguaaggaacauauugaccaug

SEQ ID NO: 4137821 - RNA, 77 nt, Human
caugaacaagcacagguguacaaugcaugacagcacgugugaccguggguucgugcaccugcgaguuaaugcacaug

SEQ ID NO: 4137822 - RNA, 72 nt, Human
caugaacaauuugcucacugauuuauauucuguuauuuagugugaaauagcucagguggcagaguguuuaug

SEQ ID NO: 4137823 - RNA, 129 nt, Human
caugaacaggaagagaacagggucugggauugggguaaagaagggagucguuuuucucucaguccccauuucuuccccacccguccgucucagacuccaccguuuccucuccacuuuuccagaauugug

SEQ ID NO: 4137824 - RNA, 64 nt, Human
caugaacuguaacacucauacugaaguggguucucuccuggcuguaguguguuagagugaaaug

SEQ ID NO: 4137825 - RNA, 98 nt, Human
caugaacuguuuuggacaguguguggcaaacugggccugcaagaagggugaauuucuggggcaugcugaguuugccacaagaauuuaaaauuuuugug

SEQ ID NO: 4137826 - RNA, 117 nt, Human
caugaagauuuuguuccaugaaacauaaaagccugcaucuuuuuccaaguuuauuuuauacugccauaaggaaagugaguggaaugaguuguaggcuugacucaacaguagcucaug

SEQ ID NO: 4137827 - RNA, 90 nt, Human
caugaagcaaccucagagccuuaguucuccuagaaugcagagagaagcauucuggaagccaugggaacaggagcucgaggcugcauccug

SEQ ID NO: 4137828 - RNA, 57 nt, Human
caugaaggaaugaguauacuguuucuacuugcagaaaacgugugaucuuucuuucug

SEQ ID NO: 4137829 - RNA, 72 nt, Human
caugacagagcuauaauagagcuucagugauagcuucuugcuucauuuuccuaccuuguagcucaguacaug

SEQ ID NO: 4137830 - RNA, 79 nt, Human
caugacugggauguugcugcuguaaacagugguguccccauuaggggacaugugcagacagcaagcaggcucagugaug

SEQ ID NO: 4137831 - RNA, 81 nt, Human
caugagcacguucaugugugcaucugugugugugugugugugugugugcaugcacaccugugcacauuuguauguguggug

SEQ ID NO: 4137832 - RNA, 57 nt, Human
caugaggcaaggcuggccguguucccugggaacacuccaggucugacuugccccaug

SEQ ID NO: 4137833 - RNA, 116 nt, Human
caugauaugggcauaucauauuuuauguaucuguucaucaguuaaugggcacauggauuguuuccacuuuuuggcuggugaauaaugcugcuuugaauauuuguguacagauuuug

SEQ ID NO: 4137834 - RNA, 84 nt, Human
caugaucauuggauuuuguagugcuuuuguaguucaugggaaacccaugaaacagcuaucaguagacugcaguucaaauuuaug

SEQ ID NO: 4137835 - RNA, 130 nt, Human
caugaugcaggaugaguuuugagagauaaaccaugaaggacuuaggccuugcuaagcauuuuggccuuuuucccaaaaguacaggaaagccuagccauuuuauuauuuuauaccacccauccauuacagg

SEQ ID NO: 4137836 - RNA, 130 nt, Human
caugauguuccucugccacauccuaggacauuguucccaucugcacaguugaaguugggguaccaccagcuccagauuccugcuggcagaaaaggggauaugaauauggaagaagcacaaccagcgucug

SEQ ID NO: 4137837 - RNA, 80 nt, Human
caugauuuugcacaacacagggacucccaggagaagagcaagggagcuauucaaucugccuuucccugucuguguuuaug

SEQ ID NO: 4137838 - RNA, 56 nt, Human
caugcaaaggucaagaucaggagaaggaaggaauuccuccugaucagccuuugcug

SEQ ID NO: 4137839 - RNA, 85 nt, Human
cauuuaaucauuuggauauucacggauuggaguucuuuaugucacuacagacaggacagcaaccguuauucacacuaguugaaug

SEQ ID NO: 4137840 - RNA, 66 nt, Human
cauuuaauuugcuguugcuuaguuucauuaucccugauaugaaucaagugagaacagcaucaagug

SEQ ID NO: 4137841 - RNA, 60 nt, Human
cauuuacccucuguaugcauccucuagaaaaacauggaaauguaaucacagaggguuuug

SEQ ID NO: 4137842 - RNA, 68 nt, Human
cauuuacuuaaaucuuuacaagagagagggaagauaaucuaaucagauuguaaagguuuagaagaaug

SEQ ID NO: 4137843 - RNA, 115 nt, Human
cauuuagcaauauauguagucaauaaacauuuaugauugagguaaauauacacuagucacucaauaaaugcccaaugaaugaaugaaugaauggcugauuauauguuucugaaug

SEQ ID NO: 4137844 - RNA, 89 nt, Human
cauuuagcuucagguugucuuguuucuguauauaaugacagcauucugcugccaucuuagccguggacaaugggggaucagcuggcaug

SEQ ID NO: 4137845 - RNA, 72 nt, Human
cauuuagguuuugaugauaguggaauuaaauguagcacauuuaauugaacuaacaugcaaacaucuuuuaug

SEQ ID NO: 4137846 - RNA, 57 nt, Human
cauuuauucauuugcuagggcuagaggcuuagcacagucccuggcacauggaaaaug

SEQ ID NO: 4137847 - RNA, 55 nt, Human
cauuuccacucugggagucagauuugaggcccugauguggcugccaggagaaaug

SEQ ID NO: 4137848 - RNA, 75 nt, Human
cauuuccucccaggccugauugggaaucuugcaccggcaucgcgagccccgcucuucggccuccaggagcgagug

SEQ ID NO: 4137849 - RNA, 61 nt, Human
cauuucuaagaagaucuggguaaucaauuauuagcaugccaagaucuuuucuauagaagug

SEQ ID NO: 4137850 - RNA, 73 nt, Human
cauuucuauauggugaugaacuucaggcuucagguuucuuauugcuugagcucuccucaucacccuggcaaug

SEQ ID NO: 4137851 - RNA, 57 nt, Human
cauuucucacuuucuguucaucuggaauaucuucugaggaaagagagugggauguug

SEQ ID NO: 4137852 - RNA, 87 nt, Human
cauuucucagggucugguccuuagauuugaaagaacugggaaguaaaaaaauuggauuuugaaacuaagaaccaggccugagaaaug

SEQ ID NO: 4137853 - RNA, 87 nt, Human
cauuucucauuucuccucccuaacucaugaugagugguaggccugaucccaucagccaugaguggggagggcugagcugagggcaug

SEQ ID NO: 4137854 - RNA, 57 nt, Human
cauuucuccgccgagaucacugaggcagggagcaggugagucgggggcggagagaug

SEQ ID NO: 4137855 - RNA, 77 nt, Human
cauuucugaugacuggauggccccacuggauccaugacucuugacucaacugguccuauggccacuacucagaagug

SEQ ID NO: 4137856 - RNA, 76 nt, Human
cauuucugcucuaaucucuagcccaugcaaagacauguuuugugucuuuuucauucuuagagguugcacugaagug

SEQ ID NO: 4137857 - RNA, 130 nt, Human
cauuugaagcuucugagaauuuuuagcaauaaaugggaaagguacacucucauuuuugucuuggacaaaaugcugaguuuugauagaguguugccucucaauuauagcuuuuacuguuugagcuucaucg

SEQ ID NO: 4137858 - RNA, 84 nt, Human
cauuugaaguugacguacaaguauucaugacauugcauaugcaguggaaacacucagcucaugauucuguaugagaagcaggug

SEQ ID NO: 4137859 - RNA, 57 nt, Human
cauuugaauggcauuucacuuugucgucugggauucugugaaaaauccguucugaug

SEQ ID NO: 4137860 - RNA, 86 nt, Human
cauuugacuacaaugaguaauuucugagaaaggauagugagggagaagaacuuuucugucagcgucagaaauucuuaagucugaug

SEQ ID NO: 4137861 - RNA, 83 nt, Human
cauuugcgaaagugcaaucugaugaguaaagcacuaugggaauaucauagugcauuuuauuaucagcaacauuuuugugaaug

SEQ ID NO: 4137862 - RNA, 72 nt, Human
cauuugcuggggucuugggaguuaaagccaaguaaacuugagacaacucacuuccaguugcuucagcauaug

SEQ ID NO: 4137863 - RNA, 72 nt, Human
cauuugcuguauuuucagauucacuuaccuauauagcagaguuuaguacuuaucuggaagaacugguaagug

SEQ ID NO: 4137864 - RNA, 60 nt, Human
cauuugcuucugugaaaucaaguucuccaucaaguggaacaugacuauaggagucaggug

SEQ ID NO: 4137865 - RNA, 87 nt, Human
cauuuggcagucaguauaauagaguggaaaaaccuuugguuugaaagaacuguauucuagucauguuugucacugucuagucaaaug

SEQ ID NO: 4137866 - RNA, 60 nt, Human
cauuugguguuaggcauguuaaucugauaaccacggauacaggcugcuuccaccaauaug

SEQ ID NO: 4137867 - RNA, 58 nt, Human
cauuuguaggaugcuucuuguuuguaagcuggcauacuugaaguaguccuaauaaaug

SEQ ID NO: 4137868 - RNA, 59 nt, Human
cauuuguagggagaagccuuguugaacgcuagcaggugcguuacuucacucuccagaug

SEQ ID NO: 4137869 - RNA, 55 nt, Human
cauuuguauagugcuuagaccagcaucugguaucuuuuuaagugcuaugcaauug

SEQ ID NO: 4137870 - RNA, 55 nt, Human
cauuugucuuugagugcccugcucuuuccacugaagagcccacagaacacagaug

SEQ ID NO: 4137871 - RNA, 70 nt, Human
cauuuguuucagcuauucaguaccuuacacagaaaaauguguuaauaguguacauaguuaggaacaucug

SEQ ID NO: 4137872 - RNA, 82 nt, Human
cauuuuagucgacauauguuuguuaucagagagaggugcugugaacacacagccauuuucuuagcagcuuuuugacuguaug

SEQ ID NO: 4137873 - RNA, 104 nt, Human
cauuuuauaccugaagaaacugaaucuuagaaagaugauaggacuugcuuaaggccucuuagccaguaagaauaugaaucaggauuuauucuagguaggaaaug

SEQ ID NO: 4137874 - RNA, 120 nt, Human
cauuuuauuuugcauacagagucuuugagucaggaaauuagacagcaacuagcagggguggcuagccucugcucccuggugucugagaccucagcuggaaagacuugaaagcugagaaug

SEQ ID NO: 4137875 - RNA, 67 nt, Human
cauuuucaagggcagggaaaucauuucaguuaggaaccuuagaugguguccccagccuuugaagaug

SEQ ID NO: 4137876 - RNA, 56 nt, Human
cauuuuccuagucaugugcuucucuggauugccacagagacacuggauggaaaaug

SEQ ID NO: 4137877 - RNA, 76 nt, Human
cauuuuccuuucuccagggacugaggcuggagucccuggaugggcccagccuggugcacugugggguaggaaggug

SEQ ID NO: 4137878 - RNA, 73 nt, Human
cauuuucgccuuguuaucaagcuuaucuggcaucauuugcaagaacucagaauagggugcagggcgugggaug

SEQ ID NO: 4137879 - RNA, 68 nt, Human
cauuuucucaagauccaaugcacucacucaucuguuuuuugaaagagucuuuguauuuugaaagagug

SEQ ID NO: 4137880 - RNA, 116 nt, Human
cauuuucugccauacuauaauaaggcaguauaggucguaugucuuucuaguaucugccacauaguagaugcucuagacauacuggcuauguccagucuucaugguauuagauagug

SEQ ID NO: 4137881 - RNA, 68 nt, Human
cauuuucuuguuuuagucacaggacuuuacaauaauaauaaaggaaccuggaguagagggaguggaug

SEQ ID NO: 4137882 - RNA, 66 nt, Human
cauuuugagucuuuucauuguguggauuucuuaacaaguuguuuuuacaagaaaagccucugugug

SEQ ID NO: 4137883 - RNA, 62 nt, Human
cauguacuuaucccaugagaagaagaaaauaaaaucuuuuucauucaaaaggaaaagucaug

SEQ ID NO: 4137884 - RNA, 73 nt, Human
cauguagaagcugcggaagauuggugaguuacucuuuaaaaaaccaauuucuuggcuuccaaaucacuacaug

SEQ ID NO: 4137885 - RNA, 68 nt, Human
cauguagaguccauuaaugcaaguuucuuuaacuuuguguuuaugaaauaggcaaaugcuucugggug

SEQ ID NO: 4137886 - RNA, 76 nt, Human
cauguaggguaaguuccugacauugccauggcauuuguaaacugucauggugcuagcgggaaugucucuuagcaug

SEQ ID NO: 4137887 - RNA, 74 nt, Human
cauguauaguuuaaaaguuagggaugaucuauaauauaguaugaucauuuucuaaaauuuuugaaaacaauaug

SEQ ID NO: 4137888 - RNA, 58 nt, Human
caugucagcaucaaaaauuaugagucguguugauaguaugaacuuuugaugugacaug

SEQ ID NO: 4137889 - RNA, 85 nt, Human
caugucauguagccuugaugcuuucauucucucuggaccacaacagagaugcccuugaaaggauuagcaguuugacucugacgug

SEQ ID NO: 4137890 - RNA, 58 nt, Human
cauguccauuuaugcacagaaaaggcuagcucugagcuucauggcaagaauggaaaug

SEQ ID NO: 4137891 - RNA, 80 nt, Human
caugucugccugcaagaaguccucucuggguggcagccucagccucucaguuaugagggcuuguuagcacacacaccaug

SEQ ID NO: 4137892 - RNA, 62 nt, Human
caugucugucuccgugaauaggccuuccuuaguugggaaagucauuuaaaagggaacacaug

SEQ ID NO: 4137893 - RNA, 77 nt, Human
caugucuuauuuaugcuucuuacuccccaugaugaagaaaaccagcuccgaggggugaggacauuggucaggacaug

SEQ ID NO: 4137894 - RNA, 86 nt, Human
caugucuuuuuuguggcucuuaguuuaucuuugacaaaguuaauauauuaugcugaauuuaacuugggaaagacaagaaggaaaug

SEQ ID NO: 4137895 - RNA, 109 nt, Human
caugugaaagacucuguacuugggucugaccuugagccucaggugggucuggcucagcugaggaugccugccuguuggcugaggugcaaacucagggagcagacacaug

SEQ ID NO: 4137896 - RNA, 96 nt, Human
caugugauuuugguaggaagcugacaguguguaaaggaugguggguguuuagguauaugcacaggacacugcagcaucagcuacggaaauuagaug

SEQ ID NO: 4137897 - RNA, 58 nt, Human
caugugcaauaauaccucaauuacugaaacucaucggaaaugaguuauuuuguauaug

SEQ ID NO: 4137898 - RNA, 57 nt, Human
caugugcagcuucuucagcgagaucucacacuccaucacacuggaggagcugccaug

SEQ ID NO: 4137899 - RNA, 81 nt, Human
ccaugggaaucccagcuuuggaguguuguugcuguugcugcuuagccagaauuuaaauugcaguggcugauguuuccaugg

SEQ ID NO: 4137900 - RNA, 129 nt, Human
ccauggggguuuuggugggauucuggguaggccaggaagcaguguggcuaggaagagaccuccaggcaaaguugacgcugucacccagauggccuauaauccaggguaguaaacucagacgcuugcagg

SEQ ID NO: 4137901 - RNA, 82 nt, Human
ccaugguauucuggcaggagaacaccagguagaaaggaaacuggguccuaaggcuuggacuucuccaacccugauauagugg

SEQ ID NO: 4137902 - RNA, 56 nt, Human
ccauguaacuguagcuaaccgaugagagcaagcucuccuccuagauacagucaugg

SEQ ID NO: 4137903 - RNA, 69 nt, Human
ccauguaugagguaggacaucaggaaaugcuggacagguuaauuucguguguguucuacuuaaguaugg

SEQ ID NO: 4137904 - RNA, 55 nt, Human
ccauguggcaggaagguguuuccucugaagcagggcaaacucugaaggccacugg

SEQ ID NO: 4137905 - RNA, 58 nt, Human
ccaugugugcuaauguaugcucuaagaauaaaguuuuuaaagcaguuuguauacaugg

SEQ ID NO: 4137906 - RNA, 64 nt, Human
ccauguugucaaacuuagaguagaugaccucucagucccuuucuauuuaguuuuacaaaugugg

SEQ ID NO: 4137907 - RNA, 64 nt, Human
ccauuaaagcaccacuguaauaauuguuucuggcaagauccaucagugguugcugaauuagugg

SEQ ID NO: 4137908 - RNA, 61 nt, Human
ccauuagaauuccacagcugcacagagguguuccacacagucucagcaaguggaaggaugg

SEQ ID NO: 4137909 - RNA, 56 nt, Human
ccauuaguaccucuggaaaauugacgcuccguucucuauauucagagggcuaaugg

SEQ ID NO: 4137910 - RNA, 72 nt, Human
ccauuaugaauccccaugccaggccacaaugugguuagcccacagguggaaacaugguguuggguuuuuagg

SEQ ID NO: 4137911 - RNA, 97 nt, Human
ccauuaugucuugguggaaauauagcaauuaugccuacuagccucucgaacaaugcuaaugggcauaauuguucauauuuccaccaagacaugaugg

SEQ ID NO: 4137912 - RNA, 92 nt, Human
ccauuaugucuuuaguugcuuagauuugaucuugacccggggcugaugaagaggagcugggcuugcagcucugagacugaggcuauggaugg

SEQ ID NO: 4137913 - RNA, 80 nt, Human
ccauuauugcuucuuauguagugacugacuguuagguaggcugauucuuuuucauauugcaaacuuggggagcaugaugg

SEQ ID NO: 4137914 - RNA, 79 nt, Human
ccauucagagcuuuuacuuacauucuaugccagaaaaaaauucccuuuagggccuguagcuuguaaauagugcucuggg

SEQ ID NO: 4137915 - RNA, 92 nt, Human
ccauucaggacauauuuauguacccuuuuuuaugucaagcauugugucaggcacuugggagacacaagaagacauggucuguguccuggagg

SEQ ID NO: 4137916 - RNA, 58 nt, Human
ccauucaguaugucuauucucugucucauuccaggacagaguacagugugcuuagugg

SEQ ID NO: 4137917 - RNA, 86 nt, Human
ccauuccacuuagucucaccaguucaguuuuccuucaucugucuauuuuacuggaagacagaacugugugaugauuaagacccugg

SEQ ID NO: 4137918 - RNA, 88 nt, Human
ccauucccccacgcugacugugcuccuugaggacagagcgcccuugguuagaggcagaucugcaggagcagggcguggagggugaugg

SEQ ID NO: 4137919 - RNA, 60 nt, Human
ccauucuaaaguucaagcaagggcaugguuaguaaaauaccagcucuaauuuuagaaagg

SEQ ID NO: 4137920 - RNA, 109 nt, Human
ccauucuggcuagacuguuguuuaucaaauagaguaguagagucuauuuaacucugaauauuacuugauuugaaaaucauagcccuuuuauuaauuagcccugacuugg

SEQ ID NO: 4137921 - RNA, 63 nt, Human
ccauugaagcuugagugucaguuccucuuggaagaggaucuugaacccuacaggcuuaguugg

SEQ ID NO: 4137922 - RNA, 86 nt, Human
ccauugauaguuuucaugaaucguggaaugauuuaucuuuucagaaacagauaaaugguuccgugauucaugaaaacuaccagugg

SEQ ID NO: 4137923 - RNA, 99 nt, Human
ccauugcccuguguggagagagacuggagugucuuuaggguucuaccugcuagagucccagggacacuccagacuuggaaacugcacgugguucaaugg

SEQ ID NO: 4137924 - RNA, 70 nt, Human
ccauuggaggcuauuauuuuuaugucaaggacaacaaaccugaggcuuagauuugguaacucgccaaagg

SEQ ID NO: 4137925 - RNA, 72 nt, Human
ccauugggguucacaacacccggcuguccccagacuuguguccagggaagauaguguugagggcccucaagg

SEQ ID NO: 4137926 - RNA, 129 nt, Human
ccauugguuauuugauucacagacaauucccauagagcuauaagaauuuuguguuuuccuagaaagucacauauuugaugaagcuuuguuguuuucuguguccuuaacaaaugacauucaguaaugugg

SEQ ID NO: 4137927 - RNA, 58 nt, Human
ccauuguaaagaguauacuuuguuucaaaacagaaaaauguauaugucuuuagggugg

SEQ ID NO: 4137928 - RNA, 62 nt, Human
ccauugugacuuuauuucgaaauggggucuuugcagauauaaucaagaugaggucauacugg

SEQ ID NO: 4137929 - RNA, 99 nt, Human
ccauuuaaaaagacaaaaucugcuaugcuauucuucagaguguucuuuggguacaauaugaaugcuuugggaauucagaauaguaaguuucuuucaugg

SEQ ID NO: 4137930 - RNA, 65 nt, Human
ccauuuaaaugacuuuuauuauucucauaugaguuaagaugggagaagauuuggcauuuaaaugg

SEQ ID NO: 4137931 - RNA, 56 nt, Human
ccauuuaauaucucacacuuccaugccuggauugucagguaggugauaaugagugg

SEQ ID NO: 4137932 - RNA, 83 nt, Human
ccauuuagugagugugaaucaaaugcuaggcaccagacugaugcuuucuuuuugcuauuucauuugauccucacaauaaaugg

SEQ ID NO: 4137933 - RNA, 65 nt, Human
ccauuuauagauguauuuggcugucaguuaccuuugacuguagaagcaccuuacagcuauaaugg

SEQ ID NO: 4137934 - RNA, 65 nt, Human
ccauuuauguaacagugccgccauggauaaaguggacguaauaccuggaugcugcacguagaugg

SEQ ID NO: 4137935 - RNA, 82 nt, Human
ccauuucauugccuguaaagugaguggaugcuugcuguaccccugucauaaaguuuuauaggcucaaauaaaaugaaugugg

SEQ ID NO: 4137936 - RNA, 99 nt, Human
ccauuuccaaguagaguauucagguuagcauuaagacuucauuaguaauauggugcaugcuguuaaaauguggucuuaaaauuauaccuguguuaaugg

SEQ ID NO: 4137937 - RNA, 100 nt, Human
ccauuuccuccagggccucuuuccuggcuuuugggcuaauucaguauucagugagaaggggguauagaucagggguugggagaauggcagcuggacaugg

SEQ ID NO: 4137938 - RNA, 85 nt, Human
ccauuugccaaggcuguuauauuuuugcccaugaggaauuacucaauuuuggucauguaguagagacagcuuuguagacaaaugg

SEQ ID NO: 4137939 - RNA, 65 nt, Human
ccauuuggaauggauguccuagaggucucaggaacuaagccugaguuggggcauccaccgaaugg

SEQ ID NO: 4137940 - RNA, 70 nt, Human
ccauuuguaugucggugcuguuuugagugcuacccccugcugguggggcuuucauacagcacacagaugg

SEQ ID NO: 4137941 - RNA, 55 nt, Human
ccauuugucaccucugcacuccauuugucacagagucccaguggugggcugaugg

SEQ ID NO: 4137942 - RNA, 60 nt, Human
ccauuuugagggggguagggucaagcucugcaacuugacaaagccucauccuucagaagg

SEQ ID NO: 4137943 - RNA, 115 nt, Human
ccauuuuuaaaauaaagacuuuaaaaaucacuagcacaagauuggcacauaauagguaaccaguaaaugaugucuaucuuuguaguauuugcuauuguuauuugaguauagaugg

SEQ ID NO: 4137944 - RNA, 66 nt, Human
ccauuuuuaggauuuuuugguuguucucaaagguuguuccuuuaaaacuaaggaacugaaaaaugg

SEQ ID NO: 4137945 - RNA, 129 nt, Human
ccauuuuuuucaaaauuacauagaaagaagauguagucuuaagggggguggagggacaaacuuccauugaguaccuggagacacugcguguacaucuucaucuccacaguaggcacgugagguaaaugg

SEQ ID NO: 4137946 - RNA, 65 nt, Human
cccaaaaauuagauacacauauauuauguuuuggaaauauguguacaguauacugguuucuuggg

SEQ ID NO: 4137947 - RNA, 67 nt, Human
cccaaacaguggcaagaacaguaauaaugauuauuuuaguucaucuuuacacugcacuugcuauggg

SEQ ID NO: 4137948 - RNA, 59 nt, Human
cccaaaccuaggcagaguuccgugcgugauucacaacuuuggaggccugcagguuuggg

SEQ ID NO: 4137949 - RNA, 65 nt, Human
cccaaacucaagucuaugaacaaggacauucugguguggccuuguuccguaauggccuugguggg

SEQ ID NO: 4137950 - RNA, 80 nt, Human
cccaaacugaacuuucuugcugcagacucuugguuugcuuaugaaccaagugaguacuuggcagaaaccaaguauauggg

SEQ ID NO: 4137951 - RNA, 73 nt, Human
cccaaacuggagcguggguccaaggcucugguucuaucccagggaucaaagcagcauggcccaguccaauggg

SEQ ID NO: 4137952 - RNA, 64 nt, Human
cccaaagaguuagguccacaagaucaaugcaguaauugcaugugaucuggggcuucucccuggg

SEQ ID NO: 4137953 - RNA, 57 nt, Human
cccaaaggagagugagucagaugcccugcacaccagccaggggcuccuccccugggg

SEQ ID NO: 4137954 - RNA, 69 nt, Human
cccaaaggcugccuguuccaaucuccuucccugcuagggacaaggcaaagagagagaaggaggccuggg

SEQ ID NO: 4137955 - RNA, 63 nt, Human
cccaaagugcugguauuacaggugugagccacugugcccggccuguuuuaucaguuuuuaagg

SEQ ID NO: 4137956 - RNA, 100 nt, Human
cccaaauaaaaaucuacccacaaucuuagagagauucuuuuaugauguauugggguaaauguguggaagguuucuuaagguucuagggagggaguuuggg

SEQ ID NO: 4137957 - RNA, 75 nt, Human
ccagacccuccacucacugcuguguuugaaccagggcaaagaaacacucagcaccugacuggagcuucgguuugg

SEQ ID NO: 4137958 - RNA, 57 nt, Human
ccagacuccagggcuccaucccuugucagcacagagaagcugggagccuggggaugg

SEQ ID NO: 4137959 - RNA, 90 nt, Human
ccagacucuucaauccucacuucugaauccaaguggcuaaugggaaccuuaucuuucugcccuguucaagggaugauugaccagagcugg

SEQ ID NO: 4137960 - RNA, 87 nt, Human
ccagacuggggcuccuugagggcaggggccaagcucccauccaaggggaggcaagaaccugccacucgggcagggcuucagaacugg

SEQ ID NO: 4137961 - RNA, 68 nt, Human
ccagacuuucaagcaagaacacuuugagaugauaagucuuguauuguuuuaggcuaugaaguuucugg

SEQ ID NO: 4137962 - RNA, 73 nt, Human
ccagagacuggaagaugggggcuuaauacuucucaaugauuacaugucaaagagauggcucccaggucucugg

SEQ ID NO: 4137963 - RNA, 68 nt, Human
ccagagagcuacaaggcauaaauuuagauuucagaacauuuuuuaugaaccaacaugauggccucugg

SEQ ID NO: 4137964 - RNA, 72 nt, Human
ccagagauccaugcaauacaguuuauaguaauucuucauuugcaauuugacaaguugcauguuuccaucugg

SEQ ID NO: 4137965 - RNA, 90 nt, Human
ccagagcuggugucaaaugucagauucuguuagagcugaaggggccucuggcuugucucagggucugauugaccuugggccagccccugg

SEQ ID NO: 4137966 - RNA, 64 nt, Human
ccagaggagggacugugagcucuccaggccgcuuccucggaggaggaguucccagcccuccugg

SEQ ID NO: 4137967 - RNA, 55 nt, Human
ccagaggcugauggcuguagccaugcugagcugauggcuggagcagaggcucugg

SEQ ID NO: 4137968 - RNA, 84 nt, Human
ccagaggcugcacccagugcucccgcugccgcugugaagcacugcccacaggagggagcgggcagccagcuggggcugccaugg

SEQ ID NO: 4137969 - RNA, 84 nt, Human
ccagaggucaggaguggcccugugaacagcgcagucccgugguacagugggagggugcuguggcugggccggucuggguccugg

SEQ ID NO: 4137970 - RNA, 55 nt, Human
ccagagguggugggugcuacaggagagggacuccagcaagcuucucauccuuugg

SEQ ID NO: 4137971 - RNA, 73 nt, Human
ccagagucuuugggcaaaagaguuucccagugcccaggcugggucggaaugcucuuugguccuagacuccugg

SEQ ID NO: 4137972 - RNA, 72 nt, Human
ccagagugggagaguagcagaaggaugagagaguguccucucucauuucuccgaccugcugucccuuuuugg

SEQ ID NO: 4137973 - RNA, 59 nt, Human
ccagaguguguucgaccuuccagagucuucuuucuaaaggcucuuuggacaacuacugg

SEQ ID NO: 4137974 - RNA, 75 nt, Human
ccagauaacuuuccauuuccaaccaagccuauucuuggucaucuugaguuagaagugcuuugggauggagucugg

SEQ ID NO: 4137975 - RNA, 64 nt, Human
ccagauagucaucucuucuacaauaugggaacuauucucagaugauuguaggaugaaaaucugg

SEQ ID NO: 4137976 - RNA, 55 nt, Human
ccagauaucacugccguguuguuccacuaguuuaacaauaugcucagugguuugg

SEQ ID NO: 4137977 - RNA, 85 nt, Human
ccagauaucgugguugcauugaaaauauauuuuaaaguacaaacgcuucuugagauauaguuuuaguuuuguucacuaaaccugg

SEQ ID NO: 4137978 - RNA, 66 nt, Human
ccagauauucacuuuuacaugcaguaaauuguuuaucaucaauagcauguauuagaugauaucugg

SEQ ID NO: 4137979 - RNA, 65 nt, Human
ccagaucuccgggggcccacgcagccccgcacgccagggcucugcuggaaguucucuggaaaugg

SEQ ID NO: 4137980 - RNA, 90 nt, Human
ccagaugagauaaugacgcagaagggccuggcgugccgagggcagaaggccuggucacugcccucccuuuugcacuuacuuguugugugg

SEQ ID NO: 4137981 - RNA, 67 nt, Human
ccagauggggcucaguguggaggccagacagaggugugugccucccagugagcugggcccugccugg

SEQ ID NO: 4137982 - RNA, 55 nt, Human
ccagauguauguaugagugcauaaucaugguuaugugauuagcugaauacacugg

SEQ ID NO: 4137983 - RNA, 130 nt, Human
cccaucuuggagggcugugcuauagaauaagugaggaagugguuguaugguuuccaucauauauuagcugcuugauggacacuggauaacccuguuggcucucuauacugucccagguacaagaauauag

SEQ ID NO: 4137984 - RNA, 64 nt, Human
cccaugcaacaaaugcuacgaaucgcucgcugucgauuuagaagcauuugugguggacgauggg

SEQ ID NO: 4137985 - RNA, 108 nt, Human
cccaugccagauguuaccauaagcuuuguuauuguuucuugaucaaaccaagacuaugguaauuaggaaacugaaugucagaacuguguuauuauugauuaaaauggg

SEQ ID NO: 4137986 - RNA, 71 nt, Human
cccauggaauaguucugaaaugcuugggaaauaauccaaggcacagaggcagggcacuuguauuuuauggg

SEQ ID NO: 4137987 - RNA, 55 nt, Human
cccauggcaauaaggucacagguccagaggacccuugugcugcggugcccguggg

SEQ ID NO: 4137988 - RNA, 89 nt, Human
cccauggccacucccucacucuuucuuucuuggagucugggauuccucucuguuucuauaaagacaagaguuuucagaguguuuauggg

SEQ ID NO: 4137989 - RNA, 60 nt, Human
cccaugguauaagcuggggagauuuacaggaccauguguccugggcccaggcugccaggg

SEQ ID NO: 4137990 - RNA, 60 nt, Human
cccaugugucuccccuggaaguagaaguagaagcucuuaugggaagcagaggcacguggg

SEQ ID NO: 4137991 - RNA, 72 nt, Human
cccauuggucaucaugcuugggucuagcucugguccugccacuaacuagcugugugaugggaaaccuuuggg

SEQ ID NO: 4137992 - RNA, 62 nt, Human
cccauuuuacagauguaggaacugaaguuuggaaagcugaaguaacucacaucguuaguggg

SEQ ID NO: 4137993 - RNA, 121 nt, Human
cccauuuuguaucugacucuuucuaauaguagggcuggagccugaggccagggaccuccacucuaccccucagggucucucacagcaccuggcaugagaaaggcucaggacagauaugcgg

SEQ ID NO: 4137994 - RNA, 63 nt, Human
cccauuuuugugugaguaaugaagaauggagggaauuauuuccauacuuauuagaaauauggg

SEQ ID NO: 4137995 - RNA, 129 nt, Human
ccccaacaugugcuuuccagagccucagauguuuccuuaguucuacagaugguuuguaaauucauuucagcucaauuugccagugcugcagaaaguaucuauggcugauuggagucacaguuuggacgg

SEQ ID NO: 4137996 - RNA, 108 nt, Human
ccccaacuaagguccaacaagaugugugagugaacaagucuuuagaucuuuccagcccuagcuggaacuaucugccuguauuuaccaucauugcuguaccuguugggg

SEQ ID NO: 4137997 - RNA, 60 nt, Human
ccccaagccucauguuugccagaguugcuuagcuuacauugugugcaugaggggaugggg

SEQ ID NO: 4137998 - RNA, 70 nt, Human
ccccaaggaucuugcggcccgcagcgcccucugaguuuaucuagcuguccacaggccacagagcuugggg

SEQ ID NO: 4137999 - RNA, 70 nt, Human
ccccacaauucucccucaucgccucuuucauugccacucuuugaagcguaaauaaaugaggcauuugggg

SEQ ID NO: 4138000 - RNA, 88 nt, Human
ccccacacaugcuccucguagccauggcucuggcacagugccaggugcuggccucagagggucaugguggugcuggcgcugucugggg

SEQ ID NO: 4138001 - RNA, 57 nt, Human
ccccacagccgccagcagggagcucccuuucggcucggccugcgcggucgcuggggg

SEQ ID NO: 4138002 - RNA, 74 nt, Human
ccccaccagccaggccacucccggguccugcccaccaugggugcccagaaccuggagggcuugcccaggugggg

SEQ ID NO: 4138003 - RNA, 82 nt, Human
ccccaccugcucagagccagccugggugcuggaaccacacuugccucaggacccugggcuugcuccuggggaaagagugggg

SEQ ID NO: 4138004 - RNA, 88 nt, Human
ccccacucaggaaaccuugacuucugaauuccuaucagguccagaggguggaaggcccuggcaggaagcaggaggaggaggagagggg

SEQ ID NO: 4138005 - RNA, 58 nt, Human
ccccacucucggccagauaggcucuucucggccugauucugagaagucaaggaugggg

SEQ ID NO: 4138006 - RNA, 72 nt, Human
ccccagaauacuuccuguguugcaucguuaaauaucaacugagcaggagcagcucaagaguaguucgagggg

SEQ ID NO: 4138007 - RNA, 128 nt, Human
ccccagauaggccgaaguccccuccugagugcagguggcaggucagagaggggcaggaaaguucuucugaggucucaugacuugcauaaggccuugaggcacucaccuggggaaaauauuaccugggg

SEQ ID NO: 4138008 - RNA, 72 nt, Human
ccccagcaccugggacccagaggcaccagcggguacugggaggugccgguggcccuggcccagcugcagggg

SEQ ID NO: 4138009 - RNA, 58 nt, Human
ccccagcacuuggaguggggagacacaagcuggcagcucccuaagccagaugcugggg

SEQ ID NO: 4138010 - RNA, 83 nt, Human
ccccagccaugcaaagugcuguacaguguguaaaucuaccuuuaccuuggauugauggguacaguaguuuugcaucugugggg

SEQ ID NO: 4138011 - RNA, 63 nt, Human
ccccagcccuccggauguucugggcuuccaacaugggagcccugagaguugugaggccaaggg

SEQ ID NO: 4138012 - RNA, 56 nt, Human
ccccagcccucgguagucccauagaagcugugggcuccugcagcucaggccugggg

SEQ ID NO: 4138013 - RNA, 64 nt, Human
ccccagccucugcugccaucucuuccucgugcugcuccuggggcagcggugggugcggcugggg

SEQ ID NO: 4138014 - RNA, 58 nt, Human
ccccagcugagauuugaggagauugcuaauucuaacuuuccucacaggcacacugggg

SEQ ID NO: 4138015 - RNA, 88 nt, Human
ccccagcugcagguucagcauuccaccugccucgucaagcuccaaggcaacgugacugaaagcugaccuguggaucuaggagcugggg

SEQ ID NO: 4138016 - RNA, 72 nt, Human
ccccaggaaccugcaagacagacuugacggauacuuacugcugugucuggguggcugcuuucagcucugggg

SEQ ID NO: 4138017 - RNA, 61 nt, Human
ccccaggacguggcccucauagggggguugagcuucuaggucugaggccgcauucuggagg

SEQ ID NO: 4138018 - RNA, 128 nt, Human
ccccaggagaaaacauacgcuccagacaccagcuucaucuuggcaguggucucaguuggacuugagaguaaauaggagaugacagcugaaucugguguggagauucaggaaggugguuuuccuggagg

SEQ ID NO: 4138019 - RNA, 80 nt, Human
ccccaggaguacagcgcauggcauuuguguguguuuucaagagaauggcagaaagaaccaugugcaaggcaauuaugggg

SEQ ID NO: 4138020 - RNA, 80 nt, Human
ccccaggucccugucccccaggccuguaccagggucugagcccagcacugguacaaggguugggagacagggccaugggg

SEQ ID NO: 4138021 - RNA, 55 nt, Human
ccccaggugugauuuggcagugucuggagacauuuuugguuuucacaacuggagg

SEQ ID NO: 4138022 - RNA, 107 nt, Human
ccccaucccuagaagcccuugcuaacccagucuccucguguaaaccuuuccccagguuuacacuccaggcuggggugggcaaagaggggcucagcuauaggaugggg

SEQ ID NO: 4138023 - RNA, 62 nt, Human
ccccaucuccaaauaccaucacauuggagguuagggcuucaacaugugaauuuggggugggg

SEQ ID NO: 4138024 - RNA, 67 nt, Human
ccccauggucuugauagguagaauggcugagguguuaggcauggucuuugcuugcaggauacagggg

SEQ ID NO: 4138025 - RNA, 78 nt, Human
ccccauucagcagaaagaaguuaguacaguuguuggccaaccuccccaacagcacuuggguuuuccuguugagagggg

SEQ ID NO: 4138026 - RNA, 129 nt, Human
cccccaaaccuaccccaaacaagaaacuccccagaccucaggcuaagaaggccaagugcacaugagugccugcgcccucucuucucuggccucugcuggucgguucugcuaugggacuguguucugggg

SEQ ID NO: 4138027 - RNA, 65 nt, Human
cccccaagguuccucucuccacccagcccucucugggcuuggcugggaugaggugacccaggggg

SEQ ID NO: 4138028 - RNA, 88 nt, Human
cccccaccauuccggguuucuccaaucucuccaggggccucagagaccccagacagaagaggaacuuggacagaggcuuggguggggg

SEQ ID NO: 4138029 - RNA, 74 nt, Human
cccccacccaggguuccuccacccugaacaauagaagcuaaguauagggcuggcccagcgcccagggcaggggg

SEQ ID NO: 4138030 - RNA, 77 nt, Human
cccccaccuucaucacuaugggcauuauauuuagggaguaguucuugggcuggauuuucugguuguggaaguggggg

SEQ ID NO: 4138031 - RNA, 68 nt, Human
ccccucagacuggggcucccugaguaagggcugugucuccccucagucugagcccuaucuaggagggg

SEQ ID NO: 4138032 - RNA, 93 nt, Human
ccccuccagcagugccacugccuccccaggcuccacacugccauguggugauguggguccuguguggggagcagcccauguguugggaggagg

SEQ ID NO: 4138033 - RNA, 56 nt, Human
ccccucgaggccuuaaaaagcugguaaccaaagagcagcugaagaucuggaugggg

SEQ ID NO: 4138034 - RNA, 103 nt, Human
ccccucgguccccggagucggaggguggaccggagcuggaggagcuggguguccggggucagcucugcaaggucaccuccccgcuccuggggaaagacugggg

SEQ ID NO: 4138035 - RNA, 128 nt, Human
ccccugagccuuggcuucuucaucugugacugagcugugagugaggcuaauaggcaaugguuuuaaaauuauguuuugcugagcccucaguccuuccacagacagcauuguaagaggagggucagggg

SEQ ID NO: 4138036 - RNA, 68 nt, Human
ccccugagugaccuccaagccucaguuucccguuugugaaagugggcagcccaggaggucuugagggg

SEQ ID NO: 4138037 - RNA, 76 nt, Human
ccccugagugcuuccagagucaugggaguccagccauuuuuccccuuuuucaugacauccugaagcugcacagggg

SEQ ID NO: 4138038 - RNA, 92 nt, Human
ccccugcguuucugcuccugcaccccugaaauuugaagaccugaauguucacuauugcacggacuaaauuuacagcggggagcagacggggg

SEQ ID NO: 4138039 - RNA, 74 nt, Human
ccaacugugaaagcaugcuugccaagcuuucagcaccacagcaucgggggaagcgggaggcacguuuguacugg

SEQ ID NO: 4138040 - RNA, 59 nt, Human
ccaagacagaaagugggucuagaauggcccuugggcuaagacugccauuguucuuuugg

SEQ ID NO: 4138041 - RNA, 83 nt, Human
ccaagaggcuucaauguucagggcagcccugcuacccuauuuuuugggugguggggugggaacuuggaaagaggucuugcugg

SEQ ID NO: 4138042 - RNA, 68 nt, Human
ccaagagggcuguuggugcccucgagggcaguggugggcugugugggcgaagacagccuuugccuugg

SEQ ID NO: 4138043 - RNA, 63 nt, Human
ccaagcagacuaaaacaauuaccaucuaagagauacucugaguguugcuuuagucugguuugg

SEQ ID NO: 4138044 - RNA, 76 nt, Human
ccaagccuaggucugggucuagcagaaaagagucaaagguauggcuugaccugcuuuaauuuagacaaggcagugg

SEQ ID NO: 4138045 - RNA, 95 nt, Human
ccaagcuacaugcaccccaucuggugccaucccaacacugggcuugacauuugcuccagcugucucagggaggugauccagggccauaggcuugg

SEQ ID NO: 4138046 - RNA, 59 nt, Human
ccaagcuuucgaucaaccagaagcuccauggauaauuugaguuacugcagaaaguuugg

SEQ ID NO: 4138047 - RNA, 58 nt, Human
ccaaggcagugguugugauacuguguuccaguaaggugcauuaguagcuagugccugg

SEQ ID NO: 4138048 - RNA, 66 nt, Human
ccaaggcuccucagcuggucuugggcugagggaagccuggagugaccaagcugguaugggguuugg

SEQ ID NO: 4138049 - RNA, 58 nt, Human
ccaaggcugagguuuccaguuggaagguacauuugaugggggagcugucugcccgugg

SEQ ID NO: 4138050 - RNA, 70 nt, Human
ccaagggaccugggaagucagccaaggacgcuugccugggugucuccuggcugguuucucugugcugugg

SEQ ID NO: 4138051 - RNA, 74 nt, Human
ccaagggcauaugucagaagugauguugagcuaguccucuagaggcuauuuagcuuccacucucaugcccuugg

SEQ ID NO: 4138052 - RNA, 59 nt, Human
ccaagggccuccaccuugcucgucgucagaggcagacagccaggacuuggcccucuugg

SEQ ID NO: 4138053 - RNA, 93 nt, Human
ccaagggcuguugccagggaaacauaguucucggucuucagccuggucuuccugagggcugggaguuugauuugacugguaggaaagucugag

SEQ ID NO: 4138054 - RNA, 69 nt, Human
ccaagguagaggagcugauaaaagggggucagguagccugacuuccggauguaugcucugauuucuugg

SEQ ID NO: 4138055 - RNA, 61 nt, Human
ccaaggucuuggacagcuaaugugaaugaacauaugcaauacuguaaaccaggcuucuugg

SEQ ID NO: 4138056 - RNA, 92 nt, Human
ccaagguggucuggcgucagaagucacugacuuggcccucgugcuuucucuggcagcaggagucacugacuugguccuaguacuaucucugg

SEQ ID NO: 4138057 - RNA, 76 nt, Human
ccaaguaaaugguguuuccguuaagcugaacuauaaaauguggguuacuuaaacagaaaugcagaaaggcacuugg

SEQ ID NO: 4138058 - RNA, 80 nt, Human
ccaaguaauaucuggcaccaggaacuuaacuguacuuaacagccauuuacaauuuccugcaaagccagaugucgacuugg

SEQ ID NO: 4138059 - RNA, 93 nt, Human
ccaaguagcugggacaacaggugagcaccaccacacccagcuaauuuuuguauuuuuuggagagacagggucucacuauguugcccaggcugg

SEQ ID NO: 4138060 - RNA, 124 nt, Human
ccaaguagcugggauuacaggugcgugccaccaugccuggcuaauuuuuguguagagacgggguaucgucauguuggccaggcuggucucaaucuccugacuuuaagugaucugccagccuugg

SEQ ID NO: 4138061 - RNA, 59 nt, Human
ccaaguauuugucuuguuggucuccaaucacguccuggaaccguagaggcagaauaugg

SEQ ID NO: 4138062 - RNA, 82 nt, Human
ccaaguauuugugcuacaaaugaguuguaugaaccagugcaacagcuugcuuucuauuccuucauuuccaggacaaauaugg

SEQ ID NO: 4138063 - RNA, 60 nt, Human
ccaaguccucugguuucaaauaguguuuuuucaaucaauuguauaguacuagaggcuugg

SEQ ID NO: 4138064 - RNA, 73 nt, Human
ccaagucugugaccauuggguguccuuaaacaggcagcuggagaucccagaauuuggaucaugauuuuacugg

SEQ ID NO: 4138065 - RNA, 84 nt, Human
ccaagucuuugcuauugugaauagugcugcaauaaacuuaugugugcaugugucuuuauaguagcaugauuuauaauccuuugg

SEQ ID NO: 4138066 - RNA, 69 nt, Human
ccaagugaucaauaggcuuuuaaaaaucucugaguaaucucagaagugacaguguauuugacuauaugg

SEQ ID NO: 4138067 - RNA, 61 nt, Human
ccaagugcauguguguuccaaaacaucaugccaugaggcugcugaagauacacaugacugg

SEQ ID NO: 4138068 - RNA, 62 nt, Human
ccaaguggaugguguucucuggggccuguuuaccugucuucuugggguucaccugccuuugg

SEQ ID NO: 4138069 - RNA, 82 nt, Human
ccaagugucgguggagaguguugaccuggaaguccugugauuggcaggggacaaccaacuuagcauuacaaacugauugugg

SEQ ID NO: 4138070 - RNA, 77 nt, Human
ccaaguugucauaagccuauuauuucuuuacauuacugaagugaaagacagcauuaauggcuaaaugccauacuugg

SEQ ID NO: 4138071 - RNA, 124 nt, Human
ccaaguuuuugucuucuucuugucuugaacucuuuaacugaaauacaggcauagacaauccguguccgcccuuuaaagaugccuguuaucugcagaccuucagggcagagaagcuggaaguugg

SEQ ID NO: 4138072 - RNA, 72 nt, Human
ccaauaaccuaaauuaucaugagaauuaugaagccaaguuuuuauguacuuugugauaauuuagguugaagg

SEQ ID NO: 4138073 - RNA, 95 nt, Human
ccaauagaagggccacacugcaggccacaggauugcacagcaugcggggcugacaugcugcugcaguacuugcuguguucaguggcccuuucugg

SEQ ID NO: 4138074 - RNA, 86 nt, Human
ccaauauacuguaacuuacaguggaaguuaaccccauuuugaaaaauuagauuguuuuaauuccauugugaaguugaaaaaauugg

SEQ ID NO: 4138075 - RNA, 62 nt, Human
ccaaucaguuagaaggaagagaauauuaagcucaaauauuccccuucugccuacgcugaagg

SEQ ID NO: 4138076 - RNA, 129 nt, Human
ccaaucccaaaaaauuacauauuacaaaauucucuuuguauaacaucuugacauaaaaucauaguaaagaacagauuagugguugccagguguuaagcggagagggagcguaguagaaaggugaguugg

SEQ ID NO: 4138077 - RNA, 57 nt, Human
ccaaugaaauucuuuccgagccuuuauuaaaagaucuguuugaaagaguuuuauugg

SEQ ID NO: 4138078 - RNA, 89 nt, Human
ccaaugagaaaaacaguuugaaguguauaacgaccuacaggaaaaaauuccugaucccauuuaauacugagaacaugauuuucuuuugg

SEQ ID NO: 4138079 - RNA, 56 nt, Human
ccaaugagacagaaagagccuccuaggaggagacagugucuugaaugucccauugg

SEQ ID NO: 4138080 - RNA, 83 nt, Human
ccaaugauuucuuuauugagaaggagauuggcaucuagagaaguuaagugacuuaaucuccucucaggguaagucagcauugg

SEQ ID NO: 4138081 - RNA, 58 nt, Human
ccaaugcauugaauuagguuuugauucugagugagaaaaggagccaucaguggguugg

SEQ ID NO: 4138082 - RNA, 104 nt, Human
ccaaugccacaacaauagaauacauuacauucauguuuucuugcuucaagcucucauuucugaguucugcaugaaaagaacugaacaauguauucauggaaggg

SEQ ID NO: 4138083 - RNA, 79 nt, Human
ccaaugccuuaucaugucuuucucaucacaucuaguugcugaagucacuuggauauaaaggcauaaggcacaucuuugg

SEQ ID NO: 4138084 - RNA, 66 nt, Human
ccaauggcugccuuaauucuucagcgggggcguucuuuuucuuccucccaagcaggcggccguugg

SEQ ID NO: 4138085 - RNA, 67 nt, Human
ccaauuaauuuuucugacagccacagcccuccuaaggcugauccuagcugacagaggaauagaaagg

SEQ ID NO: 4138086 - RNA, 83 nt, Human
ccaauuagagaucgauuucauauccucuuaucuagcagcuuaguuuugagugggagagaaauggaacagugagaagcugaugg

SEQ ID NO: 4138087 - RNA, 77 nt, Human
ccaauucauugauuauugaagggucuuuaggcaagaugguuaacgucucugaaagauuuuccugaucugugaaaugg

SEQ ID NO: 4138088 - RNA, 65 nt, Human
ccaauuugcuauguaugucucaucuacaaauuguccguggagugaggcauuuguagcugagaugg

SEQ ID NO: 4138089 - RNA, 57 nt, Human
ccaauuuucuggccagaggcucaaccaagaaggggagcccagggaaccaggaagugg

SEQ ID NO: 4138090 - RNA, 71 nt, Human
ccacaaauuauguagcuggccugucuagagccuuacuacucaaagugugguugcaggaccagcagcauugg

SEQ ID NO: 4138091 - RNA, 75 nt, Human
ccacaacuacagucccucauauguugguaaauauugguugcaacaaaaagaccaucagcuaugcuggcugugugg

SEQ ID NO: 4138092 - RNA, 91 nt, Human
ccacaaugcuggaucuuaggcuuuugaggaggggauaccugcugguguuggcaucucugagagaguuugaugcaccugguucugauagugg

SEQ ID NO: 4138093 - RNA, 128 nt, Human
ccacacaaaauuuaauucucaguuuuuuucauguagauuuuuuggagacucucuguaucuccucugaaauggagaguuuccaggaaauuaucagcggcuccuaauacaaauuuuuaauacaauugugg

SEQ ID NO: 4138094 - RNA, 102 nt, Human
ccacacagccccucuccuccaggaacucacaguacagcugagaaauuaccuggaaaaggcuggaaauuguauaaguaccuggaaaagacuaaggugugcugg

SEQ ID NO: 4138095 - RNA, 68 nt, Human
ccacacaugcuccucguagccauggcucuggcacagugccaggugcuggccucagagggucauggugg

SEQ ID NO: 4138096 - RNA, 72 nt, Human
ccacaccagggagugaaucuuucuggcuaccaaaccagcaggagucagaagcaaacaucacucuaggcuugg

SEQ ID NO: 4138097 - RNA, 80 nt, Human
ccacagacuuugcagccucugcuuuugcacagugacccagggaaccaguggcagaggaagggugcugcgaaagccugugg

SEQ ID NO: 4138098 - RNA, 88 nt, Human
ccacagauccuacuuucugagcuuagagccuccaaguucaguccugucucucugaacucagagccugagcuaggagacagauucgugg

SEQ ID NO: 4138099 - RNA, 74 nt, Human
ccacagauggccauauuacuauauuuuucaaaaaauggugacauuucacuguguaagugguuggccauccuugg

SEQ ID NO: 4138100 - RNA, 56 nt, Human
ccacagauuagcguacacccaccuccaaccugcagcugcauggcgcacaucugugg

SEQ ID NO: 4138101 - RNA, 65 nt, Human
ccacagcaggacuggagccgccugagugucccuccgacccaucucccuggcagguccagcugugg

SEQ ID NO: 4138102 - RNA, 65 nt, Human
ccacagcucucuagggagcugguugcagauuugauuccuacagccucuucccuggaguggauugg

SEQ ID NO: 4138103 - RNA, 57 nt, Human
ccacagcugacaauggauagacuguuaucaaucaaacuguucccauugcaguugugg

SEQ ID NO: 4138104 - RNA, 63 nt, Human
ccaggaaugcuggccaauacagaaacaucauaaacauuuuccuuguauuucaugcauuccugg

SEQ ID NO: 4138105 - RNA, 81 nt, Human
ccaggaauuguguacaaugacucucaguuuggcuuuguuuaguguuuuucucauggucaaauagagguuauguguuuuugg

SEQ ID NO: 4138106 - RNA, 66 nt, Human
ccaggaauuucgaaauacuguuuccccuuuauguauuuuccauuugauggaaauaauuucuccugg

SEQ ID NO: 4138107 - RNA, 55 nt, Human
ccaggacaagcucuuguuucaugguuuuuguagagccccuaacaguuugucaugg

SEQ ID NO: 4138108 - RNA, 66 nt, Human
ccaggacacugcuucacagcagagagcggcuggagaagacagccgaagcuuugagcagugauuugg

SEQ ID NO: 4138109 - RNA, 117 nt, Human
ccaggacaguggucaggaacaggagcccggcacaugcaggguuaacccugucucucuucacugccgcucagggugcccugccaggaugugccaucuccauggugaccgcuguccugg

SEQ ID NO: 4138110 - RNA, 74 nt, Human
ccaggaccccauuuagauaacaguucaaagacauucucuuugaacaugacauuuaaacuuagaucuggggaugg

SEQ ID NO: 4138111 - RNA, 89 nt, Human
ccaggacuauuuuaaaagucucucugaguaaaagugacaaaauacugcauuucuuaaaacuucagggagaaauaaugaaucuguuaugg

SEQ ID NO: 4138112 - RNA, 65 nt, Human
ccaggagccugggccaggcugggcaagcguugcagagccaaguccgaggcccagcaggcuccugg

SEQ ID NO: 4138113 - RNA, 66 nt, Human
ccaggagcucaaagaugccaggaggaacuuaggucuauaucuugccucugcucucugaguuuuugg

SEQ ID NO: 4138114 - RNA, 57 nt, Human
ccaggaggaaauucuaaagguaacccagucccuggagccacugauguuaucuccugg

SEQ ID NO: 4138115 - RNA, 63 nt, Human
ccaggaguggggaccccggggggcucccucacagagccuguccccaaggugcucacugucugg

SEQ ID NO: 4138116 - RNA, 129 nt, Human
ccaggaguugccucucuaguggugaauaccuuugggcugagucaggaagucucauacaucaaaagaccauguguauauaagcauuuacuuguuauuugguucagagccuccagaaggcaaaucuuuaag

SEQ ID NO: 4138117 - RNA, 94 nt, Human
ccaggaugaagcagugggcuuggcacaugggcucagccucagggcguuaggagcucagcaugguugaggugaugccagcccugcccuuuccugg

SEQ ID NO: 4138118 - RNA, 73 nt, Human
ccaggaugcgacuccccagagggccccuggacuguccaucccugggacaggaggccucuggagacaucucugg

SEQ ID NO: 4138119 - RNA, 70 nt, Human
ccaggauguggccuagaggugcaaggaaccagacaccacuggccuacaucaaacuccaggccacagaugg

SEQ ID NO: 4138120 - RNA, 69 nt, Human
ccaggauuguggaagucagugguucugauggaagcgggagaaccaguggagcuugccacagagccuugg

SEQ ID NO: 4138121 - RNA, 61 nt, Human
ccaggcaauucugaaagcauuuagugauaaacacauucacagagugauggauguugccugg

SEQ ID NO: 4138122 - RNA, 89 nt, Human
ccaggcaccuuuuuucaucucagggcaauucucagcgacagcugccaggugacgcuggaugugcccuugauuccugaaggggugucugg

SEQ ID NO: 4138123 - RNA, 55 nt, Human
ccaggcagaaugaaaccccuguuguuggugaggugggggucagccuccagccugg

SEQ ID NO: 4138124 - RNA, 88 nt, Human
ccaggcagcccuuguuugggaaggaugagagauggagauuaugcuccuacauccuugguauucuccccggaucagggcaaugaaaugg

SEQ ID NO: 4138125 - RNA, 81 nt, Human
ccaggcagcuuugcagacagcaggccgcauugcaggaggugcuccucccuccucggcagcugauugcagagcaccgcuugg

SEQ ID NO: 4138126 - RNA, 55 nt, Human
ccaggcauccauugcuuccucucaucgugaggucccugcagcagacugccaaugg

SEQ ID NO: 4138127 - RNA, 75 nt, Human
ccaggcaugugguccuuuagaggauguaauauggacuguagcuuuuauugagucagagaggggaacguuguaggg

SEQ ID NO: 4138128 - RNA, 61 nt, Human
ccaggcccccgagcagaagacaaacaacaggaacagaguuuggcuuuuguacugggccugg

SEQ ID NO: 4138129 - RNA, 56 nt, Human
ccaggcccugcugcugagaccuugaccccuccaagucccuccacgcagcgggcugg

SEQ ID NO: 4138130 - RNA, 67 nt, Human
ccaggccuugcauuugugauuuagcuuggugcuucccagaauucuaggcugcagaugcauggaaugg

SEQ ID NO: 4138131 - RNA, 61 nt, Human
ccaggcucaggugcgagagacacauguaacccagugccugaccuuaugcagcugagcuugg

SEQ ID NO: 4138132 - RNA, 55 nt, Human
ccaggcuggagugcaauggcaugaucucagcucacugcaaccuccgccuccuagg

SEQ ID NO: 4138133 - RNA, 69 nt, Human
ccaggcuuggggaugccaacagaagacccgcuccuccaggucuccucccuuucauucaccucggccugg

SEQ ID NO: 4138134 - RNA, 56 nt, Human
ccaggcuuuaagagguggaaacuaguaguuuccaccguagacucuuggaagucugg

SEQ ID NO: 4138135 - RNA, 59 nt, Human
ccaggcuuuggccuucaccaccuguuuuauguaagugacugcugaggccugaggccugg

SEQ ID NO: 4138136 - RNA, 61 nt, Human
ccagggaaggacucucuuucccuuggacugucagcuccacaggauaaggauuuuugccugg

SEQ ID NO: 4138137 - RNA, 76 nt, Human
ccagggaaggaguacagggagggucccugugugcagcugcucagggaguuccgaucugugcacccucuugaccugg

SEQ ID NO: 4138138 - RNA, 59 nt, Human
ccagggaagucacauugucuaguaacaauuguauggacacuggggugugacugccuugg

SEQ ID NO: 4138139 - RNA, 56 nt, Human
ccagggauguggggcuugcagugcuaaaauugcaaauauuccagguacaucccugg

SEQ ID NO: 4138140 - RNA, 65 nt, Human
ccagggcagccgcgugaccugccaggccugggggccccgaggagcuggaggcagguggugccagg

SEQ ID NO: 4138141 - RNA, 55 nt, Human
ccagggcagggaccacgugucuuuaugucccugaccacggggccuggcacccugg

SEQ ID NO: 4138142 - RNA, 63 nt, Human
ccagggcagugggagaaggugccuucgaucaucagggcacaagccuggcucucacuggccugg

SEQ ID NO: 4138143 - RNA, 63 nt, Human
ccagggccuccuaaggcaucuaaaauaugcaaaucuuuggugagcccccagugaggcuccugg

SEQ ID NO: 4138144 - RNA, 89 nt, Human
ccagggcugcuguugggccagggguggggacaccuuggauggggcguugcucuccccaggcucagagacuaagacacacacagacuugg

SEQ ID NO: 4138145 - RNA, 61 nt, Human
ccagggcuuuaucugccuuugacuuugaagcaaaagggagaaaggaacgaucaggcccugg

SEQ ID NO: 4138146 - RNA, 59 nt, Human
ccagggcuuuguaauaugagcacuuaacaucuuucaagugaucucuccaaggcaccugg

SEQ ID NO: 4138147 - RNA, 64 nt, Human
ccaggggaaacagggagcacuccaccuucuuaauaccaaauggccugcuuccaacagcuccugg

SEQ ID NO: 4138148 - RNA, 64 nt, Human
ccaggggaaggcuagagaaugaucacguggccgggauggggcuguguuccuggcaguccccugg

SEQ ID NO: 4138149 - RNA, 61 nt, Human
ccaggggcuacuuguuauggaaaaguuaugauugguguagaacuguacagguugcuucugg

SEQ ID NO: 4138150 - RNA, 57 nt, Human
ccaggggcugcagauccaugguggccuuccagccaucacccaucuuucugcuccugg

SEQ ID NO: 4138151 - RNA, 79 nt, Human
ccaggguaaggucauauuucuggcuugucugaguucaugaauuuucauaguauuuccagaaauagucuagccuccuagg

SEQ ID NO: 4138152 - RNA, 73 nt, Human
ccaggguaaucagauaucaccugggggauggcaagaauuuuuuucagcuauugaggguggugaguuauugagg

SEQ ID NO: 4138153 - RNA, 87 nt, Human
ccaggguagaagcuccauccugcauugcuauucagaugcacacaucacaucugggagguggcagggugcaugcugcugcucccuugg

SEQ ID NO: 4138154 - RNA, 56 nt, Human
ccaggguagggagguuuucauacaauuuuguagcccgcguaaccucucuacugugg

SEQ ID NO: 4138155 - RNA, 85 nt, Human
ccagggucuccugccuguuugacuggucucugcugugugcaaacuuccccaucacagcaggugacccaagcaggcuggagccugg

SEQ ID NO: 4138156 - RNA, 57 nt, Human
ccaggguggaggcuggauggagguaucuacucguggcccgcauugccucugcccugg

SEQ ID NO: 4138157 - RNA, 70 nt, Human
ccagggugggucugugugcacagcgagugccugggccaggcauuugacucagugacuggguuugcucugg

SEQ ID NO: 4138158 - RNA, 55 nt, Human
ccaggguggugugcaguggugcgaucucgucucacugcaaccucugccucccagg

SEQ ID NO: 4138159 - RNA, 59 nt, Human
ccaggguuauaaaugcaucugucugggcacauuaucuaaauuguuauguaucacccugg

SEQ ID NO: 4138160 - RNA, 65 nt, Human
ccaggguugcuguauggcacuuugcagaggagggcauggcugagaagugugucccagcagccggg

SEQ ID NO: 4138161 - RNA, 77 nt, Human
ccagguaccuguucucugcagcaaccuuucaccucccauacuugggagugaguucuguuccugcagagugcccugug

SEQ ID NO: 4138162 - RNA, 76 nt, Human
ccagguacuuucucccccucccacugucagcuggauucccucagugaugugaggugugagagggaaagccccuugg

SEQ ID NO: 4138163 - RNA, 81 nt, Human
ccagguaugagcaggggcguuuguggcgcggagagagcuccuaucccugccguccaucuacgucucaggcuuggccccugg

SEQ ID NO: 4138164 - RNA, 57 nt, Human
ccagguauguccuaagcuucagggauccaguuucuuguccuucugaaauauaucugg

SEQ ID NO: 4138165 - RNA, 101 nt, Human
ccagguauguccuucacauggcaauagagagggaaagagugaagaagcccaagagcccuucuaacccuccuuuugugugaugccuguuaagauucacuugg

SEQ ID NO: 4138166 - RNA, 88 nt, Human
ccaggucauaguuaguuaauugcuaggugcaucaucuugacaacauauguccaggaaucugugccuagcccugauggugauuucuugg

SEQ ID NO: 4138167 - RNA, 122 nt, Human
cccucacacccuccccuuuuuuuuuccacccaccaggugggguucagucucagccggguucggucuggcagaguucgcuccuauucagugaguggagggcauggggaagacgggagaagggg

SEQ ID NO: 4138168 - RNA, 59 nt, Human
cccucaccagccccagguccuuucccagagaugccuggagggaaaaggcugagugaggg

SEQ ID NO: 4138169 - RNA, 63 nt, Human
cccucagcccucucauccccuugccccuuucugugggguccagaaugagaaugggcuccaggg

SEQ ID NO: 4138170 - RNA, 60 nt, Human
cccucagcuccacccucagcagaugauaauaucaagacaccugccgagcgucugcggggg

SEQ ID NO: 4138171 - RNA, 62 nt, Human
cccucagcugccccaguggccccagcauccacugcuugggggcgguggggucaggugcaggg

SEQ ID NO: 4138172 - RNA, 64 nt, Human
cccucaggaugcuuggaucaccuuuauagcacacuccuaaaaggucuucucaaacaucccaggg

SEQ ID NO: 4138173 - RNA, 83 nt, Human
cccucaucaucuagauucaacuuaguuugcaugauuauggagcauguauuuagacuccaguaucagauuagggaugaugacgg

SEQ ID NO: 4138174 - RNA, 73 nt, Human
cccuccaggagaggcccuggcacugccugggaguggggagacauguucaguagggucagggcugagaaagggg

SEQ ID NO: 4138175 - RNA, 59 nt, Human
cccuccaggcuggauccaagucaagggcuguaccucgcugcuggaaccugccugugggg

SEQ ID NO: 4138176 - RNA, 60 nt, Human
cccuccagugagugagcaggcgaccacggccaccuuguugccuguggcucugcugucggg

SEQ ID NO: 4138177 - RNA, 119 nt, Human
cccuccauagaguugaacuuccucucuuuuuagaagaauggauuucucggagucugaaaaauuuaugguucuucucuggaagaauuuuauuuuaaagguaaguugaacuaccuauaggg

SEQ ID NO: 4138178 - RNA, 62 nt, Human
cccucccacucggauccacgcaucaaagggguccucggaugcagggaacuuagugggcuggg

SEQ ID NO: 4138179 - RNA, 130 nt, Human
cccucccauggugaggguggggggugcuccaggccugcccuggcuggggccccuuccuaggugaaccccaggaauguguguccaccggggaauguguggaggagccucucucugcucaaaaugggugggg

SEQ ID NO: 4138180 - RNA, 55 nt, Human
cccuccccaggcccugugccuguagcuuuagggcacgagggcacacgugggaggg

SEQ ID NO: 4138181 - RNA, 56 nt, Human
ccguccgauugucggcaggacucgcuuucaggaggaccuggcugcauucaggacgg

SEQ ID NO: 4138182 - RNA, 57 nt, Human
ccgucggacgcccgugggccucugcuccgugcgcgcccacccucagcguccucacgg

SEQ ID NO: 4138183 - RNA, 59 nt, Human
ccgucuuucuucuuuauuacaguggcugggacuuucaguccuguguuaaacaagagcgg

SEQ ID NO: 4138184 - RNA, 67 nt, Human
ccgugauaugugcaagaguuuauuuucuuccauuuaggaugaaagaacuaccuguaugauauucagg

SEQ ID NO: 4138185 - RNA, 67 nt, Human
ccgugcagguguuuuggcugccagcccuggcuaaggucucagcugucagccaguagcauuugcaagg

SEQ ID NO: 4138186 - RNA, 61 nt, Human
ccgugcccaaacuuacugguuuaaaacuacuaauuuauuuaguucaggaguuuguggaugg

SEQ ID NO: 4138187 - RNA, 60 nt, Human
ccgugcuucaguucauaaccuugcuaaucauguaucugaccuugugagcugaagaacagg

SEQ ID NO: 4138188 - RNA, 56 nt, Human
ccguggucaccugagcuccuuggcguuucaucugacaggugagguuggugccaugg

SEQ ID NO: 4138189 - RNA, 76 nt, Human
ccgugugcuuugguuuuacaggaugucaggagagcugcagagccaugugagcaucuguaaguagcagagcccaggg

SEQ ID NO: 4138190 - RNA, 101 nt, Human
ccgugugucugcgggugugaggcugaggaucguacuuuccaccuauaggcacagguggaggcugcaucaucacucgagccugucggccccauucacucagg

SEQ ID NO: 4138191 - RNA, 61 nt, Human
ccgugugugggccuucaacccugucuggguggguucuggacaguggguggggacccggcgg

SEQ ID NO: 4138192 - RNA, 66 nt, Human
ccguuagaggccuguggcugucgcugugagcugauucuccagcuaacaccuacuggccauugaugg

SEQ ID NO: 4138193 - RNA, 94 nt, Human
ccguuguacugacaguguucugaaaguugaggguguguguuuacuugccuuuauauccccacaacaaaauucagagucacuauuuguauauagg

SEQ ID NO: 4138194 - RNA, 72 nt, Human
ccguuguccagaacugagucucauggccauaucuagcugaaagaugggcuaggaaauguaguuuuaaaaugg

SEQ ID NO: 4138195 - RNA, 80 nt, Human
ccguuucugccacugaaauccuuaacaugaucuauuaacccggagauaaaagauaucuuagggauuuguguaagacuugg

SEQ ID NO: 4138196 - RNA, 71 nt, Human
ccggguaccucaguuggaaaugcagaaaucacccaucuucugcguugcucacgcugggagcuguagacugg

SEQ ID NO: 4138197 - RNA, 57 nt, Human
ccggguucaccuugcuuagguaugucucgcuuuagaucauaaggcaauuggauuugg

SEQ ID NO: 4138198 - RNA, 64 nt, Human
ccgguauguuuugucucuugaaacguuggcccaaauggcauuuucaaacauucaaauaaaccgg

SEQ ID NO: 4138199 - RNA, 60 nt, Human
ccggucagucuugaacagcccccugugugcauguguguauaguggggacaggaugguugg

SEQ ID NO: 4138200 - RNA, 72 nt, Human
ccggugaccugggagagaggagccggcggaacaugugucuuggucucucgccuccugucuuccagucuccgg

SEQ ID NO: 4138201 - RNA, 56 nt, Human
ccgguuugccuuguguuacaguuuuguggguaauuacccaaggcacagggcacugg

SEQ ID NO: 4138202 - RNA, 81 nt, Human
ccguaaagaggagcugguggcagagacaucagguguuugcucagugacacagugacaucacggccaccucuuauuucaugg

SEQ ID NO: 4138203 - RNA, 66 nt, Human
ccguaccccaggagcugugccuaguccaggagaggcuggggggcgccccauggaggugagacgcgg

SEQ ID NO: 4138204 - RNA, 59 nt, Human
ccguccauugcccaacagcaugggcagcauugcuuggugccagugagggcagaggaugg

SEQ ID NO: 4138205 - RNA, 98 nt, Human
ccguccccgaccuccucggaaaaggugagcagugcagguggcagaggacagccucugggcugcugucaucuggcgcugugcaggcgagacggggacgg

SEQ ID NO: 4138206 - RNA, 74 nt, Human
ccgucuggaggcugggucgggugcuguccaggccuuccugugacgugucuccuggcaccacgugccaccagagg

SEQ ID NO: 4138207 - RNA, 116 nt, Human
ccgugaggcuggauaggcagcacaugaugccucuggcuggcauugcuggacuuccaugggagggggauccuggcaaguaggggcuggugcuugggagccaauguccaguguugagg

SEQ ID NO: 4138208 - RNA, 89 nt, Human
ccgugaguuuggggcuggcuggagagaggccaacugggggacacagaggauuccucaggauccaucuccugcccuccucacacuuuugg

SEQ ID NO: 4138209 - RNA, 65 nt, Human
ccgugcccaucgacgcagggauggggacaucccuggaccccagcccagcguucgagggguucugg

SEQ ID NO: 4138210 - RNA, 55 nt, Human
ccgugcuucuucagaugugaaugacuuuauucagagagaucuagagggagccugg

SEQ ID NO: 4138211 - RNA, 108 nt, Human
ccguggcgggccucugucuugcagagaagcaaccguguggauagugacaggccacaggccucuuccagcuguugcuuccagggcugagccagaggccacuuuccaugg

SEQ ID NO: 4138212 - RNA, 65 nt, Human
ccguggcuccuggcuccaggcagccaaggcccucuggccuccuccaugcagccaggagcuucugg

SEQ ID NO: 4138213 - RNA, 116 nt, Human
ccguguggcgggcgagggggcccuggaacugguucuggaggcugcaggggcccccacauccacugcagcuccggaagcgggugaggaugaggguccccccagcccuggcaagacgg

SEQ ID NO: 4138214 - RNA, 61 nt, Human
ccguguuauauaauuccugugguagucuauguggaaguaccccaagaguuguguagaaugg

SEQ ID NO: 4138215 - RNA, 65 nt, Human
ccguguuuggggaugugcugagagugcggagccugauaaauauccguccagaagucccugagcgg

SEQ ID NO: 4138216 - RNA, 74 nt, Human
ccguuacagccccagcacuuagcugagugacuggcaccuaguaagcacucaguaacuguuugcugaauaaaugg

SEQ ID NO: 4138217 - RNA, 125 nt, Human
ccguuauuaaucuagguuuuuaauccauauguaauguauuaugaggacugguguaagguggagcucuaacuucaauuucuucauaucacucguagagcugacauuucacuaccugguuuggaugg

SEQ ID NO: 4138218 - RNA, 70 nt, Human
ccguuauuguaggaacaaggugugcaggucugaaaugggacuagggcaucuuaauuucuaacaggcacgg

SEQ ID NO: 4138219 - RNA, 78 nt, Human
ccguuccuuacacagcuucaguuucugacuugggaauuauucuuaguuaugaugauggugaggcuuuagcaggaacgg

SEQ ID NO: 4138220 - RNA, 75 nt, Human
ccuaaacagauacugcccagagcugcccguggaccuugugagggcaccagggcugccuggccgugugugugaagg

SEQ ID NO: 4138221 - RNA, 92 nt, Human
ccuaaagauguauuugaaaucauuuaugccccaauuagaugggucaucucauaaacuaauugggguauaguuauaugaucaaaguguuaagg

SEQ ID NO: 4138222 - RNA, 75 nt, Human
ccuaaauauuuugaaaauaugaugcuagucauuccaauguauguaccagauguauguucucagauaaauuuuagg

SEQ ID NO: 4138223 - RNA, 92 nt, Human
ccuaaauucuccaaagucucaguuucuuuaugugcauaaagauaguaauaccuaucuccaaagcacuugaagaauugaacuggaaaaugugg

SEQ ID NO: 4138224 - RNA, 70 nt, Human
ccuaacaguuuaugagauaugcuauguuuccucuucugauauaugguauacaauuauggacuguucuagg

SEQ ID NO: 4138225 - RNA, 84 nt, Human
ccuaagaagugcuuuuuaauauuuauacaucuaaagaggguuugcccuuccagacauagaaaaucauuaggaagcauucucagg

SEQ ID NO: 4138226 - RNA, 66 nt, Human
ccuaagcacaguucuuagaguuacauucaggagggaggaauguaaccugacugcuuugcucucagg

SEQ ID NO: 4138227 - RNA, 62 nt, Human
ccuaagcccagcucugccugcucugcggacuccccuauagcaguagaaugcugugugguagg

SEQ ID NO: 4138228 - RNA, 70 nt, Human
ccuaagcgugcagggccuggaguggcaccucugcaagaguggcacugcccagcgucuuaggcacaaaagg

SEQ ID NO: 4138229 - RNA, 77 nt, Human
ccuaagggaucuagauguccucugaauagcccaugggaagguuuucagaggagagcuggaccaaacaugcccuuagg

SEQ ID NO: 4138230 - RNA, 127 nt, Human
ccuaauaaauuacauuauuuuuuuccugggaugaggaaacaaggacagaguugaaacaccuucccccagaaaugugcuugccucucucagaccacagguaagggcuuaauaugaugugagaaagagg

SEQ ID NO: 4138231 - RNA, 57 nt, Human
ccuaauaacagugucugugguuaaagguguucacuguaugccuggcacuguucuagg

SEQ ID NO: 4138232 - RNA, 67 nt, Human
ccuaaugguaauagcaugcauccugcauagaaucacuggugaaucugggcacugcugagccuguagg

SEQ ID NO: 4138233 - RNA, 75 nt, Human
ccuaauuaucucccaaagaucccaccuccuaauacccucacacuggggguuaggauuucaacagauaaauuuggg

SEQ ID NO: 4138234 - RNA, 61 nt, Human
ccuaauugacugagggaaugcugguacuguuagaaaguauuagugaaagaauuaguuuggg

SEQ ID NO: 4138235 - RNA, 62 nt, Human
ccuaauuugacagcaauagaagauuuauguuugcaugaaugucuaugauccuuuaaguuggg

SEQ ID NO: 4138236 - RNA, 90 nt, Human
ccuacacugagagcucuucaggguuauccacauaggaguaaauucaagaauuccuggcugagugccuugggcuggagacaucaguguagg

SEQ ID NO: 4138237 - RNA, 72 nt, Human
ccuacagcuugcaugcagaggcacugaagacacauuaggguuuugagugcuucuucugugccaggcuguggg

SEQ ID NO: 4138238 - RNA, 76 nt, Human
ccuacaggcacaccaguuuaauaacugcucaaggcuccuugccagcaccauaaugugagcuugggugccacguggg

SEQ ID NO: 4138239 - RNA, 65 nt, Human
ccuacagggcucgucgggcccucggggucggcggcugcuggaggcgcccaggggaguccugcugg

SEQ ID NO: 4138240 - RNA, 75 nt, Human
ccuacagucuggcaggaauguuauaucauuagccauauuuaaacucagaaauaacagccaugaagauuguaaagg

SEQ ID NO: 4138241 - RNA, 77 nt, Human
ccuacauaacacugccaaacuguacacuuagagaugguuaagaucucuaaguguacaguuuggcaguguuauguagg

SEQ ID NO: 4138242 - RNA, 67 nt, Human
ccuacauguggucccuguaggcuggguggggcucuuuucacaccauccuaucugaccuacuuguagg

SEQ ID NO: 4138243 - RNA, 87 nt, Human
ccuacccccacuagaagcacaggaaccuauggggaaacaccuugacaaacccaccaggcaccuggagguuuacuggauggcuuuagg

SEQ ID NO: 4138244 - RNA, 85 nt, Human
ccuacccgcauguggugccgaguuccagccgcccugaguccccaaggcccagccuggagcuuguugugcacucagugggggaagg

SEQ ID NO: 4138245 - RNA, 62 nt, Human
ccuacccugggaacuggaaacuggauuuggcaagaaucccaggaagaucccagggacccagg

SEQ ID NO: 4138246 - RNA, 58 nt, Human
ccuacccuucucccccucugcggcguggugcgcaugcgaggcgggaggaggccuuagg

SEQ ID NO: 4138247 - RNA, 73 nt, Human
ccuaccucggcugggccuuggccacugcaacagggucuccauuggcaugugagcuggggcccggccagcaagg

SEQ ID NO: 4138248 - RNA, 66 nt, Human
ccuaccuucucccugaggguuccacacaccgaugaugucaugugugggacccuuagguuguguggg

SEQ ID NO: 4138249 - RNA, 98 nt, Human
ccuacggcguggccgaggcgggcggcuccuucgaccugcggcccuuccugacgcagccgcaggugguggcgcgcgcccugugcuuggugagcccgggg

SEQ ID NO: 4138250 - RNA, 64 nt, Human
ccuacgggauuacucaggccucaggggaagauuuggggugccugguaucugagaaugcuggagg

SEQ ID NO: 4138251 - RNA, 64 nt, Human
ccuacuccaaaauacucacacuggacugaaugaagucuacagugucaaugugucuugagagagg

SEQ ID NO: 4138252 - RNA, 82 nt, Human
ccuacuggaucagaaucucugagaguuuggagauggagaaaucauuuuuacuaaauucuucagguaauuuugaucaucaagg

SEQ ID NO: 4138253 - RNA, 80 nt, Human
ccuacuuagccacaguuuccauuaucuucaugagcaguagcuggaaugaaggagaaauggaaagugggaaugaagacagg

SEQ ID NO: 4138254 - RNA, 66 nt, Human
ccuagacagcauuucccggaaccgcauaggccauugacauuaugcuguuuccccaugugcugaagg

SEQ ID NO: 4138255 - RNA, 67 nt, Human
ccuagaccccaucccugauuuucacucgucuuggaggagccugaaucagagggugagaggucagagg

SEQ ID NO: 4138256 - RNA, 57 nt, Human
ccuagacuggaugguucgcauuuuucuggaugcaggaaagagagcuauucacuuggg

SEQ ID NO: 4138257 - RNA, 60 nt, Human
ccuagaggcugcaaggagaggcuguaaaauccuccuaaccuugcuuccagccuuccuagg

SEQ ID NO: 4138258 - RNA, 84 nt, Human
ccuagauuaggaaguagauagguuguucucugcugucauuguuuggacacagcucuauuuaccuuauuuauuguuccugcuagg

SEQ ID NO: 4138259 - RNA, 71 nt, Human
ccuagauuuuauuguucuguagugacauguagccaaaaagcaacauguaucuaaggacaagaugauauugg

SEQ ID NO: 4138260 - RNA, 130 nt, Human
ccuagcaauuuacucaacauuucucugagggcccaggccacuggguguaaaggacuuaagcaccuguucacaucuaauagcuuggucauauacgucuccggggguugcugggccagaacauggggagagg

SEQ ID NO: 4138261 - RNA, 82 nt, Human
ccuagcagccauccugugcccucuuauggacacccuuucaucagccuguccagaggacagggcuuugagcauggggcugugg

SEQ ID NO: 4138262 - RNA, 79 nt, Human
ccuagcguaaguauagcuuugucuauauugugugaauaagaaaacugagcuacaagaugauaaagcagcuugccuaagg

SEQ ID NO: 4138263 - RNA, 63 nt, Human
ccuagcuggcucccacaaacucacuacuuuacccccagaagucacugagauggugaggcuagg

SEQ ID NO: 4138264 - RNA, 71 nt, Human
ccuagcuucaguaaagucucuagaggguaggacaaguaacuccucucucagcauuacucuuacuaggcagg

SEQ ID NO: 4138265 - RNA, 57 nt, Human
ccauugagaacugugaacugugaugaagaaagcauucauccguuuauaucucugugg

SEQ ID NO: 4138266 - RNA, 81 nt, Human
ccauugauagccuuuuucuguccccagaauguggccaacauauguaugacucacauucacaggacagaaggauuguucugg

SEQ ID NO: 4138267 - RNA, 56 nt, Human
ccauugcagauucuucucagggagauaacuaucuuguuuagaaaaaugucugcugg

SEQ ID NO: 4138268 - RNA, 80 nt, Human
ccauuguggucagagaacauauuuuguaugauuuaaaucuuuuuaaaucuauugagacuuguuuuauggcccauaugugg

SEQ ID NO: 4138269 - RNA, 84 nt, Human
ccauuguuucuugcaggucacucacugagcguaggagcagacagagcugacuucaacuuaggggcgacuucaguaagaaagugg

SEQ ID NO: 4138270 - RNA, 62 nt, Human
ccauuguuuugaaacuccaucaaauugggcagcucuuuccagaagacagucucaagacaagg

SEQ ID NO: 4138271 - RNA, 73 nt, Human
ccauuuauucucuaguuggucagaugauguuuauuauugaucauaugaagaauuccaauuuggagaguguugg

SEQ ID NO: 4138272 - RNA, 63 nt, Human
ccauuucacccacugcuuuaggcugccagucucuugucugucucuucagcaguggugaggugg

SEQ ID NO: 4138273 - RNA, 55 nt, Human
ccauuucuuguuccaacuguguacuguucaagggaacacuugacaccagaaaugg

SEQ ID NO: 4138274 - RNA, 63 nt, Human
ccauuugaagacuuagaagaggacaaaggagauagaagcgucccuaagggaguuugcaggugg

SEQ ID NO: 4138275 - RNA, 115 nt, Human
ccauuugcauaaaauuuaaauuccuuauaaaagcucacaguaauacaaggccuguggagucaggccuuguauuugucaggcugugguaagaaauagacccaaaaaugcagacugg

SEQ ID NO: 4138276 - RNA, 106 nt, Human
ccauuugcaugcagauuuuacauuauuagcaaccaagagccucuagcaagaaggcugauggaagggucaguguguugcuuuucugagugagaucuggauggagagg

SEQ ID NO: 4138277 - RNA, 59 nt, Human
ccauuuguacauguugucuucuuuuaucuacacauuuaaagaggucaaauuauaaaugg

SEQ ID NO: 4138278 - RNA, 101 nt, Human
ccauuugugacccagauuguccaacuuucuccuuuauacugaguguauggcucaaaugaagcaauuagaaacuugaaggacaaaagcugaguugcagaugg

SEQ ID NO: 4138279 - RNA, 56 nt, Human
ccauuugugauguggcagcaucuuucaugaaaaugacaagcuccagaucaaggugg

SEQ ID NO: 4138280 - RNA, 99 nt, Human
ccauuuuaacacaccuccacaacucacagcuguuuggauuaggcauucaagacaagcauugacuuagccucaaaagucgugaggagguuacugaauugg

SEQ ID NO: 4138281 - RNA, 74 nt, Human
ccauuuucaguaugagugacuuccagggguucagucgguugcucugaacaucaguauucucaucuguaaaaugg

SEQ ID NO: 4138282 - RNA, 130 nt, Human
cccaaaacauucuucuagucagguccuuagcucagguauuuccaccuauuauuuucuguauuuacagaaugaguuuuuaggggggcauagugauauuuguaguggccuaagaagccugcaauuaguuggg

SEQ ID NO: 4138283 - RNA, 67 nt, Human
cccaaacaguggcaaggacaguaauaaugauuauuuuaguucaucuuuacacugcacuugcuauggg

SEQ ID NO: 4138284 - RNA, 71 nt, Human
cccaaacucuuggcugcguccuggcuguggaccuguauccuagaaacacuccaaggcagccaggagguggg

SEQ ID NO: 4138285 - RNA, 63 nt, Human
cccaaacuucagaaguucuuauuuuaaagcacucgagcaccuaggaaauacuguaaguuuggg

SEQ ID NO: 4138286 - RNA, 72 nt, Human
cccaaagauacacguuguauugaauacaagugugguaaacaacaagacuauuuuuuacaacuuguuucuggg

SEQ ID NO: 4138287 - RNA, 58 nt, Human
cccaaagguguuggccuucagugugggaagggccuccacccugacuccccaccuuggg

SEQ ID NO: 4138288 - RNA, 98 nt, Human
cccaaagucagcuaguaaauuuguggcaguauaagagcuagaaccuagucccuccucucaguucauagcauuuuguccugcucugugcugccuuuggg

SEQ ID NO: 4138289 - RNA, 76 nt, Human
cccaaaguuuuuauaguuagcauuaagaauauuaauaggcaacuaugaacuaagugguagcugcuaagauuuuggg

SEQ ID NO: 4138290 - RNA, 113 nt, Human
cccaaauccuagcugucccagggggccugugcuuggccagagagguuccucaccuuacugagguggcucugcuugaggccagccugcaggccgcuggugaaguaggaaguggg

SEQ ID NO: 4138291 - RNA, 66 nt, Human
cccaaaugccuuggcaggaccuccuguguacacaucccugacaggacacugcuguagcauauuggg

SEQ ID NO: 4138292 - RNA, 65 nt, Human
cccaaauugucuuggcuauugugagucuguggcgguaaucuauggauagugucuggauauuuggg

SEQ ID NO: 4138293 - RNA, 95 nt, Human
cccaacacauuaaaguagaauuggcagacaguguuacaauuuaauggaauuuccuccuuuaacauuagcauuguuucuuuuugcuuauuuuuggg

SEQ ID NO: 4138294 - RNA, 62 nt, Human
cccaacagaaaaucuaaaaaucugaaguuggaccaugcaagaguuuucuguuuucuguaggg

SEQ ID NO: 4138295 - RNA, 66 nt, Human
cccaacaugcccuaaguccaucagcaugccuugucuucauuagacaguugaugggacucauguggg

SEQ ID NO: 4138296 - RNA, 60 nt, Human
cccaaccccacuacacguuggagaagccauuuaucuucagguagugaguggggugcaggg

SEQ ID NO: 4138297 - RNA, 74 nt, Human
cccaacccccucccugaccugguugggcagggugugcaugagcucaugggagccccaggcagggcagggcaggg

SEQ ID NO: 4138298 - RNA, 77 nt, Human
cccaagaaccagcucagagcaggcuccugcccuguacgaggaaacccagagaaugauucugagacuugcuucauggg

SEQ ID NO: 4138299 - RNA, 109 nt, Human
cccaagacaaaaccgcaaagccccagaaugaggaaugugacaaaaccaaggagcccugcagcuugccuuugaaagcauuucuccucuggccguuuugugggcuccuggg

SEQ ID NO: 4138300 - RNA, 102 nt, Human
cccaagacagcaggcuagagcuaugguggcugagcugaguuucccagcuagacacuccccuagacacuuggcucagauaccaugcccuagcagugccugggg

SEQ ID NO: 4138301 - RNA, 56 nt, Human
cccaagagcuggcucuugcagcagccuccucugaggcucccugcucagcuccuggg

SEQ ID NO: 4138302 - RNA, 129 nt, Human
cccaagaucacuuuaggcucuaauuguaggccagauauugugcuacccacauuauaacaaggaugaccuuuccuccauugcccacuggguagcauaguaucggguguacaauuagagccuggagugggg

SEQ ID NO: 4138303 - RNA, 84 nt, Human
cccaaggauacuggccaggcgaaccacacugcgauaagaaacagcagcugaaaguuuguuuuuggagccaccagauccaguggg

SEQ ID NO: 4138304 - RNA, 61 nt, Human
cccaaggccaucagguagguccugacaggacagcugaccaagggcauaugauggucauggg

SEQ ID NO: 4138305 - RNA, 68 nt, Human
cccaagggaugcuugaguaguuucuaaggcaagcagaaucuuccaucugcucaaauggcacuuuuggg

SEQ ID NO: 4138306 - RNA, 78 nt, Human
cccaagguccugggcuagaaggaccaggauggggaagaaguggccucugccauucuggaccaagcugggugccuuggg

SEQ ID NO: 4138307 - RNA, 68 nt, Human
cccaaguguaagcaaagcucaagcuuacaggaaagccacacggaggaugggcuuuuuugcaauauggg

SEQ ID NO: 4138308 - RNA, 129 nt, Human
cccaauacaucggugaacuccauuguagggagcgcuacuuaagagggguaaaaaggccccaaaucucucuuuuuaaccuaccuuaagagcaacagguuaccuuagcuuuauggaggcaaccguaugugg

SEQ ID NO: 4138309 - RNA, 129 nt, Human
cccaauaccuuccuuuuccuggccugggagccugcuugaguucagggguugauuggauuuaagcgauacagagagcuccggacauucauacauguuccccaaacuagggccagcucaggaagccagggg

SEQ ID NO: 4138310 - RNA, 88 nt, Human
cccaauacuucagaaugugaccuuauuuggaaagaggguuguugcagauguaauuggucaagaugaggucauacuggaauagagaggg

SEQ ID NO: 4138311 - RNA, 72 nt, Human
cccaaugcaucgaucuauuuacucuuuuccuagauccuuaggcuguggaagguuuagauagguaaaauaggg

SEQ ID NO: 4138312 - RNA, 102 nt, Human
cccaaugucagcccaaagcccagcagucaggcccuccugugaucugccuggggcacccaggaaggggauggggcaugcugggaugggccaugauguguuggg

SEQ ID NO: 4138313 - RNA, 76 nt, Human
cccaauuacuggccaucccugaguaaggaaaagcuucauaauauauuuccaaacaggguggcuuaauuccaaaggg

SEQ ID NO: 4138314 - RNA, 67 nt, Human
cccaauucagagccuugcuucucuugccuggaugcccaggcagcagccacaaggccugagcauuggg

SEQ ID NO: 4138315 - RNA, 82 nt, Human
cccaauugauuugagaagcagauccaaaccauguccuuauuccaagauggucaaggauacuguucaucuacaagucuguggg

SEQ ID NO: 4138316 - RNA, 101 nt, Human
cccaauuuuucagguggucaaaauauccacuuguugaaaccagccuaggcgaacuuaaggacauugguuuugaguaauguaaaacaccuggggauaauggg

SEQ ID NO: 4138317 - RNA, 73 nt, Human
cccaauuuuuggaguuuucaagagaagccagaaaucuguuguauauuuuugugaaaucuccagacauuucagg

SEQ ID NO: 4138318 - RNA, 68 nt, Human
cccacacaggcaaaggaugauguuuguaaaucuaauuacauugaauuucacuuuuguaccuuuuuggg

SEQ ID NO: 4138319 - RNA, 58 nt, Human
cccacaccauuucuagagucccaagaggugucuuaaaugccuccagaauuggucuggg

SEQ ID NO: 4138320 - RNA, 70 nt, Human
cccacagaaccuggaccuuuuggguauuguuucaguggaacaugccuuucauaaguucaguuuucuuggg

SEQ ID NO: 4138321 - RNA, 76 nt, Human
cccacagcccaggguucagugggcccucuuguccaucugggcugggccuggagcccacgagccccuggccuuuggg

SEQ ID NO: 4138322 - RNA, 63 nt, Human
cccacagcuggggcucuagcgugauguauaaccuuugcuuccuaugcugcuguccuugcaggg

SEQ ID NO: 4138323 - RNA, 64 nt, Human
cccacagcuucacccauuaucccugccuucacccucaauucagggcaaaucugaagacucuggg

SEQ ID NO: 4138324 - RNA, 72 nt, Human
cccacaggcagaccucccacauccuagcucugcuuccaagaaccacccccuuggguguggaaggucaguggg

SEQ ID NO: 4138325 - RNA, 61 nt, Human
cccacagguccccaugaacucguuccugcuucucagccucugaccuucaggugaccguggg

SEQ ID NO: 4138326 - RNA, 73 nt, Human
cccacagugugcugagcagguggggguguguucuagacugaucacauccucacauucucaggacaaccuuggg

SEQ ID NO: 4138327 - RNA, 55 nt, Human
cccacaugcuggaaugcccacuuacaggacagguacugcauaacuggcauguggg

SEQ ID NO: 4138328 - RNA, 102 nt, Human
cccaccaagcccuguguucauaggaggagaugggaguaaccaggacagccccuggccaccucugacuccuggacuuggggcucuugaauacugccugguggg

SEQ ID NO: 4138329 - RNA, 58 nt, Human
cccaccacgugcuuugcuggagccuuuccuucuuuacuucagcucuuacccugguggg

SEQ ID NO: 4138330 - RNA, 89 nt, Human
cccaccccaggugguucucaggaguagugggauccauggagaagucagcccagucuugcauuuucugaagaugccaaguggggaauggg

SEQ ID NO: 4138331 - RNA, 76 nt, Human
cccaccccaucacacagggaggaggugcugugcccgcugggggggcagcugccccucucugggcccuuuggguggg

SEQ ID NO: 4138332 - RNA, 103 nt, Human
ccuaggaggaucacugcagauucuuaaauuuucaucuacaagaaacuaacaguuucaugggagugagaugaaaauaaauaaaggucacguuguggucccuggg

SEQ ID NO: 4138333 - RNA, 88 nt, Human
ccuaggauucccaacuuguaaucucauaccggucucuuugggcuucauguucacaguauuggggguggaggagguggggaaguuuagg

SEQ ID NO: 4138334 - RNA, 56 nt, Human
ccuaggcucgagugcaguggcgggaucucagcucacugcaaccucugccucccagg

SEQ ID NO: 4138335 - RNA, 60 nt, Human
ccuagggaugcugguucaaagugaagauccuugucuacacaacuaaucagaaucucuagg

SEQ ID NO: 4138336 - RNA, 67 nt, Human
ccuagguacauccuuccuaccacugcccuccgccaccccacaaccaggcuuucaggaauguccuagg

SEQ ID NO: 4138337 - RNA, 106 nt, Human
ccuagucgaacagccugauuuguaugcugaaaucuuagccauucugccuuggaaaaagucagaggcagaugagaugggaagaagcauagucaggggaugauggagg

SEQ ID NO: 4138338 - RNA, 67 nt, Human
ccuauaacagagugaaaaucagcacacauuauucggguuuacugugugcgugaugcuuuguugaagg

SEQ ID NO: 4138339 - RNA, 66 nt, Human
ccuaucuggcuuuuaccccacggcccaguucuagcuggggcauuguaaggcaaaagccauuugagg

SEQ ID NO: 4138340 - RNA, 62 nt, Human
ccuaugaaagacaggagaugcgagggauccagcagacaauuuuuucucuuuucuucuauggg

SEQ ID NO: 4138341 - RNA, 66 nt, Human
ccuauggaaucuucauaaaaaucuaguagaauuagauuucuacuagaauuuagcgagaucacaagg

SEQ ID NO: 4138342 - RNA, 104 nt, Human
ccuauguaaacaucauuaggacuagguucucuauugcccccaaagauauauuuuaguaucuccugcaaaguuagagcugaauuuuaugacucuguuuucauggg

SEQ ID NO: 4138343 - RNA, 109 nt, Human
ccuauuaaaaugcaaauacccuuaggagauauuagacuugaagucauuuaaaucaaguguaacuuacugugaguuuauuuaucugaucugaguagauugcuuugauagg

SEQ ID NO: 4138344 - RNA, 81 nt, Human
ccuauucucugaccaccagagguccguggguauguguucgugaguaugugggcuuuggggguuuuggcugaagagggaagg

SEQ ID NO: 4138345 - RNA, 68 nt, Human
ccuauugcagauagagggcauccccuucgcccuuugcugguaagggaauccaucuaucuucauuuagg

SEQ ID NO: 4138346 - RNA, 83 nt, Human
ccucaaagcguucacuccagaaauucaacagcaaauuuacuucauuucagagauuugugucucuuucagugaaacauuugggg

SEQ ID NO: 4138347 - RNA, 89 nt, Human
ccucaacccccuuccccugcgugcagaggcagcacugaucuggugaggacauugucucugccaugcuugagggugagcagggucccugg

SEQ ID NO: 4138348 - RNA, 79 nt, Human
ccucaacgagacauucuuaggaacaauguugucaaggaaacauacugaaacuguuacauaaaagaaugucucugugagg

SEQ ID NO: 4138349 - RNA, 74 nt, Human
ccucaacguuuccaucuaaaaugguucuuugguagaugguacuauaggaccauccuaagguaggcaaccugggg

SEQ ID NO: 4138350 - RNA, 87 nt, Human
ccucaacuccacuccuccucccaccgacuuuucagaggugauuuuuaauugcuuuuucccagguggagagagggaguggagaugagg

SEQ ID NO: 4138351 - RNA, 110 nt, Human
ccucaagaagggggcaugaccuugggaaagacaauucucucagucaaggcaguuucaaagagaguugacaguugaggguugucuaaacuaaaguuauucuguuucagagg

SEQ ID NO: 4138352 - RNA, 118 nt, Human
ccucaagagcucugccaccuguccaaggagagagccauguugggcuggccacagcuaaaaacuguccuggcccaguggcaucuucacugcuuggguugugugcaguuguauuuagagg

SEQ ID NO: 4138353 - RNA, 60 nt, Human
ccucaagaugcacugaacauauguugacagucaagcacugaugugucuuagagcaucagg

SEQ ID NO: 4138354 - RNA, 109 nt, Human
ccucaaggaaaagauaaguacaguugauucuuguuauuugcaguagcuguauucuauaaaguugccaccagcacugaauuagggaacacugaacuauuguuccuagggg

SEQ ID NO: 4138355 - RNA, 65 nt, Human
ccucaaggagcugugauguguccagaaacagacgaagccaucgacaucacacgccuuccaggagg

SEQ ID NO: 4138356 - RNA, 73 nt, Human
ccucaauaucagugcaugaaacaauaugcagugacuaaaagucucuaauuuuuguucugcauugaauaugggg

SEQ ID NO: 4138357 - RNA, 62 nt, Human
ccucacaagcuggagguuggagcuacuaucaauauaguggagagaccaauuagcugaggagg

SEQ ID NO: 4138358 - RNA, 106 nt, Human
ccucacccaucaacacuauugcccacuuaagcugauuaagccccuucuagcagagagguuggaggaaucagggcuuaggcuggucaagggaaugggaaaagugagg

SEQ ID NO: 4138359 - RNA, 77 nt, Human
ccucaccugggcaggcugccgugaagcaggccugagacuggugcucaggcccugggcaguucuguagcaccaggagg

SEQ ID NO: 4138360 - RNA, 113 nt, Human
ccucacucccuggcugcuccugugccugcacucccucuaguugcauucuguuccugacaagucuaacauuuauagggaguauagagagcagaguagguccugggaguuugagg

SEQ ID NO: 4138361 - RNA, 67 nt, Human
ccucacugcuauguguuugcucauagcagcugcuaauccagaaagaacaggcacuaagcaugugggg

SEQ ID NO: 4138362 - RNA, 56 nt, Human
ccucacuguuuaauagcuggaucuaaaaagcuaggccaugcgggagaauagugagg

SEQ ID NO: 4138363 - RNA, 66 nt, Human
ccucagaaaacagugaacuacucuaggcuccaaggggcuuaguaggagagcuuguucauucugugg

SEQ ID NO: 4138364 - RNA, 61 nt, Human
ccucagaagaaguggaauugaugcucccuuuaccuucuaagcaucaaacugcucuuugagg

SEQ ID NO: 4138365 - RNA, 59 nt, Human
ccucagaagcucaaggacauugucuguaaaacagaaauaauauuccuugucuugugggg

SEQ ID NO: 4138366 - RNA, 55 nt, Human
ccucagacgcaggccuaugggccaugggcccuaacuaggaccugcugugcugagg

SEQ ID NO: 4138367 - RNA, 76 nt, Human
ccucagaguuuggguggaaggaggguaaggaggcaagauuccuaugcccauucgcuccaccacccaccccucuagg

SEQ ID NO: 4138368 - RNA, 67 nt, Human
ccucagcacagugcaaacuuuugucuccucugcgaaagagaggaggccuguguuugucuguagaagg

SEQ ID NO: 4138369 - RNA, 58 nt, Human
ccucagcagaauguggcaugucacccaaacagggacaugcgaaguccugcugcaaagg

SEQ ID NO: 4138370 - RNA, 96 nt, Human
ccucagccucccaaacuguugggauuacagguguaagccaccaugcccaggugagaugcuggcucauuucuaaacccagcucauuggcaagugagg

SEQ ID NO: 4138371 - RNA, 63 nt, Human
ccucagcuagaaagucuguuagggagauaguuuuccucuucuuauucgucuuuuuugcugagg

SEQ ID NO: 4138372 - RNA, 130 nt, Human
ccucagcugagauggccagaagugggagccuaccuuugcuauccuuggaauccuaguucaauugaccucaucaagaagugggccaaauggaggcaaguggcucauaccauuguuuauuuucugagcuagg

SEQ ID NO: 4138373 - RNA, 67 nt, Human
ccucagcugcuucccuggagccauccaaguaaaggccaagaauaaauaggaggagcaggcucugggg

SEQ ID NO: 4138374 - RNA, 58 nt, Human
ccucaggguggcaucagaucuuuuuaucuucuaaccuaagacggaggccgcccugagg

SEQ ID NO: 4138375 - RNA, 56 nt, Human
ccucaggugugggccagcugucaacuuaaggcgaugcugguaccuggcaccagagg

SEQ ID NO: 4138376 - RNA, 75 nt, Human
ccucaguccugggcucagaaccuuguuaaggcucugacagccugcuuagaaucuugacuaucugagucccugggg

SEQ ID NO: 4138377 - RNA, 66 nt, Human
ccucaguuuucaggucuguacaaugggaugugaacaaaaauaccucccuugcuaaagacugugagg

SEQ ID NO: 4138378 - RNA, 107 nt, Human
ccucauaaccuagcaugccuuucauggaacaucagguuaagaaaugagcaucucaccuucugaagaugaguuucuacagggagcggcagaaugcuggcaaugugggg

SEQ ID NO: 4138379 - RNA, 78 nt, Human
ccucauaccccauccguccaaccuccggcgggcgccacugcuuguccucuggucuucgguguggacagauaggagagg

SEQ ID NO: 4138380 - RNA, 63 nt, Human
ccucauauguguauauuuauuguaguuucuuuuacuaauaagauucuagaauauauugugggg

SEQ ID NO: 4138381 - RNA, 72 nt, Human
ccucaucacucuuuaucuuuuaugucugcaguauaaauagcauagacauuuggugugaagggaggagaaagg

SEQ ID NO: 4138382 - RNA, 70 nt, Human
ccucauccugaacccauuuucugagcacgcugcauucauaaauagccugccaggcuuugggcuucugagg

SEQ ID NO: 4138383 - RNA, 103 nt, Human
ccucaucuuagcuuccaauaagagauuuuguauuuguuucucauccagcuggucauuguuggugaaagcuaaggagcaaguaggaguucucaagaugaaaugg

SEQ ID NO: 4138384 - RNA, 107 nt, Human
ccucaugaucugcccuccucagccucccaaagugcuaggauuacaggugugagccaucacauccauuguuuugucccagccugggccccaggagcacaggcaugagg

SEQ ID NO: 4138385 - RNA, 61 nt, Human
ccucaugaugcugagaguggauugacuaugcaguuauuccacuccaauaagugucaauagg

SEQ ID NO: 4138386 - RNA, 60 nt, Human
ccucaugccucaguuugacuggcuggucuuauugucuuccaggaaacugaggccaugggg

SEQ ID NO: 4138387 - RNA, 63 nt, Human
ccucauuagaucagaucggcaguaauccaggaggaagacuggugauuggaucuaaggaaaagg

SEQ ID NO: 4138388 - RNA, 102 nt, Human
ccucauuauuaccaaucucacugauuagaucaauacuaaagaaguuacguuuuuuguaugcuuuuaguauuguuuuauagcagguagaaguuuaaggagagg

SEQ ID NO: 4138389 - RNA, 55 nt, Human
ccucauucauugcaagcacacgcaaugaauguuguaguggaacagguggaugagg

SEQ ID NO: 4138390 - RNA, 86 nt, Human
ccucauucgucugccaggaaggcgccuccuacaggugucccaggcuggacacuggacucacguauuccugagcaaagucaaugagg

SEQ ID NO: 4138391 - RNA, 75 nt, Human
ccuccaaacaccuuuacaguuuaagaggaaacaaaaugauuguuuuuauuucccuucuuugacugugguuagagg

SEQ ID NO: 4138392 - RNA, 85 nt, Human
ccuccaagacccuaaggccgggcaagguaggcaagaagauaggucucugccucuuucaggccuggcacacucagggggcuggagg

SEQ ID NO: 4138393 - RNA, 94 nt, Human
ccuccaagcuugagcagcaguuuugaaguguggagaugggaggugaguuauucacaucucuaacaaaggagcugcugcuucuggcuucaggagg

SEQ ID NO: 4138394 - RNA, 56 nt, Human
ccuccacagguaggcagagcgagucugcaucuguuggcugccuucccugcuggagg

SEQ ID NO: 4138395 - RNA, 65 nt, Human
ccuccacuauuggucccugggcaagaaugugugccccagggcauguaacuaaugguggccacagg

SEQ ID NO: 4138396 - RNA, 70 nt, Human
ccuccacuccucagccagcaucagggagaaagaagcuuccagaguccauguuggcucaggaccaaggagg

SEQ ID NO: 4138397 - RNA, 88 nt, Human
ccuccagaaucaaugcuauguaacuggcagauagauugucauuaugcugaauuugucccaggacuugcauagauaucuucuuuggggg

SEQ ID NO: 4138398 - RNA, 121 nt, Human
ccuccagaccuccccaacuccucgccuccccaccucccugccucuuggcgucagcgaaggcucugcugccugcagggcagagaggagagggaggaggccagcgagagggagccucugucgg

SEQ ID NO: 4138399 - RNA, 63 nt, Human
ccaggagguucugggccagguugagugucuucagaugggucagaggcuggaagagccuccugg

SEQ ID NO: 4138400 - RNA, 59 nt, Human
ccaggaucuggguccaugggaccccuaccuuaucaacuguccccauacccaggcccugg

SEQ ID NO: 4138401 - RNA, 80 nt, Human
ccaggaugcccgaggguggggagaagcagcucagauggcgucacuguguugccuucccccagccgaugggauuuuugugg

SEQ ID NO: 4138402 - RNA, 64 nt, Human
ccaggauggucaggugggcaguggguugagcgugcagccucguacccagccuccuguguccugg

SEQ ID NO: 4138403 - RNA, 66 nt, Human
ccaggaugucagggcucuagagauacaacucagugauucucuggguuuuuguccuguacguaaugg

SEQ ID NO: 4138404 - RNA, 58 nt, Human
ccaggauuugggaucccugaggccuuuaacacaucacucagucauugccuccuucugg

SEQ ID NO: 4138405 - RNA, 77 nt, Human
ccaggcaaaaucaaaucaggauagaaccucacgugugauaacauucauccucaccaugacuuucauccugagccugg

SEQ ID NO: 4138406 - RNA, 128 nt, Human
ccaggcaaguaaaugaacaucaacuuacaucuacaguccauaacuggaaccuggcuaggaacagggaaacguuugaauagaaauuagcaaggugaaguaugggugagaaaagugauguuccuuccugg

SEQ ID NO: 4138407 - RNA, 76 nt, Human
ccaggcacugaccugggcauuacaggugcaguggggacaagugggccaguccugccuaaggugguugacagccugg

SEQ ID NO: 4138408 - RNA, 86 nt, Human
ccaggcagcauugcaugagugucacaggguaauuguuuaacguaauuuugaauaaaauauauugugaugaaguggaaagagcuugg

SEQ ID NO: 4138409 - RNA, 57 nt, Human
ccaggcaggcagcguucucagggccuggcccccaggcugugggaugugugugucugg

SEQ ID NO: 4138410 - RNA, 71 nt, Human
ccaggcagucaggguuguguguuaggaggaaccuggguuccucaucuugcagagcugcccuauugccuugg

SEQ ID NO: 4138411 - RNA, 72 nt, Human
ccaggcaugguggcaugcaucuguuguccuagcuacucaggaggcugaggcaggagaguugcuugaaccugg

SEQ ID NO: 4138412 - RNA, 72 nt, Human
ccaggcaugguggcuugugccugugguucuagcuaaucuggaggcugaggcaagaggaucacuugagccugg

SEQ ID NO: 4138413 - RNA, 67 nt, Human
ccaggccaguguuugguccagguuccucagaaaucacaccugguuacacgugaaccacugggccugg

SEQ ID NO: 4138414 - RNA, 96 nt, Human
ccaggcccuagucuucucuuccuuugucaacugaucaugggcaacaaccuaugaggccaucagugcagggugggagagagaaggcaggguggcugg

SEQ ID NO: 4138415 - RNA, 85 nt, Human
ccaggcccugccccccagagacagucucaccuggaguuuaaacuuuuugaaaaccgugggaggcugaaucagggaggcagccagg

SEQ ID NO: 4138416 - RNA, 82 nt, Human
ccaggcccugugagacugcaaggguacaaugaugagcaaguuacagagccugcuuucaggagcucacagucuuugggucugg

SEQ ID NO: 4138417 - RNA, 84 nt, Human
ccaggccucaguguacccauuuguggaccaccacccaccuuggaggguugagugggauuaaaugaggugacagugaggcacugg

SEQ ID NO: 4138418 - RNA, 72 nt, Human
ccaggccugugcaaggagggaggguguccguucaccugcccucccagauugcaagccacaaccagugccugg

SEQ ID NO: 4138419 - RNA, 100 nt, Human
ccaggcgagcagagggaguagagcaucuccuucaaccccauggucccugcauguacguuagcaggugguccagaggagaugccuccucugugcuguuugg

SEQ ID NO: 4138420 - RNA, 85 nt, Human
ccaggcguuuccaacucugaguuuacaguauguuuugauuugaucauuacagauuauaaauuugagcugguuuuaaaauuucugg

SEQ ID NO: 4138421 - RNA, 71 nt, Human
ccaggcuagugcuugcgaaccuuggccaaccuuucccaaguccuuggcccagcaugcgggucugugccugg

SEQ ID NO: 4138422 - RNA, 65 nt, Human
ccaggcucagucagaaaauguaucucugccuccuggggaaagaaacauuuuucuugcuggcaugg

SEQ ID NO: 4138423 - RNA, 63 nt, Human
ccaggcucgucauacgccugcuugcugauccacaucugcuggaagguggauggcgaggccggg

SEQ ID NO: 4138424 - RNA, 73 nt, Human
ccaggcucuccaggagcucaggcucucagcacaguauuugcaccugucuaggcugcugccuuggagagugugg

SEQ ID NO: 4138425 - RNA, 76 nt, Human
ccaggcucucuguggcgccgcugagagcagagggcugucuuggggucuucgagcucuggagccaaggauggccugg

SEQ ID NO: 4138426 - RNA, 62 nt, Human
ccaggcugcuuagccuuaucuuaguccucauccgcuuucagcccagggagaagcagccaugg

SEQ ID NO: 4138427 - RNA, 68 nt, Human
ccaggcuuugucuccagccaagccccaggcaggcagcacugccuggacaggcaagcaagacauacugg

SEQ ID NO: 4138428 - RNA, 63 nt, Human
ccagggaaaggagguugacuuguuugggacuuuuucacuccagaauuccgccccuauucuugg

SEQ ID NO: 4138429 - RNA, 62 nt, Human
ccagggaagaaagaugaagugccugguggcuccaaggcagccaccucauuuauccucuuugg

SEQ ID NO: 4138430 - RNA, 83 nt, Human
ccagggaagaggccuuugggcaacaucccaauucauuacagcuagaaaagaagaagggcugcuuuuaagggucucagcuuugg

SEQ ID NO: 4138431 - RNA, 60 nt, Human
ccagggaauaguaacuuuuguuacuuacauacuauguauaaaacagaaagcacuaccugg

SEQ ID NO: 4138432 - RNA, 60 nt, Human
ccagggagacuaguguggaggucaccaaaagagcaggaagagccccaaaagucacccugg

SEQ ID NO: 4138433 - RNA, 62 nt, Human
ccagggaggucgagggcccuuggucaccauccucucagcaccaggagccaagaucucccugg

SEQ ID NO: 4138434 - RNA, 77 nt, Human
ccagggauggaugugguuuuaguaaaccugauaggguguaagcaggaucagaauggagcccacauggucgaccgugg

SEQ ID NO: 4138435 - RNA, 55 nt, Human
ccagggcaggggcuggaguucaaccuggucuggacagucucugccccugccccgg

SEQ ID NO: 4138436 - RNA, 62 nt, Human
ccagggcucuaugaggguggagaccauggagcagcacuggccaccuggagcuggagccuugg

SEQ ID NO: 4138437 - RNA, 55 nt, Human
ccagggcuggcgcuggagcacguguugaguucaggcucuccagggccagcccagg

SEQ ID NO: 4138438 - RNA, 74 nt, Human
ccagggcugggucuggaugcucagguggaagguggggaugggauccagaaccccagggcagcucccagaccugg

SEQ ID NO: 4138439 - RNA, 84 nt, Human
ccagggcuguggggugggaugccgcugucuccaccucuuagcugcaugagauggagcaugcgucucaaccccucaaagccucgg

SEQ ID NO: 4138440 - RNA, 56 nt, Human
ccaggggaggcagcgauaaaccuggauaauuugggccaggccucuuccuccccugg

SEQ ID NO: 4138441 - RNA, 94 nt, Human
ccaggggaggcugucagcgagggcuguguacuaugaggaggggaaguacaaacaucucugggcucugcgaagcccuucuccagcccuuuccugg

SEQ ID NO: 4138442 - RNA, 68 nt, Human
ccaggggcaggagaagguuuggagugcaggcagaaacuuccugaaucuuccccuuacuccugcuaugg

SEQ ID NO: 4138443 - RNA, 75 nt, Human
ccaggggcugcuaugacaauaccagugggcucuguccucacuagcagccugcuggcuguccauugcagccccugg

SEQ ID NO: 4138444 - RNA, 74 nt, Human
ccaggggcuuugcaaagaaauuauugcuguguuagguagaacacuaacauagauaucuugaagagccuuucugg

SEQ ID NO: 4138445 - RNA, 58 nt, Human
ccagggucacaaauaacugcagcuccagcuuccugcugcagacauuugauaacucugg

SEQ ID NO: 4138446 - RNA, 61 nt, Human
ccagggugaggaggcucccacgcugccgagaggcugggaaggagacgcguccugccacugg

SEQ ID NO: 4138447 - RNA, 58 nt, Human
ccaggguucagacaggguaauggugaagaaauucccaagcaaugagucagggcccagg

SEQ ID NO: 4138448 - RNA, 101 nt, Human
ccaggguuccaguaggcggguggugggaguccauuagucacucaccuucugcccuuucuggucucagcugggcucuuaucaccuguaccugggccuccugg

SEQ ID NO: 4138449 - RNA, 58 nt, Human
ccagguaaauuaccuacugaauuucacuuugguuuguuucuguuggugacuugccugg

SEQ ID NO: 4138450 - RNA, 78 nt, Human
ccagguaacccaugcccugcugccaucuggccggaccgggaugguccaaggagaggaggcagggcaggggccuccugg

SEQ ID NO: 4138451 - RNA, 84 nt, Human
ccagguagaaaaagaugugaucaaaagauuucauugguucuguuugcugugucuucuuucuggucucgccuuauucuaccaugg

SEQ ID NO: 4138452 - RNA, 64 nt, Human
ccagguagaagaccugucagccauaucaucucauucaaguggccugcaaagucuucuugcuugg

SEQ ID NO: 4138453 - RNA, 82 nt, Human
ccagguccugaccuugcacucacaucuuuaggcuuacaggugugcuuuuugugcauccugaucgaagauggagaggacuugg

SEQ ID NO: 4138454 - RNA, 85 nt, Human
ccagguccugcaggggcaguccacuuccuucauagagucuguggauccucuugggauugcugguuuguucuugcagucgaucugg

SEQ ID NO: 4138455 - RNA, 64 nt, Human
ccaggugauucuugagaaucuucucugaagaggaguuauauuuuucagauagauuuuuagcugg

SEQ ID NO: 4138456 - RNA, 68 nt, Human
ccaggugcaauaggauuauugacaaccuuguugaaagcagcuuuagaguggaaguucuguugcauugg

SEQ ID NO: 4138457 - RNA, 98 nt, Human
ccaggugcaguggugcacaccuguaauaccagcuacuugggaggcugagagguggagguuacagugagccgagauuaugccacugcacuccagccugg

SEQ ID NO: 4138458 - RNA, 81 nt, Human
ccaggugccucgccuccuggaucagcuguauuacaaauggucuucuucacagucccagagaggucggggccauauucuugg

SEQ ID NO: 4138459 - RNA, 61 nt, Human
ccaggugcuagcaaucacugucaagggaaauacaaugauggagaucaacagugagcccugg

SEQ ID NO: 4138460 - RNA, 64 nt, Human
ccagguggcagggggcuaaagggcacuuccugccagggaggcucucacccucugaccagacugg

SEQ ID NO: 4138461 - RNA, 56 nt, Human
ccaggugggguccagagcucagugcgucuugcuggcucccagaggccccagcccgg

SEQ ID NO: 4138462 - RNA, 80 nt, Human
ccagguguccgguuccucggcugagggcucgcuugacuccauggucuaggcagcagagguugaggaaaggggugcucugg

SEQ ID NO: 4138463 - RNA, 99 nt, Human
ccagguugccauggugagcuggcugccgacuggcucuuggcuggggacccaggaggccucccccggcggcccugccugaaccucaccauggcagccugg

SEQ ID NO: 4138464 - RNA, 56 nt, Human
ccaguaaaaaauuaagucaaaauuugaggggaaaaucccugcuuaauuuugacugg

SEQ ID NO: 4138465 - RNA, 78 nt, Human
ccaguaaccagauggcaugcauuucauaccaagcuuguugaaauaagaacugaaaucaucugccaauaaguugcaugg

SEQ ID NO: 4138466 - RNA, 70 nt, Human
ccaguaauggaaauagcaguucagcuaaaauauauauugacaaagcuaggucaugcuaugguguuacugg

SEQ ID NO: 4138467 - RNA, 66 nt, Human
ccaguacugucuccaauauuccauagguaauuagaauguugcagugaugauggcaggcagcacugg

SEQ ID NO: 4138468 - RNA, 85 nt, Human
ccaguaucugugaaugugaccuuauuugggaauagcaucuuuaacgauauuuaaauuaaguugagguuauaauggauuagcaugg

SEQ ID NO: 4138469 - RNA, 79 nt, Human
ccagucaaugucuauuuuacagcauacauuauuuaacaaaaaauaguagugaaauugcuguaagaggaaaugcagaugg

SEQ ID NO: 4138470 - RNA, 56 nt, Human
ccguuucugcuuuuagcuaaacuauaggaaacuguccccuaugaagcaaggaaggg

SEQ ID NO: 4138471 - RNA, 55 nt, Human
ccuaaacagaacaaagaggcagaggauggcaaaucugcuucuuguuugauuuggg

SEQ ID NO: 4138472 - RNA, 65 nt, Human
ccuaacaccaaugccauuuucuacacauuguguccuaauguaaagggcaugguauugggaggagg

SEQ ID NO: 4138473 - RNA, 56 nt, Human
ccuaacuuucauuaggccccagggacugcauccuagggccuaauaagaaggauggg

SEQ ID NO: 4138474 - RNA, 61 nt, Human
ccuaagaaggaggaaaagugccaaauuagugucucuaugacuggcaugcucucuuuuuagg

SEQ ID NO: 4138475 - RNA, 71 nt, Human
ccuaagcccuggaggucuacagugguagcucccaugccugucugagucuacucuaggcuauaggucuuugg

SEQ ID NO: 4138476 - RNA, 66 nt, Human
ccuaaggggucuugucaguuuuguauacuggcacacagccaugauuuacagaaacaggacuuuugg

SEQ ID NO: 4138477 - RNA, 102 nt, Human
ccuacaaaaguuuagaauguauugauucuuuggagagcuauauagauuaacgacuuucuuuaugcucauccaaggaagguauuuaaucauaauguaaauggg

SEQ ID NO: 4138478 - RNA, 129 nt, Human
ccuacagaauuaaaggcuaucacauagcaaccagcagagagcaguagagaacuucucgagugccugcugcuaagcucuuuguuucugcuguuuuaacuuuguguauagaacaaucauugagcugucagg

SEQ ID NO: 4138479 - RNA, 80 nt, Human
ccuacagagcuaguccugucugcucaggaguuugucgucgugcaacacagcaacuugcaguauggagcugccuuugaagg

SEQ ID NO: 4138480 - RNA, 80 nt, Human
ccuacauauuugccauauaauuauucagcaucaaaccuuauuaaucaaaucgaugcuguguuuuaaauggaaauugcagg

SEQ ID NO: 4138481 - RNA, 79 nt, Human
ccuaccacaguuacagccuucaucuuugccuugcaggguaaggcacgcauaagagggggccacguugugcaaggguggg

SEQ ID NO: 4138482 - RNA, 74 nt, Human
ccuaccaguaggaggccagagaugaggcuuuagagcaaagagauuucuguagucugaccuaaggaauugguagg

SEQ ID NO: 4138483 - RNA, 79 nt, Human
ccuacccucucccgccuccagggcuacaaggcaccagaccaguggguccuggccgcuggccccugagaggcagggcagg

SEQ ID NO: 4138484 - RNA, 87 nt, Human
ccuacccuuucagaaugugaccuuauuuggaaauaggccauugcagauguaauuaguugagaugagaucauauuggaguaggguagg

SEQ ID NO: 4138485 - RNA, 84 nt, Human
ccuaccugauaagcucuaugaguacaaggacucugucucucuuuaccaguauguagcauaggguccuaguacacaguuaggagg

SEQ ID NO: 4138486 - RNA, 77 nt, Human
ccuacuaccccugaaccccauuccauccuagagucuaugguaggaagcacuggaagggguuggggggggaaacgagg

SEQ ID NO: 4138487 - RNA, 72 nt, Human
ccuacuauaguuggaaguaaggaugggggccuugaguaauugcucugcuucuaaccugcuuccuguagcagg

SEQ ID NO: 4138488 - RNA, 105 nt, Human
ccuacucacagaaagcacacaccuguucuguccuccacacuguaaguuguugaggggcagcuccuacaagaggaggcuaguucagugcuaccugugaucaagagg

SEQ ID NO: 4138489 - RNA, 57 nt, Human
ccuacucccuuucuagaguauggcagagccaauucucaacccuaguaagggaguagg

SEQ ID NO: 4138490 - RNA, 62 nt, Human
ccuacucucacccagcccccuucuugguucccuaggggaggaaggcuugggugaguauuagg

SEQ ID NO: 4138491 - RNA, 69 nt, Human
ccuacucuggucauuuucacuuucaaguuaucaacaugaggucacuguagauggaggugggaagagagg

SEQ ID NO: 4138492 - RNA, 62 nt, Human
ccuacugcaugaccuuggacagaacuugccucuuaggccucaguuuccucaacugcagaagg

SEQ ID NO: 4138493 - RNA, 76 nt, Human
ccuacuuaauucuaguuuaacacuuaguaaggcuuccaggcuucaaaauuugagugcuaaaauagaauaaaguagg

SEQ ID NO: 4138494 - RNA, 80 nt, Human
ccuacuuaggucgauuugugucaagguuuuugaaaguaaacaaaaacuuucaaacauaaaacuaaaucgagcuauccagg

SEQ ID NO: 4138495 - RNA, 73 nt, Human
ccuagaaagucuuguagugaguuuccugcucuuucuuuuaaaagcaggaaccuaaugaaggcucaccucuagg

SEQ ID NO: 4138496 - RNA, 63 nt, Human
ccuagaacgucuuuacucuuacgaaugggacaccuaugaaaaguuaccagugaggacuucagg

SEQ ID NO: 4138497 - RNA, 66 nt, Human
ccuagaagaaacugucggggauauuuuguugugccggaaugugguucccgucuaguuuuaaaaagg

SEQ ID NO: 4138498 - RNA, 76 nt, Human
ccuagaauuauaaacuuauuagaauaagcuucauaugccuugaggaaugcguuuaauagguaguacuguauuuagg

SEQ ID NO: 4138499 - RNA, 80 nt, Human
ccuagaccuugagaggaaguuuguagaaauauugauauggugaacaaugauuccagcuugacuucuacuuaauauucagg

SEQ ID NO: 4138500 - RNA, 63 nt, Human
ccuagaggauccuaagaagauaugacaacuaaauguaaugugguauccuggaugggauccugg

SEQ ID NO: 4138501 - RNA, 63 nt, Human
ccuagaggguggugaggccugguucacagaucugcugcgcuguguaacccacagcccucuggg

SEQ ID NO: 4138502 - RNA, 83 nt, Human
ccuagagguuucaugguacauaguacauguauguguaugugugugcaugugcaaauacauaugcuguggaggugggacaaggg

SEQ ID NO: 4138503 - RNA, 61 nt, Human
ccuagccaucaugucuaucuggcuacuauuaguucaggucugggcacaugguacaauuagg

SEQ ID NO: 4138504 - RNA, 64 nt, Human
ccuagcccugucucucacuccagguggcccaucugugacugggguuguuaggcagggacagagg

SEQ ID NO: 4138505 - RNA, 103 nt, Human
ccuagcuuucaauugugugaaaaucuacuuguuugaaucucucuagagucaagauuagagggccugggcagaaguuaaaggaggcagauuucuaacaauuagg

SEQ ID NO: 4138506 - RNA, 56 nt, Human
ccuaggcuggagugcaguguugccaucucggcucacugcaaccucugccucccagg

SEQ ID NO: 4138507 - RNA, 65 nt, Human
ccuagggcaccacacaugacugugacuuccugacagauagaccaagugcaggugccacuaucagg

SEQ ID NO: 4138508 - RNA, 64 nt, Human
ccuagggccuuucuugucauggggcugaaaugaacccucagcucucagacagggaggcucuggg

SEQ ID NO: 4138509 - RNA, 90 nt, Human
ccuagguggauuucauaaggaccuguguucaggucgugguggaaagacaggaggggacacgugagaccuugcagagguggaauccacagg

SEQ ID NO: 4138510 - RNA, 88 nt, Human
ccuagucaaugguacagcugagagccugccucuggugagacugcacuucccagagucccuugcagcucaguguggcccagugacuagg

SEQ ID NO: 4138511 - RNA, 85 nt, Human
ccuaguguccccugcugugcuugcauggcucacuguuguaccuucagcaucuagcacagugcugggcacacaguaggugcucagg

SEQ ID NO: 4138512 - RNA, 70 nt, Human
ccuagugucuuaaugaaguagauuauacauuuuuaugaaccauaaucagaauucaugaaagauaacuagg

SEQ ID NO: 4138513 - RNA, 63 nt, Human
ccuaucaauaccuccugcugcuaaaaagcagcagcuaaaaagcagcaggagguauugauaagg

SEQ ID NO: 4138514 - RNA, 61 nt, Human
ccuaucaggugauuugauuugucccauugcuggugguguuaacuuugaucacuugauaagg

SEQ ID NO: 4138515 - RNA, 130 nt, Human
ccuaucauuccagcccaauucuuucuauggugaugucccugcuguccuguuugguauuuugaaggauuccguucaagcagcuuuuacagaagaggcgacaggugcagccaucuggagcuuuuagaaaugg

SEQ ID NO: 4138516 - RNA, 89 nt, Human
ccuaucugaacuacuguauuguuggcucuuuugucugaagcccauuauuuagccagaagccuaaauagugcaccagguaaaggaaaagg

SEQ ID NO: 4138517 - RNA, 55 nt, Human
ccuaucugggguccuuuggcuccauacacaccagacccagagcccgccagauggg

SEQ ID NO: 4138518 - RNA, 66 nt, Human
ccuaugacuauuuuguugugucuuuuagccagauauugagccagcacaauagagcaguuaaaaagg

SEQ ID NO: 4138519 - RNA, 67 nt, Human
ccuaugcuuguccaugcugugguuauuugauuaacuuaauguaauaccacuguuggacauuaauagg

SEQ ID NO: 4138520 - RNA, 77 nt, Human
ccuauguguguuuaaugggccuugcuggagggaggacuguuuuuagcagaaacucauuaaauugcagacauuucggg

SEQ ID NO: 4138521 - RNA, 73 nt, Human
ccuauguuugggcacacaaauauuuuaugacaaauuaaugcauaccaguacacauugugugcuacaugauggg

SEQ ID NO: 4138522 - RNA, 82 nt, Human
ccuauuucagcuacagcaucucugcuuuuaucuauuuuauuuguuagaucacugaaagaaagaauguuguggcuuaaagggg

SEQ ID NO: 4138523 - RNA, 74 nt, Human
ccuauuuugaaauuucaaguggcaucuuugaucugauuccuuaggcauuagauauccuugaaguuauagugagg

SEQ ID NO: 4138524 - RNA, 87 nt, Human
ccucaaaacauuuccagauauuuuuauguggaauauaugauuagauguuauuuuuccuuguuaauagugucuggauuugauuugggg

SEQ ID NO: 4138525 - RNA, 72 nt, Human
ccucaaaaugugugccuguuaaggggcaaauaaauguaauggauguacuuagaggguaacauggacuugagg

SEQ ID NO: 4138526 - RNA, 71 nt, Human
ccucaaacaguuuaugauaaauucuuagggucucuugauuucuuaagucucucguuugauucauuuugagg

SEQ ID NO: 4138527 - RNA, 125 nt, Human
ccucaaauguaauuggcauuggaaaacugcugguugguugaaugaauaaguggaugagugauuaauuuacucuguacucauuucaaacagcacaaaaguuacaacauugcacgauaaauuugagg

SEQ ID NO: 4138528 - RNA, 55 nt, Human
ccucaaauugucaaauaagaauuuccuuaaguaauuuuuaugagauaauaugggg

SEQ ID NO: 4138529 - RNA, 63 nt, Human
ccucaacccaggaaagaauuuagagccauuuguaauguuucuaaggaaauuccugcacugagg

SEQ ID NO: 4138530 - RNA, 82 nt, Human
ccucaacuguggaccaggggcgcacucccugcacacaaggguguccaguaggggcggagucccagggucuccggcagugagg

SEQ ID NO: 4138531 - RNA, 87 nt, Human
ccucaauucauuagagcugauaaugaggccaaggccaaggccagggcuaugaccucugugaauguccuaagcucccuggauaugagg

SEQ ID NO: 4138532 - RNA, 56 nt, Human
ccucacagagcacacaagaauugcagcacauccugcagaaguaggcucuguguagg

SEQ ID NO: 4138533 - RNA, 72 nt, Human
ccucacagcugaaguagccauguggccaggacagaaagcuugaguuagcacaauuauuucaguugucauugg

SEQ ID NO: 4138534 - RNA, 74 nt, Human
ccucaccucagagcccugaagcagagcuaaaguuggacugcuccaugcucuccuuagggcuaccccaggugcgg

SEQ ID NO: 4138535 - RNA, 76 nt, Human
ccucacgugauccacaugaggugacuuccaagcuguuaacuggcaagcucuugagucaguucaucuggggaugagg

SEQ ID NO: 4138536 - RNA, 80 nt, Human
ccucacugcagggcccucauuccuguccuucuucagcaccagcugccuuggaccccagggaaugagcucagcaagcgggg

SEQ ID NO: 4138537 - RNA, 59 nt, Human
ccucacugggauaugcccauuugcaagagagugacuucaaguuauggcuucccaguagg

SEQ ID NO: 4138538 - RNA, 57 nt, Human
ccucacuguacuacgaccuccagggccaccucuuugccauggagagcagcagugggg

SEQ ID NO: 4138539 - RNA, 58 nt, Human
ccucacugucaucaguaguuauggcugucucuuccagauuacugcuggagauguuagg

SEQ ID NO: 4138540 - RNA, 75 nt, Human
ccucacuuaugucaucccugugugguggcuuggacuuugguaguccagcacuguuaugggaugacuuaaggaagg

SEQ ID NO: 4138541 - RNA, 56 nt, Human
ccucagagcucuuccuccuguccaugggacuuucuuggaagccagcauccuugagg

SEQ ID NO: 4138542 - RNA, 84 nt, Human
ccucagagcuuauuagaaaugcauaauuuuaggaccccaucccaggccuacugaauuagacugcauuuuaucaagauucucagg

SEQ ID NO: 4138543 - RNA, 117 nt, Human
ccucagauguucgugggaaugucacauaagggguggcauguaugcagcuggcuuaugcauagggaaucacuagcuacauacuuggccauucuccuucauuucugccuuugucugggg

SEQ ID NO: 4138544 - RNA, 75 nt, Human
ccucagauuuacugcuugacacauugguugugucauucugcauugugaaaggcugauggugaagcagcaaacagg

SEQ ID NO: 4138545 - RNA, 83 nt, Human
ccucagccaaugacuaacaugaggaauaugcuaauuucugugccccucagguucagagacauguucuagaucaucgccagagg

SEQ ID NO: 4138546 - RNA, 115 nt, Human
ccucagcccacagugagucugguuucugaguugucccggucuagccacuuucguuuccccuggggccggguggaggcuggggcagaaagcggaacugagcccgcguguucugagg

SEQ ID NO: 4138547 - RNA, 70 nt, Human
ccucagcccuuuccaugaacugucucaauucccgcaauaaucauacauugcacaguuucggaaacugagg

SEQ ID NO: 4138548 - RNA, 130 nt, Human
ccucagccucucaaaguccugggauuacaggcgugagccaccgcgcccggccuguauucauuucuuaaaaauauuauuggccgggcgcgguggcucaugccuguaaucccaguauuuugggaggcugggg

SEQ ID NO: 4138549 - RNA, 93 nt, Human
ccucagcucaucuuacaccauauacuuacucuccuguuugcagccucaaaccugcaacaggagaguaaauauaugauguaagaugagccgagg

SEQ ID NO: 4138550 - RNA, 82 nt, Human
ccaguguaccauuugagaagcucuagagguguuuuugcuauacaaaagcuaguucaagggcuucuuucagaaugggggcugg

SEQ ID NO: 4138551 - RNA, 89 nt, Human
ccaguguagccagcauuaaaccagagaggaugaggaagguagggugcccaagucugcccuuggcucucuuguuguguaagcacauuugg

SEQ ID NO: 4138552 - RNA, 91 nt, Human
ccaguguauuuucaguacuuacauaaaaacugaauguauuuuguaugcaguacauaucgguugaaugcaaguauugaugaaggacagaugg

SEQ ID NO: 4138553 - RNA, 72 nt, Human
ccaguguauuuucauccacucacggagagguuaauuauuaacacacugaaggugagaugggguacaugaugg

SEQ ID NO: 4138554 - RNA, 56 nt, Human
ccagugugugcuguuccccggagggugaagcagcagcccuuucagacacacgcugg

SEQ ID NO: 4138555 - RNA, 55 nt, Human
ccaguguguuaguggauuucccucagacagaaacacagacccgcugacacacagg

SEQ ID NO: 4138556 - RNA, 66 nt, Human
ccaguguuuauaaguacuuugucugcuuuauuaauuuugaagaggaaugaccacuugugauauugg

SEQ ID NO: 4138557 - RNA, 129 nt, Human
ccaguuaaacuggaauuucagauaaaucacaaauaauguuucaguacugucugucccauucuuuuaauauuugggacacacuuuugcuaaaaauuguuugugguuuaucugaaauucaaauuuaacugg

SEQ ID NO: 4138558 - RNA, 100 nt, Human
ccaguuaacuuucauguacguugucuugauuagaaugaugggcucugcucuacuuagacguucugcucagacuuuauaguacguggagugugcagcuugg

SEQ ID NO: 4138559 - RNA, 68 nt, Human
ccaguuaagcaggcucguuggaaguccccuucugacauugaaggucuuguaaagagucugccuucugg

SEQ ID NO: 4138560 - RNA, 104 nt, Human
ccaguuaccuauguggacaguuagguuauuuugguuuuucacuaucacaaacaaugguacaauuaaaauaauuuuguaagcucaucugucagguaagucccugg

SEQ ID NO: 4138561 - RNA, 79 nt, Human
ccaguuauuucagguuucauuggcagcuucaucagagcccauuagggagaaaugaaaaucaugagauuuggagaauugg

SEQ ID NO: 4138562 - RNA, 78 nt, Human
ccaguucagcucuucuucuugucuacugugugaaauagccguucauuuuucaaacuguuuacagugagauaggacugg

SEQ ID NO: 4138563 - RNA, 67 nt, Human
ccaguucaugaaaccucuaagaaauggaaggucagaggcugcuguuuuccuguggagacaugacugg

SEQ ID NO: 4138564 - RNA, 61 nt, Human
ccaguuccccaagugugcuaccuuuuguuauaagaggagacuucagcaacuugggagcugg

SEQ ID NO: 4138565 - RNA, 101 nt, Human
ccaguucuuaucucaagguuuugcuuguaagggaacccaaaucaaacaggaugauacaggaguucacuuuaggggcaucaaaccuagugguaagggccugg

SEQ ID NO: 4138566 - RNA, 76 nt, Human
ccaguucuucuugacacgaaagacaguaaaauuuuacaccuaacugccuuuugauggaguucaagaagcagacugg

SEQ ID NO: 4138567 - RNA, 71 nt, Human
ccaguugcccugccucccugaggugauguuaccuuuuugaucaucuuccaucacuucacuagggguauugg

SEQ ID NO: 4138568 - RNA, 74 nt, Human
ccaguugggcaccuuauuccuuucucccuuuccacuuaagcugaguggcggggauuagcaguguuugccccugg

SEQ ID NO: 4138569 - RNA, 71 nt, Human
ccaguuucaggagucugauucuuuugcuugcuaggcagaaaaagaaaguggauuugucugcugaaaccugg

SEQ ID NO: 4138570 - RNA, 61 nt, Human
ccaguuucucucauacauauuugcaugucaaacauacaaauaagugauugauggaaaucgg

SEQ ID NO: 4138571 - RNA, 68 nt, Human
ccaguuucuuuagauagaaaguucaauuauuaauuugagaacuuuuauuuucuaaaguaagcauuugg

SEQ ID NO: 4138572 - RNA, 63 nt, Human
ccaguuuuguuuuguuuucagccaaggauuugguuuccuuuguuaaaggcaaaacaagcacgg

SEQ ID NO: 4138573 - RNA, 80 nt, Human
ccaguuuuucaugugcccugccaagaccaagugguuggauggcaagcaaguggucuuuggcagggugaaagaaggcaugg

SEQ ID NO: 4138574 - RNA, 82 nt, Human
ccauaacauuuuaguauauaaaaagagaaguaaaucaccacuuuuuaggagaugggcugagaauuuuauguacugaauaugg

SEQ ID NO: 4138575 - RNA, 80 nt, Human
ccauaacugccuuuugcuauauuuaauuacuuauaaucuccuaaggcuguuaugagauaauagauguguaaaugcuuugg

SEQ ID NO: 4138576 - RNA, 66 nt, Human
ccauaaguagauaagcgcucugaggauuuauuucuguuucagaguguuuuacuaaacaaguuaugg

SEQ ID NO: 4138577 - RNA, 85 nt, Human
ccauacgcuugcaugcauuuuuuauguuuuagguagugauauaaugcuugaauguaaauaauguacaggauaaaacaggcuaugg

SEQ ID NO: 4138578 - RNA, 58 nt, Human
ccauacucaguuaugcuuauccugugaaaggagccauaggcugcaugcaugagugugg

SEQ ID NO: 4138579 - RNA, 60 nt, Human
ccauagaauucaagaguucccuggggaucucugcaaaccucaagcuccugaacucugugg

SEQ ID NO: 4138580 - RNA, 91 nt, Human
ccauagagauccaugucuuagaaaaaugguauguuuuuaucagaucucaguaaagauaaugcuauuuucugacuuuuguuguuuuuaaugg

SEQ ID NO: 4138581 - RNA, 62 nt, Human
ccauagcccagcagggggcagcgcagaucagcaccugcugagggcuccccgcugcugugugg

SEQ ID NO: 4138582 - RNA, 75 nt, Human
ccauagcgaggccguggggcucugccgcccaggccaaugccugugauccuggccagggcucgcggucccucgugg

SEQ ID NO: 4138583 - RNA, 75 nt, Human
ccauagcuuucuccauaauaagcucucuaauugguggguguaacccagcaauaguguguuuguuucagagugugg

SEQ ID NO: 4138584 - RNA, 79 nt, Human
ccauaggagcaaaugcuaaaguguagagaccugaugugaugauaauacaaauguuuuuacacauuaauuuauucugugg

SEQ ID NO: 4138585 - RNA, 57 nt, Human
ccauaggagcccuggucccugaucucucugaggucagucuggccacuguuccugugg

SEQ ID NO: 4138586 - RNA, 62 nt, Human
ccauagugagaagaugcagcugcuaugguaauaugaccacaacauugcauauuucauugagg

SEQ ID NO: 4138587 - RNA, 111 nt, Human
ccauaucgaucccugaagaagacaugguucuggagaguccugcucacguccaguuugaucugguggauguguucagaagaccucuugcccuucuccuucaugaucuguagg

SEQ ID NO: 4138588 - RNA, 86 nt, Human
ccauaugaaggguauaguuugaaggcuguucuacucagaagcacugagagaaacuaaauggucuucuaaauuauuguuucauuugg

SEQ ID NO: 4138589 - RNA, 67 nt, Human
ccauaugcgugugaguauuuuuagguaaguaaauugccuuccaaaggagccacaucugcagcuuugg

SEQ ID NO: 4138590 - RNA, 70 nt, Human
ccauauuccuggcacauuguaauauauacacauauguaugugugugucuguggaaguguuccugguuugg

SEQ ID NO: 4138591 - RNA, 78 nt, Human
ccaucaccugucacuuuguuuguuugggcugcaguggaccaaugguuucccaggcacacugaagugacauguagaugg

SEQ ID NO: 4138592 - RNA, 61 nt, Human
ccaucagacaauucuuucucuuggugauauuaaccacuucaauaagaaagaguuuugaagg

SEQ ID NO: 4138593 - RNA, 56 nt, Human
ccaucagauuagcaaaauccaggauuccuauuuaucuuguuguuaaugaaugaugg

SEQ ID NO: 4138594 - RNA, 74 nt, Human
ccaucaggcaccaguggaauuauucuguggugauuagucauaggcuguaauaauucacauuguaugcucagugg

SEQ ID NO: 4138595 - RNA, 88 nt, Human
ccaucagguucccuggcagugcuccuuuagacaugcacccaccuuggcaaaggcauugaggucuggauggcugcaggguccgggaugg

SEQ ID NO: 4138596 - RNA, 65 nt, Human
ccaucauucucuggggaaagaaauuuggugucuguaccaccacaauuucugaucagugaauuugg

SEQ ID NO: 4138597 - RNA, 63 nt, Human
ccaucauugaucauccugcugucucauccacuacuagcagucagacagcagauagucgaaagg

SEQ ID NO: 4138598 - RNA, 63 nt, Human
ccauccagaaacuuccauccccaucugcaguuggguuuggccuugagaaaguggucugggugg

SEQ ID NO: 4138599 - RNA, 89 nt, Human
ccauccauaaccuugacacucauaauuuugaaaccuaucguucauuacaaggguuaaaaucuaaaaugugacugugcagguugagaugg

SEQ ID NO: 4138600 - RNA, 66 nt, Human
ccauccauggagcugguaguuugcugauuggaguagagucauugaauuucacagcuuuaugaaugg

SEQ ID NO: 4138601 - RNA, 88 nt, Human
ccaucccaggguacuuucuauucccacagagauagucaugguccauaaugagacuuaguccugaugaaagaauauuacucaugggugg

SEQ ID NO: 4138602 - RNA, 62 nt, Human
ccauccccacugcuucucaucaaguagcucuagccucagaucuugcagcagugaggugaagg

SEQ ID NO: 4138603 - RNA, 92 nt, Human
cccaccccuccuuccacccagccccucugccuuccagcaagugaaugaagucaggcaggcccugggccaucccgggugaaggagggaguggg

SEQ ID NO: 4138604 - RNA, 93 nt, Human
cccacccucaggagccaguugcuaaauguuuaccagcaaacaaccaauaaugguggguagaggaauugggcuaccuuuuauguagaggguggg

SEQ ID NO: 4138605 - RNA, 72 nt, Human
cccaccgaccuuccuggcuguccgccugaucccuggaacugggcagacgcuaggggagcuuuugucaguggg

SEQ ID NO: 4138606 - RNA, 78 nt, Human
cccaccgggagcuugguguuauuucuguggacgcuggggaauugggcaccggggaacugggcaccgagcgcgcguggg

SEQ ID NO: 4138607 - RNA, 104 nt, Human
cccaccucccccugcagcccaaagcaggcaccagcucucucccgagcagccggcuccacccugggcagcugggccugagcuggaagcugcaggggccaggaggg

SEQ ID NO: 4138608 - RNA, 57 nt, Human
cccaccuccucuuuagccccagcuggaguccagcccuccagggguuaagggggcggg

SEQ ID NO: 4138609 - RNA, 55 nt, Human
cccacgagcccagcaggccgucaaucuguagaaauggcuuuuauggagcucuggg

SEQ ID NO: 4138610 - RNA, 94 nt, Human
cccacgcugcccccuuuguucccugucgacagcacccacuccuguccugguccugacaugguggagcuguggacaggaaggacuguagccuggg

SEQ ID NO: 4138611 - RNA, 68 nt, Human
cccacgggacgccagcauccuucgguggggcucugcgugcacccagggagcggggcugggucucuggg

SEQ ID NO: 4138612 - RNA, 84 nt, Human
cccacgggugcuggcaagugggggugccagcuucugggguauuugaccucagcagacacgcuucucacagugcccaccuguggg

SEQ ID NO: 4138613 - RNA, 82 nt, Human
cccacucagagaccagugugaggaauuaguguccaggccacagauccagggacugggcacaaacaucugccuguugaguagg

SEQ ID NO: 4138614 - RNA, 55 nt, Human
cccacucccuacgacacgcucccaguuaaccaagaccaggcuucagggagcuggg

SEQ ID NO: 4138615 - RNA, 59 nt, Human
cccacucuccaugagguucccacgcucuuguggucuggagccagccuguggggagcggg

SEQ ID NO: 4138616 - RNA, 116 nt, Human
cccacucuccucucccaguccaggagggcuggagcucugggcaucucagggucagcugcggugagccuggccacagggcucugcauuccuucugggcuuugcuugguuugaguggg

SEQ ID NO: 4138617 - RNA, 56 nt, Human
cccacugcugcucuccauggcaaagagguggcccuggaggucguaguacagugagg

SEQ ID NO: 4138618 - RNA, 103 nt, Human
cccacuggggguuguccauaaaaucugacaaucggaauguucugaccaucuucagaaagcaucuccauuguagguauggggacacaagcgagacugcaguggg

SEQ ID NO: 4138619 - RNA, 71 nt, Human
cccacugugugccaagcgguggcccccacccugggaggucagcaggccaccgcugaaggcacuggcauggg

SEQ ID NO: 4138620 - RNA, 72 nt, Human
cccacuguucagucuuguugaaaacuuggcacacaugcuugaggaguuuaauagggaucuuguccaguaggg

SEQ ID NO: 4138621 - RNA, 106 nt, Human
cccagaagagaccccauuucucagucuccucucacaguuaaguguggccaaaugaccaaguuguggccaauggcucaugagcaggaccgacgggucuaauucuggg

SEQ ID NO: 4138622 - RNA, 111 nt, Human
cccagaagcagccagggcauggcugggcacgccugggaagguugagucccggaguaguccuggacucagcagccaggaguggccccacugccagcucugcacuccucaggg

SEQ ID NO: 4138623 - RNA, 70 nt, Human
cccaucuccugugucuuccccacuggugucacacagugugugagcacccuggggaagcacaaaggcuggg

SEQ ID NO: 4138624 - RNA, 58 nt, Human
cccaucugucagcuggagauggcaugggagcuuccaugccaggcagucgaugcauggg

SEQ ID NO: 4138625 - RNA, 71 nt, Human
cccaucuucaagcuugugucggaucugguugagggauuuaaccugaggagaacagugcuuggaaggaaggg

SEQ ID NO: 4138626 - RNA, 57 nt, Human
cccggggcugcuauuuuuagcucccacguugggagccuccaaaugucaggucccggg

SEQ ID NO: 4138627 - RNA, 55 nt, Human
cccggggcugugcucuugagcucagccagccugccgagcagagcagggccguggg

SEQ ID NO: 4138628 - RNA, 63 nt, Human
cccggugucuuggaccuggggcuggcacagacagugcccgggcccaugggcuccagaccuggg

SEQ ID NO: 4138629 - RNA, 65 nt, Human
cccgugcccaguccugccuugacagagcucaccacugcuucccaggcugucccugggcaaucggg

SEQ ID NO: 4138630 - RNA, 63 nt, Human
cccguggcacagacagaucaggagucucugggucccuaugaccucugcccucugugccaaggg

SEQ ID NO: 4138631 - RNA, 72 nt, Human
cccguggcuucacccguccuccccacgcucccagguucaguggguggagacugggugcaagcagguugaggg

SEQ ID NO: 4138632 - RNA, 57 nt, Human
cccguguggacagcgugccaguuugacggcucagaaucggaagggcacccacauggg

SEQ ID NO: 4138633 - RNA, 117 nt, Human
cccguuagagaaggccuguggugggcaggcauguccaggcacugggacucuagcugugcaagacuguccuggugccaggacucuugcugugcacagccaugggcuggggcugccggg

SEQ ID NO: 4138634 - RNA, 69 nt, Human
cccguuccuauaauagcauagagugcuuuuauuacuggaaguuaaugugauguuuuauaaaagaacggg

SEQ ID NO: 4138635 - RNA, 66 nt, Human
cccuaaaauauucuuauaacaugccuuguagcauaaguaacugaaggcaaagaggauauuuugggg

SEQ ID NO: 4138636 - RNA, 61 nt, Human
cccuaagaaucucccuuguagcacgccauaaccaggaauguacaaaaaaggaaauucuggg

SEQ ID NO: 4138637 - RNA, 85 nt, Human
cccuaagacccacaggcaggggcagagacacacaaggagccuguuggagcuuggccugucuagcccauugaucuuggccuugggg

SEQ ID NO: 4138638 - RNA, 69 nt, Human
cccuaaugagcuguaugaucugaggcaaguuacuucacuucucaugucaguuucuucuauaaauugggg

SEQ ID NO: 4138639 - RNA, 75 nt, Human
cccuaauuguuucccucuccgggagcaguugguugucugccugauucuccagacaggcagagggaaggugugggg

SEQ ID NO: 4138640 - RNA, 63 nt, Human
cccuaccaucaggcugcuacaaggaauucaaagauuccuggguagagaccugaugaaaauggg

SEQ ID NO: 4138641 - RNA, 73 nt, Human
cccuaccucaccccauucuucaugguuuccugugauccacagauugaaguccagaauggcuuggugcuuuggg

SEQ ID NO: 4138642 - RNA, 130 nt, Human
cccuaccugugcagugagagaggagcaagagaagaagaggaguccaggccaugguggacacagccugacaugcacagugggacugggcugccccaggccuccuuuucuucccauacucugcagaggaggg

SEQ ID NO: 4138643 - RNA, 78 nt, Human
cccuacucuggacagggacacagccagugagguggaugaccuggagccugacagcgugucccuggcccuggaaauggg

SEQ ID NO: 4138644 - RNA, 70 nt, Human
cccuacuguaccuuucacugaugucaaguggcuaucaauucauauagcugaaaauuagugauaguuuggg

SEQ ID NO: 4138645 - RNA, 100 nt, Human
cccuagauguccaugcuuaauucagcucuuugaguauuccauuuacauuuacaaguagaaaaauggagucagggagaaguuagguaauuugccuuugggg

SEQ ID NO: 4138646 - RNA, 61 nt, Human
cccuaggcccuggggucuguuaaauuguucaaguuagucaauauccaccaggagcccaggg

SEQ ID NO: 4138647 - RNA, 84 nt, Human
cccuagggggcucuacuccagacuggcuggcagguguccccuccccaccagccaucugagaguguccccaagucccccucaggg

SEQ ID NO: 4138648 - RNA, 84 nt, Human
cccuagucuucucuuccuuugucaacugaucauagggaacuccucaugaggcuauuagugcagucuuggggagaagaggcaggg

SEQ ID NO: 4138649 - RNA, 117 nt, Human
cccuaguguacugaacagagauuccuuggugaugguggcuaggccagugcuauuuuguguguggcagaggaaaaagucacugggaccaagagcuucugugaauuucacauguaaggg

SEQ ID NO: 4138650 - RNA, 70 nt, Human
cccuauauuguuccucugugaugaucccucuaaaauauugaucaaaagagagggcagggaaaagauaggg

SEQ ID NO: 4138651 - RNA, 67 nt, Human
cccuaucauuugguggauaaaaacugugacgccuaaugagauaaaguauuucaccagguagauaggg

SEQ ID NO: 4138652 - RNA, 65 nt, Human
cccuauugaucuggauauuuagacagguuucacccuauugaucuggauguuuaggcagguuuggg

SEQ ID NO: 4138653 - RNA, 58 nt, Human
cccucaccaggcuccaggcaugucugcagaagaucagcucccuaaaagccagggaggg

SEQ ID NO: 4138654 - RNA, 129 nt, Human
cccucaccaguuuaacuuucuuccuuuccuaaaauguuguuuuucugcaugucuauuuaaguuagugaacauucuuggaggaaauaacaggaccaggcugaaugauuucugagguuuagucuuuuucag

SEQ ID NO: 4138655 - RNA, 57 nt, Human
cccucaccucagucugggccucaucaugccccucgcacaugacccagacccagaggg

SEQ ID NO: 4138656 - RNA, 91 nt, Human
cccucagacucagugucuauuuuccuuguggguuagcgaagucagcuucugucuuugauaauacacaagagaaagucuuuugaauuuaggg

SEQ ID NO: 4138657 - RNA, 58 nt, Human
cccucagagccugaagcaagcauauacagggcucuucuuugcugcagucaggcgaggg

SEQ ID NO: 4138658 - RNA, 63 nt, Human
cccucagcuucugagcgagcaguuguaguuuguacaauggcagaaugggccagaagcuuaggg

SEQ ID NO: 4138659 - RNA, 58 nt, Human
cccucaggaugcaguggaagugcacccagaugucaagcggcacauuggauucuggggg

SEQ ID NO: 4138660 - RNA, 77 nt, Human
cccucagguacgugcuucuagacacagagucuucaugguuggugaaauuuuaguaaggaaguugaguaaauugaggg

SEQ ID NO: 4138661 - RNA, 92 nt, Human
cccucaguaacuguuaaaaacgcaugccauuugguggauugagagcgaagcuccagcuucaugaagugcgugcccugacagucgcugauggg

SEQ ID NO: 4138662 - RNA, 70 nt, Human
cccucaguuugauucugauccugucuggagacugcguggccuccugccagugauuaaauuagucuguggg

SEQ ID NO: 4138663 - RNA, 86 nt, Human
cccucaucaacagccaccucugggacaucccuuggccuaaaggugugccuagucagguccuaagaaguugguuuuaguugauuggg

SEQ ID NO: 4138664 - RNA, 59 nt, Human
cccucaugaccaaucuaccugaagaauguucauuuuacaaggaaguauugucaugaagg

SEQ ID NO: 4138665 - RNA, 66 nt, Human
cccuccaccaggaagcaucuggcuagcuaacaugucuauuuaggguuggggugcugaccugaaggg

SEQ ID NO: 4138666 - RNA, 62 nt, Human
cccuccaggcugacgcagcuauuuacguucagagugaaaugggcuguguggcugggauuggg

SEQ ID NO: 4138667 - RNA, 80 nt, Human
cccuccauacuuacaaaugaugguguugcuuucuugcugccuaugaauacuaaguuguagucacacaucccaggugaggg

SEQ ID NO: 4138668 - RNA, 96 nt, Human
cccucccgaccacaugggcagagggucuaugcuaagaugggcucucauaugggcucucuuuaaacugcauggcuucucuguugaugaggggcaggg

SEQ ID NO: 4138669 - RNA, 120 nt, Human
cccucccucugugucgagugccaaggucagucuaggugucugcagaggaacgguuguuugcccaaggaagacgcuugugauauuccuggccuggugacuggcagucacguggugggaggg

SEQ ID NO: 4138670 - RNA, 83 nt, Human
cccuccuaacugaucucuacuugggcuuugucaggaugggccuccuccaggccuaggccaagugauuggugagcugggagagg

SEQ ID NO: 4138671 - RNA, 63 nt, Human
cccuccuacuuccuuccaaacauucauuuaauuuaaaggugacagggacagggagagggaagg

SEQ ID NO: 4138672 - RNA, 89 nt, Human
cccuccucaacccugaacuucaaguccagcucaugcucuaggccauuuccuagaaagugccucccuugggagcucagggacggggaggg

SEQ ID NO: 4138673 - RNA, 78 nt, Human
cccuccucagucucuaaggccucagcuggaaagacuugaguggucaggcgugaugcugagggcuggggcugagcaggg

SEQ ID NO: 4138674 - RNA, 87 nt, Human
cccuccuccuuuucuuccaaucucccgccucugggaucuaagguggaugaaaggggcacuagaaugggagacuuuuggggggcaggg

SEQ ID NO: 4138675 - RNA, 59 nt, Human
cccucgccgcagcugcuucccggacucgggaggggacggaagcggcccugagcgcaggg

SEQ ID NO: 4138676 - RNA, 64 nt, Human
cccucgguggucauaaguggcuggcggauuguuuacuuguauaucuguuagaggccacggaggg

SEQ ID NO: 4138677 - RNA, 61 nt, Human
cccucuacagggaagcgcuuucuguugucugaaagaaaagaaagugcuuccuuuuagaggg

SEQ ID NO: 4138678 - RNA, 109 nt, Human
cccucuacccacuaguagaaaagcaggcuugacaaggaaauuacuagcuggauugauugcagucuuagaaguucauguuccagcuuauauuugcuaaguggcugcaggg

SEQ ID NO: 4138679 - RNA, 78 nt, Human
cccucuaccugccccgccgcggcggccugcggccaggagaaguaggcuggcgacaucuggcgggccgcgggccgaggg

SEQ ID NO: 4138680 - RNA, 93 nt, Human
cccucuauuaaaguaaacgccuugagccuugccugaauuuaucugaaugguggaacagaaaucauuuagggcucuauucuaauggauucuggg

SEQ ID NO: 4138681 - RNA, 55 nt, Human
cccucucccugcagaauguggcaggcggaccuggaauguguuggagggaaggggg

SEQ ID NO: 4138682 - RNA, 69 nt, Human
cccucucccugcugcauggccuccacgacccuggacuggguguggcucugccuggcaguauucagaggg

SEQ ID NO: 4138683 - RNA, 78 nt, Human
cccucucccuguccccaccccagaacuacuagggguccccuuuuccuucaaguugucugagggugggcauagugaggg

SEQ ID NO: 4138684 - RNA, 61 nt, Human
cccucucugacuucugaacuuggcuugccuuccugacaaguacaagagugaccggggcggg

SEQ ID NO: 4138685 - RNA, 59 nt, Human
cccucucugcacuuugggaauguugggccuccaaguuuucuggguucagagcaacaggg

SEQ ID NO: 4138686 - RNA, 55 nt, Human
cccucucuuagaagaaacacagccuucagcacuugguaccggcuucuggaggggg

SEQ ID NO: 4138687 - RNA, 57 nt, Human
cccucugccugcgcccuggugugugccuuggcuagccagggucccuggggcagaggg

SEQ ID NO: 4138688 - RNA, 64 nt, Human
cccucugcugccuggcuggguccacacacgugcacucauguacagaccugcgggguagcaaggg

SEQ ID NO: 4138689 - RNA, 66 nt, Human
cccucugucucuuggccuguguccugugucuggcagaggcugcccaugguccaggaagacagaggg

SEQ ID NO: 4138690 - RNA, 108 nt, Human
cccucuucgcucccuuccuugagagugaagcguaugccuucacugccuuuacggacagagugaagcauaugcuucucugccuuuauggacauuuccaguggggggugg

SEQ ID NO: 4138691 - RNA, 65 nt, Human
cccucuucuacuggccuggcugcuccucccucaaugaggagaggcagcuggcucagagagguggg

SEQ ID NO: 4138692 - RNA, 63 nt, Human
cccucuucugugaucuauguguuuuaagugagguuuaccccagguccagguuacagagguggg

SEQ ID NO: 4138693 - RNA, 77 nt, Human
cccugaagucuuccugaggccucaaggcuggcucauaggauucugccuuggcccuagccucaggcaaggcugcaggg

SEQ ID NO: 4138694 - RNA, 67 nt, Human
cccugaauaacuauucuguggacucuuauagucagugugguuuaguguagagaacgcaggauaaggg

SEQ ID NO: 4138695 - RNA, 57 nt, Human
ccugagaggcccucucacugucgucuuucugacaguggcaggcagaagcuucucagg

SEQ ID NO: 4138696 - RNA, 85 nt, Human
ccugagcagcucucauugucuuggugcccccgaaaccuggacuagcagcuagcccgaggaggcacuaguuagugacaguuucagg

SEQ ID NO: 4138697 - RNA, 130 nt, Human
ccugagcucaguaguucaagaccagccuggacaacacagcaaaaccccaucucuacuaaaaauagaaaaauauuagccaggugugguggugcaugccuguaguccuagcuucuugggaggcugauucagg

SEQ ID NO: 4138698 - RNA, 57 nt, Human
ccuggcagaauauuaaagugcaagaaccaguuuuucuugcucuuuaccccugcaagg

SEQ ID NO: 4138699 - RNA, 63 nt, Human
ccuggcagucaggggaguccuuaggaagaggaagacagaauagggcgccccgggaaugucagg

SEQ ID NO: 4138700 - RNA, 57 nt, Human
ccuggcaguuuugcccaggauuagcaggucauaacuaggcuugggaagcugaccagg

SEQ ID NO: 4138701 - RNA, 117 nt, Human
ccuggcauaauuccugauacagacuggaauccuaaauaaauuaagaaaggauugguggcaugucaaauuccuuuaacuugauuauuuucaucaucaugucaggaugucaaucucagg

SEQ ID NO: 4138702 - RNA, 55 nt, Human
ccuggccaguuuccaggcccuguuccugcacaugcucugugaguauuggcccugg

SEQ ID NO: 4138703 - RNA, 56 nt, Human
ccuggcccauugccuucucucucugcaaccucggagagaccuaaaagugggcgagg

SEQ ID NO: 4138704 - RNA, 60 nt, Human
ccuggccccauugccugugucugccuucaccaccuuuagcuucacaagcaguggccaugg

SEQ ID NO: 4138705 - RNA, 66 nt, Human
ccuggcccucccucucuucucccaccacuuuagggccugugagagaaauuggagggaaugcuuagg

SEQ ID NO: 4138706 - RNA, 62 nt, Human
ccuggcccugaaggccuugagcauuaggaugugugcugagccaaggucgccccagggcaagg

SEQ ID NO: 4138707 - RNA, 78 nt, Human
ccuggcccuuucuuccgugacuucugcuacucauuaguaucuccaccagagggcagacaguaaaagagaaaggaaagg

SEQ ID NO: 4138708 - RNA, 55 nt, Human
ccuggccucagccuagggcugagcagugagccccaccccaguggcuguggccggg

SEQ ID NO: 4138709 - RNA, 58 nt, Human
ccuggccuuugaacgcuagacugcagaaagcggcaggacagcgguucucaaagucagg

SEQ ID NO: 4138710 - RNA, 70 nt, Human
ccuggcgaggcagggcugugggcacugggcuguccauuguaggguggcagugcugguucugccugugggg

SEQ ID NO: 4138711 - RNA, 71 nt, Human
ccuggcgcgguggcucacgccuguaaucccagcacuuugggaggccaaggcgggcggaucacgaagucagg

SEQ ID NO: 4138712 - RNA, 78 nt, Human
ccuggcgcucuguggguggcugugccccaggaugcauccguguguucccugccagccugccaucccacagaggcaagg

SEQ ID NO: 4138713 - RNA, 56 nt, Human
ccuggcuccuucucucucuuccucaagucccaggaagugaaagggaaggaguuagg

SEQ ID NO: 4138714 - RNA, 58 nt, Human
ccuggcugguggcagcgacaagggaaagaauugcgaucccuuccugccaccugucagg

SEQ ID NO: 4138715 - RNA, 65 nt, Human
ccuggcugguugucugauucuaacauagcugcuaucccugauucuagaaaucagaaaaccacagg

SEQ ID NO: 4138716 - RNA, 56 nt, Human
ccuggcugugcauguuucuauggugucuguguguugagaggcagggugaggccagg

SEQ ID NO: 4138717 - RNA, 64 nt, Human
ccuggcuucagcauugcccucucccauuuccucguauugaaauagguggcaagcugcagucagg

SEQ ID NO: 4138718 - RNA, 84 nt, Human
ccugggaaccuuguuaaaaugcagauucugauucucaggucuaggcuggagauaaugauucugcauuucuaauuaacucccagg

SEQ ID NO: 4138719 - RNA, 60 nt, Human
ccugggacaggcaggaguuagcagaaccaaccaggugggauuccuuggcucugucucagg

SEQ ID NO: 4138720 - RNA, 58 nt, Human
ccugggagggaaguagacuaggaaagcuguugaaagggcuccuucacuucuuaccagg

SEQ ID NO: 4138721 - RNA, 68 nt, Human
ccugggcagcacugucuugucuuaggacucagaaaguccaguccugagaugagacagugcugcccagg

SEQ ID NO: 4138722 - RNA, 74 nt, Human
ccugggcagccacacuccagaacgagaguaauuauccuaauugcuuuauugcaucagugugggggcagcucggg

SEQ ID NO: 4138723 - RNA, 62 nt, Human
ccugggcagggcuggacucucaaggaaucaguaaacaaguugagaaguccggcaggcugagg

SEQ ID NO: 4138724 - RNA, 74 nt, Human
ccugggcaucacuagaauaaugagagacuugcacaaggcaaucucuaaagucuguucagcucugaugccauagg

SEQ ID NO: 4138725 - RNA, 74 nt, Human
ccugggccaucagauuuggcccuguccugcaggguuucgcucauucuguggaagcugccagucugaagccuggg

SEQ ID NO: 4138726 - RNA, 63 nt, Human
ccugggccugaaaacauuucucggguuuauuugacaaagcaagagggcaguggcggggccagg

SEQ ID NO: 4138727 - RNA, 78 nt, Human
ccugggccuguguccugugcaaggggaugauuuccuuugggccccucgaccacucugcaaggcacacaaggcucaugg

SEQ ID NO: 4138728 - RNA, 59 nt, Human
ccugggccuucauugcucucccauaccacuucaauggggaacagaucauaggcucuugg

SEQ ID NO: 4138729 - RNA, 66 nt, Human
ccugggcucaagcgaucuugucaccucagccucccaaggugccaggauuauaggcaugagccaugg

SEQ ID NO: 4138730 - RNA, 62 nt, Human
ccugggcuggugaggcugcccugcagggcuucucacuauguagcaccagucaccagcccagg

SEQ ID NO: 4138731 - RNA, 75 nt, Human
ccugggcuucaguggccagagaugaugccuguuagcaucauuuaguggggcauuggaauccgugcgcagcccggg

SEQ ID NO: 4138732 - RNA, 99 nt, Human
ccuggggaauuguuagcaaugcagauucucaggcccacagcagacccacggacucagaagcugggguggggccuggcacuguuuaucaagcccuccagg

SEQ ID NO: 4138733 - RNA, 90 nt, Human
ccuggggacccugugaaaugcagauucugauucuguagcgcugaaaaagagaugcagcccuggauucugcauuucuaacaaacuccuagg

SEQ ID NO: 4138734 - RNA, 65 nt, Human
ccuggggagcccuacgccucucagaaagcuguaacaagcaggaggguuuuguagagucccauagg

SEQ ID NO: 4138735 - RNA, 55 nt, Human
ccuggggcaccuccucuuggcaauuccugggaauaaaggcagagguggccucagg

SEQ ID NO: 4138736 - RNA, 120 nt, Human
ccuggggcccuucaugccaggccccgcggcuguguccgcaagcgcagauggucucgggacucgggccacccugacgccgcagacccagcacgcugcggaccgggcacguuggaucucggg

SEQ ID NO: 4138737 - RNA, 89 nt, Human
ccuggggcggcguuccaggggcgggagucggcugugugggcugcgcguccgggcgggggcucucgucaccugggaaguccuggcucagg

SEQ ID NO: 4138738 - RNA, 57 nt, Human
ccugggguccaugcugucaucauccccauuuuacagaugagaaaguagagacucagg

SEQ ID NO: 4138739 - RNA, 109 nt, Human
ccuggguaagagcaagccacccaggagagagcuauaaaaucuccugcugaaauuugguuuagcuuucuuugugugugugcccuauucuuugcuacauuuuuuucccagg

SEQ ID NO: 4138740 - RNA, 66 nt, Human
ccugggucccugaguuaguacaguugaguagggcuccuggccagcaugugcuacauaggcaucagg

SEQ ID NO: 4138741 - RNA, 69 nt, Human
ccuggguccuggcagccuccuggagcuagagaauugcuaagcuagucacagugagguccccagccuagg

SEQ ID NO: 4138742 - RNA, 78 nt, Human
ccugggucgucucagucugacugaagugcccuagcaugggccaagcaaguuccuagugagacuggaggaaaucccagg

SEQ ID NO: 4138743 - RNA, 57 nt, Human
ccugggucugggccuccuggaguuggcaagagcugcugacugagaaccugacccagg

SEQ ID NO: 4138744 - RNA, 59 nt, Human
ccugguauucaucuuuaccucacccucuaaguaaaauugagguaaaagugagcuucagg

SEQ ID NO: 4138745 - RNA, 79 nt, Human
ccuggucccccgcagagagugagauccuccuggggaugaccucguuguccuccaguuccuugguuucagugggaccagg

SEQ ID NO: 4138746 - RNA, 57 nt, Human
ccugguccuagggguggaaccauggaggaacacccuggucacccacugggacugcgg

SEQ ID NO: 4138747 - RNA, 84 nt, Human
ccuggucugguugaagaauuucaagcagugcaauguugcuagaaugcaaaguugcagguggugagagguagaagcaagaccggg

SEQ ID NO: 4138748 - RNA, 59 nt, Human
ccuggugcuuaccagagcuuuuguccucugagaauuggacucacuuuguaggcaugggg

SEQ ID NO: 4138749 - RNA, 57 nt, Human
ccugguguaucguaguuuggauuucugaauauaaagagcauuuaaacuacuacaagg

SEQ ID NO: 4138750 - RNA, 75 nt, Human
ccuggugucuguuuacagcagccucaugucaguggagucaaagcucaauggccagcucugugaaauuucaccagg

SEQ ID NO: 4138751 - RNA, 97 nt, Human
ccugguuucgggcucccugcuguucucucccucauaacccuuguuuguaucugagccaggucugagcaggggagaacagacauccagagcuucaagg

SEQ ID NO: 4138752 - RNA, 66 nt, Human
ccugguuucuguaggguaguaguggagauccagaaaauuugccaucuccauccacuucaguucagg

SEQ ID NO: 4138753 - RNA, 63 nt, Human
ccuguaacuccuuggcucaagugauccucccaccucagccucuugagcaacuaggguuauagg

SEQ ID NO: 4138754 - RNA, 68 nt, Human
ccuguaaugacuuucuucugugcugugcacuaguguaguguaagacauagccaagagcaucccauagg

SEQ ID NO: 4138755 - RNA, 61 nt, Human
ccuguaccaucucagcauucaggaacaaugguguccacaugucuuuuugagguuguacagg

SEQ ID NO: 4138756 - RNA, 68 nt, Human
ccuguagugauuuagaauucaaauguggcuaauuuauaaaacaaccacauuucacuguucacagcagg

SEQ ID NO: 4138757 - RNA, 62 nt, Human
ccuguaucuguguuggaugaguuuguauauuaaacaucuguagccacuugacacagaugagg

SEQ ID NO: 4138758 - RNA, 63 nt, Human
ccugucacccaggcuagagugcaauggcaugaucucggcucaaugcaacuucugccucccagg

SEQ ID NO: 4138759 - RNA, 58 nt, Human
ccugucaugucaguguguguguguggccucccagcccaaccagaaauugacagacagg

SEQ ID NO: 4138760 - RNA, 83 nt, Human
ccugucauucucuaggcagagaggccauaagaauuacacuaccugcgauuuuuaugguccuuuccugccuuaauacuuauagg

SEQ ID NO: 4138761 - RNA, 81 nt, Human
ccuguccccuggggugggcuucggcccauaggccccaaugguggagcagaagggggcccuggccgaaucccucuggacggg

SEQ ID NO: 4138762 - RNA, 68 nt, Human
ccuguccucccccaaaguuugcacggauaaucggaaggugugguagggugggcuugggggaagccagg

SEQ ID NO: 4138763 - RNA, 60 nt, Human
cccugaauggcuggcauccaggugggcuucccauaaggagcccccuucugcgggccuggg

SEQ ID NO: 4138764 - RNA, 57 nt, Human
cccugagcacaccuggcagacaaucagugaggccguagggucaggaugggcugaggg

SEQ ID NO: 4138765 - RNA, 55 nt, Human
cccugaggaaaggguggagggcacaagggauccaauaccaucucuuccucauggg

SEQ ID NO: 4138766 - RNA, 55 nt, Human
cccugaggggaguggugagguggacucuguugcucacccaaacuguucauuaggg

SEQ ID NO: 4138767 - RNA, 82 nt, Human
cccugaucaguuuguauaugaaacacuuuuuuuccugccuuaagguuggaaucugguaaguuucagacaagugguugcaggg

SEQ ID NO: 4138768 - RNA, 88 nt, Human
cccugauuccuucaacuuggagcacauuuggcugcagugcgcugccgagucaacuguacuuuagguacguauuauugacaaucagagg

SEQ ID NO: 4138769 - RNA, 57 nt, Human
cccugauuuuuaaagcaaaaucaaaacgugugcuugauucugcuuugagaaucaugg

SEQ ID NO: 4138770 - RNA, 56 nt, Human
cccugcaggaagccuuaccaagcccaaggaaaugugggccccaguuucuucagagg

SEQ ID NO: 4138771 - RNA, 89 nt, Human
cccugcccccagacacuggugcccuccugaagccaucacagauaagaaugcuggcugugugugcaggagagcagguguuguggcauggg

SEQ ID NO: 4138772 - RNA, 59 nt, Human
cccugccgguccgagcccccaccugcgcugcucaggagggugauccgggcuggucaggg

SEQ ID NO: 4138773 - RNA, 105 nt, Human
cccugccugccuucgccuuucugagggagcuggagucuccagggguuggguuaacaccuggauauguuucagcuugggaagauucugaggggaggugcagcaggg

SEQ ID NO: 4138774 - RNA, 66 nt, Human
cccugccuucaguuuucagguguuuaccucagagacuggggacagcagaaagaaggcaaggcaggg

SEQ ID NO: 4138775 - RNA, 99 nt, Human
cccugccuucugcuucagggaaaagucacacugggucggcuccaaagagugucccugcugauucacuguggcuuucucugaucauuagccaaaccaggg

SEQ ID NO: 4138776 - RNA, 70 nt, Human
ccuggaccucugggugccacugucuguacauguccagcuuggcaggcagcuggcauccuaaggauucagg

SEQ ID NO: 4138777 - RNA, 80 nt, Human
ccuggagccgugcagagccaugggagguuuuugagcaggggcucggaggccucagcucaugguuuccaucugguuccagg

SEQ ID NO: 4138778 - RNA, 60 nt, Human
ccuggagucugugacuuuccucaugcaaauugcucuaagguaagguaucagaaguccagg

SEQ ID NO: 4138779 - RNA, 62 nt, Human
ccuggaguuuguaggucaucacuagagcgcaccugcucaccuggcugccuacaugcugcagg

SEQ ID NO: 4138780 - RNA, 56 nt, Human
ccuggauuauaggcccucugaauauacaggaucaggaagggcaauaaaaucucagg

SEQ ID NO: 4138781 - RNA, 105 nt, Human
ccuggauuuccuaauucuguucuuuuguuauaaacuguguauuauuuuacuggcuuuaugguuucacaaacaaaagguucggcagaaucuuuggacaucaaaugg

SEQ ID NO: 4138782 - RNA, 59 nt, Human
ccuggcacauauaauaauuuuugaguauugccucagagugauggguugugcugaccagg

SEQ ID NO: 4138783 - RNA, 82 nt, Human
ccuggcacauguagauacaucuugaacuucuagaauauuaauuuaagucuagagauguaguguguauugcugacaguuuagg

SEQ ID NO: 4138784 - RNA, 61 nt, Human
ccuggcacgaagggcugagguugggaaaccccaugacaauccaauccuaggcccugccagg

SEQ ID NO: 4138785 - RNA, 58 nt, Human
ccuggcacuuaaugcaugugcuaugucucucuacagagcacugccccaagguguuggg

SEQ ID NO: 4138786 - RNA, 86 nt, Human
ccuggcagcuccugaggacugcugggaugaugacacagcauuuuugcaucagcaucguacucacagggacucggagcucagccagg

SEQ ID NO: 4138787 - RNA, 60 nt, Human
ccuggccaccucugcccuacugagugggacccuucaccgggcaggagggggguggccugg

SEQ ID NO: 4138788 - RNA, 60 nt, Human
ccuggccacucagguguggggcgggucucuccucauuuagcuuucaccugcgugcccagg

SEQ ID NO: 4138789 - RNA, 60 nt, Human
ccuggccagcagccccuuccucuguccuguuuauucugcagcugaagggaccuggucagg

SEQ ID NO: 4138790 - RNA, 124 nt, Human
ccuggccagcugggaagcccugaguggaccggacugccugugucccuucagugcccaccucccacuuuuccagggccauggauaggagcagcuagugguccgucagggcucccucuaggccagg

SEQ ID NO: 4138791 - RNA, 58 nt, Human
ccuggcccagggacuuucgccugggacugcccaguggugccagcucugugggcccagg

SEQ ID NO: 4138792 - RNA, 92 nt, Human
ccuggcccccagcccccagcagcucagcuacuggucaccugccaccgccuggaaugcugauuggcaguuggcuggggugggugggggcuggg

SEQ ID NO: 4138793 - RNA, 62 nt, Human
ccuggcccucuggcuuccgcauggggcuugugggaagccucagcaggggaccauagggaagg

SEQ ID NO: 4138794 - RNA, 70 nt, Human
ccuggccucugaggucauggacuuggccuccuucuuuuccaaaggggcccaugauccagcucagagcagg

SEQ ID NO: 4138795 - RNA, 61 nt, Human
ccuggccuggcacucccucugcacacauuccaugggcaggcaagcaggggcccgggccagg

SEQ ID NO: 4138796 - RNA, 76 nt, Human
ccuggccuuggccugggacagagcagcaguggggaggggccuuugugcaucucugcuccuacagcucagggcuggg

SEQ ID NO: 4138797 - RNA, 74 nt, Human
ccuggcggugcgagguucucgccggggaugcggcggcggcagcugcuuccugguuugaagcucgccgagugggg

SEQ ID NO: 4138798 - RNA, 105 nt, Human
ccuggcguaaccugccugauguuccauucuguucuucuguaaaguuaaguuguggcuacuucacaaauauagugagaaccagauguauguaacaagcacuccagg

SEQ ID NO: 4138799 - RNA, 58 nt, Human
ccuggcucccuggaccucauuaccucagacccuggagauaagagaaaaaggggcaagg

SEQ ID NO: 4138800 - RNA, 55 nt, Human
ccuggcuccugccucugcaggggcgaugcuucccgcggccgguggaugagccagg

SEQ ID NO: 4138801 - RNA, 57 nt, Human
ccuggcucuagaggccacuccuagcuuuuaaagcaaaguggaacccuuagggucagg

SEQ ID NO: 4138802 - RNA, 58 nt, Human
ccuggcucugaaguccacaucaauuccacuacacuggauguuaggauucagcaucagg

SEQ ID NO: 4138803 - RNA, 56 nt, Human
ccuggcucugagguaugccuggagcuugaguuugcagagguguaccuggagcuugg

SEQ ID NO: 4138804 - RNA, 72 nt, Human
ccuggcucuggcuggcugggccucaguggggaaggucugccccugauacuugggaugguggccagagcgagg

SEQ ID NO: 4138805 - RNA, 60 nt, Human
ccuggcugcuuccucugccaugugguuccaggcccacagccagcagggaagcagaccagg

SEQ ID NO: 4138806 - RNA, 84 nt, Human
ccugggaauuuuguuaaaguacagauucugauucaaacaggcuggagucgggucuaagggucuguauuucuggcaagccccagg

SEQ ID NO: 4138807 - RNA, 78 nt, Human
ccugggaccagguacacgguguuuccauggccuggacaucaucccagcccuggcaagugcuguguagcuucuucuagg

SEQ ID NO: 4138808 - RNA, 63 nt, Human
ccugggagaacaucauggaaggggcaggauucacaacgacugcagcuuugucugucuucgggg

SEQ ID NO: 4138809 - RNA, 74 nt, Human
ccugggagauugggcgaggagaaugcugugaaugagaaagacccauucuuugcuuccuugcuuucuaagacagg

SEQ ID NO: 4138810 - RNA, 84 nt, Human
ccugggaguuuguuaguaaugcagcaucuccaacccaucccagauuaacuuugucagaaucugcauuuuaacaaaacccccagg

SEQ ID NO: 4138811 - RNA, 74 nt, Human
ccugggaucugauagucauuucaggcugccuccaaaacugagggaccugucaaugacaguuauucauuuccagg

SEQ ID NO: 4138812 - RNA, 61 nt, Human
ccugggaugcuguccucaucuacaugguaaaaacuauucaggaccaugaccguauuccagg

SEQ ID NO: 4138813 - RNA, 65 nt, Human
ccugggauguuuaagcccaggcugacugaugcacagaagucaggcuugcgauggaagucaccagg

SEQ ID NO: 4138814 - RNA, 125 nt, Human
ccugggauucugggcucacugaguucaccugcgagucagcccuaccugcacugcucuggucuaguacaaacaggcugcuggcauugagguagguggcagagagaguaauggucccauggcccagg

SEQ ID NO: 4138815 - RNA, 68 nt, Human
ccugggcacuguggggagcagaaagaggacuaauacugcccuugugcugaggcaccuacagucucggg

SEQ ID NO: 4138816 - RNA, 55 nt, Human
ccugggcagccugcucaaggacuuuaacauugugucuccuuucagacuguucagg

SEQ ID NO: 4138817 - RNA, 85 nt, Human
ccugggcagcgacgggggaugugugagguuuagagcuaagaggagugcucuccuuucacuaaauauucuuaagucucuguccagg

SEQ ID NO: 4138818 - RNA, 58 nt, Human
ccugggcauagaaccccaggugaaggcacuuaacacugguuaucccugugcauccagg

SEQ ID NO: 4138819 - RNA, 60 nt, Human
ccugggcaucccuucuuccagugucauuccucuggcagagggagaggaggaugcauaagg

SEQ ID NO: 4138820 - RNA, 62 nt, Human
ccugggcaugaaaaggaugccaggcugcaggacugcaguuggcuucuccuuccugacccagg

SEQ ID NO: 4138821 - RNA, 84 nt, Human
ccugggcuaucagcuuagggcucugcuucuguuuuucugccugcugggagguguggaaacagagagggcaacagcuagcuuggg

SEQ ID NO: 4138822 - RNA, 69 nt, Human
ccugggcucccucguguucugaguucucuugaccuucuagaaaccugguucugcgugaggggguguggg

SEQ ID NO: 4138823 - RNA, 79 nt, Human
ccugggcucuccuggaggacaacagggaaauaaaaagggccugcaagucaaagaguguucuccaggguagagccuuugg

SEQ ID NO: 4138824 - RNA, 89 nt, Human
ccugggcugcagcaagaaggaagccuuccuguaugcuccacccucaaccguggagcagcuggacaggccucccuacacugcagcuuggg

SEQ ID NO: 4138825 - RNA, 57 nt, Human
ccugggcuggaguacagcagugugaucucagcucacugcaaccuccguccccccagg

SEQ ID NO: 4138826 - RNA, 55 nt, Human
ccugggcuucugucuagauguuuaagccuuugcaccuuuggacagaguguccagg

SEQ ID NO: 4138827 - RNA, 129 nt, Human
ccuggggacacccaauauuuacugccugaggccuaaguccuucccaagcauguaccuacagaucuguaccugagaggugaugaugaggaggcuuuucaggcucaggcagaugaagagcucagcuccagg

SEQ ID NO: 4138828 - RNA, 59 nt, Human
ccuggggccacaacggcgcacgcgcaaaaacuccaucgcgcgcaugcgcgugccucggg

SEQ ID NO: 4138829 - RNA, 70 nt, Human
cccaugaaugucuugagaagagaaaucuucccaucguuaaggauucucagcuucaaguuauucucuuggg

SEQ ID NO: 4138830 - RNA, 81 nt, Human
cccaugagucaaaugcaugagcuuugugauccugacugagguuugacuagggcuuaggaacuagacucaugacucaguggg

SEQ ID NO: 4138831 - RNA, 70 nt, Human
cccaugcuuagggcuccuccaauagaucauaaacgaaugcuuggucccauuguuugcucuaggcugaggg

SEQ ID NO: 4138832 - RNA, 58 nt, Human
cccauggccagcaaguucagaauuucuguaaucagaaaaugagaccucagcugguggg

SEQ ID NO: 4138833 - RNA, 58 nt, Human
cccauggccuugcaggcuuaacaggaagagcucugagccagacaagacagccaguggg

SEQ ID NO: 4138834 - RNA, 77 nt, Human
cccauggucuucugaaggauuuuaaaguacauuaaggaaacuugcagaaaauuucuuuggaaucuuaggaguguggg

SEQ ID NO: 4138835 - RNA, 64 nt, Human
cccaugucuuucacucucuuucucuuuaucacuacuuuggaagcuuugugaaagcagacauggg

SEQ ID NO: 4138836 - RNA, 101 nt, Human
cccauuauggacauccgacgaccuggguucagacccacauuugccccucugagauaguggugaugguggacucuugauucaggcagucuggauucaagggg

SEQ ID NO: 4138837 - RNA, 66 nt, Human
cccauucauugucuccaauucuauauauuacuauuauauaaacguuauagaaagaugauggguggg

SEQ ID NO: 4138838 - RNA, 68 nt, Human
cccauucugacuucauugccucagccgggccucuccuccgugaagcaguucucagaaguggggguggg

SEQ ID NO: 4138839 - RNA, 76 nt, Human
cccauuggaagaggcccaugacugccuuauugaucugagauuuacgaaagcagcaauuauguguuauuugaguggg

SEQ ID NO: 4138840 - RNA, 120 nt, Human
cccauugguaaaacuagaggggugguggucuccaucagcaugcaggcuguuccagcucaauuuugaugagccuaaugugcugguugcagaucauuuaccaccacagugagagacuagggg

SEQ ID NO: 4138841 - RNA, 66 nt, Human
cccauugugaucauuguaguuucccacugaacaaacaacagaaacucugcagugacuuauaaaggg

SEQ ID NO: 4138842 - RNA, 63 nt, Human
cccauuuaugacuacacaggugauccauggaaagaauggauuauguguggauacauacuuggg

SEQ ID NO: 4138843 - RNA, 62 nt, Human
cccauuuauuuaaguaggucuugccuuaacggaaagggagucuaucuucucaaauaaguggg

SEQ ID NO: 4138844 - RNA, 80 nt, Human
cccauuuccaggguucguuuccacguggcucaagauuucuuccuggcagucugggaacugggaacguuucccuuuguggg

SEQ ID NO: 4138845 - RNA, 58 nt, Human
cccauuuguauagagccuuauagucacaguaaggacucugggcuuuacuccaaguggg

SEQ ID NO: 4138846 - RNA, 118 nt, Human
cccauuugucaucuaaaugguccguccccuucuuaaacaucauuuuggcccaagguccauucauggggccugccggguguuccugggaagaugggcagaaaaucccaaggcaaguggg

SEQ ID NO: 4138847 - RNA, 67 nt, Human
ccccaaacaggcugcagaggccuuucauggucaaaaagacuuggauuuaggauuuucagcagagggg

SEQ ID NO: 4138848 - RNA, 67 nt, Human
ccccaaaguauauuggauugaauggguuguugucaacuggcaccaucagcuccaguaucuucugagg

SEQ ID NO: 4138849 - RNA, 72 nt, Human
ccccaaaugcugguuuccucuagauguuggaguuccaguuucuacgaaggucaacccuaaagcacuuggagg

SEQ ID NO: 4138850 - RNA, 82 nt, Human
ccccaaccagcgccaggccacgccccggcgugugacgcaagcacgcuccgugcgcgccgucgcgucgcggcgcucacugggg

SEQ ID NO: 4138851 - RNA, 62 nt, Human
ccccaaguggggagaucaauuagugcaacaacucuggccugucuccaucucauuacuugggg

SEQ ID NO: 4138852 - RNA, 55 nt, Human
ccgcgccacccauucccacugacuccagcuccauggaccugggugggaggagcgg

SEQ ID NO: 4138853 - RNA, 83 nt, Human
ccgcgcgcccacggggcuagagaagguuucuuucgaguuugagaaggaauuggcacggccuucucagucucccgaaagcgcgg

SEQ ID NO: 4138854 - RNA, 76 nt, Human
ccgcuaaaguaagcagagcagauaguauuaucucacuuuuuagaugaggaaacuaaggcucagugaagcuuagugg

SEQ ID NO: 4138855 - RNA, 96 nt, Human
ccgcuccagggccuccuccagcucugcugugcgccgguuggaauccccgccaggacccaggccauuggcaagagucuggagugagggaaggagggg

SEQ ID NO: 4138856 - RNA, 55 nt, Human
ccggaauccugcuuucaauucuuuugaaagaauugaaagaagugggauugccagg

SEQ ID NO: 4138857 - RNA, 71 nt, Human
ccggacucgagcgccacccgcuggaggcagggcucaucgcccagcuuccgaccgggggcugcaagggccgg

SEQ ID NO: 4138858 - RNA, 65 nt, Human
ccggacuggcccugcuccgcgccgcgggcucuuuggccggugaguggggcgcagggcgcggcagg

SEQ ID NO: 4138859 - RNA, 56 nt, Human
ccggacuugaaucuuuugccuggccgcaacccgccagccugcaauguagguaccgg

SEQ ID NO: 4138860 - RNA, 105 nt, Human
ccggagacuuacuacuaccucaaccaggucgggggagcccuuguggugcggcggggaggccugcccagaggaggaucucggcccggaggucugaggaguagccgg

SEQ ID NO: 4138861 - RNA, 72 nt, Human
ccggcaacuacaggcagauuaaggguaggcauuucagacucgaaauacugcucuuguuuuuuguuguuaugg

SEQ ID NO: 4138862 - RNA, 66 nt, Human
ccggcaagagaggaagugagaggguguugggaggugccagguucuuucacaaccugcuuuaguggg

SEQ ID NO: 4138863 - RNA, 113 nt, Human
ccggcagccuuucgcgggcgagaugggggagguuagccaggccuuugaucccggcggggcgcgccuccaccuccccgucugcccggccuuccuccaccuccucccgcugccgg

SEQ ID NO: 4138864 - RNA, 78 nt, Human
ccggccaccagccaccuuugcaaaccaaaucugagcugcugccagucagagacuggucugcagaugccucuuggcugg

SEQ ID NO: 4138865 - RNA, 55 nt, Human
ccggcccgcucagggcaggaaguuucuguucuucucugcucugcuuugcaggugg

SEQ ID NO: 4138866 - RNA, 63 nt, Human
ccggccucaaccuucagggucccugacugcugcauggaacacgccuuuggaggaugaggcugg

SEQ ID NO: 4138867 - RNA, 86 nt, Human
ccggcggcucccgcgagagggaacggaucccagcgcggccgcggcuccccgcgcgguaaccccgaucucucagcgcgggcccccgg

SEQ ID NO: 4138868 - RNA, 58 nt, Human
ccggcgggcagcggcagugagcccagcgagguggucucggugcgccaguguccguugg

SEQ ID NO: 4138869 - RNA, 62 nt, Human
ccggcuauuggcuucucccauccccuaccagagggugacgagacgggaagccgggaagccgg

SEQ ID NO: 4138870 - RNA, 76 nt, Human
ccggcuccaguucucaggcuguggagccgucuaggcaccgugcacgaagugggucuccagggcucugagaggccgg

SEQ ID NO: 4138871 - RNA, 71 nt, Human
ccggcucucuggaggagcucacccugcuggcucagcugaguuuaagggggaagcugcuccuggggagaggg

SEQ ID NO: 4138872 - RNA, 61 nt, Human
ccgggaaguucaaggucaaggcccuggcagauuuggugccucaugaaggucugcuuccugg

SEQ ID NO: 4138873 - RNA, 107 nt, Human
ccgggaugacugucaggauggcagcuuguucuaaggaagcauuuguaucuucagacgcaaauuuccccagaacgccccuggcugguuucaacugucagucacuccgg

SEQ ID NO: 4138874 - RNA, 94 nt, Human
ccgggcacgcgggggucggggccgccccucguccgccgcugccgcucgguggccgggccgggcgccuccaccccccucgcagucaugugccugg

SEQ ID NO: 4138875 - RNA, 108 nt, Human
ccgggcacucggagcuggccgggggagccccaccucggugcccgcagcccgggaccgacgggccauggccggggacgggguuccugggguaggcccggaagugucugg

SEQ ID NO: 4138876 - RNA, 82 nt, Human
ccgggccgggcuggagcgccucggaugcggcgccggagggagacccagguccuggccgccgcguggggccgggccgggccgg

SEQ ID NO: 4138877 - RNA, 92 nt, Human
ccgggcgcgguccccgcgcggggcugggggcacacggaccgagucuccgcccccuuguucucugcgcucccggcccgggaagccgugcccgg

SEQ ID NO: 4138878 - RNA, 65 nt, Human
ccgggcgcugcgcccccgcgcgcucugccugcugagcggcgccggagggaggugcggaggccggg

SEQ ID NO: 4138879 - RNA, 70 nt, Human
ccgggcuccgggcgugcgcacgaggagcaggugcccgggcgagucucgagcugcacgcccccgagcucgg

SEQ ID NO: 4138880 - RNA, 58 nt, Human
ccgggcuuugggaugcuguuccuuuguuggagggagcagagcccuuccauggccuugg

SEQ ID NO: 4138881 - RNA, 59 nt, Human
ccggggcugaggcaacgcggagauuggugccuggcgccccucuucggccuccgccuugg

SEQ ID NO: 4138882 - RNA, 58 nt, Human
ccggggcugcggggcucccgccgcggcuguucugccaaggcugucccgcggcugccgg

SEQ ID NO: 4138883 - RNA, 68 nt, Human
ccgggggcaauagaguuggaacugaaacccaguacaaccacuaucagaaguccaauuuucgcaccugg

SEQ ID NO: 4138884 - RNA, 86 nt, Human
ccgggugacucguacguagucagugcugggaagcgcuggucuacagucauguuucucaagcuugaaugcacauccgaaucccccgg

SEQ ID NO: 4138885 - RNA, 73 nt, Human
ccgguccgcgccuccgccgcuuuuuauagcggccgcgggcggcggcggcagcgguuggagguuguaggaccgg

SEQ ID NO: 4138886 - RNA, 68 nt, Human
ccggugagugagcucugcggugucuucccacaucacaccuuggacugcuggggcucauucaucuccgg

SEQ ID NO: 4138887 - RNA, 93 nt, Human
ccguaaccccauccuucaggcagguuucccggcugucaaugagguucguuguggcugcggauuugaucucccuuggccugcagggugggcagg

SEQ ID NO: 4138888 - RNA, 65 nt, Human
ccgucaccucugcucuaucuccagccuacuguucagucuggagagcugagcagaguuaggagugg

SEQ ID NO: 4138889 - RNA, 130 nt, Human
ccgucccccacccucuccaggguggaagacugcuccaaggaggccccaggucagcugcuggagaagcagagaggcugcccagugaggccucuugugagcagacuuccacccugggaggguccccugccgg

SEQ ID NO: 4138890 - RNA, 65 nt, Human
ccgucuccagggcagagaauagcaauggcaggaaacgucacuauccagaguugcugcuggagcgg

SEQ ID NO: 4138891 - RNA, 65 nt, Human
ccgugaaggcuuuuagcucugaaaacacugacaucucuuuucagaggccuaagagguuuacaugg

SEQ ID NO: 4138892 - RNA, 65 nt, Human
ccgugacgugcccagggccacagcaggagaggugccugucuggggcagcaaggcgcgcguuccgg

SEQ ID NO: 4138893 - RNA, 63 nt, Human
ccgugcugugcugguugcuggggugguugcaguccugccccagucagagcagcgcucgcaugg

SEQ ID NO: 4138894 - RNA, 63 nt, Human
ccgugggaguggcaggaaaugggagcgaaagaaagggacuucacucucucuccauucccaggg

SEQ ID NO: 4138895 - RNA, 63 nt, Human
ccgugggcaggaggcggcaccagcguggcucccgggggggccagggccaaggcuuucccacgg

SEQ ID NO: 4138896 - RNA, 63 nt, Human
ccgugggguggccuagggcccagccugugucaaggcugcgggcagggcacugguccccugugg

SEQ ID NO: 4138897 - RNA, 62 nt, Human
ccgugggucccaggaaggaccagcagacccgggucacugccacuguccacugagacugacgg

SEQ ID NO: 4138898 - RNA, 128 nt, Human
ccguggguguacuggacucagccuucucacagcgccggcaugggcugcucagugggaaucuccaaggcugucaggccaugugggccuugccugagccagggaucggagggacagcgagcagccagcgg

SEQ ID NO: 4138899 - RNA, 60 nt, Human
ccgugugcucagccucagagccguaggcgagagcgccugucugcaugagugagcauaugg

SEQ ID NO: 4138900 - RNA, 126 nt, Human
ccguuaccagucaagcaacauucaucauguucacccuaaggcuucuggagcuugcuggcuggcugacuggcucgccagguacauuuaagaagccugugcuuggggauguuucuuaacugcagacgg

SEQ ID NO: 4138901 - RNA, 60 nt, Human
ccguugcuucucuuaaguccagcuggaaguacauucaucuggcaaaaaagagaggggagg

SEQ ID NO: 4138902 - RNA, 95 nt, Human
ccguuuugggagggggcggaagugccaggacagcaggagcggucagugguggccagugugugcugccggcucccacguggccccccucgguuugg

SEQ ID NO: 4138903 - RNA, 94 nt, Human
ccuaaaagggcuugcccagaaaaggagcugcaggaugaugacagagagcugugcgucuugcaagaugcuccucauucaucauguccccccuagg

SEQ ID NO: 4138904 - RNA, 56 nt, Human
ccuaaaaggugaaaucauaugauugaguaaauuaugugauagaguuacuuuauagg

SEQ ID NO: 4138905 - RNA, 73 nt, Human
ccuaaaaugucucuuuagagcaacaguaagugaacuuauuuucuguaaagggacaaauaguaaauauuuuagg

SEQ ID NO: 4138906 - RNA, 114 nt, Human
ccuaaaguauuuuuagaaaauagcauugaauuuuugcuguugauauugugaauuauaauugagacacaguacagcugaaacuuuagugugaauucuaaaguuggcugauuaagg

SEQ ID NO: 4138907 - RNA, 62 nt, Human
ccuaaagugcuacagcagaagucuucaugaaccuucugaaaugugagcaaaaucucuuuagg

SEQ ID NO: 4138908 - RNA, 59 nt, Human
ccuaaauuuuucccuagugaauauuggugcuuggcagaugugagcuggggagagugggg

SEQ ID NO: 4138909 - RNA, 55 nt, Human
ccuaacagcuugaggaauaucaucauuuguaugaaugaccaucucaaugcugugg

SEQ ID NO: 4138910 - RNA, 65 nt, Human
ccuaacugacaguggcuaaaggaauugcuaaauauaagucacuucuacagcuucuucaguuaagg

SEQ ID NO: 4138911 - RNA, 83 nt, Human
ccuaacuugggagauuuuucaacaagaauaggaucuuuuagaaagaccuuucacagaguuuggaauuguuuccuuaguuaagg

SEQ ID NO: 4138912 - RNA, 70 nt, Human
ccuaacuuugagucauugccucuuuccacccuccuauaaaaaagggaaaagaauugugagucaagauggg

SEQ ID NO: 4138913 - RNA, 130 nt, Human
ccuaagaaucacuuggggugcuugcuaaaaugcagauuucuugaccccugucucagagauugauucaguaauucuugaguaggcaucaggaaucaguauuuuuaaacauacaccccagguuauucugaug

SEQ ID NO: 4138914 - RNA, 91 nt, Human
ccuaagagcaaguguggugcacagguaauagccuaggcuauagaggugacugaguguaguuuaauuccuggccuuuccacuugcucuuggg

SEQ ID NO: 4138915 - RNA, 113 nt, Human
ccuaaggugauuccagcagaugagccagauuugacaacucuguguuguagaauugaaucuucucuauaacaucuuugccaaauugcuauuuggcugugauugauuaccuuggg

SEQ ID NO: 4138916 - RNA, 94 nt, Human
ccuaaguccagagcccucagaagcccuccauacucuguuggcucucugagcuggcagcuuuaaaggaggcucugagguguguucuggaaggagg

SEQ ID NO: 4138917 - RNA, 63 nt, Human
ccuaaucccagagaauaaugaucaggcguugauccaagugagaauuauuacucuuugggcagg

SEQ ID NO: 4138918 - RNA, 110 nt, Human
ccuaauuaaacauauuucuguuccuauagugaaauuuaugcacagcuacacaaauuggguaguauuauaaauagacuucaauuuauucagguagaguuauguugacuagg

SEQ ID NO: 4138919 - RNA, 56 nt, Human
ccuacacagagccuacuucugcaggaugugcugcaauucuugugugcucugugagg

SEQ ID NO: 4138920 - RNA, 86 nt, Human
ccuacaggcuuaccuguccugagauagcaucugagguuccugaaauaagccuaguccuccuguccagugacuuugggccauguggg

SEQ ID NO: 4138921 - RNA, 84 nt, Human
ccuacagggaugaacauuuguaugcguuuuuacugucaguuucuaaacuguuuagauuuuuaaccaucacaaaugucuuugggg

SEQ ID NO: 4138922 - RNA, 60 nt, Human
ccuacaugcuuuaccaaagcagugaugagagugaucagugcauguggugugagugguagg

SEQ ID NO: 4138923 - RNA, 88 nt, Human
ccuacauuuuuuccagugauugcugcucucaucuuuuugccaaauugaucagaguuggcaguaaaacacaggcaguugaaaauguggg

SEQ ID NO: 4138924 - RNA, 58 nt, Human
ccuaccaguucccgugaacagaauaaaaaauaauauuuugcaaugggcauuuuggagg

SEQ ID NO: 4138925 - RNA, 56 nt, Human
ccuucagaaagccucccccgguguagucuuuuuaaagauucaugaaggcuugaagg

SEQ ID NO: 4138926 - RNA, 63 nt, Human
ccuucagaaugaaauucuaaugaucugguaagcaguuaguuagaauuugguucugcccuaagg

SEQ ID NO: 4138927 - RNA, 74 nt, Human
ccuucagcccacaccagagguuaccugcaaacucuuccgguaugugguggcagcucugagucucugucugaggg

SEQ ID NO: 4138928 - RNA, 76 nt, Human
ccuucaguaaaaucaccaaaagcagguggagaauaaaaaguguaacagccacuugaauggugaugcuacugagagg

SEQ ID NO: 4138929 - RNA, 64 nt, Human
ccuucaguaagcagcugauuucacagcucaggcuagaccuagauggugucacugcuucuuaagg

SEQ ID NO: 4138930 - RNA, 58 nt, Human
ccuucaugucaccaggucugaugcagccacguguggcugucauugaacaggugaaggg

SEQ ID NO: 4138931 - RNA, 71 nt, Human
ccuucauuuccucacccaugaaaugcaggaaguaaggucuacuuugcagagugguugugaggauuagaugg

SEQ ID NO: 4138932 - RNA, 56 nt, Human
ccuuccagggagucaaaugaacuacuuuaggaguauaaguuaaacacccugggggg

SEQ ID NO: 4138933 - RNA, 67 nt, Human
ccuuccaguucuugguuguaauuggauucaggcuaaaacaaccacguccccaaccaggaaaggaggg

SEQ ID NO: 4138934 - RNA, 69 nt, Human
ccuucccacaaacgccacggcccuguccaguccccacugugacaucgcugugucuguuuuuuaggaagg

SEQ ID NO: 4138935 - RNA, 81 nt, Human
ccuucccauuucaaugcugguuguuuuauggucacacauaacuacaaggcuacucauacagcugcauucuuaacaggaagg

SEQ ID NO: 4138936 - RNA, 67 nt, Human
ccuuccccccaugcuccaaaaacaagagaauugcugauuauucuuauuuuuguguauuggggguagg

SEQ ID NO: 4138937 - RNA, 66 nt, Human
ccuucccugauaagagccucagaauguuuucuguccaagcuguuuggguucaaguacagggcaagg

SEQ ID NO: 4138938 - RNA, 63 nt, Human
ccuucccugggcuggaagcaucuucuccauuuuacuguuggggaagcugaggcccagugaagg

SEQ ID NO: 4138939 - RNA, 61 nt, Human
ccuuccggcccugauuugcacuacacaguccuagauguagaaaagaagucuggccgggagg

SEQ ID NO: 4138940 - RNA, 65 nt, Human
ccuuccuccucaugcggcagcagcacgaggcugcggcccugaacgcugugcagaggauggagugg

SEQ ID NO: 4138941 - RNA, 84 nt, Human
ccuuccucucauuucccuuuuucagguguugguuccccucucucaaaucagugcaaaggagaggguagugagagaucacgaagg

SEQ ID NO: 4138942 - RNA, 77 nt, Human
ccuuccugcuucuggccuuuuaucucaggcugagaccacagccacugugagaggaccagggaguaauuccuggaggg

SEQ ID NO: 4138943 - RNA, 63 nt, Human
ccuuccuuuaugucuuaggcuguuuaugagacccauucuucuccacugucacauaaaggaagg

SEQ ID NO: 4138944 - RNA, 59 nt, Human
ccuucgaagaaaacccaggaagacccaugcaauagauuccugggacucaacuuagaagg

SEQ ID NO: 4138945 - RNA, 55 nt, Human
ccuucgaccccagaccaauggcuguauuuguaagacagcugucugaggucugagg

SEQ ID NO: 4138946 - RNA, 69 nt, Human
ccuucgcugccagcacaguucagcugugccguccccagcgcugcggugccuguagcuggugugcggagg

SEQ ID NO: 4138947 - RNA, 70 nt, Human
ccuucuaagagaguacaagcaauuuaauaagaaaacugucuccacggugaaguugcuugaaccugggagg

SEQ ID NO: 4138948 - RNA, 81 nt, Human
ccuucuacugaguguggagucugcguacccuccgggcuaguggauggccaggguggcguagaugcugggcucagcuggagg

SEQ ID NO: 4138949 - RNA, 63 nt, Human
ccuucuagccugcgccagggcagaccccuugcucaccccguccuuggugcucugcugggaugg

SEQ ID NO: 4138950 - RNA, 89 nt, Human
ccuucuauacaaagugagaugucugggccaauggagugcaccccccuagagccugcacccucucagaaaucccacucuguguacugagg

SEQ ID NO: 4138951 - RNA, 70 nt, Human
ccuucuauuccugcauggauugaggcuauuguggaccacaugcauggcccaggaaucaggcugugggagg

SEQ ID NO: 4138952 - RNA, 71 nt, Human
ccuucucaccagguguaaagugguuaguuaaacaucuaacuuuggccacaaguacccugaagcagagaagg

SEQ ID NO: 4138953 - RNA, 82 nt, Human
ccuucucguugcugcagcuauguaacagugccauggagggaguucccuguucuuugcacugugcaagcagaagccgagaggg

SEQ ID NO: 4138954 - RNA, 83 nt, Human
ccuucucucauaguuacuuugacuuagucuauagucaugggugcuucaugaaaaauuuacuguuaacaaauugugaauaaagg

SEQ ID NO: 4138955 - RNA, 61 nt, Human
ccuucucugucaauggggguaauaagauaagcauucuuggccccauuuuacagaugaaagg

SEQ ID NO: 4138956 - RNA, 65 nt, Human
ccuucugcauuauuggggccuguuucuucauucuuagaaggcaggccaauaaguagugccuuagg

SEQ ID NO: 4138957 - RNA, 72 nt, Human
ccuucugccgucugagugugucuaaucuuucucugccgcuaucuuagaagaacauuuaugauggcauuuagg

SEQ ID NO: 4138958 - RNA, 101 nt, Human
ccuucuucccucaaagaaaggguugugucuuaagcugguucccucaggggaacacccggagacauagauuuaagagcaauuaguuaauugggaggugaagg

SEQ ID NO: 4138959 - RNA, 64 nt, Human
ccuucuucuggacaggcagcucccgaggcagccccgcacuaaggcagcgccgccagucagaagg

SEQ ID NO: 4138960 - RNA, 73 nt, Human
ccuucuugcccucaggcuuccagcuggguuuggcaaaugggagacacagcuaggaaaccagagggcaggaagg

SEQ ID NO: 4138961 - RNA, 73 nt, Human
ccuucuuguugcugggugcuauuaugaacaguagaagcagcagcuguaauaaugaggcauccagccauggagg

SEQ ID NO: 4138962 - RNA, 71 nt, Human
ccuugaaccugggaggcggagguuguagugagccaagauggcaccauugcacuccagccucccauaauagg

SEQ ID NO: 4138963 - RNA, 60 nt, Human
ccuugaaggccaccuuauuggaacgugagguccugcccucggccaauguuggccccaagg

SEQ ID NO: 4138964 - RNA, 87 nt, Human
ccuugacgucuuuaagcuaauggccguuugcaucugugucuucaaacagauccugguuacagccauuuugugugauucacuucgggg

SEQ ID NO: 4138965 - RNA, 65 nt, Human
ccuugacucuuggugauuacuggguuaugcauguaaacaguacaacuccacaagacuagucaagg

SEQ ID NO: 4138966 - RNA, 78 nt, Human
ccuugaggccaggaaagcaaaaucacccacgauguuaaacaguuuggaugagucacugcuccuuuuugcgccucaagg

SEQ ID NO: 4138967 - RNA, 70 nt, Human
ccuugcaagguuucucucugccuaaaugagucuccauugcaggcgauagaguaggagaggccuugugggg

SEQ ID NO: 4138968 - RNA, 81 nt, Human
ccuugcagagauaagaagccgguaggggauucauaggcuuggcccuaggagcccccuggacugagcuccuugaggccaagg

SEQ ID NO: 4138969 - RNA, 64 nt, Human
ccuugcccacucuguuucccaagauucuaucuuugguucuagggagcucuagcagugguaaagg

SEQ ID NO: 4138970 - RNA, 58 nt, Human
ccuugccccagugcacugcuuuaguuguuugaaaaaggcugccagaaauuggguaagg

SEQ ID NO: 4138971 - RNA, 95 nt, Human
ccuugccuagcagcacauuuuucuugaguaucuucuguuguaccugugcugguacacaaagauaagucagaaagucacaguuccugccuucaagg

SEQ ID NO: 4138972 - RNA, 86 nt, Human
ccuugcgcccggccggccugcugcucacagucccuccacguacccacaggaggcccagacucagcggggcgggugcaagcgcgggg

SEQ ID NO: 4138973 - RNA, 64 nt, Human
ccuugcugugugucagucacugguaaggauuucuccaagcacuuccaguacugcacacucaagg

SEQ ID NO: 4138974 - RNA, 105 nt, Human
ccuuggagaagagccauguggcgcuggcauaggcuuguggggaaagugccuccuucagcugcuguggccacaucuggcucugauuuuuuuuuuuucucccugagg

SEQ ID NO: 4138975 - RNA, 56 nt, Human
ccuuggagagugugaggcucugggcucugaaugcccagaccuugugcugcccuugg

SEQ ID NO: 4138976 - RNA, 66 nt, Human
ccuuggcuuaggucacuggaccuccaggacucaccuggugcugggcaccagugccugcaggagagg

SEQ ID NO: 4138977 - RNA, 92 nt, Human
ccuugggaguuaggauuuuaacaugugaauuuuggaaggacacaaauguucaguccuuaccagccaccauguaaaguccuaccacccugagg

SEQ ID NO: 4138978 - RNA, 90 nt, Human
ccuuggggcggucgcucugcagauuucaugcgaaauggggucaaaaggccgcgcagaagcguggagucugcaggggaaggcuccccgggg

SEQ ID NO: 4138979 - RNA, 84 nt, Human
ccuugggggcuguugcagggcuuggggauuacagccuguuuucagcaucccuauuuaaagcccagcuucucaguguucccgagg

SEQ ID NO: 4138980 - RNA, 107 nt, Human
ccuuggguauugucagaguagaggaggcuggguccagauaauaaaagacuuugaguguaacaguugcuuucauuuguuuggaagaugcuuuuuccucuuaccuuagg

SEQ ID NO: 4138981 - RNA, 89 nt, Human
cccucagcccugaagccuaugggacccugaggccccugcucugcuccaggcccccagcaccaggccauggggucccugcucagggaggg

SEQ ID NO: 4138982 - RNA, 65 nt, Human
cccucaguccccuuaggcuuucagagcggccauagaggugguggcuggacucaggggacucaggg

SEQ ID NO: 4138983 - RNA, 59 nt, Human
cccucaguguguuuggggugaggcaguggguucugccucccacgaccacacauuggagg

SEQ ID NO: 4138984 - RNA, 62 nt, Human
cccucauaugcacauuugugcugccaacccgauggucagcaagauggugaaugagacgaagg

SEQ ID NO: 4138985 - RNA, 99 nt, Human
cccucauuaauuuaagccuaaaagugcauucgaaaguccauccuccugugugauuguaaggaugaugcacuggucacuuuggcaucugaaccaauaggg

SEQ ID NO: 4138986 - RNA, 55 nt, Human
cccuccagcucaaagcaaccggcaaagcuaggcuuuuguugagagacugagaggg

SEQ ID NO: 4138987 - RNA, 81 nt, Human
cccuccauuuuuagcuuggucaagucuuaaagaaaaauugaguguaaguaauuuuucggcuuagacccaguugaacuaggg

SEQ ID NO: 4138988 - RNA, 65 nt, Human
cccuccuaagccaugcaagccacaaggugauuuucuuccccuaugugauagcugguugugggggg

SEQ ID NO: 4138989 - RNA, 76 nt, Human
cccuccuaccauuccucuagcuucucacuaacauguauguugugaaacagaguugagguacaugguccuaggaggg

SEQ ID NO: 4138990 - RNA, 85 nt, Human
cccuccuccacccaauuauuccuguuccccaucaccacaguaccaccuggguggcaggauuggcaggaguggguaaggggaaggg

SEQ ID NO: 4138991 - RNA, 127 nt, Human
cccuccucugggacccauagcuucccacagaguuuggccaaggggaugcugaagauguuggugcuuccccugcugcagccagcaucgacuuccugccugaacuuugaguggaggaauuagaggaggg

SEQ ID NO: 4138992 - RNA, 79 nt, Human
cccucgcccgcagugccuggccggcuuccauuucuccuugagguggcugagcuggccggagcguucgcgggcugagagg

SEQ ID NO: 4138993 - RNA, 65 nt, Human
cccucgggcgcugggccugaggcguagcagggacugcacagagcaggcaccagcggccucgaggg

SEQ ID NO: 4138994 - RNA, 85 nt, Human
cccucucaggcccacagguuggggacuuaggaugacuuagaaugaaagucagcuuagacucccugccuggccaggcugaggaggg

SEQ ID NO: 4138995 - RNA, 108 nt, Human
cccucuccacgugccuccgugugggugcgcugggcugcuguguuccugaggcaccggugggugcgugacgauggcagcucccacccagcagagccgcgaacagaaggg

SEQ ID NO: 4138996 - RNA, 56 nt, Human
cccucuccauuuuccccagaaauaguuuuacuguaggggugagauguaggagaggg

SEQ ID NO: 4138997 - RNA, 65 nt, Human
cccucucccauuaggacaaccaaaagugucucuagacguugccgaauguuuccugaggugaaggg

SEQ ID NO: 4138998 - RNA, 58 nt, Human
cccucuccuggcugcauggagcaccuccaccacggugcaccccgcuugagagagaggg

SEQ ID NO: 4138999 - RNA, 103 nt, Human
cccucuggggucccauuggcccugcuggagggaggaggcugcuauuggggcccccucagccacaaccccaagccuacucgcuuggccugggacuccagggugg

SEQ ID NO: 4139000 - RNA, 76 nt, Human
ccgagguagggcagagcaggggcugaaccuggauccaacucccaaguguaggacuugcucugugaagccuucuugg

SEQ ID NO: 4139001 - RNA, 88 nt, Human
ccgauagacccucuuccuuaccuggcacuauggggagaaaaacuuccaaucuugucauuuggugccaggaaagauucauggucucugg

SEQ ID NO: 4139002 - RNA, 61 nt, Human
ccgcaccaccgcgcgcgcccgcucugcgccugcgcgcaggcaaugcuccgcgggggcgcgg

SEQ ID NO: 4139003 - RNA, 66 nt, Human
ccgcaccaggcuucccucaagauaaguuaaccuuggggacugggcuagaguggaagcugguggagg

SEQ ID NO: 4139004 - RNA, 70 nt, Human
ccgcagacccuuucugcaugcuuaucucaucagauugaaacucugcacugcgguaagguggaaauugugg

SEQ ID NO: 4139005 - RNA, 89 nt, Human
ccgccacguaccuaguuaccaguugcccuuugugucugcguguuugcauauuuagaaauaaaucugcagcuggggcuuuuugguggugg

SEQ ID NO: 4139006 - RNA, 64 nt, Human
ccgccagagccugccaccuuucucccugcugcuugcggugagguccugagaggcuugugggugg

SEQ ID NO: 4139007 - RNA, 77 nt, Human
ccgccagccccuucagcucggccuaggcccacggucagcccaggggagcugggggcugcagccgggugggugagugg

SEQ ID NO: 4139008 - RNA, 102 nt, Human
ccgccagcugcaucagaucccuccagggccucauugucaguccuguaaucuuuucauccgugauaggaugggccgugggcccuugugggugaagcucggcgg

SEQ ID NO: 4139009 - RNA, 69 nt, Human
ccgccaucccgcgggguugagcccucguggucugagccccagaacuagagaaacgccgugggaggaugg

SEQ ID NO: 4139010 - RNA, 76 nt, Human
ccgcccggacccugagggaugagaguugcagccuagaaaaccaggugccaggcccugcggggucccacgcgggcgg

SEQ ID NO: 4139011 - RNA, 65 nt, Human
ccgcccuaggcacugaggggagcaagguggacaaugacaucggccuagcucccguggguuggugg

SEQ ID NO: 4139012 - RNA, 70 nt, Human
ccgccgggcucgggcagcgugggcgaguggcggggggucccggccccacugcugcgccgggcgccggcgg

SEQ ID NO: 4139013 - RNA, 81 nt, Human
ccgccuacacgcgccagcaggucuuggagcuggagaaggaauuucacuacaaccgcuaccugacacggcgccggagggugg

SEQ ID NO: 4139014 - RNA, 75 nt, Human
ccgcgccccccgccgccccgauccgggccggcaugaugugccuggaaugcgccucggcggcggcgggcggcgcgg

SEQ ID NO: 4139015 - RNA, 59 nt, Human
ccgcgggaggcuguucuggggcugauauuaauugggucagucccaacagcuucuccugg

SEQ ID NO: 4139016 - RNA, 103 nt, Human
ccgcggucggugggugcgggccacgugguggcgaaggugcgcgcaguggaugcggacucaggcuacaacgcguggcuuucauaugaauugcagccggcggcgg

SEQ ID NO: 4139017 - RNA, 65 nt, Human
ccgcucaaggggugcuguuggaaacccagcuucugaggguggguguuuaaaagacccuagagugg

SEQ ID NO: 4139018 - RNA, 98 nt, Human
ccgcucaguagggagcacacggccaagguacauauuuucaucccaccauccuuuccagauuauuuugcacuuggcugugaucucuaggcccagagugg

SEQ ID NO: 4139019 - RNA, 56 nt, Human
ccgcucugcacuaguggucauauguccaagguacgugacagcauagagcagggagg

SEQ ID NO: 4139020 - RNA, 81 nt, Human
ccgcuuucccucuggaccaccucccgcugcguuuccuacucagagaaacagcaagggcggggucaagacacgggaugacgg

SEQ ID NO: 4139021 - RNA, 57 nt, Human
ccgcuuucugugauugcagccucuccggaugcccgaucgcugcagcagagaaacugg

SEQ ID NO: 4139022 - RNA, 65 nt, Human
ccgcuuuuucugugccuuucagaugucucucucuuucuugacauuucaagauauuuaaaaggugg

SEQ ID NO: 4139023 - RNA, 73 nt, Human
ccggaagaggcggcccaaggccaaggccagagagcgucaggccugccagcugugggccagccucccuccccgg

SEQ ID NO: 4139024 - RNA, 101 nt, Human
ccggaaguagaauggggucugagaggaggcagccucggauaauggggacaagcagccuugaggcaauguuucuucuaucuuacagcccuauuauccuuugg

SEQ ID NO: 4139025 - RNA, 97 nt, Human
ccggagcccaaggauugcuguguccacagaggagccagcacacugugacaugccggcaucgugaucuggaauucccugugguacacguggguucugg

SEQ ID NO: 4139026 - RNA, 64 nt, Human
ccggaggccgccugggagaagccagaaaccgcagggcuuccugccucgggcuggccgacuccgg

SEQ ID NO: 4139027 - RNA, 92 nt, Human
ccggaggggagcgcgucuagccugggcuccggcggccucaggcugaggagggagcagcaagccgcucggagcccagccacggaccccugugg

SEQ ID NO: 4139028 - RNA, 82 nt, Human
ccggagugggaagagguggcaggaaggggaucugaggaggagaacagggguccugguggucugugcuucuucccagacacgg

SEQ ID NO: 4139029 - RNA, 64 nt, Human
ccggauugucaucuccuggcgccuggauggauucacggccagagcaccagugggagacaagagg

SEQ ID NO: 4139030 - RNA, 66 nt, Human
ccggcaaaggccccuuccccaggacagaggugugguggcacagugcugggggccagggaccgcugg

SEQ ID NO: 4139031 - RNA, 67 nt, Human
ccggccacugggacacguugugcuuuaacaagaucgaaauugauugcugccagcguguccgugucgg

SEQ ID NO: 4139032 - RNA, 76 nt, Human
ccggccagggccugagggcugcucugcuggcagcgaagaccuugacacacugcagacggcccuggcccucgcgcgg

SEQ ID NO: 4139033 - RNA, 93 nt, Human
ccggccggcuccgcccccaagcccuggacggcccuucccccagcccgccuggcugggggccgcugcacaccggggguggaaguggggagccgg

SEQ ID NO: 4139034 - RNA, 66 nt, Human
ccggcgcagcuucagggccaggagggcggccccgugcacguccccaugaacuuguggcugcuccgg

SEQ ID NO: 4139035 - RNA, 63 nt, Human
ccggcgcgccucggaggcuuaucaggcuccccgcacgccccgcaagcuuccuugggcgcccgg

SEQ ID NO: 4139036 - RNA, 98 nt, Human
ccggcuaccgcugccccgagccgcagugcgcgcuggccuucgccaagaagcaccagcucaaggugcaccugcucacgcacggcggcggucagggccgg

SEQ ID NO: 4139037 - RNA, 62 nt, Human
ccggcugguuaggugagggugcgccagcaucagccuggcuggcuccaccuagguagcuccgg

SEQ ID NO: 4139038 - RNA, 89 nt, Human
ccggcuugccugggacugaggcauuuccaaggaugcaggacuucaaauguuaaacccaggaaagucucaggcaaaccaggacaaguggg

SEQ ID NO: 4139039 - RNA, 115 nt, Human
ccgggccaucgccgggcccgguuucacuguuaagggguuuucguuuguuccguuuucgccuccuguagagcugaacgggaauuccccgaagggugcuggggaacggguggccugg

SEQ ID NO: 4139040 - RNA, 90 nt, Human
ccugccauuuugacuuugguuagagguaaaaacauuaaguucugggauuugucauuaccauugcugccuucugagaaguuaaauggcagg

SEQ ID NO: 4139041 - RNA, 59 nt, Human
ccugcccaucccguccuuggccugagaaaggacaggcacugaggacggaugugggccgg

SEQ ID NO: 4139042 - RNA, 78 nt, Human
ccugcccauuauuccuuugaacuuggggauauuaggagaaagcaauguauccuggcaagcagaggagaacugaacagg

SEQ ID NO: 4139043 - RNA, 65 nt, Human
ccugcccuccccagccgugaaggagaggaggagccccuccgccuggugcaggcuggggaggcagg

SEQ ID NO: 4139044 - RNA, 65 nt, Human
ccugcccugccccaggcggcuucacucaccuggacuugaggggcuguagagggagcagggucagg

SEQ ID NO: 4139045 - RNA, 70 nt, Human
ccugccuacccuugcuugcccagucacaggccuggaaacacaggccuugcccugagcaggggucagcggg

SEQ ID NO: 4139046 - RNA, 57 nt, Human
ccugccuagggagggccucucugccugaguguggguggaggucucugucugggcagg

SEQ ID NO: 4139047 - RNA, 86 nt, Human
ccugccucggccucccaaagugcaaggauuacaggcaugagccacugugcccagccccuaauuuguguauuuuuaguagaggcagg

SEQ ID NO: 4139048 - RNA, 122 nt, Human
ccugccucuaaaugucaagagugucucaguugagggucuugcaaaaguagcaauuccuucucucuuuggcaugguccucacuauaaucauucugauaucaauuaaggauaauaaaaaucagg

SEQ ID NO: 4139049 - RNA, 64 nt, Human
ccugccucuggauguucuucugcaauuauggugccagccaugcuacaggaagacgucaggcagg

SEQ ID NO: 4139050 - RNA, 71 nt, Human
ccugccucugugcuauucauccacucacccaucacuaaauauucccugagugccuacggcacaggcgcagg

SEQ ID NO: 4139051 - RNA, 90 nt, Human
ccugccugaauccucugcugggauguaaagucuucuaaagcaggccugcacagggcuuuacuucucaguucuauggggacacaggauagg

SEQ ID NO: 4139052 - RNA, 77 nt, Human
ccugccugccaggccauucccagaguugcucuguccuggacagcuuggcagcugugaagugccucacacagugcagg

SEQ ID NO: 4139053 - RNA, 60 nt, Human
ccugccuguaagauggguacaauaguauccacagugcacagugccucuucuucagguagg

SEQ ID NO: 4139054 - RNA, 59 nt, Human
ccugccuuccaucuugugaaggaaugaggcugcucuaccugcaggaugcugaagccagg

SEQ ID NO: 4139055 - RNA, 105 nt, Human
ccugccuugaaacugucuguccuggugcagucaauguccucggcucuguggagguccaaguccacagggcacaagggagguuggggggaggaaugucaggguggg

SEQ ID NO: 4139056 - RNA, 104 nt, Human
ccugcgaggcacucgccgacccucccagcaguggaacuacccagggacaugaugaauggcuccucacugggcacuuuggagacagggugggaguagcaaguggg

SEQ ID NO: 4139057 - RNA, 77 nt, Human
ccugcgcuugcuggagcggagcgggugucagcagucaggagccuuaccccgugcacucugucuaguggaagcucagg

SEQ ID NO: 4139058 - RNA, 130 nt, Human
ccugcgggaaggagaggcuggugggaggaaagaagccuuguugagcaucuacugcagucccgcccuggggcuauggcugggagcuggacaggccggguccuugcccuccuggggccugccuucuaguggg

SEQ ID NO: 4139059 - RNA, 62 nt, Human
ccugcgggaaugguuucuaucuccgucugcguuuacgagugguggucagcccuuucuggagg

SEQ ID NO: 4139060 - RNA, 101 nt, Human
ccugcgggaugggcaagagacgcggugacggggcccagguuuccuuuaccuggaggaacuccacggucuugucgggcagcuuggugcuuaugaaccgcagg

SEQ ID NO: 4139061 - RNA, 57 nt, Human
ccugcggggguguggggagccuggccuggcccagguccucuccucacccgugucagg

SEQ ID NO: 4139062 - RNA, 63 nt, Human
ccugcuauaucuggacuuuaucaggcaaugagcuaaucagccaaagagacacagguaaguagg

SEQ ID NO: 4139063 - RNA, 70 nt, Human
ccugcuccguggguggauggcucaccuccaggcacccugaggccagccacagccacccucuggaaaaagg

SEQ ID NO: 4139064 - RNA, 87 nt, Human
ccugcucgaguuucauggggugggcgugcagggacacccagcuaauuuauggaauguguacugagugccccuuggaauagaugcagg

SEQ ID NO: 4139065 - RNA, 89 nt, Human
ccugcucggcggccgagccgcuguuccgcagcacccguaacuccaccggguccagcgacagcaggcucaggcgcaggccgcugaacagg

SEQ ID NO: 4139066 - RNA, 73 nt, Human
ccugcucguuggaagcuccaccuaagccuuguugccaggaaaugccacaaggccuguggggcugcuuuguagg

SEQ ID NO: 4139067 - RNA, 58 nt, Human
ccugcugagacccugaggugggccuagaaccucuuccgucucacaggucucagcgagg

SEQ ID NO: 4139068 - RNA, 65 nt, Human
ccugcugcugccuguagccagggugaccagugggcuuuuaccuuaagcagcagguagacaguggg

SEQ ID NO: 4139069 - RNA, 113 nt, Human
ccugcuggaaaugucuuaagguaggaacacauccuccucuagcacaaagcacaagauuuggcucuuggaagacaggauguguuugcugaaugauugaaauauaucagagcagg

SEQ ID NO: 4139070 - RNA, 58 nt, Human
ccugcugggacuccuauuuuauauauauauauuaguauacuuggugguguuccauagg

SEQ ID NO: 4139071 - RNA, 60 nt, Human
ccugcuguaaugugucuuuauuuguugcucaccauuuaauguuggcuauauugaaguagg

SEQ ID NO: 4139072 - RNA, 55 nt, Human
ccugcuucagacucuuggacgugcucuuaaaugcagauccuggcagucagagagg

SEQ ID NO: 4139073 - RNA, 127 nt, Human
ccuuuguuuaaaccuacuuaauauuaauauuucauauggaaauuagaaaacuauauagguucuggaaaucuuagaaucauuauauuuauuaagcacagugaaauguugauagaugggaaacgagugg

SEQ ID NO: 4139074 - RNA, 63 nt, Human
ccuuuuaguuuaguaugccauucuaccucaauuacagagaaguagauggguuaaagcuauggg

SEQ ID NO: 4139075 - RNA, 59 nt, Human
ccuuuuauagaucaguguguuaccacugaugacaguggaagaaaugcugcuauuagagg

SEQ ID NO: 4139076 - RNA, 81 nt, Human
ccuuuucauuugguugcgucaggagccucauagcagcaugcuacugacaggugauugugaacuaaguguuauagcagaagg

SEQ ID NO: 4139077 - RNA, 57 nt, Human
ccuuuucccauguuucuggagccaagagcauauuuacucuaauaauauggcaaaagg

SEQ ID NO: 4139078 - RNA, 84 nt, Human
ccuuuuccccuuugcuaggucaaaugcauguugaucauacacguauguaugauauauguguugagcuugcgguuggggaugggg

SEQ ID NO: 4139079 - RNA, 86 nt, Human
ccuuuuccugugcuuaauucucacugaagccagagaguguuaaaugcccaugaggauacaguggaguuaaggaauacaggaagagg

SEQ ID NO: 4139080 - RNA, 75 nt, Human
ccuuuucucugccacagcuucugccuuuggaggcuuacccuuccuaggagcagaacuguuguggaggggaagagg

SEQ ID NO: 4139081 - RNA, 108 nt, Human
ccuuuucuuaaaaaagagucucuuauaauguagccaaauuaagaugaggucaugcuggaguagaauaggcccuuaaucugauauggcuggugucuuuguaagaagagg

SEQ ID NO: 4139082 - RNA, 73 nt, Human
ccuuuucuugauaguugagucuccagcgaaguaggauacuauucuaucugcaugcugagagauucagagaagg

SEQ ID NO: 4139083 - RNA, 55 nt, Human
ccuuuugagaggcagggaccaccucauugccagagcccagagccucuccuaaagg

SEQ ID NO: 4139084 - RNA, 57 nt, Human
ccuuuugcucucccauccagaagggcaccuaaccaggccccuggagcagacaaaagg

SEQ ID NO: 4139085 - RNA, 59 nt, Human
ccuuuugucuaugaaguucuuuaucccauagaaggggugacaggcuaggaggcugaagg

SEQ ID NO: 4139086 - RNA, 98 nt, Human
ccuuuuuagugcuauugugauauggaaagagugcagacuguggaguuaaccacaucuggguucucuucuucauucuucuaucgcgugaccucaagagg

SEQ ID NO: 4139087 - RNA, 79 nt, Human
ccuuuuuuaaaguuuguauuaaauauaacccugagauaauucuucauaaaguuguuuuaaugggaacaucacuggaagg

SEQ ID NO: 4139088 - RNA, 103 nt, Human
cgaaccucuuuauucuugcagccaucuuucuuggaggaaaaagugaaaaaagauguagcaaauccugccagagaggugcuggcaguuuagcuuggcagguuug

SEQ ID NO: 4139089 - RNA, 72 nt, Human
cgaacuccugaccuugugaucugcccaccuuggccucccaaagugcugggauuacagguguuagccaccacg

SEQ ID NO: 4139090 - RNA, 57 nt, Human
cgaagacagaccaucugaguagguuugcuggcaagugaauagaugggcuguuguuug

SEQ ID NO: 4139091 - RNA, 74 nt, Human
cgaaggaaacacuuugccucuuaccuguggugccggcugggcuacuguacugguagggucgagugaagacuuug

SEQ ID NO: 4139092 - RNA, 72 nt, Human
cgaauuuaugugagccuuuucucuggacacagguuaguuucuggagcgugaauggcuaagcacauagacuug

SEQ ID NO: 4139093 - RNA, 56 nt, Human
cgacacuguagauauagaguuaguguaguauuggucucuagagucuauugugcuug

SEQ ID NO: 4139094 - RNA, 77 nt, Human
cgaccgggagcggcaguccuuccaguacaggcucgcaucgcucuaccugcacuaccuggggcugcugcgccgcuucg

SEQ ID NO: 4139095 - RNA, 120 nt, Human
cgagacucccauucagcccacacccucauguaggcacagcaucugagcaccuggcuugugggacaucacaccucacaccucgcaugcugcgucgcucagggugggagcagggagauuucg

SEQ ID NO: 4139096 - RNA, 91 nt, Human
cgagacuuaaagaggucuagcaacuugucuuuguugauaaguggcaaagcuaaaaucaaaacccagacaggcuggacuucagagccccucg

SEQ ID NO: 4139097 - RNA, 79 nt, Human
cgagagagaaucucuuuccaaaggaggaaccaguuuauuuagggagaaaaauugcuuuggaaagagaaaaacucucucg

SEQ ID NO: 4139098 - RNA, 107 nt, Human
cgaggacaaaggacuaagggaugagcagaauguucagauaaauggcuugggugaaccuagaagugacauuuaacaucuguucuucuccugcuucuugcuuuuucuug

SEQ ID NO: 4139099 - RNA, 63 nt, Human
cgaggaggaacgggcgacauuugcccaaguaaauugugcacauguugcuaguuacuugcuuug

SEQ ID NO: 4139100 - RNA, 64 nt, Human
cgaggcuagaagucugagaucaaggugucaguaaggcuguuuuuuucugaggcuucuccccuug

SEQ ID NO: 4139101 - RNA, 57 nt, Human
cgagggaggugguaagccuuggaaaacuguagaggugacaaggccaccauuucuccg

SEQ ID NO: 4139102 - RNA, 66 nt, Human
cuaaacaucuuuacaacagaccuagugcaaauuuagcuaucacuggucugcuagaaagaugcaugg

SEQ ID NO: 4139103 - RNA, 90 nt, Human
cuaaaccaacuagguaagaaaucuagguucauucuugauucuggcaauaacugugagaacuuaauucagugacuuaaccuuugaguuuag

SEQ ID NO: 4139104 - RNA, 77 nt, Human
cuaaagaaaagcaaggggaauaguaggaccugggacagcaguccuaggcccauuaauuccccuugccccucugacag

SEQ ID NO: 4139105 - RNA, 69 nt, Human
cuaaagagaguucaagacuccuuauuugaaaggucaagguuuaugggaaagucauguauucauuuuuag

SEQ ID NO: 4139106 - RNA, 65 nt, Human
cuaaagaucuacagaggcuuuugacauauaacauuacuucucagaagccuuucauggauuauuag

SEQ ID NO: 4139107 - RNA, 58 nt, Human
cuaaagcuucuuuuaccaggaaguugcaauucugcaacugaaugcuggaagaagagag

SEQ ID NO: 4139108 - RNA, 70 nt, Human
cuaaaggccuuucuuaucaguagauucuccuaagcauuuaugaguguaacaggauggaauaggccugggg

SEQ ID NO: 4139109 - RNA, 89 nt, Human
cuaaagggcugcaaagagauguaaauacuugugaauaggaaugauuauacacuguguaaaaugcacuuuuguuugcuguauuccuuuag

SEQ ID NO: 4139110 - RNA, 83 nt, Human
cuaaaggguguguaucucuuagagguguguguguguauguacugugccuuacauguguacuuuuaaggauguguguguuuuag

SEQ ID NO: 4139111 - RNA, 68 nt, Human
cuaaauauaccaguugccugcauccauuauaugauguugaaauaggugccuguucuuggcauauuugg

SEQ ID NO: 4139112 - RNA, 129 nt, Human
cuaaaucgucucuuaaauccucuucagcugucauuuucuagaauuauuugauuuaugguaaauuagaagggugucagaaaaaugauaugugaguacuugaaguggauuuuaguagguuaggaguuguag

SEQ ID NO: 4139113 - RNA, 58 nt, Human
cuaaaucuagucuuuacugauuuagagggacaagccaaauuagaagggacugauuuag

SEQ ID NO: 4139114 - RNA, 99 nt, Human
cuaaauuaauugaagccugugacucuuaaauauacuguugaaugaugccauuggauuguaauauaacaguuugaauauaggugccagugcuauguuuag

SEQ ID NO: 4139115 - RNA, 88 nt, Human
cuaaccaacgcauuuuaagaagaguuaucacuuucaaaguccauuuuugaggaaaggaauuuauuuuaaaaaugauugcguuucuuag

SEQ ID NO: 4139116 - RNA, 73 nt, Human
cuaaccugcuucugcccucacgguaacgugcacaaucuucaucgcauguccuggguggugguaggagcaguag

SEQ ID NO: 4139117 - RNA, 82 nt, Human
cuaacgcucuaagagcaugacauaagugaaaaacaucaauuaaauuuguguaaauauauguuauguauuuggcuucaguuag

SEQ ID NO: 4139118 - RNA, 68 nt, Human
cuaacugggucucuauuuugguuuuggcugccaagaagcucacagccagaucugagagaucuuuauag

SEQ ID NO: 4139119 - RNA, 73 nt, Human
cuaacuucuguucugaguaacugaagguauggcaaggguuugguggugucaggggacuuaggagagaaguuag

SEQ ID NO: 4139120 - RNA, 85 nt, Human
cuaagaaaagugccaaguccacaacauccacacccuccccagugaagcagggugggaaccacaggacucggcacauuucccuuag

SEQ ID NO: 4139121 - RNA, 75 nt, Human
cuaagaaucccuugcaaguuguuguaggucucugauaaguugagauauguacaauucuuuguaagguggucugag

SEQ ID NO: 4139122 - RNA, 89 nt, Human
cuaagagaagccucgcuucagggcaugagggacacauccugauacaaaaugguguuguccucuugcccugacauacaugguuuccuugg

SEQ ID NO: 4139123 - RNA, 82 nt, Human
cuaagaggagauagugcauagggggaugcacagcucuguaaaagauaaugccuccuugcauacccuauguucuguucuguag

SEQ ID NO: 4139124 - RNA, 61 nt, Human
cuaagauagauuuuuucacuuuccucuccugaucuggaagcugaaauaauaucuauguugg

SEQ ID NO: 4139125 - RNA, 100 nt, Human
cuaagauucccaauuauuugcaguuccaaguauaauugugaaaugccaucuuucauaacuuauuagauuggagcuggagugagccuuccaggaauuuugg

SEQ ID NO: 4139126 - RNA, 64 nt, Human
cuaagcagcaggcaaggcagccucugccagccggggccuccuccuggggcuguuccugcgcugg

SEQ ID NO: 4139127 - RNA, 101 nt, Human
cuaagcaggaggaucccuugagcccagaguuugaagauacagugagcuaugaucacgucacuguacuccaaccugggcaacagagugagucccugucuuag

SEQ ID NO: 4139128 - RNA, 92 nt, Human
cuaagccugccgcuugcuuuaccugugguauauuucagcaccauccuccaagcccaaagccacuaaaguggggcacagccuacagguccuag

SEQ ID NO: 4139129 - RNA, 87 nt, Human
cuaaggcaccagguuugacuaggugucaguaacuuugaaauguguguguuaagguccugacuucugcaauagugacuugggacuugg

SEQ ID NO: 4139130 - RNA, 91 nt, Human
cuaagggugagccccaucugaacacagggccuugugugacugcacuggcuacaggccugcucagcuggcccugcucaggaucacaccuuag

SEQ ID NO: 4139131 - RNA, 80 nt, Human
cuaaggguuaauugacuuuguuguuccuugucuaaagagacuuuguucaaggaauaguaaaugaauacauggacccuagg

SEQ ID NO: 4139132 - RNA, 74 nt, Human
cuaaguaaaugguucucaguugguggcaguuuugccccucagggacauuugucaauaacuggagucauuauugg

SEQ ID NO: 4139133 - RNA, 72 nt, Human
cuaaguaggauuaaugccgauuugaggcuuaggaauaaacuuaagccucaaauuggcauuaauuaagcuaag

SEQ ID NO: 4139134 - RNA, 101 nt, Human
cuaaguaggugcucaauaaauauguucugacucuacaugggagcccuuugaacaugaggcugggucccuggagucugaucacauuagguuuaccuucuuag

SEQ ID NO: 4139135 - RNA, 91 nt, Human
cuaaguauuacuagguuugcuuccucauuucugguauuugagaccugagacuugugaaggagaugaagggagugagccgcuaagugcuuag

SEQ ID NO: 4139136 - RNA, 104 nt, Human
cuaagugucauuuucacaucaugauuccuacaguggagaaggcaugaggcuaacagacugggcuagaguuucugucuucccauuaacuugauaagugaccuugg

SEQ ID NO: 4139137 - RNA, 57 nt, Human
cuaaguguuuaaugguuuugaugagucaauuugacuagucaacuagugagcauaugg

SEQ ID NO: 4139138 - RNA, 108 nt, Human
cuaaguugaauuucacugaccugaauugcaugugguauaauacuaacaaaugguucacuauuagcauaucaugaaugguuauacuuuauagaaauuccauagacuugg

SEQ ID NO: 4139139 - RNA, 61 nt, Human
cuaauaucucugugggccacuauuccgcucaggucaggagacaguggccgagagguacuag

SEQ ID NO: 4139140 - RNA, 68 nt, Human
cuaaucucaugagaucugaacugccugagcucucucucccaggaguccucaggggauuuugagauuag

SEQ ID NO: 4139141 - RNA, 84 nt, Human
cuaauggaaauggggaugcucaaguaaagcagagcuggaacaaucaguaguuucauguuaaauugaguuugcaauguccauuag

SEQ ID NO: 4139142 - RNA, 78 nt, Human
cuaauggcacaugaagagagucuaguaaucacauaauuacuuugccauuacuaagaaaucauuuucagaguccaugag

SEQ ID NO: 4139143 - RNA, 71 nt, Human
cuaaugguuaacuggaaugugguaucaguagaaagggacauccuaaacugguaugauauccuugccacuag

SEQ ID NO: 4139144 - RNA, 55 nt, Human
cgggcugcuuuuuucuuagcagauaaagcugaucugcuuauuuaacagcagcaug

SEQ ID NO: 4139145 - RNA, 66 nt, Human
cgggcuuucacagcagggagggacaaggcggaggagcggcuccuguuuuuucuugcgugaggccug

SEQ ID NO: 4139146 - RNA, 59 nt, Human
cggggacacacuggcagcuccuaccaauuagugaccuaacccugccagugugcucuccg

SEQ ID NO: 4139147 - RNA, 57 nt, Human
cggggagagcggccggcugcggacgccggccccgggaaaggcugcucgcucuccccg

SEQ ID NO: 4139148 - RNA, 55 nt, Human
cggggaggaacuggauuuggagccagaagaacugguucuaauaucuacuucccug

SEQ ID NO: 4139149 - RNA, 73 nt, Human
cggggcccagcacuggcugggauccugucccugggcuugcuuggggccacccugauccccgccguggguccug

SEQ ID NO: 4139150 - RNA, 65 nt, Human
cggggcgagcgggcuguggcugggugcuggugggcagacaccaucagagcacaguccgugcccug

SEQ ID NO: 4139151 - RNA, 73 nt, Human
cggggcucaagcuggaguacaucuuuggcggcacuuggcaaccccagccccaggagaucugcgcagugccccg

SEQ ID NO: 4139152 - RNA, 103 nt, Human
cggggcugcggccauggcagccacccuccagcucccgggggcuggggaagacgcugggguccccguggaggcuggagcggcguucagguccugcggucacucg

SEQ ID NO: 4139153 - RNA, 104 nt, Human
cggggcugcuaauaugauugugcugccuggaaaugcaaaagccaugagucgguuaaacaucaaggugaaguuauuuccagcggaucgauugcagcaucuccccg

SEQ ID NO: 4139154 - RNA, 129 nt, Human
cgggggagcuuagugagcagcggcagggcccugcagcccgucacacgcuagcauccaccggguugaguggcugcgcacgaccgcggcgggcgggcgggcgcgcugccggaacgcucuaggccuccugcg

SEQ ID NO: 4139155 - RNA, 74 nt, Human
cgggggcagggcugaugcugcuggccagacauaccggcccccacccugccccagcagcuguggcuuugccucug

SEQ ID NO: 4139156 - RNA, 72 nt, Human
cgggggcggcgucggacuggagccgagcggcagcgcgagcugcccagggcgcugucgugagcucgcccgccg

SEQ ID NO: 4139157 - RNA, 104 nt, Human
cggggugggaggcgguguugaaagacccuuuucagacucagguacccagacuccagggauuuacagaucuaagggucacauucauugcacagacauacaccccg

SEQ ID NO: 4139158 - RNA, 60 nt, Human
cgggguuuggagaaaggggaagacgggauaggaaccaugcauucucugugcuagacucug

SEQ ID NO: 4139159 - RNA, 67 nt, Human
cggguaaaggucgcccucaaggugacccgccuacuuugcgggaugccugggaguugcgaucugcccg

SEQ ID NO: 4139160 - RNA, 90 nt, Human
cgggucagggcugagaacaggcccagccucuguccagggugaaucugggcccagcgggguacugggacaucuguuuuccauccugauucg

SEQ ID NO: 4139161 - RNA, 64 nt, Human
cgggugcagggucuccagcagcugagcucccggagugucaaguugccggaggcuucugugccug

SEQ ID NO: 4139162 - RNA, 71 nt, Human
cgggugcuggaggagaagguugcucauaaguagauugcauaccuauaagccccaaguccuuucagcaccug

SEQ ID NO: 4139163 - RNA, 80 nt, Human
cggguuugcgucuguuacggucugcugguggguugcuuccuccucugccuguauuucuuggacaguugcucuaaagcucg

SEQ ID NO: 4139164 - RNA, 59 nt, Human
cgguagaggcaguauacaauccgagcuauuuggcucuccauccugugcucuucacacug

SEQ ID NO: 4139165 - RNA, 98 nt, Human
cgguagcauucaaccagcccauuagccagucuucugauuacaaaguaguuggagccuguuuuguuuagaaagagauuggugcuuuucagaaugcacug

SEQ ID NO: 4139166 - RNA, 89 nt, Human
cgguagccucuuggagguuucuaugcuguuuaucuuuuuucaagcaaagggaaguaaaaagcaauaggagaacuuucuuuaggccacug

SEQ ID NO: 4139167 - RNA, 93 nt, Human
cgguauguaauaagauuuaaguuguuugccacagggcauuugaaaaaugcaguugggcaggaacagaugcuugaagaguuauuaauuaugcug

SEQ ID NO: 4139168 - RNA, 75 nt, Human
cggugacgacugccaaagauugccuucccaugccauacaaaacagguaaaggucuuuauuggucagccacuacug

SEQ ID NO: 4139169 - RNA, 79 nt, Human
cggugagugggccagugggaacugggucuccggaccaagaagccgugagccugcccuguucacaguggauaacuuucug

SEQ ID NO: 4139170 - RNA, 81 nt, Human
cggugcaguacgcagucuaucaacagcaauaaguguggaugagaaaacuuguguggagagaagaggcagugugcuguguug

SEQ ID NO: 4139171 - RNA, 67 nt, Human
cggugguguaagaaccuucuagagcccucuagcucagcgugggguuucaugguucucacaaugacug

SEQ ID NO: 4139172 - RNA, 75 nt, Human
cgguguaguccaacuguucacuagugaggguugauuagaaauaaucacccuucaugagagaauaguggugaccug

SEQ ID NO: 4139173 - RNA, 58 nt, Human
cgguguuacugggaggacggagguugcgacagcagccgagcccacccaguugcagccg

SEQ ID NO: 4139174 - RNA, 61 nt, Human
cgguuccuccuguuagugccauauuccagcaaaugcaauaggcagcuuagcaggggcucug

SEQ ID NO: 4139175 - RNA, 68 nt, Human
cgguuuccagcuugggccuggggauuggagauguccccacugagaguagggcacaagugaggaaauug

SEQ ID NO: 4139176 - RNA, 81 nt, Human
cgguuuuaggcagaacauggacuuugagaaguuuuaaaaauucuauuauucccacccauguuucccucugucuuuaagcug

SEQ ID NO: 4139177 - RNA, 77 nt, Human
cgguuuucacacauguuuacagucuucagucucuaaauuuucauuuacacuaaggccuugguaggcagugugaacug

SEQ ID NO: 4139178 - RNA, 67 nt, Human
cgguuuuuaaaagauauuguuuuccucagccuuuggcuuucuaacaauguucuuuuagcuugaauug

SEQ ID NO: 4139179 - RNA, 62 nt, Human
cguagaggcaggauggggucauuagggcuuuuccagcccagugccucaggccagccugcacg

SEQ ID NO: 4139180 - RNA, 65 nt, Human
cguagaugaggguacugagguucaguuggugauagggaaagaaaccagcccuuuauccuccuaug

SEQ ID NO: 4139181 - RNA, 69 nt, Human
cguaggauacucagugcucauuauguugaagucagcucuuaagccaguaugagucacugaauccucacg

SEQ ID NO: 4139182 - RNA, 82 nt, Human
cguagggcgacgccgugucccggcacucuucuaugucaaagaaagaggcgccggguacguggcgcucgagguacuccuugcg

SEQ ID NO: 4139183 - RNA, 67 nt, Human
cgucaguuuacuguugccauggcaacacugggacguuacagucccuuuccauggcaaugaucugaug

SEQ ID NO: 4139184 - RNA, 57 nt, Human
cguccauuccuuaaugaaucaggccauuccauuccuggaggcuguuagggagggacg

SEQ ID NO: 4139185 - RNA, 119 nt, Human
cgucgggacgcggcccugggccgggagcgcaggggagucgggcugcagccgagcgagcgcgggccccugccugggucuccuccgcuuccccgcugguaccaggaagaguuugagcgacg

SEQ ID NO: 4139186 - RNA, 67 nt, Human
cgucguccgguacucguauugcgccucgauggccucggggccguagaccacguccgggcucucgacg

SEQ ID NO: 4139187 - RNA, 75 nt, Human
cgucugggaggugaggggcgccucugcccggcugccccuacugggaagugaggagccccucugcccggccagccg

SEQ ID NO: 4139188 - RNA, 89 nt, Human
cgucugugucccacaggagccugagucccacagcacagcagcuagagcauaggcuuuggggucaggcugaccagggcugaacacaggcg

SEQ ID NO: 4139189 - RNA, 64 nt, Human
cuagcuuugccuguuaaucacaaaaggacaaaccuuucaccugcuuguagauaugcgaagcugg

SEQ ID NO: 4139190 - RNA, 60 nt, Human
cuaggaagagaaggaauuccccuucaaaagugacugaaauggaauccuucuuguuuguag

SEQ ID NO: 4139191 - RNA, 129 nt, Human
cuaggaaggugcccaggaugcauguuuuaaggaagcacucacucuuggggcuuugcaaguacaaggcuagcaaugggagaugagugccuccuuaaaguuggcuucuugggccuuguuugccugaccuag

SEQ ID NO: 4139192 - RNA, 58 nt, Human
cuaggaggcccgugcaccagggcuuagcugucugcaagcuuccuugacuggccccuag

SEQ ID NO: 4139193 - RNA, 81 nt, Human
cuaggauucucugcuaucuaucaccugacuaaaaaugccugaacaucagcacaggugcaguuauguacagugaaaaccuag

SEQ ID NO: 4139194 - RNA, 68 nt, Human
cuaggccauauuuugagaacugcuaacagggaauguaaccuuaaaauagauuuuaagaaugugccugg

SEQ ID NO: 4139195 - RNA, 58 nt, Human
cuaggccaucagcauuuaacuugauguuccacugggaauugcagggcugucugccuag

SEQ ID NO: 4139196 - RNA, 66 nt, Human
cuaggcugcauuugaaccaaugucggccuucccuuaggaccagcagagacgguaagcagaacuuag

SEQ ID NO: 4139197 - RNA, 64 nt, Human
cuagggaagaauuugcuuccaagaucccuuauaugguucuuggccagaugcacuuccuccuugg

SEQ ID NO: 4139198 - RNA, 74 nt, Human
cuagggacuucaagacucaaggaacaacacagugcugaguucacuagguuuucuuucagucucauauauucuag

SEQ ID NO: 4139199 - RNA, 80 nt, Human
cuagggauugauuuucaauucauugacaauuuaacaaguucuugcuguugucuuagaauuggaagggacauuccaacugg

SEQ ID NO: 4139200 - RNA, 58 nt, Human
cuagggcagggaguguuugcgccgccagccaucggcagcugggacucgauguugcugg

SEQ ID NO: 4139201 - RNA, 98 nt, Human
cuagggcucaucuacugaaaguaaugucauauuuuagcguuggagcuaucgugaaguauaugcuaaaaacuugaucauuauaguaggguuggcuuugg

SEQ ID NO: 4139202 - RNA, 66 nt, Human
cuaggguaugaauuugguguacagguugaacagucuguguauaaaauugccaaauccaugcccagg

SEQ ID NO: 4139203 - RNA, 78 nt, Human
cuagguccccaaaggaaauacuaaucuggaaucauuuaaaauuaaauucaagguuugagguuuucuuuuacuaccuag

SEQ ID NO: 4139204 - RNA, 57 nt, Human
cuaggucccugggggcuaaugugggucuuggagccacagggccagccugggaccugg

SEQ ID NO: 4139205 - RNA, 76 nt, Human
cuagguccucccuuuggcugucacuuguccaucugcagcaggcgaggacuguggccuuggaccaugggagaccugg

SEQ ID NO: 4139206 - RNA, 88 nt, Human
cuaggugaauauauuggugaaaauaguucagauaaacauacaaccauguauguaaaaguauuuaucaucaaugcauuauuuguaguag

SEQ ID NO: 4139207 - RNA, 56 nt, Human
cuagguggugggaagcguauuguguuugaacuuagcaaucugaaucccaguccuag

SEQ ID NO: 4139208 - RNA, 83 nt, Human
cuaguacuuugaguggcaauugacaacaaaggaguguaagaucagaaguuuccuuccaaaguuaaaugucacccugaagcuag

SEQ ID NO: 4139209 - RNA, 55 nt, Human
cuaguagguuaguaaugguggagcuccagggcucuauacauacugcagccucugg

SEQ ID NO: 4139210 - RNA, 83 nt, Human
cuaguagguuggugcaaauguaauugugauuuuugccauugaaaguaauaacaaaaacaauuauuuuuguaccaaccuaauag

SEQ ID NO: 4139211 - RNA, 58 nt, Human
cuagucagagucuauugcugugguuacacagaaaugaccaaguggugggcuguggugg

SEQ ID NO: 4139212 - RNA, 56 nt, Human
cuagugaccacacgucuggaauugugcaaugggccaguacuugguugugguuauag

SEQ ID NO: 4139213 - RNA, 58 nt, Human
cuagugaccuuggaaaauuuuuuaccucagauaauuuaaaaucaccuuaggucacugg

SEQ ID NO: 4139214 - RNA, 70 nt, Human
cuagugagagguguggccaggacucaagcuggaucugucccugcauuggcugugcuauaccaccuccugg

SEQ ID NO: 4139215 - RNA, 97 nt, Human
cuagugccaauuuggggagccguggugaguucugucuaagauauguuuacaaaaagaaucuaaaagauaacacacaugagucuccccauuggccuag

SEQ ID NO: 4139216 - RNA, 58 nt, Human
cuagugcucuaggggcugaaggugggcucaagcccuaacuucagccccagugcucuag

SEQ ID NO: 4139217 - RNA, 130 nt, Human
cuaguggaauaacaugaagaaacaucaaugcuauggcauuugaaucugucuuuugaacacgaucagugcaguagaaguaucaggaagauucucagugugcucagaugugccuccaucucuauuugccuag

SEQ ID NO: 4139218 - RNA, 70 nt, Human
cuagugucaaaguuaugaaugauaagauuugcuucaauagguaaauucucuucuccuguaaugucacugg

SEQ ID NO: 4139219 - RNA, 61 nt, Human
cuacuuugugcugacauuugggucauaaugaaaaugugauaagacaguaggcacaaggcag

SEQ ID NO: 4139220 - RNA, 71 nt, Human
cuacuuuuccuggaaacaaggacuuugaacaugagccccguguucaauagagccuucuuucagguggaugg

SEQ ID NO: 4139221 - RNA, 86 nt, Human
cuagaaagaagcuuucugagaaacugcuuugugauguguguauucacuucacagaguuaaaaguuucuuuugaaucagcacuuugg

SEQ ID NO: 4139222 - RNA, 62 nt, Human
cuagaaagcagcuucccuggcuccuggugcaucgcaugaggaguggcagggcugcucccuag

SEQ ID NO: 4139223 - RNA, 55 nt, Human
cuagaagguaggcagggaucagugacaacgcugcugcuguaucaugccuucaugg

SEQ ID NO: 4139224 - RNA, 57 nt, Human
cuagaauucauaggaaguuuccuagggauagcucaauccuuuaggaaggugaacuag

SEQ ID NO: 4139225 - RNA, 66 nt, Human
cuagaauuggggcaaggacagguauggcagggauccagccuccagggccaguccuugucugucugg

SEQ ID NO: 4139226 - RNA, 80 nt, Human
cuagacuccuuauguaaguggagucauauagcacuuacuuccugugacuggcuuauuucacuuagcauaauaucuucaag

SEQ ID NO: 4139227 - RNA, 76 nt, Human
cuagacugaauuuuaaagguuugcaaaucauacaucuaagaauuagaaguaguaaaucauaaaauuugagcucugg

SEQ ID NO: 4139228 - RNA, 63 nt, Human
cuagacuugggaccuaggaauggaggguaucauugaucaucccccuaaagccccaggauuuag

SEQ ID NO: 4139229 - RNA, 77 nt, Human
cuagacuuucagugucgggcuacucucagcagcugagcccugggacaagggacggggguggucaucugaaggucugg

SEQ ID NO: 4139230 - RNA, 84 nt, Human
cuagagagagcuuagauccugcgacucacccagcgaggaaaaccagcugggaagaggaugaggcauaugagccccacucucuag

SEQ ID NO: 4139231 - RNA, 65 nt, Human
cuagagaugugggcaauggaauggagaaguagggccacaucaccacacaaugucccacaucauag

SEQ ID NO: 4139232 - RNA, 73 nt, Human
cuagaggaguggguuagugcuuauuuucacagauuguauaaauaacaggccugcuauugcuucuuucuucuag

SEQ ID NO: 4139233 - RNA, 81 nt, Human
cuagaggaugauauaauagaaagaaguuuuggauccaggcagacaguccuggacuugauauucucuuuccccauuuucuag

SEQ ID NO: 4139234 - RNA, 59 nt, Human
cuagagggcagcagcaacaacucuuuacaaagggcucugaagccugcaugccacuccgg

SEQ ID NO: 4139235 - RNA, 72 nt, Human
cuagaguacuguuauguuauuacccauguggcguuuugaccacaggauuauuagucugacagguugucuugg

SEQ ID NO: 4139236 - RNA, 68 nt, Human
cuagagugugagggauuaaaugagcagggauuuuguuuauuuuguucacuauaucccucagugucuag

SEQ ID NO: 4139237 - RNA, 102 nt, Human
cuagauauuuuacuguucauucccugucucuucaauccuguggcccuuauucagccucccagguaucaggguagaagaguauaagaaauacaaauuauuuag

SEQ ID NO: 4139238 - RNA, 62 nt, Human
cuagaugccaauuuuuauggaugucagcccaacgauauuccauaaaguauuuggcaaucugg

SEQ ID NO: 4139239 - RNA, 79 nt, Human
cuagccuauagaguugaguuuuagaagaagccuuucggauacugaaaacaaggcacugaacuuaaauucugcagacugg

SEQ ID NO: 4139240 - RNA, 77 nt, Human
ccugcagcaugccaugcagcccuccugaggcccuacagagcaggcagccaugggaggucugcaaggugcugugcagg

SEQ ID NO: 4139241 - RNA, 79 nt, Human
ccugcaggaguuuuguguuuucuguuuucucuuuaucuuuuuaggguaucuuuggaaagccaagcacagcuuguuuagg

SEQ ID NO: 4139242 - RNA, 79 nt, Human
ccugcaggccccugugucuucguggagggguuuggggugguggacccacagccuugagcgaggacaaggccuggcuagg

SEQ ID NO: 4139243 - RNA, 61 nt, Human
ccugcaggccuguggggagagaucucuuagggccagcugcccugagcccccagccugcagg

SEQ ID NO: 4139244 - RNA, 61 nt, Human
ccugcagucuuccuuccuuaggcuccccagggagggccugagagcacagaaagacaguagg

SEQ ID NO: 4139245 - RNA, 82 nt, Human
ccugcauggauuugauagcuccuuccuuccuguaaggcacuuaggcucuuaagggagguaaagcuauuuaaauaaugaaugg

SEQ ID NO: 4139246 - RNA, 91 nt, Human
ccugcaugggaguggcggggaggccgagggccacuccccagggaaagggcuccucagggcuuucggcacucugagggcuccauaaugcagg

SEQ ID NO: 4139247 - RNA, 72 nt, Human
ccugcauguauaugcauauagaugcacacacauauggaugagugugcuaacuaaauguauuagcuaaauagg

SEQ ID NO: 4139248 - RNA, 62 nt, Human
ccugccaacgucccaaaugagaaucugcauuuaauaauguaguucacaauugguacugaagg

SEQ ID NO: 4139249 - RNA, 80 nt, Human
ccugccacacccacucggcagccuauagucacauggcuacaaguagcugugggaauacugcgaguguaguuuuuggcagg

SEQ ID NO: 4139250 - RNA, 58 nt, Human
ccugccagcgcuuaucucucggcauggucugaugggccgaaugggagugggagucagg

SEQ ID NO: 4139251 - RNA, 56 nt, Human
ccugccagcuggguaccuucaucucuaaccuucugauaaagcugcccucaggcagg

SEQ ID NO: 4139252 - RNA, 76 nt, Human
ccugccaggggcuccuagacugucagaguguggagugguugcugcaucugcuggcaucucuagcccaccugucagg

SEQ ID NO: 4139253 - RNA, 72 nt, Human
ccugccaugugauuugaugcugucuuucagaaucacuaucaguggccccugaggagcgucagccaugguagg

SEQ ID NO: 4139254 - RNA, 111 nt, Human
ccugccccgucaccuggugcgcgucuucccgcagcccagcagggcccggagcggcggggacggugccucugucagcagggccugugggagggaggcugggggcuggguggg

SEQ ID NO: 4139255 - RNA, 55 nt, Human
ccugcccggcggggacccggacgacggcgacgugccccuggcccugcugcgcggg

SEQ ID NO: 4139256 - RNA, 83 nt, Human
ccugcccuccucacaggcugaaaggagcugcugacgucauuaaaucaauaacuuuguuuagcauuguguuuucugggggcagg

SEQ ID NO: 4139257 - RNA, 99 nt, Human
ccugcccuucucccucagggcaccccagggcaguaccgcccucuggcccagcugaugggccgggccaggcuccccuggcuucccaaguggaggaggagg

SEQ ID NO: 4139258 - RNA, 89 nt, Human
ccugccuaugcugggaagggagucucugcucucauucccuguuaaacacagagaagagagccgcgggacaucagccuccagaagguagg

SEQ ID NO: 4139259 - RNA, 103 nt, Human
ccugccuccagcuccccuggcagcccaaccuagagucucucgggguaaacucagaguccaggaggcucaggaggagcugccggaggcugugcggaggccuagg

SEQ ID NO: 4139260 - RNA, 81 nt, Human
ccugccugaugagauauacucugaacuccaggaggcucauccaggugagccccaggaggacaggggcaucucaauggaagg

SEQ ID NO: 4139261 - RNA, 60 nt, Human
ccugccugcucaccagugugccuuuauuaguucgguggagaaaccucgguaagcaggagg

SEQ ID NO: 4139262 - RNA, 69 nt, Human
ccugccuggcacuguagccacuacugccuugagccaaggccagaggaggccugcaggggcuggagcagg

SEQ ID NO: 4139263 - RNA, 77 nt, Human
ccugccugguccccaucggcccagcgcccacccagccuuggcuuuugcccgugggccguugggagcgccagcgcggg

SEQ ID NO: 4139264 - RNA, 57 nt, Human
ccugccugguguaagucuaagguugcaagaaaggugaggagucuggcaccagguagg

SEQ ID NO: 4139265 - RNA, 62 nt, Human
ccugccugucuuuauccccuguagauacccacugucuauccaagggccuggaguacagcagg

SEQ ID NO: 4139266 - RNA, 78 nt, Human
ccugccuuauaagaccccagggaccuggcaccugcaaccauagcaggaggcaggagccagcguuccucaggauucagg

SEQ ID NO: 4139267 - RNA, 85 nt, Human
ccugccuucucucuggauguaacuuuccuaguccauauccuggcccaugaggacauggaaaucagguucauccaagaggcucagg

SEQ ID NO: 4139268 - RNA, 61 nt, Human
ccugccuuuccugccccaucugcccagucugccuugcagaugagggcuggaggugagcagg

SEQ ID NO: 4139269 - RNA, 81 nt, Human
ccugcggccucacuucuucccugaagaccucaugugacaggaguacugcccuauaccaggagggaaggaaugucacucagg

SEQ ID NO: 4139270 - RNA, 74 nt, Human
ccugcucccagggaggcccaggcucugcuccgagggcagauggcgcaggggcuggguuggcccuaggaggaagg

SEQ ID NO: 4139271 - RNA, 64 nt, Human
ccugcucuccggcuuccguggccugcccuguaagugaggcaggaaaaucgagucuggaggcagg

SEQ ID NO: 4139272 - RNA, 78 nt, Human
ccugcucuggcuuucucagcauggcauucacuuuccuucccuugccuaugaaaucugugauuugaaauguuagacagg

SEQ ID NO: 4139273 - RNA, 67 nt, Human
ccugcucuuguauccaaaagugaucauggguugccugugucccgaucauuaacagugcagggguagg

SEQ ID NO: 4139274 - RNA, 57 nt, Human
ccugcugcuaugaaggugacaguccuccccacugcucacauauugcauagcugcagg

SEQ ID NO: 4139275 - RNA, 82 nt, Human
ccugcugcuguaagaauauguuugacauuuaguugguuccuaauuaaacaacccaauaucaaacauaucacacagaagcagg

SEQ ID NO: 4139276 - RNA, 72 nt, Human
ccugcuggccaggcccagcccuuagccaggugcuuuuucagggaccaaguagagcuggggccugaccacagg

SEQ ID NO: 4139277 - RNA, 66 nt, Human
ccugcuggccaguggagggcuguggaagagguuugcacaggccucgcuguccccgaggucaccagg

SEQ ID NO: 4139278 - RNA, 58 nt, Human
ccugcugguuuuuacaaagaugugggucucucuuuccccgagugucagagcuugcagg

SEQ ID NO: 4139279 - RNA, 110 nt, Human
ccugcugucagaccggcgcuuguguggagccaggggcuguagguaccccggcugaguagccucucagauguccaugguccuggcugcacgccagcgugggggcaggcagg

SEQ ID NO: 4139280 - RNA, 64 nt, Human
ccugcugucaguggggcaggcacaggcuuuuuccagucccaggcugcccccuacuggcagcagg

SEQ ID NO: 4139281 - RNA, 72 nt, Human
ccugcugugcacccaggaaggcugacuuauaugauuuguuucauuuaagcauucuugggcguuuagucaagg

SEQ ID NO: 4139282 - RNA, 72 nt, Human
ccugcuucuagcaccaagucccuugugacccuccccaggcacccucccaggcacugugcagucccaagcagg

SEQ ID NO: 4139283 - RNA, 57 nt, Human
ccugcuucucuaaaugaagggcucugggccuugccaggaaccuggggaaggaguagg

SEQ ID NO: 4139284 - RNA, 64 nt, Human
ccugcuuugcugguaccaucagcuuaaacuuagucugacuucugggugagccagcauugguagg

SEQ ID NO: 4139285 - RNA, 81 nt, Human
ccuggaacucaggguggcagacaaaaugacuguugacauugucacacugucaugacguuugucaccccaccugucuccagg

SEQ ID NO: 4139286 - RNA, 63 nt, Human
ccuggaauucccagauguucugcuggucugugggacaguuggcgggacauguggaaagcuggg

SEQ ID NO: 4139287 - RNA, 59 nt, Human
ccuggagaccagaggauacuucaucuucaguccaagaguaguuccuuuggucuucaagg

SEQ ID NO: 4139288 - RNA, 60 nt, Human
ccuggagcaugagggaaggcagcagauggcagacccgucagucaccccucugcucucugg

SEQ ID NO: 4139289 - RNA, 61 nt, Human
ccuggagcccaaggcagugagaggcaggagguaaacugagucccagcucugaggcucgagg

SEQ ID NO: 4139290 - RNA, 60 nt, Human
ccuggagcgcgggucaagcugggcacguggccgggcaccagcgggcgcucgcgcgccagg

SEQ ID NO: 4139291 - RNA, 65 nt, Human
ccuggagcuggcuuccuuccacuccaugcugaaaguaggccaguggagcagaagucugcuggggg

SEQ ID NO: 4139292 - RNA, 80 nt, Human
ccuggaggaggagguuggagggcuggccugcagggucacugcaccucugcccagagccucuuaccuccagauccuucagg

SEQ ID NO: 4139293 - RNA, 86 nt, Human
ccuggagggauuaguaguuuuuggacuguucuaaaguuagugauguaggcuaggauggucacagagauggacaugauguugccagg

SEQ ID NO: 4139294 - RNA, 61 nt, Human
ccuggagugggagcgugcugggcuuucgggggcugguuagguucagcuuucuuacucuggg

SEQ ID NO: 4139295 - RNA, 55 nt, Human
gagaaggaugaggaaaugguaugagggaaacuguggaaucacgcuuuaccuucuc

SEQ ID NO: 4139296 - RNA, 84 nt, Human
gagaaggcaggauggcaggaguggagaccauggggauuugagccacuuccucacguaacuuacuugugccuucacgaccuucuc

SEQ ID NO: 4139297 - RNA, 67 nt, Human
gagaagggacuggaaagaucaccuuaccuggacugacauucaguggagggaaauccagucacuuuuc

SEQ ID NO: 4139298 - RNA, 67 nt, Human
gagaagggcauggugacaucaugugaaugccuggacugggccuuauuuaaaacuagugccucuucuu

SEQ ID NO: 4139299 - RNA, 68 nt, Human
gagaagggcuggucuagaaagggagaggggaaauuccgucucucaucccugucugccacucugaaauc

SEQ ID NO: 4139300 - RNA, 63 nt, Human
gagaagggcuuagauuuagaacaugcugauaaacaggccaguucuaaacauaaagcuaauuuu

SEQ ID NO: 4139301 - RNA, 87 nt, Human
gagaagguaccaucugcucgggcucaggaggaaacaggagccuugauggaguggggcccuauccugcaggccugggcugggcagcuc

SEQ ID NO: 4139302 - RNA, 59 nt, Human
gagaagguggaccugaaggagcgaguggagaaacuggagcuucaauucauccaccucuc

SEQ ID NO: 4139303 - RNA, 72 nt, Human
gagaagguuuaaugagacagcuugucagugaccagcaccggguagguccccagcaguggcugcuuccuucuc

SEQ ID NO: 4139304 - RNA, 63 nt, Human
gagaagucuggaauggauccuccccucacagcccucagaaggaaccaagccagccagccucuc

SEQ ID NO: 4139305 - RNA, 56 nt, Human
gagaaguggaaacugcccgagcuucaaaaaguuacuacaguccuuuccgcuuucuc

SEQ ID NO: 4139306 - RNA, 74 nt, Human
gagaagugguagcuccaggcugucugaacccagaacacugaaguucagaauauggcuaggagugcuaugcacuc

SEQ ID NO: 4139307 - RNA, 58 nt, Human
gagaaguuguguggauuuaaaggugccccuucuccuaaaggccacacugcucuuucuc

SEQ ID NO: 4139308 - RNA, 73 nt, Human
gagaauacagaggaaacauuuaauacaagauauucugauuuuuuuccauuguauuugcuuucuucugguuuuc

SEQ ID NO: 4139309 - RNA, 77 nt, Human
gagaauacuaggcuucagaaagguuuucuaaauuuaauugaaaaaaacccucuauuuugauaccugguaauaugcuc

SEQ ID NO: 4139310 - RNA, 80 nt, Human
gagaauaguucccuuagcgaccuuucccuucaaauacuuugcagccagguagagaaguuuggagugaagguuuuguucuu

SEQ ID NO: 4139311 - RNA, 76 nt, Human
gagaauauacacuuucuggagcucuucucuccugaacaaagguaagcagcagauccaaaaaaugugaauguuucuc

SEQ ID NO: 4139312 - RNA, 65 nt, Human
gagaauaucuuggcagucucugucaaucacauuuggaccaucacaggaacugccaagauauucuc

SEQ ID NO: 4139313 - RNA, 64 nt, Human
gagaaucaaggugaagcccacagguccauacaucugauagggcugaauuuugagaggguuucuc

SEQ ID NO: 4139314 - RNA, 85 nt, Human
gagaaucacuugaaccuggaggcagagguugcagugagccgagauugugccacugcacuccagccugggugacagagugagucuc

SEQ ID NO: 4139315 - RNA, 77 nt, Human
gagaucugggaauguuuuuagcuuucuaaugucuucaacuugaauggaguuagaauggauguugagagccaguucuc

SEQ ID NO: 4139316 - RNA, 56 nt, Human
gagaucuguguuugcugaagcuacaauuacauggcuucagagugacucagcaucuu

SEQ ID NO: 4139317 - RNA, 80 nt, Human
gagaucuuugagaauuacuggauaaaugcaggauacaauguaugacagcaaauauccaugagcucauucaaaagauacuu

SEQ ID NO: 4139318 - RNA, 68 nt, Human
gagaugaauauguacacaucugucaacgucuaccuaaguguagaccugaaauguguccauguuauuuc

SEQ ID NO: 4139319 - RNA, 67 nt, Human
gagaugaauguaaacaaaggcagauguccauaaucauaacgucaagauguuuucguuaguucaucuc

SEQ ID NO: 4139320 - RNA, 57 nt, Human
gagaugagaaauggacaggaguggagccugaguccaaguacugugauuucuuaucuc

SEQ ID NO: 4139321 - RNA, 60 nt, Human
gagaugagaguccaacuggggcuuauuuuuaaaaaguccugccuguucuaacuccauuuc

SEQ ID NO: 4139322 - RNA, 65 nt, Human
gagaugaucucugaggacagucaguggguggcuucuauucacaguguuggaaucagagcuguuuu

SEQ ID NO: 4139323 - RNA, 63 nt, Human
gagaugcacagugacccugccagucccuuugguaaugccaaaaugcugacguuacuugcucuu

SEQ ID NO: 4139324 - RNA, 56 nt, Human
gagaugcaggccuggaaugguggaucuggggccagugucagccaggcucugcacuc

SEQ ID NO: 4139325 - RNA, 70 nt, Human
gagaugcauguguguguauguggcauuuuuugaguccuugcuauguucaacaguuugcacacauuaucuc

SEQ ID NO: 4139326 - RNA, 91 nt, Human
gagauggaaucucguucugucgcccaagcuggagugcaguggcacgaucucggcucacugcaagcuccgccucuggguucaugccauucuc

SEQ ID NO: 4139327 - RNA, 65 nt, Human
gagauggaguuccgcuauguuggucaggcuggucuccaaauccuggccucaagugguccacccuc

SEQ ID NO: 4139328 - RNA, 96 nt, Human
gagaugggauagcuugaacccgggaggcagaagcugcagugagccgagauugugccacugcacucuagccuaggugacagagcaaggcccugucuc

SEQ ID NO: 4139329 - RNA, 95 nt, Human
gagauggggccaggaagggguuaaagcaggaagcaucuugcagggcuguuaggaaaaugauauucugcuguuugacgucauuuuaauuccauuuc

SEQ ID NO: 4139330 - RNA, 89 nt, Human
gagauguaagaggaaguuauuguugggggggcuucaggaaaucuuuuuaaaagggucugacuccucuggcaagcucuuccuuucuuuuc

SEQ ID NO: 4139331 - RNA, 61 nt, Human
gagauguagggagaagagaggcaccuugggaagguaccuuaccuccuuuacaaguuuucuc

SEQ ID NO: 4139332 - RNA, 78 nt, Human
gagauguuagagcuucuuuggcaacccugacauccccacagaugaugacccaggcccagggagaagaaggacguucuc

SEQ ID NO: 4139333 - RNA, 72 nt, Human
gagauguucauguggcugcuggcagccucaaacucauauccucuugaaacuucagcagaaacauaaauucuc

SEQ ID NO: 4139334 - RNA, 67 nt, Human
gagauguuguggguaguuuuggugagcuaauaaugaauccguucucuauaacacacuucagcuucuc

SEQ ID NO: 4139335 - RNA, 55 nt, Human
gagauguuuugcugagaaugggagcuuuggccuuaaacuucagugcagaacacuc

SEQ ID NO: 4139336 - RNA, 75 nt, Human
gagauuaaaugugcuaaguguugcuuucagaguggacuuuguguucacaggugagcauuaggccgugcaaaucuc

SEQ ID NO: 4139337 - RNA, 69 nt, Human
gagauuacaacaugggacgcauauuuaagaagagauaaaauaugacacugcuuguccuuauguaaucuc

SEQ ID NO: 4139338 - RNA, 75 nt, Human
gagauuacaguuguccuaucuaauccaguccuguuuuguucccucgacccagauugagaaggauacauuguucuc

SEQ ID NO: 4139339 - RNA, 64 nt, Human
gagauuaguguguguggguuuguaugugagagagaaacacacacaugcacccaguuacacucuc

SEQ ID NO: 4139340 - RNA, 69 nt, Human
gagauucucugcaagauggucuuagagguuauuaaagaauaucucagaaaacccuugcuagugaguuuu

SEQ ID NO: 4139341 - RNA, 63 nt, Human
gagauugagaguguauagcugaucucacuccuuugagcugaugauagaaacucuuguagucuc

SEQ ID NO: 4139342 - RNA, 130 nt, Human
gagauuggaaaaguaaaucugauaaauaggggcaauaacucaaacauguaaaaauuaagguaagagcugcucuucuccccugcaguuuuauauaugcuugaucccguucuuuuuuccuuuccaaauuuuc

SEQ ID NO: 4139343 - RNA, 77 nt, Human
gagauuuaaguggaaguguuguauucgauuucugggaaggcuccuuaaaauggauagugcgucuucucuucuguuuc

SEQ ID NO: 4139344 - RNA, 78 nt, Human
gagauuuacaauguguaauuauauaaagaucuacagcuaacacuguguggaacugccaauugucacuuuguggauuuu

SEQ ID NO: 4139345 - RNA, 67 nt, Human
gagauuuaguagugacagauucuggguucagaauccugauuuugucacuuacuaacuaagugaucuu

SEQ ID NO: 4139346 - RNA, 105 nt, Human
gagauuuauuuucuuacaguucuggaagcuagaaguccuagauaaaggugcugacaaauuuaguucuuggugagggcuuccuggcuggcagacagacaucaucuc

SEQ ID NO: 4139347 - RNA, 85 nt, Human
gagauuucauauauacauuuuucaauccuuauauaaugccuuccauauaauugguggcuuauaaaggaugauggcuuauggucuu

SEQ ID NO: 4139348 - RNA, 60 nt, Human
gagauuuggggggagguaggggcagaauaugguuuggcucugcgucuucacccaaaucuc

SEQ ID NO: 4139349 - RNA, 88 nt, Human
gagauuuguuaaauugaucguuugggaugaaaucaagcaaagagaauacuaggcaaacuuuuaagauuucuuccuaaauacagaucuc

SEQ ID NO: 4139350 - RNA, 64 nt, Human
gagauuuugugggauuuaaauugaggucaaccuguuguuuugguuucuuaaguuacaaaaucuu

SEQ ID NO: 4139351 - RNA, 81 nt, Human
gagauuuuguuggcuuuacaucaaauugaguauaguacuucaaacugaguauuugaugaagguaaagucuuaucaaguuuc

SEQ ID NO: 4139352 - RNA, 69 nt, Human
gagcaaaaguuauuacagaaguugcaaacauaucacugaagaaacugcuuguagugacuugccuugcuc

SEQ ID NO: 4139353 - RNA, 62 nt, Human
gagcaaaggcagcaacuaauggaucucagaugccugggaccauuuauaugacugcuguuguc

SEQ ID NO: 4139354 - RNA, 110 nt, Human
gagcaaaucagcucagcugcagggcccccagucuauggaaaucuagguggcugcuagagaaagccagcuguaggcaggggguuuagcagagacuguggcuucuauugcuc

SEQ ID NO: 4139355 - RNA, 92 nt, Human
gagcaacuacuguaagucagaccuuguugauagcuuauuucaaauagagcugacuuuugaacaauauggguuugagcuguguggacaugcuu

SEQ ID NO: 4139356 - RNA, 62 nt, Human
gagcaacuaggcuugcaggguggacauguuaugucuaaauaacuaucuauugagccuugcuc

SEQ ID NO: 4139357 - RNA, 57 nt, Human
gagcaacugcccacagugaaugguuggcuggcaggcagcaccaccugggggcagcuc

SEQ ID NO: 4139358 - RNA, 95 nt, Human
gagcaacuugaccaagauggcccaguuaguuccagcugcagccaagacaauuuggcagcuguuggaccuugacccuccuugccuucuucaagcuc

SEQ ID NO: 4139359 - RNA, 56 nt, Human
gagcaagauucuaucucaggcaaaauccaguguuggccuggcagguggaagggcuc

SEQ ID NO: 4139360 - RNA, 84 nt, Human
gagcaagcaggagagccagcaggcuucccucggcuagccccccgccuggguggccuggaagcccagcugucuccuguccaucuc

SEQ ID NO: 4139361 - RNA, 75 nt, Human
gagcaagggaggguggugagcaguagcacuuuguacauuugaaauggucauuagcauugucgacauuuuccccuc

SEQ ID NO: 4139362 - RNA, 69 nt, Human
gagcaaugaauaccguuucacucaguugaaggagguaacauuuaaauaugugagguauguucagugcuu

SEQ ID NO: 4139363 - RNA, 68 nt, Human
gagcacagaggauuuuuagggcagugaaacuacuuuguaggauacuguaaugguggauccaugucauc

SEQ ID NO: 4139364 - RNA, 75 nt, Human
gagcacagauccuggagccacacuuccuggauuugaaucccaaaucugauacuugcugguuauaugaucuugcuc

SEQ ID NO: 4139365 - RNA, 56 nt, Human
gagcacagcgcaguuuguaauuuugauucuguuucaugcugaaucuuguugugcuc

SEQ ID NO: 4139366 - RNA, 115 nt, Human
gagcacaggaaaggaaauagcuguacugcuggguuuguucaaaaauuauaagauauugaaauuaguaucuccuguuuugacaaauucuaaaagacagcaaucauuucucuugcuc

SEQ ID NO: 4139367 - RNA, 60 nt, Human
gagcacauacuuguguguacauauguaugcaugcacgcauguguguuugagugugugguc

SEQ ID NO: 4139368 - RNA, 67 nt, Human
gagcacccugcugguuucuccugugauacaugacaccuucaacaaaugggccagccaggcguugcuc

SEQ ID NO: 4139369 - RNA, 55 nt, Human
gagcaccgccuccacgaugcccgccgugaagcuggcgcaguugagcgugcuguuc

SEQ ID NO: 4139370 - RNA, 76 nt, Human
gagcacuauguaugguguuuuacaaaaauguaguuuucauuacaaucuuauauagaucauaaauacuauggugcuu

SEQ ID NO: 4139371 - RNA, 56 nt, Human
gagcacucacuuuuugccugggggagcacucacuuggcaaagccuaugaaguccuc

SEQ ID NO: 4139372 - RNA, 60 nt, Human
gagcacucuggcauguaaccuuuaagccugucagguuuucaaguucuugccagauuguuc

SEQ ID NO: 4139373 - RNA, 58 nt, Human
gagcacuguacucauuugcacuguguugugagaaguaagugaaaugaaguguaugcuc

SEQ ID NO: 4139374 - RNA, 65 nt, Human
gagcacuugaaguuugggggacucugguacaaaaucccaauccauuuaccuuugcuugaaggcuu

SEQ ID NO: 4139375 - RNA, 67 nt, Human
gagcagaugccggccagggcaccaugcugaugugugucagcagcugcgugcccaggccggagagcuc

SEQ ID NO: 4139376 - RNA, 60 nt, Human
gagcagauuuucccuuuagugaguuuuaguuaaacucauugaaacuuaagaucuaggcuc

SEQ ID NO: 4139377 - RNA, 63 nt, Human
gagcagcacuugaggcaugucaccagggcuagggcaccaauguggugguuggaguagcugcuu

SEQ ID NO: 4139378 - RNA, 65 nt, Human
gagcagcaggcugggaugagucuggguggagaccucuagaaggcacagaauccagucugcugcuc

SEQ ID NO: 4139379 - RNA, 57 nt, Human
gagcagccagaaugggacucugaagugaguuguaaacagaggcccaugagggugcuc

SEQ ID NO: 4139380 - RNA, 80 nt, Human
gagcaggacuuucucccacccacccgucuuccccuaugcagguguccagacaggcuguggguagggggcgaugccugcuc

SEQ ID NO: 4139381 - RNA, 78 nt, Human
gagcaggagaggaaaggggccaagagaugagacugaggucccuuccugggcucugucuggcugcuccuuucaaugcuc

SEQ ID NO: 4139382 - RNA, 57 nt, Human
gagcaggauggcacuucugugaagugggcugaugcucacacagugcugucacugcuu

SEQ ID NO: 4139383 - RNA, 63 nt, Human
gagcaggcaggaaggcagcacugacauaaaaucaaaggcaccagagcugagcaucuccugcuc

SEQ ID NO: 4139384 - RNA, 66 nt, Human
gagcagggaggcggugugcuggcgcugcggcugagccucgccgggaacugugcgcuucucauguuu

SEQ ID NO: 4139385 - RNA, 76 nt, Human
gagcagggagggcaagaguuggaaacgguaaaggguaccccucuccccugcccccaaaggcucugcuuuccuucuc

SEQ ID NO: 4139386 - RNA, 85 nt, Human
gagaaucagcauagaagguuuugguaucaacucucuuguauauuuaaauaauuugauuucagaauuuuggugcuuuuuuauucuu

SEQ ID NO: 4139387 - RNA, 89 nt, Human
gagaaugaacgacuggaugcuggaagugcugaucuugucacucuagguuuucccauggcgucaggaccacuaguaucccauucauuuuc

SEQ ID NO: 4139388 - RNA, 78 nt, Human
gagaaugccagcaggcuacuccuguguucguuaaccacuacuggacagggaauauuugaguagaaugcuuacagccuc

SEQ ID NO: 4139389 - RNA, 66 nt, Human
gagaauguggagccugugguugccaauccaaguucaacagcuucaaagcccaguuuccaaauuuuc

SEQ ID NO: 4139390 - RNA, 63 nt, Human
gagaauuagaaaccaagaggcaggcugggcagacagcaagacuuuuuggcuuuuugacugcuu

SEQ ID NO: 4139391 - RNA, 103 nt, Human
gagaauuagaccguguaguacaugaagcacuuggcaaaacagcuggcacaaaggagccacucacaugcugauuguuaucauuacucacucagucuuucuucuc

SEQ ID NO: 4139392 - RNA, 77 nt, Human
gagaauuagggguuucagggugaaauuguaugccucauucacaggcauagaaugugcugugacaaccaacuaagcuc

SEQ ID NO: 4139393 - RNA, 58 nt, Human
gagaauucuuuuuuaaggaauagaacagacuuuguucaaauccaaagaaagaaaucuu

SEQ ID NO: 4139394 - RNA, 63 nt, Human
gagaauugaaugcuuaauuugaugaaaucugaggaaaagcauuagaaggcauuccucauucuu

SEQ ID NO: 4139395 - RNA, 86 nt, Human
gagaauugcuugaaccugagagguggagguugcagugagccaagaucuugccacugcacuucagccugggcgacagagcaagacuc

SEQ ID NO: 4139396 - RNA, 72 nt, Human
gagaauuuuaacacauagaggaaguuugcuauuggcucacauguagaaaucuuguuacuauguguuuuucuu

SEQ ID NO: 4139397 - RNA, 56 nt, Human
gagacaaaaguuggagugcaagucucaccaaagaggagaaacucagcuuuugauuc

SEQ ID NO: 4139398 - RNA, 82 nt, Human
gagacaacagagcacugcccugugccgcuguugagcacguuauauagacagaagugggggguaguaguucugguaauaaauc

SEQ ID NO: 4139399 - RNA, 64 nt, Human
gagacaagagaccaagggaauagucucauuuccugaugguuuucuauuuccugguuuccaucuc

SEQ ID NO: 4139400 - RNA, 68 nt, Human
gagacaaugacaccgcuucagugugaacucucaugaauugagucuagauccccagugcuguccgucuc

SEQ ID NO: 4139401 - RNA, 106 nt, Human
gagacaaugaggaauucaggagcugcuuuagguugagcucagcuccugucucacuuuagguguugagccgaaggcacugaacaccuccugcaccuucccagaucuu

SEQ ID NO: 4139402 - RNA, 82 nt, Human
gagacaauuucuccuggcuuugcgucuuugccacaguuugaguucuggaacaagacagcauagagcucacagauauugucuc

SEQ ID NO: 4139403 - RNA, 67 nt, Human
gagacacaagacgcaacucugucuucauugcucaacaaaugcuaacagggugugugcuucuguucuc

SEQ ID NO: 4139404 - RNA, 55 nt, Human
gagacacagagaggcugugugaucagccaaaaaucacacagccucuccgugucuc

SEQ ID NO: 4139405 - RNA, 91 nt, Human
gagacacaguuucacucugucgcucaggcuugaguguaguggugcgaucucggccccuccacuuccuggguucaagcgauucucgugucuc

SEQ ID NO: 4139406 - RNA, 72 nt, Human
gagacaccaucagagaaguuucacuggcaucuuucuagaggccucugggucucucuguuuggccaaaguuuc

SEQ ID NO: 4139407 - RNA, 104 nt, Human
gagacaccugauaauauguuaaccuuuugucauugggguuauuuguuaaaaucuaaagagcuaagaaacaugauuaauggcagaggguuugcauuccuugucuc

SEQ ID NO: 4139408 - RNA, 123 nt, Human
gagacacuggcguuuugugaugccaccauagaaacagcagcuuucaggaucaucuuggcaaggaagagacaggggauagaacugacagcugccuguaaaugccaggcuaggaaugugugucuc

SEQ ID NO: 4139409 - RNA, 80 nt, Human
gagacagaacauuccagcaggcagacaggagaugaggaugcuucaucacuucagcacugauggacugaaugcuucuucuc

SEQ ID NO: 4139410 - RNA, 95 nt, Human
gagacagaacugcuugaacccaggaggcugagguugcagugagccaggaucuuggccacugcucuccagccugggugacagagugagccugucuc

SEQ ID NO: 4139411 - RNA, 60 nt, Human
gagacagagaucuugcugaguccugguccucgacuuggucuuccuugucauuucuguuuc

SEQ ID NO: 4139412 - RNA, 58 nt, Human
gagacagcagagcagacuaauggaggaaauagagcuuguccauguggcucuguuucuc

SEQ ID NO: 4139413 - RNA, 82 nt, Human
gagacagcucuuuuuguaaagggucauuucuguccggcagcugagcucugggacagaaaugauguuuggcaauaccagccuc

SEQ ID NO: 4139414 - RNA, 99 nt, Human
gagacaggagaauugcuugaaaccuggaggcagagguugcagugagccgagauagggccacugcacuccagccuggguaacagagcaagacucugucuc

SEQ ID NO: 4139415 - RNA, 63 nt, Human
gagacaggccaggugguacuuaacugacuaaguccaguucaaguucaagucacagccugucuu

SEQ ID NO: 4139416 - RNA, 62 nt, Human
gagacaggguuucaccauguuggccaccauguuggccaggcuggucuugaacuccugaccuc

SEQ ID NO: 4139417 - RNA, 67 nt, Human
gagacaguggagccacguugggagccuguauuuuuugcugcuucccuacuucagugcucccugccuc

SEQ ID NO: 4139418 - RNA, 61 nt, Human
gagacaguguccauccaggggcgcuggcauugugccuccuuuucucuccugggccugucuc

SEQ ID NO: 4139419 - RNA, 56 nt, Human
gagacauuagaucagggaccauaaugaagugaaguuaugauucaugaugaugucuc

SEQ ID NO: 4139420 - RNA, 58 nt, Human
gagaccaaugagcaagugaaagcagauugguuugaaucuugcauuugcugguuggcuc

SEQ ID NO: 4139421 - RNA, 106 nt, Human
gagaccacccgugggcacguggcuuuugggauuggagaccugcugccacagaucucugaagagucuggaccugcugggucuccccaagugacucucugggggucuc

SEQ ID NO: 4139422 - RNA, 87 nt, Human
gagaccaccucuuucuucccucugcuccccagcaaacuccucauccuuccauggggcagaagaccaugguggaaagagugugugcuc

SEQ ID NO: 4139423 - RNA, 82 nt, Human
gagaccagaugcugucgaaaccaaacaucuuuuccuuugcucuaugggaacauuuuaggguuuguuuugcacagcugguuuc

SEQ ID NO: 4139424 - RNA, 129 nt, Human
gagaccagcccaguucuuggcuccccgcccaaugcucuguccaagacaccauaguggaaaccugggucugcugaauaggggcccugugguugcuagggcacaggaugaagccaaaguuggaaaacucuu

SEQ ID NO: 4139425 - RNA, 62 nt, Human
gagaccagcuucuugaaauagcuugaacaaccucucagcucucagguacaaagcugugucuc

SEQ ID NO: 4139426 - RNA, 60 nt, Human
gagacccacagcugggacacgaaggaugcuuucgauagaauauacuagcuguguggucuu

SEQ ID NO: 4139427 - RNA, 85 nt, Human
gagaccuagaaaguuaaugcuugucuagaucuucuuuucccaaaaagagauagaauucagugacugcauuuuaauuuuagggcuc

SEQ ID NO: 4139428 - RNA, 87 nt, Human
gagaccuauuaaagcuggaaucuucuuugguuacuaugcucauuaaacuaaagauacauauuuguucuagugcaauugaugcuucuc

SEQ ID NO: 4139429 - RNA, 73 nt, Human
gagaccucucuauuaagacucauuugcgauuugguaccauauugcaaaugagucuuaauauaaaagauguguc

SEQ ID NO: 4139430 - RNA, 55 nt, Human
gagaccugcucccucuuuguuaaaaggagacauuagcaaaggcaggagagguuuc

SEQ ID NO: 4139431 - RNA, 64 nt, Human
gagaccuggaugugagggaaguaaugccccucuagggccugucucccggguuuguccaggccuc

SEQ ID NO: 4139432 - RNA, 81 nt, Human
gagacgagagcuucacuuuguacuuugucaggacugccauuggccugugggagaugggguggagauaguaacacucgucuu

SEQ ID NO: 4139433 - RNA, 106 nt, Human
gagacggagugucgcuuuaucacccaggcuggagugcaguggugcaaucuuggcucaccguucauggcaaccuccgccucccggguucaagcgauucuccugccuc

SEQ ID NO: 4139434 - RNA, 102 nt, Human
gagacgggguuucacuguguuagccaggauggucucgaucuccaggauggucucgaucuccaggauggucucgaucuccugacgucgugauccacccgccuc

SEQ ID NO: 4139435 - RNA, 67 nt, Human
gagacgguggaucaccugaggucaggaguucgagaccagacuggccaacauggugaaaccccgucuc

SEQ ID NO: 4139436 - RNA, 89 nt, Human
gagacgugggauuuauccccucauaggucagacacgcauaauucuugugugugucugacaccugugaguuauuuaucauccccgugcuc

SEQ ID NO: 4139437 - RNA, 57 nt, Human
gagacuacagccuuuuuugaacuuggauggugacuucauaaagagugcuguuguuuu

SEQ ID NO: 4139438 - RNA, 81 nt, Human
gagacuaccuuuuguuccaaacaagucauaaaguacacugacuugaugcuuuaaccaucuuguuuggaagggagguguuuc

SEQ ID NO: 4139439 - RNA, 91 nt, Human
gagacuauuuuuagauaaaugaaugauuaaagaguacaguguuauugcacaauguguuuuuauacauuugguauuuuuaaaaaaugauuuc

SEQ ID NO: 4139440 - RNA, 94 nt, Human
gagacuggucuugaagagcugcugaaugacacugcaaguccuauuaugggauuuucauuguaaaucaggaaaccuagucuagaagaccucucuc

SEQ ID NO: 4139441 - RNA, 60 nt, Human
gagacuguaagcuccuugaggacaggaaccauagguuugucuaccguagagcacauucuc

SEQ ID NO: 4139442 - RNA, 124 nt, Human
gagagaaagacagagggagaccaagggacagagagugaauaugacauugcagacccuacaagaaggauaguuguguucuuuccuguugacuuuugucuucccauuccaauauguacguucucuu

SEQ ID NO: 4139443 - RNA, 64 nt, Human
gagagaaaguuuauuccuaucuagcuugugugaaaucaaauuggcagagaaugaacuuuggcuu

SEQ ID NO: 4139444 - RNA, 84 nt, Human
gagagaaaugcagccagccacuucagcuauggcuucagcugaggcaaaagcugugcugccaaguugcugaaccugcucuuucuc

SEQ ID NO: 4139445 - RNA, 72 nt, Human
gagagaagagaggaauagauaugacuccaguaaggucauuaagaguuauaccuauuucuaacuggaauuuuc

SEQ ID NO: 4139446 - RNA, 62 nt, Human
gagagaaggaagugaauuucccaaccagaagcguagggaaauucagauggcuuucuuuucuc

SEQ ID NO: 4139447 - RNA, 57 nt, Human
gagagaagggacuucuacacuuucuugccaugugggaaugugcuagugucuucucuc

SEQ ID NO: 4139448 - RNA, 62 nt, Human
gagagaagguauuuuugagaaugucauuucgucacagaugacacuuggugauacuuuguuuc

SEQ ID NO: 4139449 - RNA, 59 nt, Human
gagagaauguacaugcuaggggaauugcuuuucuucccugcuuuugcaacacuucucuc

SEQ ID NO: 4139450 - RNA, 81 nt, Human
gagagacaaagcacauuugagaggcugccugaagaaacagcuugacacaggcuacagccucaagagugcaaugcuucucuc

SEQ ID NO: 4139451 - RNA, 107 nt, Human
gagagacagauauaagaugugggacagauuuaauuuauuucaacugccaagggaaaggugauuguggcagauuuuauaaauugcuguacauacuuuuguuaguucuc

SEQ ID NO: 4139452 - RNA, 56 nt, Human
gagagacagcagaacgugcagcaaacuguugcugugccuccagucucgcuucucuc

SEQ ID NO: 4139453 - RNA, 81 nt, Human
gagagacaguaaauauaacagcauauuuacaauuguugaaucuagauaaagaguagauauguguuuauuaugcuguaauuc

SEQ ID NO: 4139454 - RNA, 93 nt, Human
gaaaaucuggcagauuguuuucagauccuggcucggcuacucacuaacauguagucuuggcaaauuuuugaggcucuuuuugccuggguuuuc

SEQ ID NO: 4139455 - RNA, 57 nt, Human
gaaaaugaggaacggaucauggcucccuccaccuggcuuuuuccagucuucauuguc

SEQ ID NO: 4139456 - RNA, 83 nt, Human
gaaaaugauugcuucacugaguagucuagacucaaagccaccguuggucuagauaguaacuucagugacgcacuucuuuuuuc

SEQ ID NO: 4139457 - RNA, 80 nt, Human
gaaaaugcagacucuuaggcaagucaacaguaugccaacucucagggcugaugauuuacacaccuaugauuuauauuuuc

SEQ ID NO: 4139458 - RNA, 59 nt, Human
gaaaaugccucuggcauuaaacaaagccuuuuuauauuuaaugccagcccgggauuuuc

SEQ ID NO: 4139459 - RNA, 57 nt, Human
gaaaauguuuucuuucuggggcaaucaggcaaaaucuuggaaagaugaacuuuuuuc

SEQ ID NO: 4139460 - RNA, 58 nt, Human
gaaacaaauucagguugcucuaggccggccuagaucuggcacaucugcuuuggauuuc

SEQ ID NO: 4139461 - RNA, 122 nt, Human
gaaacaacugcuuccuuggcuucugagaguggucaucuauuuauguagaacaaggguucucucgagaaaauuuguuuuuaaagagacauccccuccucaaaagacaagagguuuguuguuuu

SEQ ID NO: 4139462 - RNA, 58 nt, Human
gaaacaaugggaaagcaauauuggaagauaacugucuccaaauacucccaauuguuuu

SEQ ID NO: 4139463 - RNA, 77 nt, Human
gaaacacaaauugcagagcuucacucuggacuuucugauuuuggaaaucugcggugaggccugagaauuuguauuuc

SEQ ID NO: 4139464 - RNA, 71 nt, Human
gaaacagaaaacaggaguauguaagcuuacuucuagugaaguguuaaaagauuaaaugcuccugcuguuuc

SEQ ID NO: 4139465 - RNA, 67 nt, Human
gaaacaggcacugcacuaccacuuuuagagacauauucaaaaguaguuccugcaguccagaaguuuc

SEQ ID NO: 4139466 - RNA, 130 nt, Human
gaaacauaagaggcuucuuauuucuugcaugcucacuuuuauacuguaacuagaagauuccaaacaaauacugauugcaaauuauauaagggaugcugcauuuugaaauaaguuauaaccucaacucuuu

SEQ ID NO: 4139467 - RNA, 60 nt, Human
gaaaccagaaagaccugggcucaagagggggcuucuucugcucuuggcuuugcugguuuu

SEQ ID NO: 4139468 - RNA, 60 nt, Human
gaaaccaggaggcuacacugucccagugauaugacauuggguagauugccugcugguuuc

SEQ ID NO: 4139469 - RNA, 69 nt, Human
gaaaccauuuguuucuaaaauucugugaaaaacuuuuuaaaaagaaggcuaaagaaacagauugguuuc

SEQ ID NO: 4139470 - RNA, 95 nt, Human
gaaaccccgggcggagcagagcugggcuuggcugguccaugugauucccccuugcugaccagcacaggccccucucucccagggcccaggguuuu

SEQ ID NO: 4139471 - RNA, 62 nt, Human
gaaacccugugagauuggauuccccauuuuacagauggggaaacugcaacucagagagguuc

SEQ ID NO: 4139472 - RNA, 64 nt, Human
gaaaccugggauauauaaguuucagccuucaacacuccacugacauuaaguuucccaggguuuc

SEQ ID NO: 4139473 - RNA, 80 nt, Human
gaaaccuuguuccaaauuuucacaguuguugaguaugagcaaaugccacacagucugguagaauagaggaacauuuguuc

SEQ ID NO: 4139474 - RNA, 69 nt, Human
gaaacgcaccagaaucugagucgugauuguauuuagguaaugcaauuaugggcaauuuuuaacuguuuu

SEQ ID NO: 4139475 - RNA, 81 nt, Human
gaaacuaugaaaguaccaaagacaugacccuaauucuccaaggagcacaguuguagggcugcuuugggucucucuaguuuc

SEQ ID NO: 4139476 - RNA, 78 nt, Human
gaaacugaggcuuggagaggucagggacuugccuaagauuauaaaccugaguccaaaccugaaugcgggucucacuuc

SEQ ID NO: 4139477 - RNA, 55 nt, Human
gaaacugaguaggcuagagcacugugaaccuuagugcuuggcucaugcagucuuc

SEQ ID NO: 4139478 - RNA, 100 nt, Human
gaaacugcagugggcucaggcuguggcuuugaccgcaugucauaaccauuuaaacugugguuaguuguucaaagcucaaagcuucuccaagcuggguuuc

SEQ ID NO: 4139479 - RNA, 58 nt, Human
gaaacugccuccugggcaacuaagcuaagaaagcuguugcucucaucuggcugguuuc

SEQ ID NO: 4139480 - RNA, 62 nt, Human
gaaacugugaucguguucuggggaaugucccuuuucccauucaaguguaugaucauauuuuc

SEQ ID NO: 4139481 - RNA, 88 nt, Human
gaaagaaaaagagugaucugggagucccugauccugcuaaugaaaucaugcggcaggaaaaccuucccauguuucugauuuuuuuuuc

SEQ ID NO: 4139482 - RNA, 77 nt, Human
gaaagaacgucuuugaaaauucaucucauagcagagucaauauugcuucugcauguggauuuuuauuaucaucuauc

SEQ ID NO: 4139483 - RNA, 58 nt, Human
gaaagaaucagaagucucaaacagccucuuuugaguccuguuuguacuugauuuuuuu

SEQ ID NO: 4139484 - RNA, 66 nt, Human
gaaagaaugcugggagccaucuugaauaaauggaaaguuagacaaaauggcauucagcaaccuuuc

SEQ ID NO: 4139485 - RNA, 78 nt, Human
gaaagaccguuugggcucuaaaaugguuacauaugucuugguuaauguccucagucauggugccuucagcugucuuuu

SEQ ID NO: 4139486 - RNA, 77 nt, Human
gaaagacucaaagaaacaucugaggagaauaugaucuaauccuauugucuuaaacaaauguguuuucugaguucuuc

SEQ ID NO: 4139487 - RNA, 80 nt, Human
gaaagagcagaacugaggggagcagggucagcaugugccucuugcugcagcugccagcuucucuccauccugccuuuuuc

SEQ ID NO: 4139488 - RNA, 58 nt, Human
gaaagagccuuaggagugagccacauggcuuugucaaacacucugagcuugcucuauc

SEQ ID NO: 4139489 - RNA, 68 nt, Human
gaaagaguguacaaaagucuguuacuugguacacuaucccaccaacaguauagcuuuugacugcuuuc

SEQ ID NO: 4139490 - RNA, 82 nt, Human
gaaagaguugauguauaaauaccucaguucccucacccucagauggguugagauaacucugauuuauguuuuacacucuuuc

SEQ ID NO: 4139491 - RNA, 99 nt, Human
gaaagaugaaggcauaggacauugaguaagagcagagaagcccuuaaaaaaaaggcaaggcuuauauugcucuauucacaacucucaugucugucuuuc

SEQ ID NO: 4139492 - RNA, 129 nt, Human
gaaagauuucuuuuggaauaaaagaaaaugccuggcaaagaagguggugauuccaaggugcuuacuauuuuuggccauuuucugucuuguuuauucauagcuuuuuucuccagcccaucucugucuugc

SEQ ID NO: 4139493 - RNA, 82 nt, Human
gaaagauuuuucaugaaagcaaaaauggguggagucaugggacucuaugcacagaaguuugcugaaucaugauuuauuuuuu

SEQ ID NO: 4139494 - RNA, 63 nt, Human
gaaagcaagaguuggagugauguuagccagauggcagaauaggaagcaccaaauucuccuuuc

SEQ ID NO: 4139495 - RNA, 89 nt, Human
gaaagcacuuugggauaaacauuuguguuugcuaaaaaugucucuaaagaauuggaaguauuucaucaaaagauuuaucugugcauuuc

SEQ ID NO: 4139496 - RNA, 66 nt, Human
gaaagcagccacuggccaguuauaggggaaguuuuguuauuuguaaaagaaacagugguuguguuu

SEQ ID NO: 4139497 - RNA, 70 nt, Human
gaaagcaguucucuggggaucucuagcugacuccauucuaugcacggcuagcccaggagaauugucuuuc

SEQ ID NO: 4139498 - RNA, 110 nt, Human
gaaagccaaggguuugauuaagguuugggccagaggcauggagcuauuuuggcagguaggagaagcauguuuccauguaucuggucuucaccgaagagccucacuuuuuc

SEQ ID NO: 4139499 - RNA, 85 nt, Human
gaaagccaggccucuuggcaaugaaagcugcccggggcagcccucucccucuuccuggugcagguguguugccagcguggauguc

SEQ ID NO: 4139500 - RNA, 112 nt, Human
gaaagccgacuccaccgccauauguguuagagcuggccgggacagcuggaagaaauaucgcccagcccgaaucccuggccaggauugugauccaugucugcauacggcuauc

SEQ ID NO: 4139501 - RNA, 95 nt, Human
gaaagccugaaauaacagaacuguacuuuggauaaugaauucuucaucuguggagaacuuuaaaacaaaguacaguguuggcauuuuuuucuuuu

SEQ ID NO: 4139502 - RNA, 129 nt, Human
gaaagcuacaauaaauuuggcuuugaugcaaauuagauugguuuuauccuacccacacagcccuccaaaauuaggaagagggggauaagagaguauuuaugcauuaaugaccuauugcuugugacuuuu

SEQ ID NO: 4139503 - RNA, 104 nt, Human
gaaaggagaggagaaaguagagcuacuuccucuguaugcuuugcugcuuggaaaggagacagaaaaacagcaggaaaugcucacuucuucucuugggaucuuuc

SEQ ID NO: 4139504 - RNA, 69 nt, Human
gaaaggagugcuuuccaggucucucaguuuuaaccaugggaaucuuuuucacaagaaagcacuuguuuc

SEQ ID NO: 4139505 - RNA, 78 nt, Human
gaaaggccgauaaugaaucagcauagggugaggcauccuuuuuguaaaagucuuauauuugcuuguuucauuucuuuc

SEQ ID NO: 4139506 - RNA, 60 nt, Human
gaaaggccugaggggguuagacugaccuuugucuguccuguagcuccaucagucucacuc

SEQ ID NO: 4139507 - RNA, 73 nt, Human
gaaagggcgauggcugugggauaugugacugacaggggcugcacgacucgucugucaccuauggcugcucuuc

SEQ ID NO: 4139508 - RNA, 123 nt, Human
gaaaggggaaugaucguguacauuuuuauaaaagcaagcaguguggaauuuuagaauaccacuuuuaaucuuuaaacuuuuccauaacucuugagugaacaaugucauaacucaaauucuuuc

SEQ ID NO: 4139509 - RNA, 58 nt, Human
gaaaggucaaaaucgugacauugggaguuagcuuaaugcacccagaguuugaacuuuu

SEQ ID NO: 4139510 - RNA, 98 nt, Human
gaaaggugcuguuuucagaaucugggauaagaccacagauuuccucuuacuagcuggcugauauuugggucugucccugagccucaauuuaaucuuuc

SEQ ID NO: 4139511 - RNA, 96 nt, Human
gaaaggugugguugggccagaugugccugcucagaaagccaccagagcgcuuuccaagucuuuggggcaucugggagauugugcccggccccuuuc

SEQ ID NO: 4139512 - RNA, 81 nt, Human
gaaaguaaguagguuaucuaagguaacuccagaggauuaugaacaauauccugcuuguuacuuauagagaucucuucauuc

SEQ ID NO: 4139513 - RNA, 77 nt, Human
gaaaguacagaauuaugccaugaggguaucuaggauugcacugugcuaauucuucacugaguauuuuuuguauuuuu

SEQ ID NO: 4139514 - RNA, 86 nt, Human
gaaaguauuuuagcaucuugauuaugacaugacuucucuggucccaaggcuucauguagaugguucccucugccuagaaucuguuc

SEQ ID NO: 4139515 - RNA, 122 nt, Human
gaaagucaaguucauacauauuugccuauuaagacaggacccuuaaaucuccaagcuggggggaaaggaaguuaagucuuagaaugcacauguacaaacuucccuguauaacugagauuuuc

SEQ ID NO: 4139516 - RNA, 77 nt, Human
gaaagucugccucuuggccaucuaccaucucugaaagcucuggcuucaaaaauggucuuugagcugcaagaacuuuc

SEQ ID NO: 4139517 - RNA, 73 nt, Human
gaaagugggugcaagcuuggcugauguugauccaaugaacauugauaaaucaguaaguuuuguaaauguuuuu

SEQ ID NO: 4139518 - RNA, 61 nt, Human
gaaaguggugggggauggggagguucuuaacguaugcaucuuugccagcccucgcgcuuuu

SEQ ID NO: 4139519 - RNA, 97 nt, Human
gaaauaaaguuguggcaauacuuuaguaaaauggcccuagauuuauagcaagguuaccuggguucuuuuccuggauaguugacugugauuuuguuuc

SEQ ID NO: 4139520 - RNA, 78 nt, Human
gaaauacaaacaguaaauaaugcauguugauugguuacuaugugccaggaauaugcuaaguauuuacaugauuauuuc

SEQ ID NO: 4139521 - RNA, 71 nt, Human
gaaauacaaucuagucugucagcaaagagaagugucaggaugaaagcuuuguaccaggcuuagaguauuuc

SEQ ID NO: 4139522 - RNA, 61 nt, Human
gaaauacguguuauacaggcucagggacuauucccuguuccugguuccugcaugauguuuc

SEQ ID NO: 4139523 - RNA, 75 nt, Human
gaaauacugagaacagaguuucaaauaacaucucauaaaggagaguuuacaaagcuuuguuuuguuuuguauuuc

SEQ ID NO: 4139524 - RNA, 58 nt, Human
gaaauagauacuagagauagaacuggacuaaaaccuagguuuucugaaugucuauuuc

SEQ ID NO: 4139525 - RNA, 62 nt, Human
gaaauagcuuauugacagugaauuuggcccucacacaaguucaguggaaaaagagcuucuuc

SEQ ID NO: 4139526 - RNA, 77 nt, Human
gaaauauacauugcaggaagagaauggauuaccacauacuguuaauuucguccauaauucugaccaauguauauuuu

SEQ ID NO: 4139527 - RNA, 55 nt, Human
gaaauauccauacugauuuuccguuacuuguucugagaaaaaguguggaaauuuc

SEQ ID NO: 4139528 - RNA, 55 nt, Human
gaaauauuucucuugagccccucauuuauuaggguagguagaagggaaguguuuu

SEQ ID NO: 4139529 - RNA, 75 nt, Human
gaaaucaucggugauauccucacaaagaagcuuuuguuguuuacucugugucagaagauaucauggcaugguuuc

SEQ ID NO: 4139530 - RNA, 128 nt, Human
gaaauccuaacacaaccacauuaguugagauuuauuuagcugcauuaucaaaguuaugucaauugauguguacagugauuugaguucacaucuuaauuucugugauguuagguaaauaauuucauuuc

SEQ ID NO: 4139531 - RNA, 73 nt, Human
gaaaucuaugauguacagaaaguuggcggcuaguccuaaaagcuuccccacacucuuuacauucauagguuuu

SEQ ID NO: 4139532 - RNA, 71 nt, Human
gaaaucucagcccuuauuuuagaauuuaacccacaagauguugggguauuaucuggaauugcugagauuuu

SEQ ID NO: 4139533 - RNA, 66 nt, Human
gaaaucugaaucuucuguuggucacucuugggcugaaaugauguucaagucagaggucagcguuuc

SEQ ID NO: 4139534 - RNA, 104 nt, Human
gaaaucuguuuuccuucccugucugucuccaucucugcugugucucuguggcuucugugucucuuucacaguggauccucugacucccucuuauucuggcuuuc

SEQ ID NO: 4139535 - RNA, 57 nt, Human
gaaaucuuuuaaccauucauuuccucuugccuggagaugauugugcaguaagguuuc

SEQ ID NO: 4139536 - RNA, 81 nt, Human
gaaaugaaaagcaaaagguggcagaaaugggacuuugaguuuaaaauacugaguuuauuuuucuccauauaguuuuauuuc

SEQ ID NO: 4139537 - RNA, 110 nt, Human
gaaaugaaauguguuuacaugagaauuagggggcucagcauggauggagagaggcugaaacuccuucauagccuggguccuacaggucuaauguauuauagcuuuuaguc

SEQ ID NO: 4139538 - RNA, 67 nt, Human
gaaaugauagauuauuguaaugacugccagaauggccuuuuggcauguuuaaauggcaauaaauuuc

SEQ ID NO: 4139539 - RNA, 57 nt, Human
gaaaugaugucugugcugccacugucucucugugguaauagcaucaucaaucauuuc

SEQ ID NO: 4139540 - RNA, 78 nt, Human
gaaaugcaaauuauguggucccuccucagaucuacugaaucagaaacucuggggacagggcucagcaauuuguguuuu

SEQ ID NO: 4139541 - RNA, 60 nt, Human
gaaaugcucuggugugucucauccauauucccuagaguauagaugaaaucagaguauuuc

SEQ ID NO: 4139542 - RNA, 116 nt, Human
gaaaugcugcuucuccaacuugcugauucaugucuuccuggagcagauggguuggcuauuuuugcccaaggucuaggagacauugaucccaagaaaacaugcacuuaaggcauuuu

SEQ ID NO: 4139543 - RNA, 56 nt, Human
gaaauggaagagaccugucucacaccuaaugaguggcucagcuaguuuuccauuuc

SEQ ID NO: 4139544 - RNA, 61 nt, Human
gaaauggauuucaaaugcggcagcaacuccuuaaugcugcccugcuaaugaguuccaauuc

SEQ ID NO: 4139545 - RNA, 88 nt, Human
gaaaugguaaaguugacuguuuuacuuauguuuuugcaguaagaagcuaaacauccaguaucagaagcaucaguacuuuuacucuuuc

SEQ ID NO: 4139546 - RNA, 83 nt, Human
gaaaugucaaguugaacggcuggaauuagauaacauuuugaaauaauagcaagaugugccuaaucagaccuagcuaucauuuc

SEQ ID NO: 4139547 - RNA, 74 nt, Human
gaaaugugucaaaguguggaguauuuauaugacaauuucauuuaagcuuucagggcacuauugaaacacauuuc

SEQ ID NO: 4139548 - RNA, 57 nt, Human
gaaauuacugggcccugauugcaacaaacuuccuugaagauccugggccagucuuuc

SEQ ID NO: 4139549 - RNA, 80 nt, Human
gaaauuagugaaacugcuuuguaaacuguccucuaccauuaugaagacguuaauacuaaaggucaguuucgaaaaauuuu

SEQ ID NO: 4139550 - RNA, 83 nt, Human
gaaauuauauguguguuaucuguuguuuuggauucucuacaaggcuauucuccaaugacauggauaaucauauuuuuaauuuc

SEQ ID NO: 4139551 - RNA, 79 nt, Human
gaaauucaaguaugacaucaaguuucucagauauuauccaaaacauuugaugaagggcguuggugcauauucuguuuuc

SEQ ID NO: 4139552 - RNA, 57 nt, Human
gaaauugugggguuaaaaggcugugggaccacauucguucauucauuccacaacuuc

SEQ ID NO: 4139553 - RNA, 70 nt, Human
gaaauuuaaaauuuucagcuugacuugaucaaacauugaucauagggucucuugaaaaugauuaaguuuu

SEQ ID NO: 4139554 - RNA, 99 nt, Human
gaaauuuauuucuggcuacauauuccagauuguuaguuggauaacuucuauuugacaauauaagaaucuauuaggaauauguagccccucauuaauuuc

SEQ ID NO: 4139555 - RNA, 62 nt, Human
gaacaaagaucagaggauagcugagucugaaagcaguuagagaagcaagaugaucuuuguuc

SEQ ID NO: 4139556 - RNA, 61 nt, Human
gaacaaaguguacuuccauacuguuugccugaaggccucagucaugggaguuacuuugguc

SEQ ID NO: 4139557 - RNA, 56 nt, Human
gaacaaaguuucaggaagauagacacagcuuacaguuuaugacuggaccuuuguuu

SEQ ID NO: 4139558 - RNA, 68 nt, Human
gaacaaauaaauauuaagcauuuggcccugugccuggcacagaguaggugcucaguaaauaucaguuc

SEQ ID NO: 4139559 - RNA, 118 nt, Human
gaacaaauaaggcuggagcugucacagguaagggaacagcagucacucauguuauucagagaaggagaacguuuaguuauuuuugugauuacuggguggcuuuaucuuuaucuuguuc

SEQ ID NO: 4139560 - RNA, 77 nt, Human
gaacaaauuccagcaacaccuuuuuacaugugccaaauaguacuucaagagcauugaaaaggauauuguauuuguuc

SEQ ID NO: 4139561 - RNA, 87 nt, Human
gaacaagagagcagggacugagccagugggacugacuaucaacaugacaaaucucauuuggcuuuguuuuaaauugcucuccaguuc

SEQ ID NO: 4139562 - RNA, 55 nt, Human
gaacacaaggucauaccauuuaugacguuucaauuaugugucugccucuguguuc

SEQ ID NO: 4139563 - RNA, 81 nt, Human
gaacacagaaaaggauugauggaucagaucacaaguuacuucgaugcuuaauuuucuggcuuuauuccuucacugauguuu

SEQ ID NO: 4139564 - RNA, 88 nt, Human
gaacacagacccuggcagccccuugguuugguuucuuggaggaacaagucuucuuuagaaacuaaagccaagggcucuaaauguguuu

SEQ ID NO: 4139565 - RNA, 111 nt, Human
gaacaccgaguuucuauugguuuuacaccuguuaacucuaagacagaaaugauuuagcuuugacaugguugugcuucuuucuuaaacuguaggguacuuggucauauguuc

SEQ ID NO: 4139566 - RNA, 57 nt, Human
gaacacugagagagaugggcagggcgccagugccugccacacucugccggucuguuc

SEQ ID NO: 4139567 - RNA, 73 nt, Human
gaacacuggacaggaggcuagguccacuuaguaaguagucacucuugcauaccagccuccuggucuucaguuc

SEQ ID NO: 4139568 - RNA, 99 nt, Human
gaacagagagacucauuuugucuuauguucauuuuaugaauccuuuuuuuuggaucaaggaaugacuauaugaggaaauuuugccagagucucuuguuc

SEQ ID NO: 4139569 - RNA, 88 nt, Human
gaacagauugcuggcauuauggcagccaggauauugucaggaggaacuuggcagugcucguagguguuaugaugcuggcucuuugcuc

SEQ ID NO: 4139570 - RNA, 68 nt, Human
gaacagcuggggcagccacgugcggguucuuaaagcaccgccccacugggaccucuggcccagauuuc

SEQ ID NO: 4139571 - RNA, 65 nt, Human
gaacaggaucauaauuauucuguaaccagcagucuguguugguuacagaaaguaugcuuuuguuu

SEQ ID NO: 4139572 - RNA, 61 nt, Human
gaacagggaaccacagcggugcuaccucaccaauuuuuacagcugugguuuguuucuguuc

SEQ ID NO: 4139573 - RNA, 79 nt, Human
gaacaguguuuguugaaguaaacacuuuauaaccuggggcagguuauaguauuagguacucaacaagcuucguuuguuc

SEQ ID NO: 4139574 - RNA, 61 nt, Human
gaacaguuuggguagguauguaguuggaaaaauaaucccaaccuauuuugcucagacucuc

SEQ ID NO: 4139575 - RNA, 62 nt, Human
gaacaguuuuuguauacaggaauauugaacagaaacagagaguuccuguauacaaagaguuc

SEQ ID NO: 4139576 - RNA, 83 nt, Human
gaacauagcuuuaaaaaucaucaaagcauauuagaagaaauugcuaauuuugguuuagaugagauuuuagaacagcugucuuc

SEQ ID NO: 4139577 - RNA, 55 nt, Human
gaacaucaugaagaaaacauauuucaggacucaggacuauguuaucuugauguuu

SEQ ID NO: 4139578 - RNA, 64 nt, Human
gaacaugcauauagguaaauggaccaguauacaugcuauucuguucuguuuuguaagcauguuu

SEQ ID NO: 4139579 - RNA, 57 nt, Human
gaacaugccugauccaugcccuccgcagaagcugcgguggcugggucuggcagguuc

SEQ ID NO: 4139580 - RNA, 105 nt, Human
gaacauuguauuaagaaauuuacugggaauuccaaggcuaaauagucucugcccagagauccuuagggauuuuuccagucaguuccacucauuaaauauauacuc

SEQ ID NO: 4139581 - RNA, 75 nt, Human
gaacauuugagaaaaauacucuuaagcaagucuucuuaugaagauguagacaaagauguauuuuuaccaaauguc

SEQ ID NO: 4139582 - RNA, 76 nt, Human
gaacauuuguauuugaacaagauccuugguguguaguucagucuugcaguauacaagcuuuuguguauaaauguuu

SEQ ID NO: 4139583 - RNA, 68 nt, Human
gaacauuuuuggcugagaaaaugguuuuagguuuuguagaggccuacuaguaugucucaguuauguuc

SEQ ID NO: 4139584 - RNA, 63 nt, Human
gaagcaagaagggcaaggaaguuugagcagggcacccaugacgcacaccacccuucaugcuuc

SEQ ID NO: 4139585 - RNA, 71 nt, Human
gaagcaagcuggugaaucguaaugaggcaugugcugccaauaugcacuguacauuccacaagcauugcuuu

SEQ ID NO: 4139586 - RNA, 94 nt, Human
gaagcaccccaauuuuccagaagcuuuuccaccuguguagcaugagcuuggcuaugagcagcugcacauggcagaggccuuuggaaagugcuuc

SEQ ID NO: 4139587 - RNA, 63 nt, Human
gaagcagcacgagaucgaugugccuuugcucgugguaagagcagugggcucgugcauauuuuc

SEQ ID NO: 4139588 - RNA, 60 nt, Human
gaagcagcagaauuccauggcagauuguucaaaacuagucucuuuguggacucugccuuc

SEQ ID NO: 4139589 - RNA, 126 nt, Human
gaagcaggagcucuuugcuucauugagcugaacacuacagggguccacagcugauugucaagagucugauguaggcuuuucugggagaaaauacuucagcucaaugaagcaaagagcuccuggguu

SEQ ID NO: 4139590 - RNA, 77 nt, Human
gaagcagguaucaugaaagcguaaagcccauaacccuaauucauagcacacacuucucauuugauacuaacugcuuu

SEQ ID NO: 4139591 - RNA, 81 nt, Human
gaagguaagcaagaugcauuauuucuuaucugaauuacauuuaguaaaugaaagugauauuugcauauuguuuuuaccuuu

SEQ ID NO: 4139592 - RNA, 71 nt, Human
gaagguagcugcugagaugacacccaaugauccauaccuccugguagucacacccucauguacuuaucuuc

SEQ ID NO: 4139593 - RNA, 57 nt, Human
gaagguaggcccacaguuagugagagaguugccuugucuaucuccuggcgugccuuc

SEQ ID NO: 4139594 - RNA, 66 nt, Human
gaaggucaccuccccucucuggcucucagagccauauaauacaaggagaagguggacuugaucuuu

SEQ ID NO: 4139595 - RNA, 66 nt, Human
gaaggucagaagucugcuauuaaucucaugaggcuaaaaucaagguguuagcagggcuuguccuuu

SEQ ID NO: 4139596 - RNA, 85 nt, Human
gaaggugcccaggacagcuaaacaaguguguagccauuuuggacaauacagaaugccuuuuguuagggcugccagauccauuuuc

SEQ ID NO: 4139597 - RNA, 62 nt, Human
gaagguucuguguacacuacuucccaaggagcugagggauguccuuguacaacaguaccuuc

SEQ ID NO: 4139598 - RNA, 86 nt, Human
gaagguuguaggaaauaauucuggaaaagaaaguuaagaucaggaccugaaaauccucuaauucuagaauaaguuuucuuaaucuc

SEQ ID NO: 4139599 - RNA, 98 nt, Human
gaagguuuccucacacuggcugcacucauaaggacugggucucuggugaacauuuauuccagugcugaaugaggaggucucugugguagaaggccuuc

SEQ ID NO: 4139600 - RNA, 78 nt, Human
gaagguuugucugagucaauaccucuacugcaugccugggcccagcagagcuuauguugggucaguaguccaaccuuc

SEQ ID NO: 4139601 - RNA, 82 nt, Human
gaaguaaugagaacaugcauauaggacacaaagaaauauccaccucaucacucuuuggucacacauguaucucaauggcuuc

SEQ ID NO: 4139602 - RNA, 80 nt, Human
gaaguacaugcuauauaggaagagcacuuugaaauuuugggguguucuuuuucuuauggugcacuucuuucauguacuuc

SEQ ID NO: 4139603 - RNA, 93 nt, Human
gaaguacuuagugaaagaaaccacaugccuucaaaugcucauauauauguauguaaagcauacauugguaugugguuuugguucauuuucuuc

SEQ ID NO: 4139604 - RNA, 64 nt, Human
gaaguaggugagcuugugcuucugugcugucccacccagccggucugccaggucucucugcuuc

SEQ ID NO: 4139605 - RNA, 58 nt, Human
gaaguaugacauuuaagacaauugugccuugagcuaauuggacuugcugucaaacuuc

SEQ ID NO: 4139606 - RNA, 66 nt, Human
gaaguccauguucucuucaagucuuacacugauguacgcguaggcacuguggaagacaugguuguc

SEQ ID NO: 4139607 - RNA, 107 nt, Human
gaagucuaugaaagccaacauuuguggugagcagggaacgucaguuaaucacauauuagggaugauuccuuuguucauugugcaaaagugguuucuagcagacauuc

SEQ ID NO: 4139608 - RNA, 65 nt, Human
gaagucucauuuggugucaguuguggaauaacacagucagcuaccacucgcaucccuugagguuc

SEQ ID NO: 4139609 - RNA, 57 nt, Human
gaagucucuuuguauaaauaggcaucacaauagaugccuuuaugauaaagugauuuu

SEQ ID NO: 4139610 - RNA, 73 nt, Human
gaagucugaagauaaguggagauauuuuugccacagugaaauucuggcauuuguagccacuugccuugauuuc

SEQ ID NO: 4139611 - RNA, 60 nt, Human
gaagucuuuuagcaaaacgaacguggcugcagccuuuuucgucuuucuaaaagaaucuuu

SEQ ID NO: 4139612 - RNA, 77 nt, Human
gaagugaaaauugcauucuugucuugauagagaugaaaauggauuucuggucaugaaauagauguaguugucacuuu

SEQ ID NO: 4139613 - RNA, 69 nt, Human
gaagugaacucagcauccugcacagagaagccacugcugucucugagcucaggagcugcaggaagcuuc

SEQ ID NO: 4139614 - RNA, 76 nt, Human
gaagugagauuacugggucaaaagguccuucugcuaguguguaaccugggccagcugcucagugucucugugcuuc

SEQ ID NO: 4139615 - RNA, 87 nt, Human
gaagugagucauuagucauugcauuuucuggaaaagucgguagagaaaaguuuaagugaaauguaauacaguguuauaauucacuuu

SEQ ID NO: 4139616 - RNA, 79 nt, Human
gaaguggaacacacacagaaaaaugaucccuacgugguuuaauuaaggggaaagugaauuguguaguguuuuaccauuc

SEQ ID NO: 4139617 - RNA, 64 nt, Human
gaaguggaacaggacacaaauuuaguggaauuucuuuacaaugugugcuucuugucaccaguuc

SEQ ID NO: 4139618 - RNA, 69 nt, Human
gaaguggcagugugcaucuguguggcccagaaauggauggcuagugcuaauguacauguugguuauuuu

SEQ ID NO: 4139619 - RNA, 66 nt, Human
gaaguguauugucucacaguucuugaggcuacaagcccaagaucaagguguuggcagggucacuuc

SEQ ID NO: 4139620 - RNA, 60 nt, Human
gaagugucuuuuauaaaucuccaggaaaucuccuaggaagcauuuaaagagauggauuuc

SEQ ID NO: 4139621 - RNA, 67 nt, Human
gaagugugcauggaucuagauggguugagaaucuuugcuuguccugcucuagguuccugcauauguc

SEQ ID NO: 4139622 - RNA, 72 nt, Human
gaaguguuaaggacaaucagguuaguagcuaacucagcucugaccuccugcuuguuaauuacuuggugcuuc

SEQ ID NO: 4139623 - RNA, 97 nt, Human
gaaguguucaauaaaaaacaguuguuauuggaacugauugaugauaaugaugauuaaaauuauuuccuugcaaguuucuguaacaacuuggcacuuu

SEQ ID NO: 4139624 - RNA, 62 nt, Human
gaaguguuuaaguuacacacauaucagcguacaccgcuauauggggcggaauuugacacuuu

SEQ ID NO: 4139625 - RNA, 99 nt, Human
gaaguuaugggaggaaggaugacccgagucuggggaacaagugccguucacuagguucccauuggggaucuugggcuguuucuccuccaaucugccuuc

SEQ ID NO: 4139626 - RNA, 76 nt, Human
gaaguuauguuuuauaugucucugcugacauuuacaaguccagugucuguugaacaguaagacaaugaguaacuuc

SEQ ID NO: 4139627 - RNA, 90 nt, Human
gaaguucaaagagcucaugugucaauuuucauuccuacugucaucagggaagcaauauuagauaucagugaauaugcuuugcugaacuuc

SEQ ID NO: 4139628 - RNA, 57 nt, Human
gaaguucaacugccaugcuugggaguaagcaauugucaugcuuggcagugagcauuc

SEQ ID NO: 4139629 - RNA, 67 nt, Human
gaaguucacaccaaaguuagguagggucagggacacccuuccaccaccugcuuguggggugagguuc

SEQ ID NO: 4139630 - RNA, 85 nt, Human
gaaguucacuaccuuuugcuucugcuugcuguucuacauaauggcacauugugaaaagccgcaaguauagagcgggcacgacuuc

SEQ ID NO: 4139631 - RNA, 101 nt, Human
gaaguucaucaggcaggugggcuccuggcauggguggagagagcacaagauccauuucucugugacuccuuugcucuugcccuuuccugcguguuggcuuc

SEQ ID NO: 4139632 - RNA, 91 nt, Human
gaaguuccaguuguuuuacaucucaccagauucauaugccccuccuuugccuuuguaucauucugguggguguguagcugcuggcaauuuu

SEQ ID NO: 4139633 - RNA, 76 nt, Human
gaaguucuucaauguuuguucaugaaaauaguguguuccuuauuauuaauguuaaaguggauaagcugaaugcuuc

SEQ ID NO: 4139634 - RNA, 58 nt, Human
gaaguucuucaucauuaacacucugaauggcacagaggauggcagugugaggaaaauc

SEQ ID NO: 4139635 - RNA, 72 nt, Human
gaaguugaaaaguuuauuuucccugguuagugcuaaauguauaucaucaaggaaaaauaaaugagcaacuuc

SEQ ID NO: 4139636 - RNA, 83 nt, Human
gaaguugauuugauguucauaaaugauacaggcuauaguguuaagcagaccugguuguuaauucuggcgucagcauuggcuuu

SEQ ID NO: 4139637 - RNA, 57 nt, Human
gaaguuguaagccugggaagguaaucacagaaucucuggccagggcaaagcaauuuc

SEQ ID NO: 4139638 - RNA, 129 nt, Human
gaaguuguggggauuaaauaugauaaauggaaagauacacggucaacucucaagcauuguagagauguuagauuguauuaugacugugacuguuauuccucaagugucagcuuacuuuuaaacagcuuu

SEQ ID NO: 4139639 - RNA, 62 nt, Human
gaaguuuacagugacuggacuuugucaucauaucugagaugaguacagagcuguacucuauc

SEQ ID NO: 4139640 - RNA, 55 nt, Human
gaaguuuagguucuuauguuuaaauuacauuuaaauuaguaaggauguaaauuuu

SEQ ID NO: 4139641 - RNA, 83 nt, Human
gaaguuuaguuucauuagacugauuuagaagcagucuuuagaugguaaagauacagcuuuuuugucagucacauauaggcuuc

SEQ ID NO: 4139642 - RNA, 71 nt, Human
gaauaacucaagucuauugauaagugcagguuuuuacucacggccugccaagcuuucagauaugaggauuc

SEQ ID NO: 4139643 - RNA, 110 nt, Human
gaauaagauucacugaugagcugcugagaguggcuuggcugcacuacagggcuagccaguugccauguggccuguggucaagucagagggagcagcugugaauccuauuu

SEQ ID NO: 4139644 - RNA, 100 nt, Human
gaauaaugaucacaguaaaucagaccucauuaugugcaggagagccgggcagcccaacuggcuagguaaugaggucuaauuuaaugcccugguauuauuc

SEQ ID NO: 4139645 - RNA, 77 nt, Human
gaauacaaaaguaaugguuaaauaauucuaggucauucauggaauagaacagcauuuggcuauuaacaaugguauuu

SEQ ID NO: 4139646 - RNA, 56 nt, Human
gaauacacgaaggcaagagucccuuauucauggacaucuguguauguguguguguc

SEQ ID NO: 4139647 - RNA, 60 nt, Human
gaauacacgaauagagcauggugauaguauggucauugcuaugucugaauguguguguuc

SEQ ID NO: 4139648 - RNA, 67 nt, Human
gaaccaaagucugggggcugaguaagaugagaucagggagcucauuuauccagccccuucacuguuc

SEQ ID NO: 4139649 - RNA, 92 nt, Human
gaaccaaguaccuagcuugugucuuuagaaacuuuucuucaugaaaaaaaaucauuaauaaacauuucagaagacuugcaggaacaggauuc

SEQ ID NO: 4139650 - RNA, 129 nt, Human
gaaccagcaucaggaagggaaagggagaauucagggaucaaacuguaaagaguucuuguagcuuugagauucagacucguuugcacacaaggcuuuuaugauuuuucuccuauuuuucuuucuagcuuu

SEQ ID NO: 4139651 - RNA, 80 nt, Human
gaaccaguugaggugggccagcauuuugaagaguuggcaucucccuauccuuacuucuucacugauucuggcucagguuc

SEQ ID NO: 4139652 - RNA, 66 nt, Human
gaacccagaggccacuuugccugugauguuuaucugaauauucaggucacaguggcuucucuuuuc

SEQ ID NO: 4139653 - RNA, 60 nt, Human
gaacccuggggguggccagugccagcuuuguuaggucacgaauggcuucucccaggcuuc

SEQ ID NO: 4139654 - RNA, 113 nt, Human
gaaccguucaaaggaaaacuccuggcuuggccuuguuaaggaggcccucucaguccaggagguggggccucucaggauuaaggccacagauccagguaccuucgaugauguuc

SEQ ID NO: 4139655 - RNA, 111 nt, Human
gaaccuacucaaaucuuucccaggaacccaguccaggugcagccucgccugcagaaggccgccaugcuggguguggugccuggggaaggugaaagguccaggagcagguuc

SEQ ID NO: 4139656 - RNA, 55 nt, Human
gaaccucucagcagccaugauccuuauaggacuuagugagcuauuuagagguauc

SEQ ID NO: 4139657 - RNA, 58 nt, Human
gaaccucuuuagugcauccuucacguucuuguuccugaggcuguagauuagaggguuc

SEQ ID NO: 4139658 - RNA, 56 nt, Human
gaaccuggaauguggcgcccaacaauguaaugaauggcgcuuaauuuuccagguuc

SEQ ID NO: 4139659 - RNA, 82 nt, Human
gaaccuguugggggcagcugucuugguucucaaaagacugaauuauaaaaguccuugaucuagacuggcggcccacagucuc

SEQ ID NO: 4139660 - RNA, 60 nt, Human
gaaccuuaugguaaaucuagaggaaguuugucucucaugauagaugcugccauaagauuc

SEQ ID NO: 4139661 - RNA, 71 nt, Human
gaacgcaguccaucccucgaguuagggugcagucagccacugcccuaagcuuucgggcugagagugaaguc

SEQ ID NO: 4139662 - RNA, 82 nt, Human
gaacggggccuuucuggagcagauuggaaaaucccccggagcgggugggggccuugccagcugcuugggaaaaugucuuuuc

SEQ ID NO: 4139663 - RNA, 60 nt, Human
gaacguaaauguucauguuugagagggaacaauggcacugggaaugugaauauuuacuuc

SEQ ID NO: 4139664 - RNA, 94 nt, Human
gaacuaaaaguguggucucaagaugucagggcaccugcuuacucaguccuagaaauggcaugcuuaucuggcauuuugagucucacugacuuuc

SEQ ID NO: 4139665 - RNA, 77 nt, Human
gaagugcagaaggguagggcaagaggugcccagcaaggcuuugggcaagcacaaggcccugaccuucacugacucuc

SEQ ID NO: 4139666 - RNA, 59 nt, Human
gaaguggcuguuugguucuguuuggguuucccagccaguauauuccaaagccuuuuuuc

SEQ ID NO: 4139667 - RNA, 60 nt, Human
gaagugguagucacagggacaguaaggcaagcccagucugugucuaaugacuauuucuuc

SEQ ID NO: 4139668 - RNA, 76 nt, Human
gaagugucugauuagcauguuccugauccucguucuauuuguagcaaagaugggaggucagggacugucacauuuc

SEQ ID NO: 4139669 - RNA, 59 nt, Human
gaaguguuuugugguugugaaucacuuuuaauggaagugacaacuuuacaaaauucuuc

SEQ ID NO: 4139670 - RNA, 59 nt, Human
gaaguuacaccuuugccccaagucauagauaauuuucuggacgggcauaagguggcuuc

SEQ ID NO: 4139671 - RNA, 92 nt, Human
gagcaggacguguuauuggguugacuuuguaaagauuguuuuacuguaacuguagucauuuugaaaagcauuugaguaacuacauuaugcuc

SEQ ID NO: 4139672 - RNA, 69 nt, Human
gagcaggaguaaaccuagcaauaaaaaccaaaccucugccuucagagguauaugcuauuacuucugcuu

SEQ ID NO: 4139673 - RNA, 65 nt, Human
gagcaggauuuugaagacagcgaaagcagcauuguucucuggcuggcugucugcggggccuguuc

SEQ ID NO: 4139674 - RNA, 73 nt, Human
gagcaggcacccagggaugucucuggaagggaggauggggcccacuucaccaacugccacaucccuccugcuc

SEQ ID NO: 4139675 - RNA, 68 nt, Human
gagcaggggcugggaaugccaggcaauacuacacaaugaagaauuguccagcagcucagucuacguuc

SEQ ID NO: 4139676 - RNA, 60 nt, Human
gagcagguacuccugugugggccuccacccaccuuggaguagcacauacaguacuuguuc

SEQ ID NO: 4139677 - RNA, 68 nt, Human
gagcaggugcccaggggacaguggcuguuuguucugcaugggccaugcgguguccugagcaccuguuc

SEQ ID NO: 4139678 - RNA, 65 nt, Human
gagcaguaauccaucauggccuggcguuggcgggugcugccagcugaagcccugguggaacuguc

SEQ ID NO: 4139679 - RNA, 75 nt, Human
gagcaguauucacaguggaaacagcuaagccuugaggcaaacauaucagggcuuaaaaucuuguuccacuugcuc

SEQ ID NO: 4139680 - RNA, 62 nt, Human
gagcaguggucugaucuucuaaguguucacucccaccacuuccugaagaggcuacacugcuu

SEQ ID NO: 4139681 - RNA, 70 nt, Human
gagcaucaucaagagaaggggaagaugaagcugacucccugcaccugcuuccuccccauucuguuggcuc

SEQ ID NO: 4139682 - RNA, 85 nt, Human
gagcauccugcagugggcugggccaucuccuuuguguggcccuuugccaggccacucugagaucuggcuuauccuugaagggcuc

SEQ ID NO: 4139683 - RNA, 55 nt, Human
gagcaugacaggagccgaauugcacggccagcaagggcgggcucaucacaugcuc

SEQ ID NO: 4139684 - RNA, 62 nt, Human
gagcaugagacuagcucaugagcagggaaaacccugccuauucgauuguugucuuaaaacuc

SEQ ID NO: 4139685 - RNA, 79 nt, Human
gagcaugggugccaggaagggggauccuuggaagccauucuggaaggcugcccaccacaccugcuccugcacccaccuc

SEQ ID NO: 4139686 - RNA, 58 nt, Human
gagcaugguacucacacugaucucuauccacuuugacauccuggaguauuccaugcuu

SEQ ID NO: 4139687 - RNA, 67 nt, Human
gagcauguuuacucuuuuaaaaaugaauugaaaugaucgauuguacuuuugucagguggacauguuu

SEQ ID NO: 4139688 - RNA, 88 nt, Human
gagcauuuucuugguauuuuguuugaugguguuuuggaguuuuuaguucacugagauauuuaaaucagacaaagaauggagaaugucc

SEQ ID NO: 4139689 - RNA, 77 nt, Human
gagccaaauccagcagcuggcuuacuugagaugcaucuggcaaauuccagggcaaagccagugacucccagcggcuc

SEQ ID NO: 4139690 - RNA, 56 nt, Human
gagccaacaggcaaccugcuccaaugauuuagugaggggguuguguggaagguauc

SEQ ID NO: 4139691 - RNA, 81 nt, Human
gagccaagacaaugaguggaaucaggccgugcguggggccaagauaaacugugcuaauguccugaccguucuggauggcuu

SEQ ID NO: 4139692 - RNA, 83 nt, Human
gagccacucuaguauauucucauuuuggcccagaggcauaaaaucgcaagggcagcaucguguggaaagugguagaaaggcuc

SEQ ID NO: 4139693 - RNA, 78 nt, Human
gagccacuuugaauagcacuuuauucaggaacuccaaaugccaauuuguuuucuacugugagguguguguucaagcuu

SEQ ID NO: 4139694 - RNA, 60 nt, Human
gagccagaaagugacuuuaaacucaggcaaccugacucuaaagccaacacuuuacugcuc

SEQ ID NO: 4139695 - RNA, 80 nt, Human
gagccaggaacccaacaacauagggcuaguuggaggugguuauucaugccagcagcugcuaugugguuuuucuaugguuc

SEQ ID NO: 4139696 - RNA, 61 nt, Human
gagccagggcucuccuucgcgugcugguuucuuucccagcaccuggacuguggccuggcuc

SEQ ID NO: 4139697 - RNA, 59 nt, Human
gagccaggguuugaaacuagacagaucagcucuagagacugcucuuucagccuuggcuc

SEQ ID NO: 4139698 - RNA, 56 nt, Human
gagccaugagauaguugguucgucgaaaacaauaacaaccaacagaaucaugucuc

SEQ ID NO: 4139699 - RNA, 73 nt, Human
gagccaugggguuuucggucauuuggccuggcuuauucucugccccaucaccagcuccgugagccucgggcuc

SEQ ID NO: 4139700 - RNA, 67 nt, Human
gagccauuguccaagccuguuucucuagucagccuggcaaugcagugugagcuugggcaacuugcuu

SEQ ID NO: 4139701 - RNA, 85 nt, Human
gagcccaaguuucuucaucuguaagauaagcaaauuuacuaaggucauggguaucuaguacaugauggacagagauuugaagcuc

SEQ ID NO: 4139702 - RNA, 77 nt, Human
gagcccaccaccugugcaaagacuggucaggacuugaacccugaaaggcccucugcaugggaggcugguggacguuc

SEQ ID NO: 4139703 - RNA, 59 nt, Human
gagcccagcccagagccauauguggccuccccaagagggcucacuggugggcugggcuc

SEQ ID NO: 4139704 - RNA, 86 nt, Human
gagcccaguguggauggccuuuccguguucugugaaggcgcuggcaacuccacagagcuggaaaggcugggccaugaacagggcuc

SEQ ID NO: 4139705 - RNA, 61 nt, Human
gagccccuccaguggcauaaaauuagguuuuaugacagauuuucaggcuccuagagggauc

SEQ ID NO: 4139706 - RNA, 61 nt, Human
gagcccgagcgcguacccggcggagcgcgcgcccgcccccgagugcgccugcgcggagcuc

SEQ ID NO: 4139707 - RNA, 56 nt, Human
gagcccucaaugaaucugcauuuuauagcauguacugugcaaguuucggggguauc

SEQ ID NO: 4139708 - RNA, 77 nt, Human
gagcccucagcccgguucccggcuggccuuggcccacacggucuggcccuggcuggagcccaggcuacacucggcuc

SEQ ID NO: 4139709 - RNA, 60 nt, Human
gagcccucagggcuggaaagccaggaagacucuuccuugggagcccagccuuaaggguuu

SEQ ID NO: 4139710 - RNA, 59 nt, Human
gagcccugcuuccaagggggcagaaggcaccuugccuuaugccucccugagagcagcuc

SEQ ID NO: 4139711 - RNA, 56 nt, Human
gagcccuggacuuuccuaaaaccgggaaaucccaggacaggacuagaccagagcuc

SEQ ID NO: 4139712 - RNA, 79 nt, Human
gagcccuggagauuggcaguagucucggcuaccccucauggugccgggguccgaauuacucgccucucugggacagcuc

SEQ ID NO: 4139713 - RNA, 75 nt, Human
gagcccuggggugucggggaggccacauguagcuugucuaagcaucugaggcccuacccugagccuugcaugcuc

SEQ ID NO: 4139714 - RNA, 59 nt, Human
gagccgaggcgcacagcucgggccccacgaugggccgcgagcgccgccgccucgggcuc

SEQ ID NO: 4139715 - RNA, 55 nt, Human
gagccgugccagcccugucucgccaucccagccgaggagggcagcgcgauggcuc

SEQ ID NO: 4139716 - RNA, 69 nt, Human
gagccuagcaugggucgcgucucuggauggaaggggucaguuccaguuuggacagacccugcuucacuu

SEQ ID NO: 4139717 - RNA, 57 nt, Human
gagccuagugagauggcgguagcuguggacacaguggcagccuuguucauuaugcuc

SEQ ID NO: 4139718 - RNA, 67 nt, Human
gagccuccagguggacaaaauggcuccagaaauuagggaucuggcaggccuugucaaucugagguuu

SEQ ID NO: 4139719 - RNA, 61 nt, Human
gagccucugaggaucugaagggaacaguggauacuguucagaaaaaaucuucauggugcuc

SEQ ID NO: 4139720 - RNA, 60 nt, Human
gagccucuggaucugaguuucuuguuuuucuuucaugccgagguggcucuuccugggcuu

SEQ ID NO: 4139721 - RNA, 79 nt, Human
gagccucuuacucaucccgaagucaucagucauguuuccaagagugugaguaauucagggagggagggagagagggcuc

SEQ ID NO: 4139722 - RNA, 61 nt, Human
gagccugagcaaugugauguuuucaauugauuucuaaauacacacagcucaguuuuugcuc

SEQ ID NO: 4139723 - RNA, 111 nt, Human
gagccugccugaucaucuucacugucaccuugcucauccucggaggaugaggacuuuucaucugaggaacuggcaaagauggcccugaauaaguccauggaugggcggcuc

SEQ ID NO: 4139724 - RNA, 92 nt, Human
gagccugcuggcucucaggcugguccccagggucacagucacuuuccaugggcaaggcuggagccugcagagccacauccugaggcagguuc

SEQ ID NO: 4139725 - RNA, 64 nt, Human
gagccuggggucucugacucacaguccagggcaccugugcugucucucuaggacacuggggcuu

SEQ ID NO: 4139726 - RNA, 76 nt, Human
gagccuguuauaugucagguguuaugcuaaguauucuuacauagaugacuucauuucauuugcacagugacagcuc

SEQ ID NO: 4139727 - RNA, 65 nt, Human
gagccuguucaguaaccuauaaaacacauuuaauauugauguuuuuccaugugcagaacaagcuc

SEQ ID NO: 4139728 - RNA, 130 nt, Human
gagccuucagaaaugaagacccauuaucccccaaagcaaggcgccacagugauugcaaagcgguagugauuuguaguuguggaugcugaaguugugugagauguugauucugaaccucuguuuggcaauc

SEQ ID NO: 4139729 - RNA, 70 nt, Human
gagccuucuaggaugucaucugcuacugguguccauuccaguugugucugucugcaucccuaugaggacc

SEQ ID NO: 4139730 - RNA, 88 nt, Human
gagccuugaauguguccucucuuaaucucaucuuuuacagggaagggcauugaggcugagagacauuaagagacacuugcucaaguuc

SEQ ID NO: 4139731 - RNA, 76 nt, Human
gagccuugcuggaauuuuucuaggauuuuuaugccaacuuaaacauuggagguucaagagaguauuccaugggcuu

SEQ ID NO: 4139732 - RNA, 80 nt, Human
gagccuuuuaaaguuucagaaacuuggucuaugggccuuuguucucuucugauuaaguaacugaacacuuuguauagcuu

SEQ ID NO: 4139733 - RNA, 97 nt, Human
gagcgaaauuuuggcccaugguuuuauuucucuauagcuagaaaacaagcccauuuuccagcuguagaugagaaaggaaggaagggcauguuugcuu

SEQ ID NO: 4139734 - RNA, 82 nt, Human
gagcgacgauggcuccuggaccgccuaugaagccggcgucugugacgaucuggagcagcagguggccaggggcaaccagcuc

SEQ ID NO: 4139735 - RNA, 74 nt, Human
gagcgagagagacaggaauggcauuaagaucugcuuuaaguacaguuaucugaaauguucucuuguuuugacuu

SEQ ID NO: 4139736 - RNA, 70 nt, Human
gagcgcagcggcuggaccagcguucaagcccaagcacaggccugcgagaaccuuguuccagccgccguuu

SEQ ID NO: 4139737 - RNA, 58 nt, Human
gagcgccagguagagcagcaaguugaguucccacuccaugcuggaggcgccggcgcuc

SEQ ID NO: 4139738 - RNA, 62 nt, Human
gagcggaagaaggguguucuugggacaucaaccccaagguauuucaaagcccacuuccucuc

SEQ ID NO: 4139739 - RNA, 75 nt, Human
gagcuaaacugcaaacagaaaagcuacuuugucugcuucuugcggccagagagcgaaccugugugcuaguugguc

SEQ ID NO: 4139740 - RNA, 73 nt, Human
gagcuaaggucacaagaagcaggaucuucauuugcucugcuaugaaaaacucugugaccuuaaacaaacgcuu

SEQ ID NO: 4139741 - RNA, 82 nt, Human
gagcuaauuuuuagcauauuuccaugaaggcagauuuuaucuuccauaaaugcuuagauucauagaaauggugaguuggcuc

SEQ ID NO: 4139742 - RNA, 112 nt, Human
gaauguagaagaaugugaaaauguauguaauuagucacuucugccuguuugguagaauauuggggccagaugggaagaagcaugacuucuccaugcuuugcugacuacaauc

SEQ ID NO: 4139743 - RNA, 83 nt, Human
gaaugucaugguaguuacucaaggcugauauaaggcagcucuuguugguuuaauuguugggagccuugaaguaccuuccauuc

SEQ ID NO: 4139744 - RNA, 77 nt, Human
gaaugucccuaucccugcccuccagaagcucccaguguugugggacucugauggauggacagggguagugaagacuc

SEQ ID NO: 4139745 - RNA, 70 nt, Human
gaaugucccugcaguugcugccuaaccagauugcaguucugcugggcugcagcuacuggagggaacauuu

SEQ ID NO: 4139746 - RNA, 93 nt, Human
gaaugucugaguuuccacagaauuuaaagcucuagacugaucuauuuuaguuuccaggcaggagcuaauucuuauggcuacuauagggcuuuc

SEQ ID NO: 4139747 - RNA, 60 nt, Human
gaaugugggcugugaagaggagggccucugcucugccccucuuaguagccuguuauguuc

SEQ ID NO: 4139748 - RNA, 67 nt, Human
gaauguuacuuugauuuuguccacacuuucuuuucuuucccaauggauagagucauagaaaucauuc

SEQ ID NO: 4139749 - RNA, 118 nt, Human
gaauguuagcacuagaguuguuaguacacaugcuaagucauaaaagaguaucacucuucagcagaggacuuuaaauuauaugacugugguggauuguauuaaaguucagcaaacauuc

SEQ ID NO: 4139750 - RNA, 82 nt, Human
gaauguuauuuuuuccuacaguuauauucuugauuggaccacaaaguuuuucauaauacuguacaugaaaaauaggacauuc

SEQ ID NO: 4139751 - RNA, 94 nt, Human
gaauguucauaaaauguaacuguucaucucuuagaaaguacaccaauuuucaacugguaugcuugcaagagaugcaaugacuauguucacauuc

SEQ ID NO: 4139752 - RNA, 84 nt, Human
gaauguuuuauguacucagaagauguggguagauagaagagaaaaugcagccuucugucuggcugucucugaguauagacauuc

SEQ ID NO: 4139753 - RNA, 100 nt, Human
gaauguuuuggcagaaauuuuucagauaucauuaauuuaguagcaaaaaugcuaugaaaugugaugauauuaugaaaguauaguucuacucauaacauuu

SEQ ID NO: 4139754 - RNA, 55 nt, Human
gaauguuuuucaaaccuguggcaugcaucauuucagcuaagggagaaaaacauuu

SEQ ID NO: 4139755 - RNA, 102 nt, Human
gaauuaauguuguagaggaaugucagcuucucagggaaaaguuuaaauaaagucaaaauaguguuuuuccuuagggguuacucaccuuuguacuaauaauuc

SEQ ID NO: 4139756 - RNA, 62 nt, Human
gaauuaauuugccaagguuaucuuguuauugaacaacaaugugaggccuugguaguuaucuc

SEQ ID NO: 4139757 - RNA, 85 nt, Human
gaauuacacaaucuguuuuuccauuugaaugaaacaucaugaacauugcgauuuuguuaaaugguaaaacuguguugugugguuu

SEQ ID NO: 4139758 - RNA, 67 nt, Human
gaauuacagccagaagaaugaaauguuuugaaccugaacagcccauguaauuucucuggggugauuc

SEQ ID NO: 4139759 - RNA, 61 nt, Human
gaauuagcuguuuugccauaagcgcuaagcugugcuguaagugcuaaguugacagcaguuu

SEQ ID NO: 4139760 - RNA, 88 nt, Human
gaauuaggcagguauucuccaguggucacguuauuuuuagaucuccaaaugauggagcuggaaugggccauuugaggccugcugguuu

SEQ ID NO: 4139761 - RNA, 57 nt, Human
gaauuagucaccuguggacuacucugucacgcauuggcaggucuucauguggcuguc

SEQ ID NO: 4139762 - RNA, 58 nt, Human
gaauuauagguuugcaugcuaacuaagcagaguugauguaugacccgaaccuuaauuu

SEQ ID NO: 4139763 - RNA, 77 nt, Human
gaauuaugucuugccuggcagucuuuauuaauauuggauccugcaguuauaaagauuguuauguaucuuuauaguuc

SEQ ID NO: 4139764 - RNA, 60 nt, Human
gaauucaagugcaaugguauaucuggauuuuccugccccaguuauuuuugccuugauuuc

SEQ ID NO: 4139765 - RNA, 82 nt, Human
gaauucacugugcuuguaguaaacacuauucugaucuucuacgugaagcuugggcaacauuuuacuucacagguaaguauuc

SEQ ID NO: 4139766 - RNA, 56 nt, Human
gaauucauuagggaagcuaucuaaauugguuagauuuuaugcuuucaaaugaguuc

SEQ ID NO: 4139767 - RNA, 68 nt, Human
gaauuccagcaggguagggguggaagggagugcaaaaacaugcagucuggccuugccuugucgaguuu

SEQ ID NO: 4139768 - RNA, 120 nt, Human
gaauucccaaugccaaguugcaauaauacauuuaaugcuuuuccuucaaauaagaaaucaauaguauuuauauaugagguuggggcaccagugucuuugcaauuuuccaggagggaauuu

SEQ ID NO: 4139769 - RNA, 64 nt, Human
gaauuccucugagcuaggagauuuaggagaucaugagcaaccacauuucuuuuucagagaauuc

SEQ ID NO: 4139770 - RNA, 62 nt, Human
gaauucuaccagggcaagaggggaaccagacagcugucaccucuaaugcccuuguucaguuu

SEQ ID NO: 4139771 - RNA, 71 nt, Human
gaauucucuguaggugccucugucuacaauugauaauguuauugauugguucagaugggaucugcgaacuc

SEQ ID NO: 4139772 - RNA, 77 nt, Human
gaauucugguuuugaaaugaaugguuggaaugcauuuucuuugauaaaauaugcacaaaauuuuagagcuagaguuu

SEQ ID NO: 4139773 - RNA, 101 nt, Human
gaauucugucuaguugauguaccaguccuuagauuuuacugccaaguugcuaaaaccauaugggguaaaauguaggagauacguacacacagacuuaguuc

SEQ ID NO: 4139774 - RNA, 84 nt, Human
gaauugauucaauggauguaugguuucuucugcacaacauuauguguugaagucaguucauauuuuuauaaggaguuauaguuc

SEQ ID NO: 4139775 - RNA, 55 nt, Human
gaauugcagaugauccccaaguuaggagcuccugcauggggcuauacugcuguuc

SEQ ID NO: 4139776 - RNA, 60 nt, Human
gaauugcucugccuggccagccugcauuccagcguuuacucugguggccuagggcaccuc

SEQ ID NO: 4139777 - RNA, 120 nt, Human
gaauugggaaugugcauagacuuuggauggaaguauggaauuuggaacuagauuuuuaaauuccaaucucacugguucuacaguuccuauuacuuacaaacucucuguuaugucuaauuc

SEQ ID NO: 4139778 - RNA, 83 nt, Human
gaauugugaagcauuuaauaugcuugauuaggaaaacacaagccacacccuauucagcauaaucaguagcuugaccacaaguc

SEQ ID NO: 4139779 - RNA, 80 nt, Human
gaauugugggcaaugucugucuauagccaugagaucagaacaacucuguuucauggggauaguauuuuucuccacaguuu

SEQ ID NO: 4139780 - RNA, 91 nt, Human
gaauugugggguguuagaaaggcuauuggaccaguuauuagaagaccugaaauaugguuucuagaccuuuugaugaauaccugaaugacuc

SEQ ID NO: 4139781 - RNA, 77 nt, Human
gaauuguguuuuuccuuuccuacuuguuggucagguucuuuuuaaucauaagaaggaaaauauuuaaaauauaauuu

SEQ ID NO: 4139782 - RNA, 58 nt, Human
gaauuguuagcugaucuugagugcauauuuucuauguacuguugcacacuaauaguuu

SEQ ID NO: 4139783 - RNA, 67 nt, Human
gaauuguugaggagacucuucaauguggaaaucaaaaccagcaauugaggguaaauuucaauaauuu

SEQ ID NO: 4139784 - RNA, 103 nt, Human
gaauuuaggauauuuauugggauagaaugguaccuugagaauugaaaaccaagccucaaaaucucagagcaucauuuucuuaguagaauuagacccuucuuuc

SEQ ID NO: 4139785 - RNA, 68 nt, Human
gaauuuaucuacguuaaguauggcaugcuuacaguacauuauugccugugauacuggaggauaaauuu

SEQ ID NO: 4139786 - RNA, 56 nt, Human
gaauuucaacaguccucaaaugguggguauuaccuuauuugugguaguugagauuu

SEQ ID NO: 4139787 - RNA, 73 nt, Human
gaauuucagugugucaguuucagcagggaaaucacaucuccagccucccuugaccucaagauccacugaauuc

SEQ ID NO: 4139788 - RNA, 91 nt, Human
gaauuuccuagauacucagagucauugcccuucuaucaguucaccaugcuagaaggccuagaguaagacauuuggccguaucuggaaguuc

SEQ ID NO: 4139789 - RNA, 82 nt, Human
gaauuuggucuucagugauuucuguugccagcaauaucuuauuuuuucaacuaggucaugagaaaucuuugaagguuguuuc

SEQ ID NO: 4139790 - RNA, 130 nt, Human
gaauuuggugagggagccagcagcucugauggcuaugucguugguguggaaguugguaucaaucacaagucgacugucauacacaagacaugcaucauugagggcuuuaaacguuucauaauccacauuc

SEQ ID NO: 4139791 - RNA, 57 nt, Human
gaauuuuaauaaagguuuaucaggcgcuuguuauggugcagaacuuuuauuaaauuc

SEQ ID NO: 4139792 - RNA, 65 nt, Human
gaauuuuagaauaugugggcuuuugugauuagcuucuuucacuuagcauaacguuuccaagguuc

SEQ ID NO: 4139793 - RNA, 94 nt, Human
gaauuuuuacagagugugagauguuugcagaccaggaggcuuucuugcauuuaugccucaggaaaugggucguuuuauaauucuugugggguuc

SEQ ID NO: 4139794 - RNA, 87 nt, Human
gaauuuuugagcggguaaaggucgcccucaaggugacccgccuacuuugcgggaugccugggaguugcgaucugcccgaccuuauuc

SEQ ID NO: 4139795 - RNA, 64 nt, Human
gacaaaacauuugcugcuaucugaagaguauauuccacacuucguuuuuaguagcaauguuguu

SEQ ID NO: 4139796 - RNA, 61 nt, Human
gacaaaacugagaucacacuguuagaauauagcugauugaggguuuggucccagguuuguc

SEQ ID NO: 4139797 - RNA, 86 nt, Human
gaccgggcgcgcggcgcccccggccgguccccgcccgaccccgcgcagggcacagaucggggcgcacgcguuacucguauccgguc

SEQ ID NO: 4139798 - RNA, 87 nt, Human
gaccguaucucuucucuuuugaugaccagcaugcucuagguucucuccugcuggcacguggaccaggagaaguuagcagauacgguc

SEQ ID NO: 4139799 - RNA, 69 nt, Human
gaccgucuucccauggggucuccuggaguuucuaggaggcucuggagagguucccaugggaggcugguu

SEQ ID NO: 4139800 - RNA, 69 nt, Human
gaccuaggcugcaccuaggauggcuucuggaacucgacccaccagcaguccuguguccagucauugguc

SEQ ID NO: 4139801 - RNA, 85 nt, Human
gaccuauauaauuaaguccuucaccuaauccucaauauuuucugcccuugagaugcaggagaugggacuguuuuuauaugcuguc

SEQ ID NO: 4139802 - RNA, 59 nt, Human
gaccucagauuuucccaggccaggucuaccacgaaggggccugaaauagcucugagguu

SEQ ID NO: 4139803 - RNA, 60 nt, Human
gaccucaguauuguucaggaugcagccaaaauccagcuccaucaucucaaagcugagguu

SEQ ID NO: 4139804 - RNA, 104 nt, Human
gaccucauccuccaguggccauuucuguaggaccuguuccuugccacuguuugcugauugauacaggcuucucacagaaaagggaucuccagaggauggugguc

SEQ ID NO: 4139805 - RNA, 84 nt, Human
gaccucaugccaccugcuguagccacugggcucagcccuggagcugagagcaucgcuggagauagacguggcagagaagagguu

SEQ ID NO: 4139806 - RNA, 64 nt, Human
gaccucgucccugucggaagggucaggccugggugccugggcuucuggaguggggcagaugguu

SEQ ID NO: 4139807 - RNA, 89 nt, Human
gaccugaacauauuuaauuugcucauugugauaggcuuggccaaaccacaagacugaaucucauaugaauaaauuagucuuuguuaguc

SEQ ID NO: 4139808 - RNA, 90 nt, Human
gaccugagaaaaaacaacuuugacccuuguucuuaaaaugcuuuaaccuugaaguugcuugagacuuaagaggucauguugcuuuagguu

SEQ ID NO: 4139809 - RNA, 77 nt, Human
gaccugcuggaccugccacccucucaaugcauuccucaaaucugucugcucagugggugagcuuggucuagauaguc

SEQ ID NO: 4139810 - RNA, 56 nt, Human
gaccuggauucaaauucagacucugccacuuaguugcuuuugaauuugggccaguc

SEQ ID NO: 4139811 - RNA, 73 nt, Human
gaccuggcccagcaacuucacugauuuaagccugcaaagcugaaugcugagaauggaguuguucugcuagguc

SEQ ID NO: 4139812 - RNA, 59 nt, Human
gaccugggguaagcuuggcaacaaugaaacaucuuuuccaggcuauucccuuuggaguc

SEQ ID NO: 4139813 - RNA, 78 nt, Human
gaccuguggcuccagcugcugccagccaagcugcugugaaacuagcugcugccagccaagcugcugccagaccagcuc

SEQ ID NO: 4139814 - RNA, 64 nt, Human
gaggaccuuuaguagaagugcaaaaauaagagucgcuuucaauguaucuucgcugcaggugcuc

SEQ ID NO: 4139815 - RNA, 70 nt, Human
gaggacgggggcacccacaaaugaggaaauggcagggucaaguugggcguuauggagugccccucccuuc

SEQ ID NO: 4139816 - RNA, 59 nt, Human
gaggacuguggcacauugguagggucugugccgucuacagggcuuaucugucacucauc

SEQ ID NO: 4139817 - RNA, 92 nt, Human
gaggacuuacugcucaauauuuagaaacuugguauggauggguuucugcggcaacacagcaaagcagauuucauuuaaaccuuucuguccuc

SEQ ID NO: 4139818 - RNA, 73 nt, Human
gaggacuucgggugcuuuuagauauguagcuucuagccauauuaucuauuuaaaagcauacauacccuuccuc

SEQ ID NO: 4139819 - RNA, 90 nt, Human
gaggacuugaggaccugucuggacaaaggacucacaggauguuagauuuagauucguauauuaggauuuuguccaaguagcucaugccuc

SEQ ID NO: 4139820 - RNA, 91 nt, Human
gaggagaaacacacaagaucugugaauagauugaagcuuuggucaagaaauggagguuguauguuugauuugaaggucuugaguucuccuc

SEQ ID NO: 4139821 - RNA, 85 nt, Human
gaggagaaacccauauacuucccugcagaguaaagagaaugcgcaauugcuuuugcuaaagggggaaauagauuugggucucuuc

SEQ ID NO: 4139822 - RNA, 63 nt, Human
gaggagaauuuggugaaagcuuugccuggcuagaucucaggcuggaaaucacuagauuccuuu

SEQ ID NO: 4139823 - RNA, 86 nt, Human
gaggagagaaaaagcuggcaaggcaauuuggauuaugcuucagaggagaaaaaguugaucuuucuguacccuugucaucucuccuu

SEQ ID NO: 4139824 - RNA, 78 nt, Human
gaggagaguaccauugggccgcaccagaacuaauauuaaugaaugccuuacacuacgcccaaaugcagugcuuucuuc

SEQ ID NO: 4139825 - RNA, 74 nt, Human
gaggagaugacucugugggaggaggcucagccguagucuggauggugaugcucuguucuacgcacaguagccuc

SEQ ID NO: 4139826 - RNA, 60 nt, Human
gaggagauggguagguaagaggguuagaacaaauugcuuccuuuaguuacacguuuccuc

SEQ ID NO: 4139827 - RNA, 68 nt, Human
gaggagcagggcuuugcagacuugggcgauuccaucaauuuauuguccuuuuguaaacccugcugcuu

SEQ ID NO: 4139828 - RNA, 80 nt, Human
gaggagccaagguauguguguugugguuugaccuccugaauccuacugagccugaaaacuuuacaucccuuggcauuuuc

SEQ ID NO: 4139829 - RNA, 59 nt, Human
gaggagccaggaggucucccugcuccaaucugccuaaggcuuccucuuccugccuccuc

SEQ ID NO: 4139830 - RNA, 73 nt, Human
gaggagcuagguguggggcugugguguucuucugcugggagugugggggacgcagggccccgcguagcgguuc

SEQ ID NO: 4139831 - RNA, 58 nt, Human
gaggagcucuucuaaagauggcaaugaggcaacuuaagugcuaccaaaagaauuccuc

SEQ ID NO: 4139832 - RNA, 72 nt, Human
gaggagcuggcugucgggaggcagggaucagaccccucaagggcauccacaggccuccgacccuggcuccuu

SEQ ID NO: 4139833 - RNA, 61 nt, Human
gaggaggaaguucucuguaggcugcuauuuuucaucagccugagagaugugcuuuuuccuc

SEQ ID NO: 4139834 - RNA, 61 nt, Human
gaggaggaccugaaauucuugcuuuucacagugcuaugauaagcauuauuagauccuguuc

SEQ ID NO: 4139835 - RNA, 83 nt, Human
gaggaggacgugaacugaugggaauuuccacuaucuggguuuaaauccuggcuggaauuucucacucuuuccauuuccauuuc

SEQ ID NO: 4139836 - RNA, 74 nt, Human
gaggaggagguggaugccuaggcugggcaucucucaaaacccugccccggagcacacagucuuccuuccuccuc

SEQ ID NO: 4139837 - RNA, 57 nt, Human
gaggaggcacuugagcagauguuagcuauucucccuagccugugcacauguguccuu

SEQ ID NO: 4139838 - RNA, 58 nt, Human
gaggaggccugucugggaggccuccaagggaggagguacaccucagcagggcucacuu

SEQ ID NO: 4139839 - RNA, 58 nt, Human
gaggaggcuaucagcaaucagguacacaucaaccauauggcugucauguagucucuuc

SEQ ID NO: 4139840 - RNA, 99 nt, Human
gaggaggcuuucuggaggaggugacaaugcucagagucccuucccucgugguggcgcguuuccccgcggggcgugggcucuuaccugcuccuccuccuc

SEQ ID NO: 4139841 - RNA, 67 nt, Human
gaggagggcaggggaccuuccucagcucagcaccaacagccgcccugcagagagcccugccuuccuc

SEQ ID NO: 4139842 - RNA, 58 nt, Human
gaggaggggcacuugucuccuaguccgccaggaugaaggaacaagggagccuuuucuc

SEQ ID NO: 4139843 - RNA, 56 nt, Human
gaggaggggccggcacgcaguccuugaaagugggggcuguugcccgccgccucuuc

SEQ ID NO: 4139844 - RNA, 124 nt, Human
gaggagggucuaguucugggaggcggggcuauggguggagcuccacaaccuguuccugaggcuccuacaguugucaaagagcaccggcuaccccaaggccuccugacaaaagcucgacuucuuc

SEQ ID NO: 4139845 - RNA, 66 nt, Human
gaggagggugacaggacagagaaaugaccugcucugcagguaaauuuucaccugucgguucucauc

SEQ ID NO: 4139846 - RNA, 71 nt, Human
gaggaggguuagccuaaguggagaaaugaauggcuuacaacaacgauuucuagacuucaggcauucuccuc

SEQ ID NO: 4139847 - RNA, 61 nt, Human
gaggagguuccggguggagaagugcugugccacuggcagcugccacccugggagcucacuc

SEQ ID NO: 4139848 - RNA, 102 nt, Human
gaggaguaaagacacuucgguuuccuccuagccuccagccgcggacccucgcgggcgucccugcggcuuggugguugggagagacggaggcacuuuucccuc

SEQ ID NO: 4139849 - RNA, 60 nt, Human
gaggaguagaagggcaggaggggggacuccgugugccccagaacugucugcugcuuccuc

SEQ ID NO: 4139850 - RNA, 57 nt, Human
gaggagugacauuaagguauuacauccuauguguauacaugcuuuauguuauuucuu

SEQ ID NO: 4139851 - RNA, 62 nt, Human
gaggagugugggaauucaguccauaaacccuugguuucuucucgcaggacucccagcuccuc

SEQ ID NO: 4139852 - RNA, 78 nt, Human
gaggaguuucuggcucagugcugaggaaaguugaaacccauuuggccuucagcuuuucagcacugcuaguguauccuu

SEQ ID NO: 4139853 - RNA, 65 nt, Human
gaggaucaggcauugagaaggauggcuaaagaacuugaaaacuagucaccauuuucaccugccuc

SEQ ID NO: 4139854 - RNA, 86 nt, Human
gaggauggcuugaggccaggaguucaagguugcagugagcuaagauggugucacugcacuucagcuugggcaacaaagcgagacuc

SEQ ID NO: 4139855 - RNA, 81 nt, Human
gaggauucaagaggagaaaggcuggcuuugaagauggagaaagugccacaaagcaagaugcaguuucuccucuagagccuc

SEQ ID NO: 4139856 - RNA, 87 nt, Human
gaggauugcuugagcccaggaguuggaggcugcagugagcuaugacugugccacugcacuccagcccgggcaauaaagugaggucuc

SEQ ID NO: 4139857 - RNA, 67 nt, Human
gaggauuuaucuuuccgccgcuuuucuaccugccuaacaagcuggaaguggcagaaaaugaacacuu

SEQ ID NO: 4139858 - RNA, 72 nt, Human
gacuccagagugcauucguaugaacuguauguucggggcugauguuacaguauuaugagugauugaaaaguc

SEQ ID NO: 4139859 - RNA, 56 nt, Human
gacuccagccagagugccucuguucaguaguuuuaacagucguaucugucuggguu

SEQ ID NO: 4139860 - RNA, 59 nt, Human
gacuccccauccaggcagcaggugcucccugggcacuuacccugccaggcaugggguuc

SEQ ID NO: 4139861 - RNA, 87 nt, Human
gacucccucagcccaguuaagaaccuguuacucuuguuuauuagagucccaugaacagugguuuuuaguacagggaaagaggaaguu

SEQ ID NO: 4139862 - RNA, 92 nt, Human
gacuccuagaccaucuugccacuugguccucacucccugugccuuucccagccagaggccagcagacgugggacugaaggcaggaaggaguu

SEQ ID NO: 4139863 - RNA, 89 nt, Human
gacuccuauggcaggugugucucccaagaaggcccaccccugugagauguguggcccgaucuugggagacauuuugcauguggcagauc

SEQ ID NO: 4139864 - RNA, 73 nt, Human
gacuccucagagagaaucuuggcagcugagccugcccaagguucagugcacccaauucucuccaucuggaauc

SEQ ID NO: 4139865 - RNA, 123 nt, Human
gacucggguaaguuccaaaagagcuauguauuugcuaaaaggccauugauuuauauugaaacucaaugaaaauaauguuauuuuuagacaagggaguaauauugcccuuaacuuaccuguuuc

SEQ ID NO: 4139866 - RNA, 60 nt, Human
gacucuaggcugcccaggagcugagcgguauagagguugagagccuggcagccuggguuc

SEQ ID NO: 4139867 - RNA, 71 nt, Human
gacucucaaaagugcugggauuacaggugugagccaccacgccuggccuaaauuaguaauuuucaagaguu

SEQ ID NO: 4139868 - RNA, 97 nt, Human
gacucuccguaggauuuucugggaacugagcuccccuaggacaaucagguucuugcucuugggaauuagggagcucaguccucagauuuucucuguc

SEQ ID NO: 4139869 - RNA, 78 nt, Human
gacucugaggaagauacuguuccucuguguuucagaugaaggcauugaggcucagagaacagugacuugcccaagguc

SEQ ID NO: 4139870 - RNA, 80 nt, Human
gacucugcucucacuguucacccagcacuagcaguaccagaugguucuguggaguccuggggaauggagagagcacaguc

SEQ ID NO: 4139871 - RNA, 76 nt, Human
gacucugcuguucauuauuguuguguagugcaguggcuuacagauagcaacauaacaaucauaggacauagcaguc

SEQ ID NO: 4139872 - RNA, 77 nt, Human
gacucuuauguucagaaguagcuccccuucauuagaacagaaauuacugaguggauaggaauugcuuuagaugaguc

SEQ ID NO: 4139873 - RNA, 71 nt, Human
gacucuugauuaugggauggaagaaauuagcauuaugaauuuucucugugccauuuccauaauuaauuguu

SEQ ID NO: 4139874 - RNA, 67 nt, Human
gacucuugugaaacauggcaaguuugggcucuguggcuuaagaaaugucuaguuuuugucaaaaguu

SEQ ID NO: 4139875 - RNA, 62 nt, Human
gacugaacaguaagaggcuuuaugaauauauccaggugaaagccuuauuugucucaucaguc

SEQ ID NO: 4139876 - RNA, 61 nt, Human
gacugaaccucaaauuuggcucuaaacuucuuggcagcccaaaaaagagguagauucaguu

SEQ ID NO: 4139877 - RNA, 78 nt, Human
gacugaagggaaguuaaucguucacuuuuguuggguauuaaacuauugauaacaguaccauuaacuuugauuacaguc

SEQ ID NO: 4139878 - RNA, 58 nt, Human
gacugaagugauguggcuaaggggccaguuuggaucccggcuucauuuucuucugguu

SEQ ID NO: 4139879 - RNA, 65 nt, Human
gacugaaugcaugagcaggaagagcacaaagaggaugccucugagcuccuccugcucuguaaguc

SEQ ID NO: 4139880 - RNA, 67 nt, Human
gacugagagcguguacaaacuuauuuugaaucugaagccuaauggguuguauuuaugccucuuuguc

SEQ ID NO: 4139881 - RNA, 56 nt, Human
gacugagccugagguuuuggagcuggacaggcucagcuuugaauccuggcucuguc

SEQ ID NO: 4139882 - RNA, 72 nt, Human
gacugaggagguggagucaugcagaggggcugaaaguuuuacagcagcugcugaugaggccaccccacgguu

SEQ ID NO: 4139883 - RNA, 91 nt, Human
gacugagguccaggcugaccccuagaggacaugccccagcacaguuugggccaaaccuuucccuagggucucaacgucggacaaaccaguc

SEQ ID NO: 4139884 - RNA, 87 nt, Human
gacugauggguggcaccaggcgggguggcuguccaaagccaucacauggacagucuuugcaaaguccuggugcagauccuaaacguc

SEQ ID NO: 4139885 - RNA, 93 nt, Human
gacugauuucugccuugccucguuucuauguuuucuccuuuauuucagaaauacagagaagggguagaggauggaggaaagggaaaaucaguu

SEQ ID NO: 4139886 - RNA, 83 nt, Human
gacugcaagcaggcuagauugaagggcuggucauacuuucaucaccccaugucccgcagccuggccaguuucaccccauaguu

SEQ ID NO: 4139887 - RNA, 78 nt, Human
gacugcaaggaggugggguaucacuuaauguaauaauccauccuauaaaaacauuuauugacccccuccuugucauuc

SEQ ID NO: 4139888 - RNA, 59 nt, Human
gacugcauccuggaaauagcuaagaucagauuaccucuuggcagaauccaaugcacguu

SEQ ID NO: 4139889 - RNA, 58 nt, Human
gagauggauuauauguggaccauggaaaaugagguucguggcugugggcaucuguuuc

SEQ ID NO: 4139890 - RNA, 63 nt, Human
gagaugggaaaucgccaugggguaacggcagccgccucaaagucauucgauuuccucuaucuc

SEQ ID NO: 4139891 - RNA, 99 nt, Human
gagaugggaggauugcuugaacccaggaggcagaggcugcagugagccgagauugcacugcugcacuccagccugggugaaggagcaagacuccaucuc

SEQ ID NO: 4139892 - RNA, 96 nt, Human
gagaugggaggauuucuugagcccaggagguggaggcuaaagugagccauaaucacaccauugcacuccacccugggcaacaagaguuuuuaucuc

SEQ ID NO: 4139893 - RNA, 69 nt, Human
gagaugggcagaucacuugaagccaggaguucaagaccagccuggccaacauggugaaacccccaucuc

SEQ ID NO: 4139894 - RNA, 57 nt, Human
gagauggggggcaagggcuggccgaggaguccugaggcagucacccccuccugcuuc

SEQ ID NO: 4139895 - RNA, 68 nt, Human
gagauggggucuugccauguugcccagcuuugucucaaacuucuggccucgagcaauacucccaucuu

SEQ ID NO: 4139896 - RNA, 61 nt, Human
gagaugguugcaauaguuuaaacgucaguuugucugcguuuauccaacucuguaaucucuc

SEQ ID NO: 4139897 - RNA, 59 nt, Human
gagauguaagaggacuucaggaugcacagugcccuuugaggucccugccuugccuucuc

SEQ ID NO: 4139898 - RNA, 98 nt, Human
gagauguagauauggacauagauauagauaaaugaagauggugggcuauuuuagucaggaugcuauuguuauuaaucucugcuccauacugcaagcuc

SEQ ID NO: 4139899 - RNA, 125 nt, Human
gagauguauccauaauaagcccuguaacauuuaaaccaacuuguaaaugccuuuccaaaggcagugcuaccccggaaguugguuggagaauugcugaauuugcuacuauuggggaaaaacauguu

SEQ ID NO: 4139900 - RNA, 104 nt, Human
gagaugucaggugguggugauacucagccgaggcagaggcugaaacggcugcgccacaggcagccaaaaguuuuugcuuuguguauuuucaccucauugcucuc

SEQ ID NO: 4139901 - RNA, 95 nt, Human
gagaugucauuguuugcugcuguagcuaggcuuucuguuaaaaaucacagcaugaggcuuaaacugcugcaaccauuauccagugcuaacauguc

SEQ ID NO: 4139902 - RNA, 56 nt, Human
gagaugucuuaucgugaggaaaaagaaacuuccuuuuguucacauuuaggacucuc

SEQ ID NO: 4139903 - RNA, 88 nt, Human
gagauguuuaauuggguuuccuggcauuuuuuuaaugaaauuuuuuguggcuuaaaaaugcugugguagcuguguucauaaauaucuc

SEQ ID NO: 4139904 - RNA, 125 nt, Human
gagauuaagaaaaaaaaauucuauuuuuguuguaauguccucgcggcucuggggacgcuaaaagaaccgggccugccccgcccugcgcggggauaacgaaagcugaguguuuuucccuuuuuuuu

SEQ ID NO: 4139905 - RNA, 100 nt, Human
gagauuaguuaggacucuauuggaauaguuuagaagaagcuaaauauuuacugagcuuuguuauggcuuugcuuuggcuguuucaguccugcuuaguuuu

SEQ ID NO: 4139906 - RNA, 98 nt, Human
gagauuaguuuauuuuacagacuaaacagccuaaaacuuucuuucuucccacuauuauuccuugaggaaauaggcugcaagcuguauuuucuggucuc

SEQ ID NO: 4139907 - RNA, 60 nt, Human
gagauuauucugcacuuuuaaaauaugcucagcuaugcaguauauaugcagguuaaucuu

SEQ ID NO: 4139908 - RNA, 68 nt, Human
gagauucuuuuggggaucucauuaacaguuucuucuguuugugggauggcucuucccaaaggggucuu

SEQ ID NO: 4139909 - RNA, 68 nt, Human
gagauugcaugcuuuuucaaaugugcauuucuaugguggugugcauuuggaacugggcaugcaaacuu

SEQ ID NO: 4139910 - RNA, 76 nt, Human
gagauugucuccuagagccuccagagggagagugacccugcugucaccuugaugauggccuagcaaaacugauuuu

SEQ ID NO: 4139911 - RNA, 83 nt, Human
gagauuuaaggaacuggcuuacaugauuguugugugucuaucaaguucaaacucuguaggacaguucaacagacuugaaacuc

SEQ ID NO: 4139912 - RNA, 82 nt, Human
gagauuuauccauaucauuaaaaucuauccauagaauagcaccuaaaugcuggcaggauuuuuuugguggggauggaugcuu

SEQ ID NO: 4139913 - RNA, 67 nt, Human
gagauuucaaggcaaaagugacaauuagugguagcaacaccuuugggaauuuacugccuaaaaucuc

SEQ ID NO: 4139914 - RNA, 82 nt, Human
gagauuucauugaaguuaauucuucgucacuauuguugguaaauuaagaguuuuuaggaagcaguuucuguaaugaaauuuc

SEQ ID NO: 4139915 - RNA, 83 nt, Human
gagauuuccuuaauuuaagccuagaaugcagcuuugaguuacaagcugcauucuaggcuuaaauuuacuuugaaggaguaauc

SEQ ID NO: 4139916 - RNA, 88 nt, Human
gagauuucucagaccacugaugccaucucaccuuugagaugcuuacaagaucauucuagcucagcaggugggacagguucugagucuu

SEQ ID NO: 4139917 - RNA, 69 nt, Human
gagauuuuuaggaaaugacuuggugcuucguuucuuugggggaagugagugauuagguuuuuccuucuu

SEQ ID NO: 4139918 - RNA, 71 nt, Human
gagcaaacauccugacuguaacuaagagacuuuugcuacaaauucucucuugggagucagugauaagguuc

SEQ ID NO: 4139919 - RNA, 106 nt, Human
gagcaaacuguccagaugccuguguggucugcgcauuaagguauuuuguaauucucuaugauccaagcugaccacauaugguuucugauacuuacagggaguguuc

SEQ ID NO: 4139920 - RNA, 92 nt, Human
gagcaaagaguuagcagaugaaaccacagguguuuuuacucagaagaacaugaggggaagacuuagucgguucaaugcuucauuucuuccuc

SEQ ID NO: 4139921 - RNA, 62 nt, Human
gagcaaagcaaggccggaaggaaacucuccagaagaugaguaagagcuggcuuuggugucuu

SEQ ID NO: 4139922 - RNA, 64 nt, Human
gagcaacacugugaucuugagaaagguuuuuaaaauccaccucacuuucgcugugugaaugcuu

SEQ ID NO: 4139923 - RNA, 60 nt, Human
gagcaagauuaaaaggcuggguugugaucacacucacucucauuuuuucagucauuguuc

SEQ ID NO: 4139924 - RNA, 69 nt, Human
gagcaagguccugacuccacguucuagaggccacuuggccgauuggagacccuuggagucaaccuguuc

SEQ ID NO: 4139925 - RNA, 71 nt, Human
gagcaaugauuuggauaggccugaacuuaaaccaaguugucaccucuauucaaaucucauucagauugcuc

SEQ ID NO: 4139926 - RNA, 77 nt, Human
gagcaauucaauucaccuaguagaacccagcagcucccagccuguguggggauuaugagguagaaguugggcugcuu

SEQ ID NO: 4139927 - RNA, 126 nt, Human
gagcacacaucaagcgagucuuuuucuuuaggauacugaaaaaugaaccaacagugcgaauuucaauguuuuaguucacaguuuuauaccugagaggacaaaugccugaaagacaguguaguguuu

SEQ ID NO: 4139928 - RNA, 64 nt, Human
gagcacaggaagucuuugcccaggccagagaucucugugccugggaucagaauucccucagcuc

SEQ ID NO: 4139929 - RNA, 71 nt, Human
gagcacaguccuuuuguuaaaauuauuuuuugcuuuaaaaugcuugaguuagggauagagggauaguguuc

SEQ ID NO: 4139930 - RNA, 65 nt, Human
gagcacauguggagagucugggcccaguccuugcucugggaucugccucauucucgcguguguuu

SEQ ID NO: 4139931 - RNA, 89 nt, Human
gagcaccugccagacacugugcaaaggccucuacccccgacuucaggugguacacaggcagcccagugcugggaaaacagucugugcuc

SEQ ID NO: 4139932 - RNA, 59 nt, Human
gagcacgcucuauuuaggagaauucuauuuaauuugaucuccuaacuauaaaguggcuc

SEQ ID NO: 4139933 - RNA, 56 nt, Human
gagcacggaguaaggaauuccuucugaagacuggauuuggauucugcugccugcuc

SEQ ID NO: 4139934 - RNA, 86 nt, Human
gagcacucucauaguuccuuaagaucagaacuuuauacaggaaaaaguucccuuuacauaaaguuugauuuggcuggagaaagcuu

SEQ ID NO: 4139935 - RNA, 68 nt, Human
gagcacuuagaugcuaugaaugguauuucacugccauuaaaaggaagcauucuuugaaaaaaguguuu

SEQ ID NO: 4139936 - RNA, 63 nt, Human
gagcagaaacagcccuaguacagccugugacauuuacaacaugagguuuaucuguuucuucuc

SEQ ID NO: 4139937 - RNA, 69 nt, Human
gagcagacacugagcauuuuccuagcucucugcugacacagagcagucgcugaugcuaguguucuuuuc

SEQ ID NO: 4139938 - RNA, 77 nt, Human
gagcagacagacacuauuguguauaaaucaacuguaucuaagaugauguguagauaaauagguuaaauagaaugcuc

SEQ ID NO: 4139939 - RNA, 77 nt, Human
gagcagaggcaagcaaaggcaggacugcagcauaggccuaugggcuuggccucuguggcccugacucucuucugcuu

SEQ ID NO: 4139940 - RNA, 61 nt, Human
gagcagagucuuggcaggcccaugacagugccuugcaaaguccggcagccuggacaugcuc

SEQ ID NO: 4139941 - RNA, 72 nt, Human
gagcagaucacagagccuccaggagugcuggcuccucccuggcaucccagccucccugaggcucauaggcuc

SEQ ID NO: 4139942 - RNA, 103 nt, Human
gagcagauggaaauucuaucuagagcucaggguggaucagagucagcccacagcuuggcucccaccuccagccugaguuccaggugcuuguguccagcugcuc

SEQ ID NO: 4139943 - RNA, 73 nt, Human
gagcagauggguugggggugggaguggugagaaaguggagcccaucaaauccaggccccagaccguacugcuc

SEQ ID NO: 4139944 - RNA, 61 nt, Human
gagcagcacacaaagcccucaaugagcaagaaagaacagcucguaaggcaagugcugcauc

SEQ ID NO: 4139945 - RNA, 61 nt, Human
gagcagcaucuccggcuuaaagggaaacucucuaaguuccgggcagccgggagagucguuc

SEQ ID NO: 4139946 - RNA, 71 nt, Human
gaguauagggauaagaauuaaauucuuguuuucaaaggugagaagcaagaaaaucucuguccaaugggcuc

SEQ ID NO: 4139947 - RNA, 82 nt, Human
gaguaucucuguucuuacggaacuuaucuuuuaagguauugaauuuaauuugcuuuuuagaaaguuguucaguaagaaacuc

SEQ ID NO: 4139948 - RNA, 82 nt, Human
gaguaucugcuucacguugugccuuguuggcugacagacauaucuuagcaucucacaaaacgaugaggccaucaagaaacuc

SEQ ID NO: 4139949 - RNA, 81 nt, Human
gaguaugacaugcuuaagggaaguagagaagagucugcauuucuguagucuccuuaaauauuucccagagcaaacuuacuc

SEQ ID NO: 4139950 - RNA, 69 nt, Human
gaguauggagcaggagcccaggagcccacaaccaaacccacagggauucuggcuccgagcuccaucuuc

SEQ ID NO: 4139951 - RNA, 87 nt, Human
gaguauuaaaugagugaguccauagaaagcauauaucugccagguucuaugcugaaaauuggauuugaauagucucauuuaaucuuc

SEQ ID NO: 4139952 - RNA, 87 nt, Human
gaguauugcauagaggaaccagacugccuggguucagaucucagcucugccacuauuaauagcuguguguccuugggcaaauuacuc

SEQ ID NO: 4139953 - RNA, 83 nt, Human
gagucaaagguugcaugguauaugaccauguuauuugcaguguauguuaauaauguacauacauauuucgugcaaccuggcuc

SEQ ID NO: 4139954 - RNA, 129 nt, Human
gagucaaagugaaauuguguugagaagcugguaaugaaaguggcuguucuugccccaugcugugcaggugcccccaguugcagggacacccacuuccacguuucucagcuguccuucuuuucuuuauuc

SEQ ID NO: 4139955 - RNA, 66 nt, Human
gagucaacaagucagaucucacaggaaauucugagagcccagcacaucuggccuugaaaauggcuc

SEQ ID NO: 4139956 - RNA, 59 nt, Human
gagucacaaaagaugcccagggucaguuucuaguccuuccuuuugcaucugugugacuu

SEQ ID NO: 4139957 - RNA, 71 nt, Human
gagucacagaauaaauugguaucagagucuaauucagaaauaaugucuguucugauaccauacucugucuc

SEQ ID NO: 4139958 - RNA, 78 nt, Human
gagucacguuaauucucuugguuuugcugcaauguauuaugacucugucaggaggguccagagaaaacaaugugauuu

SEQ ID NO: 4139959 - RNA, 113 nt, Human
gagucacucugccaccuuuuggcuguacguaggaauugcaccuuuucuggcauuccccucauccggagaggaccugcaacucgcucuacagaccuagggcagcagcaucauuc

SEQ ID NO: 4139960 - RNA, 72 nt, Human
gagucacugccugauguggugaauauuuugaggccaaaaauuucccccaaauauuccugccauuaaugacuc

SEQ ID NO: 4139961 - RNA, 62 nt, Human
gagccacagccugacuuaacuguccuuuuccucuccagaguacagucagugcucuguggcuc

SEQ ID NO: 4139962 - RNA, 76 nt, Human
gagccacaggugggcucugggaaauaggaguagcuugguucugucauuuaccuuucccugagccacaggugggcuc

SEQ ID NO: 4139963 - RNA, 72 nt, Human
gagccaccacagagagcuguaauagucaugucuggggaauucuaggcauucuguagcuguuugcuggaguuc

SEQ ID NO: 4139964 - RNA, 76 nt, Human
gagccaccgaaucagaaacuugggggaagggggcccagcaauuuguuuuagccgcccuccaggugauuccgugcuc

SEQ ID NO: 4139965 - RNA, 66 nt, Human
gagccacgagcuguaauugcugcuguccuucuaagcaggggaaaagcagaccacgcuuuguggcuu

SEQ ID NO: 4139966 - RNA, 75 nt, Human
gagccagaaacuguggauucauuaaauucaguuuuauucucuucagaguuuaauguuuauaguuucauucaguuc

SEQ ID NO: 4139967 - RNA, 59 nt, Human
gagccagaaugacccaucaggcugcaccucucuggccuguaaauaguuucuucugacuc

SEQ ID NO: 4139968 - RNA, 97 nt, Human
gagccagcagcccacaguuaauucucacuuggauaucacucagaaagauacucugaauaacuuucugguaugucuagcaacugggggcuaauaacuc

SEQ ID NO: 4139969 - RNA, 85 nt, Human
gagccagccaggcagccuuacauggacaucucagggacaugguauuuaugagaugagguauccagugaagcagccaugcaagcuc

SEQ ID NO: 4139970 - RNA, 104 nt, Human
gagccagcgugcagugucuggaaaaucacccgcagcccaggcccuucugcaaaggauggggccuggaagggccucgggcgugggaccgcacuccgcucgggcuc

SEQ ID NO: 4139971 - RNA, 63 nt, Human
gagccagcuggagacuggcagggguacugacacuucuccagccucaucuccuggcugucccuc

SEQ ID NO: 4139972 - RNA, 62 nt, Human
gagccaggagauaccuaaggggcuugucaacaccuaaugcugucucuccuucuccuuggcuc

SEQ ID NO: 4139973 - RNA, 55 nt, Human
gagccaggagcagagagcccugcaucuugccuggggccccuuguaucucuggcuc

SEQ ID NO: 4139974 - RNA, 57 nt, Human
gagccaggcaguuugaaggcuuccuucggguagaaaaaauuacacuagccuugguuc

SEQ ID NO: 4139975 - RNA, 70 nt, Human
gagccagggcaugucugcggcccaggccagggcgcagugugugcccugggggcccaggccugcauggcuc

SEQ ID NO: 4139976 - RNA, 91 nt, Human
gagccagggccccgaucccaggcugggcggggaaccuggaugcugccugcccaccaccgcccacaccugaccucggcguccuccugagcuc

SEQ ID NO: 4139977 - RNA, 96 nt, Human
gagccagguguauuucacagcuuguuuuguugaauacuuaagaaaccucuuacaucuauuugacagauacaguaaugaagauuuagagacuuguuc

SEQ ID NO: 4139978 - RNA, 95 nt, Human
gagccagugaaauuauagucaaacugcaugaagcugauuuuagaaccacauuuucuuaaaauggagguuauguagguuacauguuuuacuggcuc

SEQ ID NO: 4139979 - RNA, 55 nt, Human
gagccauuauguaugguauaugcuaaaauccuagaauauagagucaaaauggcuu

SEQ ID NO: 4139980 - RNA, 74 nt, Human
gagccauuauuugauaguaugacagggcagcauuucauggacuuaaguguuguuugcucuucaaauauaugcuu

SEQ ID NO: 4139981 - RNA, 91 nt, Human
gagccauuccauacaugguuguauuuuguuaugcuacugcacagaguuucuguuguauguaguuucacaaaauauagcuuuuguuaaucuc

SEQ ID NO: 4139982 - RNA, 107 nt, Human
gagccauuuugaauucuuuaaagaagaaacguuggcauaaguuuaugcucugguguauaaaguuucugcuuguuuuucccccagucuuuguugaauuuaaauggcuu

SEQ ID NO: 4139983 - RNA, 76 nt, Human
gagcccacagugugacugaccuucagccaggguccuccugucaccugcggaagguacaguacaccuguggagucuc

SEQ ID NO: 4139984 - RNA, 61 nt, Human
gagcccagcaaggaccaagggccgggaugcccaggcucuuccauccugcugaggaacccuc

SEQ ID NO: 4139985 - RNA, 80 nt, Human
gagcccagccucagcugccaccucugccuuuggggaacccaaguccucaggcugcccugacagcccccgaugcugggcuc

SEQ ID NO: 4139986 - RNA, 55 nt, Human
gagcccagcuguccuuggcaaacaccccacagaggaggcgagggcuugcuggcuc

SEQ ID NO: 4139987 - RNA, 73 nt, Human
gagcccaggaaaugccccguggugggagggcaggcucaucaggagcuccuggcacagcaggguuccugggcuc

SEQ ID NO: 4139988 - RNA, 118 nt, Human
gagcccaggagcagcaucugacucuaugcucccuuagugugccugaggcagauaucacuaaucgaugacugcagucuucuacauugagcuuagaagcagcaucugacucuguaugcuc

SEQ ID NO: 4139989 - RNA, 79 nt, Human
gagcccaggcaguuccgagccucgugugucagccacggagagaaugcggccagccaggguuuagcaagccuacaagcuc

SEQ ID NO: 4139990 - RNA, 74 nt, Human
gagcccaguauguuugaaauguaauaaaggcuaaacagacagcuguuauguauugcacaaacuuucuguggcuu

SEQ ID NO: 4139991 - RNA, 68 nt, Human
gagcccagugguggcugugcuuugcugucaggacugacaguagaagaugcuguuacagaacugagcuc

SEQ ID NO: 4139992 - RNA, 55 nt, Human
gagccccaauaacagcugagaugaauuuccaaucagcucagcaagauggaggcuc

SEQ ID NO: 4139993 - RNA, 61 nt, Human
gagcccugcgaucgugauuucuucucucacaaggggaugagaaaucuucucuuagcggcuc

SEQ ID NO: 4139994 - RNA, 55 nt, Human
gagcccugcugggccuugucucugcccuugcacaggccggguuuggcagaggcuc

SEQ ID NO: 4139995 - RNA, 56 nt, Human
gagcccuggggcuuuagguccccucuccacugcuggggacaccaacuccagggcuu

SEQ ID NO: 4139996 - RNA, 92 nt, Human
gagcccuucugcugaguaaaguuauaaauuaccugucacugucaucguacaaugauucugugcuggcuuugccaucaugcagaccuggguuc

SEQ ID NO: 4139997 - RNA, 74 nt, Human
gagccgcccgcgccagccucuccaucucgcaaguuuuaauuaacgcugagggggaggcggcugacgggcggguc

SEQ ID NO: 4139998 - RNA, 55 nt, Human
gagccgccugggggcccuagggaggcugaacgcccgguggcucccgggauggcuc

SEQ ID NO: 4139999 - RNA, 82 nt, Human
gagccgcugcacaggguuuaccauugauuacgggcucaacaaaggcuguuguuaucauuggaggcacugugcaguauuucuc

SEQ ID NO: 4140000 - RNA, 75 nt, Human
gagccggaggaggacgagcccgcggcggcgcagcgcucaugcuccaaggcgacgggcucgguccgcuuccucauc

SEQ ID NO: 4140001 - RNA, 81 nt, Human
gagccggggguccgcggggagugguugccugugauccccauugcccgggcaggcauggccacucccuaggccccaggucuc

SEQ ID NO: 4140002 - RNA, 93 nt, Human
gagccgucccuucugcagguagaggcugccaucagcugccauggagacccgguaguggcagaccuuggccugggcccggacuaggaaggguuc

SEQ ID NO: 4140003 - RNA, 74 nt, Human
gagccguccgcgccagccucuccaucucgcaaguuuuaauuaacgcugagugggaggcggcugacgggcggguc

SEQ ID NO: 4140004 - RNA, 61 nt, Human
gauaagagcuagucuuuuccuugcacaaaaaucugcacgaggaaaggcgauggcucucguu

SEQ ID NO: 4140005 - RNA, 74 nt, Human
gauaagccaggucacaggguugaaguacuucuuaacucuaaagggaaguuuaaaacuuugggacauugauuauu

SEQ ID NO: 4140006 - RNA, 69 nt, Human
gauaaggcagugacuucaucuauuuuuccauaugugcugacucugcaauagaugaauucugccucuguc

SEQ ID NO: 4140007 - RNA, 101 nt, Human
gauaagggccuguuggugggccuggcucagagaugucugcugccuugcuacagagcagaaagcacccugcacuuucuggacaggacacccagguuuuuauc

SEQ ID NO: 4140008 - RNA, 58 nt, Human
gauaagugcccaaaaugaaaggaaauauggguuccuuggcagcagggagcaugauauc

SEQ ID NO: 4140009 - RNA, 70 nt, Human
gauaaguuaugggggcuucuguagagauuucuaugagaacaucucuaaggaacucccccaaacugaauuc

SEQ ID NO: 4140010 - RNA, 72 nt, Human
gauaauaggauaugagcaaugaacccuugggugggguuccagggcacuuaaauugccucgugucuugaguuc

SEQ ID NO: 4140011 - RNA, 87 nt, Human
gauaauaggauucauguuccauacaucaccagucuaaguugccaaaauaugcaaguuucagacugcugugugaaacugaaacucauc

SEQ ID NO: 4140012 - RNA, 62 nt, Human
gauaauauuugacuuggagggucucugucucucugauggaaauaccugaauuagauauuauc

SEQ ID NO: 4140013 - RNA, 75 nt, Human
gauaaucuaaacaaugaacaaagcacugauugaucauugaacagagcuugaauguccaugguuuuagugguuguc

SEQ ID NO: 4140014 - RNA, 86 nt, Human
gauaauuggauucucauaauugcuccuguauucaagcuguugcaauauguuguuuugguuuaaguauaugaagaaaauccauuauc

SEQ ID NO: 4140015 - RNA, 95 nt, Human
gauaauugucugauuauuuauuuuucaauuguaaugauaguaauuuugcuauuaauuuugggacgauugaagaauagucuuaaccaccaauuuuc

SEQ ID NO: 4140016 - RNA, 129 nt, Human
gauaauuucaaaguaugccaaaguuugaaacccgcuuagguuagggacaggucaauaugagagaaaauagucaucuugauuuacucuaauagcuuuaucauuuagauuaaaacauacacccaauccguu

SEQ ID NO: 4140017 - RNA, 66 nt, Human
gauacaaagaagaggucaaggcugagaaagacccccugauucagcccugggcuuccucaugguguu

SEQ ID NO: 4140018 - RNA, 55 nt, Human
gauacaaguggaguuaggaaguuuugauugggucaaagcuucacuucauuugauc

SEQ ID NO: 4140019 - RNA, 60 nt, Human
gauacacauuugcuagagaugggcuguaggauuuauuagccaacucagacuaauguguuc

SEQ ID NO: 4140020 - RNA, 76 nt, Human
gauacacguucugaagaauaggauguugugugguggucacucauucauucauucauucauucagcaggcauguauc

SEQ ID NO: 4140021 - RNA, 81 nt, Human
gauacacugguacucuguggguuggggauggaguaaaaugagaauucuguaugcccagguuugagugcccaaggauguguc

SEQ ID NO: 4140022 - RNA, 65 nt, Human
gauacaggaugcugaacaucucuggguugucuuuccaaggggauggucuccagguccacuguauc

SEQ ID NO: 4140023 - RNA, 59 nt, Human
gauacaguuuguuacauuguuagugggcuaguccaccuagaaugaagcaaugcugucuc

SEQ ID NO: 4140024 - RNA, 84 nt, Human
gauacaucuguggccucaugucuauaaagagcacacuagauuguacccagcacuuuuggacaugacaugcuaauuauauguauu

SEQ ID NO: 4140025 - RNA, 66 nt, Human
gauacauugaggguggaggaccaccuguuagagaugcuauuaaggguccucuagcuucagaguguc

SEQ ID NO: 4140026 - RNA, 66 nt, Human
gauacccagcaaaaugcaggagaguugccuuccacuuucugauacccauauuuugcugggauuauc

SEQ ID NO: 4140027 - RNA, 129 nt, Human
gauacccaguuaaaugggaauuucagauaauagacaaugguuuuuuaguauaaguacaucccaaguauuguacaagauguacuaaaaauuauucuguguuuaugugaaauucaaauuuaacuggguguc

SEQ ID NO: 4140028 - RNA, 79 nt, Human
gauacccgucucucugcugcuacagacucucuagggaugggcucuggggaaggcugcuggcaugcagcuggacccuguc

SEQ ID NO: 4140029 - RNA, 96 nt, Human
gauacccugaaggucuuguugagaugcagauuuggauucaggaggucacagguggguccugagauucugcauuucuaacaagguccaggugauguc

SEQ ID NO: 4140030 - RNA, 70 nt, Human
gauaccgucacauuuaaugauccuacugugaauucaagaauucacgaugaaaguuggauugagcgguauu

SEQ ID NO: 4140031 - RNA, 124 nt, Human
gauacuccaaacuauuucugguaaaacuguaagauuuacgagguggauagguacauggacuuuagagcuagagccagagaccuggguucacaguguaaacucugccacucaguagcaagguguc

SEQ ID NO: 4140032 - RNA, 81 nt, Human
gauacucgaaggagagguuguccguguugucuucucuuuauuuaugaugaaacauacacgggaaaccucuuuuuuaguauc

SEQ ID NO: 4140033 - RNA, 76 nt, Human
gauacugaaguuuuucaauuuauguuauuugguguaaaucuaggcagucuuuaacaaaauuggugcuucauguguu

SEQ ID NO: 4140034 - RNA, 86 nt, Human
gagucuugcucuguugcccaggcuggagugcagaggcacgaucucggcucacugcaaccuccaccucccggguucaagcgauucuc

SEQ ID NO: 4140035 - RNA, 86 nt, Human
gagucuugcucuguugccuaggcuggaaugcaguggcgcaaucuuggcucacugcaaccuccgccucauggguucaagcaauucuc

SEQ ID NO: 4140036 - RNA, 59 nt, Human
gagucuuguuaagauuuuggaauaauaauauuaauauuucaguuuuuauaauagggcuc

SEQ ID NO: 4140037 - RNA, 84 nt, Human
gagucuuugauuccuaagucuuucucuaccucuuuuguccaacuuggaagucuugguagagaaggacuuaggaaucagagacuc

SEQ ID NO: 4140038 - RNA, 112 nt, Human
gagugaaaaaggcaacaugaaacaagcaugugacaugugucaucuuuucuacaaaauuggagggaaagagaaauguaugcacauauuugcuugaaugugcagaaaauagcuc

SEQ ID NO: 4140039 - RNA, 63 nt, Human
gagugaaaaguggagugagauagugaacuuuaaaaauccuauugucugccugcuucuucacuc

SEQ ID NO: 4140040 - RNA, 81 nt, Human
gagugaaauaccagaaaauaaagugccacaggaaagcucaaaaagguuuccaaaugagcucugccuuccaguguucaacuu

SEQ ID NO: 4140041 - RNA, 81 nt, Human
gagugaacagcuagacuuugauauuguacacccuugaucuucaggggaugauaaugccagaguuaaauaagcuucccauuc

SEQ ID NO: 4140042 - RNA, 84 nt, Human
gagugaagacagggucauggaucccaaauaccacugccaggaggcagguggccuuggcuucuacccugaccuggucaugaacuc

SEQ ID NO: 4140043 - RNA, 108 nt, Human
gagugaagagggaaagagagaaacaagcacauuauagcuaucuaggucaaaauuuuaaacaaccuuuugguuuaaaugugugugugugcucuuugcaaagcuucacuc

SEQ ID NO: 4140044 - RNA, 89 nt, Human
gagugaauacagagucaugaggcagucauaugggaagggaacauaaguagugagcugccuuauggaguaugaaaacucauguuuuacuc

SEQ ID NO: 4140045 - RNA, 78 nt, Human
gagugaaugagggagggagagagcaagcaagugggucuucccauugcugaccuuugcucuccguuccccaggcuacuc

SEQ ID NO: 4140046 - RNA, 70 nt, Human
gagugacaggccuugucaagaaaaugccacuucugaccaaaaaagauuuggcaaacugcaagcuucauuc

SEQ ID NO: 4140047 - RNA, 67 nt, Human
gagugagagcugguucauggacugccuggcaggcacaccuaugcucaguccagggaccggccuccuu

SEQ ID NO: 4140048 - RNA, 80 nt, Human
gagugaggugacuagcaggugggggugguguaggggagagagagcaauguccccaucugcugugugaccucuguccacuc

SEQ ID NO: 4140049 - RNA, 67 nt, Human
gagugaguagcuacaguuuuuaacauguuuaacuuacggccuucaaaaauuguuagcggacuuucuc

SEQ ID NO: 4140050 - RNA, 65 nt, Human
gagugaugggucuggggugacuuuguaugcucuucaugaagguguuuauaccucagauccuccuu

SEQ ID NO: 4140051 - RNA, 59 nt, Human
gagugaugugguccagaaugguccucagcauguucuaggugguccugucccacccacuc

SEQ ID NO: 4140052 - RNA, 67 nt, Human
gagugauuuccagagagacguuuccuuagagguccagauuuaucagagagcaucucccugaucauuc

SEQ ID NO: 4140053 - RNA, 55 nt, Human
gagugauuuugucagcuucugcagacuggauggaucugcagacuacaaaaaacuc

SEQ ID NO: 4140054 - RNA, 76 nt, Human
gagugcaaagugcuuuaggauauuuggaaaugguuuguuccuuuaaguauuucaaguauucccuuuccuuguacuc

SEQ ID NO: 4140055 - RNA, 64 nt, Human
gagugcagggcuuuuccacuccagugcuugcuuuugagccugggacccuuagcucuuggcauuc

SEQ ID NO: 4140056 - RNA, 56 nt, Human
gagugccagggggcacugaacagaugugugauguuuguuagguccuuucggcaauc

SEQ ID NO: 4140057 - RNA, 57 nt, Human
gagugccuggacccucuuuccggaggaaacaguccccucuggaccucguucggccuc

SEQ ID NO: 4140058 - RNA, 106 nt, Human
gagugcuacuggguggcagccuagggggcccagcugccugccuugggccacccugcagaagagaccaggcaggcuugggacugcuuaggagcacccagugugucuc

SEQ ID NO: 4140059 - RNA, 70 nt, Human
gagugcuuacaaugacagguguaucauuaugacuuuacauauaucaccucauuuauuguuuugagcaauc

SEQ ID NO: 4140060 - RNA, 97 nt, Human
gagugcuuuagaagagagcuguuucauucguguuauggggugccuagcacuuugcaauacuuaauacaaaugaaacuauaauagcuuuuuuguacuc

SEQ ID NO: 4140061 - RNA, 81 nt, Human
gaguggaaagagcgggaggaacggcucgggcaggcagguccugugcuguggucuaagucacuucccacguccgucccacuc

SEQ ID NO: 4140062 - RNA, 81 nt, Human
gaguggaauuagguuagugugcaagagaacaaaaggaaguaauggauauucauuuuucuucguauucugauugguccacuc

SEQ ID NO: 4140063 - RNA, 70 nt, Human
gaguggacuuucugucaucuagacaaguaacuuccaagggugacuucgagaggacggaagguucuggauc

SEQ ID NO: 4140064 - RNA, 81 nt, Human
gaguggauaguguaggacaggguaaguacuaguguggucccagaccaccugugaugauaguuuguccuauuaacuucccuu

SEQ ID NO: 4140065 - RNA, 70 nt, Human
gaguggcaucucgcauucuuguuucuacagugccuugaggcaucagccaagaugcugagguugccuucuc

SEQ ID NO: 4140066 - RNA, 81 nt, Human
gaguggcauuacagagcuggguggagagaggggcuagccaucuuuugugucgcccaccgggcucaugugucaucgccucuc

SEQ ID NO: 4140067 - RNA, 104 nt, Human
gaguggcccggguaccggggguguggccagcgccaaagcugugaaggauuugcucacaggcuggugguccuggccauggccaugcugcaggccugaggucccuc

SEQ ID NO: 4140068 - RNA, 117 nt, Human
gaguggcucagggcugagguauuucugccuaggguucaugccuggauacuggaaucacagcaagauagucauccaagagccugggcagugccuuccuaacagauagccccuucacuc

SEQ ID NO: 4140069 - RNA, 67 nt, Human
gaguggcugggggugaaagucuggacaguagugggacuugcucccagcuuuguaccuucacccacuc

SEQ ID NO: 4140070 - RNA, 68 nt, Human
gaguggcuguuuauagguggguaugggguucuuaucauugggugaaaguaucuccuaggcagcugauc

SEQ ID NO: 4140071 - RNA, 69 nt, Human
gagugggaggaucgcuugagcccaggaguucaagaccaaccugggcaacauaggaagauucugucucuu

SEQ ID NO: 4140072 - RNA, 84 nt, Human
gagugggaugcuggccagaggugagggggauucuuguccugugcaacccugggcaagucacuuugacucucugggccuccauuu

SEQ ID NO: 4140073 - RNA, 58 nt, Human
gagugggcaaaagaaaguaggcaucugguacauaaugcugccuuuuaaagccucgcuu

SEQ ID NO: 4140074 - RNA, 63 nt, Human
gagugggcagucucuauguuccugcaauauguagauacaugggcuuggaaagagacuggacuc

SEQ ID NO: 4140075 - RNA, 65 nt, Human
gagugggccuggggggagcaggcuggcagaugugcagccuugccuccucccagcagcaacaauuc

SEQ ID NO: 4140076 - RNA, 55 nt, Human
gagugggcuuggggagaguuuguuggaguccagcccaccucguccaacccaccuc

SEQ ID NO: 4140077 - RNA, 66 nt, Human
gaguggggcagguggcaaagccagaggggagcagugauuugucuuugcuuggccccugccaccuuc

SEQ ID NO: 4140078 - RNA, 58 nt, Human
gaguggguaaaggugcuuggcuuugguguaagaaaggccucacuuugaaucccggcuc

SEQ ID NO: 4140079 - RNA, 61 nt, Human
gagugguggagcgcaggcuuggaugcagauggccuggguucacauccuggcugugccacuu

SEQ ID NO: 4140080 - RNA, 65 nt, Human
gagugguuagaaguaguguggcuggaaauaucuaguucgcccagacauuucugcuucaaucauuu

SEQ ID NO: 4140081 - RNA, 59 nt, Human
gagugguuuacuucaucucauuugugccuuuucauuuucaugucugaaguaauccauuu

SEQ ID NO: 4140082 - RNA, 66 nt, Human
gagugguuugcaggaugcaucaagaagugcacacaauaaccuuggcagcauccauggaggccgcuu

SEQ ID NO: 4140083 - RNA, 71 nt, Human
gaguguaaaaccccagccagcugguuggacgccuggccuagguuaacagcagcugcuggcguugaucacuc

SEQ ID NO: 4140084 - RNA, 62 nt, Human
gaguguacagacaaugcccugcagaaugagugacccgugaggucaggagccgucuuacauuc

SEQ ID NO: 4140085 - RNA, 55 nt, Human
gagauuuaauuccccugcucaggucaguguagggccucagggaaguucaaagcuc

SEQ ID NO: 4140086 - RNA, 102 nt, Human
gagauuugaguauaguacauauaguaauuuagccauuucaaacaguugaacaaauuguacaccugugguuagauugacaguaaugacagugauuuaauuuuc

SEQ ID NO: 4140087 - RNA, 113 nt, Human
gagauuuggugaaauugaaggagaaaauuuaagugagucuuuaaaauauauucugaaugaaaacuguauugaggauucauuuuuguuccuuuuuuuucuuuuucucuuuucuc

SEQ ID NO: 4140088 - RNA, 95 nt, Human
gagauuuugacauuuaaaugagauguguguaaagugcuacaguaggccccagcgccugccauuucucacauauguaugugaagugggcaugucuc

SEQ ID NO: 4140089 - RNA, 112 nt, Human
gagcaaaccugcaagaaccacagaugguuaugggaggauggggggauuaaagaaguggcaaauuuaguaguagcaaaacucaucucuuuggcucucuguggcaggaaagcuc

SEQ ID NO: 4140090 - RNA, 58 nt, Human
gagcaaagcaaugagaccgcaucauggguuagagaccacugcacaaguugcuuugcuu

SEQ ID NO: 4140091 - RNA, 64 nt, Human
gagcaaagcuuuuagggccuuucacaaggaaaaaggcccuuccaacccagagggcaacuugcuc

SEQ ID NO: 4140092 - RNA, 60 nt, Human
gagcaaauaucuuugggaagaguaaauaaugucaauuaacacuuuaauggauauuuguuu

SEQ ID NO: 4140093 - RNA, 82 nt, Human
gagcaaaugacuugcaguaccuggaguacuucagaccauaucaaucagaaucugacugucuucauaucugugucuccuguuc

SEQ ID NO: 4140094 - RNA, 78 nt, Human
gagcaaauucacauuuuauuucacuggaugacuagaaaucauaagcuguaguuuccagcauuagaugugaaauugcuu

SEQ ID NO: 4140095 - RNA, 106 nt, Human
gagcaaauucuacccuaaaaauguucuaguaguucacaggaagaagaugagguuuaauaacuuucaagguaauucuagauugacauuuugaggggaaaaugggcuc

SEQ ID NO: 4140096 - RNA, 66 nt, Human
gagcaacuuagcucuuucugugccauaggucaacaccucuggcaguuugagaaaggcuauaaacuc

SEQ ID NO: 4140097 - RNA, 93 nt, Human
gagcaagaagaauacaaauaauaccaagguguugagccaagaaaaccccgaugcuccugaaucauuuugguaauguucguuugcuccuuguuc

SEQ ID NO: 4140098 - RNA, 69 nt, Human
gagcaauagaaagaauacugcucugcacuuggaugucaaagaucuggguuugaauucuuucucugccuc

SEQ ID NO: 4140099 - RNA, 64 nt, Human
gagcaaucaaugagcgaaagcuuuuaccuauauuauuauuguuaucguuuauuugaaauugcuc

SEQ ID NO: 4140100 - RNA, 78 nt, Human
gagcaauggcaucgcuggugaucaaaggccuggccgagcuaccccaggcuccauaccaucuccggagaugccuggcuu

SEQ ID NO: 4140101 - RNA, 80 nt, Human
gagcaauguggccagugugugccucuguguucucauguggguacaugugucugaagcaguauacacugauacaugagcuu

SEQ ID NO: 4140102 - RNA, 65 nt, Human
gagcacacacuuugaaauuaggagaaccugugucugaauccugauuuuugccauuugugugacuu

SEQ ID NO: 4140103 - RNA, 83 nt, Human
gagcacaccauuuugagacaauauauaauuuuaguuggagugaaacaacauucaacaaguauagcuguuuugaagugguccuc

SEQ ID NO: 4140104 - RNA, 96 nt, Human
gagcacgguccuccccacccugugcuucagguugucgccacguguucuugugaguguggcaaggcagcuugaagcagcgggaaggaacucaggcuc

SEQ ID NO: 4140105 - RNA, 80 nt, Human
gagcacuagaccaagaaucagaccugucaggguuaacugguuguuugauccaagcaaauugucugacaucucugggccuc

SEQ ID NO: 4140106 - RNA, 79 nt, Human
gagcacuuacuguaugccaggugcacucaagaccugcugcuaagugggaagcuggguucagaggcacauggaacagcuc

SEQ ID NO: 4140107 - RNA, 59 nt, Human
gagcacuuauuuugugccaguugcuggagauguagcuguguacacaauagaugagguuu

SEQ ID NO: 4140108 - RNA, 93 nt, Human
gagcuauggcuggaguaucuggggaaggaggcuaacugacauacacggcacaugucuucuucucuaccugaacuuuaagaaccauuucagcuc

SEQ ID NO: 4140109 - RNA, 55 nt, Human
gagcuauugacaagccuuuuggccacagauguggaaggaggccugcagauaguuc

SEQ ID NO: 4140110 - RNA, 84 nt, Human
gagcuauuggaaaagauggaaagaaagugugaacaacuugggaauuucagugucuuacaguuuuuuuaaagcuuguuauaguuu

SEQ ID NO: 4140111 - RNA, 62 nt, Human
gagcucaaguagaagccucgggcugggcuccucuccugggguggaacccuucugcugggcuc

SEQ ID NO: 4140112 - RNA, 117 nt, Human
gagcucaguacauuugagauguuuaccaagauggucuugagauauuauaaagggcaaagagaaaugcaauuauguuuuucaagugcacacuaugaacuaggcauugugcugauacuc

SEQ ID NO: 4140113 - RNA, 73 nt, Human
gagcucagugccuuaccuuugcagggccaggguccccguucuggccaguguuggcuagggacacuugcagcuc

SEQ ID NO: 4140114 - RNA, 61 nt, Human
gagcucauucauucauugccuguuuagaaaaugcuuacuaugugcagugaagaaagagcuu

SEQ ID NO: 4140115 - RNA, 56 nt, Human
gagcucugauguuuaguggagauaauaccccccaccuccaugcaaauacagaguuu

SEQ ID NO: 4140116 - RNA, 107 nt, Human
gagcucugauuucaaguguaagguuuaaggucuauaaauguuugcuagaggggagaauaaggaaguaguuauaaaccuauauaccucucacaucuucugcagagcuc

SEQ ID NO: 4140117 - RNA, 69 nt, Human
gagcucugugcauggcagaggauagcauaugaaccucuggugaccagagggucuugcagguacggacuu

SEQ ID NO: 4140118 - RNA, 63 nt, Human
gagcugaaauaugaagccaauuacuaaggggaagauuuccagcaaauuggcuccugauagcuc

SEQ ID NO: 4140119 - RNA, 91 nt, Human
gagcugacaauaauaugguuguuugaagaaauauugccucugugacaaugauagaggacacaucuuuccucaaaugaguuucugucacuuc

SEQ ID NO: 4140120 - RNA, 102 nt, Human
gagcugaggaaaauggggcucguacucacugaugaggagcacgagaagcugcugaaaacucugccaauucgcagugaguauuuaccacauccuuugagacuu

SEQ ID NO: 4140121 - RNA, 67 nt, Human
gagcugcauuuucuuucuucuuucccagugaugggccauuggucaccauaaagaagaacaucagcuc

SEQ ID NO: 4140122 - RNA, 59 nt, Human
gagcugcccugagcuuugcauguucccuugagugucuuacacaaagcugugagcagcuu

SEQ ID NO: 4140123 - RNA, 60 nt, Human
gagcugcccugcucuccgggaucuuaggcccagguucaggagacagagggcaaggcauuc

SEQ ID NO: 4140124 - RNA, 61 nt, Human
gagcugcggggcccccaggugggcuccacauggagcagagcuugcuggugccugcaggcuc

SEQ ID NO: 4140125 - RNA, 71 nt, Human
gagcugcucagggcuuucugauucguggcuguggcacggguagcuuuggccucguuuagaaauggcaguuu

SEQ ID NO: 4140126 - RNA, 83 nt, Human
gagcugcugaaggacccugagcgggcaugccggaaugcggaguggguguugggauccuccucaggguagcacaguauggacuc

SEQ ID NO: 4140127 - RNA, 57 nt, Human
gagcugcuggauauguggccuggcuuuguuguuuucaguaugucacauccacaguuu

SEQ ID NO: 4140128 - RNA, 57 nt, Human
gagcugcuggccuccugcgggaagaaguucugcagccgagggagccggugcgugcuc

SEQ ID NO: 4140129 - RNA, 58 nt, Human
gagcuggacuuucagauacaucugucuaaguggcugauguguagggaaagucagacuc

SEQ ID NO: 4140130 - RNA, 68 nt, Human
gagcuggcauucucacucccaugucugcagggauuucucugguuucaugagaugagaauuuccuucuc

SEQ ID NO: 4140131 - RNA, 55 nt, Human
gagcugggacauggguccucuccugcccucagacuggaacucacgucaucagcuc

SEQ ID NO: 4140132 - RNA, 68 nt, Human
gagcugggcuuuuggcuacucuuuuugcaauaauuauguaaagagcuggucacagguccauuuuccuc

SEQ ID NO: 4140133 - RNA, 64 nt, Human
gagcuguccaagauggucguaauauauuguucauaauaaccgugcuuggcuagcuuggcagcuc

SEQ ID NO: 4140134 - RNA, 76 nt, Human
gagcugugaaucucaaauuaagaauuuuauugaaaaaguccauggaguuuuaagagcuuaaucuggaucguagcuc

SEQ ID NO: 4140135 - RNA, 77 nt, Human
gagcugugccaucuuuuugcuaccucaacauuacauuugcacugaaacuuggaaaggugggaacugugguauggcuc

SEQ ID NO: 4140136 - RNA, 79 nt, Human
gagcuguguggggacugaguggaggcuucugaggacucaccaggguuaagacggguguucauucaaugcuccccaguuc

SEQ ID NO: 4140137 - RNA, 59 nt, Human
gagcuguucaaggacaggcacgggucugauuuacuuccguguccccuagaucccagcuc

SEQ ID NO: 4140138 - RNA, 73 nt, Human
gagcuguucaaguuaaaucucagaaggcauuuccaagauuccuuuccuggcucuucugaguuuucugcaguuc

SEQ ID NO: 4140139 - RNA, 89 nt, Human
gagcuguuuuccagggcucuguagaagaagcuguccagcuccucacacugcuguguuucuucuucccuggagaccuggagcagaggcuu

SEQ ID NO: 4140140 - RNA, 100 nt, Human
gagcuuacucuauuuuucuuuacaugaguacucacuuaggaaaggccauaugagccuacauugagaagguggucauuugcaagccaggaagagagagcuc

SEQ ID NO: 4140141 - RNA, 97 nt, Human
gagcuuauuaagacagaaguuucugggccccacugccauaauuccugacucaccaguucuggaguaggaccugaaaauaugccuuuccagugagcuc

SEQ ID NO: 4140142 - RNA, 76 nt, Human
gagcuucaaauggacgaccuuuucccucugcaaucuguuaagggccaaacucagaggauaucuuuaucugaaguuc

SEQ ID NO: 4140143 - RNA, 56 nt, Human
gagcuucagaauuuaacagacuucuugagagggaagcuggaugauguuugagguuc

SEQ ID NO: 4140144 - RNA, 61 nt, Human
gaguguaugugugcacgcacuuguguauguguacaugugcaugugugcacacaugacauuc

SEQ ID NO: 4140145 - RNA, 104 nt, Human
gagugucuggcaccaaauauucaacauguaaccagcauucaucuggucacuggcuuccagaugagauguguugauguggagugguuugaugccuccaagaccuc

SEQ ID NO: 4140146 - RNA, 60 nt, Human
gagugucugugacagcucaugagcagguaaaagcaugccccaggagcuuuaaagacauuc

SEQ ID NO: 4140147 - RNA, 61 nt, Human
gagugugcaugucccggaaacacuggcaagacugacagugggauaugggggcagcauucuc

SEQ ID NO: 4140148 - RNA, 66 nt, Human
gagugugcgugcuacauacaguaaaguaaauuguccauacuuguuucuguagggugcagcaggcuc

SEQ ID NO: 4140149 - RNA, 60 nt, Human
gaguguggaacccgggcaugagcugcuugugugggcagcuggcagggguucacacugcuc

SEQ ID NO: 4140150 - RNA, 55 nt, Human
gaguguggaucccagaagcagaucuuuuccccucugcauuucgggaacucaccuc

SEQ ID NO: 4140151 - RNA, 64 nt, Human
gaguguggauggguucagugauucacuccuaauaaaaacggacaaugcagccccuaccacauuc

SEQ ID NO: 4140152 - RNA, 63 nt, Human
gagugugggucucagcuuuaagcugauggguuaaauucuauauguauaagcagauccacauuc

SEQ ID NO: 4140153 - RNA, 70 nt, Human
gagugugguuucucccuucgcagugagaugcucccgacguuuuuauuucagccaauuagaagccccacuc

SEQ ID NO: 4140154 - RNA, 78 nt, Human
gaguguuccuggucuuggucccuaugacuagguucucucacaauacuagugaagggcaaccccaggcccaggacauuc

SEQ ID NO: 4140155 - RNA, 61 nt, Human
gaguguugcuguguuagaauuacaugaacuaauuaaguaaacuuacacauaguaaauacuc

SEQ ID NO: 4140156 - RNA, 64 nt, Human
gaguguuggagcccagggugguugcagucggaggggccugccugccuuggccuccaggagacuc

SEQ ID NO: 4140157 - RNA, 68 nt, Human
gaguguuuaggggagcucgggugcaaucggagaguuagcucuuugaggccggcugcccuuaaauccuc

SEQ ID NO: 4140158 - RNA, 99 nt, Human
gaguguuuguguguguguguguguguguguauguguguguggggugugugcaugcauauaugugcaggcucacacauguucccaugaccacagacucuc

SEQ ID NO: 4140159 - RNA, 67 nt, Human
gaguuaaaugacuugguuaaggucaccaagugguaacacuaggauuugaaccacaguuauccaauuu

SEQ ID NO: 4140160 - RNA, 76 nt, Human
gaguuaauuaaucaaagacauggggaagcugaggugucuauccuucauuccugccagucauugguugagggcacuc

SEQ ID NO: 4140161 - RNA, 65 nt, Human
gaguuacaagcaucugaaaucugccuacaagcugaucgguguuguuggcgauaucagaaugacuc

SEQ ID NO: 4140162 - RNA, 114 nt, Human
gaguuacgguugcaggagaaaggcacauuacucaaacagagggccacugaggcucgggaugauguaacuggagagggaguccucugcuuggugccaguuuucuaaauugauuuc

SEQ ID NO: 4140163 - RNA, 59 nt, Human
gaguuagaagacagaauguaaaagugccuaauuauuuuuuauaaguuguaagcugacuc

SEQ ID NO: 4140164 - RNA, 78 nt, Human
gaguuaggagacuugaguuuuugucuuaguuuuguuaggaaguaguccuguaaguauaaaaauucaaguccuuuccuu

SEQ ID NO: 4140165 - RNA, 78 nt, Human
gaguuagggguguggagagaguguggagaguucagggucucacagcaacaucucacauuucucauucuccccuaacuc

SEQ ID NO: 4140166 - RNA, 62 nt, Human
gaguuaugguggccauggagagcacugugauacucaguugcucacccauaucuccaugacuc

SEQ ID NO: 4140167 - RNA, 62 nt, Human
gaguuauuucagaaggaaagaucuagugaacaugguccuuuaaauccuucugaaaagggcuu

SEQ ID NO: 4140168 - RNA, 71 nt, Human
gaguucaaguucucugcaugacccaaggcugaaucaucugcaguucggccucugcccaguagagugaacuu

SEQ ID NO: 4140169 - RNA, 62 nt, Human
gaguucaguaguuauagucuaggagauucccaggccauccucccugcuguaacucugugcuc

SEQ ID NO: 4140170 - RNA, 78 nt, Human
gaguucauauguuucugaaugaucauagcuuguuaauauaaacauuuuauuuacagagcuuaauucaggagcuugcuc

SEQ ID NO: 4140171 - RNA, 82 nt, Human
gaguucauuuauauguguuuguguguguauuucauaauaaauuucauaucucagguauacuugcagacauuuauauauacuu

SEQ ID NO: 4140172 - RNA, 123 nt, Human
gaguuccacagcaugucucacucagaaaaaccaauucuugacugcuggucucuaggaacaguugggauccaagaaccaguuuaagauuuggguuucaugccugacucauggaacugaugacuc

SEQ ID NO: 4140173 - RNA, 83 nt, Human
gaguucccauauaugcaaaaauguaaccgucagaaauggguguuaacagagugagaauuauauuuuuuuauacuugagaauuu

SEQ ID NO: 4140174 - RNA, 72 nt, Human
gaguucugagucugggcucuggguggccugagcaagaaaucugcuccugggcacccgcggcugugacggcuc

SEQ ID NO: 4140175 - RNA, 130 nt, Human
gaguucugcacaugcucucccgugacagcuggauagggauggccuccugagaagccacaggcuauggcccugccagccuggcacugaggcagggcgacacuuccagcugaagggaguguucuucaauacc

SEQ ID NO: 4140176 - RNA, 116 nt, Human
gaguucugggcaauaacacaaguccuaaaauauugauguggcuacuucuaaaguauagcaauauuacauaguuauaugcagugugucauucaagcuguuuucauugcccagaaauc

SEQ ID NO: 4140177 - RNA, 107 nt, Human
gaguugaaagaggcccauaucaacauaauucucaguuguguaauaucugagagaccaagaucugaagaaauacagcugggguuggaaaugggauuuuagacagucuc

SEQ ID NO: 4140178 - RNA, 66 nt, Human
gaguugacuacauagaugcagaccaggccaaacuagucaugaccugcccugcacuguggguagcuc

SEQ ID NO: 4140179 - RNA, 94 nt, Human
gaguugaugcucugugauuaugcuaaugaccaaaagaaucgaugaugcgagacuagaugaaaucagugguauaaucggggaaaguuaucaguuu

SEQ ID NO: 4140180 - RNA, 60 nt, Human
gaguugcaggguagacugagugagcugauaaaugauaagcucuagcuuagugccugccuc

SEQ ID NO: 4140181 - RNA, 68 nt, Human
gaguugccuuacugcauucaguaaacauacuugaagggugguuccguuuacuggaaacaaggcaauuu

SEQ ID NO: 4140182 - RNA, 94 nt, Human
gaggacuuagauucaaaugauacuguuuuuagucuuguuuguuauugaauccuuggauaaaacaguaugauuaccucuagaauuuaaagucuuc

SEQ ID NO: 4140183 - RNA, 84 nt, Human
gaggagacagaccaggcaggccugagaggcagggcuggcucacggcgagcaccugucaaguccaggcuguggaugccucuccuc

SEQ ID NO: 4140184 - RNA, 85 nt, Human
gaggagacagcacagacacugagacccccuugucuuccucaucugggggaaggaagguacucagugauucugucagaagcucuuc

SEQ ID NO: 4140185 - RNA, 70 nt, Human
gaggagaccuggagcgggaggaagaguaaaaggacaggcaccgauccuccaccucugcuccaguuuccuu

SEQ ID NO: 4140186 - RNA, 55 nt, Human
gaggagacuccucgugcagcuacuagauagaguagcagcagggcaugucuuacuc

SEQ ID NO: 4140187 - RNA, 75 nt, Human
gaggagacugacagcagauucuaccagcauuaccuuuauaaagucugugcuccccuuucugcuguugucucucuc

SEQ ID NO: 4140188 - RNA, 66 nt, Human
gaggagagagccugaguggcagcuaugcaggagacaguaaagccaguggcccaggcuuacuagauc

SEQ ID NO: 4140189 - RNA, 80 nt, Human
gaggagagccaaaaggacugaugcugaguaccuuccuuauucugauaugaaguauuuaugcacuuaauuuuuuaauccuc

SEQ ID NO: 4140190 - RNA, 69 nt, Human
gaggagaggccaucguuguuauuaaaaauaagaauauaaauuguuaccaaacacugaggccuacucuuc

SEQ ID NO: 4140191 - RNA, 57 nt, Human
gaggagagggcagagaaauguaguugagcuuccuguuuggcuagcugccuacuuuuu

SEQ ID NO: 4140192 - RNA, 64 nt, Human
gaggagcaagaaauagugcccauuaucuucugugauaacacagcaucugauuacuuguucucuc

SEQ ID NO: 4140193 - RNA, 61 nt, Human
gaggagcucugcuccauccuucaagaugacuuacguuggaggauggcgauucgagcaccuc

SEQ ID NO: 4140194 - RNA, 60 nt, Human
gaggagcugauuagagagggucauuggguucucacuggcuggcccucaggcagcuccauc

SEQ ID NO: 4140195 - RNA, 60 nt, Human
gaggagcugcacugggaguuuuuccauucuugguggaggaaagaugagggcaugcuucuc

SEQ ID NO: 4140196 - RNA, 60 nt, Human
gaggagcuggcagcgcaacccagauguccaggauuaucucauucagugcucuaguuuguc

SEQ ID NO: 4140197 - RNA, 55 nt, Human
gaggagcugggucagggagacaaaagucuucuauuagucuuauggauagcuccuc

SEQ ID NO: 4140198 - RNA, 57 nt, Human
gaggagcugucaccgugacucacuggagcagagcuuucuaaacggugucagcucuuc

SEQ ID NO: 4140199 - RNA, 55 nt, Human
gaggagcuugugagaagaugucauuaacucaaauacuuuuuaucagaagcucuuu

SEQ ID NO: 4140200 - RNA, 77 nt, Human
gaggaggaugaaaauugacagcggaaguacuuucaaacagaucuccaguuaaugugcucgcugauaauuuccucuuu

SEQ ID NO: 4140201 - RNA, 88 nt, Human
gaggaggccugaggcuucuggggcaccgagcgaccacaggccggggugcguggcucccccaggagcuccagaggcccuaugcccccuc

SEQ ID NO: 4140202 - RNA, 65 nt, Human
gaggaggccugcucuggccccaguggccccuuguaagcaggaaaggcagcuggcuagaccucuuc

SEQ ID NO: 4140203 - RNA, 83 nt, Human
gcaaauccuuauugaucaguuuucucuguacaggcccaguguagguggacaggggacacagagaaacuggagaaggauccugc

SEQ ID NO: 4140204 - RNA, 116 nt, Human
gcaaaucucaugauauagucuuucuuuuauuucuccuuccugguuagcaccuuauuuuucugaucucauaaaguguuuuuggagggaaguggaggggauugggauuagagguuugc

SEQ ID NO: 4140205 - RNA, 81 nt, Human
gcaaaugaucuaaucucucuaaguuuccauuucuccaucugugaaaaugagaaguggcuacccacuuaagagagcauuugc

SEQ ID NO: 4140206 - RNA, 55 nt, Human
gcaaauguauugcauaggauauuuuaauauaaaauaauuuauggaauacaugagu

SEQ ID NO: 4140207 - RNA, 96 nt, Human
gcaaaugugaugugagcagagacaugaaaagcucuugagcauuggcccucuugcugcuuuugagguccugcucagccaccauaucgauaagcuugc

SEQ ID NO: 4140208 - RNA, 111 nt, Human
gcaaauguucaguguaaugguuugaaacccagccguguagcugccgccgcccacacacagagcugccguggcacugagcuucagcaggcaaaccauaucaccagcgucggc

SEQ ID NO: 4140209 - RNA, 74 nt, Human
gcaaauucagguucccagguccagggcuucauuucacaauauuacuuaugaagauccuugggaaauugaccugc

SEQ ID NO: 4140210 - RNA, 91 nt, Human
gcaaauuuagggcuugggucuggcuuguuccccuccggcucgaaccaccucuucucugagccgagccagcuaccggggcuccuggaauugc

SEQ ID NO: 4140211 - RNA, 80 nt, Human
gcaaauuucuggauucuacccgccuccccgcacuccgacauuacgauguagcagcucugugguaggauccaggaaucugc

SEQ ID NO: 4140212 - RNA, 56 nt, Human
gcaacagagcaguugaucaggaacagacccugucugagaagcgugucucuguuugc

SEQ ID NO: 4140213 - RNA, 63 nt, Human
gcaacagcauucucauugacauuuggggccagauaauucuuuguugucaggggugugcugugc

SEQ ID NO: 4140214 - RNA, 87 nt, Human
gcaacagggaaugauuuaguguucaaggaauaucauucuucacauaaauugaugucacagauucuuugaauagauguucccaguggu

SEQ ID NO: 4140215 - RNA, 62 nt, Human
gcaacaguugagucagcagagcucagggccccugacgaacccugggagccgacugacugugc

SEQ ID NO: 4140216 - RNA, 86 nt, Human
gcaacauacugugugauuccauuuacgugacacuguggaaaaagguaaaacaacagaucagcacugaagaacgcaucagugguugc

SEQ ID NO: 4140217 - RNA, 58 nt, Human
gcaacauaguuuugggggcugagaaggccacuuaaggccuuguccagaaaggcauugc

SEQ ID NO: 4140218 - RNA, 60 nt, Human
gcaacaucgguauuggaggaguuaaaggauaauuccuuguuuuuucucgugcuugucugc

SEQ ID NO: 4140219 - RNA, 65 nt, Human
gcaaccaaucagauguugcauaggagcguaacuuuguaacuucacuucagccucugauugguugc

SEQ ID NO: 4140220 - RNA, 87 nt, Human
gcaaccauuucuauugcaucaagaagucuaaguuugcaaaggcaagcuuaaacuuugcaaacugauuuugauagcauuaagaauugc

SEQ ID NO: 4140221 - RNA, 55 nt, Human
gcaacccugggacacgcucauggcuccagccacuuuccuggcgcucccagggugc

SEQ ID NO: 4140222 - RNA, 63 nt, Human
gcaaccugugaugaagugggcagagcugacugugagcuucaugcccugcuaaauauagguagc

SEQ ID NO: 4140223 - RNA, 55 nt, Human
gcaacgucuucucuccaaguaaauucaccgacaggccgaagggaggagguguugc

SEQ ID NO: 4140224 - RNA, 59 nt, Human
gcaacuacuguguuuaagaaacagcaaaaaggcugugugcugaaaugcagugagaaagc

SEQ ID NO: 4140225 - RNA, 84 nt, Human
gcaacuagugcacgcuuggcuuauacagagaagacgcugaaaaaaaaguuuauugugugaaagcucaaguggucagccuggugc

SEQ ID NO: 4140226 - RNA, 57 nt, Human
gcaacugaaucauuuugcauucccagcaggaauguacaaggguuccaguuuuucugc

SEQ ID NO: 4140227 - RNA, 85 nt, Human
gcaacugcaucugcaaucucuagcagcagcccuuccuuacgagacuguguagggcauuuguggguguuguuauuguuguuguugc

SEQ ID NO: 4140228 - RNA, 73 nt, Human
gcaacuguagggugucuucuguuugcagguaacuuguaaucaaccuguccuugaauccuagcauccuaucugc

SEQ ID NO: 4140229 - RNA, 60 nt, Human
gcaacugugauuuguuaucuuguauuuccuaccucaagaugaugcacauuuaacaguugc

SEQ ID NO: 4140230 - RNA, 71 nt, Human
gcaacuucuacuuucaguguuaauguuaugucaaagaagugaggguauuaauaugagaaaguggcagaagc

SEQ ID NO: 4140231 - RNA, 82 nt, Human
gcaacuugcauggcuuccaaggcccuccgugauccgauccugcccaccuucacaggcuccggccuugcagcccuugcccugc

SEQ ID NO: 4140232 - RNA, 75 nt, Human
gcaacuuguacucauucuucaaaugccagugucuauaauguaauacuucaaagcaauagaaagagugacgggugc

SEQ ID NO: 4140233 - RNA, 55 nt, Human
gcaacuugugacuuucaaccugaaugcuggccuucaggaugagucaucaagcugc

SEQ ID NO: 4140234 - RNA, 78 nt, Human
gcaagaauacauucaaggccuucugacacaauuucuagauuagucuuuguuacagaaaguuuaugaaugguuauuugc

SEQ ID NO: 4140235 - RNA, 63 nt, Human
gcaagacagcaauaccugaaugagaagucugaacuacuuuucccuugguagaguugcuucagc

SEQ ID NO: 4140236 - RNA, 73 nt, Human
gcaagaccagagcugagcaccaagcauggucuggaaaccccggcuggcguagcaaguucagcccugguuuugc

SEQ ID NO: 4140237 - RNA, 57 nt, Human
gcaagagcacgugcccuccauaagggaugacccucuuacugggagggcugccuuagc

SEQ ID NO: 4140238 - RNA, 90 nt, Human
gcaagaggaacccaacuaaacuguagugcuuauagacucugccauucccuguggggaguuuauugcugaguugcuugcaguuccuuuugu

SEQ ID NO: 4140239 - RNA, 90 nt, Human
gcaagagggacagaggagcagguggacagaggaagaaagugaauccucuugagaagaguuucccccuuuguuacuuucacuguccugugc

SEQ ID NO: 4140240 - RNA, 65 nt, Human
gcaagauaaucuucaaagccaucauuucgaccugagguccccugaaaguucugaagagaucaugc

SEQ ID NO: 4140241 - RNA, 59 nt, Human
gcaagauguuaaaaccacccuuggauuauacacuagaccaacuugguuuuauauuuugc

SEQ ID NO: 4140242 - RNA, 64 nt, Human
gcaagauuccuugagccuaguuuggcuggcuggcccaucucucaggcccaaguagagucucugc

SEQ ID NO: 4140243 - RNA, 62 nt, Human
gcaagauugaggcuuccucagcuuuuggaucgacaaucgacagcugagaggcuauuuuuugc

SEQ ID NO: 4140244 - RNA, 74 nt, Human
gcaagauuucuuuuaggugaagcagaaacucucuagaguaagagaaugaguagauuuacuugaaaaaucuuugc

SEQ ID NO: 4140245 - RNA, 62 nt, Human
gcaagcaaguaucuggcagggaugccccaaggacccucaguucccucuggguacugccaugc

SEQ ID NO: 4140246 - RNA, 67 nt, Human
gcaagcaccgaaccuggcugcaaagaaggggaaccguuccccaaauuuugccaagucaggcugcugu

SEQ ID NO: 4140247 - RNA, 57 nt, Human
gcaagcaguuguggcuucugagaagaauguaucuugugggccauucagcugcucugc

SEQ ID NO: 4140248 - RNA, 70 nt, Human
gcaagcauguagacauccuaugggaagaacaccauggcagcaugguccuuuuugccuggaugcaguuugu

SEQ ID NO: 4140249 - RNA, 57 nt, Human
gcaagccccacagccuuggugucuuggcuccaaaaggcccaacucugugagggcugc

SEQ ID NO: 4140250 - RNA, 77 nt, Human
gcaagccuagcucuuugucacucauacagucacagugagaacagugaccccuccaggagcaagggguugggcugggc

SEQ ID NO: 4140251 - RNA, 83 nt, Human
gcaagccucaguuaucagcagcuucuuucacuccuggauaaauucugauaauucaggaaggacuguccauggcuguuguuugu

SEQ ID NO: 4140252 - RNA, 67 nt, Human
gcaagcugagacugcagccgggccaguuggugcaggcccagcauccuggcuguggauuugggccugc

SEQ ID NO: 4140253 - RNA, 59 nt, Human
gcaagcuggcuguuagaggaugauuacuucucuuaaauuaccucuuacccucaucuugc

SEQ ID NO: 4140254 - RNA, 61 nt, Human
gcaagcuguccuuuugcauggcugacugccuuuucaagaccaguguuggaggauggcuugc

SEQ ID NO: 4140255 - RNA, 55 nt, Human
gcaaggaaaucugaauaauuguguuucuggggcacaauaacuucuguuuccuugc

SEQ ID NO: 4140256 - RNA, 55 nt, Human
gcaaggaagcagcugucacucaaagugcucagcucaaugucagcagcuugcuugu

SEQ ID NO: 4140257 - RNA, 88 nt, Human
gcaaggagauaaggacaguauuuguuacagcauuagcugcuuccauguuuuggcuggcuuguaauaggaauuucacuuguuucuuugu

SEQ ID NO: 4140258 - RNA, 57 nt, Human
gcaaggagccuggaggugagugcauucccuggcccugcucagcugcuugguuccugu

SEQ ID NO: 4140259 - RNA, 79 nt, Human
gcaaggcagauauuucaguucacauugaaggccuaaauuauuggauuuuaaagaauguugaucugauauauuugauugc

SEQ ID NO: 4140260 - RNA, 56 nt, Human
cuuggugcccagcagguggcuggagcuggcgacaacaacacacugguggcaucagg

SEQ ID NO: 4140261 - RNA, 75 nt, Human
cuugguuaauuucuuucucuccacaaggcuugggaaauucaaggaccuugucaagagaaaauaauuugcaacaag

SEQ ID NO: 4140262 - RNA, 101 nt, Human
cuugguugaguauuuaugguauugcacuuacacaacccugaaaaaucuuuuaaucuucccaguuugacaaaguuuaguaauaaucguuuguacucaaagag

SEQ ID NO: 4140263 - RNA, 83 nt, Human
cuugguuucaacuugcagaaauaacucauauugcaauaaguuuauuguaaucuaguaguuuucuaaggguagaagaaacucgg

SEQ ID NO: 4140264 - RNA, 77 nt, Human
cuuguaaaguggcugcuaucaacuccuuccagcuuuaucuccaauggaaaagagucuuaggcagucauagucacaag

SEQ ID NO: 4140265 - RNA, 111 nt, Human
cuuguaaggcacauuuauucauaaaguaauuuuucuauguauaaaguugugcuuuguuuuacuggaugucuaacaacauuauacauagaaagcuuugauggaugguacaag

SEQ ID NO: 4140266 - RNA, 62 nt, Human
cuuguaauggcagagaccugucacuaaaagugacuuauuaaccagguuucuaacuauucaag

SEQ ID NO: 4140267 - RNA, 58 nt, Human
cuuguacuaggggcauagugucaaccuugagaggaggaaaugaaugugguagugcaag

SEQ ID NO: 4140268 - RNA, 65 nt, Human
cuuguacucaggaggccaccaggaccugucacgcagagggccugucagcgguguccuguugcaag

SEQ ID NO: 4140269 - RNA, 69 nt, Human
cuuguauaaacaugcucuggauugcugugaaggcaauauucuuucaugcaguuuaaagcaguuuuuaag

SEQ ID NO: 4140270 - RNA, 63 nt, Human
cuuguauacagagaaggcucaugucacucauuugacaaauauugagugucuacugcaugccag

SEQ ID NO: 4140271 - RNA, 84 nt, Human
cuuguauucuuccacuuaagauugaauauugacaacagcaucuucccaauuuuugauuaauuuuugagugggcagcaaagcaag

SEQ ID NO: 4140272 - RNA, 64 nt, Human
cuugucaagggugaccuucagcuuuuacguuaggugacuggugaauauuggaggcauugagaag

SEQ ID NO: 4140273 - RNA, 89 nt, Human
cuugucacuaugggaacauuuguuagaacugaagaagauuaaggccaaggaaacuggcagaucucccaguacagauuuccuaggcuaag

SEQ ID NO: 4140274 - RNA, 59 nt, Human
cuugucacucuggcuccagagcauaucuaaagcauuaugcuuugcugcuccaggacagg

SEQ ID NO: 4140275 - RNA, 89 nt, Human
cuugucagaaaugcaauuucuugggccccacccaguugagacuagaucagggacucagagugaggcccagcaaucuguguuuuagcaag

SEQ ID NO: 4140276 - RNA, 76 nt, Human
cuuguccaaaugacccgaugaaucacuuccuuccuuuuuggccagucuggucuguucaugggucaccgaagacaag

SEQ ID NO: 4140277 - RNA, 66 nt, Human
cuuguccacuucugacuuguucagauacaggcugguguaugaacacacuuuggaagugagggcaag

SEQ ID NO: 4140278 - RNA, 56 nt, Human
cuuguccaggugggugccauucauugaaaccccuugguggcaauguccuggagaag

SEQ ID NO: 4140279 - RNA, 77 nt, Human
cuuguccagugccugcugaugucucucuggguuguggggaaaggggugccugggguggcagaaguagcauggacggg

SEQ ID NO: 4140280 - RNA, 70 nt, Human
cuugucuaguuccuggugauguucuaauaauacaacauauuucugaugcauuugcaggaaacuggaaaag

SEQ ID NO: 4140281 - RNA, 63 nt, Human
cuugucugcuacuugguucuaccacggaaguuguccugguauuuggcugaguggcaugagagg

SEQ ID NO: 4140282 - RNA, 67 nt, Human
cuugucugggcagcuugggagucuuuucaccauuauaaauuggcauccacucugaggcugagacaag

SEQ ID NO: 4140283 - RNA, 114 nt, Human
cuugucuguuuugcaugaccuccacuacagccucaauaucauguugaauuucugagaagcuuuccaauguuagcuaagauaugaucguuggggcaccuagggagcauagauaag

SEQ ID NO: 4140284 - RNA, 61 nt, Human
cuugucuuggaguagagauuuagugaacuugaagaguagcaagaugucacuccaaguuaag

SEQ ID NO: 4140285 - RNA, 80 nt, Human
cuugugcuucuccugacaugucuggaggaaugcagcucccgcugagucuuccccagagcaugagcaggacugagcagagg

SEQ ID NO: 4140286 - RNA, 67 nt, Human
cuuguuaaaaugcagauuuugaugcagcaggucugguucucucagaagauucugcauuucuaacaag

SEQ ID NO: 4140287 - RNA, 90 nt, Human
cuuguuaaacauguaaaugcucagaccuuauuccagacauauuaaaucagaaccuuuuggggugggccugagaauuuguguuuuaccaag

SEQ ID NO: 4140288 - RNA, 72 nt, Human
cuuguuacagaauagagacugccugcucuggaaauucuuuugguuucaguuuaguuuuuaucuaucuacaag

SEQ ID NO: 4140289 - RNA, 92 nt, Human
cuuguuaugcaccauaagcuaacugauacaggagggaagagaauggcuauucuuuucaaacgcugaugucaguugcagccaugcauggcgag

SEQ ID NO: 4140290 - RNA, 61 nt, Human
cuuguuccuccagucauaugggcuuguuuggggcugccacagucaggacggggagagccag

SEQ ID NO: 4140291 - RNA, 58 nt, Human
cuuguucugugacuccagaaggcucauaaaugugagccucugaugaucacagggggag

SEQ ID NO: 4140292 - RNA, 81 nt, Human
cuuguugcucuacccagauuucuuauuuucuguuucuuuuacauuaaggaaccuaggacuauagauaucaugaggggcaag

SEQ ID NO: 4140293 - RNA, 76 nt, Human
cuuguuggugaaugauagcuucucuuuggggaacaugugugcucccucaacugagagguugucuuuauuaaguaag

SEQ ID NO: 4140294 - RNA, 82 nt, Human
cuuguuuuauucuugcuaucucagauuuauccuugaggccucagguucaaggcauacauuuagaagaggagaguguaccagg

SEQ ID NO: 4140295 - RNA, 56 nt, Human
cuuguuuugucuuguuucccuucuuugaagugagaauuuguaaaagauaagacaag

SEQ ID NO: 4140296 - RNA, 129 nt, Human
cuuuaaaaccaucuaaggagaccauguucuuuucuuuugcucauauuugcauguguuuacaaaauuacuguuauuaaacaaaggugcaagugugcaaagaaauggaagguucugaagaugacaguaaag

SEQ ID NO: 4140297 - RNA, 127 nt, Human
cuuuaaaaugguaauuguaaacccugccuugcggauguuucugaaguuuacagauaauguaaaacacauugcuuagcucauaggaaacacugaaugaaagguaacuauuaguauugccaauuugaag

SEQ ID NO: 4140298 - RNA, 63 nt, Human
cuuuaaagaauaacuuuaggaauagguaaucuugcaaaagcaagccuggaguauccuuugaag

SEQ ID NO: 4140299 - RNA, 58 nt, Human
cuuuaacaugggcucuuaagauauauguuuuaaucuacagagaggccugugcuugaag

SEQ ID NO: 4140300 - RNA, 77 nt, Human
cuuuaaccacuguguuaugcuuuccauggguaaagcaaccuaaaaaggccccuggaaucaguuacaugugguuggag

SEQ ID NO: 4140301 - RNA, 60 nt, Human
cuuuaaccugugcauuuuauaugcuuagggauuuagcaauagaagcacauagguucaaag

SEQ ID NO: 4140302 - RNA, 84 nt, Human
cuuuaacugcagccaaggcaugcugaguccuaaaagggagguuauuuccuugagggacucuaugacuuaguuuaacaguuggag

SEQ ID NO: 4140303 - RNA, 65 nt, Human
cuuuaagcccccaggaagguguuugaggaugaggacuagcagcaccagcgugggggccguugagg

SEQ ID NO: 4140304 - RNA, 67 nt, Human
cuuuaaguggucagagauaauuugggacacauggaucccaagauaaacaauuucuacuacuauaaag

SEQ ID NO: 4140305 - RNA, 55 nt, Human
cuuuaauaggacagcaggccaucuguuuggaugagggaagggcuggccuuuggag

SEQ ID NO: 4140306 - RNA, 92 nt, Human
cuuuaauccaguuaaagcaguuuaugaaauuuagggggaagggcaaaaaucaaucccuuucaaauuacaugacugcuauacauaggguaggg

SEQ ID NO: 4140307 - RNA, 93 nt, Human
cuuuacaggcauaggcuguuacacugugcacuaaauuugagaauucggaacagcuaucagaaugcauuuuguguagcuaugaugccuguggag

SEQ ID NO: 4140308 - RNA, 71 nt, Human
cuuuacagugaacuugcuugucaaaugccucuuuaaaaagaaagugaagauaacugcaagucagcuggaag

SEQ ID NO: 4140309 - RNA, 74 nt, Human
cuuuaccuaccacugucuuauuggguccaagguggccaguggaauacaaggccacuggacccagaaagggaaag

SEQ ID NO: 4140310 - RNA, 78 nt, Human
cuuuacucacaaauaagggcugcaggcaagauauggcugguuagcuguaguuuucuaagcccuggugagugggaggag

SEQ ID NO: 4140311 - RNA, 55 nt, Human
cuuuacugccaugcauuuauaacacuugugugucugucuguguaugugcagaaag

SEQ ID NO: 4140312 - RNA, 82 nt, Human
cuuuagacuaaagaagcauguguuaaugucaaccagaaaagauugcuuuuuucugcuugcaggcacauagcuuaguucgaag

SEQ ID NO: 4140313 - RNA, 94 nt, Human
cuuuagagccagaauuugguccgaauuuuguuuauuuccuucacauggcauggagauagcaccaugacuaaacaauuauacuucuggcuuuuag

SEQ ID NO: 4140314 - RNA, 92 nt, Human
cuuuagagccuuaaauacugaugcccaggcccauaccuagaugcugugguuuaguuggucugggauauggccugggcuuggggauuuuucag

SEQ ID NO: 4140315 - RNA, 127 nt, Human
cuuuagaguuagaaagcuuugaauucuuguccugggaacuggacagcuaaaacuuuccaagauaaccuagauaacuuuaguaugugcaggcuuuucccuguaggacaagaaagcuuacacuuuguag

SEQ ID NO: 4140316 - RNA, 57 nt, Human
cuuuagcaaaguuugccaucuaguggccaccaggacuaaauggggcuuugcuuaaag

SEQ ID NO: 4140317 - RNA, 63 nt, Human
cuuuagcccuguuccuagcuaggaguuucagcaagacucuggcuugaggaccaggucaaaaag

SEQ ID NO: 4140318 - RNA, 88 nt, Human
cuuuaggggcuuccaagugcugaggacaguagggaacaugacacuaugcuaacuccugacagguugguagcuuuggaagcagcaagag

SEQ ID NO: 4140319 - RNA, 55 nt, Human
cuuuaguccuuggcagguacccugacaccuccccaggagcucuccaaggacaaag

SEQ ID NO: 4140320 - RNA, 111 nt, Human
cuuuauaaaauguauucauaacucuuaaggcaauugauuauuuuuccucguaaaccgaaugaaagagaaucuguuuucagaaagaaccuguuggauacaugcagaagaaag

SEQ ID NO: 4140321 - RNA, 69 nt, Human
cuuuauacacaguaucaaauuucaucuucagaauaaccuuaugaggaagauauguuauuguguuugaag

SEQ ID NO: 4140322 - RNA, 130 nt, Human
cuuuauaccaaagucuguuacagguuagauugaaggcagugaaaggaaaaacugauauuuagcauaaauuccauaaugucuuuuuaacugucauucacacuaacuuuuacauauaauuuuaaaauaaaug

SEQ ID NO: 4140323 - RNA, 84 nt, Human
cuuuaucuucauucccagcagccauguaccacacucagugccuggacaugguagauggcugccuaaugaaugaaucugaugaag

SEQ ID NO: 4140324 - RNA, 57 nt, Human
cugcagcuccccugagaucaaguaacaucgcugguuggaggucuauggugcugacag

SEQ ID NO: 4140325 - RNA, 58 nt, Human
cugcagcuggagcaucuucucaucuugcauuugagcguggugggguccuccagugcgg

SEQ ID NO: 4140326 - RNA, 129 nt, Human
cugcagcugugacuccccuccucucauuaaugcauguccuggggucuucucuucagaagcugaggcagcauucuucaagacaguucuccuaauugauggaggagcacugggaggugcacguucaggcag

SEQ ID NO: 4140327 - RNA, 68 nt, Human
cugcagcuuuuugugcuuguaaagaaguccuagugaacuaaucugccaagcauggcauaaaaaggcag

SEQ ID NO: 4140328 - RNA, 65 nt, Human
cugcaggaaagggaaguaaauacucuguucuaauagaaaacaaucguuuugcuuuccuucuucag

SEQ ID NO: 4140329 - RNA, 65 nt, Human
cugcaggaauuguuuuaaagccucuucuuugaaauugagaagauuaugaauuagagcaguagcag

SEQ ID NO: 4140330 - RNA, 61 nt, Human
cugcaggacagggaggagcaagguuugacaaaacuacccugugugacuucccuaaccucag

SEQ ID NO: 4140331 - RNA, 58 nt, Human
cugcaggaggauccugagagugguguuaacucuuucuggucagcacgucuuccuucag

SEQ ID NO: 4140332 - RNA, 78 nt, Human
cugcaggaucuggagguaagaggcccugggccgaggugcagugacccugcaggccagcccuccaaccuccucccacag

SEQ ID NO: 4140333 - RNA, 70 nt, Human
cuucuauggcuuucuaugaacucaaaggcaggcagugguuuguaggucugagugcauagguggcaugagg

SEQ ID NO: 4140334 - RNA, 64 nt, Human
cuucuauucuugcaguauacaacuacugaugucaaaggcagugggcuguaauuuaggaaugaag

SEQ ID NO: 4140335 - RNA, 60 nt, Human
cuucuauugaauuuguuggucaaauaagucacuaaggccagcucaguuucaaaguagggg

SEQ ID NO: 4140336 - RNA, 55 nt, Human
cuucucagcuuagguaugguuucugguggaauagggcuggacuggaccugagaag

SEQ ID NO: 4140337 - RNA, 98 nt, Human
cuucucaguacucaaacagaugccccauguaucaugaaguuucuucauuuugcuauuaaaauggaagcuauuuaugauucugaaggagcucugagaag

SEQ ID NO: 4140338 - RNA, 61 nt, Human
cuucucccaaaaugcagaaggggguuuauagacacuauuuccuggauuuugacggggcaag

SEQ ID NO: 4140339 - RNA, 63 nt, Human
cuucuccugaaccacagaaacgugcucugccuuaagcaccuguaaccuggaaguuuagggaag

SEQ ID NO: 4140340 - RNA, 56 nt, Human
cuucuccuuauaugucccguucauugaguaucuggauggggaucuggagguggaag

SEQ ID NO: 4140341 - RNA, 68 nt, Human
cuucucuaggucgccgcccugguagaucauguccaguaucuggcucacccagguggugccuggagagg

SEQ ID NO: 4140342 - RNA, 75 nt, Human
cuucucucacccugcuaggccauggagaugcaaagauaaugaggugccuccaggaccucccaggcuagagagagg

SEQ ID NO: 4140343 - RNA, 85 nt, Human
cuucucuguguuucccaaguccucuccaggaggcucugaugaacgucugucuggucuugcugcccugggaggcugcacagaggag

SEQ ID NO: 4140344 - RNA, 73 nt, Human
cuucucuguuuuccaggaaucucauagagcacugcacccuaaaaauucuucuaugaccuuaggaagcaagaag

SEQ ID NO: 4140345 - RNA, 80 nt, Human
cuucucuugguaguucuuguuggaugaaacuauauugcuguugcuuuauuaaaguaaaacaagaauaugccaauggcaag

SEQ ID NO: 4140346 - RNA, 67 nt, Human
cuucucuuuuaaucucaguuucuagugugguauaauugacuuuggaauccugagaugagaauugaag

SEQ ID NO: 4140347 - RNA, 89 nt, Human
cuucugaaauuuuacaagcagugggacaugccagcagcucguggaacaugguccuggagaguguuccauaaagaguguaagcucagaag

SEQ ID NO: 4140348 - RNA, 81 nt, Human
cuucugagcugauuccaugguugcuagcauguucauaguauccccaccgucuguguccuggcucuguggaucccucaggag

SEQ ID NO: 4140349 - RNA, 118 nt, Human
cuucugaucugcuugucucugugcaaaucaaggaaguacugcggcguauucagagggaccaccugucuggaagaccagacuucccgaacugcaacacgaggaauacagaaucaagaag

SEQ ID NO: 4140350 - RNA, 86 nt, Human
cuucugcuccccucccgcaugccauuccgaguggcccugcugggggcagaggcucagauuccgaguggcccugcugggggcagagg

SEQ ID NO: 4140351 - RNA, 81 nt, Human
cuucugcugcucugagucuaguuugauuuaacuucuuguuagcaacuuccaguuuuaauuaaauugccagggguagagagg

SEQ ID NO: 4140352 - RNA, 129 nt, Human
cuucugcugguauccugauagaauaaugugagcuccauauggcccugggaccuguacagucuuucuuucugugccuuccuagcugaagggccuugugcacauuaaaauacaacaggugcacugcugagg

SEQ ID NO: 4140353 - RNA, 93 nt, Human
cuucuggaagcgggagggcugggucagccgugggaauauucaugagggguggggaagggucccuggggauguuggccugccggcuuccaggag

SEQ ID NO: 4140354 - RNA, 59 nt, Human
cuucuggagcucaccaacuuccuacuuacaucuggacugguggugguggcucucagagg

SEQ ID NO: 4140355 - RNA, 55 nt, Human
cuucuggaggcucuggaggagaauccacuuccuuggcuuuuucaccuucuagaag

SEQ ID NO: 4140356 - RNA, 55 nt, Human
cuucuggaggcuugaggggagaguacauuucuuugccuuuuccaguuucuagggg

SEQ ID NO: 4140357 - RNA, 60 nt, Human
cuucugggauuaauuuuuccugaggaaaacuaaugaaugaggaagguaagcucccagaag

SEQ ID NO: 4140358 - RNA, 77 nt, Human
cuucugggccuccagguccuuguuuguaaagcaggguggcccaccccucccuggagggcuugagaggccugcagaag

SEQ ID NO: 4140359 - RNA, 59 nt, Human
cuucugggugccugagagagagacagacagacagaacgguuucaaaggcaccuaugaag

SEQ ID NO: 4140360 - RNA, 96 nt, Human
cuucugguccuauugagguggccucuucuuggcuuccagguggaaguaauaauuuauauuagggagagaagccagcucuauaaaaagauucagaag

SEQ ID NO: 4140361 - RNA, 64 nt, Human
cuucuguggauauguucucucuucuuguaugguguuuaugagaagagaaauauuuccauggaag

SEQ ID NO: 4140362 - RNA, 60 nt, Human
cuucugugggugccuccagcagugacagaaagaauguacaggaggugugaccaauagagg

SEQ ID NO: 4140363 - RNA, 70 nt, Human
cuucuguuuuaaccugaauuucuugauccagucacuuuugguccagaagcucaaguugaacuugaagaag

SEQ ID NO: 4140364 - RNA, 61 nt, Human
cuucuuaaauuggauugcuauuggacaagauuuucaguauuuaucccauugauuuaaggag

SEQ ID NO: 4140365 - RNA, 130 nt, Human
cuucuuacagccuccagaaaggacuggguuuggaaguuuauuuuaauuagaguuuaagaguaaugaacauuaauuacagucaaacauauggacauucccagaagcauuucuacaagcacuauguucauug

SEQ ID NO: 4140366 - RNA, 62 nt, Human
cuucuucaaccugaaaguuucauauauaugaaaaugagggaaacuaucaaguguugggggag

SEQ ID NO: 4140367 - RNA, 55 nt, Human
cuucuucacacuggucugaagcccaagaggcugaacuacauagacuaugaggaag

SEQ ID NO: 4140368 - RNA, 55 nt, Human
cuucuucaguugcauguauugggauaauuaaugcaaggaagugcaacagaagaag

SEQ ID NO: 4140369 - RNA, 79 nt, Human
cuucuucccccgaggguucccagucuugcauagauaaagagagucugaggcagugcugggaagccugcagggcaggaag

SEQ ID NO: 4140370 - RNA, 58 nt, Human
cuucuucccccugccuccucccugguggaggagcacuaauuccugcagagggagggag

SEQ ID NO: 4140371 - RNA, 64 nt, Human
cuucuuccuuauugccuuuuguuacacaagcagugcugaauaugggcuggauauuggaaagagg

SEQ ID NO: 4140372 - RNA, 67 nt, Human
cuucuuccuucccucacuugccugcuuuucaaacccacuugaacagugcuuggggagcggagagaag

SEQ ID NO: 4140373 - RNA, 61 nt, Human
cuucuucugaggcagcuauucaguuauuacuaucaagagauaacugcuguugaagaagagg

SEQ ID NO: 4140374 - RNA, 70 nt, Human
cuucuugcaguuucacuggcauugcucuauguggaagacauaaggcauucucaugcugugaaaucagaag

SEQ ID NO: 4140375 - RNA, 61 nt, Human
cuucuugcuuauuuguucacuaucugccucugucaauagaaugugagcuucuuguaagagg

SEQ ID NO: 4140376 - RNA, 64 nt, Human
cuucuuucacucuuuaacuuccugccauuggccaaauccaccuggaagccagaggggaaaggag

SEQ ID NO: 4140377 - RNA, 74 nt, Human
cuucuuuguucuguugucucacguacucuaaggucaaaaucuuugucaccaguagaggcaguagagcagagugg

SEQ ID NO: 4140378 - RNA, 80 nt, Human
cuucuuuuagaaauggcuuuaaguagucucacauuauuuaaauuaaucgugaagucacaauaaagucugcuauugagaag

SEQ ID NO: 4140379 - RNA, 62 nt, Human
cuucuuuucuguuucuuucacccaguaaguuucauuuuaucaagggagaaacaggaggagag

SEQ ID NO: 4140380 - RNA, 59 nt, Human
cuugaaagcacuccuuugacugauuuccucccuugaugcggucaggaaguacuuuccgg

SEQ ID NO: 4140381 - RNA, 64 nt, Human
cuugaacaguagacccuggauaaacauuucuugagaaaauguugccugaucugcuguagccaag

SEQ ID NO: 4140382 - RNA, 68 nt, Human
cuugaacccggaggcgggggaugcagugagccgagauugugccauugcacuccagccugggugacaag

SEQ ID NO: 4140383 - RNA, 66 nt, Human
cuugaacccgggagguggagguuauggugaacugagauugcgccauuacacuccagccagggcaag

SEQ ID NO: 4140384 - RNA, 78 nt, Human
cuugaagaagucuuucccagaguaguugaugcuuuaagagagguauaggacucaccugggugaagaagauuuugaaag

SEQ ID NO: 4140385 - RNA, 78 nt, Human
cuugaaggaggugauggaguuagucaagugaauuuugagaacagauguauuacacuuucuucuucaagcuccaucaag

SEQ ID NO: 4140386 - RNA, 88 nt, Human
cuugaauggaauuuggaagcuaagauaauuuaaguaggucccagucucaaccuccucaaauauguuuuacuuguggguaacauuuugg

SEQ ID NO: 4140387 - RNA, 113 nt, Human
cuugaauugcaggugaauaucagccuuugguuugggcugugugccccagaugaugguggucccaaauuacauaggccaauauccagagcuggguuaaaaugaagcauuucgag

SEQ ID NO: 4140388 - RNA, 69 nt, Human
cuugacauuggucacauguuucaggccauauuugcuauuuuuuagcaagccuaaucauccagugugaag

SEQ ID NO: 4140389 - RNA, 60 nt, Human
cugccugcuccaguccuguccaccagggaggcaaaugguggcagggaaagggggaggugg

SEQ ID NO: 4140390 - RNA, 89 nt, Human
cugccugcucgcuuccccagggcaggccugacccuuagccccauucccccuacagagccaggaucuguuuuggggaaaugaacaggcag

SEQ ID NO: 4140391 - RNA, 85 nt, Human
cugccugcugaaagagccuccuguagcccucacccaggugcugcucucuggggcagagcuggaggggguuccacagucccaccag

SEQ ID NO: 4140392 - RNA, 63 nt, Human
cugccugcuuucuccucaacucaaaaaagcaaaucuauguucugagaaaaguaggaaaggcag

SEQ ID NO: 4140393 - RNA, 85 nt, Human
cugccuggaagacuuggaagacggaaaucuguagauagucugcaacuauuuauccacccauuucugcuuacauaggucauggcag

SEQ ID NO: 4140394 - RNA, 62 nt, Human
cugccuggcauagucuggucgaauuuucaugauaccaggugaucagcacuaagucaaggcag

SEQ ID NO: 4140395 - RNA, 63 nt, Human
cugccuggugcggugcccacccagccucaucuagguagccgcuggcacugcaccaguuaguag

SEQ ID NO: 4140396 - RNA, 98 nt, Human
cugccuguagggccucguuucugugcauggccaucagugcccuucuaggcauaagaagugguagcuauuccaggcugguaaggaggccgcuggggcag

SEQ ID NO: 4140397 - RNA, 57 nt, Human
cugccugugaacauacuggggguaacacacucuaaugccuucagguuggguaggcag

SEQ ID NO: 4140398 - RNA, 60 nt, Human
cugccuguuuguuaugucaugguaaaacauuuuuuguuaccacaaaauaucgaacagaag

SEQ ID NO: 4140399 - RNA, 68 nt, Human
cugccuuaugucaagacuuauuauaaagcuauagaaaugaagacaguauaguauuugcauaaggauag

SEQ ID NO: 4140400 - RNA, 62 nt, Human
cugccuucaucucugagcugggugaggcagacuggucugagccccuuugggacugagggcag

SEQ ID NO: 4140401 - RNA, 55 nt, Human
cugccuucucuggggagcugucuaugggguccccgcagcccuccaguggaggcag

SEQ ID NO: 4140402 - RNA, 55 nt, Human
cugccuucuuucaaggguaagcccuuggucacaaggggccugggacagaaggcag

SEQ ID NO: 4140403 - RNA, 59 nt, Human
cugccuugucuuguuuucaggggccucuucccucccuggggugcggccagacugggcag

SEQ ID NO: 4140404 - RNA, 77 nt, Human
cugccuuuccacaauuuggggugcccacuguaugcuucagguacugugcugggaucccaaagaugaaugaaacacag

SEQ ID NO: 4140405 - RNA, 97 nt, Human
cugcgaaucuggagaugcucaggguccuuggggagccugaacuucagggguugauugcagccauggugcaggcuuggaucacaucuccuuuuggcag

SEQ ID NO: 4140406 - RNA, 78 nt, Human
cugcguuuucaaggaaagcuuggcaaacuaaauggugggcaugccaucguuuauuuucacaagugcuccugaaugcag

SEQ ID NO: 4140407 - RNA, 80 nt, Human
cugcuaaaaagaggucagagcaggaaaggcagccaaauucaauagcaaagccugcugguuucuguucugcuuuggagcag

SEQ ID NO: 4140408 - RNA, 69 nt, Human
cugcuaaacgagucccggucccaaaagucagcuugucuccgcugcuuuucuucucacggcugucagcag

SEQ ID NO: 4140409 - RNA, 66 nt, Human
cuugccuguuuaucuaucaugaacugugaagauuuuuguacaugugauggaguauagacgugcaag

SEQ ID NO: 4140410 - RNA, 87 nt, Human
cuugccuucuggcucaggggacucugcccagcuguccccuuccccgacugcacccugcagguaccccugaucucaguggaaggcuag

SEQ ID NO: 4140411 - RNA, 67 nt, Human
cuugccuugggucaaccuuugaguguuugacacucacagucauuacaagggucugacuggagggaag

SEQ ID NO: 4140412 - RNA, 56 nt, Human
cuugcuaaaucuucuucaaaugccaggcacgugaggaaccuaugauuuagagcaag

SEQ ID NO: 4140413 - RNA, 87 nt, Human
cuugcuaacaagcauuuaguuaguaaauguuuguacaccuagcagaacuguaccugagacuugguuuaauuaaaauguguuaguaag

SEQ ID NO: 4140414 - RNA, 93 nt, Human
cuugcuaguggacuugcaaguccauaggcaguucauaacauagcagcuugcuucuauguuaugaacugccuauggagaagaccacauagcagg

SEQ ID NO: 4140415 - RNA, 90 nt, Human
cuugcuauaaacaaaugguuaaugucuuccuauucuacagagcauuugugcuauguagggagguuuauuauuuuguuguaauuauagagg

SEQ ID NO: 4140416 - RNA, 71 nt, Human
cuugcucuugugugcucuguggaucugagcaagcugcauuuaaguuugacacacacagacacacauacaag

SEQ ID NO: 4140417 - RNA, 67 nt, Human
cuugcugagaugaaauuugaaaauaguguugguucuuccacucacugaaauucauucaucccacaag

SEQ ID NO: 4140418 - RNA, 84 nt, Human
cuugcugagccuucggggcagcauucugugggcagguacuauuuuguacccauuguacaagcuaggaagcugaggcacagcaag

SEQ ID NO: 4140419 - RNA, 65 nt, Human
cuugcugaucuuugggccauuaauaaagcacauguccuguguuuugaauuccaaugauuuguaag

SEQ ID NO: 4140420 - RNA, 61 nt, Human
cuugcugcagguggucuugugcacuagccaggccagguaugagagccacucuguagcuaag

SEQ ID NO: 4140421 - RNA, 67 nt, Human
cuugcuggagucuggaaggagcugggggccaaucugaggccuccagagggucagacucugagacagg

SEQ ID NO: 4140422 - RNA, 93 nt, Human
cuugcuggcucaggagugaagcuacagaccuucgcggugaguguuacagcucuuaaugccgcgcgucuggaguuguucguuccucccgguggg

SEQ ID NO: 4140423 - RNA, 72 nt, Human
cuugcuuguauggcuuucuccauagggcaguucacaguguggcaguuugcuucaucagaguaaacaaguaag

SEQ ID NO: 4140424 - RNA, 59 nt, Human
cuugcuuucagucucggccucacucagcuucucuguggggcucugggauucagagcaag

SEQ ID NO: 4140425 - RNA, 92 nt, Human
cuugcuuuccauaguccucagaauaucaagagucaucuuuuccucuuaaaaguagcuuaguugauauuucaaaagaggaaagagaaagggag

SEQ ID NO: 4140426 - RNA, 78 nt, Human
cuugcuuuuuugugucauuuuguuagcauguuuguuacagagcuauaauuacaugcaggaaaaugcacagaucucaag

SEQ ID NO: 4140427 - RNA, 72 nt, Human
cuuggaaggcugguucucccucugaugcucugaaucccaucuaagggagcuucuggccucagccucuucaag

SEQ ID NO: 4140428 - RNA, 70 nt, Human
cuuggaauguggugguuggugguuauuuaaugaguauauauuuaguaaguaccuccacuugauugccaag

SEQ ID NO: 4140429 - RNA, 69 nt, Human
cuuggagagaacauuagcaaaaacagcucuguguguggacaugcguuuuauccuaguaguucugccaag

SEQ ID NO: 4140430 - RNA, 58 nt, Human
cuuggagccuuauucugccuuugaccuugguaugguugugggcagaauggcaucucag

SEQ ID NO: 4140431 - RNA, 61 nt, Human
cuuggaggaacacuuaugcaagaagauuuaagcaucuuaaugcagaaaugguuuuucuaag

SEQ ID NO: 4140432 - RNA, 70 nt, Human
cuuggaugaccuuuuaggauuugaguugcuggacugugaauuccaaggacuaaauucuagauucaacaag

SEQ ID NO: 4140433 - RNA, 55 nt, Human
cuuggcagcuacacagguaagaucaaguugaugucucacuagugagcaagcuagg

SEQ ID NO: 4140434 - RNA, 58 nt, Human
cuuggccacaggaccucuggggaacauugcuuuagcuuucugagcucuguggcacaag

SEQ ID NO: 4140435 - RNA, 75 nt, Human
cuuggcccggagccccaugaagcugccaucgcccagcccagcuugcaugaaacaagggccaugggaaacuccaag

SEQ ID NO: 4140436 - RNA, 58 nt, Human
cuuggcuaggaaagagccacuguuuuuaaaugagaaagcagggagauucuuagcugag

SEQ ID NO: 4140437 - RNA, 61 nt, Human
cuuggcucacuuccguggagagguggguuggcagccuacuuagacaucuuuagugguuagg

SEQ ID NO: 4140438 - RNA, 110 nt, Human
cuuggcuggguuauuaauagaauuugaaguuuauuucaaucuauucaucugaaaaaaggugagaggauggaaauuaauuagaauucucaguuuauaaaaccaguuccaag

SEQ ID NO: 4140439 - RNA, 72 nt, Human
cuuggcugugaaagcuucucaaacuuuccuugcuuuugauaacucugaaauguuugagguuuacuagucaag

SEQ ID NO: 4140440 - RNA, 72 nt, Human
cuugggacauugaagcuggaaagggaauuccaggccaggaagcccaaggucccuuguacagagugacccgag

SEQ ID NO: 4140441 - RNA, 64 nt, Human
cuugggagucaccuuagcugugagaaccguuuuucgaucuuaccagcaaaaaugacagcccagg

SEQ ID NO: 4140442 - RNA, 97 nt, Human
cuugggaugggugugggaagaagccugcaggugggcccaaccaguucagagacacucugggaggcccaggccuggcaggaacucaacccuucuuagg

SEQ ID NO: 4140443 - RNA, 67 nt, Human
cuuggggaaagauaguuuucucuagagcaauuccugagacuugcauaggaucucuauucucccuaag

SEQ ID NO: 4140444 - RNA, 64 nt, Human
cuuggggacacagagcccagggccugggaccuccugccaugugaggaagcuguggguccccagg

SEQ ID NO: 4140445 - RNA, 98 nt, Human
cuuggggacgucagcacacucaccuguggagagccagccagaagacaggcaguggcacaaguuuucugagguagagauugugacuguaggugaccaag

SEQ ID NO: 4140446 - RNA, 60 nt, Human
cuuggggcuuuguguguaggaugguuuauguccuuguucaacuugccacuguuucccaag

SEQ ID NO: 4140447 - RNA, 79 nt, Human
cuugggggcucugacucccucagcuccugcccagcuaguguguccugggugcaaguggcaguggggcagggcccuggag

SEQ ID NO: 4140448 - RNA, 75 nt, Human
cuugggguugggggacagucaggagaggccuugggagggaggggaggcccacugagugacucccucaggcccagg

SEQ ID NO: 4140449 - RNA, 81 nt, Human
cuugggucauugcaugaagagggucccugcugcccaggcugggaacagccaggcaucaggagcuucuucaggugacccagg

SEQ ID NO: 4140450 - RNA, 66 nt, Human
cuugguagcacggggaagagguacaaggaagagguacaaggaauguacccuuugccggaugccaag

SEQ ID NO: 4140451 - RNA, 130 nt, Human
cuuggucaaagucaaacucucaagaaauguggaggaacagggcuucaaacucagcuguguuugguucuaaagccuguacccuuuccacauauuacugcuucucaggguuuuccaucaaaaugaccccaag

SEQ ID NO: 4140452 - RNA, 73 nt, Human
cuuggucacauggugaaaagcagggcuuugguaaaauuccaucuaaacugugcuugccaaaccauugaguagg

SEQ ID NO: 4140453 - RNA, 71 nt, Human
cuuggucaugaagggcuagucacauaagacacgcacucugauuugacucaagcccucauguuagagcugag

SEQ ID NO: 4140454 - RNA, 101 nt, Human
cuuuaugaauggcaugugggugugggcuuagcccagagcccuggggaggagcaggaccugcugggcuggggccucagaccugcaagagccacuggguaaag

SEQ ID NO: 4140455 - RNA, 88 nt, Human
cuuuaugaguugcuaaauggaacaugaauuaauauggucuaucuuguucuagagugcauuauauguuucaaugggucaauuuauaaag

SEQ ID NO: 4140456 - RNA, 90 nt, Human
cuuuaugauauguuucaucucuccccagugucuuuauaguguauaauguuaaugaauaugugagggagggugagauggucuauugugaag

SEQ ID NO: 4140457 - RNA, 62 nt, Human
cuuuauuuccagcauaggcuuauugaaaccuaccaggugucaguacucugcuggguauagag

SEQ ID NO: 4140458 - RNA, 62 nt, Human
cuuuauuuccaugcuccuuucuaaucagaaucucucuggccaaaagcaguaugcaaguagag

SEQ ID NO: 4140459 - RNA, 90 nt, Human
cuuuauuuggcuucaguuuagaguuauuuaaucugagaagagcaacugaugcuuuaaagaggaaaagacccuagacaaguucaaggaaag

SEQ ID NO: 4140460 - RNA, 70 nt, Human
cuuuauuuuauucagucuguucagucuggcgucuccuuagcuauugacugccuuuuugagcaaaaugaag

SEQ ID NO: 4140461 - RNA, 55 nt, Human
cuuuauuuuguucuggcucuggggcuggcuuucccaggaagccaaagaaauauag

SEQ ID NO: 4140462 - RNA, 77 nt, Human
cuuucaacaacuccaugauguacgauuuuuuaugauuccuguuucacugagagucaagauagcauggugguugacag

SEQ ID NO: 4140463 - RNA, 74 nt, Human
cuuucacaaaacacuauuuucuggaaaauaaucuuaugcuugaacacuuucagaguugagcuguuuuguggugg

SEQ ID NO: 4140464 - RNA, 62 nt, Human
cuuucacacagaaucugaggagcuggcauuuauuuuugacagcaucucaaaucuugugaaag

SEQ ID NO: 4140465 - RNA, 69 nt, Human
cuuucacacagcagcaucauuuaucugguaguagcaagacagccguaugacuuuuuguuguuguuaaag

SEQ ID NO: 4140466 - RNA, 60 nt, Human
cuuucacagauucuguagaugcuccucagagacaagauucaggaggcauagucuggaaag

SEQ ID NO: 4140467 - RNA, 56 nt, Human
cuuucacagcacaagccugccuuuguugagaggcagcaacagguguguugugagag

SEQ ID NO: 4140468 - RNA, 58 nt, Human
cuuucacucuauccaacuucuugauuuggaaagcaaaucaggcaggcgcagagggaag

SEQ ID NO: 4140469 - RNA, 68 nt, Human
cuuucacugacugaugaucagaaauauuugccuggauggcacaguacagcuaaugucauuagugaaag

SEQ ID NO: 4140470 - RNA, 65 nt, Human
cuuucaguccuuaaggaaacauuuguuuucagcucuagagaccaauuuuuccugaagggcauagg

SEQ ID NO: 4140471 - RNA, 59 nt, Human
cuuucaguuuggugaaauacaagggcaaggucucuuugugcuugaaaugagacugaagg

SEQ ID NO: 4140472 - RNA, 61 nt, Human
cuuucauaagggguuuuauaauccuauuuuauaagggauuuuauagucccuuuuaugaagg

SEQ ID NO: 4140473 - RNA, 128 nt, Human
cuuucaucuucuuaaaggcucuucucugaacuuccucuguaggacuggggguggagguagcugagaaccaucaccuuugagucaucaggcuguagaucuagacauguaggcccaggaagaguagaaag

SEQ ID NO: 4140474 - RNA, 76 nt, Human
cuuucaugcuuuuuucuaguauaaauaagcaauaauagcaaagucagauuuaaaacuggaaggaagcuucagagag

SEQ ID NO: 4140475 - RNA, 79 nt, Human
cuuucaugguaucucuguaaaagaaaucacaacguaucuguuacuguugcauguuuauaacagaugaggacuaugaggg

SEQ ID NO: 4140476 - RNA, 60 nt, Human
cuuucaugucugaauucuuuagugaguaaauauguacauagacugauuuggaugugaaag

SEQ ID NO: 4140477 - RNA, 55 nt, Human
cuuucauucuuagauauuagugcaugccauauuugucacaucuaagaauguagag

SEQ ID NO: 4140478 - RNA, 61 nt, Human
cuuuccaagcucccuggagacacugguuugcagaggugugcucuuugggaucuuuggaaag

SEQ ID NO: 4140479 - RNA, 70 nt, Human
cuuuccaccgacaucuucuguguccuuaauuagucugacuaaugccacggagcccgugucaggugggaag

SEQ ID NO: 4140480 - RNA, 86 nt, Human
cuuuccacuaaggggugaccaacagcuguaauuuuaguggcaguaacugacaggaacagcuugauggcaucauguuuaaugggaag

SEQ ID NO: 4140481 - RNA, 63 nt, Human
cuuuccaggaauccucacagccuuccugaaaccugagcccugugcagcuggcuuccuggaagg

SEQ ID NO: 4140482 - RNA, 92 nt, Human
cuuuccauacacugucugucacagaugaagaaugaccuguguugauaaguauaauccauucauugauuucugaacccagauacacuggaaag

SEQ ID NO: 4140483 - RNA, 57 nt, Human
cuuuccccaagcaccacagugccuugucuauuggucacagggugaugcuugggagag

SEQ ID NO: 4140484 - RNA, 75 nt, Human
cuuuccccacuguugcuuuggaucauaaguggcagaugccacauauuuccaugcagcaugucauaaaggugaaag

SEQ ID NO: 4140485 - RNA, 68 nt, Human
cugggcguccucagaggccauccgaaaauaaagugguuuucggguggaaauucgagguuguaaauugg

SEQ ID NO: 4140486 - RNA, 72 nt, Human
cugggcgugaugguggaugccuauaaucccagcuacuuggggggcugaggcaggaaaaucgcuugaacccag

SEQ ID NO: 4140487 - RNA, 72 nt, Human
cugggcgugguggcaggugccuguaaucucagcuacucgggaggcugaggcaggagaauugcuggaccccag

SEQ ID NO: 4140488 - RNA, 66 nt, Human
cugggcuaguauuucagcauguggggcagggaaacccugguucaaugccuagaacuuagcauccag

SEQ ID NO: 4140489 - RNA, 107 nt, Human
cugggcucagagagguggagugaccaucccccgagaguuagcuaggagucacagcagggcccgggcugugacuaggccugagcucuuguccacccuuagaacccuag

SEQ ID NO: 4140490 - RNA, 58 nt, Human
cugggcucagaugagaggaaggguugguggugggcgccccuggggcagcugggcucag

SEQ ID NO: 4140491 - RNA, 55 nt, Human
cugggcucagcaggccaaggccaggacuaaggaugaggccuagcugugggcucag

SEQ ID NO: 4140492 - RNA, 64 nt, Human
cugggcucaguggcucauggcuguaaucccaggaggccguagugggagagucgcuugagcccag

SEQ ID NO: 4140493 - RNA, 60 nt, Human
cugggcucaugcuggagaugagacaaaaacagacauggucuuccucccuacagagcucag

SEQ ID NO: 4140494 - RNA, 58 nt, Human
cugggcuccacaaauuacguagcugggccugcucagcagcucugguuccugggcccag

SEQ ID NO: 4140495 - RNA, 65 nt, Human
cugggcucucuuuccugcugggaaaguaggaggcagcucuuaacacagcaggaaaagugccucag

SEQ ID NO: 4140496 - RNA, 69 nt, Human
cugggcugcaucaaagaggcauuuccaaguucuuugcaaaacuuuucuugacuuuauuugacagcccag

SEQ ID NO: 4140497 - RNA, 98 nt, Human
cugggcugccggccacccuucaggcagagcugauguucugugaugaccuucacaucaagcaugaggucgugccccaagaaggguuucacugugcccag

SEQ ID NO: 4140498 - RNA, 61 nt, Human
cugggcugggaggucacaaugagguacuugcuuacucucuuuggugcaccuugcagucaag

SEQ ID NO: 4140499 - RNA, 67 nt, Human
cugggcuggggcagcugcccaguggccacagugagcuacaggcagcugagcccugauacagacccag

SEQ ID NO: 4140500 - RNA, 72 nt, Human
cugggcugucccagggcggcagguccuuugccucaugaugcaccccguucugccgugcugggcucagccuag

SEQ ID NO: 4140501 - RNA, 66 nt, Human
cugggcuucagccucacacugauaucuuccaaccagggugguaccauggggaggcagaggugccgg

SEQ ID NO: 4140502 - RNA, 64 nt, Human
cugggcuucucagagaggcuuuaggguagguaauuauuuuaaggucuuggcugauugagucaag

SEQ ID NO: 4140503 - RNA, 63 nt, Human
cuggggaaccggaaucccccaccggcccaaucauguugcugcuggggucucuccggugcccag

SEQ ID NO: 4140504 - RNA, 68 nt, Human
cuggggagucugaucugguagcccugagguugcuuccugcucagaugcuuagagauuagacugccugg

SEQ ID NO: 4140505 - RNA, 83 nt, Human
cuggggaugccaacagagauauggaugucagaaacuuuuuuucaauuuucugaguccagaauuuacaaaaggcauuuacuuag

SEQ ID NO: 4140506 - RNA, 71 nt, Human
cuggggcaacccugggaaggugaggcccuggauuuccuggucuggccucugagaaccuccuagcaccccag

SEQ ID NO: 4140507 - RNA, 57 nt, Human
cuggggccccaccuuaggcuuggaaauuagaaucuacaguuuaagaaaaagcuccag

SEQ ID NO: 4140508 - RNA, 70 nt, Human
cuggggcucccggcugcuccggcucccggcccccugagcuggagccagagcgcagccugggccgcuucag

SEQ ID NO: 4140509 - RNA, 130 nt, Human
cuggggcugcggcacgucucugagccggggcucaccagguguggggaggacucacagaacaggcagcacugaguguggccuccccacuucuggggacgccugggguuggugguggcgcccagagucccug

SEQ ID NO: 4140510 - RNA, 79 nt, Human
cuggggcuggggcugcggacgggagcccagcccccagaugacauccuggggcucagucggcaagccccuucagucccag

SEQ ID NO: 4140511 - RNA, 55 nt, Human
cugggggcagcaagaagccauguuaggugaaggaacaaggcuguuucucccucag

SEQ ID NO: 4140512 - RNA, 103 nt, Human
cugggggcuauagagugugcugaggacagucugaaaagccuagguucaaauccugauuuggccacuacccagcugucuuugcacaguuuagcaccucccucag

SEQ ID NO: 4140513 - RNA, 107 nt, Human
cugggggcucaggauccagcaaggggcggcaggaguaaaggaggaaggaaugacaggugcaaauaccuucccaccaaagcccuuguugcccucugucuccuccccag

SEQ ID NO: 4140514 - RNA, 103 nt, Human
cugggggcuguagaggaaauggagcacucggcaauggaaggaagauggaugucuccuuccaugguggggcugcuucuauuucacaggcuucuacuaaaccuag

SEQ ID NO: 4140515 - RNA, 66 nt, Human
cugggggcuucgcgggcagcccacccccuucuacaaguggccuccagcugcucagagcagcuccag

SEQ ID NO: 4140516 - RNA, 76 nt, Human
cuggggggugagggugggguuauggagggucuuaugcauugggagaggggcugggacuuuacccuguggcccaagg

SEQ ID NO: 4140517 - RNA, 95 nt, Human
cuggggguaggugaaggcacugagccagccgucucugcuagacugugagcagugagcucggugaugcucacaccugucugccacucgauccccag

SEQ ID NO: 4140518 - RNA, 66 nt, Human
cuggggguucauccagaagagugcugccccaaaacugagggcauggcgugugcuggauucccccag

SEQ ID NO: 4140519 - RNA, 80 nt, Human
cuggggucacuccaccuucuccaccucccccugcgccaacuucgaggaccgagcguuccagguggcgagguggaccucag

SEQ ID NO: 4140520 - RNA, 82 nt, Human
cuuugcacaucuggaugaagacccagaggcuggggugacacuaaaacuccacagccugagccccauccagcugauggcaaag

SEQ ID NO: 4140521 - RNA, 59 nt, Human
cuuugcagcaauuucuguuaaaguguaugacaugugcaacauaggagggugcuuuagag

SEQ ID NO: 4140522 - RNA, 59 nt, Human
cuuugcauuacuugacuuuaguuuucaccaaaguaagagagcaaagaagugauggggag

SEQ ID NO: 4140523 - RNA, 58 nt, Human
cuuugcauucacuguaugcaugacauacuacugucuuauagugcaaugaauagcagag

SEQ ID NO: 4140524 - RNA, 66 nt, Human
cuuugcauuguuucaaaagugaauuacugcagugguucagcagaauacguugagaaaaaugcaaag

SEQ ID NO: 4140525 - RNA, 72 nt, Human
cuuugccaagcacuuuacauauguaugcucauuugguuaaaugagguaaugcauauaaagugcuuagcacag

SEQ ID NO: 4140526 - RNA, 61 nt, Human
cuuugccagccuccugauaucauccccagcuacaaacucagggaugaagaggcaggcauag

SEQ ID NO: 4140527 - RNA, 125 nt, Human
cuuugccauuuucauucaauguuguauuccuggaagagcugaaucaggcaggaaggcccagccgucaaaccugcggccuaguuacagcucuccauguaucaagaucuaggaagaaaaaaguaaag

SEQ ID NO: 4140528 - RNA, 78 nt, Human
cuuugcuauugugaauagugccgcaauaaacauacgugugcaugugucuuuauagcagcaugauuuauaaugcuuugg

SEQ ID NO: 4140529 - RNA, 89 nt, Human
cuuugcucucagauacuugaggagaucaccacauaaauucuuagaguucuggguuuagcuguaguguuuagucuagugucgaagcagag

SEQ ID NO: 4140530 - RNA, 76 nt, Human
cuuugcugauggcauucugcaucaguggcucauugacagagucauacauuacauguauaaugcuaauuagcuagag

SEQ ID NO: 4140531 - RNA, 55 nt, Human
cuuugcugccagaacccagcaggacccaccucggugcugaccuggcucagcaaag

SEQ ID NO: 4140532 - RNA, 119 nt, Human
cuuugcuugaggucacauagcuaggaaaugguggaggaaggcuuaaagacaaggcagucuaguccagagguggggcuucuagccaccauccuaugcugaaagcaugauaagggguagag

SEQ ID NO: 4140533 - RNA, 58 nt, Human
cuuugcuuuugugcucuagugguggguaauaugcugacaccacagcucagauguagag

SEQ ID NO: 4140534 - RNA, 58 nt, Human
cuuuggaaauggaucugaugagucuuuuaauagaagaaaaucaucauuauuucccaag

SEQ ID NO: 4140535 - RNA, 79 nt, Human
cuuuggaccuggaaaaugaugucuugauuuugugcauuggcaucauggcaaaauuaaacuuagcaucauguagccaaag

SEQ ID NO: 4140536 - RNA, 98 nt, Human
cuuuggagcucucagguggcugcucuccaucccaggccuggcuguaggaggcuaccuggguggggugcaggcccaugccugggguccuggcuccagag

SEQ ID NO: 4140537 - RNA, 73 nt, Human
cuuuggcuggcuucucgacuuguuuccuaugcauuacuucaugugacgaguccaguaaggcacaagccauaag

SEQ ID NO: 4140538 - RNA, 58 nt, Human
cuuugggggucccuuccugcucugacuuugggugguuuugcaagguucacucccagag

SEQ ID NO: 4140539 - RNA, 71 nt, Human
cuuugguaauguaauuuuucaauggaugaucuuuuucaaaggaaguucaaucagaugaaaaagcaccaaag

SEQ ID NO: 4140540 - RNA, 79 nt, Human
cuuuggucaagcacuuguagacuagaauuuuaaaaacagaaaacugguagaguuaggucacaagguguaugaagaagag

SEQ ID NO: 4140541 - RNA, 69 nt, Human
cuuuggucagagggauggaguucuaucaucagcccagucuuagauaccugcucaucccugugaccaagg

SEQ ID NO: 4140542 - RNA, 94 nt, Human
cuuugguugauucugauguacacagaugcuugagaaucuuugcaguagggaaacugaaucagagguuaaguaacuugcucaaagucauuuagag

SEQ ID NO: 4140543 - RNA, 92 nt, Human
cuuugguuuaauauucauggcuuauccaaaagaucuugucaccauagcuagaugaaaaaaaugacaaggcucuggagaagcagaaccacaag

SEQ ID NO: 4140544 - RNA, 76 nt, Human
cuuugguuuuauuuucaaucauugcaaaguaauggaaagguuuuaugcaaggcaauagauugaauuugugccuuag

SEQ ID NO: 4140545 - RNA, 70 nt, Human
cuuugguuuucaguagguaucauaugaagucaguggcucuccugcaucuaaugccugcuguauuccagag

SEQ ID NO: 4140546 - RNA, 79 nt, Human
cuuuguaaacagggcccagcucuauugaauuacaggucgcaggucugugaucaaccugcagggcuggaccuguacagag

SEQ ID NO: 4140547 - RNA, 82 nt, Human
cuuuguagcugcuucugauuuauagagaaacccaauuaaacuaguauuggcagaauugcuaagucagcuuucaguuacaaag

SEQ ID NO: 4140548 - RNA, 83 nt, Human
cuuugugccaagcugggaggcacugagguuucaaauggcuaugcauuaucaauaucucagugugcuucugacagggcauaaag

SEQ ID NO: 4140549 - RNA, 58 nt, Human
cuuugugcuugacccaugggucuuuacuguuucauugaccuuuaauucaagcaucagg

SEQ ID NO: 4140550 - RNA, 57 nt, Human
cuuuguggggguuucuuaucuucuuguagaggcuugagguaugaaaccugcauuuag

SEQ ID NO: 4140551 - RNA, 123 nt, Human
cuuugugugccaaggacccuguuagucucugugaagcucccguuaggccugucugcuaacuaagugccuacaacuuucagagcuaggauuuacagaguaacagaauacuaccuucuuacaaag

SEQ ID NO: 4140552 - RNA, 60 nt, Human
cuuuguucaugacaucugcuuccugugguauggaaagugaggacagauguaggaauaaag

SEQ ID NO: 4140553 - RNA, 66 nt, Human
cuuuguucucuggacucucacuucuauagggaagcucccaaaaugggaaugacaucuagagcagag

SEQ ID NO: 4140554 - RNA, 68 nt, Human
cuuuguugugccugagugcaccauagauuacaaaaaugcaaagugcuguagucaggauacaaacaaag

SEQ ID NO: 4140555 - RNA, 75 nt, Human
cuuuuaaauacucugggugaugguuaaaagcaagaugacugcugguuuauucgucacaccggaagcaagaaaaag

SEQ ID NO: 4140556 - RNA, 114 nt, Human
cuuuuaaauguuuagcuguuguaauggaugagauaugguugcuuaguuguuuuuuaaggacauuuuaaagaauuuuccagcaugucagucaaugccagcucagacacugaaaag

SEQ ID NO: 4140557 - RNA, 81 nt, Human
cuuuuaaccauuguguguguguguguguguguguagugaauuagauaaugcauauaaagagcuuaguauagugcuugaaag

SEQ ID NO: 4140558 - RNA, 67 nt, Human
cuuuuaagcuugauuguagucuagacauaauauguguuauguuuuuuuaaaaucaggcuuguauuag

SEQ ID NO: 4140559 - RNA, 83 nt, Human
cuguauccauugaaaacagcguagauucacagcuaaaacuaaauaaaaauguguuguuguuguuguuguuauucagggucuag

SEQ ID NO: 4140560 - RNA, 58 nt, Human
cuguaucugucagcuggucucgagacgucuguguuuuuccugcucagcauaguuacag

SEQ ID NO: 4140561 - RNA, 57 nt, Human
cuguaugaguugggaauagaaucaaaagauagugguuucuauucuuaauuuacauag

SEQ ID NO: 4140562 - RNA, 83 nt, Human
cuguauggguaugaugguauuaagaacaauuccaaagacaaauuacacuuuuaaauguucaugauacugaauuuaucccucag

SEQ ID NO: 4140563 - RNA, 62 nt, Human
cuguauuagcuucuacugcuacuguaccacaaauuuaguagcuuggaacaaugcaaauacag

SEQ ID NO: 4140564 - RNA, 98 nt, Human
cugucaaaugaccugguaucauggagauuuucccagauugauuuuugaaagauguccaacucugaagaagacuuccagacuucagggcaucugaacag

SEQ ID NO: 4140565 - RNA, 62 nt, Human
cugucaacauuggugucugucagcuggugguuagacacuugaacagacuuugccaauuacag

SEQ ID NO: 4140566 - RNA, 68 nt, Human
cugucaauacugcauacaguuucucauagaauguucugagaagaaacugaauaagcagucacaaauag

SEQ ID NO: 4140567 - RNA, 57 nt, Human
cugucaauuuauguugacaugcaguaaaauugaaaaucaggucaauauuguugacag

SEQ ID NO: 4140568 - RNA, 129 nt, Human
cugucacacaagaugucucaaaggcuagaaguugagugauucacaccuccguguuugaacaacugugacucacagcucugggugcaggaggugggcuguguugacucaacucuuccggcaggcagguag

SEQ ID NO: 4140569 - RNA, 72 nt, Human
cugucacagaacacacccuucgucaugaccugccaugucacacauguacaggucuuggcaaaggggagacag

SEQ ID NO: 4140570 - RNA, 125 nt, Human
cugucacaugggcuguaauuauauuuaagacuucuggugacaugacagauggugagaaugaagcucucauguucugaacaugaugucaucuggaagcugcaaaaugcacguauagcuuuggacag

SEQ ID NO: 4140571 - RNA, 61 nt, Human
cugucaccagcuacagacuacuguguagaagauacagaagccuguauuucuggcaggacag

SEQ ID NO: 4140572 - RNA, 57 nt, Human
cugucaccucugcccuuugcccacccucccugcugcagccauggggcagagagacag

SEQ ID NO: 4140573 - RNA, 80 nt, Human
cugucacuuugccugugucagcagguggaagugcucaccagacauuaaauauucagcuugcugacugcggcagaggggag

SEQ ID NO: 4140574 - RNA, 67 nt, Human
cugucagccugacuggcucuuuccuagcuaggcuagucagcucggcugaggagucaagggaggacag

SEQ ID NO: 4140575 - RNA, 65 nt, Human
cugucagccuuuagaugagcuggcuaccccuguggacauugccaggucugcaggcauccugacag

SEQ ID NO: 4140576 - RNA, 55 nt, Human
cugucagcugcuuuccuccguuaccaaggccgaggcuggccucagggcugugcag

SEQ ID NO: 4140577 - RNA, 88 nt, Human
cugucagguuugggcucccuguccuuggcugugaggcugcugcugcaggccaggauagcauggaucagaagagguguaaaucugacag

SEQ ID NO: 4140578 - RNA, 111 nt, Human
cugucagugugugggacagugacauccauggggcccaggaugagagccaagacccccuccuuuaguuucccaggcuccugcuugaucucuguccugucuauacaaaaacag

SEQ ID NO: 4140579 - RNA, 67 nt, Human
cugucaugaagccugcuggaucaagcuuaugcuguuuucagugaaagugaauccagaggcuuugcag

SEQ ID NO: 4140580 - RNA, 59 nt, Human
cugucauugagucgucagagucuuccgcauaccuguuggaggccucucauucaugucag

SEQ ID NO: 4140581 - RNA, 57 nt, Human
cugucauuuacuccauacccucaccuuaauucugguacagggaaaagagugugacag

SEQ ID NO: 4140582 - RNA, 74 nt, Human
cugucauuuccuuccugcugcuccucuccccagagucuaauggagucuccuugaggcagcugaaggagugacag

SEQ ID NO: 4140583 - RNA, 58 nt, Human
cuguccaguccaucuauccucauuguguagcugcagugcagguuaaggaacuggccag

SEQ ID NO: 4140584 - RNA, 66 nt, Human
cugucccagguccuagaugaccaggggccaaggacaugguacuuggugucagagagcugggaugag

SEQ ID NO: 4140585 - RNA, 77 nt, Human
cugucccgccacagcuucgcagucugcugccucuuugaggagcaguaggggcuggagggcugugagaggugggacag

SEQ ID NO: 4140586 - RNA, 96 nt, Human
cugucccuguguggguggggccucuuccauuucccugacuuagaaaccacaguccaccuagaacaggguuugagaggcuuagucagcacuggguag

SEQ ID NO: 4140587 - RNA, 68 nt, Human
cuguccguggcugccugccuccaagccgggcuccucugcagccugagcuccaguagcagccaggccag

SEQ ID NO: 4140588 - RNA, 59 nt, Human
cuguccuagagacaucagauguucuauguuagaauggguuucauguuucuauuggaugg

SEQ ID NO: 4140589 - RNA, 77 nt, Human
cuguccucagcccagcccuuccguacccagcauccacuguccuggugggaguccgcugugcugcuccaagaagacag

SEQ ID NO: 4140590 - RNA, 68 nt, Human
cuguccucagccucuugcacuuugaaggcccaggguuucuuccgccuccagggacaggagugugucag

SEQ ID NO: 4140591 - RNA, 57 nt, Human
cuguccuccagacgacaguccccgcagcguguggcaggggcuggcgcauggggaaag

SEQ ID NO: 4140592 - RNA, 69 nt, Human
cuguccuugcugaucugaaacguuacugugcacaacaacuauagagcagccuucagagcaguuggagag

SEQ ID NO: 4140593 - RNA, 63 nt, Human
cugucgccgucaccguuccugggaagcucuccucgcggugcccagguguggaggcgguggcag

SEQ ID NO: 4140594 - RNA, 76 nt, Human
cugucuagaauuuauuuuuguguguggaauaaaaaugugaucacauguauuucuuuuacauuaagauuucagacag

SEQ ID NO: 4140595 - RNA, 65 nt, Human
cugucuaguuaggaugccagcagaguggaacaauaugcuacaggcgauccucaacuauucuccag

SEQ ID NO: 4140596 - RNA, 63 nt, Human
cugucuaguuucugcaaaucuaguuucugcaaaaauuagcagaauaauagcagaaauuagcag

SEQ ID NO: 4140597 - RNA, 71 nt, Human
cugucuauugcccucuuaggucugcgcagcucugcugugagaggcugagcagguguaaggaaggcuagcag

SEQ ID NO: 4140598 - RNA, 58 nt, Human
cugucucauguagauggacuaugagcaauguaggccauugcuucauuaugugagauag

SEQ ID NO: 4140599 - RNA, 64 nt, Human
cugucuccgcccucuugguaggcccugugggaucaagugucuccgaggcggcgggcugagacgg

SEQ ID NO: 4140600 - RNA, 74 nt, Human
cugucuccguuguacaggcagggaaacugaggcucugguagcuucacuuccccagugccuuacagcuggaaagg

SEQ ID NO: 4140601 - RNA, 129 nt, Human
cugucucugacacugcaguagccacagucgagcuugagcuggcugguccagcaggggcugcuccgcagcccuggggcucagaccagagcaaugcugugagaguccugguacuggccagugcagagacug

SEQ ID NO: 4140602 - RNA, 55 nt, Human
cugucucuguugccuguaggugaaaugaucccaacagaagaacaucggagaccag

SEQ ID NO: 4140603 - RNA, 55 nt, Human
cugucucuugguguccagaggaggcucugccucccgcugggcagagaggagaggg

SEQ ID NO: 4140604 - RNA, 90 nt, Human
cugucugccuugccugugaauacaagccaggcacaaggcaucgaaucccguggugcgagcuucugguuugguauucaccaugacagacag

SEQ ID NO: 4140605 - RNA, 100 nt, Human
cugucugcucugcccugcccagccuggccuuggagaggcacggcccuuuccuuagggguuuggaggcuuccuaggaccaggucaaugggucagagcccag

SEQ ID NO: 4140606 - RNA, 69 nt, Human
cugucugucccgucaccgccccauguucguucaucucacuguugggcaguuuggugacgccaguugcag

SEQ ID NO: 4140607 - RNA, 60 nt, Human
cugucuguggucucaguaggccucuuucagcccagcggccuccaugccaccaucagacag

SEQ ID NO: 4140608 - RNA, 58 nt, Human
cugucuguucagauucauuacucuauaccuggccucuagagcagggucuggcagacag

SEQ ID NO: 4140609 - RNA, 55 nt, Human
cugucuguuucaaaagugguuauccuucauugagcaccaaaugugcaacaggcag

SEQ ID NO: 4140610 - RNA, 65 nt, Human
cugucuguuuuaccuucuccagagaacacacuuucagucuuuuacccgggaagaaaaagggacag

SEQ ID NO: 4140611 - RNA, 55 nt, Human
cugucuucugcaaggugcguggggguguggccaugcacaagccagcaggggacag

SEQ ID NO: 4140612 - RNA, 80 nt, Human
cugucuucuucugugguuguggaggguaagauucuggaagcuucuuaggaucaggcccucuaggguagcagagguggcag

SEQ ID NO: 4140613 - RNA, 58 nt, Human
cugucuuucaugaggcccugaggucuaggagggccugagucacaucaggagaguacag

SEQ ID NO: 4140614 - RNA, 64 nt, Human
cugucuuuguugguuuaugguguuuuguuucacuacugaauuuuaauuagaucugcaaggagag

SEQ ID NO: 4140615 - RNA, 70 nt, Human
cugugaaaggggucacagggaaagcguuaacagaucaaugccuuuggcugugugcucccuuuucccacag

SEQ ID NO: 4140616 - RNA, 76 nt, Human
cugugaacucacaaggcgcuggucacagaaagcagacagccuccgugaacuucaucagcuuccucugugguuccag

SEQ ID NO: 4140617 - RNA, 68 nt, Human
cugugaaggcaaugauaagagugacagccagaauggggaccaccuaguuuacucuucucguuuuacag

SEQ ID NO: 4140618 - RNA, 65 nt, Human
cugugaaggcagcagcucuguccauguuguuuacuguagggcugaacacugaccuugagacauag

SEQ ID NO: 4140619 - RNA, 66 nt, Human
cugugacuuuagacuuagucaaguugaauggaaacaaagaaacuugaauaggucagagaauuauag

SEQ ID NO: 4140620 - RNA, 63 nt, Human
cugugagaaaggugauggagguucugacaucagagcugugccagauucauccucuuuccacag

SEQ ID NO: 4140621 - RNA, 64 nt, Human
cugugagacacccaagagucagauggggaaacugagucccagggcucaagggcaugcuacgugg

SEQ ID NO: 4140622 - RNA, 91 nt, Human
cugugagaucccaggccccaccaggaacaagccauggaggaacagccaaccugcucauuucaguuuguugccucagccugcaucuccacag

SEQ ID NO: 4140623 - RNA, 95 nt, Human
cugugagugugccuggcgcugguugcugaucugggggcccccaccucuggugggucccucaugagaggcauuuccugccagccagguauucgcag

SEQ ID NO: 4140624 - RNA, 93 nt, Human
cugugcaccauuucuagaaauccguugcaaauguuucauaacaguagcagcuuguucacccuuuauggaauauuuguaggaaagaagguacag

SEQ ID NO: 4140625 - RNA, 86 nt, Human
cugugcagguuaaauauugauccacagagguacuuaguuuuagaguaugguacuccagacauucuguccucguuagaccugcagag

SEQ ID NO: 4140626 - RNA, 58 nt, Human
cugugccucccuuuacuuugaguucgcaucugcccucacaguaucucuggagccauag

SEQ ID NO: 4140627 - RNA, 76 nt, Human
cugugccuccuuccuccuccucacagucaccugcagcugcccgacuucagguucugagagcaggagaggucugcag

SEQ ID NO: 4140628 - RNA, 126 nt, Human
cugugcugccgggaaacugggcgcauugucguucagguccuugaucuccaccuuuaucacgcagauuuccauugagcuggacaugaccucgagcgagaugaugcacuuggggcucuggcggcacag

SEQ ID NO: 4140629 - RNA, 83 nt, Human
cugugcuggagagggagcuguuggaagugcugggugcacugauaaagaagcauguguuccucugcuuccuccccauugcccag

SEQ ID NO: 4140630 - RNA, 57 nt, Human
cugugcuggagaugggccagagggggcugguuccuagggcccagugaaccaggacgg

SEQ ID NO: 4140631 - RNA, 63 nt, Human
cugugcugucuuuucuugcuguggucaugguuaccagaugugguaguugaagggaagguacgg

SEQ ID NO: 4140632 - RNA, 61 nt, Human
cugugcuuuauugucauauacauggaaaccauuuccaauguguuuguggcauggaucauag

SEQ ID NO: 4140633 - RNA, 127 nt, Human
cuguggacuccagucugagaaaugguucucuuguuagugugcauggaugccucaacuggguucaggcaugaagacuauguuugaggccccugaaugcacagcagagaaagcucaacugcagacacag

SEQ ID NO: 4140634 - RNA, 56 nt, Human
cuguggagcagggcagggucaccggccagacugagcuguccuccccugcucuacag

SEQ ID NO: 4140635 - RNA, 71 nt, Human
cuggggguccagggacguuucugcagugcguaauccaucauagacagcauagacucucugggcuuguccag

SEQ ID NO: 4140636 - RNA, 89 nt, Human
cugggguaguuuacacacaauuagcauaguaaaaaggaaauguuguuguuguuauuguuguuauuguuguuuacuucacuuuaacucag

SEQ ID NO: 4140637 - RNA, 87 nt, Human
cuggggucccucgguccagccugguugcgggcauccuccucacggacuggggcaggcguccagcgcggaaugugcgagguacccugg

SEQ ID NO: 4140638 - RNA, 57 nt, Human
cuggggucuaaucuuccauuucuauaccuaauagcuaggguaagacuuggaccuugg

SEQ ID NO: 4140639 - RNA, 124 nt, Human
cuggggucuguucugaacaagaugaacaguaugcaacaugauuaugaugcaauaugcuccuaguuuuucccaauguggauacaaucucauuuaaaucaacaaugccaucaggagcagauuucag

SEQ ID NO: 4140640 - RNA, 74 nt, Human
cuggggugaggucaaggucaagagacagaguagaaagacaauuuuagcuuuggcuauuuuaauuucauacucag

SEQ ID NO: 4140641 - RNA, 62 nt, Human
cuggggugcuuucugaagcacacggaagaaccaccugcugcuucugaugugagcagccccag

SEQ ID NO: 4140642 - RNA, 55 nt, Human
cugggguggggagaacaugggcacgggagguggaaaaccuaagcuccagccccag

SEQ ID NO: 4140643 - RNA, 58 nt, Human
cuggguccugcacugcaagcaccucucgagcacaaggccuaacagaggcagggcugag

SEQ ID NO: 4140644 - RNA, 75 nt, Human
cugggugaggugggcuggccagagacaacacugggagccugcagugguggucuagccauagccccccucagccag

SEQ ID NO: 4140645 - RNA, 66 nt, Human
cugggugucaggagacaugauggagaggaaagcaucaucauggucauucucugucucacuguccag

SEQ ID NO: 4140646 - RNA, 82 nt, Human
cuggguugcuuauuuaaaauguagguugggacuuagagggugcagcaguucccauccuagaccuacugaaucagacucucag

SEQ ID NO: 4140647 - RNA, 73 nt, Human
cuggguuggugggcgggcaggagcgcaccuggguccguccucucagggcucgcucgcucgcucgcucgcucag

SEQ ID NO: 4140648 - RNA, 107 nt, Human
cuggguugguuccaagucuuugcuauugugaauagugccgcaauaaacauaugugugcaugugucuuuauagcagcaugauuuauaguccauuggguauauacccag

SEQ ID NO: 4140649 - RNA, 68 nt, Human
cuggguuucacaucccuggaguuacccaguggggaaaguuuaucuuaagggaggggauguaagccugg

SEQ ID NO: 4140650 - RNA, 120 nt, Human
cugguaaaaugacaucauucagaaagaaucaaucaggagacagcaggcacacaaggauagaaguucucacuuugggccgcuguuuucaggcuuuucaguuugaaggugagguuuugccag

SEQ ID NO: 4140651 - RNA, 55 nt, Human
cugguaagaaggucuaagucaauccauuaguugauucacagaauaguuuuaccag

SEQ ID NO: 4140652 - RNA, 66 nt, Human
cugguaaguauccuuccacacugucauaauucccaggaaacagcuugagacuggauaugcacacag

SEQ ID NO: 4140653 - RNA, 94 nt, Human
cugguaccucuucaccccuuugcucaccaguuugguuauucccuccagguaaguuccuagaggagaguugcuggauggaagguggagaugccag

SEQ ID NO: 4140654 - RNA, 56 nt, Human
cugguagggaauccauagggccuauuuuggguaggcuggaaguaaaaacuuacuag

SEQ ID NO: 4140655 - RNA, 69 nt, Human
cugguaggugaugucccuuuaaggcucuuuaacauaagagcaaugaaaugaaaucagucuuaaaaucag

SEQ ID NO: 4140656 - RNA, 86 nt, Human
cugguaucucccgaguguguuuguaaccauaugcggggugauaugccccagccugugugugaggacuggcugugugggaguacugg

SEQ ID NO: 4140657 - RNA, 80 nt, Human
cugguaugaaguaaaauugauuuggaauccuagcucuuuauggaaggaguuuagaguucaaauuaguucagcuuccucag

SEQ ID NO: 4140658 - RNA, 64 nt, Human
cugguauugaggagucaggggcacggaauagaagacauuuccggucacaugacaucucggcugg

SEQ ID NO: 4140659 - RNA, 92 nt, Human
cuggucacaggaauuaugaaggauccaaagggucucucuugacacuuacagagcaagacccuggguucucucuccgcuuucuugcucaccag

SEQ ID NO: 4140660 - RNA, 60 nt, Human
cuggucagggcucuuugggagccaucuggcccuccaucccauagagcugugcugagccag

SEQ ID NO: 4140661 - RNA, 60 nt, Human
cugguccccagacugggcuuagcuuuagucugaauucugggcucugggucugugggcuag

SEQ ID NO: 4140662 - RNA, 70 nt, Human
cugguccuuugccaucucuccaccucgcuccuggccuuccuugccgggggagcagagggcagaggcucag

SEQ ID NO: 4140663 - RNA, 56 nt, Human
cuggucuaguucccagcacgcuggacccgcagagugauuucagggaacagaaucag

SEQ ID NO: 4140664 - RNA, 74 nt, Human
cuggucuauaaaugcagauaugugugugcgcuucuauguauggaugcuuacauguacaugcauagguagagagg

SEQ ID NO: 4140665 - RNA, 58 nt, Human
cuggucugaaaaggaggcaugccagcaccucccacugagcguuucuauugaggaucag

SEQ ID NO: 4140666 - RNA, 60 nt, Human
cuggucugaaaugugacuuuugaaccauuccuuugguuaaaguaaguguuucagaaucag

SEQ ID NO: 4140667 - RNA, 70 nt, Human
cuggugaaguuuuauuaaauccacagaaguaaaaaccauguuaugaggaacugggagauggggccaccag

SEQ ID NO: 4140668 - RNA, 76 nt, Human
cuggugaauugucccgugcccuguguaucuaugaguccugcagagaugacaaaucaggggacggggucaugucuag

SEQ ID NO: 4140669 - RNA, 80 nt, Human
cuggugagacccuggaaggagcccgggcggaucagguccagccgguugcccgacagcuccagcuccuccaggcgcaccag

SEQ ID NO: 4140670 - RNA, 62 nt, Human
cuggugaggccaguggucugagauaaguaauguaacuugcaaauagcccuggccaucaugag

SEQ ID NO: 4140671 - RNA, 77 nt, Human
cuggugcccuuucuuucagaacacaagugauuauuacugcugauaugaaucaaggugauuuggagcugggcaugcag

SEQ ID NO: 4140672 - RNA, 90 nt, Human
cugguggaaauauuuugagugaaauccagggggacugagguauagaaacuguacucaauuucuuauggguuuccuuacuuccuccucuag

SEQ ID NO: 4140673 - RNA, 57 nt, Human
cugguggcaaagcuaauuaggcccaauuauuacccaccugaccuaauuugccaucag

SEQ ID NO: 4140674 - RNA, 130 nt, Human
cuggugggcgccgcccuucuccgcggccugcugcugagccuuccggucgcucggggccuggggcaguggucgggucuggaggagggcucugcggcucugccagggucgcggacggaggaacgccuaccgg

SEQ ID NO: 4140675 - RNA, 78 nt, Human
cuggugggcgccugggcaggaugggcccggugcauuggaggcagccucccgcugggcgccgaccugcuggcccugcag

SEQ ID NO: 4140676 - RNA, 72 nt, Human
gaacgucagaggugagcuucuugcuaagguuuugcuguccuuaaccuucagcagagcucauuuuucacaguc

SEQ ID NO: 4140677 - RNA, 81 nt, Human
gaacuaaaggcaguaggcuggugauuagaagcagcccaaguggguuugcuugaaauucagucaagaauaucugucugguuc

SEQ ID NO: 4140678 - RNA, 58 nt, Human
gaacuacauguguguugccaugauguuucucuuguccaggccuuugcacauguuguuc

SEQ ID NO: 4140679 - RNA, 91 nt, Human
gaacuauagagcaaccugcauauaaagucguucagccaagagcaugggcagaaugaagcccugcugagcauuugugcagcuucucaaguuc

SEQ ID NO: 4140680 - RNA, 63 nt, Human
gaacuauggauguucuagggaugugaugauggaaaauauuacaaaugcccauacaucuaguuc

SEQ ID NO: 4140681 - RNA, 117 nt, Human
gaacuauuuagcuuuuguggauucuagcgcagaauacaugauuaaaguuugauuugucuggacaaacuuccaucaugaauuuuaauacaguuaugaggaaaaauacuaaauaaguuu

SEQ ID NO: 4140682 - RNA, 91 nt, Human
gaacuccacaguuauccaccuuuuugccugugaauacuaucuugccucacacuggaagauggagcacgagcagaagcagaaauuggaguuc

SEQ ID NO: 4140683 - RNA, 77 nt, Human
gaacucccccuaacacugguucugacuacacagcuuuucuaggagggcugagguugccgguguaagagaaggaguuc

SEQ ID NO: 4140684 - RNA, 64 nt, Human
gaacucguugcugaagccaaagucagcaaucuugauguuggccucggcauccagcaagagguuc

SEQ ID NO: 4140685 - RNA, 59 nt, Human
gaacucugagaggagcacaggcucuacugcagugccuggacggcuuccucaugcaguuc

SEQ ID NO: 4140686 - RNA, 55 nt, Human
gaacucugaggagaaagagcuuggugccagaugcaaucccaggaacucaggguuu

SEQ ID NO: 4140687 - RNA, 61 nt, Human
gaacucugaugguaggguagagguagcgagauagucagcuucuggcucuauaucagaauuc

SEQ ID NO: 4140688 - RNA, 61 nt, Human
gaacugagccucagcucaugcuucuguaacaggaagaagccauucccuguaggcucuguuc

SEQ ID NO: 4140689 - RNA, 77 nt, Human
gaacuggcccauccagagugauggcaccugcugggugcgccgggcgcccgcgguaccacucauucccugggccguuc

SEQ ID NO: 4140690 - RNA, 88 nt, Human
gaacuggccuugagccaccuccugccucagccuccccacgugcugggagugaggcugagccacggggcuggcugcugugggcgaguuu

SEQ ID NO: 4140691 - RNA, 97 nt, Human
gaacuggggcccaucuugcuguacguuagacucuccacucugcugcuugucagcaguggggacuuaugccagcauuuaccuauaugagccucaguuu

SEQ ID NO: 4140692 - RNA, 56 nt, Human
gaacuguuuuguaaaggaacucaucuagccuuugcuggcuccuuggcaaccaguuc

SEQ ID NO: 4140693 - RNA, 78 nt, Human
gaacuuaaccguuguuuuccugggauaccaaccuggagguguuuuugagguggcccaaagaaauacaaagagaaguuc

SEQ ID NO: 4140694 - RNA, 78 nt, Human
gaacuuccuuucagaggggcguacacagcaccgcggccgugugccugugaucuccuucugaguuugaaaaagaagauc

SEQ ID NO: 4140695 - RNA, 78 nt, Human
gaacuucucuuuguauuucuuugggccaccucaaaaacaccuccagguugguaucccaggaaaacaacgguuaaguuc

SEQ ID NO: 4140696 - RNA, 78 nt, Human
gaacuugaugaguagguaugaggcccacaggagcccuucuggagcucuuuggucgcaucauccauuucuuccgaguuc

SEQ ID NO: 4140697 - RNA, 57 nt, Human
gaacuugggagaagggagugugucgaugagccggccuugcucccuauaccacaguuc

SEQ ID NO: 4140698 - RNA, 99 nt, Human
gaacuuuaaaaaauacagugccugggucccagucccuagcuuuugaucuaauucauguaggggugggauccaggaauuaccauguauuuuaaaagcuuc

SEQ ID NO: 4140699 - RNA, 66 nt, Human
gaagaaaaccugaguacugcugggaaugccacguccgggucucucucugugugccucaguuucuuc

SEQ ID NO: 4140700 - RNA, 79 nt, Human
gaagaaaauuuggcuuaguaggaaaguguuuuuguacugggcagaaacacugugucaaacuggggcaaacaaccucuuc

SEQ ID NO: 4140701 - RNA, 85 nt, Human
gaagaaaguaucagugguacucucagauguuuaauuggccugccuaagagcuucuaggccuaagagauacuacugugaucucuuc

SEQ ID NO: 4140702 - RNA, 77 nt, Human
gaagaaaugcuccuucaaaagucauaguaaaacagaucauguagauuuuuacuuuugcuguugaaguuguggguuuc

SEQ ID NO: 4140703 - RNA, 84 nt, Human
gaagaaauuaaaugacaggggaagaugauaauaauggagaccagacugcaaugauggcuguuuguuccuucauuuaauuccuuc

SEQ ID NO: 4140704 - RNA, 122 nt, Human
gaagaacauagcauguuugcuugucugcauacagaauuucagugauguuuucucaaaugaauugagaauaauacugaaaugcugaaaucuugugauauauaaguggaaugucuaugggcuuu

SEQ ID NO: 4140705 - RNA, 68 nt, Human
gaagaacuuaacauaauaaggagagagcaggaaccuuauuccaguuucuuguuguuuuggguggcuuu

SEQ ID NO: 4140706 - RNA, 73 nt, Human
gaagaacuugcagcugguuaaugggagaauuagaauuaaaaucagccuccuaacucccaggccagugcucuuu

SEQ ID NO: 4140707 - RNA, 70 nt, Human
gaagaagaugcugcuuguucacgggcauuuuuauuacauuaggaucucugagcucgugcaguacuucuuc

SEQ ID NO: 4140708 - RNA, 74 nt, Human
gaagaagcauggcugcucccuggcugcaccugcugaguugacagguagucccagagagcuggucgugggucuuc

SEQ ID NO: 4140709 - RNA, 74 nt, Human
cuuaaagaacuacugucuuauuuuagauaaauguauccucaauaaauuuguauauuuaagaggguagguuuaag

SEQ ID NO: 4140710 - RNA, 61 nt, Human
cuuaaagggagaagagugaccuccaccccuccugcacuggaguauauuucucucucuuaag

SEQ ID NO: 4140711 - RNA, 80 nt, Human
cuuaaauccugagcuacaccugcuccuuggcaucucaauggaaugauggaagaguagugaaaguguggcuaguguuaaag

SEQ ID NO: 4140712 - RNA, 75 nt, Human
cuuaaaugucuccaggggccagguaagucacccucaugacugagguggcugagcugugccccuggcuacacggag

SEQ ID NO: 4140713 - RNA, 89 nt, Human
cuuaaauuguacuuuuauuugguguaggccuggaguugcauuugaccagcaaagaagcuguuuguacuuagauaguaaguucauuugag

SEQ ID NO: 4140714 - RNA, 62 nt, Human
cuuaacagaaguuguucauugugggcucagaaggagcccacggauuuaaucuucuuguuaag

SEQ ID NO: 4140715 - RNA, 105 nt, Human
cuuaagaaguaaguuuaaaucuacuuaggguggcuuuagacuagauagcuuccugaaagcuuucugucauaguuaucuuugugcuuuuauugccuaucacauaag

SEQ ID NO: 4140716 - RNA, 65 nt, Human
cuuaagcuggggcuaugcuaaauagccaaugauaaucuaggcuaguuuauguaguccuguugaag

SEQ ID NO: 4140717 - RNA, 69 nt, Human
cuuaaggaaguacccauucuuagggucaugcuugugcagucagccccugagagugagugccaccuuaag

SEQ ID NO: 4140718 - RNA, 78 nt, Human
cuuaagucuuccuggaaaugucgcguguagaaaugccaacauacauuuccauacuacugguuccauauaagaucuaag

SEQ ID NO: 4140719 - RNA, 66 nt, Human
cuuaauacacuauuuugugcucagugauagaaaauaguguuucagugaguaugugauaguguugag

SEQ ID NO: 4140720 - RNA, 76 nt, Human
cuuaauauauucuugccugauagcaaggaagaagaauaauucccuuccugggcugcagggaagagcauggagaaag

SEQ ID NO: 4140721 - RNA, 70 nt, Human
cuuaaucaagaguggggacugugccuuugcagaaaaauaagucacagaacauccuuagcucaugauucag

SEQ ID NO: 4140722 - RNA, 86 nt, Human
cuuaauucugcucucaauuuaggcauugaauuagaauagcgacauacacuauuuuauauaaugaauaggaaggggagagaauuaag

SEQ ID NO: 4140723 - RNA, 73 nt, Human
cuuacaaauuccuauaggguaggucuugcuacugucauuucauguaugaagaaaccuauccucuagugguaag

SEQ ID NO: 4140724 - RNA, 91 nt, Human
cuuacagaaaaucauuaucauagggagagauuugaauucuggguggaauaaauuagaacaucaauuuccccuauugauagacccuuguagg

SEQ ID NO: 4140725 - RNA, 69 nt, Human
cuuacagauguuucaggaauacuauuuugaacccaaagggagaguuuagugugucugaucacuugugag

SEQ ID NO: 4140726 - RNA, 75 nt, Human
cuuacagcauucagagucugcacaacagcacugacaucccugcuucaugugcaacugugaguacccaucuguaag

SEQ ID NO: 4140727 - RNA, 73 nt, Human
cuuacaguaacauuuucagucugcagccgcgacgucugauguuagggacuagaacugagaucucugcugugag

SEQ ID NO: 4140728 - RNA, 55 nt, Human
cuuacauaugcaagacaaagggaugugaaaaacccucuguguugaggguguugag

SEQ ID NO: 4140729 - RNA, 72 nt, Human
cuuacccuuccuuauguuuaaagugcuuaaaagcuaaguuuagaacuucaugaacuaagggaucggguacag

SEQ ID NO: 4140730 - RNA, 81 nt, Human
cuuaccuaccuacuuaucuaucuguuuuuaugucuaucugucaugcuuagcauaguaacuggcagauuguaggcaguuagg

SEQ ID NO: 4140731 - RNA, 73 nt, Human
cuuaccugccugguggaguuaggcaucacaauagagguaacauuuaagcugaggaacucaccaggcagagaag

SEQ ID NO: 4140732 - RNA, 66 nt, Human
cuuacgccugccaccuaagacugauugcuuuguguucacgguccucaguccauaggugggccugag

SEQ ID NO: 4140733 - RNA, 62 nt, Human
cuuacuagaaauuaccuucucacugccaucuaaaagugguagacuucagauuuucugguaag

SEQ ID NO: 4140734 - RNA, 62 nt, Human
cuuacuagcuacuuugacuaaagcacccauuuacagcuauuuagcaaacccuugcuggugag

SEQ ID NO: 4140735 - RNA, 94 nt, Human
cuuacucauucauguaccuuacaguaguguaugucaacuacauaucaagaauuguauggauguacaagauuguaggaaugcuggaaugaauaag

SEQ ID NO: 4140736 - RNA, 64 nt, Human
cuuacuggauacucaagacauguccagaaaccaauuggauaaaggugucuggaguacuagagag

SEQ ID NO: 4140737 - RNA, 127 nt, Human
cuuacuuaaacucaggacuuacgguuacucauauggcuuuaaacuuuucauuucaucauaaguccuuugaaaugugagacguagaguuaauggaaaaugauaaggaaaacugcugcauuuaaguaag

SEQ ID NO: 4140738 - RNA, 76 nt, Human
cuuacuuuaauagcuuaguccugauucuguugagaguggcuguuaauggaacacaugauuaauggcuauuaaugag

SEQ ID NO: 4140739 - RNA, 129 nt, Human
gaaaagacgagagcuguauaaaguaagaauggccugagagaacugaccaagagcaggcucauuuucuuuucugcucguugguuccuuuucuuucaucaccgaucuugauccauccccuccucccuuuuc

SEQ ID NO: 4140740 - RNA, 63 nt, Human
gaaaagagguuuaacugacucacaguucugcauggcuggggaggccucaggaaaccuacaauc

SEQ ID NO: 4140741 - RNA, 59 nt, Human
gaaaagcuuacugccacuuggcucuguccaugauacgucauuugggagagaguuuauuc

SEQ ID NO: 4140742 - RNA, 60 nt, Human
gaaaaggcacuggauagcuggggaugcaccacaugcccuuguccuucagaugucuaacuc

SEQ ID NO: 4140743 - RNA, 59 nt, Human
gaaaaggcugcccacuuauugagucuugaguccaaaaaucaaugugagguagucaguuc

SEQ ID NO: 4140744 - RNA, 60 nt, Human
gaaaagggagagcaggucuaccauuucuaaagguacauaguggagacaauugcccuuuuu

SEQ ID NO: 4140745 - RNA, 77 nt, Human
gaaaagggggacauguaaacauuuacaguauuaucuccugauuaaaugcuguucuuuauguuauuuuuaucuuuuuc

SEQ ID NO: 4140746 - RNA, 76 nt, Human
gaaaagguuacucugcaaguugaagguggcuuagaggaccaaaagcacuuucaaaaaacaugcagacugcugauuc

SEQ ID NO: 4140747 - RNA, 59 nt, Human
gaaaauagcagauagaccaaugagauccugaguuucuuguugaaauaggugcuguuuuc

SEQ ID NO: 4140748 - RNA, 86 nt, Human
gaaaaucaaucuaguugaauggauuuguuauauuauauuuaauugaugauaauaauagauauggccgucuguuuuaauugauuuuu

SEQ ID NO: 4140749 - RNA, 58 nt, Human
gaaaaucaggccauggagaagagauucagaugagauuucacaaaccauccugauuuuc

SEQ ID NO: 4140750 - RNA, 86 nt, Human
gaaaaucuucccagaguugguagaccauuaugugagcuuucaaagagacaaggcggaaauuggguuuccugcauugggaaauuuuc

SEQ ID NO: 4140751 - RNA, 86 nt, Human
gaaaaugaugugauaaugaagauuuauaauugccuuuucucuguuggagaggcugucucauauuuuguaauauuauaugcauuuuc

SEQ ID NO: 4140752 - RNA, 69 nt, Human
gaaaaugcggcuuuuguccggcgcuguuaaugcaaguuguaacaguguaauaugggagucaguguuuac

SEQ ID NO: 4140753 - RNA, 57 nt, Human
gaaaaugugucagcuugucgaucuucucugcagcaggauccaauagcuacacauguc

SEQ ID NO: 4140754 - RNA, 73 nt, Human
gaaaauguuggaagcugacagcuggguucagauguagggacgcuuucagauuuuaucagcuuccagcauguuu

SEQ ID NO: 4140755 - RNA, 105 nt, Human
gaaaauugcagcuuuggguuaggucacuggaguugggucaagauucucuuugagagcaauggaguaugaaacccacuccaauuuggucagacccagguaauuuuu

SEQ ID NO: 4140756 - RNA, 58 nt, Human
gaaaauuucugccacauguguguauacaugcaagugaaauuagcagaaucauguuuuc

SEQ ID NO: 4140757 - RNA, 60 nt, Human
gaaacaaagugaucaaagugcugugggagcaguuuggcaacaguuugagcuuugaauuuc

SEQ ID NO: 4140758 - RNA, 67 nt, Human
gaaacaaauuuggagagaaacaaguaggaggugacuggccuauuguuucucucuaauuucguguuuc

SEQ ID NO: 4140759 - RNA, 102 nt, Human
gaaacaauaccuaggaaauauuugaacauaggaaguccuuuggccuacuuugcuuuuggugcuugucuuuuccuguuuucuguuucuuaucuuuauuuuuuc

SEQ ID NO: 4140760 - RNA, 67 nt, Human
gaaacaauacuuguccucacuaccacugauaaaaggcaugacugauggugaggguaaguauuguuuc

SEQ ID NO: 4140761 - RNA, 77 nt, Human
gaaacacaaauagaauucuuugaaauuuaugcuuuguuagcuguaaagacauguauuugcuagauucuguggguuuc

SEQ ID NO: 4140762 - RNA, 97 nt, Human
gaaacacuuucauccauucagagacuuuaacaauggguaugaaagcaauguucaugauuucauauuucuuuaaggacuuugucauugaaaguguuuc

SEQ ID NO: 4140763 - RNA, 57 nt, Human
gaaacagauuaacagcauauuuuagugaaaccaaagcaaguguguuuuaucuguuuc

SEQ ID NO: 4140764 - RNA, 75 nt, Human
gaaacagauugcuugaauuaccauguaauaaacccagcuacauuuuauuaugugugcuuuuggcaaacuguguuc

SEQ ID NO: 4140765 - RNA, 83 nt, Human
gaaacaggccauaagcagugacaagucugguaaugccagaguaguuuuucugcaguaaagauuucccuuccugcuugccuuuc

SEQ ID NO: 4140766 - RNA, 77 nt, Human
gaaacauacagauaauuagcauaaaugcugcuggcccuuguguucugagcauugaugcuaauuuuuugguuuguuuc

SEQ ID NO: 4140767 - RNA, 129 nt, Human
gaaacaucagcaucaccugagaacuuuauauuagagaugcagauucucugcccuacuccaucugcugaaucaggaacucugggguuggggcccagcagucugcguuuucacaggaacccugggugauuc

SEQ ID NO: 4140768 - RNA, 121 nt, Human
gaaacaugugauuuugcaacauguguccacaugugguucaaguacuccacaugugcucuuucaauggguccugugaccuugcuguggaucacauguguuucacauaugguuuauaugguuc

SEQ ID NO: 4140769 - RNA, 66 nt, Human
gaaacauuggucugccccuuauuguacagagcaacaagacaauaaggcuuuauuagcuauuguuuc

SEQ ID NO: 4140770 - RNA, 67 nt, Human
gaaacauuuguugaguacuugcuuuggacucaugaaaaaaguaaugaugaguacuuuacaaguuuuc

SEQ ID NO: 4140771 - RNA, 64 nt, Human
gaaaccaacucucaaaacuccagcagaaggcaaugaagcuguuaauauuuuggugaguuguuuc

SEQ ID NO: 4140772 - RNA, 82 nt, Human
gaaaccaagcagucuaacuucacagccuggaaccacaaaccacuguguagcauccggcuucuggagugagguugaugguuuc

SEQ ID NO: 4140773 - RNA, 63 nt, Human
gaaaccgcaauuucagugcugagaacuuuguguguuuacaaaggcugaggucccugugguuuu

SEQ ID NO: 4140774 - RNA, 84 nt, Human
gaaaccgggguuguuguuggauguuaccguugaaaaucagucuggaugcaaaugggcaucuccaagugugcagcuuugguucuc

SEQ ID NO: 4140775 - RNA, 55 nt, Human
gaaaccuguccccucuuccucagugcuugccugaaagguuaauggacaguguuuu

SEQ ID NO: 4140776 - RNA, 60 nt, Human
gaaacgggccggcggauauuggcucggcgacacgccgaggcuccuccccgagucuggauc

SEQ ID NO: 4140777 - RNA, 64 nt, Human
gaaacgguguuaaauguguuaguugacugaaucuggcauuuauaaugcaauuuagcaaaguuuu

SEQ ID NO: 4140778 - RNA, 73 nt, Human
gaaacguagucaaaagugcacucucagugcugcugccgaccgggcacggcgcugggccugcauuugcgcuuuc

SEQ ID NO: 4140779 - RNA, 129 nt, Human
gaaacguggggaggggauccacaggccaaggcgccgcacagugaugcccugcuccaucccaugacagggccuggaaggggacuggcagcugcagaaaugguuuccggccuucccacaucccccacgcac

SEQ ID NO: 4140780 - RNA, 99 nt, Human
gaaacuauuuuuaacaccugcauaugacaguugaaaguaacuguuucaaguaauuaacauaauuugaaaguagcagcugcauauguguuaaacaguuuc

SEQ ID NO: 4140781 - RNA, 66 nt, Human
gaaacucagucuggaaauauugacuucagagaagaauuuugcauaagucauguccagugggguuuc

SEQ ID NO: 4140782 - RNA, 89 nt, Human
gaaacugagacccacaggaguuagucaguuguggagauuuaacugaaacccagauucucagaucccacauugaauucuauuucaguuuu

SEQ ID NO: 4140783 - RNA, 122 nt, Human
cuucacagagcuggugcugucaaggaucaaaugagauuauguaugugaaaucaccuugaaaaggauuucacagauauaagauuucaccacagauauaagacauuauugcagcugcugugaag

SEQ ID NO: 4140784 - RNA, 92 nt, Human
cuucacagggugaggacaaaaugagacacaugugacuucuuuguaaacugugacaaaaugagacacaugugacuccuuuguaaacugugaag

SEQ ID NO: 4140785 - RNA, 71 nt, Human
cuucacaugaguuucccugcacuguuguucuuacuauugugucuaguggaacacaucuaaggaagcagaag

SEQ ID NO: 4140786 - RNA, 60 nt, Human
cuucacauuugcgaaggccaaagccuguuaggucaggccuccuguuggcuagugugauag

SEQ ID NO: 4140787 - RNA, 74 nt, Human
cuucaccucuuugcauugcauacaaggaacugaguaauaagaaccucagccuuguuuguaguuaauaguggaag

SEQ ID NO: 4140788 - RNA, 129 nt, Human
cuucacuacauucuggaagcauaugguguuugguaacaguuacaguaacaguaaugguaguucuguauauauguagcuguauauacauuauuuuguguuacuuugaugugggguaauuggaauaaguag

SEQ ID NO: 4140789 - RNA, 81 nt, Human
cuucacuucaauacagcagauuucccugggcuccuggcugggcacagaguggcuggcagaggggagucuguggacguggag

SEQ ID NO: 4140790 - RNA, 59 nt, Human
cuucacuuucauuuguaauaaacuucccaugcuggcugggaaguuaauugaaaguuagg

SEQ ID NO: 4140791 - RNA, 58 nt, Human
cuucagagaguccagggacugcacugcauagguucccuuagcccugcacuccugguag

SEQ ID NO: 4140792 - RNA, 65 nt, Human
cuucagagugcagaagauugggauaauuuguaauggcuuuugaguuuucuguuuuagcucuggag

SEQ ID NO: 4140793 - RNA, 73 nt, Human
cuucagcuguggucuccaaggcucgggacugggcccagggcaguguagaaggucauggagauuguagcugagg

SEQ ID NO: 4140794 - RNA, 59 nt, Human
cuucagcuucuccuaaaugucccauaaacugugauaaucauuagggcagaagcaggaag

SEQ ID NO: 4140795 - RNA, 58 nt, Human
cuucagcuuuuuaacauaggaugcguuagauuuuucuauucuuauugagcagcugagg

SEQ ID NO: 4140796 - RNA, 88 nt, Human
cuucaggaaucauuuauucauagauuuaggaagcuuuuuggcagagauagcuaguuaaacuaugaauacaccaggcccuucucugaag

SEQ ID NO: 4140797 - RNA, 82 nt, Human
cuucaggccggcucuguuuacuuucagaggcuccuuuauaucccaggcaggcugccuccaagaagagcagaguccccagggg

SEQ ID NO: 4140798 - RNA, 55 nt, Human
cuucaguggucauuugugauaaagcuauuguuuuugucauuaaucgcuauagaag

SEQ ID NO: 4140799 - RNA, 96 nt, Human
cuucauacuuagcacauuuauuguuguauaagaaguuggcagauaaagcaaaacuuugguuagagucuugacacaaaaggaguuucuuagaugaag

SEQ ID NO: 4140800 - RNA, 69 nt, Human
cuucauauuguaaguagaaauguuauggucucaaccuucagcccaugauuugagcuacuuacuguggag

SEQ ID NO: 4140801 - RNA, 76 nt, Human
gaaagcuaaaaaguuacauaaauguccucuagcaagcagguuccuuguucugagggcuaauguacuguagcaauuc

SEQ ID NO: 4140802 - RNA, 56 nt, Human
gaaagcugugaaauagugcucuaagaguugucaagagcugugguuuuacaucuuuu

SEQ ID NO: 4140803 - RNA, 59 nt, Human
gaaagcuuggaaacgacuuuaucaugaugcaagaacuugauacuuguuuucaggcuuuu

SEQ ID NO: 4140804 - RNA, 76 nt, Human
gaaaggaaaggagaaaauaaauguucuguaaguaaaaauauacgcaugaaacaaggguauuuucucuauuucauuc

SEQ ID NO: 4140805 - RNA, 69 nt, Human
gaaaggaaauauucuaagcacuaaucugaguuucaucugccggauggaaaugcuaguauauuaccuuuc

SEQ ID NO: 4140806 - RNA, 74 nt, Human
gaaaggaaucaacuugcucauuggauuguucuuacccuugaggaagaaaauuacuccagagacaaguucuuuuc

SEQ ID NO: 4140807 - RNA, 71 nt, Human
gaaaggagaggguuaaggagcuggcagccacacaaacaccuuccacauugcacuccuugccauuucuuuuc

SEQ ID NO: 4140808 - RNA, 57 nt, Human
gaaaggagucagucuuacugaacugagaucaaggugucacagugcugcauuccuuuc

SEQ ID NO: 4140809 - RNA, 94 nt, Human
gaaaggcagccuccccacuaccagacuugccuuuagguuuuguuuaauucugccacuugcaaagcaaaugccugaaggcgggcaccugccuuuu

SEQ ID NO: 4140810 - RNA, 66 nt, Human
gaaaggcauuggacuaguaucagaucauauguauuuucauccugucauacuaguuuaaugaucuuc

SEQ ID NO: 4140811 - RNA, 76 nt, Human
gaaagggaaaaguaagauuuaugcuauaaacucuaggucauuaugagcuaaugauuuaauguaguauuucccaugc

SEQ ID NO: 4140812 - RNA, 130 nt, Human
gaaagggaugggauuucuaugcucaggauaauggagaauaggggccacuggugaggcuucacuuccuuccaugcuuggccagggcccugcucaauuucuccacgccuugccaagucaguccuaggacuuc

SEQ ID NO: 4140813 - RNA, 82 nt, Human
gaaaggguaaucggcuggcaugaacuuuggcagggaagaugucaugcaaaauccaguugguuucuguagcuguuagcuuuuc

SEQ ID NO: 4140814 - RNA, 64 nt, Human
gaaagggugaagaguagaugaaugcagugaacaguugauuccucaacauccauucuugcccuuc

SEQ ID NO: 4140815 - RNA, 78 nt, Human
gaaagguugccucagaaaguggcagguagggauagauggaaacauguaagguuuaccucacuauucugugucccuuuc

SEQ ID NO: 4140816 - RNA, 66 nt, Human
gaaaguaaaggcucacuggcuugggguggcacuccacgccaccucugguccugcugccuggcuuuu

SEQ ID NO: 4140817 - RNA, 90 nt, Human
gaaaguacuagaaccugacagguuuguccuugaaucaauucacaaccuucaaagaauguuguuucgaagggcacugucaccaucacuuuc

SEQ ID NO: 4140818 - RNA, 70 nt, Human
gaaagucagagaucuggaguacaacugcgcccauuuggcugcagaaagcaaaauggaucucuguauuuuc

SEQ ID NO: 4140819 - RNA, 65 nt, Human
gaaagucugcauacaggacaugcacaccaguaacuugauaguguguuaaaugucauguaggaguc

SEQ ID NO: 4140820 - RNA, 98 nt, Human
gaaagucuucagcaaauuacaguauaauuagauaucaaaagucugguuucaauuuucucuagacuaucugaauguuauuguuguugucauuauuuuuc

SEQ ID NO: 4140821 - RNA, 71 nt, Human
gaaagugcaugucaccuucgguggcacggucugcagugggugggccucucuacuggaaggugaccaccuuu

SEQ ID NO: 4140822 - RNA, 62 nt, Human
gaaagugcugagacagacugggaagccuuuggcuaccggcuuccacugucccuggcacuuuu

SEQ ID NO: 4140823 - RNA, 66 nt, Human
gaaagugcuuuugagugugugcaugcaugcucauacauucacgugcuuaacuuaggaggcaauuuc

SEQ ID NO: 4140824 - RNA, 103 nt, Human
gaaaguggaaaguaaauagauggaaagucgugaaggcccggaaccaggaaauggaaggucaaggucaccaggcaacuauguacuccaucuugcucuucuuuuc

SEQ ID NO: 4140825 - RNA, 80 nt, Human
gaaaguggcaugcagugacucagacacaggccagucaccuccacagccugucacucugagccgcuccgugaacgcucuuc

SEQ ID NO: 4140826 - RNA, 62 nt, Human
gaaaguggcuguauagccaagucagauauaagucuuuuaucuguaggcagcaugccacucuc

SEQ ID NO: 4140827 - RNA, 76 nt, Human
gaaagugguauacaauucuuaggaacuccuuacauugcaaaguacuuuggguuucaaagaguuguaaauuacuguc

SEQ ID NO: 4140828 - RNA, 85 nt, Human
gaaaguguagcauaauaguauuuauuuggaaaaagauccauuugaucauuuuauccucugggaagcuacaaugucuacaucuuuc

SEQ ID NO: 4140829 - RNA, 60 nt, Human
gaaagugugugugugugcacgugugugugugugcacgugcgugugcgcacacauacuuuc

SEQ ID NO: 4140830 - RNA, 68 nt, Human
gaaaguucuggaaagauuugcguguaagaaaucugauuuuguuuaacuaaaauuuuccagacacuuuu

SEQ ID NO: 4140831 - RNA, 70 nt, Human
gaaaguuugguuaaacgagagaacauaugccagauagaagguauuaaauguuuaaucuaacuugauuuuu

SEQ ID NO: 4140832 - RNA, 101 nt, Human
gaaaguuuuuugugggggugcuucugggagagcuuuugcuucuuaacaaaagggaagggugugaaaggagaguucucuuagguccacccucacuuucuuuc

SEQ ID NO: 4140833 - RNA, 88 nt, Human
gaaauaaaccuuuguggucuuaagccacugugauuuggcauuuaccacagcagagccuagcuuaaucugacugauagagguuaauuuc

SEQ ID NO: 4140834 - RNA, 83 nt, Human
gaaauaaauugggaaguaucucucugucuagcuuuggcaguuuuaccaggaugggccugggauaugcuuuaguaauuuguuuc

SEQ ID NO: 4140835 - RNA, 66 nt, Human
gaaauaagcaucuuuggauuguucuucuaggguguucuuucugccauucaacuagaugauuauuuc

SEQ ID NO: 4140836 - RNA, 92 nt, Human
gaaauacacuuaaaauauauacacuauuuuuauccuauuaaugaacaugauaaugggguggauagaaagugaugugguugggguuguauuuu

SEQ ID NO: 4140837 - RNA, 78 nt, Human
gaaauacagauucucaggcuucacccaggaccugcugaaucugaaacucucuggguggggcucagcaaucuguguuuc

SEQ ID NO: 4140838 - RNA, 125 nt, Human
gaaauagaaaauagcauuaacgggguuuuaaagcuuguauugcaauauuugaaacauuagaaaaaaaugaauauguggaagauaucugcaauauaauuuaaaggcucauuaguucaauuuauuuc

SEQ ID NO: 4140839 - RNA, 59 nt, Human
gaaauagaagcugccaauuucuucaggucugagcccaggaauugucacagcaucauuuc

SEQ ID NO: 4140840 - RNA, 95 nt, Human
gaaauagccuacuggacuaacagaauucucagcugaaauucccagcccuagagagucaugcugaggaugcugugaagccaaucugggcugcuuuc

SEQ ID NO: 4140841 - RNA, 76 nt, Human
gaaauaucaguuuguguguguacgugugguuuauaucagaaggaugucucccauacacacaccaaauuuguauuuc

SEQ ID NO: 4140842 - RNA, 92 nt, Human
gaaauaucccuuuuccuggggaaguucguaggugagcugcugcuaucagcuagcauuuacucccuaggcuguuuugggagaaagggguuuuc

SEQ ID NO: 4140843 - RNA, 63 nt, Human
gaaauaugcaauuuagaacagacuuaggaaaucccuaaggcuuucuaaauaugcagaaauuuc

SEQ ID NO: 4140844 - RNA, 96 nt, Human
gaaauauguuguucucucaaauuacuauguaugugugugugcauguguguaugugcaugaacacaugugcauguauauaauuuauaagaugauuuc

SEQ ID NO: 4140845 - RNA, 70 nt, Human
gaaaucaucuuucaguuuauaagucugcuauagcuaauuuuauaguauuggauuucugaaagaugagguc

SEQ ID NO: 4140846 - RNA, 68 nt, Human
gaaauccaugugagcucagaauugcuaauaaaauucaauauaggccauucuuggagcuuacugauuuu

SEQ ID NO: 4140847 - RNA, 63 nt, Human
gaaaucucacuguagucaaagugcccaggcaaaacauauugggcagcucacagaaagaguuuc

SEQ ID NO: 4140848 - RNA, 66 nt, Human
gaaaucugagcucuaaugucagccuugccccugguaauacaguacugcugauuagagcugagguuc

SEQ ID NO: 4140849 - RNA, 76 nt, Human
gaaaucugauccacaauguguuggguuaaguuugggcucauuccaauaugacccauuuaacauauucuuugauuuu

SEQ ID NO: 4140850 - RNA, 64 nt, Human
gaaaucugggaaccaaagggugcuuaagacuuguuuuaagucuaaguacagugguauggauuuu

SEQ ID NO: 4140851 - RNA, 130 nt, Human
gaaaucuguuacuagaguggaaguugcuucugccuguaauauuuggagaagcugcaaaauagauuuacaaauuuaaagcuucuccaaauacuacaggcagaagcaacuuccacucuaguaacaagguagc

SEQ ID NO: 4140852 - RNA, 121 nt, Human
gaaaugaaaguguacauccuuuaauaaauggaaauacuugccauaaaacuuuagcaacaacugccaguuaguggcaaagugguuugauuaauuguaacuuguaaaacuaugauaaaauuuc

SEQ ID NO: 4140853 - RNA, 60 nt, Human
gaaaugaauucugaagucuuccaauguuugcauuuauuggaggggcucccgaguucuauc

SEQ ID NO: 4140854 - RNA, 89 nt, Human
gaaaugacauuuucaggacagcauuccaaauacauaguuagggacaguuguucguagcuucuggaguguuugaaaauggcccucauauc

SEQ ID NO: 4140855 - RNA, 97 nt, Human
gaauugucauaauuuacuguuucagaacuucuuaaaaacguguuuuaauuaauuuugcuguauuuaaggcccuggagcaagcuuuuugugaugcuuc

SEQ ID NO: 4140856 - RNA, 99 nt, Human
gaauuuaacuugauauauauauauggguaucuguacugauuguuauaauaauaauaaacaauuucuaauauagaucuuaccagguaucugguuuuuuuu

SEQ ID NO: 4140857 - RNA, 85 nt, Human
gaauuuaauuuugaaaagucuacuugcaauugaguauccuauccuuuguagcuauuguugccaaguacuuugaaaaguugaauuu

SEQ ID NO: 4140858 - RNA, 77 nt, Human
gaauuuacugacuccuuucugauucaugauccaguucuuauaugaggaaugauucauggaucaggagaggaaaauuc

SEQ ID NO: 4140859 - RNA, 70 nt, Human
gaauuuagacuucuugcagguaauucuuagagaaacauaaaaagaaauugguuguuugaaguguagguuu

SEQ ID NO: 4140860 - RNA, 77 nt, Human
gaauuuauauuuuauucucaagacaaugggaagccaugaggguuuuacagauugcucuggggauggacagauagauc

SEQ ID NO: 4140861 - RNA, 55 nt, Human
gaauuucacaaggugaggauaaagagaacauuccuuauccucuccugauuaauuc

SEQ ID NO: 4140862 - RNA, 87 nt, Human
gaauuucacauuaauaaaggccaguaucagauauacuuuuaaugccuuuagaaaaugucugcuguugguuuauuaugacagagauuc

SEQ ID NO: 4140863 - RNA, 67 nt, Human
gaauuucaggacaacuggaaggacagaaguggaaauaucacaauggauuucaguuaucuugaccuuc

SEQ ID NO: 4140864 - RNA, 103 nt, Human
gaauuucauugguuugcuuucuccgagagucaauuuuauugguccaaauacauaguaaggcagcuguggcuaaugaaacaggagauggugccaaaaagcauuc

SEQ ID NO: 4140865 - RNA, 82 nt, Human
gaauuucucagcuggguuccuugaggggauucacuauaacugugcaucucuucauagugacacccaucuccucugggauguc

SEQ ID NO: 4140866 - RNA, 62 nt, Human
gaauuugagguguguauguuggggaaggagguauccuuucucuaucgacccaucgcgaauuc

SEQ ID NO: 4140867 - RNA, 72 nt, Human
gaauuugcuuggcaggcuuccagucuaugccaaugugagagcaagaucuuccagcccugccuaagcccuuuc

SEQ ID NO: 4140868 - RNA, 65 nt, Human
gaauuugucccuugauauaaaaagaauuuacuaccucacauaaguaaaauuaggggacucaauuc

SEQ ID NO: 4140869 - RNA, 85 nt, Human
gaauuuucuccuuacacuggggaagguguaggaaucauguaauugccgccuacuccggcauuugucaguaguggggagaagucuc

SEQ ID NO: 4140870 - RNA, 123 nt, Human
gaauuuugaaaucuaguuuucuuuaaagcaagacacacccauagcauuaguuucuccacuacaugugucaucuaagcuuugggugcucaguuuucuuucggggaauacuaggggaugagauuc

SEQ ID NO: 4140871 - RNA, 96 nt, Human
gaauuuuuggaguuuccaggcuuugguaugguuuugguguuuacuuacuuacuauuuuuuuaagccaugcuguuuugccugggauuuccuuaauuc

SEQ ID NO: 4140872 - RNA, 100 nt, Human
gacaaaaacaauaacuacagguugcaagauguuuaaaaagaugacucuuugguaaaugaauuaaaaaguuucuaaauaaaggccaugcauaccuuuuguc

SEQ ID NO: 4140873 - RNA, 64 nt, Human
gacaaaacaagucugacagcccgaagaucuucgucaugauuagaacgcucagaguugcuuuguc

SEQ ID NO: 4140874 - RNA, 57 nt, Human
gacaaagaaagacaaggggguguugagagucacaaacaugcccuguccucuucuguu

SEQ ID NO: 4140875 - RNA, 102 nt, Human
gacaaauaauuacccucuuuuuccugguagaaacuucuguuuacacggaaaauuuucucuaagauggauuucuuccagugagaauuugagcaauuuauuuuc

SEQ ID NO: 4140876 - RNA, 126 nt, Human
gacaaauagggaaauggugaaaguucuggucauggcuauaaaagaaguuuugguacuugggacauuagcaaccacgaauucuacuauuccuuuuaucucucuagauuucaauaaagcccauuuguc

SEQ ID NO: 4140877 - RNA, 129 nt, Human
gacaaaugacuagaauucuggagccugcaccuucauuuuaggcagcuauugcuucagaagucacagucuguuccaccagccuuugccaaggaugcaggugccacagcaucucaagagaagucaccaauc

SEQ ID NO: 4140878 - RNA, 97 nt, Human
gacaaauuauuuauuacaaauuauuaagcuacuuuuuuuauccuaggcauuaccugaaguacaugcuguaaugauuggugacaaaugguuuuuaguc

SEQ ID NO: 4140879 - RNA, 77 nt, Human
gacaaauugaagaacauaauagcuacuuguaguauauugacauaagugauucugauguguuucuuuaauaauauguc

SEQ ID NO: 4140880 - RNA, 116 nt, Human
gacaacagaacauugaccagaucuaugcagucauuugacaugcacacauggccuuacccuuucauguuuguagguaagugacacugcagaccuggugagacuguuucauguauguc

SEQ ID NO: 4140881 - RNA, 96 nt, Human
gacaacauuuuuauuugauauucccgauuuaagguaaaagcugcgugagauuaacacaaguuacagaauuagauuauuagagauagaauguacauc

SEQ ID NO: 4140882 - RNA, 80 nt, Human
gacaaccacaguguuuugcauuucuuuaucagugaaaaacaaacugauaucugaaguguauaaacaguucccuaguaguc

SEQ ID NO: 4140883 - RNA, 61 nt, Human
gacaaccucaggacucagcuugugggggcccuccucugcaaagcuuuuccugagaguuguc

SEQ ID NO: 4140884 - RNA, 126 nt, Human
gacaacgaagaaggguagaaaaaacccagauuauagcuuaaggccagugagugugggggcaaacagcucugcauggcuucaaagccuuuggcaccuugauugugugguucuaucuguaggguuguc

SEQ ID NO: 4140885 - RNA, 88 nt, Human
gacaacuucauuuccggugagcugcgggcgaggacuggggugcggcuccuuagccagggcagcucaaaauccaggagugcccaagguc

SEQ ID NO: 4140886 - RNA, 119 nt, Human
gacaacuugucauguguaaucagcaucacauuagucucaagagaauaagcucuccuuuaaucagcugcuuuucuuuaaucugguggggugaggcauaugguaaccaugacauuuuuguc

SEQ ID NO: 4140887 - RNA, 71 nt, Human
gaagcagaagaccuggguucgaguccuaacuggguuaucuguuagcugugugaccuuggucaaguugcuuc

SEQ ID NO: 4140888 - RNA, 105 nt, Human
gaagcagcgugauagagccaguggaacagagccguggggaugaaacugaguuuugugcccauguuucucuguaucccuacugaaaauuuaacacucagccguuuc

SEQ ID NO: 4140889 - RNA, 77 nt, Human
gaagcagucuuggagaacugggccuuaagccccugcauucuuucgggcuugacucuugcuucccauggaucagcuuc

SEQ ID NO: 4140890 - RNA, 56 nt, Human
gaagcauaggauacucaaaguuuggcaaaagcucaggaauugagauccuagguuuu

SEQ ID NO: 4140891 - RNA, 92 nt, Human
gaagcauuggcuacuuuuaaauguagauauagaaaaagacugacccacucaggauuggguuauauguuucuguuuggaggcaucccugcuuc

SEQ ID NO: 4140892 - RNA, 59 nt, Human
gaagccaaguccucgaguuucagguagacuucaguugauuucugcgaggucuuugcuuu

SEQ ID NO: 4140893 - RNA, 110 nt, Human
gaagccaauuugcaucucuugcucauuaaguagcucacaguggcuggaaauuugacagccuuaauguuugaacuucuugaacagcagguuuagaacugccagugauuuuc

SEQ ID NO: 4140894 - RNA, 55 nt, Human
gaagccagacucagcuuuggagacucggggaagaauuuccaaagcugcugguuuu

SEQ ID NO: 4140895 - RNA, 92 nt, Human
gaagccaggaacuuucuguuacaagugaaaaaaugguuuguuucauaauuugaucacuguuaacacccugggggcuccucagaauugguuuc

SEQ ID NO: 4140896 - RNA, 58 nt, Human
gaagccaggggccugacaggcaccuaugcccuggaagccugauucaccucuggacuuu

SEQ ID NO: 4140897 - RNA, 73 nt, Human
gaagccauuuauucucugucuuuuugaaaacaggcagaaacaugccuuggaagacauuaaagagagugacuuc

SEQ ID NO: 4140898 - RNA, 55 nt, Human
gaagcccuguaggugcaaagguaaacagucuaggccccagccuacgggaaguuuc

SEQ ID NO: 4140899 - RNA, 72 nt, Human
gaagccuacuagauauuuaauguaaucaccaugauaauggcuaagauuuauuaagcaucugcuaugugcuuu

SEQ ID NO: 4140900 - RNA, 56 nt, Human
gaagccugcuggaucaagcuuaugcuguuuucagugaaagugaauccagaggcuuu

SEQ ID NO: 4140901 - RNA, 66 nt, Human
gaagccugguccagagcucccaucaagccucccauggggaugucacugggguucagggaaagcuuc

SEQ ID NO: 4140902 - RNA, 57 nt, Human
gaagccugguucgcuggccaccucccgcuggggcguuggcccaggcugccagguuuc

SEQ ID NO: 4140903 - RNA, 82 nt, Human
gaagccuuguuuucaugucugagucuuggccuuauaacauuucuuugggacuugaaagaagacauggcaggaauacagcuuc

SEQ ID NO: 4140904 - RNA, 61 nt, Human
gaagcgcaggcaggacaagggguguagaagaugcagucagcuuugguuuccuccugccuuc

SEQ ID NO: 4140905 - RNA, 58 nt, Human
gaagcggguucacuggauggcuuugaggaauuaucuguacuguccacacacucgcuuc

SEQ ID NO: 4140906 - RNA, 79 nt, Human
gaagcuaacagagcuauuggauugucggauaucauuggaccaaaccaccucaauguauuguccaugugucuguuagcuc

SEQ ID NO: 4140907 - RNA, 79 nt, Human
gaagcuaaugaagucagggauuccaugaagccauccaagcauauagagcucauuucccugggucccuuuuccuuagcuc

SEQ ID NO: 4140908 - RNA, 86 nt, Human
gaagcuaauggguuuugcuuuuguaacacagugugcacuaaggaguuugugcauucuuuguggcugaagcagguuacuuagucuuc

SEQ ID NO: 4140909 - RNA, 78 nt, Human
gaagcuagaaaugaaaccccguucccuaaaugaaaaacuucuucucaaauggcaaaugugggucccauacuuggcguc

SEQ ID NO: 4140910 - RNA, 80 nt, Human
gaagcucaacucagacuucuacuuugcagagcgagaaucccaggacacguucuauaguggagucuacccuguuuagcuuc

SEQ ID NO: 4140911 - RNA, 88 nt, Human
gaagcucaggcuagaagugguaauggaguaaggaccugaagaauuagaugacaaauuuuucauauuccccucucuggaccagggcuuu

SEQ ID NO: 4140912 - RNA, 61 nt, Human
gaagcugaagcuacacacuuaaacagguuuaauacuucucaccaguaguggguuuagcuuc

SEQ ID NO: 4140913 - RNA, 57 nt, Human
gaagcugacggcccggcagcgccgccuuccaucugguccacccgagccugcagcuuc

SEQ ID NO: 4140914 - RNA, 98 nt, Human
gaagcugacuuugguuuucaaauucugucaccagcaccugaaaaaguauuuugacaguugcaauggugaucucgauccugagauuguaaagucauuuc

SEQ ID NO: 4140915 - RNA, 58 nt, Human
gaagcuggggugcugagggcaaaguuaguuuggcccauauggaguacaccugagcuuc

SEQ ID NO: 4140916 - RNA, 77 nt, Human
gaagcuuaauaucuucuuaucugaaaguaauauuuuguaguuuuaauagaauuuaugaggaagggaguuugaguuuc

SEQ ID NO: 4140917 - RNA, 84 nt, Human
gaagcuuacuuggaagacucaacauuauucauaaaacuauuaguauugagaagaauguguugaguuucaaacucuaaguuuauc

SEQ ID NO: 4140918 - RNA, 81 nt, Human
gaagcuugggcugggcuuucagugcaguguagggugcuucccucugucccuguggcacucaagaagccuccagucagcuuc

SEQ ID NO: 4140919 - RNA, 77 nt, Human
gaaggaaauaaugaucaacagcaucuugcccugcagagaucaugaggcaugggacaggaaaggggucuguuuucuuc

SEQ ID NO: 4140920 - RNA, 64 nt, Human
gaaggaaggaaaaauauauuuacuccaaaauucauuuacugggaguuuuaagugcccuuucuuc

SEQ ID NO: 4140921 - RNA, 65 nt, Human
gaaggaagugcucauacuaguuaaucugaguuguucucugccugaaacuguaaggcauuuuuuuc

SEQ ID NO: 4140922 - RNA, 95 nt, Human
gaaggaauacucacggcaguggugauaaccucuaucauagcuaccauuaaauuacuuguugugacugguugucccgcuuuccucagguuuucuuc

SEQ ID NO: 4140923 - RNA, 82 nt, Human
gaaggacuugauuggaagaaggcagagaggcauuuaaggaaggcauuuagauacccugacuucuccaggucuuaacuccuuc

SEQ ID NO: 4140924 - RNA, 63 nt, Human
gaaggaggcugcugccaucauuaggugucugccacgccuaugagucaguggagccugcacuuc

SEQ ID NO: 4140925 - RNA, 70 nt, Human
gaaggagggcuucaguuccuuaucauaggguugcuugaguguccuugcgacaugggagcuggcuuccuuu

SEQ ID NO: 4140926 - RNA, 57 nt, Human
gaaguugaaucaguaacacaguuuucaggaaucucuuguugaccugauuuacacuuc

SEQ ID NO: 4140927 - RNA, 69 nt, Human
gaaguugucuuugccuucuccuguacccuuaaccuuucuucuagagguagaagagcaaggaauaaccuc

SEQ ID NO: 4140928 - RNA, 76 nt, Human
gaaguuguggaguacaguauuaagauuagugacaacacaugaagugaauugacugauuaugcguacucucuacuuu

SEQ ID NO: 4140929 - RNA, 67 nt, Human
gaaguuucacguaugcucuagagcucuuuucacuguuucuaguguuuguucucagagcaugagcuuc

SEQ ID NO: 4140930 - RNA, 95 nt, Human
gaaguuucauagcuuuaaugagauucuugcuguggucuuugaucuguagaucaaaggcaaaauucuuagcaggauccagaggcucaagaaacuuu

SEQ ID NO: 4140931 - RNA, 125 nt, Human
gaaguuucccuuggggaauggggcucuaacggugggauuccuggcauguggcagguccacggagaagcuacagcagugcacagagaacccuguuccaguccuggcucucaacaaauggaaacuuc

SEQ ID NO: 4140932 - RNA, 81 nt, Human
gaaguuugaguuugaggugacugcaggauauaucuaagugaaaauauucuauaagcaguuggaaguucaaauccaaauuuc

SEQ ID NO: 4140933 - RNA, 73 nt, Human
gaauaaagacucaugugcuaaacucaacaaaucugguguccuaucuaggauuuugagucuggcaugaauauuc

SEQ ID NO: 4140934 - RNA, 61 nt, Human
gaauaagugaaguuggcagcuuccucaugaauagagugacuuuguuaagcaucacuuuuuc

SEQ ID NO: 4140935 - RNA, 83 nt, Human
gaauaauaaaacugaauguguugcauagaacuauuauuuagcaauugaguuuuauaaaggcaccucagucuagauuguuauuc

SEQ ID NO: 4140936 - RNA, 80 nt, Human
gaauaauauuuauauguuuauuuguaauauguguauauauguauauguauuugcguauggacauacaugguaaauuauuu

SEQ ID NO: 4140937 - RNA, 60 nt, Human
gaauaauuacccaucuuuuuguaugcuuuggaagaguuuacauaagaugguaauuuguuu

SEQ ID NO: 4140938 - RNA, 81 nt, Human
gaauaauucuuuaucuagguauaggauucuagguuggaaaucauauucccuuagaauuuuguaguuauugaucuauuguuu

SEQ ID NO: 4140939 - RNA, 84 nt, Human
gaauaauugccauuuauacugcaagucacugccucuuuacaaugcagugaccaaaaaaaggcagguagacucugguacuuauuc

SEQ ID NO: 4140940 - RNA, 77 nt, Human
gaauaauugugaugcuugaaguugcuaaucugcuuuaaguggauuuuaaaugucaggcaauucuagacaguuuuuuc

SEQ ID NO: 4140941 - RNA, 79 nt, Human
gaauacaauugaggagcagagaugggguauacagcaagcacucuguguauuaagugauuguuguuccucgucugucuuu

SEQ ID NO: 4140942 - RNA, 56 nt, Human
gaauacauccagagcagggcuguccaauagaagugcccaugaugauggagguguuu

SEQ ID NO: 4140943 - RNA, 55 nt, Human
gaauacauuugccgugguucuccuggagagccaacacauguaaaugcaccuauuc

SEQ ID NO: 4140944 - RNA, 72 nt, Human
gaauacugagaucccacaaagcaaaaugccauccuacaucuugaagcuaugcuuagugggauucagugauuc

SEQ ID NO: 4140945 - RNA, 73 nt, Human
gaauacuguuguuuaacugauuagagauauuuuuaaaccugagauaaugucuuucuaguuaagagcuauauuc

SEQ ID NO: 4140946 - RNA, 59 nt, Human
gaauagauauccuugagggucuguuugagcucucagaucccaaggaaaacugucucuuc

SEQ ID NO: 4140947 - RNA, 64 nt, Human
gaauagcauaguuugggugaaauuaucaggcaauugcaugccuuuuaugcagauaaugcuauuu

SEQ ID NO: 4140948 - RNA, 85 nt, Human
cuugcaugauacuugaauuuggaagguuccugguagacguagaaacggcccagacugccuguucagagcuaagcaucaugguaag

SEQ ID NO: 4140949 - RNA, 75 nt, Human
cuugcauuauacuacugucucaucaguguuauuuggaaaccagggaauagcagaagacuaguagacaaaagcaag

SEQ ID NO: 4140950 - RNA, 91 nt, Human
cuugccaagcauauaaagaacaacuuucuuggaucuucucuaagauugcuggagaaagaaagggaaguuuguuuuuagucaguaauguaag

SEQ ID NO: 4140951 - RNA, 74 nt, Human
cuugcccaaguugcuucaccacucugacccugggauccucuuuccucauagggugguuagaaggaguaugcgag

SEQ ID NO: 4140952 - RNA, 59 nt, Human
cuugcccccuuccugcacgcuggcacacaccauggugucugugauguugccgggguagg

SEQ ID NO: 4140953 - RNA, 129 nt, Human
cuugccucaccucaccuuccccucucuucucaacccucuucaggauggcuugugaugccaacauucucccuuaaauuacucuugcuuggcucacgagucaccuugaggacaguagguucaaugggcaag

SEQ ID NO: 4140954 - RNA, 62 nt, Human
cuugccuggaccauaugguggccugaguugacuuguaggcagacucaauggcuagauacaag

SEQ ID NO: 4140955 - RNA, 74 nt, Human
cuugccugggauucccagaggggcaggggcuuccuaaagaccugugucuggugcucugugaugucccagccaag

SEQ ID NO: 4140956 - RNA, 56 nt, Human
cuugccuucucugggguggcaguggaaaccgauacuguuuuccaccuugaggcaag

SEQ ID NO: 4140957 - RNA, 78 nt, Human
cuugcgauaguucuuaagccauguugcuggaaccuuccuuucuucccuaagcaacagcccugagguucaugucgugag

SEQ ID NO: 4140958 - RNA, 55 nt, Human
cuugcgggccucagccgugccgcuccacacgaagcacugguagauggcccgcagg

SEQ ID NO: 4140959 - RNA, 109 nt, Human
cuugcgggcuggggcugcgguaggcgccugcgggauccuugcccuccgaguuuggugggccuacgccaguauccccaggcgccgggggcagcggcuccagagccccgag

SEQ ID NO: 4140960 - RNA, 92 nt, Human
cuugcuaaugucugaagcuaacugaacugggccagaucagagcaacuguagucacacagggcucuguccccagaggccccggauauggugag

SEQ ID NO: 4140961 - RNA, 84 nt, Human
cuugcuacagagaauugugugauuuuuagaucuauuaauuugaaauggaaagucaugcaguugaacuuuugaaaugcuagcaag

SEQ ID NO: 4140962 - RNA, 57 nt, Human
cuugcuagguauaugcaggucuauguuucuguaggucuucagcaaauacuuggcagg

SEQ ID NO: 4140963 - RNA, 91 nt, Human
cuugcuccucugcucccacagcuucgugcuuccccugccuggucauccuuuaacuugccacuggggaggcugaugugggcaaaggagugag

SEQ ID NO: 4140964 - RNA, 130 nt, Human
cuugcugcucguaauggaucaacaaguguagucuaccagcuucuucagcacaauauugaugucuuuugccaagauauaucuggauggacugcagaagacuacgcuguugcuucuaaguuucaagcguaag

SEQ ID NO: 4140965 - RNA, 55 nt, Human
cuugcugucccuugguaugaacuagccuguaugguuugccucuggggcaugcagg

SEQ ID NO: 4140966 - RNA, 105 nt, Human
cuugcuuaccgaccucugcccucugccguguguccuccaccuuggccaugcacagcgggggcuaggcgggcacaugguggaggcugccaauggugcccuggcaag

SEQ ID NO: 4140967 - RNA, 109 nt, Human
cuugcuucaaugucugugacaagaguagaauagcgagcagcaagaggccucaaauuuucaaugccucgucaaagucuggcuguuccugccugugauaauauggaaaugg

SEQ ID NO: 4140968 - RNA, 90 nt, Human
cuugcuugcuuuuuguuucucucaaaguuucucaugguauguuuuuacccagaccacauagacugugagggagauacagggggaaggaag

SEQ ID NO: 4140969 - RNA, 59 nt, Human
cuugcuuucagucucggccucacucagcuccucuguugggcccugggauucagagcaag

SEQ ID NO: 4140970 - RNA, 64 nt, Human
cuugcuuuugugugcucucuggagcucacccaugcaugauguuccaguggacuucaaaggcaag

SEQ ID NO: 4140971 - RNA, 79 nt, Human
cuuggaaacuuuggcuuuucugcugauucuggugggaagccccacucugcuaucuuagcaaaaggccaagagagccagg

SEQ ID NO: 4140972 - RNA, 63 nt, Human
cuuggaagcagagagcuaucaccagacaccaagccuguuggugccuuaauuucuacuuccaag

SEQ ID NO: 4140973 - RNA, 65 nt, Human
cuuggaagcugggucgcugggauccuccugcucacuguuuaaggaggggacagaguagcuccagg

SEQ ID NO: 4140974 - RNA, 60 nt, Human
cuuggaaggcccugccuagcaggcccugagcccacuugcaggguuugagggccucccgag

SEQ ID NO: 4140975 - RNA, 64 nt, Human
cuuggagaccagugacauugcucacccuucccacugagcagccugcagauauuggucucucugg

SEQ ID NO: 4140976 - RNA, 76 nt, Human
cuuggagauucauugccugaaacucuaauuuuacacauaaacaucuagagguucaaagggcaacugauuuuccugg

SEQ ID NO: 4140977 - RNA, 57 nt, Human
cuuggagccaugcccagcucucugcaccuggagauugcagguggaaauagcaccaag

SEQ ID NO: 4140978 - RNA, 62 nt, Human
cuuggagccuggcuauggccucccccaugcuaugcggggagggaggcugccaggaggacaag

SEQ ID NO: 4140979 - RNA, 58 nt, Human
cuuggagcgggccuugagugcccggcggcgugcgcugcgggcugucaggcgugccagg

SEQ ID NO: 4140980 - RNA, 60 nt, Human
cuuggagggcuguaguggcugagccgggaggggcuccugccagcaucuucagccccugag

SEQ ID NO: 4140981 - RNA, 63 nt, Human
cuuggaguuguuuaugucccugucugucuucuuuaccaggggguggauuccuacagguccaag

SEQ ID NO: 4140982 - RNA, 76 nt, Human
cuuggcaagaauaaugucccuggcuagaugugggcagaaacacauuacagcaaguuuacguuaaagagugacuagg

SEQ ID NO: 4140983 - RNA, 79 nt, Human
cuuggcaaggccacuguccuuuacugguagauguuggucacucagaccugugacccuuugccuagaggggcuuugagag

SEQ ID NO: 4140984 - RNA, 71 nt, Human
cuuggcacacaggagguacucgaugcauauuuagugaauaaaugaacaucaaaugccuaccaugugcuagg

SEQ ID NO: 4140985 - RNA, 100 nt, Human
cuuggcacuccaggaggucacuuucaauuggucaggacuggcauguggaaugaagcccacuuuccauaccuguaucagaugagccuuucuagagucuaag

SEQ ID NO: 4140986 - RNA, 80 nt, Human
cuuggcaggcagguuucuggaaagguuuugcuuucaaaaucauauauaaguagcugggccaggcaaccugaccuguugag

SEQ ID NO: 4140987 - RNA, 78 nt, Human
cuuggcaggcaucucuguagccaggguccugaugccacaacaccaugcuaguccccugggcauagagccuacaccaag

SEQ ID NO: 4140988 - RNA, 59 nt, Human
cuuggcaucucuuggucaaaucaauucccagggcuuuuauaggaccaggagaaaccagg

SEQ ID NO: 4140989 - RNA, 65 nt, Human
cuuggcauguguguguaggauacaggcaauuguaaaucuguaucaaaaaucaagcacagcaggag

SEQ ID NO: 4140990 - RNA, 130 nt, Human
cuuggccaaguugcuugaacucucuguggcucaguauccucaccuauacaauggaggugauaauaguacucaucucucaugguuauuguggggauuagcugaaauagugaguggcaagcucuugcacagg

SEQ ID NO: 4140991 - RNA, 75 nt, Human
cuuggccaccagccaugcacaaaccaugagaguagaagagaugucuuauggcaauucaggcuuaaagugguuagg

SEQ ID NO: 4140992 - RNA, 62 nt, Human
cuuggccagcugagauuuagcacacaggagaggaggucuguguggggaugagguugggcagg

SEQ ID NO: 4140993 - RNA, 73 nt, Human
cuuggccuauuccagcagcuguggacuccuaacaguuuuccccacucacuuacagcugcagaaucaggcuaag

SEQ ID NO: 4140994 - RNA, 76 nt, Human
cuuggccuccuuuuguagggccauuucccaggcagcuucuuguuaaagccaagaaaugccccucacagaacccaag

SEQ ID NO: 4140995 - RNA, 67 nt, Human
cuuggccugacauguggcaggguuagaacacaccuccuauccccugccagcccgcguucaugccaag

SEQ ID NO: 4140996 - RNA, 91 nt, Human
cuuggcuccuugcccugugccuucucagccucgaggcagacagucugugucagagguagagauggcaccuacagaagguaccagagcugag

SEQ ID NO: 4140997 - RNA, 81 nt, Human
cuuggcucucuauaacguuaggcacaacagcaccuugaaauaauaggggccagggugcagagcuuaacuguagguagcaag

SEQ ID NO: 4140998 - RNA, 72 nt, Human
cuuggcugaccagaaccugccccaguuuugacacacuccucugugcacagggugaggcucuggguagccaag

SEQ ID NO: 4140999 - RNA, 91 nt, Human
cuuggcugaggauaaucgcaggaucacaaauugccuuguuagagcaucagggcucuaaaaggcacuuggaugcugaguccauuagccauag

SEQ ID NO: 4141000 - RNA, 63 nt, Human
cuuauacaguaaugugucccugcagguagaacaaugccugucacauauuugcuguucagugag

SEQ ID NO: 4141001 - RNA, 64 nt, Human
cuuauagaaucuccagcauugguugucguaucuguaaaagacaggcagccguggagacuaggag

SEQ ID NO: 4141002 - RNA, 80 nt, Human
cuuauaggagacaucuaacuguagguuuuaugugaaucaaaaauugaaguugcuaaugugcagggaugucucucuauagg

SEQ ID NO: 4141003 - RNA, 91 nt, Human
cuuauagugaagauuaauuaagaaaaugaauguauagugcgccaggcauggcaaauuguagcaauuucucuuaauugccuuuuuauauagg

SEQ ID NO: 4141004 - RNA, 62 nt, Human
cuuauaugcauagguaucuauacucaaagcaaauugcagcaugugauacacugugcagggag

SEQ ID NO: 4141005 - RNA, 74 nt, Human
cuuauccuucaucuuuuaggagaggguccaaaauucucuuuaggaaucuauucccuuucuguaaaaaggaucag

SEQ ID NO: 4141006 - RNA, 62 nt, Human
cuuaucugagaaagaugcuacaugacuacaaagagguuauuuaguuucuuaguucagauaag

SEQ ID NO: 4141007 - RNA, 60 nt, Human
cuuaucuuacuuccauugugaugacccacccucaccaucgccugggaagagaaagguaag

SEQ ID NO: 4141008 - RNA, 60 nt, Human
cuuaucuuacuuccguugugaugacccacccucaccaucgccugggaagagaaagguaag

SEQ ID NO: 4141009 - RNA, 100 nt, Human
cuuaugacaaaguuuaaucaucuugcuuauaacucagggcuuagaggauauaacaaauuucagaguguuuagugaugaaagagaagauauacuacauaag

SEQ ID NO: 4141010 - RNA, 77 nt, Human
cuuauggcucuggcaggucaaucauucuuugugugaucaucacugaaaaaagaaucugauuugucuggaagcauaag

SEQ ID NO: 4141011 - RNA, 83 nt, Human
gacaagaaauguaugguaagauggcauacggaguauuaauuuguucaaaaugcuaacugaugugaacuuaccauuuuccuguu

SEQ ID NO: 4141012 - RNA, 58 nt, Human
gacaagagaauuccuaugccgcuguaauggccuacauaggaaaagcauucuucuuguu

SEQ ID NO: 4141013 - RNA, 79 nt, Human
gacaagcagugggucuggucuagguggccaggucagauuuaggugagguggcuucagagacagaaucuaucuguuuguu

SEQ ID NO: 4141014 - RNA, 59 nt, Human
gacaaggagccaccagucacgucccgcuuaaaggacgaacaaccaggaagcuucuuguc

SEQ ID NO: 4141015 - RNA, 79 nt, Human
gacaagugaaaagaguguuucaacuuuggcugauuuauucagccagcuguucagacauucuuuuuaagugaugcuuguc

SEQ ID NO: 4141016 - RNA, 72 nt, Human
gacaaguguuuaugguuauuguuaaaccuugagauuuuaccuaaugguucagcuaauaauagacacuauuuc

SEQ ID NO: 4141017 - RNA, 81 nt, Human
gacaaguuguuaauaugcaaaacggaugcgugauauuucuugcuucucaugaugcauguuucuguauguuaaugacuuguu

SEQ ID NO: 4141018 - RNA, 69 nt, Human
gacaauaagaacagauacuguguuuucuugagaucaaauugagaucaacuguauuuuuucuucuuuguc

SEQ ID NO: 4141019 - RNA, 99 nt, Human
gacaauagauuugcauguucuagcaggcaaaagcucggcauuugcauugaaauccagcucaccguuugccuucugggcauuaugcuaaauuauaguguu

SEQ ID NO: 4141020 - RNA, 68 nt, Human
gacaaugguacuagauaucuucagaguucacacuacacuuuuaccuugaaaaauauagucccauuguc

SEQ ID NO: 4141021 - RNA, 67 nt, Human
gacaauugcuuuugccgaauaacugcuucugacccagaaguccuugccuauuugcagcagaguuguu

SEQ ID NO: 4141022 - RNA, 72 nt, Human
gacacacaaagcucuucauuuucaauuuuguaaaguaagaauuacacagaggaaagugugaagggaaguguc

SEQ ID NO: 4141023 - RNA, 64 nt, Human
gacacagagacuugcaguuguagagcuagaaauccuuacagauuauauaaccaggucuccuguc

SEQ ID NO: 4141024 - RNA, 56 nt, Human
gacacagucauacuggcauagggcccacucugagggccuuguuuuaagacucuguc

SEQ ID NO: 4141025 - RNA, 60 nt, Human
gacacaguguaauucauggcugaaaaacagauuuguuuuucuguuauuauuaccuguauc

SEQ ID NO: 4141026 - RNA, 78 nt, Human
gacacaguucucgcgcccccaagcgucauugggcucucccugguuccaguggcuacagggggguugaguggggguguu

SEQ ID NO: 4141027 - RNA, 65 nt, Human
gacacauaucaaaaccagaccgaacuuuccgccccuccuggcagaaacaucucugcuuuuguguc

SEQ ID NO: 4141028 - RNA, 62 nt, Human
gacacauggagcucaaacaugagugccacccaccccugggcagcaccaagauggcucuaguc

SEQ ID NO: 4141029 - RNA, 96 nt, Human
gacacauugacggguucuacuuuuuuucaacuuccuuuuguucuacuuaagaacaaauucucuaggcaaggaagaauagaaauugucacuuggauc

SEQ ID NO: 4141030 - RNA, 79 nt, Human
gacaccaccuugucagccuugcuuuagcgguuacauguaaacuagcuuagacaggacugauguaauucaggguggaguc

SEQ ID NO: 4141031 - RNA, 57 nt, Human
gacaccaggaaggaagagcuuccaccuuaucugguggcucugucccugcuguguguc

SEQ ID NO: 4141032 - RNA, 59 nt, Human
gacaccaggaauaguucugucuuuuuaaccuucuccagagauaagauuauuccugguuc

SEQ ID NO: 4141033 - RNA, 123 nt, Human
gacaccuuguaccacccuagcaccagcuugagccacccauucccgagcccuaugaaccacaacauggaagggaacagguggguguuugagaggcugugcuggcauccaagggugcaagguguc

SEQ ID NO: 4141034 - RNA, 88 nt, Human
gacacgagagguaugcuacaguagaguaggccucugaccaaacucuuugucacauccuuacuuuauaugugguucuauuucaaguguc

SEQ ID NO: 4141035 - RNA, 58 nt, Human
gacacgcaggacccugggccagugaccuaaccccucugcaccucggagccuccguguc

SEQ ID NO: 4141036 - RNA, 84 nt, Human
gacacgccgcgcgagcaggagcucggauaggucgcuuuggccggccuggccgcuccgagcuccgccccucuucgguggcgcguc

SEQ ID NO: 4141037 - RNA, 129 nt, Human
gacacgggauuucaccauguuggucaggcuggucucgaacucccgaccucaggggaucugccugccuaggccuccugaagugcugggauuacaagugugaaccaccgugcccagcugguuuucuguuuc

SEQ ID NO: 4141038 - RNA, 78 nt, Human
gacacggucaaggcuauaauguugcuggaaacaugacuaaacccuuacuucugagcaugaauuauuuuuacccguguc

SEQ ID NO: 4141039 - RNA, 75 nt, Human
gacacucagagauauggugguugaugacaagacacugcuucacagauguaucaaaccaccuuaucucuugugauc

SEQ ID NO: 4141040 - RNA, 70 nt, Human
gacacucaguaaaugagaagcuaguaauagucaucacuguucuuuaaccuagucucauuugccacuuguc

SEQ ID NO: 4141041 - RNA, 71 nt, Human
gacacuccugcaagcccuugauggugagagcugcagagcuguuucuucagcugccaucaaggcaggaccuc

SEQ ID NO: 4141042 - RNA, 63 nt, Human
gacacucuguauaaucucuccucuacucaagugugggugggacugagaauaugaugggguguc

SEQ ID NO: 4141043 - RNA, 110 nt, Human
gacacugauucucugugaagcagggcagugcuucagcucucaugcaguggggggugugacugcuuagacuggccaagacacugauucccuggaaagcagggcaccaaguc

SEQ ID NO: 4141044 - RNA, 59 nt, Human
gacacuggggacucuggccuuuugacaggacaugugucaaaaugccgagugcccagguc

SEQ ID NO: 4141045 - RNA, 70 nt, Human
gacacuugagucugggcuccgaguggugcacguuuagccaagccaccucccagcucugagcuuggguuuc

SEQ ID NO: 4141046 - RNA, 62 nt, Human
gacacuuuaucucaucucagacagggcucuauggaggaaugggcuggaaaagaaugaagguc

SEQ ID NO: 4141047 - RNA, 58 nt, Human
gacacuuucugaggagacgggcuuugugaggagaccgcgaaguuugggcagagggguc

SEQ ID NO: 4141048 - RNA, 57 nt, Human
gacacuuuugacccuuaccuggacaucgcccuggauauccaggcagcucagaguguc

SEQ ID NO: 4141049 - RNA, 58 nt, Human
gacacuuuuuuaaagcucauuaagauuguuaaacauugauggguuuguuggagagguc

SEQ ID NO: 4141050 - RNA, 88 nt, Human
gacagaaaauuuuauauaauuaaaugcugauuuaccuguaaaaagugacaugggugugcucagauaauuaaucaugaaauuauuuguc

SEQ ID NO: 4141051 - RNA, 80 nt, Human
gacagaaagcagccagaaccuaggaugagcuggaagagguuguccccacacagcucaggcuucugcuccuucuuugacuc

SEQ ID NO: 4141052 - RNA, 70 nt, Human
gacagaaggcauagaugaaggccuuagucuaggagaauggauaguuaggcugaacauuuauccugcuguu

SEQ ID NO: 4141053 - RNA, 74 nt, Human
gacagauaaaguaggcauuugauaaauugaaacagguuuugaauuauuuugagagaaugugugcuacaucuguc

SEQ ID NO: 4141054 - RNA, 96 nt, Human
gacagcauaaaguuuugggagaaugaauuauaugcuuuauaaacuaagacaugcuaauuacugguucaaucuuccaauuuaaguuuuucugcuguu

SEQ ID NO: 4141055 - RNA, 68 nt, Human
gacagccaacuucucccacccacucccuaucuaauaaaggaagggaugauggaaagaagcaggccuuc

SEQ ID NO: 4141056 - RNA, 78 nt, Human
gacagcccagcccauggccuuccuggcggcucaggguuaggaaaagcugugccuucagggaggcagggaguggggguc

SEQ ID NO: 4141057 - RNA, 80 nt, Human
gacagccccuugucuugguuuccacuugcugaagaaaggaguccuguuguccuugugagaguggagagagcacgguuguc

SEQ ID NO: 4141058 - RNA, 68 nt, Human
gacagcuggguguguaucagauaaaguuaguacacaauuugguuuuaucugccuuuuauucagcuguc

SEQ ID NO: 4141059 - RNA, 59 nt, Human
gacagcuuggaaaguguguguguguguguguguaucaacacauauaugucgaaguccuc

SEQ ID NO: 4141060 - RNA, 67 nt, Human
gacaggaauaggagggcuagcuuguauagaccccugaucugugcuggcauaccaccuaguucauguc

SEQ ID NO: 4141061 - RNA, 56 nt, Human
gacaggcccgaguagcugaugaaauucuacgugggaaaagcuuuugagugccuguc

SEQ ID NO: 4141062 - RNA, 90 nt, Human
gacaggcugcuuugggagcuuuuccuuucccagaacuuuguaguagcccgauugcaccacaucaaugaggggagcagccccaggcuuguu

SEQ ID NO: 4141063 - RNA, 62 nt, Human
gacaggcuuucucaggaugagcuauaaaaagaagcaccuguagauagaagccaacauauguc

SEQ ID NO: 4141064 - RNA, 117 nt, Human
gacagggauuaugcaacaggugagacuucauggccagauugacauguagguaaaguuguuaccacauaugagguguuauucuauggggccugacuuaccuuaacuugcuuccccguc

SEQ ID NO: 4141065 - RNA, 56 nt, Human
gacagggcgcccagccuguuucuggugcugccagccugccauguucccgcccuguc

SEQ ID NO: 4141066 - RNA, 55 nt, Human
gacaggucacugagggagggugacugaggucccaaaacuuucuccaggaccuguu

SEQ ID NO: 4141067 - RNA, 57 nt, Human
gacaggugucucagcugcuggcagggcagaggcacugcugugguuguggcacagguc

SEQ ID NO: 4141068 - RNA, 57 nt, Human
gacagguguguguauauuagggcaaauguguguacccuaggaaacuuugcaccuguc

SEQ ID NO: 4141069 - RNA, 74 nt, Human
gacaguaagagaagagucuugucaaauuagccuugacaauuaagcaagccuuaauuugacaaggcuuuccuguc

SEQ ID NO: 4141070 - RNA, 79 nt, Human
gacaguacuuuuucgguguuaacauucugaugucuauuauuaaacuacaccagaguuugaauuuugaaaagauacuguu

SEQ ID NO: 4141071 - RNA, 57 nt, Human
gacaguaguaaagcuaggaccagaacucaggcuguuuuauaccugcaagcugcuguc

SEQ ID NO: 4141072 - RNA, 89 nt, Human
gacagucacgggacagucuuuagaguauuguccucuuggaguuccugagcaggacaucaagcugaggccugucaagcccugggccuguu

SEQ ID NO: 4141073 - RNA, 57 nt, Human
gacagugaguaccucaaaggccuuaaacaugucgaaggucucaaguaucucacaguc

SEQ ID NO: 4141074 - RNA, 60 nt, Human
gacagugcagaaagcucuaccagcuucuguugguggcagcgucuaucugacaucacuguc

SEQ ID NO: 4141075 - RNA, 63 nt, Human
gacagugcucuaggugauuccaaaaugcagacaaaguaagacccacugguuagagccacuguu

SEQ ID NO: 4141076 - RNA, 75 nt, Human
cuugaaggccaguuuugagauagguaguacagagagagaaaucucauggcuuauuucuaggcacuggcuucggag

SEQ ID NO: 4141077 - RNA, 64 nt, Human
cuugaaguucuggcucagagaggaaauggcaggcugccacuuccuuccacuucaggauuuugag

SEQ ID NO: 4141078 - RNA, 58 nt, Human
cuugaauugggggaagaucacucuucaugcccauuugaggauguuuacugagaucaag

SEQ ID NO: 4141079 - RNA, 77 nt, Human
cuugacagagaaucuggguggcacaugucuguguccacuacaucagcagugucuaccucggugaaucucuguaguag

SEQ ID NO: 4141080 - RNA, 83 nt, Human
cuugaccccaggauuuuuggaaccaguaauuaauuaaauuaacuaaucaauuaacuaauuugguacaagagucuggaacagag

SEQ ID NO: 4141081 - RNA, 55 nt, Human
cuugacugacuucugaauugguuuguaaauuggaagaauuagggagucgguuaag

SEQ ID NO: 4141082 - RNA, 67 nt, Human
cuugacuggacacaggaaucaccuuggaugcuugucaacaaugcguauuccuguauuccagucuuag

SEQ ID NO: 4141083 - RNA, 55 nt, Human
cuugagcagcucuuugaggauggugauguuuaucuccuucuucuuggcagccaag

SEQ ID NO: 4141084 - RNA, 64 nt, Human
cuugagcauccacaaaguuugguguccuuggggauccuggagccaaucuccuguugaugccaag

SEQ ID NO: 4141085 - RNA, 71 nt, Human
cuugagcccaggagauggagguugcagugagccaagaucacaccacugcacuccagccugcuggauuuagg

SEQ ID NO: 4141086 - RNA, 79 nt, Human
cuugaggacguuaugcuaagugaaauaagccagacacaaaaaagcacugugugguucuacuuauaugaggucccuagag

SEQ ID NO: 4141087 - RNA, 61 nt, Human
cuugaggagcuucagaggaaucuuagcaaagccaaguucaguuccccaaagccuccuagag

SEQ ID NO: 4141088 - RNA, 96 nt, Human
cuugaguacagaagugaaaguggggagaguauuuuauucaagucacagcagaacuggaaaaaaacucuucuguuuuaccaacuucuuguguuucag

SEQ ID NO: 4141089 - RNA, 60 nt, Human
cuugagugaucaguaacucaaguggcagcaauuggccacuuagauacuagaucacaaagg

SEQ ID NO: 4141090 - RNA, 81 nt, Human
cuugaguguugucaucaccguuguuaucaucauugucaucauguauuuaguguggaaccuggugauguacaaguacucuag

SEQ ID NO: 4141091 - RNA, 58 nt, Human
cuugauacauucuguguucucagauccuccuggggucuguuuugcaacaugugacaag

SEQ ID NO: 4141092 - RNA, 91 nt, Human
cuugaucugauaggagaaaaugguaauauuucauaguuguuuuccaaagacaaauuuaaauguugucuguuaucuccuuacuuaguuuaag

SEQ ID NO: 4141093 - RNA, 76 nt, Human
cuugaugaugcagguugggcaagugugggguggcucugccuccuucuagcucugugaccuuuggcaaaucaucaag

SEQ ID NO: 4141094 - RNA, 58 nt, Human
cuugauggaaaacggaggagcuguaguaaagaaucuauuugcugccuucccagucaag

SEQ ID NO: 4141095 - RNA, 57 nt, Human
cuugaugugccuaagucugucuauaugcagcguagacuuuacuaaggcucauuuuag

SEQ ID NO: 4141096 - RNA, 58 nt, Human
cuugauuaccucuguaaagacccuauuccuaaauaaggucacauucugaggaaucagg

SEQ ID NO: 4141097 - RNA, 76 nt, Human
cuugauuucaguggugaugcuguccauguccagggagcggcuguuguccauggacagcaccacagauguguucgag

SEQ ID NO: 4141098 - RNA, 74 nt, Human
cuugauuuugggugcaaauuguuuguuuuuaggaguauagauuugauaggaaauaagggcacuucagauucaag

SEQ ID NO: 4141099 - RNA, 59 nt, Human
cuugcaguguggccuugaagagaugcuugaaucucucugaacuuaacguccgcagcaag

SEQ ID NO: 4141100 - RNA, 74 nt, Human
cuugcaugugugugccugugugugcguguuugugaaccaggacaagugaacacaggggcucggcugggugcagg

SEQ ID NO: 4141101 - RNA, 65 nt, Human
cuugcauuuguuugggcuaaucuuaaggugcacaguaacccuaaaguggcccagcaagugauuag

SEQ ID NO: 4141102 - RNA, 87 nt, Human
cuugcccaaauucugaauccuuucuuccacuguuuucucuugggcccugaaacccagagaggccuuggcaagacagaauuaaaaaag

SEQ ID NO: 4141103 - RNA, 71 nt, Human
cuugcccucaagaacaauccaccauuagaacuauucagagguuguaaucgcuuucuugucuugaggccagg

SEQ ID NO: 4141104 - RNA, 69 nt, Human
cuugcccugagagacacaguuaucaggcauacaaggugacagaccaguacccucuguuccucaggcaag

SEQ ID NO: 4141105 - RNA, 57 nt, Human
cuugcccuggcacacacacagcuggaaccugagcccagaggugguuugaagggucag

SEQ ID NO: 4141106 - RNA, 85 nt, Human
cuuugcugauuauauucccagagggaaguguucuggcaguugggcuaauccugaaacaugagcacuugcuucauagucaucagag

SEQ ID NO: 4141107 - RNA, 89 nt, Human
cuuugcugguggcagggggauggagggauccaagcaguagaaaaagcauuucucugcucugugccucaguuucccugucuauaacaagg

SEQ ID NO: 4141108 - RNA, 79 nt, Human
cuuugcuguugugaauagugcugcaauaaacauacaugugcaugugucuuuguagcagcaugauuuauaauacuuuggg

SEQ ID NO: 4141109 - RNA, 72 nt, Human
cuuugcuuucuugauucagauuauuuuucuauaaacugaacuauguagacuaagggaaucaggaaggcagag

SEQ ID NO: 4141110 - RNA, 77 nt, Human
cuuugcuuucuuucaguucaucugugaagauuaaauuagcuauuauuauucuaguuuuacagaugagaaaagugaag

SEQ ID NO: 4141111 - RNA, 90 nt, Human
cuuugcuuugcaaauaaaaguaguauuagaacauguauuugccaaaaauauguguguaaacaaguauaauuuugcaggcauaaagcagag

SEQ ID NO: 4141112 - RNA, 55 nt, Human
cuuuggaagccaggcaguucacacaguugaugguuguuucuuuaggcuucuaagg

SEQ ID NO: 4141113 - RNA, 87 nt, Human
cuuuggcacgaagguccucaauacuucuaccggggaaucuacccuccucuucucuccaagauguugcaagggacucuucuguuuggg

SEQ ID NO: 4141114 - RNA, 60 nt, Human
cuuuggguaguauuuauuuguuugaaauacugggauguuuugggcaaaugcaauucaaag

SEQ ID NO: 4141115 - RNA, 78 nt, Human
cuuugguaggggaggucuuuugauuggcugaguggagucaugacauuuggccagauggaaaugauguucucaccauag

SEQ ID NO: 4141116 - RNA, 65 nt, Human
cuuuggucaaauauuauccugagugcauccgggaggauguuucuggauaacauuugaaucaguag

SEQ ID NO: 4141117 - RNA, 60 nt, Human
cuuugguggggguauuucuggcaacauauucuuacacuagguauuuuaaguccaccagag

SEQ ID NO: 4141118 - RNA, 95 nt, Human
cuuugguucuuagcauuaauuuuacaugcauuuuucauucugaacuuuuaaacaguuuugagaaacauaugagagauuugugaacaggggcaagg

SEQ ID NO: 4141119 - RNA, 94 nt, Human
cuuuguaacuauagcaucucucauauuugaauggcaagcauguucaaucuguugcugcauguuaagaaaauauugaggauauauaugaauaaag

SEQ ID NO: 4141120 - RNA, 68 nt, Human
cuuuguagaaguuugcuaguguuuuuuaguugagaagccuugaacacagaagaauuucuaagacaaag

SEQ ID NO: 4141121 - RNA, 65 nt, Human
cuuuguauuccauaucaugccauaagucauuggccuuccaguucaugguaugguagauugcaaag

SEQ ID NO: 4141122 - RNA, 73 nt, Human
cuuugugccucauaaaagcuuuguuuacacuuuccaguaaaaagguguguacauauuuuuaaugggcucauag

SEQ ID NO: 4141123 - RNA, 58 nt, Human
cuuuguggcuccugcaggccauuuggauguauacgggcaggucacagggguuacaagg

SEQ ID NO: 4141124 - RNA, 84 nt, Human
cuuugugguuuuggaggggaagaccuuggagcaguugcgaagauccaucuaccauguucugguuuuuccuuggaagccuaaaag

SEQ ID NO: 4141125 - RNA, 67 nt, Human
cuuuguguacauuucaguuuccuuaagacuuaggaaguccaagagaauacuggagaguaccuuagag

SEQ ID NO: 4141126 - RNA, 55 nt, Human
cuuuguguuguuuuaagccacuaaauuguggcaauuuuuuacagcagcaauagag

SEQ ID NO: 4141127 - RNA, 81 nt, Human
cuuuguuaaaaaguaggggcuggaguucgagguuacagugagcuaugauugcggcacugaaguccagccugggugacagag

SEQ ID NO: 4141128 - RNA, 78 nt, Human
cuuuguucccaaauauaaugcaagagacaaguuggcuagaucagucuuaucuugcagauauuggucgggaguucaagg

SEQ ID NO: 4141129 - RNA, 86 nt, Human
cuuuguuuuguuuuccuuccacuuuagcgggaaccacaucuucaagggccgugcugccggcauagcagugaaugagaacggcaaag

SEQ ID NO: 4141130 - RNA, 58 nt, Human
cuuuuaaaaauggcaaacuucuuccuucuaaaaggaggaacugcuucauuuuugaaag

SEQ ID NO: 4141131 - RNA, 59 nt, Human
cuuuuaaagauggcgcccugugaguuaccaugacaaccuauagauaucaucuuuagaag

SEQ ID NO: 4141132 - RNA, 108 nt, Human
cuuuuaacagcaaugagagauuaaugacuuauauuuaaagcacgauauaauuuucuugcaaugaauaugguacauuaagauguuagccucucauucugcuugugaaag

SEQ ID NO: 4141133 - RNA, 79 nt, Human
cuuuuaacagugccccuaaacagguacaguuucccucugggcuccgcugagcuccuguacgugcuucacuguucaagag

SEQ ID NO: 4141134 - RNA, 127 nt, Human
cuuuuauaaggagcgguagacaagguauaguugagaugacuuaaauuugggauugauuuugcaaccaaggaacgucccugugagucaacuaaacaagaaauauuuaugugucuagcucguuuagagg

SEQ ID NO: 4141135 - RNA, 64 nt, Human
cuuuucagcagaaauuacucuugaugacaccagccccgcugucagaguaauuccugcuggaaag

SEQ ID NO: 4141136 - RNA, 62 nt, Human
cuuuucaguuuccagcuuugucauucuguggccuuugcugugacaaugcugggaaggguuag

SEQ ID NO: 4141137 - RNA, 56 nt, Human
cuuuucaucccacuggguuucuauucaagcauagugugacccaguuugaaggaaag

SEQ ID NO: 4141138 - RNA, 129 nt, Human
cuuuucaugguauuuaucauuuuaguauugaagaugcaguguucuuuugggaauuacguaugcuuagaagagaguacugaugcucaaaggugaaaugauuugaaucuagaguuggauaaaaagggaaag

SEQ ID NO: 4141139 - RNA, 58 nt, Human
cuuuucauuucucuuagugcuuucugcauugcaggcaggcacuccggaagugucugag

SEQ ID NO: 4141140 - RNA, 64 nt, Human
cuuuuccacacucacugcacucauagggcuucaccccugcaugaauuaucugguguuggaaaag

SEQ ID NO: 4141141 - RNA, 60 nt, Human
cuuuuccuuugaccaucaugcuagagaggacaaggauagacacagaugggacaggaaagg

SEQ ID NO: 4141142 - RNA, 67 nt, Human
cuuuucguggcuggauaauauucuguuguguggauauacagcauuuuguuuauugagucaugagggg

SEQ ID NO: 4141143 - RNA, 91 nt, Human
cuuuucuacagauccuugaauauaauaacaguagcuaauaucuguuuacuuauuaccugcuaggcaaugugaucaauuuucuguggaucag

SEQ ID NO: 4141144 - RNA, 57 nt, Human
cuuuucuacuaaugaguagcuagaggcaaugacuuugcagcucauauuagagagaag

SEQ ID NO: 4141145 - RNA, 69 nt, Human
cuuuucuauuugugcuuaaagucugcaugaaauugacauuaugcauaugcaaugcacaauuuggaaaag

SEQ ID NO: 4141146 - RNA, 111 nt, Human
cuuuucuccaaccucgauggauccuguuccuugaaugcugugcuuuuuucucugauggaauugcuaacauucugaaggccuaacuagaucuuaucagaauaggggggaagg

SEQ ID NO: 4141147 - RNA, 59 nt, Human
cuuuucuccuaugccaagauaugagcaaaacucucugcuuggcugucuauaggaaagag

SEQ ID NO: 4141148 - RNA, 61 nt, Human
cuuuucucugaauuucuaguuagugucuguggaauuucauaaacugagaguucaggaggag

SEQ ID NO: 4141149 - RNA, 92 nt, Human
cuuuucugaguagccuucccuggaugauuucuuaagcaccagauugcccgaaacauacgauuuaggagaaagagcacuacacaccagaaaag

SEQ ID NO: 4141150 - RNA, 92 nt, Human
cuuuucugucauauggggaaacuauuuccuuguccagaagaaagaugauucugggaagagaggaggugguuucgucuguaaugagcgaaaag

SEQ ID NO: 4141151 - RNA, 114 nt, Human
cuuuucuuuuuaaaaaucccccuuacuauagauuuguauagaugugguugaagucacagaugccauauucuucaucuuuauaaugcaaguuuucuuuccagguagaaggacaag

SEQ ID NO: 4141152 - RNA, 59 nt, Human
gacaggcugaucagggcugggaugguggacacgcauccucuuuacccugaucacugguu

SEQ ID NO: 4141153 - RNA, 75 nt, Human
gacaggcuuauuuuaggucucucuuuaccccaccagcccaaccuggcauuuuggaaggagggcaaguagccuguu

SEQ ID NO: 4141154 - RNA, 63 nt, Human
gacaggcuuccuaagugccagaugccaacugugccagucccggcccuuaugggaaggccuguu

SEQ ID NO: 4141155 - RNA, 62 nt, Human
gacaggcuuugagucccagaacagaucagcccauuuucauaugguuacugggagaagccguc

SEQ ID NO: 4141156 - RNA, 66 nt, Human
gacagggagcaaccucagccuguccucacaucugcagggccuacagccugcugccugcuucuuguc

SEQ ID NO: 4141157 - RNA, 76 nt, Human
gacaggguggugaugagggcaguucuuguugcugugggagugcaaagcagggagccuaccucaucccaacaauguc

SEQ ID NO: 4141158 - RNA, 93 nt, Human
gacaggguugccuugacuucccuucuagcucccagacgaugagcacgaccucucagacagggagcuggagcuggaagacucugcagcucuguc

SEQ ID NO: 4141159 - RNA, 59 nt, Human
gacagguaccggucagauuacgguggcacaggcggcgugggguuagacagguaccgguc

SEQ ID NO: 4141160 - RNA, 56 nt, Human
gacagguggguucucguaucugguucugcauucagucuguugugauaccaccuguu

SEQ ID NO: 4141161 - RNA, 68 nt, Human
gacagguuuuggacuccagauuugagaaguagaugacuaagaaauacuggcaagugcuaauuccuguc

SEQ ID NO: 4141162 - RNA, 86 nt, Human
gacaguaaugcuaauaguaguaauuauuuuauuaauggcaacuacuacuaaauggaaugauuacuauaugccagguguuaaguguc

SEQ ID NO: 4141163 - RNA, 55 nt, Human
gacaguaguccuugcuauucauaucaaucgaguugugaauggaaggggugcuguu

SEQ ID NO: 4141164 - RNA, 60 nt, Human
gacagucauuuguuuuacaggcaguugguaaaugucuacuuguaauuauaauguacuguu

SEQ ID NO: 4141165 - RNA, 60 nt, Human
gacagucccccagcagcaaaccauguuccagucauucccuuuccuacuuuggggauuguu

SEQ ID NO: 4141166 - RNA, 55 nt, Human
gacagugcuaugguaggacauucaagaaaaauguaugcuaccaauagucacuguc

SEQ ID NO: 4141167 - RNA, 97 nt, Human
gacagugcugcucugccaguagcaagccccagauggaggaagcugggcccauuucuggccacuuccacccauuuggagcuuugccagaggagucguc

SEQ ID NO: 4141168 - RNA, 59 nt, Human
gacagugcugcuugucaaagagcuccuuaccaguuccuguucucacaagcaacauuguu

SEQ ID NO: 4141169 - RNA, 93 nt, Human
gacaguggggugcucaucuucuguaacuguugggaaggcucggugguccauuuucaccaguuaaagaauaugaggccagcccagaaaucuguu

SEQ ID NO: 4141170 - RNA, 56 nt, Human
gacuuucaggaaaggcuuuuguuaggauacaauacuuaagcuaagaccugaagguu

SEQ ID NO: 4141171 - RNA, 128 nt, Human
gacuuuguguugaucuuuuggccuuuauguaauuuauguuuauguuucuggcaaugcccugaugguuaauguccuuaugguaauuaaaacauguauauuaauuaagugugcuacuaguaauaaaaguu

SEQ ID NO: 4141172 - RNA, 77 nt, Human
gacuuuuacagacagcaagugguuguuuuuggugggcucuuuaaauuacuaaauacacacauuuguucaauguuguc

SEQ ID NO: 4141173 - RNA, 67 nt, Human
gacuuuuccagggaggaaugugggguuggaguuuggucucaggccuggaguacuccuugaagugguu

SEQ ID NO: 4141174 - RNA, 55 nt, Human
gacuuuucuaaauaccgcucuggaggucaaagucauuuccaaagccagagaaguu

SEQ ID NO: 4141175 - RNA, 65 nt, Human
gacuuuuggaaaagauguaagcuaaccaagguugguaaauuauuuuuauaucccuuuccaguuuc

SEQ ID NO: 4141176 - RNA, 85 nt, Human
gagaaaaagaucagaagaaagcacuucaaaaagccagcauuugucucuggguucugggguuaugggugauucuuaucuucuucuu

SEQ ID NO: 4141177 - RNA, 87 nt, Human
gagaaaacuguuuuauacuguucaagcaaaugacauuggucugagacagaaaggccauguaauuuuuuugaacaggaacugugucuu

SEQ ID NO: 4141178 - RNA, 112 nt, Human
gagaaaagaguuaguuucugcaaacuggcaaaccugucugucauaguguuuuuauucaaguugaccuggugcacuuuauagauugcuaguuuuaaaauuaacaacgguucuc

SEQ ID NO: 4141179 - RNA, 101 nt, Human
gagaaaagcuuugcucuuuauaaaaagggccgugugagauucuuugaaacugaacgccggcggagucugacucugacccuggaugaagagaugcugcucuu

SEQ ID NO: 4141180 - RNA, 69 nt, Human
gagaaaagugauucuguguguaaauuuuaaguguacuuggugauauuaugcucagaauacucuauucuc

SEQ ID NO: 4141181 - RNA, 62 nt, Human
gagaaaauuguguucaccagauccuuuucaggaacacacuggcuuuggaaacaauuuaucuu

SEQ ID NO: 4141182 - RNA, 62 nt, Human
gagaaacacuguuaguuuauuaucuuaugaaucugugacuucugcaacugauuguguuucuc

SEQ ID NO: 4141183 - RNA, 96 nt, Human
gagaaacauuaaguucucuguguaaaaauaacgcuaucucuuuaggagaugcuuuccugauauuuaugcauaaaugaguagaacuuucacuuucuu

SEQ ID NO: 4141184 - RNA, 88 nt, Human
gagaaaccuauuaacaugcauuacuauaacggcauagauuauugucauuaaugaguauccuauaugguguaaguuccuugaaggucuc

SEQ ID NO: 4141185 - RNA, 75 nt, Human
gagaaacuugagcuugcuuucacaaaaauagauuuuuauguuugauuuuaugauugagcuggcuacaggcaacuc

SEQ ID NO: 4141186 - RNA, 59 nt, Human
gagaaagagacuuuuggcagaggucauguccuugccuccugccagaugacuccuuucuu

SEQ ID NO: 4141187 - RNA, 89 nt, Human
gagaaagauucccaaagagacuucugaucauuguuuauguauaaauuacauagauaauguguagcagugaucuugaaacuucuugacuc

SEQ ID NO: 4141188 - RNA, 90 nt, Human
gagaaagcaccauuuggagcagcacaagaaaggggauuucagaugccucuguccucacuucuguugcuucagacugagucuucacaucuc

SEQ ID NO: 4141189 - RNA, 71 nt, Human
gagaaagcagcaguggucuguagaaggagugggaacugucuuucuuauuagccauuguucuuuaacuucuc

SEQ ID NO: 4141190 - RNA, 91 nt, Human
gagaaaggaaccuucugccuuuuaaagccaguguuauuuuggucucuguuaaaguagcuaaaccaguaugugaaggcagggguucugacuc

SEQ ID NO: 4141191 - RNA, 78 nt, Human
gagaaaggcuaucuguuguaguacagaugauacaaugaguguguucauuuuacuguaaauagcagagagguuuaucuc

SEQ ID NO: 4141192 - RNA, 63 nt, Human
gagaaaggucaaaaucgugacauugggaguuagcuuaaugcacccagaguuugaacuuuuuuu

SEQ ID NO: 4141193 - RNA, 77 nt, Human
gagaaaguacuuuagaaggguaacggaauuacaccuugguguuuguuucucuuucuuuuaaaaauauuuuuauucuc

SEQ ID NO: 4141194 - RNA, 84 nt, Human
gagaaaguacuuuagaguaaaauagaccuauauuaagaucccgaucuacauuggcuggcuauuugaccuuggagaccuuauuuc

SEQ ID NO: 4141195 - RNA, 79 nt, Human
gagaaagugccuuuguuuccaaaguugccauaagcuucugggaaguuuauauacacuuggaagaaaguuacacuuuuuc

SEQ ID NO: 4141196 - RNA, 88 nt, Human
gagaaauagaacccuugcuuccuggagcuggucuugcugauacccuguaggccuaggauugucuucacaggaauguaggggucuucuc

SEQ ID NO: 4141197 - RNA, 69 nt, Human
gagaaauaggcaaugguaucuaaaagcggaaugagggguuuuggagaggauggcuaugcucugguucuu

SEQ ID NO: 4141198 - RNA, 83 nt, Human
gagaaauaugaugccaaauugcuacaacugccggugccaccaccaccaaugcauucgguguucaguuugcuaucauaauccuc

SEQ ID NO: 4141199 - RNA, 80 nt, Human
gagaaaucaugaaaugggauggaaauguuuucagguaaucuguugauuagaauuucacaucuucaugagcuugguuucuu

SEQ ID NO: 4141200 - RNA, 68 nt, Human
gagaaaucuugcacuccuuucuccuaguucaucagcuaacugaaugcagagaaaccaguggaggacuc

SEQ ID NO: 4141201 - RNA, 95 nt, Human
gagaaaugaaaaaagaccuaaauaaauggugauauauaacaaauuuauguauuaggagauuccauguuuuuaagguguuaauuuucccccaaauc

SEQ ID NO: 4141202 - RNA, 70 nt, Human
gagaaaugaaggugucagcagggcugguuccuuuuggaggcucugaaggagaaccuguuccaugcuucuc

SEQ ID NO: 4141203 - RNA, 64 nt, Human
gagaaauggcugggcuccaggcuugugugacagcccgagaguggacagggcgcagcuaugacuc

SEQ ID NO: 4141204 - RNA, 59 nt, Human
gagaaauggcuuggcuaagaucuaagcuuagaagcagugcuauggccaggcuaagucuc

SEQ ID NO: 4141205 - RNA, 87 nt, Human
gagaaauuauauaacuguguauucuaaugacuaaaguuugggaaauuauggucuuggagaguauugcaauaggaguaauaaggguuc

SEQ ID NO: 4141206 - RNA, 81 nt, Human
gagaaauuuuaggcaggcugaauguagauuucuaccucugcuggaggaggaaauuugcuugagccuuuuugggcgguucuc

SEQ ID NO: 4141207 - RNA, 67 nt, Human
gagaacaaggaagagucggcaguaguacccuggaaaugcuaaaugaaacacucuuccuuauguucuu

SEQ ID NO: 4141208 - RNA, 91 nt, Human
gagaacagaaguaaauagaauacaaacacagaggacauacauguuuaugucuucgucucuguggguauuuauauguauugaagugguucuu

SEQ ID NO: 4141209 - RNA, 61 nt, Human
gagaacagagcagguggaggaguauuaucaccgauggcccugcuaccacuuuucuaauuuu

SEQ ID NO: 4141210 - RNA, 84 nt, Human
gagaacagggcagcaacuuugugccuucacucacuucccuccaacccccgaugugcaccuaggucaaaguucucucucugucuc

SEQ ID NO: 4141211 - RNA, 107 nt, Human
gagaacauguuuggguuacauaagccuccuugauguugguggguucaggugggacauuugaaaugccuaugaagucaggagggaauugaauauccugauuuguuuuu

SEQ ID NO: 4141212 - RNA, 76 nt, Human
gagaaccagacaggcucaauuggcucaacuggguucuggaacuuggcugggagaguugaagaucguuugguuucuu

SEQ ID NO: 4141213 - RNA, 101 nt, Human
gagaacuaaaguuuuaacauguaaaguaacuuguccugguucaccugccuuaggaguggaaucaaaucaaguucuuuugaguguagauuuaauagacuuuc

SEQ ID NO: 4141214 - RNA, 104 nt, Human
gagaacucgaaugaagauucacuuuggaacacauuagucaauuagauauaugcaugccugacaaauguaccccuagagucuagaauacuuucauuucuuaucuu

SEQ ID NO: 4141215 - RNA, 88 nt, Human
gagaacucugaagucaguugagugaucaaaauggcaccuucuguuauuuauagcagaaacugcuuguggucaucugacauuccuucuc

SEQ ID NO: 4141216 - RNA, 77 nt, Human
gagaacugaauuuguacaaaauguuuauaaauaauucgaaagaggacuuuaaaaguacuuuuugcaaguuuguucuu

SEQ ID NO: 4141217 - RNA, 85 nt, Human
gagaacugcccccuagugguccuggcaaccauggugaucaugugacauggccauaggugacuggaccugagaggacgugugacuc

SEQ ID NO: 4141218 - RNA, 130 nt, Human
gagaacuucuggcggcuggugcgggagcagcagguccgcaucaucaucaugccgaccaucagcauggagaacgggagggugagugcgccuugcaggcuccuagaaaggccaccagguggcgcacguucuc

SEQ ID NO: 4141219 - RNA, 56 nt, Human
gagaagaacuugggcaaagucaaaucuccccacuugauuuuguuuauguuccucuc

SEQ ID NO: 4141220 - RNA, 106 nt, Human
gagaagacauuuuaccaaauguuuuaccuguggcaacucccuucuguuuguuaccucugaagaagcaaagugaauuuugccaagaagcaacgugaaauguguucuc

SEQ ID NO: 4141221 - RNA, 65 nt, Human
gagaagacgugauggccaagaaucagaaacaauucccaacggcuuccugguagucaagucuccuc

SEQ ID NO: 4141222 - RNA, 75 nt, Human
gagaagagccugggcuuuugagucacaagggccuugggcaagucccuuaagcucuuggaggcucaguuucuucuu

SEQ ID NO: 4141223 - RNA, 83 nt, Human
gagaagaggugggaaguucuuggaggaugaagaguagacaccuccuggagcucuugauuuccaggagcuaguggccucaucuu

SEQ ID NO: 4141224 - RNA, 82 nt, Human
cuugucuauuugcauuuguauguaaaggucuucauguuguuuucauuauggagcauuuucaugccccuguaacugagacaag

SEQ ID NO: 4141225 - RNA, 66 nt, Human
cuugucucugggacaugguauuagcaggauguacagaguuccuuuuuggugccaugcuaggaggag

SEQ ID NO: 4141226 - RNA, 92 nt, Human
cuugugaaguuccuuaaggaaggagggaguguggcccugcagcccucccaaacugcuccagccuaugcucuccggcaccaggaaguuccaag

SEQ ID NO: 4141227 - RNA, 64 nt, Human
cuugugacagugaauaagucucuuaagaucugaugguuuuauacagggaguuucccugcacaag

SEQ ID NO: 4141228 - RNA, 67 nt, Human
cuugugaggcacuuaaccuacuaacugaaaugccauucauucagccaguauuugagugcucagcaag

SEQ ID NO: 4141229 - RNA, 89 nt, Human
cuugugccacaauuucuucauagauaaaugcagguauugaaaauagcugcaucauauaaugucuauggaaguagaugcaauaguauaag

SEQ ID NO: 4141230 - RNA, 90 nt, Human
cuugugccagaaggauuucuucucccagagagcaggugggccgugucaagggacauacugcugugugcucugggacccucucuggacaag

SEQ ID NO: 4141231 - RNA, 69 nt, Human
cuuuuugucucuuaaagcccuuggcagaguuccccacaaagugccuugcucucccggggguucagaaag

SEQ ID NO: 4141232 - RNA, 79 nt, Human
cuuuuuuagcacauggcucauguagaggccauuuuaucugugauggauuuaccacagggccacagugcuuacaaagaag

SEQ ID NO: 4141233 - RNA, 71 nt, Human
cuuuuuuggguuauuaucucagugucucaucuuagccacaggccauugcacuggggucauagccuccagag

SEQ ID NO: 4141234 - RNA, 117 nt, Human
cuuuuuuuaaacaacccucaaauuauaugcuuugaauguggcagcuguuucuugcaaggacccugacugauaaaggaaacaaguuacucuuaaaguauauggcuuaagugaaaaaag

SEQ ID NO: 4141235 - RNA, 129 nt, Human
cuuuuuuuuuuuugagauggagucuuguugcuguguugcccaggguggagugcaguggcaugaucucugcucacugcaagcuccaccucuuggguucacgucguucuccugccucaaucuccugaguag

SEQ ID NO: 4141236 - RNA, 65 nt, Human
gaaaaaaauccacaguggggguggcggaagaucuaugacuucuaacaacccauucugugguuuuc

SEQ ID NO: 4141237 - RNA, 129 nt, Human
gaaaaaauacuuaauaaacugauaccaagggucuguuguaggggaagucauugcuuagguauccauuuguugagacuucugaauucaguauggucuuucucucucucuuuuucuguuuauguauguauc

SEQ ID NO: 4141238 - RNA, 61 nt, Human
gaaaaagagaaggaguucaguaauggugaugccaucaguccacagagauccucucuuuauc

SEQ ID NO: 4141239 - RNA, 68 nt, Human
gaaaaagugauuugcuguucccaacugaaaucacagcugggauguuuacacagaaauuaguuauuuuc

SEQ ID NO: 4141240 - RNA, 73 nt, Human
gaaaaaguucauuagugagcuucucuccugauguguuauuauuaacuggaagcuaaaauuaaugaauuuuguc

SEQ ID NO: 4141241 - RNA, 99 nt, Human
gaaaaauacaguugucuggucuuugucaagaaaaaccguuaaaguaaaagaaagcgauuuguuuggaaacuuuggcaaagauggcuagcugugaguuuc

SEQ ID NO: 4141242 - RNA, 125 nt, Human
gaaaaaugacuccagaaucuuuaaaucugcucuacuguauagauggaguugauuuuuaaaaguugaaaaauauuauaagaugauuuuauuuacaguaaguugacuuaggauuggacuuauuuuuu

SEQ ID NO: 4141243 - RNA, 80 nt, Human
gaaaaauguucaacagauggauauuucuaaagccuaccacccuuugcuuuuuugaagcuacacaucuguuggguaugauc

SEQ ID NO: 4141244 - RNA, 70 nt, Human
gaaaacaagcacuacuuucauaaguuggauugugaauuuuccaggcugagugaaaguuugcuguguguuc

SEQ ID NO: 4141245 - RNA, 55 nt, Human
gaaaacacagugcaauguaucugaccugcugcugggucagcagcacugugauuuc

SEQ ID NO: 4141246 - RNA, 75 nt, Human
gaaaacagcucuauaugccauuaaaauauguauguguuuauaaauguuaacagaggucauuuuggggugguuuuc

SEQ ID NO: 4141247 - RNA, 113 nt, Human
gaaaacagucaaauuuaaccauuuggaguuuauuugaauucuuggaaagagcaauauucaaaaccuuuucaaaaauaagauauucuggacuacuggauggauguuuuguuuuc

SEQ ID NO: 4141248 - RNA, 77 nt, Human
gaaaacauuugguggagucauuggcauaugguaggcuuccguagauuucauuguccuuuggcuuugcaaauguuuuc

SEQ ID NO: 4141249 - RNA, 119 nt, Human
gaaaaccuagcuacuauuugcauaauccuuauauuuuaggaacagacaauaaugguucuaaaguuguugcucuguguaugagacgauacaugguuauucacugcaauagcugggauuuc

SEQ ID NO: 4141250 - RNA, 77 nt, Human
gaaaacgccacgcacuccuucuccaagcagggcuugucguagggcucaaaggagguaaugggugugaggguccuuuc

SEQ ID NO: 4141251 - RNA, 84 nt, Human
gaaaacuucugaaugcuauauguaguacuugugcuucaaauuauaaauggauaagagugucucacaguagcauuuuguguuuuu

SEQ ID NO: 4141252 - RNA, 125 nt, Human
gaaaagaguuaaagcccaauuuuggcagaaagcagggcuggagccagcuguggcugcggugaucacgcagccgggucugucuuuagagcuucuuucugccuuuccuuugucggcauccucccuuc

SEQ ID NO: 4141253 - RNA, 81 nt, Human
gaaaagaguuccccuugaauuuucagagaggggauuugguuuuauguccccuacaucugaaguugaagugaaaauuguuuu

SEQ ID NO: 4141254 - RNA, 86 nt, Human
gaaaagcauggucagauaagcaaagucucagaaaauaugcuuuuugaaaacaaauaugcuuuuugaaggcugcucauaugcuuuuu

SEQ ID NO: 4141255 - RNA, 80 nt, Human
gaaaaggacaccaggaucugaaugguuagcauucuccauugacaagcauguuuuaguucugucuugcauguguuuucuuc

SEQ ID NO: 4141256 - RNA, 58 nt, Human
gaaaaggauugguaaaauaucuguuauuucacuuacagguggaaggccaccccuuuuu

SEQ ID NO: 4141257 - RNA, 55 nt, Human
gaaaaggcuaauuaaguuuuggaucauagugugugucuccuccuuuggccuuuuc

SEQ ID NO: 4141258 - RNA, 120 nt, Human
gaaaaggcuggauuugggaaggaggucagaucuaccagggucacagaggcccuuggcauggggaauauucugugauucugugguuauguaguacugucauucccagcuuguggcuuuuuu

SEQ ID NO: 4141259 - RNA, 86 nt, Human
gaaaaggugagauuaaugguucucagugaaucucuuguuauauuguuuuaauaauuuuuauuguggacuacuguucugguuuuuuu

SEQ ID NO: 4141260 - RNA, 71 nt, Human
gaaaaguaguauucaugguuuuaauuuggcagugcaaauguaucaaccaacuacucguguugcuucuuuuc

SEQ ID NO: 4141261 - RNA, 130 nt, Human
gaaaaguugcugguggguagccaggcccugccugaucucauaaauucuggugcugugagauuuccuccaucuucauagugaguuuaaugaugcaguagauuuccauguuaccacuuuuaauuuccaguuc

SEQ ID NO: 4141262 - RNA, 76 nt, Human
gaaaauacaaggacuacacccacauugagcaugggacauggaaaaaucugauguguguguguauguguguguuuuc

SEQ ID NO: 4141263 - RNA, 70 nt, Human
gaaaauacauauucaagaaguaggaguuguaugaauuaacuuaguuuagcuccuuugaaaguauguuuuu

SEQ ID NO: 4141264 - RNA, 96 nt, Human
gaaaaucugucucaucgacagucagugauaugguaagggaagaaaaagcacaguauauuuccauuacagagaggugauugugaagaucagguauuc

SEQ ID NO: 4141265 - RNA, 60 nt, Human
gaaaaugaacagaacaauggggagcuguuguucccaggcuuauuuauuuguucgucuguc

SEQ ID NO: 4141266 - RNA, 67 nt, Human
gaaaaugagguaguuugccauugagaggcuugaggagugccuaaaugugacaaaugaucugauuuuc

SEQ ID NO: 4141267 - RNA, 64 nt, Human
gaaaaugguuggggcauaagacauggguauguccaaaauucguagauuaugcaaaacuguuuuc

SEQ ID NO: 4141268 - RNA, 56 nt, Human
gaaaaugugccuuuggguauugcuaauucagauauaaugcccuuggcacauguuuc

SEQ ID NO: 4141269 - RNA, 55 nt, Human
gaaaauguuuccuguuauuugcuggacaagucccaaagaacaggcagauguucuu

SEQ ID NO: 4141270 - RNA, 56 nt, Human
gaaaauuauguggcauauucugggaaaguggcaacagcagcaaccacauaguuuuu

SEQ ID NO: 4141271 - RNA, 103 nt, Human
gaaacaagcugggaaccaggcauggcaaaacccugucucuacuaaaaauacaaaucuauuguauuaggagagugggugcuaagucuaguucccugcucuaauc

SEQ ID NO: 4141272 - RNA, 87 nt, Human
gaaacaagugagagaaggcuuccaaauucugugaaaguaauuguacaggugcauugaauggaugcucuguuucaugauuuguguuuc

SEQ ID NO: 4141273 - RNA, 77 nt, Human
gaaacaaucacaauagcugaaaguuaugguaggagccaugccuccugcuuugaaaauaaacuugucagcuuugcuuc

SEQ ID NO: 4141274 - RNA, 62 nt, Human
gaaacacacacaguguaauaaccaucuggccccuuuauuucucaguggagcugcguguguuc

SEQ ID NO: 4141275 - RNA, 94 nt, Human
gaaacaccagaaucccggggagugucccaggagaggagacaauggggugcuggcuaggaccccaacucccuccuuccccagggauucaaauuuc

SEQ ID NO: 4141276 - RNA, 56 nt, Human
gaaacagcacgguccacagucaguauugaacacugcacuggagaauggcuguauuc

SEQ ID NO: 4141277 - RNA, 56 nt, Human
gaaacagcuuuaagugauacugcugcugcuacuggugguuuuaguucagcuguuuc

SEQ ID NO: 4141278 - RNA, 97 nt, Human
gaaacagugccaggcauuggagugagaaucuucacagaaaaaugucugcccagaggcagaugagguccuucagcuccagugcugauugguuccuuuc

SEQ ID NO: 4141279 - RNA, 80 nt, Human
gaaacauccaugcaauaaagugcuauaaauccauaaaaaagaaugagguggcucuuuaugcauuaaaaugggauuauuuc

SEQ ID NO: 4141280 - RNA, 71 nt, Human
gaaacauguuaauaugcauugaguacuaagcaugggccagcaagguacucaguaauauaacauauuguguc

SEQ ID NO: 4141281 - RNA, 59 nt, Human
gaaacauugagcagaaggagaauggggcccacauauuacuacccuccacuuaauguuuc

SEQ ID NO: 4141282 - RNA, 97 nt, Human
gaaaccaaaguuugaaucuauguugccccauaaucagccagugaaagcccauugagacaaauggaacaaugaagacugaaauuuaaacuuuuguuuc

SEQ ID NO: 4141283 - RNA, 64 nt, Human
gaaaccacaguucagugcuuuuggggaccuacuacagauucagauacucauggaacuggguuuc

SEQ ID NO: 4141284 - RNA, 128 nt, Human
gaaaccaguuaucauucauuuagucauuugcuucauucauuuauucacuauuuaauaagcaccaaaugaugcauuggucuggggaaaugaagaggccacuccggacucuagaaugacuccugggaauc

SEQ ID NO: 4141285 - RNA, 94 nt, Human
gaaacccagagggcuuuagcaggguaaauguagauggagaggccuagagaaaaacuuuuccuucuuuauaauuuuccugcuucuauucuguuuc

SEQ ID NO: 4141286 - RNA, 79 nt, Human
gaaacccauggaauguguggcuugagaauagugguugaaaaaaaccucugugccuaagaugcaugucucagagggcuuc

SEQ ID NO: 4141287 - RNA, 58 nt, Human
gaaacccuuccuagagggcaaguggaauuucaacacugaauuauuuuaggaggguuuc

SEQ ID NO: 4141288 - RNA, 78 nt, Human
gaaaccuagauaugugcugggcuggguggcagugccacagcugggcacuuuacuccccaacauaaauguaggcauuuc

SEQ ID NO: 4141289 - RNA, 78 nt, Human
gaaaccuuguggcucuacugaaacuuuucuucaacuggguuaaguaaugcacuaaaaaguuucaagcccacaguuauc

SEQ ID NO: 4141290 - RNA, 84 nt, Human
gaaacggguauaggcauuuugauuagaguggauaaguguaauuauuauucaacuguaauauuuuaagaugucugugauuauuuc

SEQ ID NO: 4141291 - RNA, 68 nt, Human
gaaacgucugcuagaauuucuggaaaagagagauuccucucuuugcuccaugaaaucuauuagauuuc

SEQ ID NO: 4141292 - RNA, 61 nt, Human
gaaacuaagacuaaugaagaacuaguguucguuuuucuaggacugcauucuucuuagucuc

SEQ ID NO: 4141293 - RNA, 57 nt, Human
gaaacuaaugauuguagauuuguggguuucuaacccaaagcaauauucaucaguuuc

SEQ ID NO: 4141294 - RNA, 67 nt, Human
gaaagagguuauuguucccagcuuauagacugagaaaacugaagcguagagggaguaacuuacuuuc

SEQ ID NO: 4141295 - RNA, 82 nt, Human
gaaagauaucuauuucaccuaaaagugucaaaggccuccugagguaggaauugugcauuagggaaaggaacugcuguuuuuc

SEQ ID NO: 4141296 - RNA, 63 nt, Human
gaaagcacagugggcagagcagcccuccauacucaugggggcagggaugacccucugugcuuc

SEQ ID NO: 4141297 - RNA, 80 nt, Human
gaaagcaggagcccuggcauguucuuccagcuuccauauagcaugccggcaaagaccagucuccagggcucaccucuuuc

SEQ ID NO: 4141298 - RNA, 71 nt, Human
gaaagcaguauuuaguucuguuuugauuuguuaaguuuaagagacaguaaugcccuaaauacuugcguuuc

SEQ ID NO: 4141299 - RNA, 93 nt, Human
gaaagcaugaagucaggauuuccaugauuuaaagauagaaauauucuccgaaugucuugguuucauaacagguaccugcacuuuaggacuuuu

SEQ ID NO: 4141300 - RNA, 62 nt, Human
gaaagcauguucugggaauaguaaggggguugugcugccuacuuugccuagaauguucuuuc

SEQ ID NO: 4141301 - RNA, 59 nt, Human
gaaagcuaaaccuguuugugucccuuuaucagacacauuuagcaccagguuuaucuuuc

SEQ ID NO: 4141302 - RNA, 68 nt, Human
gaaagcucuuacuagcuacaaauaucacuaauagugaugagagugauguugacuagcuauaagcuuuc

SEQ ID NO: 4141303 - RNA, 57 nt, Human
gaaagcugaaccaggaaccaugcguuguuucagaugcauugauuuuuaucagcuuuu

SEQ ID NO: 4141304 - RNA, 62 nt, Human
gaaagcuggcaaggcuuuagauucagacagccauggguucaagugucaggucagccacuuuc

SEQ ID NO: 4141305 - RNA, 55 nt, Human
gaaagcugguuauucugaggcagcuggagaggcugcugaagggauuucagcauuc

SEQ ID NO: 4141306 - RNA, 93 nt, Human
gaaagcugucugagcuguggggcaggcagcgaggguuucuguagggaagccugccucucuccuccucgcccugacucagucuguccagcuuuu

SEQ ID NO: 4141307 - RNA, 59 nt, Human
gaaaggaccugaugggaaaggcgcucggccccgggccggggccagggucaggaccgguc

SEQ ID NO: 4141308 - RNA, 80 nt, Human
gaaaggaugggugagggaagaaagaauugaugcguuuugauauauccaacauauuuuuucuucccuuuuauucucuuuuc

SEQ ID NO: 4141309 - RNA, 75 nt, Human
gaaaggcauggauagugaauucagagcuuaucagugcugucucuuuuauuugaaauucauuguuuuauguguuuc

SEQ ID NO: 4141310 - RNA, 130 nt, Human
gaaaggccagcccagagccucacccuccucccucugucccuggcacugaccaggcacugacugccagguuuggcucacugguggaugcugggagggagggcaggcgggugguggcaccggcuggccgguc

SEQ ID NO: 4141311 - RNA, 115 nt, Human
gaaaggcuucgugacaaaaccaaggugcggagggccguugggagggcuugaaggaaaccccauuggucucugauuucacagcugucuuccgucucggucugcaacccugucuuuc

SEQ ID NO: 4141312 - RNA, 64 nt, Human
gaaaggcuucuuaagcuucacuuucagguugggaagagucuauuuuggagaugagaagccuuuu

SEQ ID NO: 4141313 - RNA, 89 nt, Human
gaaagggagccgaaauacuuaaaaucucaaacaaugcacaaaauccucuuuugugacuguggacuuuugugggguuuuugcuuuuuuuu

SEQ ID NO: 4141314 - RNA, 89 nt, Human
gaaagggagugacagaguuguugauguaugcuuuguaguuaucacuuuacgacaguuaccaaacagcagcagcuuuuuagcuaguuuuc

SEQ ID NO: 4141315 - RNA, 71 nt, Human
gaaagggcaaaggcaugcuucuacugucaguucccuucagcaucuggccugagccuucccucugcccuuuc

SEQ ID NO: 4141316 - RNA, 80 nt, Human
gaaagggccaagagucucacgggcuucuuacguguugcuggaugcucaggaggaggcugugaggacgaaggcauccuuuc

SEQ ID NO: 4141317 - RNA, 80 nt, Human
gaaaggggacaacuuuggaagugauagauaugaugaauacaacacauucugugaccuugcaaagaaaauagucacuuuuc

SEQ ID NO: 4141318 - RNA, 67 nt, Human
gaaaggggagcuucauuuugaccugggacagggaccuguaggucucagugucugagcuacuucuuuu

SEQ ID NO: 4141319 - RNA, 60 nt, Human
gaaagggugugcugcuaucccacuaccaaguuuccaggcagcuggcagugccaccuucuc

SEQ ID NO: 4141320 - RNA, 73 nt, Human
gaaagguccccaucuaagcugaugacaauuagaaguacuauuauuuucaagacguuaagucagcuuaccuuuc

SEQ ID NO: 4141321 - RNA, 63 nt, Human
gaaaggugcuaguuugcuuuccagcuuuagaaauagagucuacugaagauaacuggcucuuuc

SEQ ID NO: 4141322 - RNA, 81 nt, Human
gaaaggugguauaaaaauagcuguuuuuaggccaaauaagcauguugguuacuucugccuuagagaacacuacagcuuuuc

SEQ ID NO: 4141323 - RNA, 63 nt, Human
gaaaguaugccaucuaccucuuuauucuagaagaguuuauguagaauuggcaauaauucuuuc

SEQ ID NO: 4141324 - RNA, 70 nt, Human
gaaaguauggacagggcacaggcgcagagacaggucacucucuguguuucauucccguccugacacuuuc

SEQ ID NO: 4141325 - RNA, 91 nt, Human
gaaaguauuauguuuuuuacuguuacuuaacucaguguaauguuucaaauagcaauagcacagcaguggcauaaacaauagcaauauaguc

SEQ ID NO: 4141326 - RNA, 67 nt, Human
gaaaguccugugaucacauaguuugaugguauugcccuuuuauuccauccagcccacagugacuuuc

SEQ ID NO: 4141327 - RNA, 60 nt, Human
gaaagucuccagcaagucuuuggaagcccugggguuucaaagggaagacgcuggaauuuc

SEQ ID NO: 4141328 - RNA, 68 nt, Human
gaaagugggcaugucuucaggaguaaauaucauuucacugaaauguccuuccugagaucccuguuuuc

SEQ ID NO: 4141329 - RNA, 66 nt, Human
gaaaguguagagugccucaaaauacgcaauuuuccuugaauguuauuauggaguaccugcauuuuu

SEQ ID NO: 4141330 - RNA, 84 nt, Human
gaaaguguaugggaaagcccuugaguaguacaguuuaggccagagguagccccagaauucacagggcuuuccgcauggacuuuu

SEQ ID NO: 4141331 - RNA, 76 nt, Human
gaaaguuccuucuagcagcaccuacacgucagagccuacugugcucaugaagcuggggcucuaaacagguuuuuuu

SEQ ID NO: 4141332 - RNA, 71 nt, Human
gaaaguuguauggaagcaacagugcaugggcacaugggugcuagcaucuguucuuucauuaaacaauuuuu

SEQ ID NO: 4141333 - RNA, 79 nt, Human
gaaaguuuucauauauaccaaagaccgcacgaauuuucccaagugcuuauguugguacuuugugcucagaagacauuuc

SEQ ID NO: 4141334 - RNA, 104 nt, Human
gaaauaaaacagacagugcacuccaggugggauuuugcugcuugaaggaaucccuuagucaagcaaggaauccuuuuguaaaguaagugcucacuguggauuuc

SEQ ID NO: 4141335 - RNA, 72 nt, Human
gaaauaaaauguccaauuucugaggcugcuguuaaaccucaaaaaacaggcugcuucaauggauaagauuuu

SEQ ID NO: 4141336 - RNA, 62 nt, Human
gaaauaagaguccaugccagguucccuaucaacaugccugacuguggcauggacucuauuuc

SEQ ID NO: 4141337 - RNA, 110 nt, Human
gaaauacccuauuuguuugcacaauuuagcugauuuuugcccaaguauuuuuuugguuaauacuaaaacuguggagcaguggcuagggauaggcaaaaaggagguauuuc

SEQ ID NO: 4141338 - RNA, 69 nt, Human
gaaauacuggaaaacacuacuacaugcacgugcacaugcgcagcacuaguguucuucaguaauauuuuc

SEQ ID NO: 4141339 - RNA, 82 nt, Human
gaaauagaaacuuugucuuuuaugcuuacagacuguuuaguuuuucuguuuccaaaugguauaaagacagggaaaauguuuu

SEQ ID NO: 4141340 - RNA, 84 nt, Human
gaaauagaugguuauuaaggccucuuucaguugugacucguggaguuccacauugcuugucucugagccuccugcuucuauuuc

SEQ ID NO: 4141341 - RNA, 83 nt, Human
gaaauagguuauauugucagcugaucauauuaaaauguagaccuuuuauguucaucuggugcaucagucacgacaaccauuuc

SEQ ID NO: 4141342 - RNA, 64 nt, Human
gaaauagugcugucuuggguagaaagagguccccaaaggacaaucuuaaaacccaaauaguuuc

SEQ ID NO: 4141343 - RNA, 85 nt, Human
gaaauauacuaaaaaacauugaauugcacacuauacguguuuuaaauuagucgauuguaugguaugugauauauguguauauuuu

SEQ ID NO: 4141344 - RNA, 76 nt, Human
gaaauaugacuaugcagaacguuugugaaacuuuuaaguuuugugaaguugaauaaaaugaucuguauucacauuc

SEQ ID NO: 4141345 - RNA, 68 nt, Human
gaaauauuuguuauaggaucagugucacuuuauuuaaauguaaguguauuugccuauaaaaauguuuc

SEQ ID NO: 4141346 - RNA, 77 nt, Human
gaaaucaaagcaucagcagggccaugcucucucugaaggcuuuagagaaguauccuuccuugcugcuuccuaguuuc

SEQ ID NO: 4141347 - RNA, 82 nt, Human
gaaaucaguacaucaguuugaaauguuggcaauauucagacagaggaguguacuuccauuucaacugacaaauuugaguuuc

SEQ ID NO: 4141348 - RNA, 98 nt, Human
gaaaucaucuuaagugcauaucuucuuccucauuuauacauacaaagagcuguauggcaaugcauaggaaggaaauggcacaggaaaugaacauuuuc

SEQ ID NO: 4141349 - RNA, 87 nt, Human
gaaauccaauguguuuugugaaaugaagucacaacugggacucauaucccaguaaugcugccauuucucaaaauaucuuuagaauuc

SEQ ID NO: 4141350 - RNA, 96 nt, Human
gaaaucugaaguaauguauuaaaaagcagugacaaaaaugaagaacauguugcagucacucuguuuuacucacuguugaugcugcuucacucuuuc

SEQ ID NO: 4141351 - RNA, 85 nt, Human
gaaaucuuagcaugcucuucaaaugauuuccuuaggacacauuuccuaaaagugggauucauuggacagauuguaugcguauuuc

SEQ ID NO: 4141352 - RNA, 62 nt, Human
gaaaucuuccuucagugaagaagagguuuuuauguuauguuccuccuucuucagaagguuuc

SEQ ID NO: 4141353 - RNA, 67 nt, Human
gaaaugaaacaggcuuuuaaggcuugaaaaaaaggaaaauagaaggccaggggcaaauugucguuuc

SEQ ID NO: 4141354 - RNA, 129 nt, Human
gaaaugaagucuuuuaaauaaguuaucuuuuggguaguuauucugcacaccuuuaaaaugcauuuuacuuauuugugguggguggaguagaaagaugaauucuggagaaguugagaggaaaauaauuuc

SEQ ID NO: 4141355 - RNA, 74 nt, Human
gaccuaaggaaaaggauauauaugugcucuaggagugaauucuggugagaacguuuguauucuuuccuuuccuc

SEQ ID NO: 4141356 - RNA, 90 nt, Human
gaccuacggcacauccagcugugacucuaauuugcacaaaggcaccauaugugcuagcagcaguccaacugagguggcauaaugaagguc

SEQ ID NO: 4141357 - RNA, 95 nt, Human
gaccuagaaucauucuuauuucacagcaaccugugucuugacuaauguuaaacugacuaauuuguuuugaagcugagaaugagaaauuggagguc

SEQ ID NO: 4141358 - RNA, 65 nt, Human
gaccuauuuuuuucccugucuuauugaaaacaggauuuacaggacaaggggaagaagauaaaguc

SEQ ID NO: 4141359 - RNA, 68 nt, Human
gaccucaagucucuuaaugggcagaaaguguuacaaaauaugggcacuaggaagagauucuagagguu

SEQ ID NO: 4141360 - RNA, 79 nt, Human
gaccucaaguuggucuccuguagcaacaacuugggcagagccaauugagaagaguccaagcaguugccaggaugagguc

SEQ ID NO: 4141361 - RNA, 92 nt, Human
gaccucacugaagaggugacauuuaagcagcaauuugaaggagaacugcuuuuaggauuuuaagaacucuuuagugaauuuguuuaaucguc

SEQ ID NO: 4141362 - RNA, 77 nt, Human
gaccucaggauguacuacagaaggcaaucaucuauaggcauucuugcauuuggagccaucugguauuuccugacuuc

SEQ ID NO: 4141363 - RNA, 55 nt, Human
gaccucagugaauggucauguaaauggacaauuugcagaaauuccagcugggguu

SEQ ID NO: 4141364 - RNA, 130 nt, Human
gaccucaguuucuuuaucuguaaaacggggauaauuauggcaccuuauuauugcggguuucucauguggcguacuggcauguaguaggugcuauaaaagcauuugcuguugucaaaauuagauggggguc

SEQ ID NO: 4141365 - RNA, 60 nt, Human
gaccuccauucugucaugacugacaccaugguagucugucagcuugaccaguggagaguc

SEQ ID NO: 4141366 - RNA, 60 nt, Human
gcuuaaugggcuguggauuuaggaacuucaugucuccugaagcucuuaagaccuuuaagc

SEQ ID NO: 4141367 - RNA, 55 nt, Human
gcuuacauucauuaccucagugucugggcuuggcacaugguggugcuugauaagc

SEQ ID NO: 4141368 - RNA, 83 nt, Human
gcuuaccaaugauuucccauugcugcuuggaaugaaaacccaaugacacauuucaaaauuuugcagugguaaaucauguaggu

SEQ ID NO: 4141369 - RNA, 68 nt, Human
gcuucauuagaauugaagagagagaaaguggcccaucccgucacccuccucucucauuguaaugaagu

SEQ ID NO: 4141370 - RNA, 58 nt, Human
gcuucauuugagaaccucuguguuaacuccacaaagggggaaacaggcucagagaagc

SEQ ID NO: 4141371 - RNA, 70 nt, Human
gcuucauuugugcuucauggacuugaaguauuuuuggacuucaaacuugcgucaugucaugaaaugaagu

SEQ ID NO: 4141372 - RNA, 88 nt, Human
gcuuccaaaguacauaauaagugaugaugagucacucuaagccagguagucaccucacaucccuuauaaagugaacuuacaugucagu

SEQ ID NO: 4141373 - RNA, 90 nt, Human
gcuuccaaccugcugaaucaaaacaaagguuuacucugugagauaaauacacacauucuaaagccuuuugacagacagcuugcaugaagu

SEQ ID NO: 4141374 - RNA, 57 nt, Human
gcuuccaaugaugcaaggagcugccugcgcaacagugagcuccucaucacuggaggu

SEQ ID NO: 4141375 - RNA, 130 nt, Human
gcuuccagcggcagcacuccuguacuuagaagucuggcugaaguuuugcagagaguaaggaaaaucccauuugcuccaggcugcagacucugagcaguuuggcugcugagucuggguccuguccuggagc

SEQ ID NO: 4141376 - RNA, 66 nt, Human
gcuuccaguuuuaggacauguggauguaauuuuauaucguguuucucauguucguugacuuaaagc

SEQ ID NO: 4141377 - RNA, 64 nt, Human
gcuucccaggcgccugaccuuucugagcugcuggcaggagagggcagugggagucagggauggc

SEQ ID NO: 4141378 - RNA, 60 nt, Human
gcuucccuaggggccagguucuugcaaagggggaaggggccuguagagcuucagggacgc

SEQ ID NO: 4141379 - RNA, 76 nt, Human
gcuucccucccccagguaccaaacucugcuagcagacccacuacagauuugacugguaccuggccucacagggagc

SEQ ID NO: 4141380 - RNA, 71 nt, Human
gcuucccugcccagcggcuccaaccuccagccugggcacccagacccagagggcugcugggagggacaugc

SEQ ID NO: 4141381 - RNA, 56 nt, Human
gcuuccuauugcuggaaaaguuucugugauguuaucaccagagauagcaauagugc

SEQ ID NO: 4141382 - RNA, 80 nt, Human
gcuuccucaugugcagccccucacagagcuguccugaggcucagagaagcugacaggggcgugcaucuggaugacaaggc

SEQ ID NO: 4141383 - RNA, 79 nt, Human
gcuuccucauuugucuuucucauuugcugccaauggccacccacaccuggcacugggugggagaucugaaugagugggc

SEQ ID NO: 4141384 - RNA, 59 nt, Human
gcuuccuccagggaggggccugcuggacccaugccugcucagccccuccuggcaguggc

SEQ ID NO: 4141385 - RNA, 80 nt, Human
gcuuccugaaacagggcaaggcagcccgcugaaccacauuuguggaugugagggaggagcugcccugcguuuugggaggc

SEQ ID NO: 4141386 - RNA, 93 nt, Human
gcuuccugcgccuuugcaacgcuuugcuagcacugcgcuucccuuggcagcgccuggaagcggcgcuagcugagauuugcgaggccagcgggc

SEQ ID NO: 4141387 - RNA, 79 nt, Human
gcuuccugcuuucagcacccugguagagcccagucucaggacaggcaccacacuaggggcugacacugagggcaggagc

SEQ ID NO: 4141388 - RNA, 78 nt, Human
gcuuccugucccauagaaugcagcaggaaaguucccacaaucaagggggccucucuuagugcauuccaugcgggaagc

SEQ ID NO: 4141389 - RNA, 56 nt, Human
gcuuccuucuaccacaucaugcugcagaaaacacagcagaugggaagagacgaggc

SEQ ID NO: 4141390 - RNA, 72 nt, Human
gcuuccuugguccuggucuaaggccucucccaccucaccauacugagagaacuaagaacaagacuaggaagc

SEQ ID NO: 4141391 - RNA, 130 nt, Human
gcuuccuuuuaacucccuugaagacugaauguuucuuauaagaaugcuguuaggggauuugggaaaaggucuuaaaucucacuggguauauuggagugaugagauuucaaagggaaaaugagaagugggc

SEQ ID NO: 4141392 - RNA, 82 nt, Human
gcuucgccauaucucguucggggacacuuugggguuggggguuuucugcugacuguguuccagggcgcgaagguggugucgc

SEQ ID NO: 4141393 - RNA, 57 nt, Human
gcuucggguggcccaggucuuggccuuggccaggaaggcucccuggucacccugagu

SEQ ID NO: 4141394 - RNA, 70 nt, Human
gcuucuaaagagugacuguguagcuaugauucugaauuuuauagacaugcaacacuuuuuaccacauagc

SEQ ID NO: 4141395 - RNA, 70 nt, Human
gcuucuauaagacucauauuucuuuauauuugagaaaggaaagaaauauugggccuuauaaaccggaagc

SEQ ID NO: 4141396 - RNA, 56 nt, Human
gcuucucauccaccccagcuagucuagugacuggaguguuuggaggaugcaggagc

SEQ ID NO: 4141397 - RNA, 87 nt, Human
gcuucucauugggccucuggguuagucccuaagcagacagguugugauggaacuaggguuacccagagcuugcuuucugagaucagc

SEQ ID NO: 4141398 - RNA, 55 nt, Human
gcuucuccccaguaagccugcacuguggggucuccauaggaggagcuggggaagc

SEQ ID NO: 4141399 - RNA, 69 nt, Human
gcuucuccccuucucaaacugagacugucuaagcccagguuugaagcaucuggucugagaauuaguagc

SEQ ID NO: 4141400 - RNA, 70 nt, Human
gcuucucucauucaaauuaaagugaauggaagcccauucccuuagacuacuaauaugagcugggagaggu

SEQ ID NO: 4141401 - RNA, 63 nt, Human
gcuucucuggccugcagggcaucagggacccugcuguccugauccccaugccgucuagaaagc

SEQ ID NO: 4141402 - RNA, 76 nt, Human
gcuucucuugggguaugugggguugaaggaggagacacauucuuccaaacacccuccaugcugcaaaauggggagc

SEQ ID NO: 4141403 - RNA, 59 nt, Human
gcuucucuuguccaagggcagggaugaaaaggaggaauucuugcuugauauagagaagu

SEQ ID NO: 4141404 - RNA, 94 nt, Human
gcuucugaccacgugaucucaggcacugcuuucugauaugugaugcucaguccaugugucauaugugcagcacuugccauuacugcagagaggc

SEQ ID NO: 4141405 - RNA, 79 nt, Human
gcuucugaguggaguagugaaugcauuucauuuuaagaauuuagguuauuagugcauagcugcgaagcauuuuugaagc

SEQ ID NO: 4141406 - RNA, 87 nt, Human
gcuucugauaacaguagcuucaguugaggccugagaauuugcauuuuuaaguuuccaggugauucugaugcuauuggugcagauagc

SEQ ID NO: 4141407 - RNA, 62 nt, Human
gcuucugcaggguccucgcugucaacgaguggugguuaucuaauaggggucccugccgaagc

SEQ ID NO: 4141408 - RNA, 71 nt, Human
gcuucugcuucccgcaguggcacucucaucacauauauugguaaguauagaggugccaaggagaagcaggc

SEQ ID NO: 4141409 - RNA, 57 nt, Human
gcuucugggcacaaaauauugaugaaucacauuucagcaucacgugguccgagaagc

SEQ ID NO: 4141410 - RNA, 76 nt, Human
gcuucugucuuguaauugaagagcuguuccucauucaucuacaugggaacccagcacucuaagugcaagacacugc

SEQ ID NO: 4141411 - RNA, 57 nt, Human
gcuucuguggugcaucuuugcuuguggguggguuccagaugauggauuaacggaagu

SEQ ID NO: 4141412 - RNA, 71 nt, Human
gcuucuguucuucacauuuuggggucacggacucguuugagcaucugaugagucuugugaagaauggaugc

SEQ ID NO: 4141413 - RNA, 87 nt, Human
gcuucuguugcuuguguguccugagucaagugugggcaguccaguggcucugcugaucuuggcuaggcucacucacaggucaggggu

SEQ ID NO: 4141414 - RNA, 61 nt, Human
gcuucuuaggaguggguugagcugauagagaaaaaacggccuucagcccaggcugggaagc

SEQ ID NO: 4141415 - RNA, 92 nt, Human
gcuucuuauaauccaugccauguuacacuuaaagagaucaguaauauuuuaauugaaaauuuuguugagguaauugucaauuuagaugaagu

SEQ ID NO: 4141416 - RNA, 62 nt, Human
gcuucuucucuacauccuuugauugccaauccaagcaucauacuggguagagagaggcaagc

SEQ ID NO: 4141417 - RNA, 79 nt, Human
gcuucuuuauccaccugcagcuuucucugguuuaguaucagaguggcaaaaaaagcagcagcacguggaagagaucagc

SEQ ID NO: 4141418 - RNA, 123 nt, Human
gcuucuuuauuugcugaaacacaggucuuugguaugagcuguuuuuccugcaccuccuaauaaggugcaguguuuaaaaguagcaaucaaacacugauuugucaauauucuaaauagaguugc

SEQ ID NO: 4141419 - RNA, 60 nt, Human
gcuucuuucccaggcauguuuuagucuagaacugaguaguaauauuuugggaaaugaugu

SEQ ID NO: 4141420 - RNA, 58 nt, Human
gcuugaaagaugagucuaguaacugacuuuggucaguuacagugaccauuuauuuagc

SEQ ID NO: 4141421 - RNA, 65 nt, Human
gcuugaaagcugggaggcggagguuauggugagccgagaucacgccacugcacuccagcccaggc

SEQ ID NO: 4141422 - RNA, 83 nt, Human
gcuugaaauucuagaaacuugauuuagaacuaaggcugccaaggcagaacccuuaggauuuagacagguagccuagauuaggc

SEQ ID NO: 4141423 - RNA, 82 nt, Human
gcuugaagauaggccccugaauuaucauggaccuucuucuaggacagaagagagaggccaguuguucagugggccgucaagu

SEQ ID NO: 4141424 - RNA, 61 nt, Human
gcuugaagugaauugauaauauuaaauaaguaccuuggauauuuucagucuccuuucaagc

SEQ ID NO: 4141425 - RNA, 78 nt, Human
gcuugaauaggcaagggauacaauauaccguuucuuaaauugagugguauuauuaaguguauuugaccuauaucaggu

SEQ ID NO: 4141426 - RNA, 66 nt, Human
gcuugacuaauuauguuacuaaucacuugaagcaucuuccaugugacaauguaauuaugucagagu

SEQ ID NO: 4141427 - RNA, 55 nt, Human
gcuugagaacuucaacucaguguuuguucagaugcugauuugugaccucucgggc

SEQ ID NO: 4141428 - RNA, 72 nt, Human
gcuugagcccaagagguugaggcugcagugagccaugaucaugccacugcacuccaacuugggcuacagagc

SEQ ID NO: 4141429 - RNA, 72 nt, Human
gcuugagcccaggaauuggaggcugcagugagcuacgaucgugcuauugcacuccagccugagcaaaagagc

SEQ ID NO: 4141430 - RNA, 81 nt, Human
gcuugaggagcccuucagcccgcagcugcaccgugggagccccucucugugcuggcugaggccugagcgggcucccucugc

SEQ ID NO: 4141431 - RNA, 71 nt, Human
gcuugaguacuuuuguuuccauaauuaagugugaggcccuugucucaaugugaauuaagaauacuucaagc

SEQ ID NO: 4141432 - RNA, 58 nt, Human
gcuugaguuuugggacaaagccuuccguauuuccuuugcuugacuccaaagcccaggu

SEQ ID NO: 4141433 - RNA, 74 nt, Human
gcuugauuaauugccaagcuaaggcuagugaaugaaaguucaauuagaauuaugcuugcuaaugaaauccaagu

SEQ ID NO: 4141434 - RNA, 62 nt, Human
gcuugcauuucacaaauggccacaucauuuugucaaauuguggagccacuuggaaauugggc

SEQ ID NO: 4141435 - RNA, 73 nt, Human
gcuugccaaauauucaggcaccuauuaugugccaauaugaauagcacauaauagguaccugaauaauguaagu

SEQ ID NO: 4141436 - RNA, 89 nt, Human
gcuugcccagugggccacuggucgugugugucugcgggucagagagcuccaggccugagcagacagcaugauggucagcagagggaagc

SEQ ID NO: 4141437 - RNA, 62 nt, Human
gcuugcuaucguagcucccacagaugacguugucaccuagggccaaaggcugugaugcaggu

SEQ ID NO: 4141438 - RNA, 87 nt, Human
gcuugcuguugccaggugcguguguggguucucuggagaggccucucugaaggcauccucacugcaacucccucacacaggcaaagc

SEQ ID NO: 4141439 - RNA, 60 nt, Human
gcuagcccagguccugagcccagauggggaaacugucugggcaccuggccugggaagagc

SEQ ID NO: 4141440 - RNA, 63 nt, Human
gcuagccugacaguuucuugaaguccugucccucagagggcagcaaugcugugcaggcauggc

SEQ ID NO: 4141441 - RNA, 56 nt, Human
gcuagcugccaguaaaaagaugcagucccaggcuccagcucuuacuuugcagcagc

SEQ ID NO: 4141442 - RNA, 95 nt, Human
ggagcugggaggaggugcugacugccaggacugacgucuucagacugauucgucuaagcucggccagccccugcccugcuuccucuuccaccucc

SEQ ID NO: 4141443 - RNA, 101 nt, Human
ggagcugggcaagagccauccaugagagcgucugggucgguuaaggucccuuucuguacccucgcgauucuccucugaggccuaugucucuguccgucucc

SEQ ID NO: 4141444 - RNA, 69 nt, Human
ggagcugggccagaccuuguggucuugcggaaugaacugcaagggaggaguugugagcuggccugcucc

SEQ ID NO: 4141445 - RNA, 55 nt, Human
ggagcugggguuggcaucuucccggauggugaaguuggccugcagccugggcucc

SEQ ID NO: 4141446 - RNA, 63 nt, Human
ggagcuguuauggcauaagcaugucuucugaccagacagcuguaaaaaucccaagacagcuuu

SEQ ID NO: 4141447 - RNA, 68 nt, Human
ggagcuucugcgccaccuugugcuugugcccgcugggcgccagcagguuggugcgcagcgcgugcucc

SEQ ID NO: 4141448 - RNA, 69 nt, Human
ggagcuugcuacuaugccuggcuaauuuuuuaaguuuuuaguauguugccuaggcuggucuugaacucc

SEQ ID NO: 4141449 - RNA, 62 nt, Human
ggagcuuugcagggaccaaaagaggcaguauaauauagugguuaagcggcccugggaagucc

SEQ ID NO: 4141450 - RNA, 66 nt, Human
ggagcuuuggcgcccaccuucaggcucuggccaugccagacaucaugaagggcagccucaggcucc

SEQ ID NO: 4141451 - RNA, 58 nt, Human
ggagcuuuggugccaaguauuugguggaccucaccggaucacucuaaucaaagucucu

SEQ ID NO: 4141452 - RNA, 71 nt, Human
ggaggaaauuggaguagauauuguacaauugacaacaucacagcuguaaaauaauucuccauguuuucuuc

SEQ ID NO: 4141453 - RNA, 73 nt, Human
ggaggaagaacauuuggauuuguaaauuuaguguguuaaaaaaaucacuuaucacagauguuuggaaucuucc

SEQ ID NO: 4141454 - RNA, 94 nt, Human
ggaacuuuggugugccuauagccacuucuaaaauccgggcauuccuuccaaauccuguucacgguguguuguuaggacacaaauccagauuucc

SEQ ID NO: 4141455 - RNA, 70 nt, Human
ggaagaacagcaggaaggccagguaagggugggaucugccucugccugacucuccuugucugaaucuucc

SEQ ID NO: 4141456 - RNA, 69 nt, Human
ggaagaacuagacagagugaagacaagugggcuccccagcuccaucuccacgucacucugcuggcuucc

SEQ ID NO: 4141457 - RNA, 101 nt, Human
ggaagaaugaaauaagugguaucuuggucgauuagcuccaaaauccauaaaaggugagggcaaauuagaaucaaauuuuaaagaauuuauuucauuuuucc

SEQ ID NO: 4141458 - RNA, 79 nt, Human
ggaagaccugaugaccuugcuacuguucuuugcuagaguugguuugauuuuggcaaccuuggccagguacucagaaucc

SEQ ID NO: 4141459 - RNA, 80 nt, Human
ggaagacggagacuucgugguucagaugucuugagucucaggggcucaggggacagccagcuggagguuugugcucauuc

SEQ ID NO: 4141460 - RNA, 100 nt, Human
ggaagagaaguuaauucauuucccaaaguuagcauucucucuugcuuaaccuaagucaguagaaaagugugacauuggauugguaugaaauuuaucuucc

SEQ ID NO: 4141461 - RNA, 65 nt, Human
ggaagagagagugguugguguaugggguauuuaaccccagugcaccauuucccucuguuccuucc

SEQ ID NO: 4141462 - RNA, 64 nt, Human
ggaagagagguucagcccuaagauagauaugguaaauuggcuuggcuuguucaaucucuauucu

SEQ ID NO: 4141463 - RNA, 56 nt, Human
ggaagagauucuuuacauucauuuuacaguuaaugaagaguaagaggaccuuuucu

SEQ ID NO: 4141464 - RNA, 60 nt, Human
ggaagaggcagcgggugcaguauaugcuaaugaccauuagacuuuaucccuguuuuucuc

SEQ ID NO: 4141465 - RNA, 73 nt, Human
ggaagaggcucucauugagggcugagguccugggauacagaauugagugagaccugggugggaccccucuucc

SEQ ID NO: 4141466 - RNA, 58 nt, Human
ggaagaggguauugcaaggacuaggggggccauuuagaguccaggccugcccacuucc

SEQ ID NO: 4141467 - RNA, 89 nt, Human
ggaagaguaauucauagcccuccuuuguucaugcugccuuugagguauccauuagacauccaaggagaggcauggaguuacaagagucu

SEQ ID NO: 4141468 - RNA, 57 nt, Human
ggaagauacaucauuuauaccuucagaauuguguuugaggguggagagaguaucccc

SEQ ID NO: 4141469 - RNA, 102 nt, Human
ggaagaugacgugcuggagcuuuucuagagccgcagcccuauguuuuaguaagaaagaaaacauuacagauggaucuagcaaaauauuucacaauuuccucc

SEQ ID NO: 4141470 - RNA, 87 nt, Human
ggaagaugcugucaucuuaucauuguugcuguugacuugaauccaagguuauuguggacaguagauggcucagagacaggcauuucc

SEQ ID NO: 4141471 - RNA, 129 nt, Human
ggaagaugucuuaaacaaaggucaguggagcuaaaucgaaggccagugccuuuccagggcuccaggaaauuccaagcucaauuuaaggcuuggcuugagaaagcucacugagaaaaugugaauaucucc

SEQ ID NO: 4141472 - RNA, 55 nt, Human
ggaagauuuuccauuccucuuuccaaaggauaggaggguugaggaggauacuucu

SEQ ID NO: 4141473 - RNA, 60 nt, Human
ggaagcaagggugcugcuaucaggaagccugucuggucuggucauagcauccuugacucc

SEQ ID NO: 4141474 - RNA, 58 nt, Human
ggaagcaaguggccugauucagauaaucacuuucucugggagagucuaacuuguuucu

SEQ ID NO: 4141475 - RNA, 56 nt, Human
ggaagccaagguggccucuauuacaguuuggaauauuuugggaggccuugguuucc

SEQ ID NO: 4141476 - RNA, 96 nt, Human
ggaagccacuggcucuagggugcaggccccaggacacuaggccacccacuacagguccuggauucugcccugaaggcacccgguggcccaccuucc

SEQ ID NO: 4141477 - RNA, 76 nt, Human
ggaagcccaguuuguucucccgauucagucccaagcaucccaaaggacuucaacuucuggggagcaaagggccucc

SEQ ID NO: 4141478 - RNA, 57 nt, Human
ggaagccuagccuugcuguuguccaggcccuggagacacccacauugcugggugccc

SEQ ID NO: 4141479 - RNA, 85 nt, Human
ggaagccuuuccagguccuuugcaacugggugcccagcacugccuguggcacagggggcugaggacuaguguggaauuagcaucc

SEQ ID NO: 4141480 - RNA, 70 nt, Human
ggaagcggaaggcuugguuuuuucaacaccuucaagcguugguguuuuugaggagcugagcuugggcucc

SEQ ID NO: 4141481 - RNA, 74 nt, Human
ggaagcuggacaggcuuugaguuccccucuacccucccuacccaaagauggauacucauuccugcuguguuucc

SEQ ID NO: 4141482 - RNA, 57 nt, Human
ggaagcugguaauuguugggacccaggcugaguccuggagugaagcgacgaguuucc

SEQ ID NO: 4141483 - RNA, 70 nt, Human
ggaaggacccuggagacccacugggagaguacugaaauuuuccaggugagagaggcccagggucugagcc

SEQ ID NO: 4141484 - RNA, 96 nt, Human
ggaaggagaauugcuugaacccagcaggaggagguugcagugagccaagacugcgccacugcacuccagccugggugagagagcaagacucugucu

SEQ ID NO: 4141485 - RNA, 58 nt, Human
ggaaggagagagacaucgucccugguuuuaaugauaggcagugucucuuauccugucc

SEQ ID NO: 4141486 - RNA, 72 nt, Human
ggaaggagagggcgcccgagcucugcucccgggcuugcgccuggccuggaguggacuuggccccucacuucu

SEQ ID NO: 4141487 - RNA, 83 nt, Human
ggaaggagaugggagucucgggcagagcucugaggacagugguguugcucagggagcuuccugguggaaguccuucuccuucc

SEQ ID NO: 4141488 - RNA, 128 nt, Human
ggaaggagauuuccuuugcucucagaauaaguaccuggugagaucuuugcuugaaggauagagugaaagcauucaaaucuuuaauugaggaaucaugaaccauuacguucugggacuaggaacaagcc

SEQ ID NO: 4141489 - RNA, 59 nt, Human
ggaaggaucuggcugaaauccaagcucugggggaaguacagggaguggcagaucuuucu

SEQ ID NO: 4141490 - RNA, 63 nt, Human
ggaaggauggaugucaguacagagaggaaacacccuguuccucaguggggcauucauuauucu

SEQ ID NO: 4141491 - RNA, 64 nt, Human
ggaaggcaagugcuccuugggucuguuuggugucgucccugggccuggaauauacuuggcuuuc

SEQ ID NO: 4141492 - RNA, 59 nt, Human
ggaaggcagaguaacuauuucuaaaacucauuccaggaaacagguagcccuagccuucu

SEQ ID NO: 4141493 - RNA, 55 nt, Human
ggaaggcagugaaggggcugaucaagacuggcaagacuccaaaacacugucuucu

SEQ ID NO: 4141494 - RNA, 69 nt, Human
ggaaggcaguuaccgcaauggaggagcccguucucuggaguaucucuaaaucugguucacuugcugucc

SEQ ID NO: 4141495 - RNA, 69 nt, Human
ggaaggccuugccgaaggaugccacccaaccagcaucuaacggacauggcauuuuuggcaaugccuucu

SEQ ID NO: 4141496 - RNA, 59 nt, Human
ggaaggcuccacccaaggcgaggaagggaguugagggcucuccaggggaagagccuucc

SEQ ID NO: 4141497 - RNA, 58 nt, Human
ggaaggcuccauacacaaagcaaaagggcuacacuuugauuucugaauggaaccuuuc

SEQ ID NO: 4141498 - RNA, 95 nt, Human
ggaaggcuuccccacggacgaggggcaagccccucgacgucagggugucgucuauguagaggggaaucugccuccucucaaaggggaauucuuuc

SEQ ID NO: 4141499 - RNA, 123 nt, Human
ggaagggagacuccggaaaggaaaagcagaugacauuuuaucaaaucaguauugguauagaaugacauagauguuauaaugcauugagcuagaauggaaaauuuuauccuggagaacccuucu

SEQ ID NO: 4141500 - RNA, 70 nt, Human
ggaagggaggacucggagggugacagggagcagguguaccacccaccccacacccuacggccucaccucc

SEQ ID NO: 4141501 - RNA, 58 nt, Human
ggaagggaguaguuggaaugcauauaaguaagcaggcauuuacaaaacagucccuucc

SEQ ID NO: 4141502 - RNA, 79 nt, Human
ggaagggauguucugugguggucaggaauucuggacaacaccuucccagauucaggacuggccacagccccucuuuucu

SEQ ID NO: 4141503 - RNA, 70 nt, Human
ggaagggcugcagaagcagaugugaucugagccaaccugguuuuccuccucagucugccuucucccuucc

SEQ ID NO: 4141504 - RNA, 74 nt, Human
ggaagggcuugagacccgggagccagacugaagccaggguuggguucaagggggucucacugagagccgcuucc

SEQ ID NO: 4141505 - RNA, 55 nt, Human
ggaaggggccuugagcaaacugaguuugugaucauguuuaaucggcugccuuucc

SEQ ID NO: 4141506 - RNA, 78 nt, Human
ggaaggugaaauugcuaggaacagguugcacccccaagaggcagaggaugguugguaacucccugugcagugccuucc

SEQ ID NO: 4141507 - RNA, 56 nt, Human
ggaaggugcucccuggacagagguucuucucacccucagccuggccuggcccuucc

SEQ ID NO: 4141508 - RNA, 79 nt, Human
ggaaggugugagggagggagagggaaugucagcucuagaugugagaagacagacuucauauccuuccucugcgacuucc

SEQ ID NO: 4141509 - RNA, 64 nt, Human
ggaagguuuuccuagggaagcugacaagccagaucuuccucccagccucccacggauuccuucc

SEQ ID NO: 4141510 - RNA, 60 nt, Human
ggaagguuuuucuccugguggguugggcuuucuccaagcggaaaaugagaaaggcauucc

SEQ ID NO: 4141511 - RNA, 93 nt, Human
ggaaguaaggcuggaaaaaugugcuagagccagagugccuaagaccucaggugagaucagagaguuuggauuuuaggacaucuagugacuucc

SEQ ID NO: 4141512 - RNA, 56 nt, Human
ggaagucucacagacagaucagacucaacaggucugaaaugaacucuugaacuucu

SEQ ID NO: 4141513 - RNA, 59 nt, Human
ggaagugacaccaacucuuguuaauuaacccuuuugacauaaacagaaggugugcuucc

SEQ ID NO: 4141514 - RNA, 81 nt, Human
ggaagugcagauggcggcugggcucguucccacacgcgugcaugcaugugugcaggagggcgcggcugucaguucacuucc

SEQ ID NO: 4141515 - RNA, 99 nt, Human
ggaagugcccccguuguacccccuacacaccccucuuggcauugagugccaguccucugccaggcucuguguuacaaguuggggagggcggcaaagucc

SEQ ID NO: 4141516 - RNA, 118 nt, Human
ggaagugcucagcaaauaugucuagggugucaggagguagaagccuuucuuggcuguaagaagauggccaggagggugguuacucaaucucuguuagccauggugcacucagcagucc

SEQ ID NO: 4141517 - RNA, 68 nt, Human
ggaauaucaugcugacacaguuuaucuauguugaaaaaagauaggaauuugggguuacaugauguuuu

SEQ ID NO: 4141518 - RNA, 99 nt, Human
ggaauauguauaagguucuuucucucccaugaagcuucuauucagagggaggaagacuaaaaaggagacaaauaagcuaauacaucaaaaaauaauucc

SEQ ID NO: 4141519 - RNA, 68 nt, Human
ggaaucaagaagguucuauugagcccuggaguauuuccacaggcuuugccuggaauuuccuugguuuu

SEQ ID NO: 4141520 - RNA, 81 nt, Human
ggaaucaagccuaaggcaucaaaaacaguaauaaagugaauuuguagccauauugucuuuggugcuuccaggacaaagucu

SEQ ID NO: 4141521 - RNA, 77 nt, Human
ggaaucagaaagaucuugaugagaaauaaauauacguagaagcacuugcguuuucacuccuggaucaucugugcucc

SEQ ID NO: 4141522 - RNA, 63 nt, Human
ggaaucaucaucgguccaagauuguuagugaucugagaaauuucaugugcugaggaugaugcc

SEQ ID NO: 4141523 - RNA, 96 nt, Human
ggaaucaugguucugcauaucagaagaggaaaaugaagcacuuaagcuuagcucugggcugcuucagccuucgccgugcuaugcgagccccucucc

SEQ ID NO: 4141524 - RNA, 93 nt, Human
ggaauccccuuuguagguuucauaguuuauacugauauuucugaugucgucucagagaauuagucacaauuauaggaacucagaaggcauucc

SEQ ID NO: 4141525 - RNA, 62 nt, Human
ggaauccugugagggcugagaguuggagcucugccucugaaguggccuuuaaauaguauucc

SEQ ID NO: 4141526 - RNA, 66 nt, Human
ggaauccuuucauuuuuucucaucugugaagacaaaucuuccaguguuucuggcaaaugaaagucc

SEQ ID NO: 4141527 - RNA, 88 nt, Human
ggaaucuuacucugucacccaggcuggaguguaguggcacgauuucggcucacugcaaccucagccuccuggguucaagugauugucc

SEQ ID NO: 4141528 - RNA, 72 nt, Human
ggaaucuuucagagcuccaucagggagucaggaccuuccuuuucccugauguuuucucugccuuuggauucc

SEQ ID NO: 4141529 - RNA, 80 nt, Human
ggaaugaacaguggagacaagagaguuaaauaggguuugacucauuaaagucuccguaugcuggguuucaauuuuauucu

SEQ ID NO: 4141530 - RNA, 107 nt, Human
ggaaugaagaugaaauaagcucccgagaugagguaggggcaguguucuuaucuaagccuuagauacagaacaagccucaccuccugcuccagccuccccuucucucc

SEQ ID NO: 4141531 - RNA, 85 nt, Human
ggaaugaagggcuuggaagggauauuggcauaugaugcucuaaucguguucguacgucagcgucuccucucagcccuuaauuucc

SEQ ID NO: 4141532 - RNA, 65 nt, Human
ggaaugaauuuccagcugggucccuugucauaggagggcucgugguaccuucugggaaacauucc

SEQ ID NO: 4141533 - RNA, 73 nt, Human
ggaaugacuggcucugaaacuccugcaccuucuucagcuugaugcacagaggcaaguucagagcuaggaagcc

SEQ ID NO: 4141534 - RNA, 78 nt, Human
ggaaugagucaaugaaugaaugagaguaggucaggggagcuacccugaacaucucugcuuuauuuaggcuuugucucc

SEQ ID NO: 4141535 - RNA, 91 nt, Human
ggaaugauuguaugaaacuuuaggaaggaauuuacaugcuuuuuguuuaaaaccugugaauucuacuuccuuugaagagcuaacucauucc

SEQ ID NO: 4141536 - RNA, 130 nt, Human
ggaaugcaaacacucaaaccauagcaaggauggagagagauucagggcagauugugaagcaccuuggaauguggucuccagugaaucuccuccugguuccaugugugaguccugggagcaguuuguuucc

SEQ ID NO: 4141537 - RNA, 83 nt, Human
ggaaugcaggggaggggcauaguucaccaucacaugaauucaaauguagugaagguuuauuugugccuuucuccaucuccucc

SEQ ID NO: 4141538 - RNA, 90 nt, Human
ggaaugcccgccuggaagguggcggcugccagguccugggcuuugagcgcgugacaugguuugccgucccugaccaagacgggcacggcc

SEQ ID NO: 4141539 - RNA, 67 nt, Human
ggaaugccuaguaucuaagcagaccugcuuagcuggucuaacaagcauuaggaacccaagguauccc

SEQ ID NO: 4141540 - RNA, 129 nt, Human
ggaaugcucucccugcccuuucccaagguggaaacugaggcuuggaggggucuggucucugguuaacagauacccagccaggcuuccaggcuuccaaccccagcugggcugggggaggggguggcugac

SEQ ID NO: 4141541 - RNA, 60 nt, Human
ggaaugcugcuuuaaaaagugcugauugcaaauuaaucaacauuauuuacaagcaguucc

SEQ ID NO: 4141542 - RNA, 65 nt, Human
ggaauggacgucagcacugagggucauaaggccccugcucuauggcuuccaggcuggccagggcc

SEQ ID NO: 4141543 - RNA, 68 nt, Human
ggaauggaugaguccacguuuagggcagcuucagguguaggcugcugugcauggagggccguucaucu

SEQ ID NO: 4141544 - RNA, 86 nt, Human
ggaauggcugaugggaaguguggccucaacgggaugcaaugcugaauucagagcauagcagcuggggcuauucaucaguuaugccc

SEQ ID NO: 4141545 - RNA, 87 nt, Human
ggaaugguggaauuccaaacacuugcgacuagccaguagagagguuguucaagccugggcugauuuagucacguuuuuccccaaucc

SEQ ID NO: 4141546 - RNA, 68 nt, Human
ggaaugguggcucacgccuauaaucccagcacuuugggaggccaaggugggcggaucacuugaggucc

SEQ ID NO: 4141547 - RNA, 73 nt, Human
ggaaugguuauacucauuugacaacguuguugugaggaucugauggguuucucugcaacaugugucaaauucc

SEQ ID NO: 4141548 - RNA, 61 nt, Human
ggaauguaacgugaccaaguuccuacacgauaagaagugggaacgaugguauuuaaauucc

SEQ ID NO: 4141549 - RNA, 56 nt, Human
ggaauguagaaucucuggucucagcuuagagcuaccgaaaucagaaucugcauuuu

SEQ ID NO: 4141550 - RNA, 63 nt, Human
ggaauguaucggagcuuggggugggaccucagggcccacaucuaagccuucaugauaugcucc

SEQ ID NO: 4141551 - RNA, 62 nt, Human
ggaaugugcugacacgcgagagugguacuggauagccaguggaaaugcguggcauacguucc

SEQ ID NO: 4141552 - RNA, 56 nt, Human
ggaauuacagaguuguuaagucagcaaggugcugagaaaacaguuuguaauaaucc

SEQ ID NO: 4141553 - RNA, 84 nt, Human
ggaauuacuguuuuagacucaugcuucuuuuaacaagaaaacacuccaucaagaaggagcugagucagcccgacagcugaaucc

SEQ ID NO: 4141554 - RNA, 73 nt, Human
ggaauuauugcuaucuucauggaaauacagggaucauaggucgcuuguacugaaaugaaggugcuucuauuuc

SEQ ID NO: 4141555 - RNA, 60 nt, Human
ggaauucaagcuuuauguguuuuaaggaccucuuauuaucuuagcauagacuugaguccc

SEQ ID NO: 4141556 - RNA, 79 nt, Human
ggaauuccugaauuccaugauaguugucaauuuaaggcucugauuacuguuacauugcaaauucauggaucugaauucu

SEQ ID NO: 4141557 - RNA, 73 nt, Human
ggaauucucacauuuuaguaccaugauuuagaaucaggcuaaauuugucaagugucugaaagugagguuuuuc

SEQ ID NO: 4141558 - RNA, 77 nt, Human
ggaauucuuggauucauacagugauuucaugguguuauguguugugaaacauugcacuguaugaaucuggaauaucu

SEQ ID NO: 4141559 - RNA, 88 nt, Human
ggaauuguagaggucaggaagugcugaggcugcuucucugaaauggggcugaaagcagggcaggcacuccaagacucauacacauucu

SEQ ID NO: 4141560 - RNA, 99 nt, Human
ggaauuuguauuuuauccugaaguugacaaacuuugcaaaacuuacaguucuugaagacugaggucaugcauaguuucuacucccagaaaaugaauucc

SEQ ID NO: 4141561 - RNA, 85 nt, Human
ggaauuugucagggaugagagauggcacagauaauuuuuccuugaauagaaagaacaauucugcauuucuuauuccuuugauuuc

SEQ ID NO: 4141562 - RNA, 105 nt, Human
ggaauuuuaagaagacauugccucuguuucagauauauuuguacuuagcucuaaggcaacaaauugaggauagugaauuuaaguggggguaguagucuuaauucc

SEQ ID NO: 4141563 - RNA, 74 nt, Human
ggaauuuuugagaugggucuugcucuugucacccaggcuggagugcaguggcacgaucucagcucacugaaacc

SEQ ID NO: 4141564 - RNA, 79 nt, Human
ggacaaagcacaacaggagaaggcaaugcagcaucagaaaggcaguaucuguuggcuccuaguuguaccccacuugucc

SEQ ID NO: 4141565 - RNA, 66 nt, Human
ggacaaagcacaggacguagagcuuggaggccaagugccugccaugccuuuaccuggcuguggucu

SEQ ID NO: 4141566 - RNA, 79 nt, Human
ggacaaaggucaaucauggauccuggguaccagucaaaagaugagggaaggguacagaggaggggauuuuaauaugucu

SEQ ID NO: 4141567 - RNA, 57 nt, Human
ggacaaagugagaugggagucagaggagcaauguccucagcaaacacuucacucucc

SEQ ID NO: 4141568 - RNA, 65 nt, Human
ggacaagaaccacuagccacaguucaucacugagggcaccagacacugagguuagaugccuugcc

SEQ ID NO: 4141569 - RNA, 86 nt, Human
ggacaaggcagaaaggcaaugucauggcucuugcccucacacucuagggccuagacuggugugacaauguccaugcuuacaugucc

SEQ ID NO: 4141570 - RNA, 89 nt, Human
ggacaaguuucccgcccucccagaguuuguguucuaguggaagacacagagaauaaacaaaggacaaggaggugcaggagaugcugucu

SEQ ID NO: 4141571 - RNA, 130 nt, Human
ggacacagacauaaggggcggaguggcaaagggcuggugagccuggccuccugccucagccugcaggggcugcaggccuggccggccacuuccuggcugccucaccucgccagauccugugucucaguuc

SEQ ID NO: 4141572 - RNA, 72 nt, Human
ggacacagcccugcccugccauguggcagcugauuggagugguguugcuaugaaacagggagggcugcguuu

SEQ ID NO: 4141573 - RNA, 61 nt, Human
ggacacagggcucacucucucuccugcucccugggaggcggagaccagagcccugcuugcc

SEQ ID NO: 4141574 - RNA, 59 nt, Human
ggacacauaguugaugagcguguacgugucgcccacgagcaugaugacggcuguggccc

SEQ ID NO: 4141575 - RNA, 76 nt, Human
ggacagaagauggagcagaguagagaugccuuuaaauaacucagagggaagggcucuuuucugagcuucacugugc

SEQ ID NO: 4141576 - RNA, 69 nt, Human
ggaaccagcaggcagucaggggaaggccacuccuaggggccucuucucuguggccugguggugauuucc

SEQ ID NO: 4141577 - RNA, 79 nt, Human
ggaaccaggagccagcuagagagcucgagagagucugauugccugaggcauccucugagagcucuagauauccauuucu

SEQ ID NO: 4141578 - RNA, 80 nt, Human
ggaaccagguguuuucugcagacagagaggcuucauaagcacccuggggccagcucagaugcaggaaggacacuggcucc

SEQ ID NO: 4141579 - RNA, 82 nt, Human
ggaaccagguugaaauccugccauugccuugugcuugcuuuaugaucacagaagcaaaagcaggaucuuuauucugaguuuu

SEQ ID NO: 4141580 - RNA, 63 nt, Human
ggaaccaugcaggucuggagcuuggggagaaacuccccuacccuagagccugacuugcuaucc

SEQ ID NO: 4141581 - RNA, 103 nt, Human
ggaacccaaacaagaguccugucucacccugucaguugcaggauagguaucucagccuucuauagucacucuuagggcagaggaagguaccugucuggguucc

SEQ ID NO: 4141582 - RNA, 79 nt, Human
ggaacccacucacuguccaacaggcuuuacuaccugagaacaugaagcaggagagaagggcaggggcgaggugggggcc

SEQ ID NO: 4141583 - RNA, 69 nt, Human
ggaacccauucuuuuagcucugcaaggaaagcuagacuugggcuuuccauuguuggagcauaaaguucc

SEQ ID NO: 4141584 - RNA, 61 nt, Human
ggaaccccguucugaggaaacaggggugcuggucagccucuggcuccauccuuggggaucc

SEQ ID NO: 4141585 - RNA, 75 nt, Human
ggaacccucaaagcagcacauucgcaagcccgacguauaauuuggagcuuccauguaugcucuugacaucuuucc

SEQ ID NO: 4141586 - RNA, 81 nt, Human
ggaacccugggucucuggccaccccagccccauaguacuggcucagcaaguggcugagggauggccggggcucaggagucc

SEQ ID NO: 4141587 - RNA, 91 nt, Human
ggaaccgggaaggcacgaagucucuaaagcauccagaagaccccuacaccagggucugguccgcuccuauucgccgcagccuuucuguucc

SEQ ID NO: 4141588 - RNA, 79 nt, Human
ggaaccuaagcaagaaagcuauuauuauccuuagagcaguuacaugcuuugaagucaggcuuucuacccuuuaaauucc

SEQ ID NO: 4141589 - RNA, 120 nt, Human
ggagacuagauuagccauugucugcucuggugccuguuuuuuccaaagucauucuaguacagaguuacugcagagaugaauauggccuugggcaagucauuuagcuuuucuguacucucc

SEQ ID NO: 4141590 - RNA, 58 nt, Human
ggagacuggcuucugcauucaaccuauaguaauggagaguuagcagauuucugucucc

SEQ ID NO: 4141591 - RNA, 78 nt, Human
ggagacugggggcaaggugcagccuuuggaauuagagacuccaugcgauccuuccacuggcugccgcccccuuucucc

SEQ ID NO: 4141592 - RNA, 70 nt, Human
ggagacugugcggcugcaagagagaugaguaacuugcuccuuuguuuccuuccagcuugugacagucucc

SEQ ID NO: 4141593 - RNA, 78 nt, Human
ggagacuuuuaacuggggagcucaauuaugucaggcuaacaaaaccuguucauacaagcagccucuguagaggucucc

SEQ ID NO: 4141594 - RNA, 79 nt, Human
ggagagaaaugcuucagauuugggguauuacugugggaacacucucuaaaucuaaucuccaaaugugguaucucuuucc

SEQ ID NO: 4141595 - RNA, 108 nt, Human
ggagagaaggccaucaggccauauacagccagcugaauguaccaugacucauacugaaugggaucaggcauucagugggcugacugaagccguguauccuaucacucc

SEQ ID NO: 4141596 - RNA, 61 nt, Human
ggagagaauuccauggacaugugcuaauguuuuuguuagucuccuccauacaauucucucu

SEQ ID NO: 4141597 - RNA, 56 nt, Human
ggagagagcuguccuggauuguucauggagcagaaacagucuccccagaucucucc

SEQ ID NO: 4141598 - RNA, 77 nt, Human
ggagagaggagauauuuguauucugucucucuaaagcaacaaaaaagagaagaaagaucaaauaguuuccagucucu

SEQ ID NO: 4141599 - RNA, 90 nt, Human
ggagagagggcugaaacuguccuugaaaaaauggauuucucagugugauguguauacagugucccuuuuucagacauggcaccuucgucc

SEQ ID NO: 4141600 - RNA, 81 nt, Human
ggagagcaagggugggggacgcaggggcgagggggauccccacucccacgcaccccacugucccucaaccaaaacgcuccc

SEQ ID NO: 4141601 - RNA, 72 nt, Human
ggagagccagggauggcagugcccagcaagagccaggacuagcauggaguuuauucaucccuagggcucacc

SEQ ID NO: 4141602 - RNA, 69 nt, Human
ggagagcucauugcauuggaauuguauuguaauuuuccaaauaauauuugaacagucacugaguuaucc

SEQ ID NO: 4141603 - RNA, 61 nt, Human
ggagagcuuggaaauaaucauggagauaaucuugauguucuuuauauauucccaggcugcc

SEQ ID NO: 4141604 - RNA, 55 nt, Human
ggagaggagcagcucccccugcuacuggaggguugggaggaagcugcuucucucu

SEQ ID NO: 4141605 - RNA, 111 nt, Human
ggagaggagggggcaugaaggugaggcugggagccccacagagucagggcgccuuagcuuucggccugggcaggcucccacguuuagagccuggcuuugucccaucucucc

SEQ ID NO: 4141606 - RNA, 69 nt, Human
ggagaggaggugagaggaaguauccugacugagugacaaagcagcuccuccuccuuucaccccuucucu

SEQ ID NO: 4141607 - RNA, 86 nt, Human
ggagaggaggugcuucaaggccaugucaagcucuucaaggccaugugauguaggagggcuggauuuggucuuagguaacaggcucc

SEQ ID NO: 4141608 - RNA, 57 nt, Human
ggagaggauuaaucaagguuuugaugccacacagaccuggauuccaauccuaccucc

SEQ ID NO: 4141609 - RNA, 60 nt, Human
ggagaggcgaugagucacagccaagcgaacuuucucugcuccugaacaaauugcuucucc

SEQ ID NO: 4141610 - RNA, 86 nt, Human
ggagagggagcagggaggaugagggagggcacgcuuugaggcccccagagucugugcuaauuuauccuuccucucaaauugccucc

SEQ ID NO: 4141611 - RNA, 64 nt, Human
ggagagggcaggcagggccacaggagggagcagggcuguccugauggccucuggcuccagcucc

SEQ ID NO: 4141612 - RNA, 94 nt, Human
ggagagggcugcuggauggccuuuggugagaagaguaagcugaaagugauacuucaaagaacgucuuccagagccuccaucccuagcccugucc

SEQ ID NO: 4141613 - RNA, 58 nt, Human
ggagagggcuggaaacuuccugggcccaucaggccccaagacaguucaagugcucucc

SEQ ID NO: 4141614 - RNA, 85 nt, Human
ggagaggggcggguguccugggcaggcagcugacgggcaucccugucuucucccaucggccgcagggaagcagccgcucuugucc

SEQ ID NO: 4141615 - RNA, 61 nt, Human
ggagaggguagggguccugcccaccugcagucaccccucagccaggccucuuacccucucu

SEQ ID NO: 4141616 - RNA, 94 nt, Human
ggagagggucuccugcucguggcucagcuccccaugguuccugaagcgcacacgcgcccagcgccggcggcggcacgagugguaggucuucucc

SEQ ID NO: 4141617 - RNA, 66 nt, Human
ggagaguaacaaagugggagaaugauugcaaagaguauguuaucaugaguuggcuuugucaucacc

SEQ ID NO: 4141618 - RNA, 69 nt, Human
ggagaguagaaaguaaaguacgaaugguugacugaguacacacaucuauuuuauuaucuacugaacucc

SEQ ID NO: 4141619 - RNA, 55 nt, Human
ggagaguccggauauguaauaugcauuugauaaauauuagguauuauugcuuucc

SEQ ID NO: 4141620 - RNA, 118 nt, Human
ggagaguccuuaaucaggacaaggaugacaaccuucuaagcacaguguuuaccccaugcacacaugcacagaugggcuuguucauacauucauacacuguccuggucggguccucucc

SEQ ID NO: 4141621 - RNA, 67 nt, Human
ggagagucugcuggccacagugauggcacauucauggaaagcaugcaacugagccagugacuucucc

SEQ ID NO: 4141622 - RNA, 56 nt, Human
ggagagucuuucuccugcacugcccuucauccuguaggagcuggagaaaacuuucc

SEQ ID NO: 4141623 - RNA, 60 nt, Human
ggagaguguuuuugugaagauuuagagcaugucucuggaugaacacauguacacauuucu

SEQ ID NO: 4141624 - RNA, 109 nt, Human
ggagaguuauuauuugugcagauggugcagggacaggcucuggggaugggugugugugcaggucucccaucucuguccuugugcuuccauguggaguuucuaccucuuc

SEQ ID NO: 4141625 - RNA, 91 nt, Human
ggagaguucugaugaauacaauguucuacauauacauaacuguauccauuuguguuuugcagagcauugaaaucauauagcagcaucaucc

SEQ ID NO: 4141626 - RNA, 85 nt, Human
ggagauaaggaggugccucaagggcagggaguuugugucuagagggcugcacggcacagaccccagcccagucaccucaacugcc

SEQ ID NO: 4141627 - RNA, 62 nt, Human
ggagauaauccagggagggacucagcugagaacaguucccugccuucucuggaauugccucc

SEQ ID NO: 4141628 - RNA, 71 nt, Human
ggagauaggcagugagcagggugucaugagcuuguaauaugucagcuuggcuaggcugaacugccuuuucc

SEQ ID NO: 4141629 - RNA, 65 nt, Human
ggagauccacuguguuuguguugaggauucauuacacaugacucaguagaaaauacauggacuuu

SEQ ID NO: 4141630 - RNA, 56 nt, Human
ggagaucccuggggcaguggcucggaggcacgaccucuccuccucacagggacucc

SEQ ID NO: 4141631 - RNA, 71 nt, Human
ggagaugaaacaagagacaugaauacucgaaggugcagaucuuugaggugucaucucuguggcuagucucc

SEQ ID NO: 4141632 - RNA, 58 nt, Human
ggagaugaccaagccuuggucugcucucuagcagcuuccacagacuuggcucguggcc

SEQ ID NO: 4141633 - RNA, 56 nt, Human
ggagaugcacgagcagguggagcagcugaagcagagcauccaccgcgugcaccucu

SEQ ID NO: 4141634 - RNA, 77 nt, Human
ggagaugcagcggcccuggggaagagcaggcauggccacgggcugggcagcuccuuuaggcugcaaagggcaauucc

SEQ ID NO: 4141635 - RNA, 79 nt, Human
ggagaugcuguagagagcacaagcuucagagucacucaucccaaggugcaaaggagcuggguguuuauuugccaacucc

SEQ ID NO: 4141636 - RNA, 56 nt, Human
ggagauggcaagaaguuauuagguucugguuugaagcuugaacugauucuauuucc

SEQ ID NO: 4141637 - RNA, 72 nt, Human
ggagauggcucaggccagaccacgacuccgacaugagaauguggggguccugagaaggccuuggcauccucc

SEQ ID NO: 4141638 - RNA, 69 nt, Human
ggagauggggucuggcauaugguagauaaucaauguugguugacuaaauaaaagccaaacuucaucucc

SEQ ID NO: 4141639 - RNA, 55 nt, Human
ggagauggugugcccgcaggaagcccuuccaccuuccuaggcaugcugagucucc

SEQ ID NO: 4141640 - RNA, 86 nt, Human
ggagaugucauagauuuuugucuuaaguagauuacagccugagagcccuccaaguugucucuggaacuugagcuauaaacaucucc

SEQ ID NO: 4141641 - RNA, 72 nt, Human
ggagauguggccauuauccaguuaauuugaucauuguaacaaccagaacugauaauggacacauaaaaagcc

SEQ ID NO: 4141642 - RNA, 57 nt, Human
ggagauuggaagcuaaaugaagacagagucaaggaugucuuuguuaauuuuaucucc

SEQ ID NO: 4141643 - RNA, 90 nt, Human
ggagauuucugaacccuucuacuacuuauuuacuuauaugugcugauuguggguaaaaugaguuaggagaaaacuuggcuucagaucucu

SEQ ID NO: 4141644 - RNA, 56 nt, Human
ggagcaaagaugccucuugcuauauuuuagcaaagagacugguggcauuuugcccc

SEQ ID NO: 4141645 - RNA, 93 nt, Human
ggagcaacucugugcaucggaaucacccgggaucccagcaggucugggagggacugagauucugcucccaggugaugcugauacugcugcucc

SEQ ID NO: 4141646 - RNA, 60 nt, Human
ggagcaagagguggugaaaaauguuuauuuacucugcauuaguggcuaaccuccuguucc

SEQ ID NO: 4141647 - RNA, 94 nt, Human
ggagcaagccggccugugagagggcgaguguagacuccgggacagccugcccgguucaucucacagcucugcugcaugcugguucauuagcucc

SEQ ID NO: 4141648 - RNA, 62 nt, Human
ggagcaaggcugucagcacagccauggccaccagauggcaggcucagguuaccagucccucc

SEQ ID NO: 4141649 - RNA, 82 nt, Human
ggagcaagggcagcccuucugggagggcaugcugcuguucauaauaugagagugggguccugucaaggguuguuguuuuucc

SEQ ID NO: 4141650 - RNA, 74 nt, Human
ggagcacagcagcugcucaguugcuccuugaaggaccccacccugagagccugaaggcagcugcugucagcccc

SEQ ID NO: 4141651 - RNA, 83 nt, Human
ggagcaccaacauaauagcauuucuaauuuguaccauaauugcaugcagagaugaaauguuguugucuaucauaugcugcuuc

SEQ ID NO: 4141652 - RNA, 81 nt, Human
ggagcacuguaagaaguuggaaaugauugagagguuauaaaauugcccccuguucuucuuccaauauucuguugauguucc

SEQ ID NO: 4141653 - RNA, 80 nt, Human
ggagcagaacuacucuucuccauucauuuuacucucacaagagcuucaagagguaggauggguggagaugaucuaccucc

SEQ ID NO: 4141654 - RNA, 94 nt, Human
ggagcagaagaaagugcaaagggcuuuauaucaguguguuuacaguaugacacaauugacuguugucccuuauaucugcauuuccuuuuacuuu

SEQ ID NO: 4141655 - RNA, 65 nt, Human
ggagcagcaggccagguugcagguugaggaagucagaaguuaacuugagcugaguuugcagcucu

SEQ ID NO: 4141656 - RNA, 87 nt, Human
ggagcagcccggcuucugggacacccaaggaaagagcagggagggacccugacuccugcaaggguguucuaaggagcucuucucuuc

SEQ ID NO: 4141657 - RNA, 105 nt, Human
ggagcaggaaaccacugcugcaucucuuugcucuuuccuuggaaagaaacauuauuucacagaaagacaacagauaaaugcugaaugguugcuuuccccugcucu

SEQ ID NO: 4141658 - RNA, 73 nt, Human
gcuucauuauuuauguauguggauguguuuacacagugauuuucagaagcacaccuauuacauaaaugggggc

SEQ ID NO: 4141659 - RNA, 55 nt, Human
gcuuccaaagucauguugcugauauugaaaugucaauuccuugaccuuuggaugc

SEQ ID NO: 4141660 - RNA, 70 nt, Human
gcuuccacuuaguggauccuuguguaauauuuacuaauuaaaaauaaagaauauccaaaaagauggaagu

SEQ ID NO: 4141661 - RNA, 63 nt, Human
gcuuccagaccccagucccucaggaaaacaucauuaauccaugugggauucauuuggaucagc

SEQ ID NO: 4141662 - RNA, 95 nt, Human
gcuuccaguugagcaccugucacagcagcgcccgaccacaagagguuuacacuggcacuggccuccaagucggcugcagcuggauccgacugagc

SEQ ID NO: 4141663 - RNA, 64 nt, Human
gcuuccauacuaauaaaacagaaugcccacuuccugcauuuuauauggcacauugguuggaagu

SEQ ID NO: 4141664 - RNA, 100 nt, Human
ggagaagcuucacuucccggaaagcaugggaggccuggaggaggucuuuggcagguccccucucgggaaauccccugugaguugggagugggaggaauuc

SEQ ID NO: 4141665 - RNA, 57 nt, Human
ggagaaggaagaaagcuacuauggccaaggccauccucaguacucacucccauuucc

SEQ ID NO: 4141666 - RNA, 64 nt, Human
ggagaaggcgaagucauucuuugucagcuaacucaugggaagggaaaacagacuuucuuucucc

SEQ ID NO: 4141667 - RNA, 60 nt, Human
ggagaaggugcuggucacugugcguaagagugcuaacaacauucugucuguuccuuuucc

SEQ ID NO: 4141668 - RNA, 86 nt, Human
ggagaaucacucaaucccaggcggcacagguugcagugagccgagacugcagcauugcacuccagccugggcgacagcgagacucc

SEQ ID NO: 4141669 - RNA, 86 nt, Human
ggagaaucacuugaacccaagaggcggagguuguagugagcugagaucaugccacugcacuccagccuaggcaagagugagacucc

SEQ ID NO: 4141670 - RNA, 88 nt, Human
ggagaaucacuugaacccaggaggcagagguugcagugagcccagaucacaucacuguacuccagccugggugacagagugagauucc

SEQ ID NO: 4141671 - RNA, 87 nt, Human
ggagaaucacuugaacccaggagguggagguugcggugagccgagaucacaucacugcacuucacccugggugacagaggagacucc

SEQ ID NO: 4141672 - RNA, 88 nt, Human
ggagaaucacuugaaccugggaggcagagguugcagugagccgagaucgcaccauugcacucuagccugggugacagagugagacucc

SEQ ID NO: 4141673 - RNA, 88 nt, Human
ggagaaucgcucgaaccugagagguggauguuguagugagccgagauggcgccacugcacuucagccugggcgacagagcgagacucc

SEQ ID NO: 4141674 - RNA, 88 nt, Human
ggagaaucgcuugaacccaggaaguggagguugcaauaagccaagaucacaccacugcacuccagucugggugacagagugagacucc

SEQ ID NO: 4141675 - RNA, 87 nt, Human
ggagaaucgcuugaaccuggaggcagagguugcagugagcugagaucgcgccauuguacuccagccugggugacagggugagacucc

SEQ ID NO: 4141676 - RNA, 89 nt, Human
ggagaaucgcuugaaccugggaggcggagguugcagugaguugagaucacgccauugcacuccagcuagggcaagaaaagcgaaacucc

SEQ ID NO: 4141677 - RNA, 87 nt, Human
ggagaaucgcuugaaccugggaggcggagguuguagugagccaagauugcgccacugcacuccagccuagcaacagagagagacucc

SEQ ID NO: 4141678 - RNA, 89 nt, Human
ggagaaucucuugaacccgggagguggagguugcagugugccgagauggcgucacugcacuccagcuugggcaacaagagcaaaacucc

SEQ ID NO: 4141679 - RNA, 56 nt, Human
ggagaauggcaggcaguaucuaggaccucauuaaagggucuguccuuccauucuuc

SEQ ID NO: 4141680 - RNA, 87 nt, Human
ggagaauugcuugaacccaagaggcggagguugcagugagccgagauugcgccauugcacuccagccugggccacaggcaagauucc

SEQ ID NO: 4141681 - RNA, 89 nt, Human
ggagaauugcuugaacccaggaggcggaagguacagugagcugagaucacgccauugcacuccagcucugggcgacagagcaagacucc

SEQ ID NO: 4141682 - RNA, 88 nt, Human
ggagaauugcuugaacccuggaggcggagguugcagugagcugagaucgcgccauugcacuccagccuaggcaacagagcgagacucc

SEQ ID NO: 4141683 - RNA, 82 nt, Human
ggagaauugcuugagcccaggagagugcagugagucgagaucaugccacugcacuucagccugggugacagugugagacucu

SEQ ID NO: 4141684 - RNA, 67 nt, Human
ggagaauuuaggaaaggaacauugaaacguucuuuuauaacauuucaauguuuuuuccuugacaucu

SEQ ID NO: 4141685 - RNA, 63 nt, Human
ggagacaaaagagagcugaggagcuccagugcuucuggagggacuucugucuuuuuagucucu

SEQ ID NO: 4141686 - RNA, 67 nt, Human
ggagacaauguggacuuuauuuuagggaggacaauguugauuuuaaauuuagguccaaaauguuuuu

SEQ ID NO: 4141687 - RNA, 55 nt, Human
ggagacaugcagacugagauacuuuuaaagguuucaaaugaaucaguaugucucu

SEQ ID NO: 4141688 - RNA, 67 nt, Human
ggagacccagccuacaaagcucaccuuuaggguguuugaaaggcgagcgugauugucagggugggcc

SEQ ID NO: 4141689 - RNA, 68 nt, Human
ggagacggccguggcccgggcgcggcggccgccccucuggcugcucugccuggucgcgugcuggcucc

SEQ ID NO: 4141690 - RNA, 55 nt, Human
ggagacuacguugugaguagcaaugccuguaaaugguuacucacauuuagauucc

SEQ ID NO: 4141691 - RNA, 72 nt, Human
ggagacucaccccgcauucuaggccggagaagcgggcgggcuugggaugccggcaggaggcaaugacucucc

SEQ ID NO: 4141692 - RNA, 65 nt, Human
ggagacucggguucuagccuugugaacuuggaccacgaccuuggccucucugggacucggucucc

SEQ ID NO: 4141693 - RNA, 107 nt, Human
ggagacuucuuauggguauucuuauucacaauuaacuuuauacuuaaaugucuuaaggauagaugggugaggggugguugugacugcuggauaccauagaaaguucc

SEQ ID NO: 4141694 - RNA, 89 nt, Human
ggagacuugcuugaaucccuggggguggagguugcagugagcugagauggcaucacugcacuccagccugggcaacagagugagacucc

SEQ ID NO: 4141695 - RNA, 79 nt, Human
ggagacuuuguacucugcuuuagaauccaguagcucuaucagugugagcuguuuccauucuugaguagaaguuuucucc

SEQ ID NO: 4141696 - RNA, 63 nt, Human
ggagagaacagagcagacucucagcccuggaguuccuggggccaaggaggcucugugguuucc

SEQ ID NO: 4141697 - RNA, 82 nt, Human
ggagagaaggggagcacagacuuuggugaagagcugguuguucauggcaaaaacuaaguaguuuguuccucuuuuucuuucc

SEQ ID NO: 4141698 - RNA, 58 nt, Human
ggagagaaggguguagccugggcccuugugaaggaggcucaggcccugccuuugcucc

SEQ ID NO: 4141699 - RNA, 79 nt, Human
ggagagacaagagcauggugcuucagugaaggcguuucugugucugaauuaacugggguugccaugugucagucucuuc

SEQ ID NO: 4141700 - RNA, 66 nt, Human
ggagagaccuuuguuauucuaggagauugggagcguaacauucuaggcaggaacaaggguuugucc

SEQ ID NO: 4141701 - RNA, 67 nt, Human
ggagagagaggaacuagcagggauuuggaguuuauugauccaguggacugcugugauucccuccucc

SEQ ID NO: 4141702 - RNA, 70 nt, Human
ggagagaggacaugugccuggggcaccaggcccaggacagggcacugacugugcagcgcacccugucucc

SEQ ID NO: 4141703 - RNA, 100 nt, Human
ggagagaguguugguccccgauauccacauguggcugagucuugaagaucaaagucucugacuccuaugccccaugggccucagggaaacacuacugccc

SEQ ID NO: 4141704 - RNA, 58 nt, Human
ggagagcauugaggagagauucugaacuaguuguuuuauguuccucuuuaugcgaucc

SEQ ID NO: 4141705 - RNA, 58 nt, Human
ggagagcgugaaccuguccauagcuccccugggggaaguagggcucauuaugaucucc

SEQ ID NO: 4141706 - RNA, 91 nt, Human
ggagagcucugugaaguuggccaagggcaugcuuugagaaugauagauuuaacguuugcuuucuuuggccuggacguuucccagagucucc

SEQ ID NO: 4141707 - RNA, 66 nt, Human
ggagagcuguuuaucuucuucaaagcaauuuuuguugcuacguugugcaaguguagaugguuuucu

SEQ ID NO: 4141708 - RNA, 101 nt, Human
ggagaggaagcaggcaggugguauugacaagguggagucuuggaacuugguuuucuaucucauauguguucuagguaccauugcugcauaacaaccuuucc

SEQ ID NO: 4141709 - RNA, 69 nt, Human
ggagaggaaggcugugagcaggcagaaugcuggugucuggaccagcagucccacauggccguuugcucc

SEQ ID NO: 4141710 - RNA, 77 nt, Human
ggagaggaauuucccucccccagccuggcagggcucugaguagggcugagcugggaaggguagggcaacaccucucc

SEQ ID NO: 4141711 - RNA, 56 nt, Human
ggagaggacauggcucccacagaaaggcuggauauuuaaggagccuguuccucccc

SEQ ID NO: 4141712 - RNA, 65 nt, Human
ggagaggacuagaaaccucugcuucucaauacaucugugacaucagaggcuucaagucauucucc

SEQ ID NO: 4141713 - RNA, 65 nt, Human
ggagaggcagggaaggguaugggcaggaagcacuuggcuguuuguucccucucuuuccugacucc

SEQ ID NO: 4141714 - RNA, 66 nt, Human
ggagaggcucaggucucaggucuggcuacugaaacuggagguuuuuccugcugacuugggucuccu

SEQ ID NO: 4141715 - RNA, 118 nt, Human
ggagagggaauggggcgggcuccccuggccaagguucauucauagcagguuuuggaccccugcagaccagagggcugggaugugcugugugacugaggguaagucccucuaccucucu

SEQ ID NO: 4141716 - RNA, 69 nt, Human
ggagaggggauuuggacaucuccugggcccugagacccagcucucugggugugucuagauagaacuccc

SEQ ID NO: 4141717 - RNA, 56 nt, Human
ggauaggggcuggggagcccagaggucuugggcucagcaaugaugagccccugucu

SEQ ID NO: 4141718 - RNA, 75 nt, Human
ggauagguauacguuuagcuuuaugagacauugccagaccuuuuccaaagcaaauguaacauuuuuuaucugucc

SEQ ID NO: 4141719 - RNA, 81 nt, Human
ggauaucacuaguuugguuuacucuggggauaucugaaaaaucucuggaagacuuagaguagcaucaguuguaggucaucu

SEQ ID NO: 4141720 - RNA, 111 nt, Human
ggauaucucacaggauuuauguagaauuuuuaaggcagugaaacuauucuguacaauacgacaaugguggauacaugucauuauacauuugcgaaaauccauggaauaucc

SEQ ID NO: 4141721 - RNA, 85 nt, Human
ggauauguggugacagaugaagcuggggaccaggcccagccaguggaaccuggucaugccacucuaucugaucagcuaugauuuc

SEQ ID NO: 4141722 - RNA, 60 nt, Human
ggauauguugguaggaaagaaagcugggugacaacagcaacauuuuucaauuaacauccc

SEQ ID NO: 4141723 - RNA, 81 nt, Human
ggauauucaaagauuacugauaugcuuuuauucaaaagaaaaguguagaguaucacaugucccuaaucuuuaggauaguuc

SEQ ID NO: 4141724 - RNA, 62 nt, Human
ggauauuuauucucauaguuaugccucaagaaaagcuggcaagcuugaaucaauggauaucc

SEQ ID NO: 4141725 - RNA, 81 nt, Human
ggaucaaauggcaugcauauuuaaaaagcauuauuggcuugaccaaauuagcuuccaguaaguugcugccauuugcagucc

SEQ ID NO: 4141726 - RNA, 82 nt, Human
ggaucacaacggcagcccuugcgacacccuggcuggggaguuuuauuccugaggggguugcgcaggggcucccuuggacucc

SEQ ID NO: 4141727 - RNA, 91 nt, Human
ggaucaccacacaaauauucuggaggcaaagcagcaccuucuguuuuaacucgggccuccgguugauauuauguuagugcugggcugaucc

SEQ ID NO: 4141728 - RNA, 60 nt, Human
ggaucaccuguguaucucuguaugugcacacugcugcagggcacacgcacgggugugucu

SEQ ID NO: 4141729 - RNA, 75 nt, Human
ggaucagauuagucuuuugagaaguauaucuacagaauguuccugaguguauuaugcagcggaggucucaggucc

SEQ ID NO: 4141730 - RNA, 57 nt, Human
ggaucaggugggagcugcggaggccugggcacccccagcaucggcucccucugaccc

SEQ ID NO: 4141731 - RNA, 89 nt, Human
ggaucauauuugggucuaucaccuuucuggcaaugaggaaaguaaagcucaguggucagauuuauguggcuaggcucauugauguauuc

SEQ ID NO: 4141732 - RNA, 79 nt, Human
ggaucaugucaggcacagcugggcaauugcgguuccagaguaaagguccgucaaaguucucaguucaugucaaugauuu

SEQ ID NO: 4141733 - RNA, 97 nt, Human
ggaucauguuuagcugcaaugacugaauaugugauuaugacuuaaaacaacugcagcaaggaucagcaaggcaaucacugcagcuggacaagcaucc

SEQ ID NO: 4141734 - RNA, 56 nt, Human
ggauccacaggucauguaauguggaguucuucugggauccauuguccugaggaucc

SEQ ID NO: 4141735 - RNA, 66 nt, Human
ggaucccagcggcucccagggucugggaauggaguuacaguuuccuagggcagagccgcuggggcu

SEQ ID NO: 4141736 - RNA, 82 nt, Human
ggauccucggugcaggagaauagcugaugagcaugggcagagaccagugcacacacaggagucuccuccacccagagucucc

SEQ ID NO: 4141737 - RNA, 74 nt, Human
ggaucgggaguguagaaagcuuucugaaaguucucuucccuucuuagaacaccauucuauauuacccaugaucc

SEQ ID NO: 4141738 - RNA, 64 nt, Human
ggauugcaaaagccgaggcacuccagcuaggacacggcgucauuggagugcccuggugcguucc

SEQ ID NO: 4141739 - RNA, 107 nt, Human
ggauugcugagcgcgucuagagaaaguucacacauccacauggauuaauacuuugcaaauucauggauuccuaugugaacuuccuccucaggagcaucaagcaauuc

SEQ ID NO: 4141740 - RNA, 64 nt, Human
ggauuggauagucgaauuucagaagguagcauugccuagauucagaaaaagaccauugcaaucc

SEQ ID NO: 4141741 - RNA, 65 nt, Human
ggauuguggcaucaagauuuagauucauuccucuguuuguuggagucauugaagccaguauaucc

SEQ ID NO: 4141742 - RNA, 81 nt, Human
ggauuguuggagugacuuuaucugagcuaaguugccucacuuaaugugucuaaacaaucagauauagucauuuaaauaacc

SEQ ID NO: 4141743 - RNA, 64 nt, Human
ggauuuauuuuaaugcagccuggaaacacacaacuuuaaaucucugggcugcuuaaggagaucc

SEQ ID NO: 4141744 - RNA, 74 nt, Human
ggauuucgccagagccucuuaugaagaucgcaguucucggcagccugcgcuucucauccaggccuugggauucc

SEQ ID NO: 4141745 - RNA, 77 nt, Human
ggauuugucuucuuguguugccugucuuggucaucacuguucauccacuugcccaagcugagaucaagaagaccucc

SEQ ID NO: 4141746 - RNA, 77 nt, Human
ggauuuuagcaacuugccucaaaucauggaaguaaaaggugaagaacaccugaauuugaaugcagguagcugagucc

SEQ ID NO: 4141747 - RNA, 70 nt, Human
ggauuuuaguggcauguuguuaguguuucccauugaaguaaaauccuggcaaagacgcuagcuaagauuc

SEQ ID NO: 4141748 - RNA, 57 nt, Human
ggauuuucugauuugcauguaguaccugcacauauucauguaacauuagagaaaucc

SEQ ID NO: 4141749 - RNA, 80 nt, Human
ggauuuuuaagugguuuuaauguuguagauuuauagugaaaaaggcuaggaaucucaagcuguaaauaccucccaagucc

SEQ ID NO: 4141750 - RNA, 125 nt, Human
ggcaaaaauaggcagguuuuugauagcucucggggaaggagguacauucaaaacugcugcccuuucugaaauguucaagugucuuucucucuccaaguggcuucagaacacugaaaacugugacc

SEQ ID NO: 4141751 - RNA, 73 nt, Human
ggcaaacagacuugaccaucuucagacccacugcauucucaagcugaaguggucugcucauaguuugugugcc

SEQ ID NO: 4141752 - RNA, 56 nt, Human
ggcaaaccaguuucugcuuuuccuguucucguggcagcagggagcaucugguugcc

SEQ ID NO: 4141753 - RNA, 83 nt, Human
ggcaaacuccugggcaugggccaccccacugcccacgcugcccauggccaggcggggguccggggguccaagcucggagggcc

SEQ ID NO: 4141754 - RNA, 67 nt, Human
ggcaaagaauucacuugacauuugcauagcacuuuguauguguaacaucacagugauguuugaugcu

SEQ ID NO: 4141755 - RNA, 67 nt, Human
ggcaaagaauugaggguggccucuggauaacagccauugagggccagaaucccucagucuaauagcc

SEQ ID NO: 4141756 - RNA, 129 nt, Human
ggcaaagcacaggugagagagauugggguccagacccugcaggaugaguccccuugcccuugaugggccuggccuguggcaguggaggacccugugucugauccucacacccugcaccagugccacgcc

SEQ ID NO: 4141757 - RNA, 74 nt, Human
ggcaaauacaagccuuggaaauccauucugagucacaaaucucucucaagaagugggccaagguugcuguugcc

SEQ ID NO: 4141758 - RNA, 72 nt, Human
ggcaaauagauauagugaaagugauguguggguuucagacuuaggccucaagauucccugugugcuucugcc

SEQ ID NO: 4141759 - RNA, 64 nt, Human
ggcaaaucuggaagaacggggcaugcugaauuccuacucuguaacucaccuuucagguaaugcu

SEQ ID NO: 4141760 - RNA, 70 nt, Human
ggcaaaugaaucuagggagaggaagcaugaguuauuuaaugucaguuacuccuuuccuuagguuuuugcc

SEQ ID NO: 4141761 - RNA, 55 nt, Human
ggcaaauguacaaauauacuugucuucugagacaccaguguccuagucauuugcc

SEQ ID NO: 4141762 - RNA, 56 nt, Human
ggcaacaugaugucaaccaggauguagugaaccacacuaguuaaugucaugauguc

SEQ ID NO: 4141763 - RNA, 89 nt, Human
ggcaaccagagcugaugaaaguuacagauugggagcagagcuauuucuaguauuguuuggaggcuggaacagaucauaacucugcugcc

SEQ ID NO: 4141764 - RNA, 69 nt, Human
ggcaacgcuggggcuuuuugcuugagauacauagccaguuuucuccaggacugagcuccagccacagcc

SEQ ID NO: 4141765 - RNA, 129 nt, Human
ggcaacuauuuauuuaauuuggucaggcaaggcagucaaagcagacuucucuugcccaaaaauuuacaugaaaggacugaguugucuggguugacagccuagcuuggccaaguuaaacagcucauugcc

SEQ ID NO: 4141766 - RNA, 82 nt, Human
ggcaacugcuguucuacuuucugugucuuugaaauugacuaauuuagauaccucauguaaguggaaucagacaguauuugcc

SEQ ID NO: 4141767 - RNA, 72 nt, Human
ggcaacuuggaaaggagauucuauuguguguggucccugaaguggguaagccuacaagaauccccaguuguc

SEQ ID NO: 4141768 - RNA, 58 nt, Human
ggcaagaacaugcuucauggggacucccccgaccuggaauuuguguguguucaaugcc

SEQ ID NO: 4141769 - RNA, 80 nt, Human
ggcaagaagaaggaaauuuuacuaaucugagugugagguauagucauccugaaucacguucacuuuggaaaauucuuccc

SEQ ID NO: 4141770 - RNA, 57 nt, Human
ggcaagagggcagauggagugcagggagauggcgugacuuccaucuaucuucuuacu

SEQ ID NO: 4141771 - RNA, 77 nt, Human
ggcaagagguccaagaggucucagaugagccccaugugacucugggguucuuuaauggcgcucucugcauucuugcc

SEQ ID NO: 4141772 - RNA, 91 nt, Human
ggcaagcaccaguugagaauguauuuuugugugagcaggguguuaucaguaagguucaacauguucuacauaagggacuggaagcucugcc

SEQ ID NO: 4141773 - RNA, 84 nt, Human
ggcaagcacgugcccagagcaguguuuguggaccuggagcccacugugguugauagguccucgggcacuggauggcagcuuucc

SEQ ID NO: 4141774 - RNA, 56 nt, Human
ggagagguguauucagugggucuugcuauuaaggacagacuggacaugcucccuuc

SEQ ID NO: 4141775 - RNA, 93 nt, Human
ggagagugagcuguuacugaaaguggucaacaguggagggagcgugcacaugugcagucacuuuugaucccuaugcagucgcagucagucucu

SEQ ID NO: 4141776 - RNA, 109 nt, Human
ggagagugaggggguggcugcuccccugaggagcuccaucucugucccuagcugggccagguggggcgcccucaggcaggacagggcggaguggaccaggccucucucc

SEQ ID NO: 4141777 - RNA, 117 nt, Human
ggagaguuagaagaaaaagucacacugaggacacaugcuagaauaaaucuccaggggccccuccuggguuccuucuuagagugccucuuccugugugcugauuguuacuaauuuucu

SEQ ID NO: 4141778 - RNA, 61 nt, Human
ggagaguugauguuccaugacauucagacucuuaauugucagaggaucaucaaacguuuuc

SEQ ID NO: 4141779 - RNA, 80 nt, Human
ggagaguuucaagaaguaucuauauguauacucaugguugggguucuagaggcauuacaucuaaauauuuaugacuuuuc

SEQ ID NO: 4141780 - RNA, 112 nt, Human
ggagauaaauauuucaauaauuuucauugacaguuguuucaaauacguuuuauacuuuuucaacauguaacuuuugugaucugucgauuuuuguggaaauguuaaacucuuc

SEQ ID NO: 4141781 - RNA, 76 nt, Human
ggagauauauaggagaaagaguuuguugcugauguuauagaaucaccaaugcagcauugcacuuuuguucuuuucc

SEQ ID NO: 4141782 - RNA, 84 nt, Human
ggagaucucaagaaacuguagcaauggguagaauggugugauguuuuuaccaagaaauucguuacuuagauuuuuucccccucc

SEQ ID NO: 4141783 - RNA, 94 nt, Human
ggagaucugaucauggcugggcucauuugugugucugggaaucugccagggaucagaccaucuaggcugggcucagcaggguugguucaucucu

SEQ ID NO: 4141784 - RNA, 60 nt, Human
ggagaucuucacgcugcggucgcuggaacuagccucagcaucuucagcauggggaaagcc

SEQ ID NO: 4141785 - RNA, 87 nt, Human
ggagaugaggagggggccugagguuauccaucuaccugugauuugauggguagguuuaauuucaggauaaaauuccaacucaugucc

SEQ ID NO: 4141786 - RNA, 69 nt, Human
ggagaugagggaugccccagcugacagaggcccagcugggcuacugacucacuguggcucuuaaucucc

SEQ ID NO: 4141787 - RNA, 78 nt, Human
ggagaugagugagucagugggggugagugcuuagggauagaaauaaucuuuggaucgcucccccuuccacucuucuuc

SEQ ID NO: 4141788 - RNA, 72 nt, Human
ggagaugaguuggggguuccagggaggcaccacaguugccaaaguccucuugccucccuggcaagucucucc

SEQ ID NO: 4141789 - RNA, 64 nt, Human
ggagaugccagaauugcaaauuuucucugcugauuuguguccuacugauucuggcucgcuuucc

SEQ ID NO: 4141790 - RNA, 61 nt, Human
ggagauggccaaaaacacaaaugaguauaauucuaggcugccugugguaugugccaucucu

SEQ ID NO: 4141791 - RNA, 65 nt, Human
ggagaugggggaaaguacgagcauggccuugucgaccaucuccuggccuuuguuccccccacucc

SEQ ID NO: 4141792 - RNA, 121 nt, Human
ggagauuccugggccccagguggcggggggaaggguccagcaccucggcuccaggcaugugugccagaggaagccccagcugugggaucccauccguuccuggagcccagaacacuucucu

SEQ ID NO: 4141793 - RNA, 128 nt, Human
ggagauucuaucaggagcaaacagaauggguggaagggagaaaacuuguggcuuauuguaaaaguggccauguguuauuuucuucucucuauccaugaccuuugguagugccaucccacacugucucu

SEQ ID NO: 4141794 - RNA, 77 nt, Human
ggagauuggagggugaggggaagggagacgccaggguauuucuuccucugucucucugcccccauugcucuggcuuc

SEQ ID NO: 4141795 - RNA, 70 nt, Human
ggagauuggcauugcugcaccugagaaagcuuccaacacuuguggacucaugugcaaaaguccaaauucu

SEQ ID NO: 4141796 - RNA, 112 nt, Human
ggagcaaaaguuaaccuaagccuagguagaaccuucuuuacuagaguauuaggcauggguuguggcaacuauucuaaccaaagaggcuccacugagggcggguuggcaaucc

SEQ ID NO: 4141797 - RNA, 59 nt, Human
ggagcaaagagcacaagcacaaagaagaagccuucucugagccccugccucuuuccucc

SEQ ID NO: 4141798 - RNA, 63 nt, Human
ggagcacagaggaagcacagacucugccuacaaggcaaagagaaaggaugcugcucugugucc

SEQ ID NO: 4141799 - RNA, 91 nt, Human
ggagcacagugucaugaaggcuggccuguaacauugcuguagucacuuuuuaaguuuguucacaggggagccauuuauuuauucugagccc

SEQ ID NO: 4141800 - RNA, 60 nt, Human
ggagcacccugcucagccaagcaacccugaagucagaggccggccgagccaaggggcucc

SEQ ID NO: 4141801 - RNA, 69 nt, Human
ggagcaccucaauuugcuauuuggggguaccugaaaugaaaaauuccaaguacugaguugggaugcucu

SEQ ID NO: 4141802 - RNA, 65 nt, Human
ggagcacugauacgaguuugacuuuuucaagagcgcuugaauuccaaauuguguuugugagcucc

SEQ ID NO: 4141803 - RNA, 75 nt, Human
ggagcagccagaauuauugaaaagaauaaagaaggaaaauuccuuugguaguuuucuuaaagaucaaauagcucc

SEQ ID NO: 4141804 - RNA, 94 nt, Human
ggagcagccucaggaguugaaggggauccugucccucccagaggaaagcucacgauuggauuggaacuucuagcgacugccugaggugagcuuc

SEQ ID NO: 4141805 - RNA, 128 nt, Human
ggagcaggaaaugagcgguugcagccggcguggagcgggaagcuguucagugucaugggccuuaucugggaacaggcugcccaauuacagggccgugcccgcugcacccggcagcugccggcuccucc

SEQ ID NO: 4141806 - RNA, 55 nt, Human
ggagcaggcaggaggcuacuaagggucuucuuuaacaaaugacucuugucuuucc

SEQ ID NO: 4141807 - RNA, 99 nt, Human
ggagcaggccuugcccucagcauuggguuaccuuuguuuauguucacagaaagaaaagccagcccagagcccgagaccccccagcagaggccugauuuc

SEQ ID NO: 4141808 - RNA, 83 nt, Human
ggagcaggcugugacacaaugugcaggacaccugucagauuuccucuggagcaagcuguccaugccauuguucaagcugcucc

SEQ ID NO: 4141809 - RNA, 57 nt, Human
ggaauaguguuguucacucaggagguugcauucuaaaccaugugucaauacuguacc

SEQ ID NO: 4141810 - RNA, 77 nt, Human
ggaauauaacaguaggcaucacauaaugacucgauugcuuuucuaaucucaguugaaugcuuuauugggauauuacc

SEQ ID NO: 4141811 - RNA, 76 nt, Human
ggaauauggcugaauggaaaagacauugauccuaagagcuagcuuaggaaauauugauuucagucaccuaucuucc

SEQ ID NO: 4141812 - RNA, 64 nt, Human
ggaaucaauuuuugagauuugucagagaggguugcaaacuguuuaucaaauucucauugauuuc

SEQ ID NO: 4141813 - RNA, 88 nt, Human
ggaauccugucagcaauguaauaaagacuccucuguuacagaaagugagguaacagcuugggaugcuuuauuucaugaucaauguucc

SEQ ID NO: 4141814 - RNA, 83 nt, Human
ggaaucguaguugucuuaguguuuagggaaucaaggggucuucccagacccugugucugcacauuacucagcucucagauucc

SEQ ID NO: 4141815 - RNA, 56 nt, Human
ggaaucucaaguccauagaaucaggaaucauaguuccaaucccuggacuugaaucu

SEQ ID NO: 4141816 - RNA, 80 nt, Human
ggaaucugugcucuaugagauccuccucaccuguucagcucaaggagagaagcagguguagggcucuuuguacagacucu

SEQ ID NO: 4141817 - RNA, 73 nt, Human
ggaaucuucaggggcaauggagauaugacccagagagacuuuguuuaaugucuucauuccccaugaagucuuc

SEQ ID NO: 4141818 - RNA, 76 nt, Human
ggaaugagauacacacagggaauggagggaucaguacagcugaagugcagagccuagcccuuuccucucucauuuc

SEQ ID NO: 4141819 - RNA, 56 nt, Human
ggaaugagcucggagcagaagggucacaucuguuuccuuuucuuggguagcauucc

SEQ ID NO: 4141820 - RNA, 60 nt, Human
ggaaugaguauuucucuaugcuagcucucagcauggauagaugaaugcuuaaagauuucc

SEQ ID NO: 4141821 - RNA, 66 nt, Human
ggaaugauggagggugguaagacagagagaggccacuuccuuucuuugcaucccuuccauaguucc

SEQ ID NO: 4141822 - RNA, 102 nt, Human
ggaaugauuacguagcucuagggugacuucaaagauauccuaauacugucuagcacuuugaaaaaugguuuccuagauaccuaugaugaucgcaggcauucc

SEQ ID NO: 4141823 - RNA, 76 nt, Human
ggaaugauuauauguauaugugaaagauguuuauuaggucuccagauaguguuuaguacauaugcauauaauuucc

SEQ ID NO: 4141824 - RNA, 67 nt, Human
ggaaugauuggagaaaggaguguuauaggggucaagagccucugagaguccaucuccaagccauuuu

SEQ ID NO: 4141825 - RNA, 113 nt, Human
ggaaugcaggagagaaugacagggaggccggaagcagccaggcagugcaaauuccacauccagauggggcccugugccuggcauucugggcuucuugggguugccugggcucc

SEQ ID NO: 4141826 - RNA, 92 nt, Human
ggaaugcaugcuuuucucaaguuaagacacauaaaagaguuguccuggcccaggugagacucgccuuuguguagcagcuggagcuucauucc

SEQ ID NO: 4141827 - RNA, 56 nt, Human
ggaaugcugagauccucaggccagauacccccaguaucuguucaaaucuuaguucc

SEQ ID NO: 4141828 - RNA, 71 nt, Human
ggaaugggaaguggcuggucuuugcuaauagagggccaaauuccugcucaggaucagccaccucuuuuucc

SEQ ID NO: 4141829 - RNA, 63 nt, Human
ggaauggucaugugaugagauuuuggauaaugaaacccaagacaauauugcugugaacguucu

SEQ ID NO: 4141830 - RNA, 62 nt, Human
ggaaugguuuagcaagguguuuuuuccuuuguuuauaaggagagagauugcuaaaccacucc

SEQ ID NO: 4141831 - RNA, 129 nt, Human
ggaaugguuugaugccuuguguacuaguauguucagaacaggagcugcuuuggugcgguuugagucaugagucacucugacaaaaggcagcuuaugauauggauauguaagguguucucuuaguguuuu

SEQ ID NO: 4141832 - RNA, 61 nt, Human
ggaaugucccaccaggguaugacaggcuguagcuugccuggcaggccuguuggggcuuucc

SEQ ID NO: 4141833 - RNA, 73 nt, Human
ggaaugugcugcuucuccaaaguaggacuuaugaaaaaaugagggucccagcauaggggaagcaucaaugucc

SEQ ID NO: 4141834 - RNA, 58 nt, Human
ggaauguucuggucugguucaucuuggagccuuggagcucauggggaccaagcauucc

SEQ ID NO: 4141835 - RNA, 118 nt, Human
ggaauguuguaauagcacuuggaucggcuucaguaauuccauguccagaaauuucugaugcaucuggugucaaauuauugaguuucaucuccaagaagucgugcuauuaaaaaucucc

SEQ ID NO: 4141836 - RNA, 57 nt, Human
ggaauucaccagagguuagaauauuuuauaugaaauaaucuuacucugcuggacucu

SEQ ID NO: 4141837 - RNA, 112 nt, Human
ggaauucagaugagagucuuuggaagagugagggaugaagaacugcgggacaaaucugcugcugcgggaccucauccuauccuagggcucuucccugggacuuucugacgcc

SEQ ID NO: 4141838 - RNA, 80 nt, Human
ggaauucugggagucaggagggugacaggcccuggcaggugggggucuuggcuaguaccuuccugccagaacaggauucc

SEQ ID NO: 4141839 - RNA, 56 nt, Human
ggaauugaauugacauucaggugcaaacagccagccacugaacacaguacaauucc

SEQ ID NO: 4141840 - RNA, 74 nt, Human
ggaauugacagcagcagugucugaaucucccacacucuuuagagguuaggagaagagacugucacugcaguacc

SEQ ID NO: 4141841 - RNA, 76 nt, Human
ggaauuggaagcuggacucugccauuuacuugccgugugacccugagugaguggagagcucuagguuuuguuuucc

SEQ ID NO: 4141842 - RNA, 66 nt, Human
ggaauuuagauguuucucaacucuuuucucauucuaggaacugauaaguggggaauucugaggucc

SEQ ID NO: 4141843 - RNA, 58 nt, Human
ggaauuucacaccccaccccauccuacccuuaaggugcccuggagggguugaagggcc

SEQ ID NO: 4141844 - RNA, 84 nt, Human
ggaauuuccugaaccacaaugugaagaaggaggugcuccugauugggcuucuuuucucagcuuugugguuguuuaugagguucu

SEQ ID NO: 4141845 - RNA, 118 nt, Human
ggaauuuggauacuuuauggacaucagcaacaucgucacaugugauaaggauuucugaagggugauuacucuucaucccuuuaucaggaugucccugacaccauaggauccaaagguc

SEQ ID NO: 4141846 - RNA, 57 nt, Human
ggaauuuggguaccauguuuccauuuccuguuuuucagaaaaugcugcucaaauucc

SEQ ID NO: 4141847 - RNA, 130 nt, Human
ggaauuuugcucuuguuucccaggcuggagugcaauggcaugaucuuggcucccugcaaccucugccucucagguucaagccauucuccugccucagccucccaaguagcugggauuacaggcacacacc

SEQ ID NO: 4141848 - RNA, 63 nt, Human
ggacaaagggguacgaucuagcuggcaugaaacuggagggaaguuggcaaggccuguuuguuc

SEQ ID NO: 4141849 - RNA, 77 nt, Human
ggacaaaucuaggcucauccuggucccacaggaaguuuuaaagugugaauggcaccaggaucagucugucauuguuu

SEQ ID NO: 4141850 - RNA, 57 nt, Human
ggacaaaugagucccuguggugaccugugaccuuccaucaacaguacugguuugucc

SEQ ID NO: 4141851 - RNA, 61 nt, Human
ggacaagauuggugaagcugcuauccuaccuggcaguuuacaucuucaaucucauuguacc

SEQ ID NO: 4141852 - RNA, 63 nt, Human
ggacaagcauaagugagaugaauaaggugacuuuagccuugucuguuuuccccuguguugucc

SEQ ID NO: 4141853 - RNA, 110 nt, Human
ggacaaggggaaggcuaauggugucuuuuguucaccugauauauguagcuccuucugcuucuuauggguaauguguauagguugugcuaauagugccaugcuucccuucc

SEQ ID NO: 4141854 - RNA, 100 nt, Human
ggaucuaaacacucauuuuucuagguuuacaauacugcaugaaucacugcuaugcuacaguaacauuuaggaaaggaaaagauugaguauuuaaugaucu

SEQ ID NO: 4141855 - RNA, 98 nt, Human
ggaucuagggaccagcucuggggaccauggcaucuaaaccaagcuguucuccaggugugauugggucauggccccagaccucuggcuuucuuggaucc

SEQ ID NO: 4141856 - RNA, 61 nt, Human
ggaucucauucacuauaugcuuaaugucccucaucuauugaguguguucccugugagauuu

SEQ ID NO: 4141857 - RNA, 70 nt, Human
ggaucugcugugccucuuuucacgugucucccuaaaaaguccaugugucuccagaggcagagcuaaugcc

SEQ ID NO: 4141858 - RNA, 55 nt, Human
ggaucugggcucugccaaucagacuuggaguaagaagcagggacugcccaggucc

SEQ ID NO: 4141859 - RNA, 73 nt, Human
ggaucuggugggacagggacacuaucagaacugaggcucugucuugguggcugcucccugccuugaccuugcc

SEQ ID NO: 4141860 - RNA, 57 nt, Human
ggaucugucucugcaauuaguccugaugccaggucugccugcuggggagacagaucu

SEQ ID NO: 4141861 - RNA, 68 nt, Human
ggaucugucuuugagaucucagccugaauauguccucucauaaaggcccugagcauccgagggcaucc

SEQ ID NO: 4141862 - RNA, 94 nt, Human
ggaucuguucaagaagacuugaguugggugcuuacuauucuauguacuugggauaccaacaauagaauaaggcacagauucuuucaagggaccc

SEQ ID NO: 4141863 - RNA, 75 nt, Human
ggaucuuaggaguguuagcuaggaauggaaauuuguguucuuuuuuguuaucauuucagccauuuuuaaaugucc

SEQ ID NO: 4141864 - RNA, 57 nt, Human
ggaucuugauuucaacccagaggaucuuaaauguucucuggaacugaaacaagaucu

SEQ ID NO: 4141865 - RNA, 55 nt, Human
ggaucuugggccacaaugagccgaggagcugaggugacugggggcgccagggucu

SEQ ID NO: 4141866 - RNA, 72 nt, Human
ggaucuuugcucuuucuguccgcagggccugggaucucagccccaccccaagacaguagaagagaagggacc

SEQ ID NO: 4141867 - RNA, 72 nt, Human
ggaucuuuucccuggacuccaacuagggacuggagagcuuccugguaaauuauguccaggcaagugggauuu

SEQ ID NO: 4141868 - RNA, 67 nt, Human
ggaugaaaugucuaucuggcauauuccaccuugggucaggaauagccggcaucagucacaugcaucc

SEQ ID NO: 4141869 - RNA, 66 nt, Human
ggaugaagccagcaugaagacagaggccaaaaucuugaccaaaagaagucugaugcuggcucuucc

SEQ ID NO: 4141870 - RNA, 79 nt, Human
ggaugaaucagacccagcaggucccacugagggcccccguugaagaucagaggggucuggcagggccugugggacaucc

SEQ ID NO: 4141871 - RNA, 67 nt, Human
ggaugaaugaaggagugugggagucaugcgugcuggaagcacauaucuuucccucuccugaacaucc

SEQ ID NO: 4141872 - RNA, 95 nt, Human
ggaugacagggaacaguggggacuggagagcacauguuuuguccagugagggcauucccagugucuccagaugcuccaauuuuuccugggaagcc

SEQ ID NO: 4141873 - RNA, 60 nt, Human
ggaugacauuuaugugugugcuguuaugacuuugagaagcacagacuagaaaggucuuuc

SEQ ID NO: 4141874 - RNA, 121 nt, Human
ggaugagaaaagacuggcccacaacuugagugcauuguucacugugaaucuugauaauaacagguaucccucaucaagcacuucuacaugacaugcacugugcucggcuuaaaaaacaucu

SEQ ID NO: 4141875 - RNA, 67 nt, Human
ggaugagaaaauucauuccauccaggacaacguagggacuccauggaaaagggccuguuuuccaucc

SEQ ID NO: 4141876 - RNA, 65 nt, Human
ggaugagaacuuuguagacuugaugaacauugugaaauguaacauuagguagacauaagccauuc

SEQ ID NO: 4141877 - RNA, 70 nt, Human
ggaugagcgagucgggucggcccgggaguguuccgaacggagcuggcuccgccacgcccacuccuacccc

SEQ ID NO: 4141878 - RNA, 55 nt, Human
ggaugagcggcguugcaaagccaggcucuggcgugcguccugcaacuggcucucc

SEQ ID NO: 4141879 - RNA, 65 nt, Human
ggaugaggcaggaaguuauauaaugcuaauugaagaauucugcauuauaaguuccuuuuuggucc

SEQ ID NO: 4141880 - RNA, 55 nt, Human
ggaugaguguuuagaaaacacuggcauacaguaggugcucaauaaaugcucauuu

SEQ ID NO: 4141881 - RNA, 94 nt, Human
ggaugcaggggcagggaagggcagggucuaugcaccaacugccuuugugcagaaaaccuuuccuuucccccauaucaaacccucaacugcauuc

SEQ ID NO: 4141882 - RNA, 55 nt, Human
ggaugcaugugcauuuugaaaaaccuccccagguaauucugacugacaugcgucc

SEQ ID NO: 4141883 - RNA, 67 nt, Human
ggaugccaugcguuucuucuuuagcaaugauuaagaauaacugcagaggaaaugcaucugaccaucc

SEQ ID NO: 4141884 - RNA, 81 nt, Human
ggaucuguuucucugcuucguagaccagaaauuuaguuuuguagggugcucagagcugauuggauccagagagacugacuc

SEQ ID NO: 4141885 - RNA, 68 nt, Human
ggaucuugaggggauuggaaggaacaccccaguggcagucagaagagcuggguucuaaucucagaucu

SEQ ID NO: 4141886 - RNA, 64 nt, Human
ggaucuuuaauacagaagcaagacacugguaggcaaacaguacaugggucaugcucuguguucc

SEQ ID NO: 4141887 - RNA, 126 nt, Human
ggaugaaaugagucuacagagaauuuagggagcacugaagaugcgacuagugcuggggagacaguggacaagccccaucccauuuaaucuucaugccgucccuguagacgacaucuauuaccaucc

SEQ ID NO: 4141888 - RNA, 61 nt, Human
ggaugaagauggagcaagugccuguacaacauaggacuaaaaagaugcucucccuuuaucu

SEQ ID NO: 4141889 - RNA, 69 nt, Human
ggaugaaggcaccaaggaagaaucuauuugaggccgucuccggcccauucccacaugguggcuccaucc

SEQ ID NO: 4141890 - RNA, 70 nt, Human
ggaugacagaugcaggcuuugagagggaccaaaaggaacacucuccacugggguguggggucagucaucc

SEQ ID NO: 4141891 - RNA, 59 nt, Human
ggaugagcaaugaugcgcuguaauguacguaagugugcagcaagcaaguaugguucucc

SEQ ID NO: 4141892 - RNA, 56 nt, Human
ggaugaggaaaccacaguguccuuauugaaggagugacuuacugacuucuacaucc

SEQ ID NO: 4141893 - RNA, 76 nt, Human
ggaugaggccaaggagccugauuuaggauucuagacucuuguguuggaauuuuguauuagcuuugaggucuugucu

SEQ ID NO: 4141894 - RNA, 55 nt, Human
ggaugaguuaggggccugaguggaccccugucccucaccuagucuuugacucucu

SEQ ID NO: 4141895 - RNA, 57 nt, Human
ggaugaugagcugugguagcacgaugaucaauaacauuagcuucaaagccaucaacc

SEQ ID NO: 4141896 - RNA, 83 nt, Human
ggaugaugaggucuggcacucaugcagcaggaaaaggagcucucucuugaaccuguuggaguguagguacuuccagggcaucc

SEQ ID NO: 4141897 - RNA, 74 nt, Human
ggaugauuauggcccagguaccacaggauguggaguuucugggcucagcaucaugguaucuggggcccacgucc

SEQ ID NO: 4141898 - RNA, 67 nt, Human
ggaugauuugaggauuucaugaggccagaauuuccacacgcugucacauggaaucuucagagucacc

SEQ ID NO: 4141899 - RNA, 71 nt, Human
ggaugcaggcacagcuaagacuggccauaaccuauggagaguccuggccaaucagcugugaccugcugucc

SEQ ID NO: 4141900 - RNA, 65 nt, Human
ggaugcagggcuggcaggagcuuugucaggcucuguggacugaguaggcacuguugucuguaucc

SEQ ID NO: 4141901 - RNA, 70 nt, Human
ggaugcaggggcagcagagccugguggagacugcaaggauuuguggcucugagucugcccuuggcuagcc

SEQ ID NO: 4141902 - RNA, 64 nt, Human
ggaugccuggaggcccagcaggugcagcaggagccacuugcuuuacaagccugcuuccucaucc

SEQ ID NO: 4141903 - RNA, 56 nt, Human
ggaugccugucucagggucuguuucugauaaaccuacccuaagacagaguauuucc

SEQ ID NO: 4141904 - RNA, 57 nt, Human
ggaugccuuaauuuucuaagcugugcccaagguugcuuacuggaaauuaagggaucu

SEQ ID NO: 4141905 - RNA, 122 nt, Human
ggaugcgauuaaaaggaaaaauacaggaaggcaauuagaaacaaaauaguuauuugauuuuggugaacaguaaaaauuuuagcuaccaguguuuuuaaugaccacuugcuuuguaauugacc

SEQ ID NO: 4141906 - RNA, 67 nt, Human
ggaugcuaccuuuguaaaaucuaaaagcauaguguauaugguuucuggauucauacagauguagucc

SEQ ID NO: 4141907 - RNA, 77 nt, Human
ggaugcugcuuucugggaagaagugggcuacauuuucuaggcuaaaucuagccuuuugguucccaaguagcaacucc

SEQ ID NO: 4141908 - RNA, 84 nt, Human
ggaugcuuuauguucuggcauuuuugucuucuuuucugaagugaacauacaagauggcauacauuuccaaagcagaucaauucc

SEQ ID NO: 4141909 - RNA, 77 nt, Human
ggauggaagagggagggcaaaggcacugagcaggaauguguauggugucuccauccugcccugcccuccuccacucc

SEQ ID NO: 4141910 - RNA, 128 nt, Human
ggccaggcccaagggauugugaaagagcuccguccuuuauuuacuggauggccuugggcaccucacuucauuucucugaaccccaaugucaugucugugaaacgaggacucauagucuccacccggcc

SEQ ID NO: 4141911 - RNA, 56 nt, Human
ggccaggcuggccagcaccuucugaaauugcucucaggcagcuggaaggccuggcu

SEQ ID NO: 4141912 - RNA, 61 nt, Human
ggccaggcuggccucuacagggaggcaggacuccugcucccugcucagagaggccagggcc

SEQ ID NO: 4141913 - RNA, 93 nt, Human
ggccaggcuggucucaaacuccuaaccuugugauccacccaccuuggccucccaaagugcugugauuacaggcaugagccaccacgccuggcc

SEQ ID NO: 4141914 - RNA, 74 nt, Human
ggccagggagcucguuggguuaaccaggaugucaaugauuuuguacuugccauagaacaacaucucuuugagcc

SEQ ID NO: 4141915 - RNA, 59 nt, Human
ggccagggggcuucagacuccacuguacucugcauuccaggauucucuguucucuggcu

SEQ ID NO: 4141916 - RNA, 59 nt, Human
ggccagguaagagugcagccgccgcccacccgacgccaggccucgcuccccgccuggcc

SEQ ID NO: 4141917 - RNA, 81 nt, Human
ggccaggugagggcgaucacuccguuucucuauccaguuaccuuuguacguuagaaaagcaggagcucaauacaccuggcu

SEQ ID NO: 4141918 - RNA, 85 nt, Human
ggccagguugauggacuugagagaaucggaggagucccuccugccaugaccgagggagagcucaucaucugauuccucccuggcc

SEQ ID NO: 4141919 - RNA, 69 nt, Human
ggccaguaacugcaagaguaaaugucuagacuuaaaauauauuucuagauaagauuuuugggguggguc

SEQ ID NO: 4141920 - RNA, 60 nt, Human
ggccagucucauuuucuucuggguuaccaaggcuauaaacaagggagagugggaauggcc

SEQ ID NO: 4141921 - RNA, 86 nt, Human
ggccagugcagcaaagcgguugaaagugugcacuugaggaggcagcagagccugaguucaauuuccagcuguucuguuuacuggcc

SEQ ID NO: 4141922 - RNA, 84 nt, Human
ggccagugugaggacagacaggugugguaggcacaggugcagggcugcuggccucacucacucugaauggcagacucacaggcc

SEQ ID NO: 4141923 - RNA, 84 nt, Human
ggccaguguguaaauugucuuggcauucaaauuaggcuccuuaagauaggaccuagaaugaaaguuaaggcuuuaucguugguc

SEQ ID NO: 4141924 - RNA, 63 nt, Human
ggccauaacaugcagaaaucuuagcuacuuaacaucauuuuuaagagcucuuuuguuaugguc

SEQ ID NO: 4141925 - RNA, 59 nt, Human
ggccauagcagugacuaauaggauacaaucaccuuguucauucgcuauugucuauggcu

SEQ ID NO: 4141926 - RNA, 59 nt, Human
ggccauauuucuguaucagucuuggugagcugugcuguggcagaacagaggucauggcc

SEQ ID NO: 4141927 - RNA, 79 nt, Human
ggccauccaauuaauaaugcagcucugucgccauuaaacaauuuggcaguggugacugggacuggauaugaacaugguc

SEQ ID NO: 4141928 - RNA, 57 nt, Human
ggccaugcauccuuggacuuggcgcagguuuuugcuuggccucugagggugugugcu

SEQ ID NO: 4141929 - RNA, 63 nt, Human
ggccauguggaagcugugggucucuggaaaucagugucuccucagacccuguguccuguggcc

SEQ ID NO: 4141930 - RNA, 59 nt, Human
ggccauguucaaugaaucaggcuguugugcagagcagccugugugcuuuggacagggcu

SEQ ID NO: 4141931 - RNA, 71 nt, Human
ggccauuuauaaaaggaguauagugugacaagauuaaagauuacacaggcuggcucuuugagauacaggcc

SEQ ID NO: 4141932 - RNA, 75 nt, Human
ggccauuuucugcuuucagagugagacaaaguucaaaaugacagucugucagcucauugaaggcacaagauaccc

SEQ ID NO: 4141933 - RNA, 76 nt, Human
ggcccaacucagauucaagagaaggggaaauagacuccacuucuggagucuggcccuucuuuuaaagagaguggcc

SEQ ID NO: 4141934 - RNA, 59 nt, Human
ggcccaaggcccaggucgagcuccucguccucgucggagucugggagggguguugggcu

SEQ ID NO: 4141935 - RNA, 73 nt, Human
ggcccaccaaggcagcagacuguuaaucagacaaacagaucucugagaaggugcaucagcugcuuugaaggcu

SEQ ID NO: 4141936 - RNA, 64 nt, Human
ggcccagaaaaaggcuuagaauguguuucuggaagugguauaaaggaagccuuucuuuagggcc

SEQ ID NO: 4141937 - RNA, 69 nt, Human
ggcccagacaggaacacacaucucccuaaauucugacuaaaaggcguggugaacccugcucugucggcc

SEQ ID NO: 4141938 - RNA, 78 nt, Human
ggcccagagcugggcgggagggagacaggcagauagcagggaagaaugagccaucucuguccccucagcuggggugcc

SEQ ID NO: 4141939 - RNA, 65 nt, Human
ggcccagcacagugcuugggggccggcggcucccagcucccgggccgcccugcugcacaaaggcc

SEQ ID NO: 4141940 - RNA, 72 nt, Human
ggcccaggagggggcuagcuaagugccugagauguucaaaguuaccaucauaacagcuaagucccuuucucc

SEQ ID NO: 4141941 - RNA, 64 nt, Human
ggcccaggccucugagcagcacucaugggucacuuuacucauuguggaucacagagccugggcu

SEQ ID NO: 4141942 - RNA, 60 nt, Human
ggcccaggcuggagugcaguggugugaucauagcucaccacagccuccaucuccugggcu

SEQ ID NO: 4141943 - RNA, 67 nt, Human
ggcccagguagguauaaugcacuuccgguccaugaugccacagguguccaauaccugcuuccuggcc

SEQ ID NO: 4141944 - RNA, 129 nt, Human
ggcccaguagaugcagacaaucuugggugaaagugggaccggagcugccggcccacaguacuacuugugagaaguagcaccauacccggcagcucgagacucacauucaccacauuguggguggggggc

SEQ ID NO: 4141945 - RNA, 78 nt, Human
ggcccauccugcccucuaggcuacaguuccagcgcucacgacggagcuggaacucaggauggaacucaggaugggacu

SEQ ID NO: 4141946 - RNA, 81 nt, Human
ggccccaaaaugauugucaaaguucuguucacuuaaauucacuguaauuaguaagaauaguuaucauuuauuuugggugcc

SEQ ID NO: 4141947 - RNA, 74 nt, Human
ggccccagggaagaagguggucucuucagaucccacaguaugagccagcuucaaccaucucccugacuuggguc

SEQ ID NO: 4141948 - RNA, 57 nt, Human
ggccccagguagaagauauagaagcaaaggggauacuucugugauuucugugggguc

SEQ ID NO: 4141949 - RNA, 58 nt, Human
ggccccaggugagcuuuauuuggccgugaagcugaauguacaggcuggcuauggggcc

SEQ ID NO: 4141950 - RNA, 67 nt, Human
ggccccaggugaggggagcuagcaugccuugggauauacauucagcuggaagcgccucucaacugcc

SEQ ID NO: 4141951 - RNA, 68 nt, Human
ggcccccacagaagaaagcuacacauagaguggaaauccuguguuuacuggcuccugugguucaggcc

SEQ ID NO: 4141952 - RNA, 74 nt, Human
ggcccccaccuggggcucucuggaaugcuuguggucaggcccacagggggcugcugaggcccggguguggggcu

SEQ ID NO: 4141953 - RNA, 58 nt, Human
ggcccccacucuccagcacaccccauuucucugaaagggccaauggagagugugggcc

SEQ ID NO: 4141954 - RNA, 64 nt, Human
ggcccccgcgcggccggaggcucggggccgcagcagccagugccucugcucugcguuggggacu

SEQ ID NO: 4141955 - RNA, 57 nt, Human
ggcccccugcuugcuuuggggucugaguuagcuccuggcuccacugagcaggccguc

SEQ ID NO: 4141956 - RNA, 65 nt, Human
ggccccuccccacagcccaggagacuucacuaauagaugaagauccuggggucuggggaggagcc

SEQ ID NO: 4141957 - RNA, 124 nt, Human
ggccccugagaucagagguggugccuccucugugugcuggugggguccugggcucuagccacagaagcaccugucagcuacauguuggugagaugguuuuauggcaccuggcucagcgcgggcc

SEQ ID NO: 4141958 - RNA, 75 nt, Human
ggccccugagugaggugaagaguggagcucaggaccuuugguccugaguuagugaguucacuaacaaguggagcc

SEQ ID NO: 4141959 - RNA, 56 nt, Human
ggccccugcagaccaaugccauagaguuuccucgugucaauuuucugguaggagcc

SEQ ID NO: 4141960 - RNA, 77 nt, Human
ggccccugcgaggggucacaugggcuggcuuauuuggagaacaaaguuagauaacucaugugaucccacagagggcc

SEQ ID NO: 4141961 - RNA, 80 nt, Human
gcagggguugaaacagaguggauacagugaguauauuuuauaucacguuuguucaucgauuuuauuuugacuuucccugu

SEQ ID NO: 4141962 - RNA, 64 nt, Human
gcagggucaggagaagggugcggcagauggagaaucuguaucacccguucccagaacgucccgc

SEQ ID NO: 4141963 - RNA, 63 nt, Human
gccaugccuggcuaauuuuuuucuguuuuacagacggagucuugcuauguugcccaggcuggu

SEQ ID NO: 4141964 - RNA, 92 nt, Human
gccaugcuuuugaucaaagcugauacucagcaaguauccugggugugauuguacuaguuacuuguugcuaaugucucuucugauagcuuggc

SEQ ID NO: 4141965 - RNA, 104 nt, Human
gccauggagaguccuagggaguaaaugaugcuacaguuuucccaucuggaagaagguggggugagcuuuagguaaacauaagacacuuauuggcucuaaguggc

SEQ ID NO: 4141966 - RNA, 60 nt, Human
gccauggagucuacaaaguguuggaaccuccagagguucuaggaagaaaggccccauggc

SEQ ID NO: 4141967 - RNA, 72 nt, Human
gccauggcuucuuucucugccagaccacguagcacuggcugguucuguauuugagaauguagaggucaaggc

SEQ ID NO: 4141968 - RNA, 60 nt, Human
gccauggggucacauggagagagaaagcaaaccaacuuucagagcucuaggcucucaggc

SEQ ID NO: 4141969 - RNA, 77 nt, Human
gccaugugacuuuacaguuccucucguggaggugaaauguacuuucacuccacugauguugaauuuagucauguggu

SEQ ID NO: 4141970 - RNA, 57 nt, Human
gccauguuggaacuucacauucuacagucucacuguggagauuauccugggcauggc

SEQ ID NO: 4141971 - RNA, 85 nt, Human
gccauuaaguuucaacaugcaaacuuugggagacauauucagaccauagcuguccucaaaguucauucauguuguugcauauggu

SEQ ID NO: 4141972 - RNA, 98 nt, Human
gccauuagggaucugugggccucuugaggguggcuaugagaaucaggccagggugagggucugugggcaucuauggggcaccgcgggucugcaugggc

SEQ ID NO: 4141973 - RNA, 61 nt, Human
gccauuauccauuuugagucuuaccgcaacucuuguggggucaggcaagacuggugguggc

SEQ ID NO: 4141974 - RNA, 73 nt, Human
gccauugaugcauucauucauucauuagguauguaguauguacugcugagcuggguagaaggaauacaauggu

SEQ ID NO: 4141975 - RNA, 72 nt, Human
gccauugcuggcucucucuccuggguaguccaaggaauccgugagaccacuggggugagggccaucgguggc

SEQ ID NO: 4141976 - RNA, 89 nt, Human
gccauuggcauugguagcaucacugaggaguaauaucugugugggcaguuagggagugcuugucaggauaagcucuggcugcugguggu

SEQ ID NO: 4141977 - RNA, 60 nt, Human
gccauuguuuuaguagguacacugaggccaggaaggucuuguugccaagagaauagaagc

SEQ ID NO: 4141978 - RNA, 67 nt, Human
gccauuuaggggaagaccuggcacuacagcccggagguccuggguucuuuugugguuuuccccgugc

SEQ ID NO: 4141979 - RNA, 83 nt, Human
gccauuuucuucagccuucacaaccugaaaaucuuucacucaauccagaaaggauaggaaugagagggugaggauuugugagc

SEQ ID NO: 4141980 - RNA, 70 nt, Human
gccauuuugcuucaguagcucuuuaaagcuacuuaaaguuguuuuaaaggggcuuugagugucuaguggc

SEQ ID NO: 4141981 - RNA, 60 nt, Human
gcccaaaauuguugaugcugcuuugcgggcaugcagacgguuaaacgauuuugcuagugc

SEQ ID NO: 4141982 - RNA, 68 nt, Human
gcccaaaggguggcacaggugcagagggucgcgggcccgccaaggacagcugcaccuggccgccuggc

SEQ ID NO: 4141983 - RNA, 101 nt, Human
gcccaaaugauugcuaacugauacaaugaccauauuauguaagaguagagaaguaguuuuauaaacagaaauggcauccuggaucaauaggaauuaagggc

SEQ ID NO: 4141984 - RNA, 108 nt, Human
gcccaacaaacugccccaggauguuucuuccaugaguagcaguauuuccuguuucuccucucaccuugcaggacaugcugugacugauguucccuggggacaugaggc

SEQ ID NO: 4141985 - RNA, 57 nt, Human
gcccaacagguaaacuuaaaauagggaguuaccaccugcuugcuuugucugaugggc

SEQ ID NO: 4141986 - RNA, 60 nt, Human
gcccaagaucacauuaauaaugaaucuaguauuuauacacaagaaaugugauucuagggc

SEQ ID NO: 4141987 - RNA, 117 nt, Human
gcccaagaugcccgagguggccgaaguccaggcugugcgcaccguguggggacugcuggggggcagggaucgcccgugugugguggccaugguguucggcacugggggugugugggu

SEQ ID NO: 4141988 - RNA, 87 nt, Human
gcccaaggcuuggguugugcagucagacugccugggcucaaacucugagacugaggccugcuugcuguguaaccuugagccaagggc

SEQ ID NO: 4141989 - RNA, 128 nt, Human
gcccaagggugucucugaucagggagcaauuucagggaagccugggugauccuaaagucaccucccaguucaaagauguauuuaggauaacuccaguuuucccuagaaacucuucaguacucuuuugc

SEQ ID NO: 4141990 - RNA, 55 nt, Human
gcccaagguauaucagagacaguagaucaacaagucaacugguagacuuuugggc

SEQ ID NO: 4141991 - RNA, 56 nt, Human
gcccaaggucacacacaggaaggaaggcaaaauuccuccaguauguuauuuggugu

SEQ ID NO: 4141992 - RNA, 74 nt, Human
gcccaaggugccaugcugggcgggggagauggagcaugagcuauccaaucccaccuuccguggaacccgugggc

SEQ ID NO: 4141993 - RNA, 63 nt, Human
gcccaagucaauuaguaaacuuggaaacuggaauacaguuuagcaggaagaguuggcuggagu

SEQ ID NO: 4141994 - RNA, 55 nt, Human
gcccaagucagugcuucuggcaauauguauuuuucuaaaggcaugugacuggggc

SEQ ID NO: 4141995 - RNA, 95 nt, Human
gcccaauaaauaauacgcaauucuuauguuuuauuguuauucauuagccauggauuauggcuuaugaauaacaguagguggauuauuugaauggc

SEQ ID NO: 4141996 - RNA, 67 nt, Human
gcccaauuugaacaaagauacuucaaucauuauagagaggaaaacaguacuuuuuguucaauugugc

SEQ ID NO: 4141997 - RNA, 71 nt, Human
gcccacaggggaccugguggcuccguuccacaccucaccccagcagggccagccugaguuacccugugggc

SEQ ID NO: 4141998 - RNA, 58 nt, Human
gcccacaguacgaggcucaggcauguaauaauuaacauagccuugguaccucuguggc

SEQ ID NO: 4141999 - RNA, 59 nt, Human
gcccacgucgaacuugcuccagagcugcagcggcuucugcuggaagggucggcgugggc

SEQ ID NO: 4142000 - RNA, 63 nt, Human
gcccacuccagcuucucccacacagcccucagauggagcaaggcugggccuggccgggugggc

SEQ ID NO: 4142001 - RNA, 65 nt, Human
gcccacucugauuuuggcuccacugaagaguagaagaaucagucauggaggaugauucagagagc

SEQ ID NO: 4142002 - RNA, 66 nt, Human
gcccacuugaugaauaaguaaacuccuuugguuaaaauaauuaguguuugcaauauuccagggggu

SEQ ID NO: 4142003 - RNA, 70 nt, Human
gcccacuuugaguguuuuuaauugaaguuuugguugaaaauucacuugaauucauucugcgaaagagggc

SEQ ID NO: 4142004 - RNA, 84 nt, Human
gcccagaaggcagcauggccauuucucgcugcuuuuuuguaugguuguuagaggcagcguggggcugagucagcugcugugggu

SEQ ID NO: 4142005 - RNA, 69 nt, Human
gcccagagagcuuucuuugugcuuucugccaccauggaaguuacagugaaaagaaggcucucuaugagc

SEQ ID NO: 4142006 - RNA, 76 nt, Human
gcccagccagggacgcugcaggcuacccuggggccugcugggagauguaguucugcagugucaccugagacugggc

SEQ ID NO: 4142007 - RNA, 58 nt, Human
gcccagcuggaucccugcagaacuuagaccuuaccaaaggugaaggggaccagcuagc

SEQ ID NO: 4142008 - RNA, 103 nt, Human
gcccagcuggcggguaagcugugggauggcagacgaggcagcaggggcccuuguggguccaucucugucucacugucagccuggcaggauagcccacccgggu

SEQ ID NO: 4142009 - RNA, 81 nt, Human
gcccaggaagccaggcuggaguuaccuuuaggggagccuagaguccucuccuugggguaacuccagccuggcuuucugggc

SEQ ID NO: 4142010 - RNA, 58 nt, Human
gcccaggaaguugaggcugccgugaguugugauuguggcacuaugcuccagccugggu

SEQ ID NO: 4142011 - RNA, 64 nt, Human
gcccaggagguggaggugcagugagccgagauuacagauuauagcauugcacuccagccugggu

SEQ ID NO: 4142012 - RNA, 86 nt, Human
gcccaggcagccuccuaguucucugccagucgcugaaggacacccaggacaguuauugagugcagagcagggcugcugcuggaagc

SEQ ID NO: 4142013 - RNA, 72 nt, Human
gcccaggcaugucuaccugugaagacccagauccuucuaccccacaaugcugcucuucagugacagucuggc

SEQ ID NO: 4142014 - RNA, 58 nt, Human
gcccaggcuagagugcaguggcaugaucucagcucacugcaaccucugccucccaggc

SEQ ID NO: 4142015 - RNA, 61 nt, Human
gcccaggcuccagcuuccugcucagccuuaggucaggagugguggguugggaugccugggc

SEQ ID NO: 4142016 - RNA, 62 nt, Human
gcccaggcucugugauccacaaugaguaaagugacccaugagugcugcucagaggccugggc

SEQ ID NO: 4142017 - RNA, 82 nt, Human
gcccaggcuggagugcaauggcgugaucucagcucacugcaagcucugccuccuuggguucacgccauucuccugccucagc

SEQ ID NO: 4142018 - RNA, 57 nt, Human
gcccaggcuggagugcaguggcacauaucuguucacugcaaccuccaccucccgggc

SEQ ID NO: 4142019 - RNA, 58 nt, Human
gcccaggcuggagugcaguggcacgaucuuggcucacugcuaccucugccucccgggu

SEQ ID NO: 4142020 - RNA, 58 nt, Human
gcccaggcuggagugcaguggccugaugucagcucacugcacccucaaacuccugggc

SEQ ID NO: 4142021 - RNA, 58 nt, Human
gcccaggcuggagugcaguggcgcaaucuuggcucacugcaagcucugccaccugggu

SEQ ID NO: 4142022 - RNA, 58 nt, Human
gcccaggcuggagugcaguggcgcaaucuugguucacugcaaccuccgccuuccgggu

SEQ ID NO: 4142023 - RNA, 58 nt, Human
gcccaggcuggagugcaguggugcagucauagcucacugcagucuugaucuccugggc

SEQ ID NO: 4142024 - RNA, 58 nt, Human
gcccaggcuggaguucagugguguaaucuuggcucaccacaaccuccgccucccgggu

SEQ ID NO: 4142025 - RNA, 57 nt, Human
gcccaggcuggaguucaguggugugaucucagcucacugcaaccuccgccucccggu

SEQ ID NO: 4142026 - RNA, 57 nt, Human
gcccagggcgauggucggggccuaaccugccggcucggccccccccggcccuugggc

SEQ ID NO: 4142027 - RNA, 60 nt, Human
gcccagggcugccuggccugggggugaaacacugggcucuggagucaggcagcccugggu

SEQ ID NO: 4142028 - RNA, 63 nt, Human
gcccaggguccccuggggaucagcuggaauugcagacacaguuaggauuucuccggggagggc

SEQ ID NO: 4142029 - RNA, 58 nt, Human
gcccagggugaagugcaguugugcgaucucgacucacugcagccuccaccuuuugggu

SEQ ID NO: 4142030 - RNA, 86 nt, Human
gcccaggguuggaguugagcacggaggccuagggugccaccagguguguccuggcaggugguccugccccgugcacagagcugggu

SEQ ID NO: 4142031 - RNA, 57 nt, Human
gcccagucagguccaaggccaccgcugcuugggcugugccauccgcuugaccugggc

SEQ ID NO: 4142032 - RNA, 77 nt, Human
gcccagugggcggcaccauggccaugagccuuuugcaggacuagugccaggggccuggacauggacgcgcacagggc

SEQ ID NO: 4142033 - RNA, 78 nt, Human
gcccauacagaugguggucccacagcccacccgcuagaauaccagugccugggcuguggagcaccuuugcagaugggc

SEQ ID NO: 4142034 - RNA, 123 nt, Human
gcccauccaaggcugagacggucgggaaucucacacuucuguguugcacacugccaucuacugugucucugcagcaaguggagccccagacuuuauuuaugaucccaggccuugauggugggc

SEQ ID NO: 4142035 - RNA, 60 nt, Human
gccaccaguagcuaacaacagugauuguuguugaugauuuugcuguuguguucuguuggc

SEQ ID NO: 4142036 - RNA, 59 nt, Human
gccaccaugccagacucauuuuuguauuuauaguagagacaggguuuugccauguuggc

SEQ ID NO: 4142037 - RNA, 58 nt, Human
gccaccauggccggcuaauuuuguauuuuuaguagagaugaggcuucuccauguuggu

SEQ ID NO: 4142038 - RNA, 73 nt, Human
gccacccagcacacaugugagcagagaggcgcugugaaggagugugugugugugugcgugugugugugugugc

SEQ ID NO: 4142039 - RNA, 76 nt, Human
gccaccccuaagcaucagugcacacaauccucugccgaguuucauuucuguuggaugugacacuguuaggugaggc

SEQ ID NO: 4142040 - RNA, 58 nt, Human
gccacccggucuggagccggccucgucugccagcgaacagccaacuuuagcggguggc

SEQ ID NO: 4142041 - RNA, 77 nt, Human
gccacccgugcacacucuuggggcacuuucuguuggaugucaacuugauggugacuugggagucguaggcagugagc

SEQ ID NO: 4142042 - RNA, 69 nt, Human
gccaccgcccaguuccaguggccccacgaagcccccaguggcuggcuguccagcugggcaaacaguggc

SEQ ID NO: 4142043 - RNA, 84 nt, Human
gccaccuaguuguauacuuugaaaggguuaaagugguaaauuuuauguuaugugaauuuuacuacaauuuuuuuaaacguuggc

SEQ ID NO: 4142044 - RNA, 58 nt, Human
gccaccucccaggacgaggcugucgugucagucccccagccccgcucucccagguggc

SEQ ID NO: 4142045 - RNA, 58 nt, Human
gccaccuccuccucugucccugcugggaucaacucuccacaaggaaccaggagguggc

SEQ ID NO: 4142046 - RNA, 87 nt, Human
gccaccugaagaaugcccagcauauaggaaauguugaaucaauaacaauugagugcaguaucuucuguguccuuuucccuugguggc

SEQ ID NO: 4142047 - RNA, 81 nt, Human
gccaccuggggacaagugguugcuugugaguccccggaggccgcugagggcacaaaggcaacauucauccucgggacuggc

SEQ ID NO: 4142048 - RNA, 58 nt, Human
gccaccuguuucagaugugguuggagguaugugcagccacagcaguuucugggguggc

SEQ ID NO: 4142049 - RNA, 60 nt, Human
gccacuaacuagugcacauuguuucucaaugugccauugagacacaaggcacaguaaguc

SEQ ID NO: 4142050 - RNA, 72 nt, Human
gccacuacuuuucacuuccuccgcaagcaagaguuccuaaaacagcugcuaagcugaggaagaugagagggc

SEQ ID NO: 4142051 - RNA, 78 nt, Human
gccacucacgccucaccaccugcuccuugagcugcuccugguccuuguucuggugcacguggcugcagucgauguggc

SEQ ID NO: 4142052 - RNA, 79 nt, Human
gccacucccaucccucagcaaaccgugguggucacucggaugugaguucuguccacugcuggggccucgggagugaagc

SEQ ID NO: 4142053 - RNA, 65 nt, Human
gccacucuaaccgcagugacgugggacuuccucggcagggccuguuugaugucucuguguguggc

SEQ ID NO: 4142054 - RNA, 129 nt, Human
gccacucuccccuaggccuaaaaaggaucccugcugcauuagugcaucuucagugccggugcucaguuugguuucugaggaauuaauacagaacaggcucagcucuagggaggccucugggaaagaggc

SEQ ID NO: 4142055 - RNA, 61 nt, Human
gccacugaggcuggagugcaguggugccaucucggcucacugcaaccuccaccucccgggu

SEQ ID NO: 4142056 - RNA, 63 nt, Human
gccacugaggucacagcuggggauggaguucuccucggucuucaucaccaggguguccauggc

SEQ ID NO: 4142057 - RNA, 59 nt, Human
gccacugggugaaucaugcaccucaaccucugcugagagagccugaaucucuuacuggc

SEQ ID NO: 4142058 - RNA, 56 nt, Human
gccacugucaucuugugaagcaaucaccacauguucccaucacagcugaugguggc

SEQ ID NO: 4142059 - RNA, 59 nt, Human
gccacugucauuuccugaaugcugagucaaaacuacucuguacgcaagagauggagggc

SEQ ID NO: 4142060 - RNA, 61 nt, Human
gccacuguugcuccucaggaaauggcuuggagccucagccuucagaagaaguaacaggggc

SEQ ID NO: 4142061 - RNA, 56 nt, Human
gccacuucucucgggaagccaggaaggcuccucgcaaauccugguggagaaguggu

SEQ ID NO: 4142062 - RNA, 77 nt, Human
gccacuugggagagcugggaaagccguggagagcaggaccccugaggucuccauugucccuaggucuccauugucgu

SEQ ID NO: 4142063 - RNA, 81 nt, Human
gccacuuguuccuccaauguccuagaguacauuccacugcuaucagugcuggcuguuaggacagugguuagggcagauggc

SEQ ID NO: 4142064 - RNA, 82 nt, Human
gccacuuuccauugauggaaacuuggguaagucauagaaacucugugagacucaaauuuaucaacuauauuaugggaauagc

SEQ ID NO: 4142065 - RNA, 66 nt, Human
gccagaaaagcaguaaauguaugaccuucaguuaagaaaaggucauggcuucacugcuaugcuggc

SEQ ID NO: 4142066 - RNA, 100 nt, Human
gccagaaaaggccacuucaaaagcucugguuggcccuggaaaucuccucccaccccaccuuucagcccuuccuggagcuuuuaaugagccuuuccauggc

SEQ ID NO: 4142067 - RNA, 69 nt, Human
gccagaaacauacacaucacuuccaaaaguuuccuuccacacauuuugucauuguguguguuugugugc

SEQ ID NO: 4142068 - RNA, 79 nt, Human
gccagaacauauguuguaggggugugggauggcuuuccuuccaccaucuuacaccauucaaauauuuucuuaccagggc

SEQ ID NO: 4142069 - RNA, 78 nt, Human
gccagaaguuguagguuugcauauuuacuccacuacuuccuggugagguggcaugaguaaacuguuuaguuucuaggc

SEQ ID NO: 4142070 - RNA, 58 nt, Human
gccagagagguuggggcugcagugagcugagaucacgccacuguacuccagccugggc

SEQ ID NO: 4142071 - RNA, 61 nt, Human
gccagagcauggggaccuauuuuaccaauuaaucaugcuguagguucagucuccaugcugc

SEQ ID NO: 4142072 - RNA, 58 nt, Human
gccagagcugagacacgaguccugccucuugggcucaaaguuuaggucucagacuggc

SEQ ID NO: 4142073 - RNA, 58 nt, Human
gccagagcugaugggcccaggguagauucuuaguccacuuggggcaaugaguucuguc

SEQ ID NO: 4142074 - RNA, 61 nt, Human
gccagagcuuuggcuagaugguugaucccuaagggcaacgaauacccccagaguuuugagc

SEQ ID NO: 4142075 - RNA, 58 nt, Human
gccagaggccuucaauacucauuucacacuagagaggguguccuaguugccaucuggc

SEQ ID NO: 4142076 - RNA, 91 nt, Human
gccagagugcuugugacugcuuuucacugauagaguuaugucaggcauccagccauauagaucauguuaaaagcuccagugcacucuuggc

SEQ ID NO: 4142077 - RNA, 63 nt, Human
gccagagugggccgggcccagcauccuggggaugccggggggcagccugaggcccuuucuggc

SEQ ID NO: 4142078 - RNA, 63 nt, Human
gccagaguugaggcaguuuauucaucuauguucagguggacccaaacgagccaucauucuggu

SEQ ID NO: 4142079 - RNA, 77 nt, Human
gccagaugaaaaagaaauugccuagagugauuuauuaggcaauaaguuauuagaucaucagugggcucuuauguggc

SEQ ID NO: 4142080 - RNA, 59 nt, Human
gccagauugacuaauugaagaaaugggguauauccaaauuuguucaaugucuauuuggu

SEQ ID NO: 4142081 - RNA, 81 nt, Human
gccagauuugucuucuguauucaagucuauuguaugcucuacuaauauaauacugcuuucaacagaaguaugcaucauggu

SEQ ID NO: 4142082 - RNA, 66 nt, Human
gccagcagaguaucaauguauuuucaagaaaagugcaauuugaaauucugcauuuuuaacaguggc

SEQ ID NO: 4142083 - RNA, 56 nt, Human
gccagcagccacagaagucacugguuucaggugagugauucuaaguaagcugcggc

SEQ ID NO: 4142084 - RNA, 88 nt, Human
gccagcagcgcccucccagccgugggauucugagcaaagccccgccccgcugggccucaguuuccccggccugggcgggcgcguuggc

SEQ ID NO: 4142085 - RNA, 82 nt, Human
gccagcagggaagucuuacuuuuggaaaguggccaggucccaucacgagggccucaccuggcugaacaaagucccuccuggu

SEQ ID NO: 4142086 - RNA, 56 nt, Human
gccagcagggcggagccaucuaccacaaaaauggcugccauggcucaccugugggc

SEQ ID NO: 4142087 - RNA, 55 nt, Human
gccagcaucccugggguuggccagagucccugccagugagcccugggaugugggc

SEQ ID NO: 4142088 - RNA, 88 nt, Human
gccagccaggacgcagcagcugccugcaccuucccaaagcugaggucaagggcucucagcagugugcaggugugcuggcccucauggu

SEQ ID NO: 4142089 - RNA, 58 nt, Human
gccagccauccccacagggccccauccuuuugucccugcuucccugggagaggcgggu

SEQ ID NO: 4142090 - RNA, 89 nt, Human
gccagcccacuguccugcaugggcucagaggagcuggaacggugucagcuggugccagcucccugggggcagggcaggccgggccaggc

SEQ ID NO: 4142091 - RNA, 79 nt, Human
gccagcccuuccgguggccaacaagaggccggguggaguuucugggagugugucuggccauccggagucaggggcuggc

SEQ ID NO: 4142092 - RNA, 65 nt, Human
gccagccugggugucgaucacuaguguggcacauaauugcuguggugguugaucuggggcacagc

SEQ ID NO: 4142093 - RNA, 129 nt, Human
gccagcuaagaaaaacagaucagugaaaugcauauucuucguauucuuaauuucagcccuauccaaauguuuacagaauaguuugaagagauuugcaguuucuuguuaucagucuuauuaagccuuggc

SEQ ID NO: 4142094 - RNA, 99 nt, Human
gccagcucuaguugucaccuugucugugggaggauucagaauugggaccaaaaauuguuguagccucauuuaucuuccccagguaccaugccagcuggc

SEQ ID NO: 4142095 - RNA, 57 nt, Human
gccagcugaauuuccaacuguuucaaguuuuugaaacaggaggguuuucagaugugc

SEQ ID NO: 4142096 - RNA, 63 nt, Human
gccagcugagcaaauuccagcugccugagggcagccuucuggcaaagauuugcaacaguuggc

SEQ ID NO: 4142097 - RNA, 75 nt, Human
gccagcugccaggccacaagaacuaccccaucuggcugugggaagccagccuggggucccuuguuggcacuuggu

SEQ ID NO: 4142098 - RNA, 57 nt, Human
gccagcugcucgcguaggguagagcaugugaugcuuuacuucugggggcaagguggc

SEQ ID NO: 4142099 - RNA, 55 nt, Human
gccagcuggagugagagugggcugggcugaaacgcuccacuguuguugagcuggc

SEQ ID NO: 4142100 - RNA, 58 nt, Human
gccagcuggcugcaggucccaggggaggcggccuugggagcucuggaguggguugugc

SEQ ID NO: 4142101 - RNA, 94 nt, Human
gccagcugggagcuuguuagaaauguagacucucaggcccuaucccagaccuacugaauuugaaucuguguuuuaacaaaacccccagcugagu

SEQ ID NO: 4142102 - RNA, 60 nt, Human
gccagcugucugucuccugaggagaccugcuugugcauucacccagguccaggcucuggc

SEQ ID NO: 4142103 - RNA, 57 nt, Human
gccagcuuggacuccaugacacguuagccucgagaaggccggucuggggccauuggc

SEQ ID NO: 4142104 - RNA, 57 nt, Human
gccagcuuggcaugugaggaguggggagccucagucuaccucucguuuuaaccuggc

SEQ ID NO: 4142105 - RNA, 96 nt, Human
gccagcuugucuccucugcucuguggcuaucauacugaaggcuuugcaagccuugggugcaccauagcuggagaguugggaauaaaagccuuuggc

SEQ ID NO: 4142106 - RNA, 67 nt, Human
gccagcuuucuggaagccccagagucagauguacuccuguccugacuuccagccuuccaguacuggc

SEQ ID NO: 4142107 - RNA, 65 nt, Human
gccaggaaccgaugaucagaggggaaugcguuugagcuccgcucugaauaguauuuguucugagu

SEQ ID NO: 4142108 - RNA, 64 nt, Human
gccucuuuauucaggaggugcucgaaggaaaucuggcuucuugugaguuuccuggaaguuaggc

SEQ ID NO: 4142109 - RNA, 90 nt, Human
gccucuuucuuguuccccagggaagcuccugcgcuguggggggccugaauccaaaggcaggagccccuggggaaaauccaaauuuuuggc

SEQ ID NO: 4142110 - RNA, 94 nt, Human
gccucuuugauuaaaacaggagaaaacauuacauaggugugugauccuuugccaauuuuaucaccaguaaguuuucaguuuuuuucccauaggc

SEQ ID NO: 4142111 - RNA, 61 nt, Human
gccugaagggagagagaauagccuauggaaagacacagagguaggcagcuugacccuuggu

SEQ ID NO: 4142112 - RNA, 58 nt, Human
gccugacagcacugcauuauucuuaagugaguuauuacaaggaucuguguaggcaggc

SEQ ID NO: 4142113 - RNA, 62 nt, Human
gccugacuccuauccauguucuuugccccugcggccagagccacaguggauaggagccgugu

SEQ ID NO: 4142114 - RNA, 77 nt, Human
gccugacuguucaggagaauuccaagaaguauucagagaaaacagaaucacuucuuggcuccagggaggaaucaggc

SEQ ID NO: 4142115 - RNA, 65 nt, Human
gccugagagacccauggggcaaaggucaguucucucccaggccugcucccugcagcucucauggc

SEQ ID NO: 4142116 - RNA, 90 nt, Human
gccugagagucagauagucuaugccaguucuuucugagccagcaggcugcagggaaagggcacugggcuuagaaucaaagacacuuaggu

SEQ ID NO: 4142117 - RNA, 65 nt, Human
gccugagcagcuauacacacaggcaaaaagcaacaaaaauaaucuguguuguagagacucagugu

SEQ ID NO: 4142118 - RNA, 61 nt, Human
gccugagcagggagcugggcugagcuggucuuggaggcaggcuuguccucccugcuggggc

SEQ ID NO: 4142119 - RNA, 66 nt, Human
gccugagcuugcagcacuggugaauggccaaauggcuuggccugacugucaggcuguauguggggc

SEQ ID NO: 4142120 - RNA, 83 nt, Human
gccugaggaaacuguaguaggaguaaguaugcuguguuuaagaggucacagauaaaauuaauauuaccaauccaucaauaggc

SEQ ID NO: 4142121 - RNA, 118 nt, Human
gccugaggccagggcuugggcucuaggccugcagggaagcuggugcgagcugugcucagggacagaucugugcugcagacgcaguagcucugagccaagaacugggccggcuucaggc

SEQ ID NO: 4142122 - RNA, 108 nt, Human
gccugauguuuuucaagcauuuaugacaauuuuccccauagguuaucuugaguaucaauaugauuuucuaaaugggaaaauugcugaguccuagauacaauguaaggu

SEQ ID NO: 4142123 - RNA, 102 nt, Human
gccugcaaaccuucccucagacacagccccacgaagucucugcccauaaccuaccgccaggcacuuuguaaauuguugugacucacgggaaccaucucaggc

SEQ ID NO: 4142124 - RNA, 64 nt, Human
gccugcaaauuucuuuaguacauaaagucuuacuugauguacacaaugaaauuaugauguaggc

SEQ ID NO: 4142125 - RNA, 87 nt, Human
gccugcagccugcccaccugugcccuuuccugcuccuccaggccccagccugccaguaaugagggcaaggaucaccaggcugccagc

SEQ ID NO: 4142126 - RNA, 55 nt, Human
gccugcagcuguugccuggaaaaggagcuggcuccuagcaacaguaucagcaggc

SEQ ID NO: 4142127 - RNA, 84 nt, Human
gccugcaggucugaucccugcccccagacagaauccaguugccaaugaggcagcuggggaggguuuggaggaagggcugugggu

SEQ ID NO: 4142128 - RNA, 56 nt, Human
gccugccagccacaguggcagccugguccccagagcugccgaucaccuggcauagc

SEQ ID NO: 4142129 - RNA, 122 nt, Human
gccugcccuaugcucagaaugccagugugaaggggcaucauucuggcucuuuccauggucucaagcagacccuuuagguggagaagggugagaagaacccuccagauaggucaugggguggc

SEQ ID NO: 4142130 - RNA, 56 nt, Human
gccugccucaaaaucccaguucugccacuugcuagcuuugugaugaugggcguggc

SEQ ID NO: 4142131 - RNA, 74 nt, Human
gccugccucugugugaaucuauugaauauaugugcaugcauguaacggcaggauuuuuauggugguaauauggc

SEQ ID NO: 4142132 - RNA, 67 nt, Human
gccugccuggucucaggcauggggacagcccagcccuccccagauccccugaggcaggcguaucggu

SEQ ID NO: 4142133 - RNA, 56 nt, Human
gccugccuucggugcgcagcgggggaacagggcuagugcagccgccggaggggggc

SEQ ID NO: 4142134 - RNA, 125 nt, Human
gccugccuuucugcuucugugccugggauuuccuccagucucacuaggaacuugcuuggcccaugcuagggcacuucagucagacugagacgacccaggagcuaccaucugcggaugucacaggc

SEQ ID NO: 4142135 - RNA, 96 nt, Human
gccugcggggguagguucugcagcagcccggccagaggaugcaggcuguguacugcggcuggcagggugggcuuugcuuuucugcaucucacaggc

SEQ ID NO: 4142136 - RNA, 65 nt, Human
gccugcucuguucccccaucaucucaauccuccuccuaauggcuuggcaggcggggcagggcugc

SEQ ID NO: 4142137 - RNA, 59 nt, Human
gccugcugugacaagcuaucuuuaggaaguaagaauuugugaagauuaaguuacugggc

SEQ ID NO: 4142138 - RNA, 129 nt, Human
gccugcuuacauacugucugauguugggucauauugcuuauuaaguggccgaaauauuuuucaauuauuugaugcuaagauuuaauaaaguagaugaaauaagaaccagaauacaguccacaaucaggu

SEQ ID NO: 4142139 - RNA, 63 nt, Human
gccugcuucacggacaggccucuuauaggcauagaugacgaggggucuguccgugacaguggc

SEQ ID NO: 4142140 - RNA, 64 nt, Human
gccugcuuccuuuucauagauggcacccucuagcugugucuucauguggugggaggggcaaggc

SEQ ID NO: 4142141 - RNA, 55 nt, Human
gccuggacaggugagugacucaggguggugagcuccacccugcccugauuuaggc

SEQ ID NO: 4142142 - RNA, 83 nt, Human
gccuggaccggcugcugcugucagcaggccuuguuucucaccagcagcaggggcaagugacaguugcuuuuucugcuucgggu

SEQ ID NO: 4142143 - RNA, 69 nt, Human
gccuggagaauuaaaaggaagggcacauuauuacgucugccucuauuuggucuuuuggcucucuuaggc

SEQ ID NO: 4142144 - RNA, 68 nt, Human
gccuggagaccugauggcagcggcggccuuucccagcccugaacccgcuggccgccgggucucucggu

SEQ ID NO: 4142145 - RNA, 56 nt, Human
gccuggaggaauguagcugaggucaccaaaauuggauuccuggcuuccaucuuggu

SEQ ID NO: 4142146 - RNA, 55 nt, Human
gccuggaggcgagaacccaaugucuuuguuaucgggcccucucguucuuccaggu

SEQ ID NO: 4142147 - RNA, 56 nt, Human
gccuggaggggacagucucuggggugggcuucacaggauaggucaguuuuccaggc

SEQ ID NO: 4142148 - RNA, 59 nt, Human
gccuggagugcaguggcgugaucucgguucacugcagccuccgccucccgccuccaggc

SEQ ID NO: 4142149 - RNA, 69 nt, Human
gccuggagugguuaacuucugagcaggcuggagaucuucgcaacucagcaacuuaacugcuggccgggc

SEQ ID NO: 4142150 - RNA, 56 nt, Human
gccuggaguuguggugaagccaggagcuauucugagaucuuuccacuauuucaggc

SEQ ID NO: 4142151 - RNA, 72 nt, Human
gccuggauaauuuaaugcaagugauucacaccucacuuuugagaaguuacucucguuaaauauguuccaggu

SEQ ID NO: 4142152 - RNA, 60 nt, Human
gccuggaucccagggagucaggcuaugucauuagauggaagaugcccuugagaugcaggc

SEQ ID NO: 4142153 - RNA, 58 nt, Human
gccuggauuacaaacagccaaccauaacagaguuaugcucuggcugcuggaguagggu

SEQ ID NO: 4142154 - RNA, 75 nt, Human
gccuggcaaaucuuucucuccaagucuuuuuccucaaugaacugaaggcuccuugagggaaggacuuggucacgu

SEQ ID NO: 4142155 - RNA, 106 nt, Human
gccuggcaccccucccgccucugccuuguuccauaucuacugucaggacccagaccccaguguucacucuguggagcccaggcagagcccgagaggcagccauggc

SEQ ID NO: 4142156 - RNA, 55 nt, Human
gccuggcacucaaucaucugcuauuugugguuuaauaaagaacuuugggcuaggc
